United States Patent 7,745,391 (HUMAN THROMBOSPONDIN POLYPEPTIDE) - sequence listing, part 287

SEQ ID NO: 905903 - protein, 697 aa, Homo sapiens
FSAFRYPGHSHFSPLFLVSSPIPLSPVLPLPLQWFSPLSCHQLLGPGLLRLGRLWLRSPSHTAPAPGLWLSGFGLLRGDHLFLCSAPGPGPPAPEDMVHLRRLQEISVVSAADTPDKKEHLVLVETGRTLYLQGEGRLDFTAWNAAIGGAAGGGGTGLQEQQMSRGDIPIIVDACISFVTQHGLRLEGVYRKGGARARSLRLLAEFRRDARSVKLRPGEHFVEDVTDTLKRFFRELDDPVTSARLLPRWREAAELPQKNQRLEKYKDVIGCLPRVNRRTLATLIGHLYRVQKCAALNQMCTRNLALLFAPSVFQTDGRGEHEVRVLQELIDGYISVFDIDSDQVAQIDLEVSLITTWKDVQLSQAGDLIMEVYIEQQLPDNCVTLKVSPTLTAEELTNQVLEMRGTAAGMDLWVTFEIREHGELERPLHPKEKVLEQALQWCQLPEPCSASLLLKKVPLAQAGCLFTGIRRESPRVGLLRCREEPPRLLGSRFQERFFLLRGRCLLLLKEKKSSKPEREWPLEGAKVYLGIRKKLKPPTPWGFTLILEKMHLYLSCTDEDEMWDWTTSILKAQHDDQQPVVLRRHSSSYNRLAANIAIQTEEDPGNLGGYVSHGRRIGKHRKQPGGRGNAGGLHHQRVNSTKYTKVHWESGVKLTLKRTEGLPMSPAMGWPDAGESKQGAPGGGVMEGPGGLKERGG

SEQ ID NO: 905904 - protein, 174 aa, Homo sapiens
GIDLLLSESHAPISHIPHREATDGPVVGGGSLCTMVSRDGWLSSGLRLEGVYRKGGARARSLRLLAEFRRDARSVKLRPGEHFVEDVTDTLKRFFRELDDPVTSARLLPRWREAAGIPKIPESQGPTRISAFPHQNPWFGSPPPHHFPPWGIIQRLGSGGGGKGAETHPSCICA

SEQ ID NO: 905905 - protein, 793 aa, Homo sapiens; identical to SEQ ID NO: 905902

SEQ ID NO: 905906 - protein, 715 aa, Homo sapiens
AVVGGGSLCTMVSRDGWLSSGLRLEGVYRKGGARARSLRLLAEFRRDARSVKLRPGEHFVEDVTDTLKRFFRELDDPVTSARLLPRWREAAGIPKIPESQGPTRISAFPHQNPWFGSPPPHHFPPWGIIQRLGSGEVGRGQRHIHPAFVPKNPSLCTSCHSFFPGPPQPSSIPSPELPQKNQRLEKYKDVIGCLPRVNRRTLATLIGHLYRVQKCAALNQMCTRNLALLFAPSVFQTDGRGEHEVRVLQELIDGYISVFDIDSDQVAQIDLEVSLITTWKDVQLSQAGDLIMEVYIEQQLPDNCVTLKVSPTLTAEELTNQVLEMRGTAAGMDLWVTFEIREHGELERPLHPKEKVLEQALQWCQLPEPCSASLLLKKVPLAQAGCLFTGIRRESPRVGLLRCREEPPRLLGSRFQERFFLLRGRCLLLLKEKKSSKPEREWPLEGAKVYLGIRKKLKPPTPWGFTLILEKMHLYLSCTDEDEMWDWTTSILKAQHDDQQPVVLRRHSSSDLARQKFGTMPLLPIRGDDSGATLLSANQTLRRLHNRRTLSMFFPMKSSQGSVEEQEELEEPVYEEPVYEEVGAFPELIQDTSTSFSTTREWTVKPENPLTSQKSLDQPFLSKSSTLGQEERPPEPPPGPPSKSSPQARGSLEEQLLQELSSLILRKGETTAGLGSPSQPSSPQSPSPTGLPTQTPGFPTQPPCTSSPPSSQPLT

SEQ ID NO: 905907 - protein, 793 aa, Homo sapiens; identical to SEQ ID NO: 905902

SEQ ID NO: 905908 - protein, 629 aa, Homo sapiens
FSAFRYPGHSHFSPLFLVSSPIPLSPVLPLPLQWFSPLSCHQLLGPGLLRLGRLWLRSPSHTAPAPGLWLSGFGLLRGDHLFLCSAPGPGPPAPEDMVHLRRLQEISVVSAADTPDKKEHLVLVETGRTLYLQGEGRLDFTAWNAAIGGAAGGGGTGLQEQQMSRGDIPIIVDACISFVTQHGLRLEGVYRKGGARARSLRLLAEFRRDARSVKLRPGEHFVEDVTDTLKRFFRELDDPVTSARLLPRWREAAELPQKNQRLEKYKDVIGCLPRVNRRTLATLIGHLYRVQKCAALNQMCTRNLALLFAPSVFQTDGRGEHEVRVLQELIDGYISVFDIDSDQVAQIDLEVSLITTWKDVQLSQAGDLIMEVYIEQQLPDNCVTLKVSPTLTAEELTNQVLEMRGTAAGMDLWVTFEIREHGELERPLHPKEKVLEQALQWCQLPEPCSASLLLKKVPLAQAGCLFTGIRRESPRVGLLRCREEPPRLLGSRFQERFFLLRGRCLLLLKEKKSSKPEREWPLEGAKVYLGIRKKLKPPTPWGFTLILEKMHLYLSCTDEDEMWDWTTSILKAQHDDQQPVVLRRHSSSDLARQKFGTMPLLPIRGDDSGATLFSSTDPWDDFIGKNMDR

SEQ ID NO: 905909 - protein, 869 aa, Homo sapiens
MVLDHLVIQRMDTTGKTVLHTGSAPSSSTPFNKEELSAILKFGAEELFKEPEGEEQEPQEMDIDEILKRAETHENEPGPLTVGDELLSQFKVANFSNMDEDDIELEPERNSKNWEEIIPEDQRRRLEEEERQKELEEIYMLPRMRNCAKQISFNGSEGRRSRSRRYSGSDSDSISEGKRPKKRGRPRTIPRENIKGFSDAEIRRFIKSYKKFGGPLERLDAIARDAELVDKSETDLRRLGELVHNGCIKALKDSSSGTERTGGRLGKVKGPTFRISGVQVNAKLVISHEEELIPLHKSIPSDPEERKQYTIPCHTKAAHFDIDWGKEDDSNLLIGIYEYGYGSWEMIKMDPDLSLTHKILPDDPDKKPQAKQLQTRADYLIKLLSRDLAKKEALSGAGSSKRRKARAKKNKAMKSIKVKEEIKSDSSPLPSEKSDEDDDKDEISSVKHPNKKIKTERDSEEKPEPDVYIKKEPEEKREAKEKENKKELKREIKEKEDKKDIKEKDFKEKRENKVKEAIQKEKDIKEEKLSESKSDGRERSKKSSVSDAPVHITASGEPVPISEESEELDQKTFSICKERMRPVKAALKQLDRPEKGLSEREQLEHTRQCLIKIGDHITECLKEYTNPEQIKQWRKNLWIFVSKFTEFDARKLHKLYKHAIKKRQESQQNSDQNSNLNPHVIRNPDVERLKENTNHDDSSRDSYSSDRHLTQYHDHHKDRHQGDSYKKSDSRKRPYSSFSNGKDHRDWDHYKQDSRYYSDREKHRKLDDHRSRDHRSNLEGSLKDRSHSDHRSHSDHRLHSDHRSSSEYTHHKSSRDYRYHSDWQMDHRASSSGPRSPLDQRSPYGSRSPFEHSVEHKSTPEHTWSSRKT

SEQ ID NO: 905910 - protein, 77 aa, Homo sapiens
FEIVYFQIIASRMMILGQLQALDLVRVLEAVVMEAVASQVAVTLTPDLNQAVSQSLSQTLPEKTKFKQNHRKLMELR

SEQ ID NO: 905911 - protein, 869 aa, Homo sapiens; identical to SEQ ID NO: 905909

SEQ ID NO: 905912 - protein, 869 aa, Homo sapiens; identical to SEQ ID NO: 905909

SEQ ID NO: 905913 - protein, 290 aa, Homo sapiens
MRPVKAALKQLDRPEKGLSEREQLEHTRQCLIKIGDHITECLKEYTNPEQIKQWRKNLWIFVSKFTEFDARKLHKLYKHAIKKRQESQQNSDQNSNLNPHVIRNPDVERLKENTNHDDSSRDSYSSDRHLTQYHDHHKDRHQGDSYKKSDSRKRPYSSFSNGKDHRDWDHYKQDSRYYSDREKHRKLDDHRSRDHRSNLEGSLKDRSHSDHRSHSDHRLHSDHRSSSEYTHHKSSRDYRYHSDWQMDHRASSSGPRSPLDQRSPYGSRSPFEHSVEHKSTPEHTWSSRKT

SEQ ID NO: 905914 - protein, 353 aa, Homo sapiens [sequence omitted]

SEQ ID NO: 905915 - protein, 353 aa, Homo sapiens [sequence omitted]

SEQ ID NO: 905916 - protein, 252 aa, Homo sapiens [sequence omitted]

SEQ ID NO: 905917 - protein, 305 aa, Homo sapiens [sequence omitted]

SEQ ID NO: 905918 - protein, 242 aa, Homo sapiens
VWWNSQSRVEDGEEVSDSLLFDTSDDEELREQLDMHSIIVSCVNDEPLFTADQVIEEIEEMMQESPDPEDDETPTQSDRLSMLSQEIQTLKRSSTGSYEERVKRLSVSELNEILEEIETAIKEYSEELVQQLALRDELEFEKEVKNSFISVLIEVQNKQKEHKETAKKKKKLKNGSSQNGKNERSHMPGTYLTTVIPYEKKNGPPSVEDLQILTKILRAMKEDSEKVPSLLTDYILKVLCPT

SEQ ID NO: 905919 - protein, 208 aa, Homo sapiens
MHSIIVSCVNDEPLFTADQVIEEIEEMMQESPDPEDDETPTQSDRLSMLSQEIQTLKRSSTGSYEERVKRLSVSELNEILEEIETAIKEYSEELVQQLALRDELEFEKEVKNSFISVLIEVQNKQKEHKETAKKKKKLKNGSSQNGKNERSHMPGTYLTTVIPYEKKNGPPSVEDLQILTKILRAMKEDSEKVPSLLTDYILKVLCPT

SEQ ID NO: 905920 - protein, 353 aa, Homo sapiens [sequence omitted]

SEQ ID NO: 905921 - protein, 336 aa, Homo sapiens
MAADGDWQDFYEFQEPARSLLDQENCNASPEPGAEAGAGAGGGADGFPALACSLEEKLSLCFRPSDPGAEPPRTAVRPITERSLLQGDEIWNALTDNYGNVMPVDWKSSHTRTLHLLTLNLSEKGVSDSLLFDTSDDEELREQLDMHSIIVSCVNDEPLFTADQVIEEIEEMMQESPDPEDDETPTQSDRLSMLSQEIQTLKRSSTGSYEERVKRLSVSELNEILEEIETAIKEYSEELVQQLALRDELEFEKEVKNSFISVLIEVQNKQKEHKETAKKKKKLKNGSSQNGKNERSHMPGTVSDVLQEASNTGNRFCGSPSLWGWWQVRQVVHGQE

SEQ ID NO: 905922 - protein, 344 aa, Homo sapiens
MAADGDWQDFYEFQEPARSLLDQENCNASPEPGAEAGAGAGGGADGFPALACSLEEKLSLCFRPSDPGAEPPRTAVRPITERSLLQGDEIWNALTDNYGNVMPVDWKSSHTRTLHLLTLNLSEKGVSDSLLFDTSDDEELREQLDMHSIIVSCVNDEPLFTADQVIEEIEEMMQESPDPEDDETPTQSDRLSMLSQEIQTLKRSSTGSYEERVKRLSVSELNEILEEIETAIKEYSEELVQQLALRDELEFEKEVKNSFISVLIEVQNKQKEHKETAKKKKKLKNGSSQNNAVGNLAWSPPQIKLLLYVGHRTYRIKSVNKLGTFSLSSFMAQRMCRAYDFSHS

SEQ ID NO: 905923 - protein, 252 aa, Homo sapiens [sequence omitted]

SEQ ID NO: 905924 - protein, 353 aa, Homo sapiens [sequence omitted]

SEQ ID NO: 905925 - protein, 380 aa, Homo sapiens [sequence omitted]

SEQ ID NO: 905926 - protein, 363 aa, Homo sapiens
MAADGDWQDFYEFQEPARSLLDQENCNASPEPGAEAGAGAGGGADGFPALACSLEEKLSLCFRPSDPGAEPPRTAVRPITERSLLQGDEIWNALTDNYGNVMPVDWKSSHTRTLHLLTLNLSEKGVSDSLLFDTSDDEELREQLDMHSIIVSCVNDEPLFTADQVIEEIEEMMQESPDPEDDETPTQSDRLSMLSQEIQTLKRSSTGSYEERVKRLSVSELNEILEEIETAIKEYSEELVQQLALRDELEFEKEVKNSFISVLIEVQNKQKEHKETAKKKKKLKNGSSQNGKNERSHMPGTRFSMEGISNVIQNGLRHTFGNSGGEKQYLTTVIPYEKKNGPPSVEDLQILTKSEQRQNETIT

SEQ ID NO: 905927 - protein, 381 aa, Homo sapiens
MAADGDWQDFYEFQEPARSLLDQENCNASPEPGAEAGAGAGGGADGFPALACSLEEKLSLCFRPSDPGAEPPRTAVRPITERSLLQGDEIWNALTDNYGNVMPVDWKSSHTRTLHLLTLNLSEKGVSDSLLFDTSDDEELREQLDMHSIIVSCVNDEPLFTADQVIEEIEEMMQESPDPEDDETPTQSDRLSMLSQEIQTLKRSSTGSYEERVKRLSVSELNEILEEIETAIKEYSEELVQQLALRDELEFEKEVKNSFISVLIEVQNKQKEHKETAKKKKKLKNGSSQNGKNERSHMPGTYLTTVIPYEKKNGPPSVEDLQILTKKRRLLVNNPVPLFLSPLFGNFKSGKQLSVLRAMKEDSEKVPSLLTDYILKVLCPT

SEQ ID NO: 905928 - protein, 352 aa, Homo sapiens
GRPGRGARLLRAAMAADGDWQDFYEFQEPARSLLDQENCNASPEPGAEAGAGAGGGADGFPALACSLEEKLSLCFRPSDPGAEPPRTAVRPITERSLLQGDEIWNALTDNYGNVMPVDWKSSHTRTLHLLTLNLSEKGVSDSLLFDTSDDEELREQLDMHSIIVSCVNDEPLFTADQVIEEIEEMMQESPDPEDDETPTQSDRLSMLSQEIQTLKRSSTGSYEERVKRLSVSELNEILEEIETAIKEYSEELVQQLALRDELEFEKEVKNSFISVLIEVQNKQKEHKETAKKKKKLKNGSSQNGKNERSHMPGTYLTTVIPYEKKNGPPSVEDLQILTKILRAMKEDILCPT

SEQ ID NO: 905929 - protein, 51 aa, Homo sapiens [sequence omitted]

SEQ ID NO: 905930 - protein, 1132 aa, Homo sapiens
MGMACLTMTEMEGTSTSSIYQNGDISGNANSMKQIDPVLQVYLYHSLGKSEADYLTFPSGEYVAEEICIAASKACGITPVYHNMFALMSETERIWYPPNHVFHIDESTRHNVLYRIRFYFPRWYCSGSNRAYRHGISRGAEAPLLDDFVMSYLFAQWRHDFVHGWIKVPVTHETQEECLGMAVLDMMRIAKENDQTPLAIYNSISYKTFLPKCIRAKIQDYHILTRKRIRYRFRRFIQQFSQCKATARNLKLKYLINLETLQSAFYTEKFEVKEPGSGPSGEEIFATIIITGNGGIQWSRGKHKESETLTEQDLQLYCDFPNIIDVSIKQANQEGSNESRVVTIHKQDGKNLEIELSSLREALSFVSLIDGYYRLTADAHHYLCKEVAPPAVLENIQSNCHGPISMDFAISKLKKAGNQTGLYVLRCSPKDFNKYFLTFAVERENVIEYKHCLITKNENEEYNLSGTKKNFSSLKDLLNCYQMETVRSDNIIFQFTKCCPPKPKDKSNLLVFRTNGVSDVPTSPTLQRPTHMNQMVFHKIRNEDLIFNESLGQGTFTKIFKGVRREVGDYGQLHETEVLLKVLDKAHRNYSESFFEAASMMSKLSHKHLVLNYGVCVCGDENILVQEFVKFGSLDTYLKKNKNCINILWKLEVAKQLAWAMHFLEENTLIHGNVCAKNILLIREEDRKTGNPPFIKLSDPGISITVLPKDILQERIPWVPPECIENPKNLNLATDKWSFGTTLWEICSGGDKPLSALDSQRKLQFYEDRHQLPAPKWAELANLINNCMDYEPDFRPSFRAIIRDLNSLFTPDYELLTENDMLPNMRIGALGFSGAFEDRDPTQFEERHLKFLQQLGKGNFGSVEMCRYDPLQDNTGEVVAVKKLQHSTEEHLRDFEREIEILKSLQHDNIVKYKGVCYSAGRRNLKLIMEYLPYGSLRDYLQKHKERIDHIKLLQYTSQICKGMEYLGTKRYIHRDLATRNILVENENRVKIGDFGLTKVLPQDKEYYKVKEPGESPIFWYAPESLTESKFSVASDVWSFGVVLYELFTYIEKSKSPPAEFMRMIGNDKQGQMIVFHLIELLKNNGRLPRPDGCPDEIYMIMTECWNNNVNQRPSFRDLALRVDQIRDNMAG

SEQ ID NO: 905931 - protein, 1132 aa, Homo sapiens; identical to SEQ ID NO: 905930

SEQ ID NO: 905932 - protein, 1047 aa, Homo sapiens
MGMACLTMTEMEGTSTSSIYQNGDISGNANSMKQIDPVLQVYLYHSLGKSEADYLTFPSGEYVAEEICIAASKACGITPVYHNMFALMSETERIWYPPNHVFHIDESTRHNVLYRIRFYFPRWYCSGSNRAYRHGISRGAEAPLLDDFVMSYLFAQWRHDFVHGWIKVPVTHETQEECLGMAVLDMMRIAKENDQTPLAIYNSISYKTFLPKCIRAKIQDYHILTRKRIRYRFRRFIQQFSQCKATARNLKLKYLINLETLQSAFYTEKFEVKEPGSGPSGEEIFATIIITGNGGIQWSRGKHKESETLTEQDLQLYCDFPNIIDVSIKQANQEGSNESRVVTIHKQDGKNLEIELSSLREALSFVSLIDGYYRLTADAHHYLCKEVAPPAVLENIQSNCHGPISMDFAISKLKKAGNQTGLYVLRCSPKDFNKYFLTFAVERENVIEYKHCLITKNENEEYNLSGTKKNFSSLKDLLNCYQMETVRSDNIIFQFTKCCPPKPKDKSNLLVFRTNGVSDVPTSPTLQRPTHMNQMVFHKIRNEDLIFNESLGQGTFTKIFKGVRREVGDYGQLHETEVLLKVLDKAHRNYSESFFEAASMMSKLSHKHLVLNYGVCVCGDENILVQEFVKFGSLDTYLKKNKNCINILWKLEVAKQLAWAMHFLEENTLIHGNVCAKNILLIREEDRKTGNPPFIKLSDPGISITVLPKDILQERIPWVPPECIENPKNLNLATDKWSFGTTLWEICSGGDKPLSALDSQRKLQFYEDRHQLPAPKWAELANLINNCMDYEPDFRPSFRAIIRDLNSLFTPDYELLTENDMLPNMRIGALGFSGAFEDRDPTQFEERHLKFLQQLGKGNFGSVEMCRYDPLQDNTGEVVAVKKLQHSTEEHLRDFEREIEILKSLQHDNIVKYKGVCYSAGRRNLKLIMEYLPYGSLRDYLQKHKERIDHIKLLQYTSQICKGMEYLGTKRYIHRDLATRNILVENENRVKIGDFGLTKVLPQDKEYYKVKEPGESPIFCTSLAYPVCRNVIPIILMHTPHEILSHP

SEQ ID NO: 905933 - protein, 939 aa, Homo sapiens
MGMACLTMTEMEGTSTSSIYQNGDISGNANSMKQIDPVLQVYLYHSLGKSEADYLTFPSGEYVAEEICIAASKACGITPVYHNMFALMSETERIWYPPNHVFHIDESTRHNVLYRIRFYFPRWYCSGSNRAYRHGISRGAEAPLLDDFVMSYLFAQWRHDFVHGWIKVPVTHETQEECLGMAVLDMMRIAKENDQTPLAIYNSISYKTFLPKCIRAKIQDYHILTRKRIRYRFRRFIQQFSQCKATARNLKLKYLINLETLQSAFYTEKFEVKEPGSGPSGEEIFATIIITGNGGIQWSRGKHKESETLTEQDLQLYCDFPNIIDVSIKQANQEGSNESRVVTIHKQDGKNLEIELSSLREALSFVSLIDGYYRLTADAHHYLCKEVAPPAVLENIQSNCHGPISMDFAISKLKKAGNQTGLYVLRCSPKDFNKYFLTFAVERENVIEYKHCLITKNENEEYNLSGTKKNFSSLKDLLNCYQMETVRSDNIIFQFTKCCPPKPKDKSNLLVFRTNGVSDVPTSPTLQRPTHMNQMVFHKIRNEDLIFNESLGQGTFTKIFKGVRREVGDYGQLHETEVLLKVLDKAHRNYSESFFEAASMMSKLSHKHLVLNYGVCVCGDENILVQEFVKFGSLDTYLKKNKNCINILWKLEVAKQLAWAMHFLEENTLIHGNVCAKNILLIREEDRKTGNPPFIKLSDPGISITVLPKDILQERIPWVPPECIENPKNLNLATDKWSFGTTLWEICSGGDKPLSALDSQRKLQFYEDRHQLPAPKWAELANLINNCMDYEPDFRPSFRAIIRDLNSLFTPDYELLTENDMLPNMRIGALGFSGAFEDRDPTQFEERHLKFLQQLGKGNFGSVEMCRYDPLQDNTGEVVAVKKLQHSTEEHLRDFEREIEILKSLQHDNIVKYKGVCYSAGKLPIETYFKFKVCVWHPV

SEQ ID NO: 905934 - protein, 1132 aa, Homo sapiens; identical to SEQ ID NO: 905930

SEQ ID NO: 905935 - protein, 1132 aa, Homo sapiens; identical to SEQ ID NO: 905930

SEQ ID NO: 905936 - protein, 132 aa, Homo sapiens
IIFFISPDYELLTENDMLPNMRIGALGFSGAFEDRDPTQFEERHLKFLQQLGKGNFGSVEMCRYDPLQDNTGEVVAVKKLQHSTEEHLRDFEREIEILKSLHIISRCILLACSSMYCKYFSHKGNKCLVLFV

SEQ ID NO: 905937 - protein, 208 aa, Homo sapiens [sequence omitted]

SEQ ID NO: 905938 - protein, 208 aa, Homo sapiens [sequence omitted]

SEQ ID NO: 905939 - protein, 208 aa, Homo sapiens [sequence omitted]

SEQ ID NO: 905940 - protein, 208 aa, Homo sapiens [sequence omitted]

SEQ ID NO: 905941 - protein, 208 aa, Homo sapiens [sequence omitted]

SEQ ID NO: 905942 - protein, 208 aa, Homo sapiens [sequence omitted]

SEQ ID NO: 905943 - protein, 208 aa, Homo sapiens [sequence omitted]

SEQ ID NO: 905944 - protein, 216 aa, Homo sapiens
MSSFDINSSAPAHVNMMPVTGGTINMMEYLLQGSVLDHSLESLIHRLRGLCDNMEPETFLDHEMVFLLKGQQASPFVLRARRSMDRAGAPWHLRYLGQPEMGDKNRHALVRNCVDIATSENLTDFLMEMGFRMDHEFVAKGHLFRKGIMKIMVYKIFRILVPGNTDSTEALSLSYLVELSVVAPAGQDMVSDDMKNFAEQLKPLVHLEKIDPKRLM

SEQ ID NO: 905945 - protein, 131 aa, Homo sapiens
MFSDNSHCPDCGQQWFPSLELGHWLYQTELVENECYQVFLDRINRADYCPECYPDNPANRSLVLPWSFPLEWAPQNLTRWTFEKACHPFLLGPPLVRKRIHDSRVAGFNPALQLILTRTDKTLNKKLGQNK

SEQ ID NO: 905946 - protein, 127 aa, Homo sapiens
MADSGLREPQEDSQKDLENDPSVNSQAQETTIIASNAEEAEILHSACGLSKDHQEVETEGPESADTGDKSESPDEANVGKHPKDKTEDENKQSFLDGGKGHHLPSENLGRADAHLGSSSVALPKEAS

SEQ ID NO: 905947 - protein, 123 aa, Homo sapiens
MADSGLREPQEDSQKDLENDPSVNSQAQETTIIASNAEEAEILHSACGLSKDHQEVETEGPESADTGDKSESPDEANVGKHPKDKTEDENKQSFLDGGKGHHLPSENLGKEPLDPDPSHSPSD

SEQ ID NO: 905948 - protein, 109 aa, Homo sapiens
SVSSGPPTLADSACPAPLPAAVETASGQAGLLLSQALVWRGGAAAAAGCSRAVWSGENTRRALLILTVLRFKTSPEFRQGLTVLPRLVSNSWLQAILPPQPPKVLGLQA

SEQ ID NO: 905949 - protein, 123 aa, Homo sapiens; identical to SEQ ID NO: 905947

SEQ ID NO: 905950 - protein, 570 aa, Homo sapiens
MTLLWCVVSLYFYGILQSDASERCDDWGLDTMRQIQVFEDEPARIKCPLFEHFLKFNYSTAHSAGLTLIWYWTRQDRDLEEPINFRLPENRISKEKDVLWFRPTLLNDTGNYTCMLRNTTYCSKVAFPLEVVQKDSCFNSPMKLPVHKLYIEYGIQRITCPNVDGYFPSSVKPTITWYMGCYKIQNFNNVIPEGMNLSFLIALISNNGNYTCVVTYPENGRTFHLTRTLTVKVVGSPKNAVPPVIHSPNDHVVYEKEPGEELLIPCTVYFSFLMDSRNEVWWTIDGKKPDDITIDVTINESISHSRTEDETRTQILSIKKVTSEDLKRSYVCHARSAKGEVAKAAKVKQKVPAPRYTVELACGFGATVLLVVILIVVYHVYWLEMVLFYRAHFGTDETILDGKEYDIYVSYARNAEEEEFVLLTLRGVLENEFGYKLCIFDRDSLPGGIVTDETLSFIQKSRRLLVVLSPNYVLQGTQALLELKAGLENMASRGNINVILVQYKAVKETKVKELKRAKTVLTVIKWKGEKSKYPQGRFWKQLQVAMPVKKSPRRSSSDEQGLSYSSLKNV

SEQ ID NO: 905951 - protein, 397 aa, Homo sapiens
RLPGSRSPGSALARGAEGSSARRHCTHPGCFCCALSASQERMTLLWCVVSLYFYGILQSDASERCDDWGLDTMRQIQVFEDEPARIKCPLFEHFLKFNYSTAHSAGLTLIWYWTRQDRDLEEPINFRLPENRISKEKDVLWFRPTLLNDTGNYTCMLRNTTYCSKVAFPLEVVQKDSCFNSPMKLPVHKLYIEYGIQRITCPNVDGYFPSSVKPTITWYMGCYKIQNFNNVIPEGMNLSFLIALISNNGNYTCVVTYPENGRTFHLTRTLTVKVVGSPKNAVPPVIHSPNDHVVYEKEPGEELLIPCTVYFSFLMDSRNEVWWTIDGKKPDDITIDVTINESISHSRTEDETRTQILSIKKVTSEDLKRSYVCHARSAKGEVAKAAKVKQKGNRCGQ

SEQ ID NO: 905952 - protein, 192 aa, Homo sapiens
FIHIGTSKHIEVKTQGCYKIQNFNNVIPEGMNLSFLIALISNNGNYTCVVTYPENGRTFHLTRTLTVKVVGSPKNAVPPVIHSPNDHVVYEKEPGEELLIPCTVYFSFLMDSRNEVWWTIDGKKPDDITIDVTINESISHSRTEDETRTQILSIKKVTSEDLKRSYVCHARSAKGEVAKAAKVKQKGNRCGQ

SEQ ID NO: 905953 - protein, 178 aa, Homo sapiens
FIHIGTSKHIEVKTQGCYKIQNFNNVIPEGMNLSFLIALISNNGNYTCVVTYPENGRTFHLTRTLTVKVVGSPKNAVPPVIHSPNDHVVYEKEPGEELLIPCTVYFSFLMDSRNEVWWTIDGNISHSRTEDETRTQILSIKKVTSEDLKRSYVCHARSAKGEVAKAAKVKQKGNRCGQ

SEQ ID NO: 905954 - protein, 80 aa, Homo sapiens
RLPGSRSPGSALARGAEGSSARRHCTHPGCFCCALSASQERKPRLIELRSMAYVLVCVHAADKDRPKTGQFAKERGSLDL

SEQ ID NO: 905955 - protein, 286 aa, Homo sapiens
MWYWRGGGVEEGIKLGVGENRISKEKDVLWFRPTLLNDTGNYTCMLRNTTYCSKVAFPLEVVQKDSCFNSPMKLPVHKLYIEYGIQRITCPNVDGYFPSSVKPTITWYMGCYKIQNFNNVIPEGMNLSFLIALISNNGNYTCVVTYPENGRTFHLTRTLTVKVVGSPKNAVPPVIHSPNDHVVYEKEPGEELLIPCTVYFSFLMDSRNEVWWTIDGKKPDDITIDVTINESISHSRTEDETRTQILSIKKVTSEDLKRSYVCHARSAKGEVAKAAKVKQKGNRCGQ

SEQ ID NO: 905956 - protein, 517 aa, Homo sapiens
KNWNWAGHRGKRRVKSAPSPYPTFKGWAVEGRLGLEQRRGGPSLAPPPTGLGRARSVTLSLCRRSSSVSCAVAPVAAAPVAALADAGAMAATDIARQVGEGCRTVPLAGHVGFDSLPDQLVNKSVSQGFCFNILCVGETGLGKSTLMDTLFNTKFEGEPATHTQPGVQLQSNTYDLQESNVRLKLTIVSTVGFGDQINKEDSYKPIVEFIDAQFEAYLQEELKIRRVLHTYHDSRIHVCLYFIAPTGHSLKSLDLVTMKKLDSKVNIIPIIAKADAISKSELTKFKIKITSELVSNGVQIYQFPTDDESVAEINGTMNAHLPFAVIGSTEELKIGNKMMRARQYPWGTVQVENEAHCDFVKLREMLIRVNMEDLREQTHTRHYELYRRCKLEEMGFKDTDPDSKPFSLQETYEAKRNEFLGELQKKEEEMRQMFVQRVKEKEAELKEAEKELHEKFDRLKKLHQDEKKKLEDKKKSLDDEVNAFKQRKTAAELLQSQGSQAGGSQTLKRDKEKKNFF

SEQ ID NO: 905957 - protein, 434 aa, Homo sapiens
TAQAKRRGAGVSLGQKAGEGCRTVPLAGHVGFDSLPDQLVNKSVSQGFCFNILCVGETGLGKSTLMDTLFNTKFEGEPATHTQPGVQLQSNTYDLQESNVRLKLTIVSTVGFGDQINKEDSYKPIVEFIDAQFEAYLQEELKIRRVLHTYHDSRIHVCLYFIAPTGHSLKSLDLVTMKKLDSKVNIIPIIAKADAISKSELTKFKIKITSELVSNGVQIYQFPTDDESVAEINGTMNAHLPFAVIGSTEELKIGNKMMRARQYPWGTVQVENEAHCDFVKLREMLIRVNMEDLREQTHTRHYELYRRCKLEEMGFKDTDPDSKPFSLQETYEAKRNEFLGELQKKEEEMRQMFVQRVKEKEAELKEAEKELHEKFDRLKKLHQDEKKKLEDKKKSLDDEVNAFKQRKTAAELLQSQGSQAGGSQTLKRDKEKKN

SEQ ID NO: 905958 - protein, 522 aa, Homo sapiens
KNWNWAGHRGKRRVKSAPSPYPTFKGWAVEGRLGLEQRRGGPSLAPPPTGLGRARSVTLSLCRRSSSVSCAVAPVAAAPVAALADAGAMAATDIARQVGEGCRTVPLAGHVGFDSLPDQLVNKSVSQGFCFNILCVGETGLGKSTLMDTLFNTKFEGEPATHTQPGVQLQSNTYDLQESNVRLKLTIVSTVGFGDQINKEDSYKPIVEFIDAQFEAYLQEELKIRRVLHTYHDSRIHVCLYFIAPTGHSLKSLDLVTMKKLDSKVNIIPIIAKADAISKSELTKFKIKITSELVSNGVQIYQFPTDDESVAEINGTMNAHLPFAVIGSTEELKIGNKMMRARQYPWGTVQVENEAHCDFVKLREMLIRVNMEDLREQTHTRHYELYRRCKLEEMGFKDTDPDSKPFSLQETYEAKRNEFLGELQKKEEEMRQMFVQRVKEKEAELKEAEKELHEKFDRLKKLHQDEKKKLEDKKKSLDDEVNAFKQRKTAAELLQSQGSQAGGSQTLKRDKEKKNNPWLCTE

SEQ ID NO: 905959 - protein, 522 aa, Homo sapiens; identical to SEQ ID NO: 905958

SEQ ID NO: 905960 - protein, 522 aa, Homo sapiens; identical to SEQ ID NO: 905958

SEQ ID NO: 905961 - protein, 515 aa, Homo sapiens
KNWNWAGHRGKRRVKSAPSPYPTFKGWAVEGRLGLEQRRGGPSLAPPPTGLGRARSVTLSLCRRSSSVSCAVAPVAAAPVAALADAGAMAATDIARQVGEGCRTVPLAGHVGFDSLPDQLVNKSVSQGFCFNILCVGETGLGKSTLMDTLFNTKFEGEPATHTQPGVQLQSNTYDLQESNVRLKLTIVSTVGFGDQINKEDSYKPIVEFIDAQFEAYLQEELKIRRVLHTYHDSRIHVCLYFIAPTGHSLKSLDLVTMKKLDSKVNIIPIIAKADAISKSELTKFKIKITSELVSNGVQIYQFPTDDESVAEINGTMNAHLPFAVIGSTEELKIGNKMMRARQYPWGTVQVENEAHCDFVKLREMLIRVNMEDLREQTHTRHYELYRRCKLEEMGFKDTDPDSKPFSLQETYEAKRNEFLGELQKKEEEMRQMFVQRVKEKEAELKEAEKELHEKFDRLKKLHQDEKKKLEDKKKSLDDEVNAFKQRKTAAELLQSQGSQAGGSQTLKRDKEKKN

SEQ ID NO: 905962 - protein, 515 aa, Homo sapiens; identical to SEQ ID NO: 905961

SEQ ID NO: 905963 - protein, 515 aa, Homo sapiens; identical to SEQ ID NO: 905961

SEQ ID NO: 905964 - protein, 515 aa, Homo sapiens; identical to SEQ ID NO: 905961

SEQ ID NO: 905965 - protein, 484 aa, Homo sapiens
KNWNWAGHRGKRRVKSAPSPYPTFKGWAVEGRLGLEQRRGGPSLAPPPTGLGRARSVTLSLCRRSSSVSCAVAPVAAAPVAALADAGAMAATDIARQVGEGCRTVPLAGHVGFDSLPDQLVNKSVSQGFCFNILCVGETGLGKSTLMDTLFNTKFEGEPATHTQPGVQLQSNTYDLQESNVRLKLTIVSTVGFGDQINKEDSYKPIVEFIDAQFEAYLQEELKIRRVLHTYHDSRIHVCLYFIAPTGHSLKSLDLVTMKKLDSKVNIIPIIAKADAISKSELTKFKIKITSELVSNGVQIYQFPTDDESVAEINGTMNAHLPFAVIGSTEELKIGNKMMRARQYPWGTVQVENEAHCDFVKLREMLIRVNMEDLREQTHTRHYELYRRCKLEEMGFKDTDPDSKPFSLQETYEAKRNEFLGELQKKEEEMRQMFVQRVKEKEAELKEAEKELHEKFDRLKKLHQDEKKKAGGSQTLKRDKEKKK

SEQ ID NO: 905966 - protein, 270 aa, Homo sapiens
PSDRSRINQPIDCPKQDAIFPEGRLEALNKKVFKIKITSELVSNGVQIYQFPTDDESVAEINGTMNAHLPFAVIGSTEELKIGNKMMRARQYPWGTVQVENEAHCDFVKLREMLIRVNMEDLREQTHTRHYELYRRCKLEEMGFKDTDPDSKPFSLQETYEAKRNEFLGELQKKEEEMRQMFVQRVKEKEAELKEAEKELHEKFDRLKKLHQDEKKKLEDKKKSLDDEVNAFKQRKTAAELLQSQGSQAGGSQTLKRDKEKKNNPWLCTE

SEQ ID NO: 905967 - protein, 116 aa, Homo sapiens
MVRGPICYSFPPAPLFQFWLLLVSLRYLQPPWLGNHRSAQLSPWSPVSQSLVLPGPPHPHPQEPQPFLRGFQKDSLWRLFLLTFESSPFQFSFTRSNCTQAVLKIGNAFIYTKPFP

SEQ ID NO: 905968 - protein, 515 aa, Homo sapiens; identical to SEQ ID NO: 905961

SEQ ID NO: 905969 - protein, 598 aa, Homo sapiens
GKLGRYPPWPGKIVNPPKDLKKPRGKKCFFVKFFGTEDHAWIKVEQLKPYHAHKEEMIKINKGKRFQQAVDAVEEFLRRAKGKDQTSSHNSSDDKNRRNSSEERSRPNSGDEKRKLSLSEGKVKKNMGEGKKRVSSGSSERGSKSPLKRAQEQSPRKRGRPPKDEKDLTIPESSTVKGMMAGPMAAFKWQPTASEPVKDADPHFHHFLLSQTEKETGSTSIQAADSTAVNGSITPTDKKIGFLGLGLMGSGIVSNLLKMGHTVTVWNRTAEKCDLFIQEGARLGRTPAEVVSTCDITFACVSDPKAAKDLVLGPSGVLQGIRPGKCYVDMSTVDADTVTELAQVIVSRGGRFLEAPVSGNQQLSNDGMLVILAAGDRGLYEDCSSCFQAMGKTSFFLGEVGNAAKMMLIVNMVQGSFMATIAEGLTLAQVTGQSQQTLLDILNQGQLASIFLDQKCQNILQGNFKPDFYLKYIQKDLRLAIALGDAVNHPTPMAAAANEVYKRAKALDQSDNDMSAVYRAYYTKLSTPRPHPSNPPSDPLFLTWGRGPGSSFWTSPPISISFYTDFETCHQHSTQQHPSPEAGGEGTSVSRIGVWESS

SEQ ID NO: 905970 - protein, 522 aa, Homo sapiens; identical to SEQ ID NO: 905958

SEQ ID NO: 905971 - protein, 515 aa, Homo sapiens; identical to SEQ ID NO: 905961

SEQ ID NO: 905972 - protein, 519 aa, Homo sapiens
KNWNWAGHRGKRRVKSAPSPYPTFKGWAVEGRLGLEQRRGGPSLAPPPTGLGRARSVTLSLCRRSSSVSCAVAPVAAAPVAALADAGAMAATDIARQVGEGCRTVPLAGHVGFDSLPDQLVNKSVSQGFCFNILCVGETGLGKSTLMDTLFNTKFEGEPATHTQPGVQLQSNTYDLQESNVRLKLTIVSTVGFGDQINKEDSYKPIVEFIDAQFEAYLQEELKIRRVLHTYHDSRIHVCLYFIAPTGHSLKSLDLVTMKKLDSKVNIIPIIAKADAISKSELTKFKIKITSELVSNGVQIYQFPTDDESVAEINGTMNAHLPFAVIGSTEELKIGNKMMRARQYPWGTVQVENEAHCDFVKLREMLIRVNMEDLREQTHTRHYELYRRCKLEEMGFKDTDPDSKPFSLQETYEAKRNEFLGELQKKEEEMRQMFVQRVKEKEAELKEAEKELHEKFDRLKKLHQDEKKKLEDKKKSLDDEVNAFKQRKTAAELLQSQGSQAGGSQTLKRDKEKKNLGFL

SEQ ID NO: 905973 - protein, 451 aa, Homo sapiens
LVANSARGAPVAAAPVAALADAGAMAATDIARQVGEGCRTVPLAGHVGFDSLPDQLVNKSVSQGFCFNILCVGETGLGKSTLMDTLFNTKFEGEPATHTQPGVQLQSNTYDLQESNVRLKLTIVSTVGFGDQINKEDSYKPIVEFIDAQFEAYLQEELKIRRVLHTYHDSRIHVCLYFIAPTGHSLKSLDLVTMKKLDSKVNIIPIIAKADAISKSELTKFKIKITSELVSNGVQIYQFPTDDESVAEINGTMNAHLPFAVIGSTEELKIGNKMMRARQYPWGTVQVENEAHCDFVKLREMLIRVNMEDLREQTHTRHYELYRRCKLEEMGFKDTDPDSKPFSLQETYEAKRNEFLGELQKKEEEMRQMFVQRVKEKEAELKEAEKELHEKFDRLKKLHQDEKKKLEDKKKSLDDEVNAFKQRKTAAELLQSQGSQAGGSQTLKRDKEKKN

SEQ ID NO: 905974 - protein, 515 aa, Homo sapiens
KNWNWAGHRGKRRVKSAPSPYPTFKGWAVEGRLGLEQRRGGPSLAPPPTGLGRARSVTLSLCRRSSSVSCAVAPVAAAPVAALADAGAMAATDIARQVGEGCRTVPLAGHVGFDSLPDQLVNKSVSQGFCFNILCVGETGLGKSTLMDTLFNTKFEGEPATHTQPGVQLQSNTYDLQESNVRLKLTIVSTVGFGDQINKEDSYKPIVEFIDAQFEAYLQEELKIRRVLHTYHDSRIHVCLYFIAPTGHSLKSLDLVTMKKLDSKVNIIPIIAKADAISKSELTKFKIKITSELVSNGVQIYQFPTDDESVAEINGTMNAHLPFAVIGSTEELKIGNKMMRARQYPWGTVQVENEAHCDFVKLREMLIRVNMEDLREQTHTRHYELYRRCKLEEMGFKDTDPDSKPFSLQETYEAKRNEFLGELQKKEEEMRQMFVQRVKEKEAELKEAEKELHEKFDRLKKLHQDEKKKLEDKKKSLDDEVNAFKQRKTAAELLQSQGSQAGGSQTLKRDKEKKK

SEQ ID NO: 905975 - protein, 355 aa, Homo sapiens
KNWNWAGHRGKRRVKSAPSPYPTFKGWAVEGRLGLEQRRGGPSLAPPPTGLGRARSVTLSLCRRSSSVSCAVAPVAAAPVAALADAGAMAATDIARQVGEGCRTVPLAGHVGFDSLPDQLVNKSVSQGFCFNILCVGETGLGKSTLMDTLFNTKFEGEPATHTQPGVQLQSNTYDLQESNVRLKLTIVSTVGFGDQINKEDSYKPIVEFIDAQFEAYLQEELKIRRVLHTYHDSRIHVCLYFIAPTGHSLKSLDLVTMKKLDSKVNIIPIIAKADAISKSELTKFKIKITSELVSNGVQIYQFPTDDESVAEINGTMNAHLPFAVIGSTEELKIGNKMMRARQYPWGTVQAAREV

SEQ ID NO: 905976 - protein, 363 aa, Homo sapiens
KNWNWAGHRGKRRVKSAPSPYPTFKGWAVEGRLGLEQRRGGPSLAPPPTGLGRARSVTLSLCRRSSSVSCAVAPVAAAPVAALADAGAMAATDIARQVGEGCRTVPLAGHVGFDSLPDQLVNKSVSQGFCFNILCVGETGLGKSTLMDTLFNTKFEGEPATHTQPGVQLQSNTYDLQESNVRLKLTIVSTVGFGDQINKEDSYKPIVEFIDAQFEAYLQEELKIRRVLHTYHDSRIHVCLYFIAPTGHSLKSLDLVTMKKLDSKVNIIPIIAKADAISKSELTKFKIKITSELVSNGVQIYQFPTDDESVAEINGTMNAHLPFAVIGSTEELKIGNKMMRARQYPWGTVQVYRRHMRPKGTSS

SEQ ID NO: 905977 - protein, 1019 aa, Homo sapiens [sequence omitted]

SEQ ID NO: 905978 - protein, 1005 aa, Homo sapiens
EFIIRGGRVPSHCLHFSRSFQKKTYSKMNNPAIKRIGNHITKSPEDKREYRGLELANGIKVLLISDPTTDKSSAALDVHIGSLSDPPNIAGLSHFCEHMLFLGTKKYPKENEYSQFLSEHAGSSNAFTSGEHTNYYFDVSHEHLEGALDRFAQFFLCPLFDESCKDREVNAVDSEHEKNVMNDAWRLFQLEKATGNPKHPFSKFGTGNKYTLETRPNQEGIDVRQELLKFHSAYYSSNLMAVCVLGRESLDDLTNLVVKLFSEVENKNVPLPEFPEHPFQEEHLKQLYKIVPIKDIRNLYVTFPIPDLQKYYKSNPGHYLGHLIGHEGPGSLLSELKSKGWVNTLVGGQKEGARGFMFFIINVDLTEEGLLHVEDIILHMFQYIQKLRAEGPQEWVFQECKDLNAVAFRFKDKERPRGYTSKIAGILHYYPLEEVLTAEYLLEEFRPDLIEMVLDKLRPENVRVAIVSKSFEGKTDRTEEWYGTQYKQEAIPDEVIKKWQNADLNGKFKLPTKNEFIPTNFEILPLEKEATPYPALIKDTAMSKLWFKQDDKFFLPKACLNFEFFSPFAYVDPLHCNMAYLYLELLKDSLNEYAYAAELAGLSYDLQNTIYGMYLSVKGYNDKQPILLKKIIEKMATFEIDEKRFEIIKEAYMRSLNNFRAEQPHQHAMYYLRLLMTEVAWTKDELKEALDDVTLPRLKAFIPQLLSRLHIEALLHGNITKQAALGIMQMVEDTLIEHAHTKPLLPSQLVRYREVQLPDRGWFVYQQRNEVHNNCGIEIYYQTDMQSTSENMFLELFCQIISEPCFNTLRTKEQLGYIVFSGPRRANGIQGLRFIIQSEKPPHYLESRVEAFLITMEKSIEDMTEEAFQKHIQALAIRRLDKPKKLSAECAKYWGEIISQQYNFDRDNTEVAYLKTLTKEDIIKFYKEMLAVDAPRRHKVSVHVLAREMDSCPVVGEFPCQNDINLSQAPALPQPEVIQNMTEFKRGLPLFPLVKPHINFMAAKL

SEQ ID NO: 905979 - protein, 1067 aa, Homo sapiens
MRYRLAWLLHPALPSTFRSVLGARLPPPERLCGFQKKTYSKMNNPAIKRIGNHITKSPEDKREYRGLELANGIKVLLISDPTTDKSSAALDVHIGSLSDPPNIAGLSHFCEHMLFLGTKKYPKENEYSQFLSEHAGSSNAFTSGEHTNYYFDVSHEHLEGALDRFAQFFLCPLFDESCKDREVNAVDSEHEKNVMNDAWRLFQLEKATGNPKHPFSKFGTGNKYTLETRPNQEGIDVRQELLKFHSAYYSSNLMAVCVLGRESLDDLTNLVVKLFSEVENKNVPLPEFPEHPFQEEHLKQLYKIVPIKDIRNLYVTFPIPDLQKYYKSNPGHYLGHLIGHEGPGSLLSELKSKGWVNTLVGGQKEGARGFMFFIINVDLTEEGLLHVEDIILHMFQYIQKLRAEGPQEWVFQECKDLNAVAFRFKDKERPRGYTSKIAGILHYYPLEEVLTAEYLLEEFRPDLIEMVLDKLRPENVRVAIVSKSFEGKTDRTEEWYGTQYKQEAIPDEVIKKWQNADLNGKFKLPTKNEFIPTNFEILPLEKEATPYPALIKDTAMSKLWFKQDDKFFLPKACLNFEFFSPFAYVDPLHCNMAYLYLELLKDSLNEYAYAAELAGLSYDLQNTIYGMYSYIYADPLHCNMTYLFIRLLKDDLKEYTYAARLSGLSYGIASGMNAILLSVKGYNDKQPILLKKIIEKMATFEIDEKRFEIIKEAYMRSLNNFRAEQPHQHAMYYLRLLMTEVAWTKDELKEALDDVTLPRLKAFIPQLLSRLHIEALLHGNITKQAALGIMQMVEDTLIEHAHTKPLLPSQLVRYREVQLPDRGWFVYQQRNEVHNNCGIEIYYQTDMQSTSENMFLELFCQIISEPCFNTLRTKEQLGYIVFSGPRRANGIQGLRFIIQSEKPPHYLESRVEAFLITMEKSIEDMTEEAFQKHIQALAIRRLDKPKKLSAECAKYWGEIISQQYNFDRDNTEVAYLKTLTKEDIIKFYKEMLAVDAPRRHKVSVHVLAREMDSCPVVGEFPCQNDINLSQAPALPQPEVIQNMTEFKRGLPLFPLVKPHINFMAAKL

SEQ ID NO: 905980 - protein, 464 aa, Homo sapiens
MSKLWFKQDDKFFLPKACLNFEFFSPFAYVDPLHCNMAYLYLELLKDSLNEYAYAAELAGLSYDLQNTIYGMYLSVKGYNDKQPILLKKIIEKMATFEIDEKRFEIIKEAYMRSLNNFRAEQPHQHAMYYLRLLMTEVAWTKDELKEALDDVTLPRLKAFIPQLLSRLHIEALLHGNITKQAALGIMQMVEDTLIEHAHTKPLLPSQLVRYREVQLPDRGWFVYQQRNEVHNNCGIEIYYQTDMQSTSENMFLELFCQIISEPCFNTLRTKEQLGYIVFSGPRRANGIQGLRFIIQSEKPPHYLESRVEAFLITMEKSIEDMTEEAFQKHIQALAIRRLDKPKKLSAECAKYWGEIISQQYNFDRDNTEVAYLKTLTKEDIIKFYKEMLAVDAPRRHKVSVHVLAREMDSCPVVGEFPCQNDINLSQAPALPQPEVIQNMTEFKRGLPLFPLVKPHINFMAAKL

SEQ ID NO: 905981 - protein, 428 aa, Homo sapiens
MAYLYLELLKDSLNEYAYAAELAGLSYDLQNTIYGMYLSVKGYNDKQPILLKKIIEKMATFEIDEKRFEIIKEAYMRSLNNFRAEQPHQHAMYYLRLLMTEVAWTKDELKEALDDVTLPRLKAFIPQLLSRLHIEALLHGNITKQAALGIMQMVEDTLIEHAHTKPLLPSQLVRYREVQLPDRGWFVYQQRNEVHNNCGIEIYYQTDMQSTSENMFLELFCQIISEPCFNTLRTKEQLGYIVFSGPRRANGIQGLRFIIQSEKPPHYLESRVEAFLITMEKSIEDMTEEAFQKHIQALAIRRLDKPKKLSAECAKYWGEIISQQYNFDRDNTEVAYLKTLTKEDIIKFYKEMLAVDAPRRHKVSVHVLAREMDSCPVVGEFPCQNDINLSQAPALPQPEVIQNMTEFKRGLPLFPLVKPHINFMAAKL

SEQ ID NO: 905982 - protein, 374 aa, Homo sapiens
TRVYAQVEIDQKKYEIIKEAYMRSLNNFRAEQPHQHAMYYLRLLMTEVAWTKDELKEALDDVTLPRLKAFIPQLLSRLHIEALLHGNITKQAALGIMQMVEDTLIEHAHTKPLLPSQLVRYREVQLPDRGWFVYQQRNEVHNNCGIEIYYQTDMQSTSENMFLELFCQIISEPCFNTLRTKEQLGYIVFSGPRRANGIQGLRFIIQSEKPPHYLESRVEAFLITMEKSIEDMTEEAFQKHIQALAIRRLDKPKKLSAECAKYWGEIISQQYNFDRDNTEVAYLKTLTKEDIIKFYKEMLAVDAPRRHKVSVHVLAREMDSCPVVGEFPCQNDINLSQAPALPQPEVIQNMTEFKRGLPLFPLVKPHINFMAAKL

SEQ ID NO: 905983 - protein, 181 aa, Homo sapiens
MSKLWFKQDDKFFLPKACLNFEFFSPFAYVDPLHCNMAYLYLELLKDSLNEYAYAAELAGLSYDLQNTIYGMYLSVKGYNDKQPILLKKIIEKMATFEIDEKRFEIIKEAYMRSLNNFRAEQPHQHAMYYLRLLMTEVAWTKDELKEALDGETFDLKLNAFFIFFLNSFWFILILTVYTFK

SEQ ID NO: 905984 - protein, 1019 aa, Homo sapiens [sequence omitted]

SEQ ID NO: 905985 - protein, 1174 aa, Homo sapiens
WRRAGSKRKQEAFAVIPATALANAVPASVASAPRTAQHLPLSPRRPPAASGAPVWELPGCFSKQRHYFAFPPAVCENSNFSISLTTLAICTFVISHPGGYEVVSHWNFDFHFPDDHCKSFKIYSLGRACWLMPVIPALWEDEAGGSPAVQEFRTSLTNKLLHVASESYAVKRFKQFFCLSLPSSWDYSFQKKTYSKMNNPAIKRIGNHITKSPEDKREYRGLELANGIKVLLISDPTTDKSSAALDVHIGSLSDPPNIAGLSHFCEHMLFLGTKKYPKENEYSQFLSEHAGSSNAFTSGEHTNYYFDVSHEHLEGALDRFAQFFLCPLFDESCKDREVNAVDSEHEKNVMNDAWRLFQLEKATGNPKHPFSKFGTGNKYTLETRPNQEGIDVRQELLKFHSAYYSSNLMAVCVLGRESLDDLTNLVVKLFSEVENKNVPLPEFPEHPFQEEHLKQLYKIVPIKDIRNLYVTFPIPDLQKYYKSNPGHYLGHLIGHEGPGSLLSELKSKGWVNTLVGGQKEGARGFMFFIINVDLTEEGLLHVEDIILHMFQYIQKLRAEGPQEWVFQECKDLNAVAFRFKDKERPRGYTSKIAGILHYYPLEEVLTAEYLLEEFRPDLIEMVLDKLRPENVRVAIVSKSFEGKTDRTEEWYGTQYKQEAIPDEVIKKWQNADLNGKFKLPTKNEFIPTNFEILPLEKEATPYPALIKDTAMSKLWFKQDDKFFLPKACLNFEFFSPFAYVDPLHCNMAYLYLELLKDSLNEYAYAAELAGLSYDLQNTIYGMYLSVKGYNDKQPILLKKIIEKMATFEIDEKRFEIIKEAYMRSLNNFRAEQPHQHAMYYLRLLMTEVAWTKDELKEALDDVTLPRLKAFIPQLLSRLHIEALLHGNITKQAALGIMQMVEDTLIEHAHTKPLLPSQLVRYREVQLPDRGWFVYQQRNEVHNNCGIEIYYQTDMQSTSENMFLELFCQIISEPCFNTLRTKEQLGYIVFSGPRRANGIQGLRFIIQSEKPPHYLESRVEAFLITMEKSIEDMTEEAFQKHIQALAIRRLDKPKKLSAECAKYWGEIISQQYNFDRDNTEVAYLKTLTKEDIIKFYKEMLAVDAPRRHKVSVHVLAREMDSCPVVGEFPCQNDINLSQAPALPQPEVIQNMTEFKRGLPLFPLVKPHINFMAAKL

SEQ ID NO: 905986 - protein, 428 aa, Homo sapiens; identical to SEQ ID NO: 905981

SEQ ID NO: 905987 - protein, 450 aa, Homo sapiens [sequence omitted]

SEQ ID NO: 905988 - protein, 736 aa, Homo sapiens
MRYRLAWLLHPALPSTFRSVLGARLPPPERLCGFQKKTYSKMNNPAIKRIGNHITKSPEDKREYRGLELANGIKVLLISDPTTDKSSAALDVHIGSLSDPPNIAGLSHFCEHMLFLGTKKYPKENEYSQFLSEHAGSSNAFTSGEHTNYYFDVSHEHLEGALDRFAQFFLCPLFDESCKDREVNAVDSEHEKNVMNDAWRLFQLEKATGNPKHPFSKFGTGNKYTLETRPNQEGIDVRQELLKFHSAYYSSNLMAVCVLGRESLDDLTNLVVKLFSEVENKNVPLPEFPEHPFQEEHLKQLYKIVPIKDIRNLYVTFPIPDLQKYYKSNPGHYLGHLIGHEGPGSLLSELKSKGWVNTLVGGQKEGARGFMFFIINVDLTEEGLLHVEDIILHMFQYIQKLRAEGPQEWVFQECKDLNAVAFRFKDKERPRGYTSKIAGILHYYPLEEVLTAEYLLEEFRPDLIEMVLDKLRPENVRVAIVSKSFEGKTDRTEEWYGTQYKQEAIPDEVIKKWQNADLNGKFKLPTKNEFIPTNFEILPLEKEATPYPALIKDTAMSKLWFKQDDKFFLPKACLNFEFFSPFAYVDPLHCNMAYLYLELLKDSLNEYAYAAELAGLSYDLQNTIYGMYLSVKGYNDKQPILLKKIIEKMATFEIDEKRFEIIKEAYMRSLNNFRAEQPHQHAMYYLRLLMTEVAWTKDELKEALDGETFDLKLNAFFIFFLNSFWFILILTVYTFK

SEQ ID NO: 905989 - protein, 382 aa, Homo sapiens
MGDWSALGKLLDKVQAYSTAGGKVWLSVLFIFRILLLGTAVESAWGDEQSAFRCNTQQPGCENVCYDKSFPISHVRFWVLQIIFVSVPTLLYLAHVFYVMRKEEKLNKKEEELKVAQTDGVNVDMHLKQIEIKKFKYGIEEHGKVKMRGGLLRTYIISILFKSIFEVAFLLIQWYIYGFSLSAVYTCKRDPCPHQVDCFLSRPTEKTIFIIFMLVVSLVSLALNIIELFYVFFKGVKDRVKGKSDPYHATSGALSPAKDCGSQKYAYFNGCSSPTAPLSPMSPPGYKLVTGDRNNSSCRNYNKQASEQNWANYSAEQNRMGQAGSTISNSHAQPFDFPDDNQNSKKLAAGHELQPLAIVDQRPSSRASSRASSRPRPDDLEI

SEQ ID NO: 905990 - protein, 382 aa, Homo sapiens; identical to SEQ ID NO: 905989

SEQ ID NO: 905991 - protein, 382 aa, Homo sapiens; identical to SEQ ID NO: 905989

SEQ ID NO: 905992 - protein, 382 aa, Homo sapiens; identical to SEQ ID NO: 905989

SEQ ID NO: 905993 - protein, 382 aa, Homo sapiens; identical to SEQ ID NO: 905989

SEQ ID NO: 905994 - protein, 382 aa, Homo sapiens; identical to SEQ ID NO: 905989

SEQ ID NO: 905995 - protein, 382 aa, Homo sapiens; identical to SEQ ID NO: 905989

SEQ ID NO: 905996 - protein, 758 aa, Homo sapiens
MLRACQLSGVTAAAQSCLCGKFVLRPLRPCRRYSTSGSSGLTTGKIAGAGLLFVGGGIGGTILYAKWDSHFRESVEKTIPYSDKLFEMVLGPAAYNVPLPKKSIQSGPLKISSVSEVMKESKQPASQLQKQKGDTPASATAPTEAAQIISAAGDTLSVPAPAVQPEESLKTDHPEIGEGKPTPALSEEASSSSIRERPPEEVAARLAQQEKQEQVKIESLAKSLEDALRQTASVTLQAIAAQNAAVQAVNAHSNILKAAMDNSEIAGEKKSAQWRTVEGALKERRKAVDEAADALLKAKEELEKMKSVIENAKKKEVAGAKPHITAAEGKLHNMIVDLDNVVKKVQAAQSEAKVVSQYHELVVQARDDFKRELDSITPEVLPGWKGMSVSDLADKLSTDDLNSLIAHAHRRIDQLNRELAEQKATEKQHITLALEKQKLEEKRAFDSAVAKALEHHRSEIQAEQDRKIEEVRDAMENEMRTQLRRQAAAHTDHLRDVLRVQEQELKSEFEQNLSEKLSEQELQFRRLSQEQVDNFTLDINTAYARLRGIEQAVQSHAVAEEEARKAHQLWLSVEALKYSMKTSSAETPTIPLGSAVEAIKANCSDNEFTQALTAAIPPESLTRGVYSEETLRARFYAVQKLARRVAMIDETRNSLYQYFLSYLQSLLLFPPQQLKPPPELCPEDINTFKLLSYASYCIEHGDLELAAKFVNQLKGESRRVAQDWLKEARMTLETKQIVEILTAYASAVGIGTTQVQPE

SEQ ID NO: 905997 - protein, 267 aa, Homo sapiens
MLRACQLSGVTAAAQSCLCGKFVLRPLRPCRRYSTSGSSGLTTGKIAGAGLLFVGGGIGGTILYAKWDSHFRESVEKTIPYSDKLFEMVLGPAAYNVPLPKKSIQSGPLKISSVSEVMKESKQPASQLQKQKGDTPASATAGDTLSVPAPAVQPEESLKTDHPEIGEGKPTPALSEEASSSSIRERPPEEVAARLAQQEKQEQVKIESLAKSLEDALRQTASVTLQAIAAQNAAVQAVNAHSNILKAAMDNSENCAKKKNLAPLGAG

SEQ ID NO: 905998 - protein, 747 aa, Homo sapiens
MLRACQLSGVTAAAQSCLCGKFVLRPLRPCRRYSTSGSSGLTTGKIAGAGLLFVGGGIGGTILYAKWDSHFRESVEKTIPYSDKLFEMVLGPAAYNVPLPKKSIQSGPLKISSVSEVMKESKQPASQLQKQKGDTPASATAGDTLSVPAPAVQPEESLKTDHPEIGEGKPTPALSEEASSSSIRERPPEEVAARLAQQEKQEQVKIESLAKSLEDALRQTASVTLQAIAAQNAAVQAVNAHSNILKAAMDNSEIAGEKKSAQWRTVEGALKERRKAVDEAADALLKAKEELEKMKSVIENAKKKEVAGAKPHITAAEGKLHNMIVDLDNVVKKVQAAQSEAKVVSQYHELVVQARDDFKRELDSITPEVLPGWKGMSVSDLADKLSTDDLNSLIAHAHRRIDQLNRELAEQKATEKQHITLALEKQKLEEKRAFDSAVAKALEHHRSEIQAEQDRKIEEVRDAMENEMRTQLRRQAAAHTDHLRDVLRVQEQELKSEFEQNLSEKLSEQELQFRRLSQEQVDNFTLDINTAYARLRGIEQAVQSHAVAEEEARKAHQLWLSVEALKYSMKTSSAETPTIPLGSAVEAIKANCSDNEFTQALTAAIPPESLTRGVYSEETLRARFYAVQKLARRVAMIDETRNSLYQYFLSYLQSLLLFPPQQLKPPPELCPEDINTFKLLSYASYCIEHGDLELAAKFVNQLKGESRRVAQDWLKEARMTLETKQIVEILTAYASAVGIGTTQVQPE

SEQ ID NO: 905999 - protein, 641 aa, Homo sapiens
MKESKQPASQLQKQKGDTPASATAPTEAAQIISAAGDTLSVPAPAVQPEESLKTDHPEIGEGKPTPALSEEASSSSIRERPPEEVAARLAQQEKQEQVKIESLAKSLEDALRQTASVTLQAIAAQNAAVQAVNAHSNILKAAMDNSEIAGEKKSAQWRTVEGALKERRKAVDEAADALLKAKEELEKMKSVIENAKKKEVAGAKPHITAAEGKLHNMIVDLDNVVKKVQAAQSEAKVVSQYHELVVQARDDFKRELDSITPEVLPGWKGMSVSDLADKLSTDDLNSLIAHAHRRIDQLNRELAEQKATEKQHITLALEKQKLEEKRAFDSAVAKALEHHRSEIQAEQDRKIEEVRDAMENEMRTQLRRQAAAHTDHLRDVLRVQEQELKSEFEQNLSEKLSEQELQFRRLSQEQVDNFTLDINTAYARLRGIEQAVQSHAVAEEEARKAHQLWLSVEALKYSMKTSSAETPTIPLGSAVEAIKANCSDNEFTQALTAAIPPESLTRGVYSEETLRARFYAVQKLARRVAMIDETRNSLYQYFLSYLQSLLLFPPQQLKPPPELCPEDINTFKLLSYASYCIEHGDLELAAKFVNQLKGESRRVAQDWLKEARMTLETKQIVEILTAYASAVGIGTTQVQPE

SEQ ID NO: 906000 - protein, 726 aa, Homo sapiens
MLRACQLSGVTAAAQSCLCGKFVLRPLRPCRRYSTSGSSGLTTGKIAGAGLLFVGGGIGGTILYAKWDSHFRESVEKTIPYSDKLFEMVLGPAAYNVPLPKKSIQSGPLKISSVSEVMKESKQPASQLQKQKGDTPASATAPTEAAQIISAAGDTLSVPAPAVQPEESLKTDHPEIGEGKPTPALSALAKSLEDALRQTASVTLQAIAAQNAAVQAVNAHSNILKAAMDNSEIAGEKKSAQWRTVEGALKERRKAVDEAADALLKAKEELEKMKSVIENAKKKEVAGAKPHITAAEGKLHNMIVDLDNVVKKVQAAQSEAKVVSQYHELVVQARDDFKRELDSITPEVLPGWKGMSVSDLADKLSTDDLNSLIAHAHRRIDQLNRELAEQKATEKQHITLALEKQKLEEKRAFDSAVAKALEHHRSEIQAEQDRKIEEVRDAMENEMRTQLRRQAAAHTDHLRDVLRVQEQELKSEFEQNLSEKLSEQELQFRRLSQEQVDNFTLDINTAYARLRGIEQAVQSHAVAEEEARKAHQLWLSVEALKYSMKTSSAETPTIPLGSAVEAIKANCSDNEFTQALTAAIPPESLTRGVYSEETLRARFYAVQKLARRVAMIDETRNSLYQYFLSYLQSLLLFPPQQLKPPPELCPEDINTFKLLSYASYCIEHGDLELAAKFVNQLKGESRRVAQDWLKEARMTLETKQIVEILTAYASAVGIGTTQVQPE

SEQ ID NO: 906001 - protein, 729 aa, Homo sapiens
MLRACQLSGVTAAAQSCLCGKFVLRPLRPCRRYSTSGSSGLTTGKIAGAGLLFVGGGIGGTILYAKWDSHFRESVEKTIPYSDKLFEMVLGPAAYNVPLPKKSIQSGPLKISSVSEVMKESKQPASQLQKQKGDTPASATAGDTLSVPAPAVQPEESLKTDHPEIGEGKPTPALSEEASSSSIRERPPEEVAARLAQQEKQEQVKIESLAKSLEDALRQTASVTLQAIAAQNAAVQAVNAHSNILKAAMDNSEIAGEKKSAQWRTVEGALKERRKAVDEAADALLKAKEELEKMKSVIENAKKKEVAGAKPHITAAEGKLHNMIVDLDNVVKKVQAAQSEAKVVSQYHELVVQARDDFKRELDSITPEVLPGWKGMSVSDLADKLSTDDLNSLIAHAHRRIDQLNRELAEQKATEKQHITLALEKQKLEEKRAFDSAVAKALEHHRSEIQAEQDRKIEEVRDAMENEMRTQLRRQAAAHTDHLRDVLRVQEQELKSEFEQNLSEKLSEQELQFRRLSQEQVDNFTLDINTAYARLRGIEQAVQSHAVAEEEARKAHQLWLSVEALKYSMKTSSAETPTIPLGSAVEAIKANCSDNEFTQALTAAIPPESLTRGVYSEETLRARFYAVQYFLSYLQSLLLFPPQQLKPPPELCPEDINTFKLLSYASYCIEHGDLELAAKFVNQLKGESRRVAQDWLKEARMTLETKQIVEILTAYASAVGIGTTQVQPE

SEQ ID NO: 906002 - protein, 519 aa, Homo sapiens
SGTRIDGPWRVLNIGRGLKAHGHSEIAGEKKSAQWRTVEGALKERRKAVDEAADALLKAKEELEKMKSVIENAKKKEVAGAKPHITAAEGKLHNMIVDLDNVVKKVQAAQSEAKVVSQYHELVVQARDDFKRELDSITPEVLPGWKGMSVSDLADKLSTDDLNSLIAHAHRRIDQLNRELAEQKATEKQHITLALEKQKLEEKRAFDSAVAKALEHHRSEIQAEQDRKIEEVRDAMENEMRTQLRRQAAAHTDHLRDVLRVQEQELKSEFEQNLSEKLSEQELQFRRLSQEQVDNFTLDINTAYARLRGIEQAVQSHAVAEEEARKAHQLWLSVEALKYSMKTSSAETPTIPLGSAVEAIKANCSDNEFTQALTAAIPPESLTRGVYSEETLRARFYAVQKLARRVAMIDETRNSLYQYFLSYLQSLLLFPPQQLKPPPELCPEDINTFKLLSYASYCIEHGDLELAAKFVNQLKGESRRVAQDWLKEARMTLETKQIVEILTAYASAVGIGTTQVQPE

SEQ ID NO: 906003 - protein, 711 aa, Homo sapiens
MLRACQLSGVTAAAQSCLCGKFVLRPLRPCRRYSTSGSSGLTTGKIAGAGLLFVGGGIGGTILYAKWDSHFRESVEKTIPYSDKLFEMVLGPAAYNVPLPKKSIQSGPLKISSVSEVMKESKQPASQLQKQKGDTPASATAGDTLSVPAPAVQPEESLKTDHPEIGEGKPTPALSEEASSSSIRERPPEEVAARLAQQEKQEQVKIESLAKSLEDALRQTASVTLQAIAAQNAAVQAVNAHSNILKAAMDNSEIAGEKKSAQWRTVEGALKERRKAVDEAADALLKAKEELEKMKSVIENAKKKEVAGAKPHITAAEGKLHNMIVDLDNVVKKVQAAQSEAKVVSQYHELVVQARDDFKRELDSITPEVLPGWKGMSVSDLADKLSTDDLNSLIAHAHRRIDQLNRELAEQKATEKQHITLALEKQKLEEKRAFDSAVAKALEHHRSEIQAEQDRKIEEVRDAMENEMRTQLRRQAAAHTDHLRDVLRVQEQELKSEFEQNLSEKLSEQELQFRRLSQEQVDNFTLDINTAYARLRGIEQAVQSHAVAEEEARKAHQLWLSVEALKYSMKTSSAETPTIPLGSAVEAIKANCSDNEFTQALTAAIPPESLTRGVYSEETLRARFYAVQKLARRVAMIDETRNSLYQYFLSYLQSLLLFPPQQLKPPPELCPEDINTFKLLSYASYCIEHGDLELAAKFVNQLKGESRRSEV

SEQ ID NO: 906004 - protein, 685 aa, Homo sapiens
MLRACQLSGVTAAAQSCLCGKFVLRPLRPCRRYSTSGSSGLTTGKIAGAGLLFVGGGIGGTILYAKWDSHFRESVEKTIPYSDKLFEMVLGPAAYNVPLPKKSIQSGPLKISSVSEVMKESKQPASQLQKQKGDTPASATAGDTLSVPAPAVQPEESLKTDHPEIGEGKPTPALSEEASSSSIRERPPEEVAARLAQQEKQEQVKIESLAKSLEDALRQTASVTLQAIAAQNAAVQAVNAHSNILKAAMDNSEIAGEKKSAQWRTVEGALKERRKAVDEAADALLKAKEELEKMKSVIENAKKKEVAGAKPHITAAEGKLHNMIVDLDNVVKKVQAAQSEAKVVSQYHELVVQARDDFKRELDSITPEVLPGWKGMSVSDLADKLSTDDLNSLIAHAHRRIDQLNRELAEQKATEKQHITLALEKQKLEEKRAFDSAVAKALEHHRSEIQAEQDRKIEEVRDAMENEMRTQLRRQAAAHTDHLRDVLRVQEQELKSEFEQNTVWQKLSEHRLTIPADSRQAAQGTTNTPRHNITRPMPNTQRNSNRRGTQPRHVAEKSNTKSHHTRGHTGDHTTHESTPIANKHPTKTDCDYIAQRGPQKTQPEPQARAPTDDIRETDTTPRHRGHLSSDARNDSDHKQITQQQKQNSHAQRTTDDNKPNHENTLYLQAADRTTNIEHTRPAPYS

SEQ ID NO: 906005 - protein, 380 aa, Homo sapiens
MLRACQLSGVTAAAQSCLCGKFVLRPLRPCRRYSTSGSSGLTTGKIAGAGLLFVGGGIGGTILYAKWDSHFRESVEKTIPYSDKLFEMVLGPAAYNVPLPKKSIQSGPLKISSVSEVMKESKQPASQLQKQKGDTPASATAGDTLSVPAPAVQPEESLKTDHPEIGEGKPTPALSEEASSSSIRERPPEEVAARLAQQEKQEQVKIESLAKSLEDALRQTASVTLQAIAAQNAAVQAVNAHSNILKAAMDNSEIAGEKKSAQWRTVEGALKERRKAVDEAADALLKAKEELEKMKSVIENAKKKEVAGAKPHITAAEGKLHNMIVDLDNVVKKVQAAQSEAKVVSQYHELVVQARDDFKRELDSITPEVLPGWKGMSEYN

SEQ ID NO: 906006 - protein, 194 aa, Homo sapiens
MLRACQLSGVTAAAQSCLCGKFVLRPLRPCRRYSTSGSSGLTTGKIAGAGLLFVGGGIGGTILYAKWDSHFRESVEKTIPYSDKLFEMVLGPAAYNVPLPKKSIQSGPLKISSVSEVMKESKQPASQLQKQKGDTPASATAGDTLSVPAPAVQPEESLKTDHPEIGEGKPTPALSGNLIISICSFIHDTLIRTI

SEQ ID NO: 906007 - protein, 141 aa, Homo sapiens
FRCAGRGRGHAHTQARLHLTRAAAAARVHQQRRPLDRDAAGLSVIGCDRRRPELSLWEVCPPSIATMPQILYFRQLWVDYWQNCWSWPFVCWWRYWWHYPICQMGFPFPGKCRENHTLLRQTLRDGSFITSDTLEIFSGPD

SEQ ID NO: 906008 - protein, 154 aa, Homo sapiens
AETGPKGSEDRVKAEISVYQYFLSYLQSLLLFLVSSIMATLRARFYAVQKLARRVAMIDETRNSLYQYFLSYLQLLQVGSSEQGLRGLKKEHDQSKRERRRRTSQWKNENTKKRRTSATRGTMQAPEIWMCKNGEDHVRLRRWTSEAESYDDGP

SEQ ID NO: 906009 - protein, 800 aa, Homo sapiens
NLLNVSLTGLSSTGPCALVPDTFCATARGQLESTSSAVRLTEMLRACQLSGVTAAAQSCLCGKFVLRPLRPCRRYSTSGSSGLTTGKIAGAGLLFVGGGIGGTILYAKWDSHFRESVEKTIPYSDKLFEMVLGPAAYNVPLPKKSIQSGPLKISSVSEVMKESKQPASQLQKQKGDTPASATAPTEAAQIISAAGDTLSVPAPAVQPEESLKTDHPEIGEGKPTPALSEEASSSSIRERPPEEVAARLAQQEKQEQVKIESLAKSLEDALRQTASVTLQAIAAQNAAVQAVNAHSNILKAAMDNSEIAGEKKSAQWRTVEGALKERRKAVDEAADALLKAKEELEKMKSVIENAKKKEVAGAKPHITAAEGKLHNMIVDLDNVVKKVQAAQSEAKVVSQYHELVVQARDDFKRELDSITPEVLPGWKGMSVSDLADKLSTDDLNSLIAHAHRRIDQLNRELAEQKATEKQHITLALEKQKLEEKRAFDSAVAKALEHHRSEIQAEQDRKIEEVRDAMENEMRTQLRRQAAAHTDHLRDVLRVQEQELKSEFEQNLSEKLSEQELQFRRLSQEQVDNFTLDINTAYARLRGIEQAVQSHAVAEEEARKAHQLWLSVEALKYSMKTSSAETPTIPLGSAVEAIKANCSDNEFTQALTAAIPPESLTRGVYSEETLRARFYAVQKLARRVAMIDETRNSLYQYFLSYLQSLLLFPPQQLKPPPELCPEDINTFKLLSYASYCIEHGDLELAAKFVNQLKGESRRVAQDWLKEARMTLETKQIVEILTAYASAVGIGTTQVQPE

SEQ ID NO: 906010 - protein, 499 aa, Homo sapiens
MDNSEIAGEKKSAQWRTVEGALKERRKAVDEAADALLKAKEELEKMKSVIENAKKKEVAGAKPHITAAEGKLHNMIVDLDNVVKKVQAAQSEAKVVSQYHELVVQARDDFKRELDSITPEVLPGWKGMSVSDLADKLSTDDLNSLIAHAHRRIDQLNRELAEQKATEKQHITLALEKQKLEEKRAFDSAVAKALEHHRSEIQAEQDRKIEEVRDAMENEMRTQLRRQAAAHTDHLRDVLRVQEQELKSEFEQNLSEKLSEQELQFRRLSQEQVDNFTLDINTAYARLRGIEQAVQSHAVAEEEARKAHQLWLSVEALKYSMKTSSAETPTIPLGSAVEAIKANCSDNEFTQALTAAIPPESLTRGVYSEETLRARFYAVQKLARRVAMIDETRNSLYQYFLSYLQSLLLFPPQQLKPPPELCPEDINTFKLLSYASYCIEHGDLELAAKFVNQLKGESRRVAQDWLKEARMTLETKQIVEILTAYASAVGIGTTQVQPE

SEQ ID NO: 906011 - protein, 731 aa, Homo sapiens
CVFLLQSCLCGKFVLRPLRPCRRYSTSGSSGLTTGKIAGAGLLFVGGGIGGTILYAKWDSHFRESVEKTIPYSDKLFEMVLGPAAYNVPLPKKSIQSGPLKISSVSEVMKESKQPASQLQKQKGDTPASATAPTEAAQIISAAGDTLSVPAPAVQPEESLKTDHPEIGEGKPTPALSEEASSSSIRERPPEEVAARLAQQVRQTASVTLQAIAAQNAAVQAVNAHSNILKAAMDNSEIAGEKKSAQWRTVEGALKERRKAVDEAADALLKAKEELEKMKSVIENAKKKEVAGAKPHITAAEGKLHNMIVDLDNVVKKVQAAQSEAKVVSQYHELVVQARDDFKRELDSITPEVLPGWKGMSVSDLADKLSTDDLNSLIAHAHRRIDQLNRELAEQKATEKQHITLALEKQKLEEKRAFDSAVAKALEHHRSEIQAEQDRKIEEVRDAMENEMRTQLRRQAAAHTDHLRDVLRVQEQELKSEFEQNLSEKLSEQELQFRRLSQEQVDNFTLDINTAYARLRGIEQAVQSHAVAEEEARKAHQLWLSVEALKYSMKTSSAETPTIPLGSAVEAIKANCSDNEFTQALTAAIPPESLTRGVYSEETLRARFYAVQKLARRVAMIDETRNSLYQYFLSYLQSLLLFPPQQLKPPPELCPEDINTFKLLSYASYCIEHGDLELAAKFVNQLKGESRRVAQDWLKEARMTLETKQIVEILTAYASAVGIGTTQVQPE

SEQ ID NO: 906012 - protein, 747 aa, Homo sapiens; identical to SEQ ID NO: 905998

SEQ ID NO: 906013 - protein, 608 aa, Homo sapiens
MLRACQLSGVTAAAQSCLCGKFVLRPLRPCRRYSTSGSSGLTTGKIAGAGLLFVGGGIGGTILYAKWDSHFRESVEKTIPYSDKLFEMVLGPAAYNVPLPKKSIQSGPLKISSVSEVMKESKQPASQLQKQKGDTPASATAGDTLSVPAPAVQPEESLKTDHPEIGEGKPTPALSEEASSSSIRERPPEEVAARLAQQEKQEQVKIESLAKSLEDALRQTASVTLQAIAAQNAAVQAVNAHSNILKAAMDNSEIAGEKKSAQWRTVEGALKERRKAVDEAADALLKAKEELEKMKSVIENAKKKEVAGAKPHITAAEGKLHNMIVDLDNVVKKVQAAQSEAKVVSQYHELVVQARDDFKRELDSITPEVLPGWKGMSVSDLADKLSTDDLNSLIAHAHRRIDQLNRELAEQKATEKQHITLALEKQKLEEKRAFDSAVAKALEHHRSEIQAEQDRKIEEVRDAMENEMRTQLRRQAAAHTDHLRDVLRVQEQELKSEFEQNLSEKLSEQELQFRRLSQEQVDNFTLDINTAYARLRGIEQAVQSHAVAEEEARKAHQLWLSVEALKYSMKTSSAETPTIPLGSAVEAIKANCSDNEFTQALTAARPVS

SEQ ID NO: 906014 - protein, 405 aa, Homo sapiens
MLRACQLSGVTAAAQSCLCGKFVLRPLRPCRRYSTSGSSGLTTGKIAGAGLLFVGGGIGGTILYAKWDSHFRESVEKTIPYSDKLFEMVLGPAAYNVPLPKKSIQSGPLKISSVSEVMKESKQPASQLQKQKGDTPASATAGDTLSVPAPAVQPEESLKTDHPEIGEGKPTPALSEEASSSSIRERPPEEVAARLAQQEKQEQVKIESLAKSLEDALRQTASVTLQAIAAQNAAVQAVNAHSNILKAAMDNSEIAGEKKSAQWRTVEGALKERRKAVDEAADALLKAKEELEKMKSVIENAKKKEVAGAKPHITAAEGKLHNMIVDLDNVVKKVCFLSLIVFYILKYNLLKDFKDLGKQQIPTISPSFLLQSVFVVTVLKNLPWLGVVVHTCNPSTLAGRGGQIT

SEQ ID NO: 906015 - protein, 120 aa, Homo sapiens
MLRACQLSGVTAAAQSCLCGKFVLRPLRPCRRYSTSGSSGLTTGKIAGAGLLFVGGGIGGTILYAKWDSHFRESVEKTIPYSDKLFEMVLGPAAYNVPLPKKSETLFMCIYESFCSGVEG

SEQ ID NO: 906016 - protein, 462 aa, Homo sapiens
MIQTVPDPAAHIKEALSVVSEDQSLFECAYGTPHLAKTEMTASSSSDYGQTSKMSPRVPQQDWLSQPPARVTIKMECNPSQVNGSRNSPDECSVAKGGKMVGSPDTVGMNYGSYMEEKHMPPPNMTTNERRVIVPADPTLWSTDHVRQWLEWAVKEYGLPDVNILLFQNIDGKELCKMTKDDFQRLTPSYNADILLSHLHYLRETPLPHLTSDDVDKALQNSPRLMHARNTDLPYEPPRRSAWTGHGHPTPQSKAAQPSPSTVPKTEDQRPQLDPYQILGPTSSRLANPGSGQIQLWQFLLELLSDSSNSSCITWEGTNGEFKMTDPDEVARRWGERKSKPNMNYDKLSRALRYYYDKNIMTKVHGKRYAYKFDFHGIAQALQPHPPESSLYKYPSDLPYMGSYHAHPQKMNFVAPHPPALPVTSSSFFAAPNPYWNSPTGGIYPNTRLPTSHMPSHLGTYY

SEQ ID NO: 906017 - protein, 363 aa, Homo sapiens
MVGSPDTVGMNYGSYMEEKHMPPPNMTTNERRVIVPADPTLWSTDHVRQWLEWAVKEYGLPDVNILLFQNIDGKELCKMTKDDFQRLTPSYNADILLSHLHYLRETPLPHLTSDDVDKALQNSPRLMHARNTDLPYEPPRRSAWTGHGHPTPQSKAAQPSPSTVPKTEDQRPQLDPYQILGPTSSRLANPGSGQIQLWQFLLELLSDSSNSSCITWEGTNGEFKMTDPDEVARRWGERKSKPNMNYDKLSRALRYYYDKNIMTKVHGKRYAYKFDFHGIAQALQPHPPESSLYKYPSDLPYMGSYHAHPQKMNFVAPHPPALPVTSSSFFAAPNPYWNSPTGGIYPNTRLPTSHMPSHLGTYY

SEQ ID NO: 906018 - protein, 455 aa, Homo sapiens
MASTIKEALSVVSEDQSLFECAYGTPHLAKTEMTASSSSDYGQTSKMSPRVPQQDWLSQPPARVTIKMECNPSQVNGSRNSPDECSVAKGGKMVGSPDTVGMNYGSYMEEKHMPPPNMTTNERRVIVPADPTLWSTDHVRQWLEWAVKEYGLPDVNILLFQNIDGKELCKMTKDDFQRLTPSYNADILLSHLHYLRETPLPHLTSDDVDKALQNSPRLMHARNTDLPYEPPRRSAWTGHGHPTPQSKAAQPSPSTVPKTEDQRPQLDPYQILGPTSSRLANPGSGQIQLWQFLLELLSDSSNSSCITWEGTNGEFKMTDPDEVARRWGERKSKPNMNYDKLSRALRYYYDKNIMTKVHGKRYAYKFDFHGIAQALQPHPPESSLYKYPSDLPYMGSYHAHPQKMNFVAPHPPALPVTSSSFFAAPNPYWNSPTGGIYPNTRLPTSHMPSHLGTYY

SEQ ID NO: 906019 - protein, 428 aa, Homo sapiens
MASTIKEALSVVSEDQSLFECAYGTPHLAKTEMTASSSSDYGQTSKMSPRVPQQDWLSQPPARVTIKMECNPSQVNGSRNSPDECSVAKGGKMVGSPDTVGMNYGSYMEEKHMPPPNMTTNERRVIVPADPTLWSTDHVRQWLEWAVKEYGLPDVNILLFQNIDGKELCKMTKDDFQRLTPSYNADILLSHLHYLRENLPYEPPRRSAWTGHGHPTPQSKAAQPSPSTVPKTEDQRPQLDPYQILGPTSSRLANPGSGQIQLWQFLLELLSDSSNSSCITWEGTNGEFKMTDPDEVARRWGERKSKPNMNYDKLSRALRYYYDKNIMTKVHGKRYAYKFDFHGIAQALQPHPPESSLYKYPSDLPYMGSYHAHPQKMNFVAPHPPALPVTSSSFFAAPNPYWNSPTGGIYPNTRLPTSHMPSHLGTYY

SEQ ID NO: 906020 - protein, 254 aa, Homo sapiens
MASTIKEALSVVSEDQSLFECAYGTPHLAKTEMTASSSSDYGQTSKMSPRVPQQDWLSQPPARVTIKMECNPSQVNGSRNSPDECSVAKGGKMVGSPDTVGMNYGSYMEEKHMPPPNMTTNERRVIVPADPTLWSTDHVRQWLEWAVKEYGLPDVNILLFQNIDGKELCKMTKDDFQRLTPSYNADILLSHLHYLRETPLPHLTSDDVDKALQNSPRLMHARNTGGAAFIFPNTSVYPEATQRITTRPDTKTPL

SEQ ID NO: 906021 - protein, 256 aa, Homo sapiens
MASTIKEALSVVSEDQSLFECAYGTPHLAKTEMTASSSSDYGQTSKMSPRVPQQDWLSQPPARVTIKMECNPSQVNGSRNSPDECSVAKGGKMVGSPDTVGMNYGSYMEEKHMPPPNMTTNERRVIVPADPTLWSTDHVRQWLEWAVKEYGLPDVNILLFQNIDGKELCKMTKDDFQRLTPSYNADILLSHLHYLRETPLPHLTSDDVDKALQNSPRLMHARNTDLPYEPPRRSAWTGHGHPTPQSKAVTSLHSAK

SEQ ID NO: 906022 - protein, 259 aa, Homo sapiens
PTSYPPQTGSYSQAPSQYSQQSSSYGQQNLPYEPPRRSAWTGHGHPTPQSKAAQPSPSTVPKTEDQRPQLDPYQILGPTSSRLANPGSGQIQLWQFLLELLSDSSNSSCITWEGTNGEFKMTDPDEVARRWGERKSKPNMNYDKLSRALRYYYDKNIMTKVHGKRYAYKFDFHGIAQALQPHPPESSLYKYPSDLPYMGSYHAHPQKMNFVAPHPPALPVTSSSFFAAPNPYWNSPTGGIYPNTRLPTSHMPSHLGTYY

SEQ ID NO: 906023 - protein, 425 aa, Homo sapiens
MASTIKEALSVVSEDQSLFECAYGTPHLAKTEMTASSSSDYGQTSKMSPRVPQQDWLSQPPARVTIKMECNPSQVNGSRNSPDECSVAKGGKMVGSPDTVGMNYGSYMEEKHMPPPNMTTNERRVIVPADPTLWSTDHVRQWLEWAVKEYGLPDVNILLFQNIDGKELCKMTKDDFQRLTPSYNADILLSHLHYLRETPLPHLTSDDVDKALQNSPRLMHARNTDLPYEPPRRSAWTGHGHPTPQSKAAQPSPSTVPKTEDQRPQLDPYQILGPTSSRLANPGSGQIQLWQFLLELLSDSSNSSCITWEGTNGEFKMTDPDEVARRWGERKSKPNMNYDKLSRALRYYYDKNIMTKYPSDLPYMGSYHAHPQKMNFVAPHPPALPVTSSSFFAAPNPYWNSPTGGIYPNTRLPTSHMPSHLGTYY

SEQ ID NO: 906024 - protein, 1247 aa, Homo sapiens [sequence omitted]

SEQ ID NO: 906025 - protein, 1247 aa, Homo sapiens [sequence omitted]

SEQ ID NO: 906026 - protein, 1094 aa, Homo sapiens
DCGSSQQEKYKKPSRYPDQKGKRNTFQAVLASSDSSSYAIFLYPEDGLQFHTTFSKKENNQVPAVVAFSQGSVGFLWKSNGAYNIFANDRESVENLAKSSNSGQQGVWVFEIGSPATTNGVVPADVILGTEDGAEYDDEDEDYDLATTRLGLEDVGTTPFSYKALRRGGADTYSVPSVLSPRRAATERPLGPPTERTRSFQLAVETFHQQHPQVIDVDEVEETGVVFSYNTDSRQTCANNRHQCSVHAECRDYATGFCCSCVAGYTGNGRQCVAEGSPQRVNGKVKGRIFVGSSQVPIVFENTDLHSYVVMNHGRSYTAISTIPETVGYSLLPLAPVGGIIGWMFAVEQDGFKNGFSITGGEFTRQAEVTFVGHPGNLVIKQRFSGIDEHGHLTIDTELEGRVPQIPFGSSVHIEPYTELYHYSTSVITSSSTREYTVTEPERDGASPSRIYTYQWRQTITFQECVHDDSRPALPSTQQLSVDSVFVLYNQEEKILRYALSNSIGPVREGSPDALQNPCYIGTHGCDTNAACRPGPRTQFTCECSIGFRGDGRTCYDIDECSEQPSVCGSHTICNNHPGTFRCECVEGYQFSDEGTCVAVVDQRPINYCETGLHNCDIPQRAQCIYTGGSSYTCSCLPGFSGDGQACQDVDECQPSRCHPDAFCYNTPGSFTCQCKPGYQGDGFRCVPGEVEKTRCQHEREHILGAAGATDPQRPIPPGLFVPECDAHGHYAPTQCHGSTGYCWCVDRDGREVEGTRTRPGMTPPCLSTVAPPIHQGPAVPTAVIPLPPGTHLLFAQTGKIERLPLEGNTMRKTEAKAFLHVPAKVIIGLAFDCVDKMVYWTDITEPSIGRASLHGGEPTTIIRQDLGSPEGIAVDHLGRNIFWTDSNLDRIEVAKLDGTQRRVLFETDLVNPRGIVTDSVRGNLYWTDWNRDNPKIETSYMDGTNRRILVQDDLGLPNGLTFDAFSSQLCWVDAGTNRAECLNPSQPSRRKALEGLQYPFAVTSYGKNLYFTDWKMNSVVALDLAISKETDAFQPHKQTRLYGITTALSQCPQGHNYCSVNNGGCTHLCLATPGSRTCRCPDNTLGVDCIERK

SEQ ID NO: 906027 - protein, 1247 aa, Homo sapiens [sequence omitted]

SEQ ID NO: 906028 - protein, 270 aa, Homo sapiens
MLASSSRIRAAWTRALLLPLLLAGPVGCLSRQELFPFGPGQGDLELEDGDDFVSPALELSGALRFYDRSDIDAVYVSEPREGGRGAAGRGGPGAPVEPDGLGRSRRGPGPAGRRGTGHGAGSPASAGSAKVFPTRSLLSEERVAGSGWLRAPRAVTPAPMDPAELPPRRLWAASPQGGQSASLGCPVPSGLGPGRSRVEPGSRAEPPQGKSRSWIAVCARAPGLLWLRESFAGSLLYLCVDSGCVLAVMLLSSWARFRVQSPERETQGSQ

SEQ ID NO: 906029 - protein, 50 aa, Homo sapiens
MYYSVDLIPCPTFKSFARRLYKLACSEIGYFPYGFNVDQHSGYINSRRVA

SEQ ID NO: 906030 - protein, 270 aa, Homo sapiens; identical to SEQ ID NO: 906028

SEQ ID NO: 906031 - protein, 1247 aa, Homo sapiens [sequence omitted]

SEQ ID NO: 906032 - protein, 1247 aa, Homo sapiens [sequence omitted]

SEQ ID NO: 906033 - protein, 1247 aa, Homo sapiens [sequence omitted]

SEQ ID NO: 906034 - protein, 113 aa, Homo sapiens
HQLWLTFCGRRKPARAPEDSLGSNVSVFTEGSPDALQNPCYIGTHGCDTNAACRPGPRTQFTCECSIGFRGDGRTCYGTAFDSDLLGLGNQARRRHPRSVNQRTGCSKEARMR

SEQ ID NO: 906035 - protein, 397 aa, Homo sapiens
HALTFASPLPADLGTTDVQKKKLVDAIVSGDTSKLMKILQPQDVDLALDSGASLLHLAVEAGQEECAKWLLLNNANPNLSNRRGSTPLHMAVERRVRGVVELLLARKISVNAKDEDQWTALHFAAQNGDESSTRLLLEKNASVNEVDFEGRTPMHVACQHGQENIVRILLRRGVDVSLQGKDAWLPLHYAAWQGHLPIVKLLAKQPGVSVNAQTLDGRTPLHLAAQRGHYRVARILIDLCSDVNVCSLLAQTPLHVAAETGHTSTARLLLHRGAGKEAVTSDGYTALHLAARNGHLATVKLLVEEKADVLARGPLNQTALHLAAAHGHSEVVEELVSADVIDLFDEQGLSALHLAAQGRHAQTVETLLRHGAHINLQSLKFQGGHGPAATLLRRSKT

SEQ ID NO: 906036 - protein, 707 aa, Homo sapiens
MEGDGGTPWALALLRTFDAGEFTGWEKVGSGGFGQVYKVRHVHWKTWLAIKCSPSLHVDDRERMELLEEAKKMEMAKFRYILPVYGICREPVGLVMEYMETGSLEKLLASEPLPWDLRFRIIHETAVGMNFLHCMAPPLLHLDLKPANILLDAHYHVKISDFGLAKCNGLSHSHDLSMDGLFGTIAYLPPERIREKSRLFDTKHDVYSFAIVIWGVLTQKKPFADEKNILHIMVKVVKGHRPELPPVCRARPRACSHLIRLMQRCWQGDPRVRPTFQEITSETEDLCEKPDDEVKETAHDLDVKSPPEPRSEVVPARLKRASAPTFDNDYSLSELLSQLDSGVSQAVEGPEELSRSSSESKLPSSGSGKRLSGVSSVDSAFSSRGSLSLSFEREPSTSDLGTTDVQKKKLVDAIVSGDTSKLMKILQPQDVDLALDSGASLLHLAVEAGQEECAKWLLLNNANPNLSNRRGSTPLHMAVERRVRGVVELLLARKISVNAKDEDQWTALHFAAQNGDESSTRLLLEKNASVNEVDFEGRTPMHVACQHGQENIVRILLRRGVDVSLQGKDAWLPLHYAAWQGHLPIVKLLAKQPGVSVNAQTLDGRTPLHLAAQRGHYRVARILIDLCSDVNVCSLLAQTPLHVAAETGHTSTARLLLHRGAGKEAVTSDGYTALHLAARNGHLATVKLLVEEKADLAQVHMPAPSSI

SEQ ID NO: 906037 - protein, 707 aa, Homo sapiens; identical to SEQ ID NO: 906036

SEQ ID NO: 906038 - protein, 717 aa, Homo sapiens [sequence omitted]

SEQ ID NO: 906039 - protein, 784 aa, Homo sapiens [sequence omitted]

SEQ ID NO: 906040 - protein, 109 aa, Homo sapiens
VEERYTTSIPCMTGPACRDQNDVIQARKAYDLQSDAIYKSDLEWLRGIGWVPIGSVEVEKVKRAGEILSDRKCRQPADQLKFTCITDTPEIVHVGPLGLPGELRLGRGV

SEQ ID NO: 906041 - protein, 572 aa, Homo sapiens
VEERYTTSIPCMTGPACRDQNDVIQARKAYDLQSDAIYKSDLEWLRGIGWVPIGSVEVEKVKRAGEILSDRKCRQPADQLKFTCITDTPEIVHVGPLGLPGELRLGRGVGEIPQLVGALRLYGTRVYAEVIIRVTCPLSSPQEITSETEDLCEKPDDEVKETAHDLDVKSPPEPRSEVVPARLKRASAPTFDNDYSLSELLSQLDSGVSQAVEGPEELSRSSSESKLPSSGSGKRLSGVSSVDSAFSSRGSLSLSFEREPSTSDLGTTDVQKKKLVDAIVSGDTSKLMKILQPQDVDLALDSGASLLHLAVEAGQEECAKWLLLNNANPNLSNRRGSTPLHMAVERRVRGVVELLLARKISVNAKDEDQWTALHFAAQNGDESSTRLLLEKNASVNEVDFEGRTPMHVACQHGQENIVRILLRRGVDVSLQGKDAWLPLHYAAWQGHLPIVKLLAKQPGVSVNAQTLDGRTPLHLAAQRGHYRVARILIDLCSDVNVCSLLAQTPLHVAAETGHTSTARLLLHRGAGKEAVTSDGYTALHLAARNGHLATVKLLVEEKADLAQVHMPAPSSI

SEQ ID NO: 906042 - protein, 106 aa, Homo sapiens
GATCWVSPQPPVHRSFSVLPPGLCPSTPSARCSGVGRTGWEGVVLRGGLWRNEDRALAAAMAFPCKKYFVIQNQYFGQAQWLMPVIPALWVAEVGGSFEVRSLRPA

SEQ ID NO: 906043 - protein, 639 aa, Homo sapiens
MEPAMEPETLEARINRATNPLNKELDWASINGFCEQLNEDFEGPPLATRLLAHKIQSPQEWEAIQALTVLETCMKSCGKRFHDEVGKFRFLNELIKVVSPKYLGSRTSEKVKNKILELLYSWTVGLPEEVKIAEAYQMLKKQGIVKSDPKLPDDTTFPLPPPRPKNVIFEDEEKSKMLARLLKSSHPEDLRAANKLIKEMVQEDQKRMEKISKRVNAIEEVNNNVKLLTEMVMSHSQGGAAAGSSEDLMKELYQRCERMRPTLFRLASDTEDNDEALAEILQANDNLTQVINLYKQLVRGEEVNGDATAGSIPGSTSALLDLSGLDLPPAGTTYPAMPTRPGEQASPEQPSASVSLLDDELMSLGLSDPTPPSGPSLDGTGWNSFQSSDATEPPAPALAQAPSMESRPPAQTSLPASSGLDDLDLLGKTLLQQSLPPESQQVRWEKQQPTPRLTLRDLQNKSSSCSSPSSSATSLLHTVSPEPPRPPQQPVPTELSLASITVPLESIKPSNILPVTVYDQHGFRILFHFARDPLPGRSDVLVVVVSMLSTAPQPIRNIVFQSAVPKVMKVKLQPPSGTELPAFNPIVHPSAITQVLLLANPQKEKVRLRYKLTFTMGDQTYNEMGDVDQFPPPETWGSL

SEQ ID NO: 906044 - protein, 639 aa, Homo sapiens; identical to SEQ ID NO: 906043

SEQ ID NO: 906045 - protein, 684 aa, Homo sapiens
GRGTGRPLLTPRPRPGRGGVLSRPLRPWSDGGPRPRRGPAVGAGAAHLSDPWAMTPGTANRATNPLNKELDWASINGFCEQLNEDFEGPPLATRLLAHKIQSPQEWEAIQALTVLETCMKSCGKRFHDEVGKFRFLNELIKVVSPKYLGSRTSEKVKNKILELLYSWTVGLPEEVKIAEAYQMLKKQGIVKSDPKLPDDTTFPLPPPRPKNVIFEDEEKSKMLARLLKSSHPEDLRAANKLIKEMVQEDQKRMEKISKRVNAIEEVNNNVKLLTEMVMSHSQGGAAAGSSEDLMKELYQRCERMRPTLFRLASDTEDNDEALAEILQANDNLTQVINLYKQLVRGEEVNGDATAGSIPGSTSALLDLSGLDLPPAGTTYPAMPTRPGEQASPEQPSASVSLLDDELMSLGLSDPTPPSGPSLDGTGWNSFQSSDATEPPAPALAQAPSMESRPPAQTSLPASSGLDDLDLLGKTLLQQSLPPESQQVRWEKQQPTPRLTLRDLQNKSSSCSSPSSSATSLLHTVSPEPPRPPQQPVPTELSLASITVPLESIKPSNILPVTVYDQHGFRILFHFARDPLPGRSDVLVVVVSMLSTAPQPIRNIVFQSAVPKVMKVKLQPPSGTELPAFNPIVHPSAITQVLLLANPQKEKVRLRYKLTFTMGDQTYNEMGDVDQFPPPETWGSL

SEQ ID NO: 906046 - protein, 566 aa, Homo sapiens
MKSCGKRFHDEVGKFRFLNELIKVVSPKYLGSRTSEKVKNKILELLYSWTVGLPEEVKIAEAYQMLKKQGIVKSDPKLPDDTTFPLPPPRPKNVIFEDEEKSKMLARLLKSSHPEDLRAANKLIKEMVQEDQKRMEKISKRVNAIEEVNNNVKLLTEMVMSHSQGGAAAGSSEDLMKELYQRCERMRPTLFRLASDTEDNDEALAEILQANDNLTQVINLYKQLVRGEEVNGDATAGSIPGSTSALLDLSGLDLPPAGTTYPAMPTRPGEQASPEQPSASVSLLDDELMSLGLSDPTPPSGPSLDGTGWNSFQSSDATEPPAPALAQAPSMESRPPAQTSLPASSGLDDLDLLGKTLLQQSLPPESQQVRWEKQQPTPRLTLRDLQNKSSSCSSPSSSATSLLHTVSPEPPRPPQQPVPTELSLASITVPLESIKPSNILPVTVYDQHGFRILFHFARDPLPGRSDVLVVVVSMLSTAPQPIRNIVFQSAVPKVMKVKLQPPSGTELPAFNPIVHPSAITQVLLLANPQKEKVRLRYKLTFTMGDQTYNEMGDVDQFPPPETWGSL

SEQ ID NO: 906047 - protein, 552 aa, Homo sapiens
MEPAMEPETLEARINRATNPLNKELDWASINGFCEQLNEDFEGPPLATRLLAHKIQSPQEWEAIQALTVLETCMKSCGKRFHDEVGKFRFLNELIKVVSPKYLGSRTSEKVKNKILELLYSWTVGLPEEVKIAEAYQMLKKQGIVKSDPKLPDDTTFPLPPPRPKNVIFEDEEKSKMLARLLKSSHPEDLRAANKLIKEMVQEDQKRMEKISKRVNAIEEVNNNVKLLTEMVMSHSQGGAAAGSSEDLMKELYQRCERMRPTLFRLASDTEDNDEALGLSDPTPPSGPSLDGTGWNSFQSSDATEPPAPALAQAPSMESRPPAQTSLPASSGLDDLDLLGKTLLQQSLPPESQQVRWEKQQPTPRLTLRDLQNKSSSCSSPSSSATSLLHTVSPEPPRPPQQPVPTELSLASITVPLESIKPSNILPVTVYDQHGFRILFHFARDPLPGRSDVLVVVVSMLSTAPQPIRNIVFQSAVPKVMKVKLQPPSGTELPAFNPIVHPSAITQVLLLANPQKEKVRLRYKLTFTMGDQTYNEMGDVDQFPPPETWGSL

SEQ ID NO: 906048 - protein, 425 aa, Homo sapiens
MEPAMEPETLEARINRATNPLNKELDWASINGFCEQLNEDFEGPPLATRLLAHKIQSPQEWEAIQALTVLETCMKSCGKRFHDEVGKFRFLNELIKVVSPKYLGSRTSEKVKNKILELLYSWTVGLPEEVKIAEAYQMLKKQGIVKSDPKLPDDTTFPLPPPRPKNVIFEDEEKSKMLARLLKSSHPEDLRAANKLIKEMVQEDQKRMEKISKRVNAIEEVNNNVKLLTEMVMSHSQGGAAAGSSEDLMKELYQRCERMRPTLFRLASDTEDNDEALAEILQANDNLTQVINLYKQLVRGEEVNGDATAGSIPGSTSALLDLSGLDLPPAGTTYPAMPTRPGEQASPEQPSASVSLLDDELMSLGLSDPTPPSGPSLDGTGWNSFQSSDATEPPAPALAQAPSMESRPPAQPSATSCSSQLSPRL

SEQ ID NO: 906049 - protein, 417 aa, Homo sapiens
PAVSDLEDPFGLHSGLGAAAGSSEDLMKELYQRCERMRPTLFRLASDTEDNDEALAEILQANDNLTQVINLYKQLVRGEEVNGDATAGSIPGSTSALLDLSGLDLPPAGTTYPAMPTRPGEQASPEQPSASVSLLDDELMSLGLSDPTPPSGPSLDGTGWNSFQSSDATEPPAPALAQAPSMESRPPAQTSLPASSGLDDLDLLGKTLLQQSLPPESQQVRWEKQQPTPRLTLRDLQNKSSSCSSPSSSATSLLHTVSPEPPRPPQQPVPTELSLASITVPLESIKPSNILPVTVYDQHGFRILFHFARDPLPGRSDVLVVVVSMLSTAPQPIRNIVFQSAVPKVMKVKLQPPSGTELPAFNPIVHPSAITQVLLLANPQKEKVRLRYKLTFTMGDQTYNEMGDVDQFPPPETWGSL

SEQ ID NO: 906050 - protein, 236 aa, Homo sapiens
MESRPPAQTSLPASSGLDDLDLLGKTLLQQSLPPESQQVRWEKQQPTPRLTLRDLQNKSSSCSSPSSSATSLLHTVSPEPPRPPQQPVPTELSLASITVPLESIKPSNILPVTVYDQHGFRILFHFARDPLPGRSDVLVVVVSMLSTAPQPIRNIVFQSAVPKVMKVKLQPPSGTELPAFNPIVHPSAITQVLLLANPQKEKVRLRYKLTFTMGDQTYNEMGDVDQFPPPETWGSL

SEQ ID NO: 906051 - protein, 219 aa, Homo sapiens
VGITGVSYHAGQESLLNALSPRLREKQQPTPRLTLRDLQNKSSSCSSPSSSATSLLHTVSPEPPRPPQQPVPTELSLASITVPLESIKPSNILPVTVYDQHGFRILFHFARDPLPGRSDVLVVVVSMLSTAPQPIRNIVFQSAVPKVMKVKLQPPSGTELPAFNPIVHPSAITQVLLLANPQKEKVRLRYKLTFTMGDQTYNEMGDVDQFPPPETWGSL

SEQ ID NO: 906052 - protein, 444 aa, Homo sapiens
MEPAMEPETLEARINRATNPLNKELDWASINGFCEQLNEDFEGPPLATRLLAHKIQSPQEWEAIQALTVLETCMKSCGKRFHDEVGKFRFLNELIKVVSPKYLGSRTSEKVKNKILELLYSWTVGLPEEVKIAEAYQMLKKQGIVKSDPKLPDDTTFPLPPPRPKNVIFEDEEKSKMLARLLKSSHPEDLRAANKLIKEMVQEDQKRMEKISKRVNAIEEVNNNVKLLTEMVMSHSQGGAAAGSSEDLMKELYQRCERMRPTLFRLASDTEDNDEALAEILQANDNLTQVINLYKQLVRGEEVNGDATAGSIPGSTSALLDLSGLDLPPAGTTYPAMPTRPGEQASPEQPSASVSLLDDELMSLGLSDPTPPSGPSLDGTGWNSFQSSDATEPPAPALAQAPSMESRPPAQTSLPASSGLDDLDLLGKTLLQQSLPPESQQVRW

SEQ ID NO: 906053 - protein, 303 aa, Homo sapiens
MEPAMEPETLEARINRATNPLNKELDWASINGFCEQLNEDFEGPPLATRLLAHKIQSPQEWEAIQALTVLETCMKSCGKRFHDEVGKFRFLNELIKVVSPKYLGSRTSEKVKNKILELLYSWTVGLPEEVKIAEAYQMLKKQGIVKSDPKLPDDTTFPLPPPRPKNVIFEDEEKSKMLARLLKSSHPEDLRAANKLIKEMVQEDQKRMEKISKRVNAIEEVNNNVKLLTEMVMSHSQGGAAAGSSEDLMKELYQRCERMRPTLFRLASDTEDNDEALGEPRAGAEVRSPPLPPPPAPTSPRPC

SEQ ID NO: 906054 - protein, 69 aa, Homo sapiens
PQSFSLASPLLPVPAEILQANDNLTQVINLYKQLVRGEEVNGDATAGSIPGEEVAGELGGHPSGWRGTE

SEQ ID NO: 906055 - protein, 146 aa, Homo sapiens
GRGTGRPLLTPRPRPGRGGVLSRPLRPWSDGGPRPRRGPAVGAGAAHLSDPWAMTPGTASELRREPPGRREQPPTPKAHIASRSSGPGKEHASGSPGLHLTPGREGPYYFQAPNPPLSGPAWRSWSPQVVTFAHYPVLEGRTHCPI

SEQ ID NO: 906056 - protein, 146 aa, Homo sapiens; identical to SEQ ID NO: 906055

SEQ ID NO: 906057 - protein, 775 aa, Homo sapiens
MKELYQRCERMRPTLFRLASDTEDNDEALAETLQANDKLTQVINLYKQLVRGGGGQPGDATAGLHPLGAPRACCISSVPWISRLLGTPTQLCPTCLASRPALSSPVPQFPWLDDELMSLGLSDPKSPFRPKPGLYRMEPAMEPETLEARINRATNPLNKELDWASINGFCEQLNEDFEGPPLATRLLAHKIQSPQEWEAIQALTVLETCMKSCGKRFHDEVGKFRFLNELIKVVSPKYLGSRTSEKVKNKILELLYSWTVGLPEEVKIAEAYQMLKKQGIVKSDPKLPDDTTFPLPPPRPKNVIFEDEEKSKMLARLLKSSHPEDLRAANKLIKEMVQEDQKRMEKISKRVNAIEEVNNNVKLLTEMVMSHSQGGAAAGSSEDLMKELYQRCERMRPTLFRLASDTEDNDEALAEILQANDNLTQVINLYKQLVRGEEVNGDATAGSIPGSTSALLDLSGLDLPPAGTTYPAMPTRPGEQASPEQPSASVSLLDDELMSLGLSDPTPPSGPSLDGTGWNSFQSSDATEPPAPALAQAPSMESRPPAQTSLPASSGLDDLDLLGKTLLQQSLPPESQQVRWEKQQPTPRLTLRDLQNKSSSCSSPSSSATSLLHTVSPEPPRPPQQPVPTELSLASITVPLESIKPSNILPVTVYDQHGFRILFHFARDPLPGRSDVLVVVVSMLSTAPQPIRNIVFQSAVPKVMKVKLQPPSGTELPAFNPIVHPSAITQVLLLANPQKEKVRLRYKLTFTMGDQTYNEMGDVDQFPPPETWGSL

SEQ ID NO: 906058 - protein, 644 aa, Homo sapiens
MARYEAGFKFGARLWQARINRATNPLNKELDWASINGFCEQLNEDFEGPPLATRLLAHKIQSPQEWEAIQALTVLETCMKSCGKRFHDEVGKFRFLNELIKVVSPKYLGSRTSEKVKNKILELLYSWTVGLPEEVKIAEAYQMLKKQGIVKSDPKLPDDTTFPLPPPRPKNVIFEDEEKSKMLARLLKSSHPEDLRAANKLIKEMVQEDQKRMEKISKRVNAIEEVNNNVKLLTEMVMSHSQGGAAAGSSEDLMKELYQRCERMRPTLFRLASDTEDNDEALAEILQANDNLTQVINLYKQLVRGEEVNGDATAGSIPGSTSALLDLSGLDLPPAGTTYPAMPTRPGEQASPEQPSASVSLLDDELMSLGLSDPTPPSGPSLDGTGWNSFQSSDATEPPAPALAQAPSMESRPPAQTSLPASSGLDDLDLLGKTLLQQSLPPESQQVRWEKQQPTPRLTLRDLQNKSSSCSSPSSSATSLLHTVSPEPPRPPQQPVPTELSLASITVPLESIKPSNILPVTVYDQHGFRILFHFARDPLPGRSDVLVVVVSMLSTAPQPIRNIVFQSAVPKVMKVKLQPPSGTELPAFNPIVHPSAITQVLLLANPQKEKVRLRYKLTFTMGDQTYNEMGDVDQFPPPETWGSL

SEQ ID NO: 906059 - protein, 566 aa, Homo sapiens; identical to SEQ ID NO: 906046

SEQ ID NO: 906060 - protein, 587 aa, Homo sapiens
MEPAMEPETLEARINRATNPLNKELDWASINGFCEQLNEDFEGPPLATRLLAHKIQSPQEWEAIQALTVLETCMKSCGKRFHDEVGKFRFLNELIKVVSPKYLGSRTSEKVKNKILELLYSWTVGLPEEVKIAEAYQMLKKQGIVKSDPKLPDDTTFPLPPPRPKNVIFEDEEKSKMLARLLKSSHPEDLRAANKLIKEMVQEDQKRMEKISKRVNAIEEVNNNVKLLTEMVMSHSQGGAAAGSSEDLMKELYQRCERMRPTLFRLASDTEDNDEALAEILQANDNLTQVINLYKQLVRGEEVNGDATAGSIPGSTSALLDLSGLDLPPAGTTYSSDATEPPAPALAQAPSMESRPPAQTSLPASSGLDDLDLLGKTLLQQSLPPESQQVRWEKQQPTPRLTLRDLQNKSSSCSSPSSSATSLLHTVSPEPPRPPQQPVPTELSLASITVPLESIKPSNILPVTVYDQHGFRILFHFARDPLPGRSDVLVVVVSMLSTAPQPIRNIVFQSAVPKVMKVKLQPPSGTELPAFNPIVHPSAITQVLLLANPQKEKVRLRYKLTFTMGDQTYNEMGDVDQFPPPETWGSL

SEQ ID NO: 906061 - protein, 236 aa, Homo sapiens; identical to SEQ ID NO: 906050

SEQ ID NO: 906062 - protein, 270 aa, Homo sapiens
MARYRGSETGWYRMEQLSSDATEPPAPALAQAPSMESRPPAQTSLPASSGLDDLDLLGKTLLQQSLPPESQQVRWEKQQPTPRLTLRDLQNKSSSCSSPSSSATSLLHTVSPEPPRPPQQPVPTELSLASITVPLESIKPSNILPVTVYDQHGFRILFHFARDPLPGRSDVLVVVVSMLSTAPQPIRNIVFQSAVPKVMKVKLQPPSGTELPAFNPIVHPSAITQVLLLANPQKEKVRLRYKLTFTMGDQTYNEMGDVDQFPPPETWGSL

SEQ ID NO: 906063 - protein, 464 aa, Homo sapiens
MEPAMEPETLEARINRATNPLNKELDWASINGFCEQLNEDFEGPPLATRLLAHKIQSPQEWEAIQALTVLETCMKSCGKRFHDEVGKFRFLNELIKVVSPKYLGSRTSEKVKNKILELLYSWTVGLPEEVKIAEAYQMLKKQGIVKSDPKLPDDTTFPLPPPRPKNVIFEDEEKSKMLARLLKSSHPEDLRAANKLIKEMVQEDQKRMEKISKRVNAIEEVNNNVKLLTEMVMSHSQGGAAAGSSEDLMKELYQRCERMRPTLFRLASDTEDNDEALAEILQANDNLTQVINLYKQLVRGEEVNGDATAGSIPGSTSALLDLSGLDLPPAGTTYPAMPTRPGEQASPEQPSASVSLLDDELMSLGLSDPTPPSGPSLDGTGWNSFQSSDATEPPAPALAQAPSMESRPPAQTSLPASSGLDDLDLLGKTLLQQSLPPESQQVRWENAASKTHTTGITSPGASST

SEQ ID NO: 906064 - protein, 146 aa, Homo sapiens; identical to SEQ ID NO: 906055

SEQ ID NO: 906065 - protein, 1013 aa, Homo sapiens
MGDKKDDKDSPKKNKGKERRDLDDLKKEVAMTEHKMSVEEVCRKYNTDCVQGLTHSKAQEILARDGPNALTPPPTTPEWVKFCRQLFGGFSILLWIGAILCFLAYGIQAGTEDDPSGDNLYLGIVLAAVVIITGCFSYYQEAKSSKIMESFKNMVPQQALVIREGEKMQVNAEEVVVGDLVEIKGGDRVPADLRIISAHGCKVDNSSLTGESEPQTRSPDCTHDNPLETRNITFFSTNCVEGTARGVVVATGDRTVMGRIATLASGLEVGKTPIAIEIEHFIQLITGVAVFLGVSFFILSLILGYTWLEAVIFLIGIIVANVPEGLLATVTVCLTLTAKRMARKNCLVKNLEAVETLGSTSTICSDKTGTLTQNRMTVAHMWFDNQIHEADTTEDQSGTSFDKSSHTWVALSHIAGLCNRAVFKGGQDNIPVLKRDVAGDASESALLKCIELSSGSVKLMRERNKKVAEIPFNSTNKYQLSIHETEDPNDNRYLLVMKGAPERILDRCSTILLQGKEQPLDEEMKEAFQNAYLELGGLGERVLGFCHYYLPEEQFPKGFAFDCDDVNFTTDNLCFVGLMSMIDPPRAAVPDAVGKCRSAGIKVIMVTGDHPITAKAIAKGVGIISEGNETVEDIAARLNIPVSQVNPRDAKACVIHGTDLKDFTSEQIDEILQNHTEIVFARTSPQQKLIIVEGCQRQGAIVAVTGDGVNDSPALKKADIGVAMGIAGSDVSKQAADMILLDDNFASIVTGVEEGRLIFDNLKKSIAYTLTSNIPEITPFLLFIMANIPLPLGTITILCIDLGTDMVPAISLAYEAAESDIMKRQPRNPRTDKLVNERLISMAYGQIGMIQALGGFFSYFVILAENGFLPGNLVGIRLNWDDRTVNDLEDSYGQQWTYEQRKVVEFTCHTAFFVSIVVVQWADLIICKTRRNSVFQQGMKNKILIFGLFEETALAAFLSYCPGMDVALRMYPLKPSWWFCAFPYSFLIFVYDEIRKLILRRNPGGWVEKETYY

SEQ ID NO: 906066 - protein, 983 aa, Homo sapiens
MTEHKMSVEEVCRKYNTDCVQGLTHSKAQEILARDGPNALTPPPTTPEWVKFCRQLFGGFSILLWIGAILCFLAYGIQAGTEDDPSGDNLYLGIVLAAVVIITGCFSYYQEAKSSKIMESFKNMVPQQALVIREGEKMQVNAEEVVVGDLVEIKGGDRVPADLRIISAHGCKVDNSSLTGESEPQTRSPDCTHDNPLETRNITFFSTNCVEGTARGVVVATGDRTVMGRIATLASGLEVGKTPIAIEIEHFIQLITGVAVFLGVSFFILSLILGYTWLEAVIFLIGIIVANVPEGLLATVTVCLTLTAKRMARKNCLVKNLEAVETLGSTSTICSDKTGTLTQNRMTVAHMWFDNQIHEADTTEDQSGTSFDKSSHTWVALSHIAGLCNRAVFKGGQDNIPVLKRDVAGDASESALLKCIELSSGSVKLMRERNKKVAEIPFNSTNKYQLSIHETEDPNDNRYLLVMKGAPERILDRCSTILLQGKEQPLDEEMKEAFQNAYLELGGLGERVLGFCHYYLPEEQFPKGFAFDCDDVNFTTDNLCFVGLMSMIDPPRAAVPDAVGKCRSAGIKVIMVTGDHPITAKAIAKGVGIISEGNETVEDIAARLNIPVSQVNPRDAKACVIHGTDLKDFTSEQIDEILQNHTEIVFARTSPQQKLIIVEGCQRQGAIVAVTGDGVNDSPALKKADIGVAMGIAGSDVSKQAADMILLDDNFASIVTGVEEGRLIFDNLKKSIAYTLTSNIPEITPFLLFIMANIPLPLGTITILCIDLGTDMVPAISLAYEAAESDIMKRQPRNPRTDKLVNERLISMAYGQIGMIQALGGFFSYFVILAENGFLPGNLVGIRLNWDDRTVNDLEDSYGQQWTYEQRKVVEFTCHTAFFVSIVVVQWADLIICKTRRNSVFQQGMKNKILIFGLFEETALAAFLSYCPGMDVALRMYPLKPSWWFCAFPYSFLIFVYDEIRKLILRRNPGGWVEKETYY

SEQ ID NO: 906067 - protein, 895 aa, Homo sapiens
HWGAHRWVESNPTVGFGFSYYQEAKSSKIMESFKNMVPQQALVIREGEKMQVNAEEVVVGDLVEIKGGDRVPADLRIISAHGCKVDNSSLTGESEPQTRSPDCTHDNPLETRNITFFSTNCVEGTARGVVVATGDRTVMGRIATLASGLEVGKTPIAIEIEHFIQLITGVAVFLGVSFFILSLILGYTWLEAVIFLIGIIVANVPEGLLATVTVCLTLTAKRMARKNCLVKNLEAVETLGSTSTICSDKTGTLTQNRMTVAHMWFDNQIHEADTTEDQSGTSFDKSSHTWVALSHIAGLCNRAVFKGGQDNIPVLKRDVAGDASESALLKCIELSSGSVKLMRERNKKVAEIPFNSTNKYQLSIHETEDPNDNRYLLVMKGAPERILDRCSTILLQGKEQPLDEEMKEAFQNAYLELGGLGERVLGFCHYYLPEEQFPKGFAFDCDDVNFTTDNLCFVGLMSMIDPPRAAVPDAVGKCRSAGIKVIMVTGDHPITAKAIAKGVGIISEGNETVEDIAARLNIPVSQVNPRDAKACVIHGTDLKDFTSEQIDEILQNHTEIVFARTSPQQKLIIVEGCQRQGAIVAVTGDGVNDSPALKKADIGVAMGIAGSDVSKQAADMILLDDNFASIVTGVEEGRLIFDNLKKSIAYTLTSNIPEITPFLLFIMANIPLPLGTITILCIDLGTDMVPAISLAYEAAESDIMKRQPRNPRTDKLVNERLISMAYGQIGMIQALGGFFSYFVILAENGFLPGNLVGIRLNWDDRTVNDLEDSYGQQWTYEQRKVVEFTCHTAFFVSIVVVQWADLIICKTRRNSVFQQGMKNKILIFGLFEETALAAFLSYCPGMDVALRMYPLKPSWWFCAFPYSFLIFVYDEIRKLILRRNPGGWVEKETYY

SEQ ID NO: 906068 - protein, 916 aa, Homo sapiens
MGDKKDDKDSPKKNKGKERRDLDDLKKEVAMTEHKMSVEEVCRKYNTDCVQGLTHSKAQEILARDGPNALTPPPTTPEWVKFCRQLFGGFSILLWIGAILCFLAYGIQAGTEDDPSGDNLYLGIVLAAVVIITGCFSYYQEAKSSKIMESFKNMVPQQALVIREGEKMQVNAEEVVVGDLVEIKGGDRVPADLRIISAHGCKVDNSSLTGESEPQTRSPDCTHDNPLETRNITFFSTNCVEGTARGVVVATGDRTVMGRIATLASGLEVGKTPIAIEIEHFIQLITGVAVFLGVSFFILSLILGYTWLEAVIFLIGIIVANVPEGLLATVTVCLTLTAKRMARKNCLVKNLEAVETLGSTSTICSDKTGTLTQNRMTVAHMWFDNQIHEADTTEDQSGTSFDKSSHTWVALSHIAGLCNRAVFKGGQDNIPVLKRDVAGDASESALLKCIELSSGSVKLMRERNKKVAEIPFNSTNKYQLSIHETEDPNDNRYLLVMKGAPERILDRCSTILLQGKEQPLDEEMKEAFQNAYLELGGLGERVLGFCHYYLPEEQFPKGFAFDCDDVNFTTDNLCFVGLMSMIDPPRAAVPDAVGKCRSAGIKVIMVTGDHPITAKAIAKGVGIISEGNETVEDIAARLNIPVSQVNPRDAKACVIHGTDLKDFTSEQIDEILQNHTEIVFARTSPQQKLIIVEGCQRQGAIVAVTGDGVNDSPALKKADIGVAMGIAGSDVSKQAADMILLDDNFASIVTGVEEGRLIFDNLKKSIAYTLTSNIPEITPFLLFIMANIPLPAQLVVLCLPLQFPHLRLRRNPQTHPAQEPRGLGGEGNLLLTSAPPHRPYFVFWGEEPSLPVAPPWPPPPPLSPAAPTLAGFSPLPQTSLLSLFCVSFSPSPHPSIHSSRPSHLPGLFFTPLQPPG

SEQ ID NO: 906069 - protein, 334 aa, Homo sapiens
MEEARHRLLIVSDAGGRLAAISDWGVGDGVNDSPALKKADIGVAMGIAGSDVSKQAADMILLDDNFASIVTGVEEGRLIFDNLKKSIAYTLTSNIPEITPFLLFIMANIPLPLGTITILCIDLGTDMVPAISLAYEAAESDIMKRQPRNPRTDKLVNERLISMAYGQIGMIQALGGFFSYFVILAENGFLPGNLVGIRLNWDDRTVNDLEDSYGQQWTYEQRKVVEFTCHTAFFVSIVVVQWADLIICKTRRNSVFQQGMKNKILIFGLFEETALAAFLSYCPGMDVALRMYPLKPSWWFCAFPYSFLIFVYDEIRKLILRRNPGGWVEKETYY

SEQ ID NO: 906070 - protein, 1107 aa, Homo sapiens
MGDKKDDKDSPKKNKGKERRDLDDLKKEVAMTEHKMSVEEVCRKYNTDCVQGLTHSKAQEILARDGPNALTPPPTTPEWVKFCRQLFGGFSILLWIGAILCFLAYGIQAGTEDDPSGDNLYLGIVLAAVVIITGCFSYYQEAKSSKIMESFKNMVPQQALVIREGEKMQVNAEEVVVGDLVEIKGGDRVPADLRIISAHGCKVDNSSLTGESEPQTRSPDCTHDNPLETRNITFFSTNCVEGTARGVVVATGDRTVMGRIATLASGLEVGKTPIAIEIEHFIQLITGVAVFLGVSFFILSLILGYTWLEAVIFLIGIIVANVPEGLLATVTVCLTLTAKRMARKNCLVKNLEAVETLGSTSTICSDKTGTLTQNRMTVAHMWFDNQIHEADTTEDQSGTSFDKSSHTWVALSHIAGLCNRAVFKGGQDNIPVLKRDVAGDASESALLKCIELSSGSVKLMRERNKKVAEIPFNSTNKYQLSIHETEDPNDNRYLLVMKGAPERILDRCSTILLQGKEQPLDEEMKEAFQNAYLELGGLGERVLGFCHYYLPEEQFPKGFAFDCDDVNFTTDNLCFVGLMSMIDPPRAAVPDAVGKCRSAGIKVIMVTGDHPITAKAIAKGVGIISEGNETVEDIAARLNIPVSQVNPRDAKACVIHGTDLKDFTSEQIDEILQNHTEIVFARTSPQQKLIIVEGCQRQGAIVAVTGDGVNDSPALKKADIGVAMGIAGSDVSKQAADMILLDDNFASIVTGVEEGRLIFDNLKKSIAYTLTSNIPEITPFLLFIMANIPLPLGTITILCIDLGTDMVPAISLAYEAAESDIMKRQPRNPRTDKLVNERLISMAYGQIGMIQALGGFFSYFVILAENGFLPGNLVGIRLNWDDRTVNDLEDSYGQQWTYEQRKVVEFTCHTAFFVSIVVVQWADLIICKTRRNSVFQQGMKNKILIFGLFEETALAAFLSYCPGMDVALRMYPLKPSWWFCAFPYSFLIFVYDEIRKLILRRNPGGEGARQGSRGGRGAAGSQAAGPRLPSPCWMALPPGSHSSLSSHLSGHPLCLLTGLCCVVSLSLSLSVPLSAGRLALPVSLHLLLCLFLSFFVSPGWVEKETYY

SEQ ID NO: 906071 - protein, 930 aa, Homo sapiens
MYDGVASLLMLCERGRCCTLAYGIQAGTEDDPSGDNLYLGIVLAAVVIITGCFSYYQEAKSSKIMESFKNMVPQQALVIREGEKMQVNAEEVVVGDLVEIKGGDRVPADLRIISAHGCKVDNSSLTGESEPQTRSPDCTHDNPLETRNITFFSTNCVEGTARGVVVATGDRTVMGRIATLASGLEVGKTPIAIEIEHFIQLITGVAVFLGVSFFILSLILGYTWLEAVIFLIGIIVANVPEGLLATVTVCLTLTAKRMARKNCLVKNLEAVETLGSTSTICSDKTGTLTQNRMTVAHMWFDNQIHEADTTEDQSGTSFDKSSHTWVALSHIAGLCNRAVFKGGQDNIPVLKRDVAGDASESALLKCIELSSGSVKLMRERNKKVAEIPFNSTNKYQLSIHETEDPNDNRYLLVMKGAPERILDRCSTILLQGKEQPLDEEMKEAFQNAYLELGGLGERVLGFCHYYLPEEQFPKGFAFDCDDVNFTTDNLCFVGLMSMIDPPRAAVPDAVGKCRSAGIKVIMVTGDHPITAKAIAKGVGIISEGNETVEDIAARLNIPVSQVNPRDAKACVIHGTDLKDFTSEQIDEILQNHTEIVFARTSPQQKLIIVEGCQRQGAIVAVTGDGVNDSPALKKADIGVAMGIAGSDVSKQAADMILLDDNFASIVTGVEEGRLIFDNLKKSIAYTLTSNIPEITPFLLFIMANIPLPLGTITILCIDLGTDMVPAISLAYEAAESDIMKRQPRNPRTDKLVNERLISMAYGQIGMIQALGGFFSYFVILAENGFLPGNLVGIRLNWDDRTVNDLEDSYGQQWTYEQRKVVEFTCHTAFFVSIVVVQWADLIICKTRRNSVFQQGMKNKILIFGLFEETALAAFLSYCPGMDVALRMYPLKPSWWFCAFPYSFLIFVYDEIRKLILRRNPGGWVEKETYY

SEQ ID NO: 906072 - protein, 427 aa, Homo sapiens
MGDKKDDKDSPKKNKGKERRDLDDLKKEVAMTEHKMSVEEVCRKYNTDCVQGLTHSKAQEILARDGPNALTPPPTTPEWVKFCRQLFGGFSILLWIGAILCFLAYGIQAGTEDDPSGDNLYLGIVLAAVVIITGCFSYYQEAKSSKIMESFKNMVPQQALVIREGEKMQVNAEEVVVGDLVEIKGGDRVPADLRIISAHGCKVDNSSLTGESEPQTRSPDCTHDNPLETRNITFFSTNCVEGTARGVVVATGDRTVMGRIATLASGLEVGKTPIAIEIEHFIQLITGVAVFLGVSFFILSLILGYTWLEAVIFLIGIIVANVPEGLLATVTVCLTLTAKRMARKNCLVKNLEAVETLGSTSTICSDKTGTLTQNRMTVAHMWFDNQIHEADTTEDQSGLIAEFWHLGACSIVGSERALHGAGHRGQG

SEQ ID NO: 906073 - protein, 1687 aa, Homo sapiens
MTSSSPAGLEGSDLSSINTMMSAVMSVGKVTENGGSPQGIKSPSKPPGPNRIGRRNQETKEEKSSYNCPLCEKICTTQHQLTMHIRQHNTDTGGADHSCSICGKSLSSASSLDRHMLVHSGERPYKCTVCGQSFTTNGNMHRHMKIHEKDPNSATATAPPSPLKLVGDMSSKRKLSHDAESEREDPAPAKKMVEDGQSGDLEKKADEVFHCPVCFKEFVCKYGLETHMETHSDNPLRCDICCVTFRTHRGLLRHNALVHKQLPRDAMGRPFIQNNPSIPAGFHDLGFTDFSCRKFPRISQAWCETNLRRCISEQHRFVCDTCDKAFPMLCSLALHKQTHVAADQGQEKPQATPLPGDALDQKGFLALLGLQHTKDVRPAPAEEPLPDDNQAIQLQTLKCQLPQDPGCTNLLSLSPFEAASLGGSLTVLPATKDSIKHLSLQPFQKGFIIQPDSSIVVKPISGESAIELADIQQILKMAASAPPQISLPPFSKAPAAPLQAIFKHMPPLKPKPLVTPRTVVATSTPPPLINAQQASPGCISPSLPPPPLKLLKGSVEAASNAHLLQSKSGTQPHAATRLSLQQPRAELPGQPEMKTQLEQDSIIEALLPLSMEAKIKQEITEGELKAFMTAPGGKKTPAMRKVLYPCRFCNQVFAFSGVLRAHVRSHLGISPYQCNICDYIAADKAALIRHLRTHSGERPYICKICHYPFTVKANCERHLRKKHLKATRKDIEKNIEYVSSSAAELVDAFCAPDTVCRLCGEDLKHYRALRIHMRTHCGRGLGGGHKGRKPFECKECSAAFAAKRNCIHHILKQHLHVPEQDIESYVLAADGLGPAEAPAAEASGRGEDSGCAALGDCKPLTAFLEPQNGFLHRGPTQPPPPHVSIKLEPASSFAVDFNEPLDFSQKGLALVQVKQENISFLSPSSLVPYDCSMEPIDLSIPKNFRKGDKDLATPSEAKKPEEEAGSSEQPSPCPAPGPSLPVTLGPSGILESPMAPAPAATPEPPAQPLQGPVQLAVPIYSSALVSSPPLVGSSALLSGTALLRPLRPKPPLLLPKPPVTEELPPLASIAQIISSVSSAPTLLKTKVADPGPASTGSNTTASDSLGGSVPKAATTATPAATTSPKESSEPPAPASSPEAASPTEQGPAGTSKKRGRKRGMRSRPRANSGGVDLDSSGEFASIEKMLATTDTNKFSPFLQTAEDNTQDEVAGAPADHHGPSDEEQGSPPEDKLLRAKRNSYTNCLQKITCPHCPRVFPWASSLQRHMLTHTDSQSDAETAAAAGEVLDLTSRDREQPSEGATELRQVAGDAPVEQATAETASPVHREEHGRGESHEPEEEHGTEESTGDADGGRGRVEQPEPGPGLRHQAHGLQAGGGRRRGRPGGAASQEQKLACDTCGKSFKFLGTLSRHRKAHGRQEPKDEKGDGASTAEEGPQPAPEQEEKPPETPAEVVESAPGAGEAPAEKLAEETEGPSDGESAAEKRSSEKSDDDKKPKTDSPKSVASKADKRKKVCSVCNKRFWSLQDLTRHMRSHTGERPYKCQTCERTFTLKHSLVRHQRIHQKARHAKHHGKDSDKEERGEEDSENESTHSGNNAVSENEAELAPNASNHMAVTRSRKEGLASATKDCSHREEKVTAGWPSEPGQGDLNPESPAALGQDLLEPRSKRPAHPILATADGASQLVGME

SEQ ID NO: 906074 - protein, 1687 aa, Homo sapiens; identical to SEQ ID NO: 906073

SEQ ID NO: 906075 - protein, 1687 aa, Homo sapiens; identical to SEQ ID NO: 906073

SEQ ID NO: 906076 - protein, 1687 aa, Homo sapiens; identical to SEQ ID NO: 906073

SEQ ID NO: 906077 - protein, 1742 aa, Homo sapiens
MTSSSPAGLEGSDLSSINTMMSAVMSVGKVTENGGSPQGIKSPSKPPGPNRIGRRNQETKEEKSSYNCPLCEKICTTQHQLTMHIRQHNTDTGGADHSCSICGKSLSSASSLDRHMLVHSGERPYKCTVCGQSFTTNGNMHRHMKIHEKDPNSATATAPPSPLKLVGDMSSKRKLSHDAESEREDPAPAKKMVEDGQSGDLEKKADEVFHCPVCFKEFVCKYGLETHMETHSDNPLRCDICCVTFRTHRGLLRHNALVHKQLPRDAMGRPFIQNNPSIPAGFHDLGFTDFSCRKFPRISQAWCETNLRRCISEQHRFVCDTCDKAFPMLCSLALHKQTHVAADQGQEKPQATPLPGDALDQKGFLALLGLQHTKDVRPAPAEEPLPDDNQAIQLQTLKCQLPQDPGCTNLLSLSPFEAASLGGSLTVLPATKDSIKHLSLQPFQKGFIIQPDSSIVVKPISGESAIELADIQQILKMAASAPPQISLPPFSKAPAAPLQAIFKHMPPLKPKPLVTPRTVVATSTPPPLINAQQASPGCISPSLPPPPLKLLKGSVEAASNAHLLQSKSGTQPHAATRLSLQQPRAELPGQPEMKTQLEQDSIIEALLPLSMEAKIKQEITEGELKAFMTAPGGKKTPAMRKVLYPCRFCNQVFAFSGVLRAHVRSHLGISPYQCNICDYIAADKAALIRHLRTHSGERPYICKICHYPFTVKANCERHLRKKHLKATRKDIEKNIEYVSSSAAELVDAFCAPDTVCRLCGEDLKHYRALRIHMRTHCGRGLGGGHKGRKPFECKECSAAFAAKRNCIHHILKQHLHVPEQDIESYVLAADGLGPAEAPAAEASGRGEDSGCAALGDCKPLTAFLEPQNGFLHRGPTQPPPPHVSIKLEPASSFAVDFNEPLDFSQKGLALVQVKQENISFLSPSSLVPYDCSMEPIDLSIPKNFRKGDKDLATPSEAKKPEEEAGSSEQPSPCPAPGPSLPVTLGPSGILESPMAPAPAATPEPPAQPLQGPVQLAVPIYSSALVSSPPLVGSSALLSGTALLRPLRPKPPLLLPKPPVTEELPPLASIAQIISSVSSAPTLLKTKVADPGPASTGSNTTASDSLGGSVPKAATTATPAATTSPKESSEPPAPASSPEAASPTEQGPAGTSKKRGRKRGMRSRPRANSGGVDLDSSGEFASIEKMLATTDTNKFSPFLQTAEDNTQDEVAGAPADHHGPSDEEQGSPPEDKLLRAKRNSYTNCLQKITCPHCPRVFPWASSLQRHMLTHTGQKPFPCQKCDAFFSTKSNCERHQLRKHGVTTCSLRRNGLIPQSKESDVGSHDSTDSQSDAETAAAAGEVLDLTSRDREQPSEGATELRQVAGDAPVEQATAETASPVHREEHGRGESHEPEEEHGTEESTGDADGGRGRVEQPEPGPGLRHQAHGLQAGGGRRRGRPGGAASQEQKLACDTCGKSFKFLGTLSRHRKAHGRQEPKDEKGDGASTAEEGPQPAPEQEEKPPETPAEVVESAPGAGEAPAEKLAEETEGPSDGESAAEKRSSEKSDDDKKPKTDSPKSVASKADKRKKVCSVCNKRFWSLQDLTRHMRSHTGERPYKCQTCERTFTLKHSLVRHQRIHQKARHAKHHGKDSDKEERGEEDSENESTHSGNNAVSENEAELAPNASNHMAVTRSRKEGLASATKDCSHREEKVTAGWPSEPGQGDLNPESPAALGQDLLEPRSKRPAHPILATADGASQLVGME

SEQ ID NO: 906078 - protein, 435 aa, Homo sapiens
MGVPGGAPLSPPRCACPTDSQSDAETAAAAGEVLDLTSRDREQPSEGATELRQVAGDAPVEQATAETASPVHREEHGRGESHEPEEEHGTEESTGDADGGRGRVEQPEPGPGLRHQAHGLQAGGGRRRGRPGGAASQEQKLACDTCGKSFKFLGTLSRHRKAHGRQEPKDEKGDGASTAEEGPQPAPEQEEKPPETPAEVVESAPGAGEAPAEKLAEETEGPSDGESAAEKRSSEKSDDDKKPKTDSPKSVASKADKRKKVCSVCNKRFWSLQDLTRHMRSHTGERPYKCQTCERTFTLKHSLVRHQRIHQKARHAKHHGKDSDKEERGEEDSENESTHSGNNAVSENEAELAPNASNHMAVTRSRKEGLASATKDCSHREEKVTAGWPSEPGQGDLNPESPAALGQDLLEPRSKRPAHPILATADGASQLVGME

SEQ ID NO: 906079 - protein, 1392 aa, Homo sapiens
MTSSSPAGLEGSDLSSINTMMSAVMSVGKVTENGGSPQGIKSPSKPPGPNRIGRRNQETKEEKSSYNCPLCEKICTTQHQLTMHIRQHNTDTGGADHSCSICGKSLSSASSLDRHMLVHSGERPYKCTVCGQSFTTNGNMHRHMKIHEKDPNSATATAPPSPLKLVGDMSSKRKLSHDAESEREDPAPAKKMVEDGQSGDLEKKADEVFHCPVCFKEFVCKYGLETHMETHSDNPLRCDICCVTFRTHRGLLRHNALVHKQLPRDAMGRPFIQNNPSIPAGFHDLGFTDFSCRKFPRISQAWCETNLRRCISEQHRFVCDTCDKAFPMLCSLALHKQTHVAADQGQEKPQATPLPGDALDQKGFLALLGLQHTKDVRPAPAEEPLPDDNQAIQLQTLKCQLPQDPGCTNLLSLSPFEAASLGGSLTVLPATKDSIKHLSLQPFQKGFIIQPDSSIVVKPISGESAIELADIQQILKMAASAPPQISLPPFSKAPAAPLQAIFKHMPPLKPKPLVTPRTVVATSTPPPLINAQQASPGCISPSLPPPPLKLLKGSVEAASNAHLLQSKSGTQPHAATRLSLQQPRAELPGQPEMKTQLEQDSIIEALLPLSMEAKIKQEITEGELKAFMTAPGGKKTPAMRKVLYPCRFCNQVFAFSGVLRAHVRSHLGISPYQCNICDYIAADKAALIRHLRTHSGERPYICKICHYPFTVKANCERHLRKKHLKATRKDIEKNIEYVSSSAAELVDAFCAPDTVCRLCGEDLKHYRALRIHMRTHCGRGLGGGHKGRKPFECKECSAAFAAKRNCIHHILKQHLHVPEQDIESYVLAADGLGPAEAPAAEASGRGEDSGCAALGDCKPLTAFLEPQNGFLHRGPTQPPPPHVSIKLEPASSFAVDFNEPLDFSQKGLALVQVKQENISFLSPSSLVPYDCSMEPIDLSIPKNFRKGDKDLATPSEAKKPEEEAGSSEQPSPCPAPGPSLPVTLGPSGILESPMAPAPAATPEPPAQPLQGPVQLAVPIYSSALVSSPPLVGSSALLSGTALLRPLRPKPPLLLPKPPVTEELPPLASIAQIISSVSSAPTLLKTKVADPGPASTGSNTTASDSLGGSVPKAATTATPAATTSPKESSEPPAPASSPEAASPTEQGPAGTSKKRGRKRGMRSRPRANSGGVDLDSSGEFASIEKMLATTDTNKFSPFLQTAEDNTQDEVAGAPADHHGPSDEEQGSPPEDKLLRAKRNSYTNCLQKITCPHCPRVFPWASSLQRHMLTHTGKRATGLPGSESYFLVGGATSGGQKRDPSPTVPVIPSLASSPVSEAPSLSGGAVFPMCSQYPHGLCAGAEPSKGSILLSVHPGRFEVKVVTGPQITHGVASSLPEVVARLSAGLNREAAPQT

SEQ ID NO: 906080 - protein, 96 aa, Homo sapiens
EAGRGAETGAGTTAGAPGSPAPRPPPSLWEKRRRGSDCGVDELCTSRNAILIPFPEQVCISPRSLPEAHRSPTHHAREPSVLPGRCSDCVFQEWWL

SEQ ID NO: 906081 - protein, 1687 aa, Homo sapiens; identical to SEQ ID NO: 906073

SEQ ID NO: 906082 - protein, 1687 aa, Homo sapiens; identical to SEQ ID NO: 906073

SEQ ID NO: 906083 - protein, 1687 aa, Homo sapiens; identical to SEQ ID NO: 906073

SEQ ID NO: 906084 - protein, 1687 aa, Homo sapiens; identical to SEQ ID NO: 906073

SEQ ID NO: 906085 - protein, 56 aa, Homo sapiens
MLCSLALHKQTHVAADQGQEKPQATPLPGDALDQKGFLALLGLQHTKDVRPAPAEE

SEQ ID NO: 906086 - protein, 361 aa, Homo sapiens [sequence omitted]

SEQ ID NO: 906087 - protein, 361 aa, Homo sapiens [sequence omitted]

SEQ ID NO: 906088 - protein, 251 aa, Homo sapiens
MDIQMANNFTPPSATPQGNDCDLYAHHSTARIVMPLHYSLVFIIGLVGNLLALVVIVQNRKKINSTTLYSTNLVISDILFTTALPTRIAYYAMGFDWRIGDALCRITALVFYINTYAGVNFMTCLSIDRFIAVVHPLRYNKIKRIEHAKGVCIFVWILVFAQTLPLLINPMSKQEAERITCMEYPNFEETKSLPWILLGACFIGYVLPLIIILICYSQICCKLFRTAKQNPRHHQYERHRLPSDTFYARTL

SEQ ID NO: 906089 - protein, 185 aa, Homo sapiens
WGSNQQDKRALATAARGGHGVLSGSGGGGRCCESGGGGAGRQREGARPSGGGVGAENMAGGKAGKDSGKAKAKAVSRSQRAGLQFPVGRIHRHLKTRTTSHGRVGATAAVYSAAILEYLTAEVLELAGNASKDLKVKRITPRHLQLAIRGDEELDSLIKATIAGGGVIPHIHKSLIGKKGQQKTA

SEQ ID NO: 906090 - protein, 638 aa, Homo sapiens
MYLKDSFFMFYFIFIFSDKVLLCRPGWHAVAQSQLTATSTSQVQGFFCLSLLSSWHYRCLPPCLAECLFVLLFLFLRQDLTLLPRLESNSLILAHCNLSLPGNWDYRHAPPCPANLCVFFVCLFICVVEMGFHHVGQAGLKLLTSSDPPASASQSAGITGMSHCAWRRKYFLELKTTPSLTSITPKKLSDLYFEIVRHSEMQWHLSREKKDFSFSFFKKKVLEPELGLVCIWEESSGENNTNKVLRMKNCIYIGSCNKWPGEYLTLYETFNEKCDLLWCLWLNLLRCFWHYENFQTCKKVPVVIQEFLYSPPISIVNILLVFYPVISSSMRWPLFICLLFLFSICPVISCERREGVLRSEDAIVLGDGKVLLIYVEQDSTGMCAELNQGTARSAEQGHLLLRYVNSILSKILDLLQSSFDLKYISEPFPCMSNFLNVKIFYLCLTFWINCVAAVLVHTTILSEDLVSLRISRHWKEREPGSERVIVSVHFSGFVFIGSPEWGNLKVLTVEDHPIPIPSKNRPFHNLLPVNLAFFFVFSLIESHSCHPDWSAMARSWLTATLPPGFQRFSCLSLPSSWDYRRTPPCPANFCIFSRRGVSPCWPDWSQTPDLRRSARLSLPKCWDYWQEPPGPANQHFLR

SEQ ID NO: 906091 - protein, 128 aa, Homo sapiens
MAGGKAGKDSGKAKAKAVSRSQRAGLQFPVGRIHRHLKTRTTSHGRVGATAAVYSAAILEYLTAEVLELAGNASKDLKVKRITPRHLQLAIRGDEELDSLIKATIAGGGVIPHIHKSLIGKKGQQKTA

SEQ ID NO: 906092 - protein, 869 aa, Homo sapiens
MAHNGSHLVTLRLIVGLDAASPLHSLQKFSISFSPDGFSHHYMIFAHIWDSIRGCQPVISCHSFCIYKLESYKELVLINSRGRMKIEISNSDCIGAHFEVSVLRVRPTVKVAIESCLFEKKEAGGGVQYNQQTFLWLNHLIQGNFYYSFIDNCFKCLIHFDSIVTDYIISSQGCIFNLFSNKKHRNRTTRSCTLGLALTVMISLVSFVPNPLSYFKARSSYAYHFMYNILIRIYKIAFLCFILFLFFQTKYYSVAQAGMQWHNLSSLQPPPPRFKCFFCLSLLSSWHYRCLPPCLAECLFVLLFLFLRQDLTLLPRLESNSLILAHCNLSLPGNWDYRHAPPCPANLCVFFVCLFICVVEMGFHHVGQAGLKLLTSSDPPASASQSAGITGMSHCAWRRKYFLELKTTPSLTSITPKKLSDLYFEIVRHSEMQWHLSREKKDFSFSFFKKKVLEPELGLVCIWEESSGENNTNKVLRMKNCIYIGSCNKWPGEYLTLYETFNEKCDLLWCLWLNLLDASDIMKIFKHAKKFQYLSSEFLYSPPISIVNILLVFYPVISSSMRWPLFICLLFLFSICPVISCERREGVLRSEDAIVLGDGKVLLIYVEQDSTGMCAELNQGTARSAEQGHLLLRYVNSILSKILDLLQSSFDLKYISEPFPCMSNFLNVKIFYLCLTFWINCVAAVLVHTTILSEDLVSLRISRHWKEREPGSERVIVSVHFSGFVFIGSPEWGNLKVLTVEDHPIPIPSKNRPFHNLLPVNLAFFFVFSLIESHSCHPDWSAMARSWLTATLPPGFQRFSCLSLPSSWDYRRTPPCPANFCIFSRRGVSPCWPDWSQTPDLRRSARLSLPKCWDYWQEPPGPANQHFLR

SEQ ID NO: 906093 - protein, 915 aa, Homo sapiens
MYTFSVPYMFYKLTDLEGFCCSVLLFHKNEFIGDICSMLYHIMAHNGSHLVTLRLIVGLDAASPLHSLQKFSISFSPDGFSHHYMIFAHIWDSIRGCQPVISCHSFCIYKLESYKELVLINSRGRMKIEISNSDGIGAHFEVSVLRVRPTVKVAIESCLFEKKEAGGGVQYNQQTFLWLNHLIQGNFYYSFIDNCFKCLIHFDSIDYLTTIISSQGCIFNLFSNKKHRNRTTRSCTLGLALTVMISLVSFVPNPLSYFKARSSYAYHFMYNILIRIYKDSFFMFYFIFIFSDKVLLCRPGWHAVAQSQLTATSTSQVQVILLPQPPEYAGITGACHHAWLMFVCSFVFVSETGISLCCLGWSPIAYILAHCNLSLPGNWDYRHAPPCPANLCVFFVCLFICVVEMGFHHVGQAGLKLLTSSDPPASASQSAGITGMSHCAWRRKYFLYLKTTPSLTSITPKKLSDLYFEIVRHSEMQWHLSREKKDFSFSFFKKKVLEPELGLVCIWEESSGETTQMKVLRMKNCIYIGSCNKWPGEYLTLYETFNEKCDLLWCLWLNLLRCFWHYENFQDMQKSSSSYPVNSYTHHLISIVNILLVFYPVISSSMRWPLFICLLFLFSICPVISCYRREGVLRSEDAIVLGDGKVLLIYVEQDSTGMCAELNQRNCPNVLEQGHLLLRYVNSILSKILDLLQSSFDLKYISEPFPCMSNFLNVSNILFMFDLLDKLCCCSVVHTTILSEDLVSLRISRHWKEREPGSERVIVSVHFSGFVFIGSPEWGNLKVLTVEDHPIPIPSKNRPFHNLLPVNFSFFFFFSLIESHSCHPDWSAMARSWLTATLPPGFQRFSCLSLPSSWDYRRTPPCPANFCIFSRRGVSPCWPDWSQTPDLRRSARLSLPKCWDYWQEPPGPANQHFLR

SEQ ID NO: 906094 - protein, 185 aa, Homo sapiens; identical to SEQ ID NO: 906089

SEQ ID NO: 906095 - protein, 185 aa, Homo sapiens; identical to SEQ ID NO: 906089

SEQ ID NO: 906096 - protein, 185 aa, Homo sapiens; identical to SEQ ID NO: 906089

SEQ ID NO: 906097 - protein, 171 aa, Homo sapiens
WGSNQQDKRALATAARGGHGVLSGSGGGGRCCESGGGGAGRQREGARPSGGGVGAENMAGGKAGKDSGKAKAKAVSRSQRAGLQFPVGRIHRHLKTRTTSHGRVGATAAVYSAAILEYLTAEVLELAGNASKDLKVKRITPRHLQLAIRGDEELDSLIKATIAGGEKRRCS

SEQ ID NO: 906098 - protein, 185 aa, Homo sapiens; identical to SEQ ID NO: 906089

SEQ ID NO: 906099 - protein, 179 aa, Homo sapiens
WGSNQQDKRALATAARGGHGVLSGSGGGGRCCESGGGGAGRQREGARPSGGGVGAENMAGGKAGKDSGKAKAKAVSRSQRAGLQFPVGRIHRHLKTRTTSHGRVGATAAVYSAAILEYLTAEVLELAGNASKDLKVKRITPRHLQLAIRGDEELDSLIKATIAGGGMYYYLSLDSYWSF

SEQ ID NO: 906100 - protein, 71 aa, Homo sapiens
VWVSVRFKTCTWSENKKASLIRAVGEQRDTLLGDAGNLQLGPNGTRFFGNSPVWTYYVLLKIKLLICKLCN

SEQ ID NO: 906101 - protein, 873 aa, Homo sapiens
MLYHIMAHNGSHLVTLRLIVGLDAASPLHSLQKFSISFSPDGFSHHYMIFAHIWDSIRGCQPVISCHSFCIYKLESYKELVLINSRGRMKIEISNSDGIGAHFEVSVLRVRPTVKVAIESCLFEKKEAGGGVQYNQQTFLWLNHLIQGNFYYSFIDNCFKCLIHFDSIVLDYIISSQGCIFNLFSNKKHRNRTTRSCTLGLALTVMISLVSFVPNPLSYFKARSSYHITSCIIFNTYLKDSFFMFYFIFIFSDKVLLCRPGWHAVAQSQLTATSTSQVQGFFCLSLLSSWHYRCLPPCLAECLFVLLFLFLRQDLTLLPRLESNSLILAHCNLSLPGNWDYRHAPPCPANLCVFFVCLFICVVEMGFHHVGQAGLKLLTSSDPPASASQSAGITGMSHCAWRRKYFLELKTTPSLTSITPKKLSDLYFEIVRHSEMQWHLSREKKDFSFSFFKKKVLEPELGLVCIWEESSGENNTNKVLRMKNCIYIGSCNKWPGEYLTLYETFNEKCDLLWCLWLNLLRCFWHYENFQTCKKVPVVIQEFLYSPPISIVNILLVFYPVISSSMRWPLFICLLFLFSICPVISCERREGVLRSEDAIVLGDGKVLLIYVEQDSTGMCAELNQGTARSAEQGHLLLRYVNSILSKILDLLQSSFDLKYISEPFPCMSNFLNVKIFYLCLTFWINCVAAVLVHTTILSEDLVSLRISRHWKEREPGSERVIVSVHFSGFVFIGSPEWGNLKVLTVEDHPIPIPSKNRPFHNLLPVNLAFFVFFSLIESHSCHPDWSAMARSWLTATLPPGFQRFSCLSLPSSWDYRRTPPCPANFCIFSRRGVSPCWPDWSQTPDLRRSARLSLPKCWDYWQEPPGPANQHFLR

SEQ ID NO: 906102 - protein, 869 aa, Homo sapiens
MAHNGSHLVTLRLIVGLDAASPLHSLQKFSISFSPDGFSHHYMIFAHIWDSIRGCQPVISCHSFCIYKLESYKELVLINSRGRIKEKFQILIEYGAHFEVSVLRVRPTVKVAIESCLFEKKEAGGGVQYNQQTFLWLNHLIQGNFYYSFIDNCFKCLIHFDSIVTDYIISSQGCIFNLFSNKKHRNRTTRSCTLGLALTVMISLVSFVPNPLSYFKARSSYAYHFMYNILIRIYKIAFLCFILFLFFQTKYYSVAQAGMQWHNLSSLQPPPPRFKGFFCLSLLSSWHYRCLPPCLAECLFVLLFLFLRQDLTLLPRLESNSLILAHCNLSLPGNWDYRHAPPCPANLCVFFVCLFICVVEMGFHHVGQAGLKLLTSSDPPASASQSAGITGMSHCAWRRKYFLELKTTPSLTSITPKKLSDLYFEIVRHSEMQWHLSREKKDFSFSFFKKKVLEPELGLVCIWEESSGENNTNKVLRMKNCIYIGSCNKWPGEYLTLYETFNEKCDLLWCLWLNLLRCFYIMKIFKHAKKFQELSSEFLYSPPISIVNILLVFYPVISSSMRWPLFICLLFLFSICPVISCERREGVLRSEDAIVLGDGKVLLIYVEQDSTGMCAELNKELPECAEQGHLLLRYVNSILSKILDLLQSSFDLKYISEPFPCMSNFLNVKIFYLCLTFWINCVAAVLVHTTILSEDLVSLRISRHWKEREPGSERVIVSVHFSGFVFIGSPEWGNLKVLTVEDHPIPIPSKNRPFHNLLPVNLAFFFVFSLIESHSCHPDWSAMARSWLTATLPPGFQRFSCLSLPSSWDYRRTPPCPANFCIFSRRGVSPCWPDWSQTPDLRRSARLSLPKCWDYWQEPPGPANQHFLR

SEQ ID NO: 906103 - protein, 913 aa, Homo sapiens
MYTFSVPYMFYKLTDLEGFCCSVLLFHKNEFIGDICSMLYHIMAHNGSHLVTLRLIVGLDAASPLHSLQKFSISFSPDGFSHHYMIFAHIWDSIRGCQPVISCHSFCIYKLESYKELVLINSRGRIKYKFQILIEYGAHFEVSVLRVRPTVKVAIESCLFEKKEAGGGVQYNQQTFLWLNHLIQGNFYYSFIDNCFKCLIHFDSIVTDYIISSQGCIFNLFSNKKHRNRTTRSCTLGLALTVMISLVSFVPNPLSYFKARSSYAYHFMYNILIRIYKIAFLCFILFLFFQTKYYSVAQAGMQWHNLSSLQPPPPRFKGFFCLSLLSSWHYRCLPPCLAECLFVLLFLFLRQDLTLLPRLESNSLILAHCNLSLPGNWDYRHAPPCPANLCVFFVCLFICVVEMGFHHVGQAGLKLLTSSDPPASASQSAGITGMSHCAWRRKYFLELKTTPSLTSITPKKLSDLYFEIVRHSEMQWHLSREKKDFSFSFFKKKVLEPELGLVCIWEESSGENNTNKVLRMKNCIYIGSCNKWPGEYLTLYETFNEKCDLLLVPMVEFVAMLLDIMKIFKHAKKFQYLSSEFLYSPPISIVNILLVFYPVISSSMRWPLFICLLFLFSICPVISCERREGVLRSEDAIVLGDGKVLLIYVEQDSTGMCAELNQGDCPNVLEQGHLLLRYVNSILSKILDLLQSSFDLKYISEPFPCMSNFLNVSNILFMFDLLDKLCCCSVVHTTILSEDLVSLRISRHWKEREPGSERVIVSVHFSGFVFIGSPEWGNLKVLTVEDHPIPIPSKNRPFHNLLPVNLAFFVFFSLIESHSCHPDWSAMARSWLTATLPPGFQRFSCLSLPSSWDYRRTPPCPANFCIFSRRGVSPCWPDWSQTPDLRRSARLSLPKCWDYWQEPPGPANQHFLR

SEQ ID NO: 906104 - protein, 911 aa, Homo sapiens
MYTFSVPYMFYKLTDLEGFCCSVLLFHKNEFIGDICSMLYHIMAHNGSHLVTLRLIVGLDAASPLHSLQKFSISFSPDGFSHHYMIFAHIWDSIRGCQPVISCHSFCIYKLESYKELVLINSRGRMKIEISNSDGIGAHFEVSVLRVRPTVKVAIESCLFEKKEAGGGVQYNQQTFLWLNHLIQGNFYYSFIDNCFKCLIHFDSIVTDYIISSQGCIFNLFSNKKHRNRTTRSCTLGLALTVMISLVSFVPNPLSYFKARSSYHITSCIIFNTYLKDSFFMFYFIFIFSDKVLLCRPGWHAVAQSQLTATSTSQVQGFFCLSLLSSWHYRCLPPCLAECLFVLLFLFLRQDLTLLPRLESNSLILAHCNLSLPGNWDYRHAPPCPANLCVFFVCLFICVVEMGFHHVGQAGLKLLTSSDPPASASQSAGITGMSHCAWRRKYFLELKTTPSLTSITPKKLSDLYFEIVRHSEMQWHLSREKKDFSFSFFKKKVLEPELGLVCIWEESSGENNTNKVLRMKNCIYIGSCNKWPGEYLTLYETFNEKCDLLLVPMVEFVAMLLTLLKFSNMQKSSSSYPVNSYTHHLISIVNILLVFYPVISSSMRWPLFICLLFLFSICPVISCERREGVLRSEDAIVLGDGKVLLIYVEQDSTGMCAELNQGTARSAEQGHLLLRYVNSILSKILDLLQSSFDLKYISEPFPCMSNFLNVKIFYLCLTFWINCVAAVLVHTTILSEDLVSLRISRHWKEREPGSERVIVSVHFSGFVFIGSPEWGNLKVLTVEDHPIPIPSKNRPFHNLLPVNLAFFFVFSLIESHSCHPDWSAMARSWLTATLPPGFQRFSCLSLPSSWDYRRTPPCPANFCIFSRRGVSPCWPDWSQTPDLRRSARLSLPKCWDYWQEPPGPANQHFLR

SEQ ID NO: 906105 - protein, 185 aa, Homo sapiens; identical to SEQ ID NO: 906089

SEQ ID NO: 906106 - protein, 159 aa, Homo sapiens
WGSNQQDKRALATAARGGHGVLSGSGGGGRCCESGGGGAGRQREGARPSGGGVGAENMFPVGRIHRHLKTRTTSHGRVGATAAVYSAAILEYLTAEVLELAGNASKDLKVKRITPRHLQLAIRGDEELDSLIKATIAGGGVIPHIHKSLIGKKGQQKTA

SEQ ID NO: 906107 - protein, 128 aa, Homo sapiens; identical to SEQ ID NO: 906091

SEQ ID NO: 906108 - protein, 128 aa, Homo sapiens; identical to SEQ ID NO: 906091

SEQ ID NO: 906109 - protein, 412 aa, Homo sapiens
GRGGGGESERGNCRGGSCAAARAARHPRRLCARAAPPAPPPQRAPGRSSAPRSSAMARENGESSSSWKKQAEDIKKIFEFKETLGTGAFSEVVLAEEKATGKLFAVKCIPKKALKGKESSIENEIAVLRKIKHENIVALEDIYESPNHLYLVMQLVSGGELFDRIVEKGFYTEKDASTLIRQVLDAVYYLHRMGIVHRDLKPENLLYYSQDEESKIMISDFGLSKMEGKGDVMSTACGTPGYVAPEVLAQKPYSKAVDCWSIGVIAYILLCGYPPFYDENDSKLFEQILKAEYEFDSPYWDDISDSAKDFIRNLMEKDPNKRYTCEQAARHPWIAGDTALNKNIHESVSAQIRKNFAKSKWRQAFNATAVVRHMRKLHLGSSLDSSNASVSSSLSLASQKDCAYVAKPESLS

SEQ ID NO: 906110 - protein, 111 aa, Homo sapiens
GRGGGGESERGNCRGGSCAAARAARHPRRLCARAAPPAPPPQRAPGRSSAPRSSAMARENGESSSSWKKQAEDIKKIFEFKETLGTIKHENIVALEDIYESPNHLYLVMQL

SEQ ID NO: 906111 - protein, 365 aa, Homo sapiens
ADEFDDFGHLLGAFSEVVLAEEKATGKLFAVKCIPKKALKGKESSIENEIAVLRKIKHENIVALEDIYESPNHLYLVMQLVSGGELFDRIVEKGFYTEKDASTLIRQVLDAVYYLHRMGIVHRDLKPENLLYYSQDEESKIMISDFGLSKMEGKGDVMSTACGTPGYVAPEVLAQKPYSKAVDCWSIGVIAYILLCGYPPFYDENDSKLFEQILKAEYEFDSPYWDDISDSAKDFIRNLMEKDPNKRYTCEQAARHPWIAGDTALNKNIHESVSAQIRKNFAKSKWRQAFNATAVVRHMRKLHLGSSLDSSNASVSSSLSLASQKDCLAPSTLCSFISSSSGVSGVGAERRPRPTTVTAVHSGSK

SEQ ID NO: 906112 - protein, 440 aa, Homo sapiens
GRGGGGESERGNCRGGSCAAARAARHPRRLCARAAPPAPPPQRAPGRSSAPRSSAMARENGESSSSWKKQAEDIKKIFEFKETLGTGAFSEVVLAEEKATGKLFAVKCIPKKALKGKESSIENEIAVLRKIKHENIVALEDIYESPNHLYLVMQLVSGGELFDRIVEKGFYTEKDASTLIRQVLDAVYYLHRMGIVHRDLKPENLLYYSQDEESKIMISDFGLSKMEGKGDVMSTACGTPGYVAPEVLAQKPYSKAVDCWSIGVIAYILLCGYPPFYDENDSKLFEQILKAEYEFDSPYWDDISDSAKDFIRNLMEKDPNKRYTCEQAARHPWIAGDTALNKNIHESVSAQIRKNFAKSKWRQAFNATAVVRHMRKLHLGSSLDSSNASVSSSLSLASQKDCLAPSTLCSFISSSSGVSGVGAERRPRPTTVTAVHSGSK

SEQ ID NO: 906113 - protein, 310 aa, Homo sapiens
GGCPRHWDGCSVARRQGGDRPPGAESAMLMKRCEKMDSWIGSSWGPTVPGTSAPTEMQMSPVLVTLPGNLAPPGWCCYSQDEESKIMISDFGLSKMEGKGDVMSTACGTPGYVAPEVLAQKPYSKAVDCWSIGVIAYILLCGYPPFYDENDSKLFEQILKAEYEFDSPYWDDISDSAKDFIRNLMEKDPNKRYTCEQAARHPWIAGDTALNKNIHESVSAQIRKNFAKSKWRQAFNATAVVRHMRKLHLGSSLDSSNASVSSSLSLASQKDCLAPSTLCSFISSSSGVSGVGAERRPRPTTVTAVHSGSK

SEQ ID NO: 906114 - protein, 503 aa, Homo sapiens
MEAAVAAPRPRLLLLVLAAAAAAAAALLPGATALQCFCHLCTKDNFTCVTDGLCFVSVTETTDKVIHNSMCIAEIDLIPRDRPFVCAPSSKTGSVTTTYCCNQDHCNKIELPTTVKSSPGLGPVELAAVIAGPVCFVCISLMLMVYICHNRTVIHHRVPNEEDPSLDRPFISEGTTLKDLIYDMTTSGSGSGLPLLVQRTIARTIVLQESIGKGRFGEVWRGKWRGEEVAVKIFSSREERSWFREAEIYQTVMLRHENILGFIAADNKDNGTWTQLWLVSDYHEHGSLFDYLNRYTVTVEGMIKLALSTASGLAHLHMEIVGTQGKPAIAHRDLKSKNILVKKNGTCCIADLGLAVRHDSATDTIDIAPNHRVGTKRYMAPEVLDDSINMKHFESFKRADIYAMGLVFWEIARRCSIGGIHEDYQLPYYDLVPSDPSVEEMRKVVCEQKLRPNIPNRWQSCEALRVMAKIMRECWYANGAARLTALRIKKTLSQLSQQEGIKM

SEQ ID NO: 906115 - protein, 503 aa, Homo sapiens; identical to SEQ ID NO: 906114

SEQ ID NO: 906116 - protein, 503 aa, Homo sapiens; identical to SEQ ID NO: 906114

SEQ ID NO: 906117 - protein, 503 aa, Homo sapiens; identical to SEQ ID NO: 906114

SEQ ID NO: 906118 - protein, 503 aa, Homo sapiens; identical to SEQ ID NO: 906114

SEQ ID NO: 906119 - protein, 200 aa, Homo sapiens
MEAAVAAPRPRLLLLVLAAAAAAAAALLPGATALQCFCHLCTKDNFTCVTDGLCFVSVTETTDKVIHNSMCIAEIDLIPRDRPFVCAPSSKTGSVTTTYCCNQDHCNKIELPTTVKSSPGLGPVELAAVIAGPVCFVCISLMLMVYICHNRTVIHHRVPNEEDPSLDRPFISEGTTLKDLIYDMTTSGSGSGNIIVSPFS

SEQ ID NO: 906120 - protein, 503 aa, Homo sapiens; identical to SEQ ID NO: 906114

SEQ ID NO: 906121 - protein, 503 aa, Homo sapiens; identical to SEQ ID NO: 906114

SEQ ID NO: 906122 - protein, 503 aa, Homo sapiens; identical to SEQ ID NO: 906114

SEQ ID NO: 906123 - protein, 503 aa, Homo sapiens; identical to SEQ ID NO: 906114

SEQ ID NO: 906124 - protein, 115 aa, Homo sapiens
VNLEIFSKNLSLFPALQCFCHLCTKDNFTCVTDGLCFVSVTETTDKVIHNSMCIAEIDLIPRDRPFVCAPSSKTGSVTTTYCCNQDHCNKIELPTTGKLYKIFFLDTTRKTLHTL

SEQ ID NO: 906125 - protein, 706 aa, Homo sapiens
YPNMAAPVGPVKFWRPGTEGPGVSISEERQSLAENSGTTVVYNPYAALSIEQQRQKLPVFKLRNHILYLIENYQTVVIVGETGCGKSTQIPQYLAEAGWTAEGRVVGVTQPRRVAAVTVAGRVAEERGAVLGHEVGYCIRFDDCTDQLATRIKFLTDGMLVREMMVDPLLTKYSVIMLDEAHERTLYTDIAIGLLKKIQKKRGDLRLIVASATLDADKFRDFFNQNETSDPARDTCVILTVEGRTFPVDIFYLQSPVPDYIKSTVETVVKIHQTEGDGDVLAFLTGQEEVETVVSMLIEQARALARTGMKRHLRVLPMYAGLPSFEQMKVFERVSRSVRKVIVATNVAETSITISGIVYVIDCGFVKLRAYNPRTAIECLVVVPVSQASANQRAGRGGRSRSGKCYRLYTEEAFDKLPQSTVPEMQRSNLAPVILQLKALGIDNVLRFHFMSPPPAQSMVQALELLYALGGLDKDCRLTEPLGMRIAEFPLNPMFAKMLLESGNFGCSQEILSIAAMMQIQNIFVVPPNQKSHAIRVHRKFAVEEGDHLTMLNIYEAFIKHNKDSKWCQEHFLNYKGLVRAATVREQLKKLLVKFQVPRKSSEGDPDLVLRCIVSGFFANAARFHSTGAYRTIRDDHELHIHPASVLYAEKPPRWVIYNEVIQTSKYYMRDVTAIESAWLLELAPHFYQQGTHLSLKAKRAKVQDP

SEQ ID NO: 906126 - protein, 675 aa, Homo sapiens
YPNMAAPVGPVKFWRPGTEGPGVSISEERQSLAENSGTTVVYNPYAALSIEQQRQKLPVFKYLAEAGWTAEGRVVGVTQPRRVAAVTVAGRVAEERGAVLGHEVGYCIRFDDCTDQLATRIKFLTDGMLVREMMVDPLLTKYSVIMLDEAHERTLYTDIAIGLLKKIQKKRGDLRLIVASATLDADKFRDFFNQNETSDPARDTCVILTVEGRTFPVDIFYLQSPVPDYIKSTVETVVKIHQTEGDGDVLAFLTGQEEVETVVSMLIEQARALARTGMKRHLRVLPMYAGLPSFEQMKVFERVSRSVRKVIVATNVAETSITISGIVYVIDCGFVKLRAYNPRTAIECLVVVPVSQASANQRAGRGGRSRSGKCYRLYTEEAFDKLPQSTVPEMQRSNLAPVILQLKALGIDNVLRFHFMSPPPAQSMVQALELLYALGGLDKDCRLTEPLGMRIAEFPLNPMFAKMLLESGNFGCSQEILSIAAMMQIQNIFVVPPNQKSHAIRVHRKFAVEEGDHLTMLNIYEAFIKHNKDSKWCQEHFLNYKGLVRAATVREQLKKLLVKFQVPRKSSEGDPDLVLRCIVSGFFANAARFHSTGAYRTIRDDHELHIHPASVLYAEKPPRWVIYNEVIQTSKYYMRDVTAIESAWLLELAPHFYQQGTHLSLKAKRAKVQDP

SEQ ID NO: 906127 - protein, 706 aa, Homo sapiens; identical to SEQ ID NO: 906125

SEQ ID NO: 906128 - protein, 105 aa, Homo sapiens
MLVREMMVDPLLTKYSVIMLDEAHERTLYTDIAIGLLKKIQKKRGDLRLIVASATLDADVRALPPLSSSPHKHFCPIYPWEVTSSKSLSLAECPIFFMGPSDVLD

SEQ ID NO: 906129 - protein, 223 aa, Homo sapiens
SWLVRSGIPGLAAVEFVTYEVTPLESLPFNSSWSACLALGSFCSLRPAPSLRAGLQRRAQPSAACQQPPSRPAAQPRTKPGQSFLAARAMNTEMYQTPMEVAVYQLHNFSISFFSSLLGGDVVSVKLDNSASGASVVAIDNKIEQAMDLVKNHLMYAVREEVEILKEQIRELVEKNSQLERENTLLKTLASPEQLEKFQSCLSPEEPAPESPQVPEAPGGSAV

SEQ ID NO: 906130 - protein, 128 aa, Homo sapiens
MWFPLSWTTGNRWPQLRRLPSRGAGRSWARSPVSERAVCRRSLFPAVQHPGKGRGGGDAGRGGSPPLWDPSSKRPCGRCAVKTSCCSRRGSRRQRGGGQDQTGLGRGLAERRAPLGRRPEAYQPRRNS

SEQ ID NO: 906131 - protein, 121 aa, Homo sapiens [sequence omitted]

SEQ ID NO: 906132 - protein, 285 aa, Homo sapiens
PYGRIRPLWHEQCPPPPTSIERVTTDGDQLRWQVRFRKGEGQQIWRNRRSLSFPGTLESPQASSVGAHLPAAPDLAGQATSEPEKMAQSKLDCRSPVGLDCCNCCLDLAHRSGLQRGSSGENNNPGSPTVSNFRQLQEKLVFENLNTDKLNSIMRQDSLEPVLRDPCYLINEGICNRNIDQTMLSILLFFHSASGASVVAIDNKIEQAMDLVKNHLMYAVREEVEILKEQIRELVEKNSQLERENTLLKTLASPEQLEKFQSCLSPEEPAPESPQVPEAPGGSAV

SEQ ID NO: 906133 - protein, 128 aa, Homo sapiens; identical to SEQ ID NO: 906130

SEQ ID NO: 906134 - protein, 91 aa, Homo sapiens
SWLVRSGIPGLAAVEFVTYEVTPLESLPFNSSWSACLALGSFCSLRPAPSLRAGLQRRAQPSAACQQPPSRPAAQPRTKPGQSFLAARAMN

SEQ ID NO: 906135 - protein, 128 aa, Homo sapiens; identical to SEQ ID NO: 906130

SEQ ID NO: 906136 - protein, 223 aa, Homo sapiens; identical to SEQ ID NO: 906129

SEQ ID NO: 906137 - protein, 262 aa, Homo sapiens
QEPKYLRVWVGLAAVEFVTYEVTPLESLPFNSSWSACLALGSFCSLRPAPSLRAGLQRRAQPSAACQQPPSRPAAQPRTKPGQSFLAARAMNTEMYQTPMEVAVYQLHNFSISFFSSLLGGDVVSVKLDNSASGASVVAIDNKIEQAMDLVKNHLMYAVREEVEILKEQIRELVEKNSQLERENTLLKTLASPEQLEKFQSCLSPEEPAPESPQVPEAPGGSALGPSALQVAIRPIPWLHQPFPSRSSLPSLIPRGDSTPLP

SEQ ID NO: 906138 - protein, 119 aa, Homo sapiens
IWGQTVRNSGPGRREGEREEEPRQMEDFGHNCHVLKSRTEWVMGRFAFCLGSASGASVVAIDNKIEQAMVSGITASFSSPDLAAAYVTLGRIEGMGEKALSQNPEEADSLPPIRTGGGV

SEQ ID NO: 906139 - protein, 224 aa, Homo sapiens
QEPKYLRVWVGLAAVEFVTYEVTPLESLPFNSSWSACLALGSFCSLRPAPSLRAGLQRRAQPSAACQQPPSRPAAQPRTKPGQSFLAARAMNTEMYQTPMEVAVYQLHNFSISFFSSLLGGDVVSVKLDNSASGASVVAIDNKIEQAMDLVKNHLMYAVREEVEILKEQIRELVEKNSQLERENTLLKTLASPEQLEKFQSCLSPEEPAPESPQVPEAPGGSAV

SEQ ID NO: 906140 - protein, 200 aa, Homo sapiens
MAQSKLDCRSPVGLDCCNCCLDLAHRSGLQRGSSGENNNPGSPTVSNFRQLQEKLVFENLNTDKLNSIMRQDSLEPVLRDPCYLINEGICNRNIDQTMLSILLFFHSASGASVVAIDNKIEQAMDLVKNHLMYAVREEVEILKEQIRELVEKNSQLERENTLLKTLASPEQLEKFQSCLSPEEPAPESPQVPEAPGGSAV

SEQ ID NO: 906141 - protein, 122 aa, Homo sapiens
MWFPLSWTTGNRWPQLRRLPSRGAGRSWARSPVSERAVCRRSLFPAVQHPGKGRGGGDAGRGGSPPLWDPSSKRPCGRCAVKTSCCSRRGSRRQRGGGQDQTGLGRGLAERRAPLGRSSSPV

SEQ ID NO: 906142 - protein, 224 aa, Homo sapiens; identical to SEQ ID NO: 906139

SEQ ID NO: 906143 - protein, 223 aa, Homo sapiens; identical to SEQ ID NO: 906129

SEQ ID NO: 906144 - protein, 223 aa, Homo sapiens; identical to SEQ ID NO: 906129

SEQ ID NO: 906145 - protein, 80 aa, Homo sapiens
MAQSKLDCRSPVGLDCCNCCLDLAHRSGLQRGSSGENNNPGSPTVSNFRQLQEKLVFENLNTDKLNSIMRQDSLEPVLRD

SEQ ID NO: 906146 - protein, 1765 aa, Homo sapiens
MRRSKADVERYVASVLGLTPSPRQKSMKGFYFAKLYYEAKEYDLAKKYICTYINVQERDPKAHRFLGLLYELEENTEKAVECYRRSVELNPTQKDLVLKIAELLCKNDVTDGRAKYWVERAAKLFPGSPAIYKLKEQLLDCEGEDGWNKLFDLIQSELYVRPDDVHVNIRLVELYRSTKRLKDAVAHCHEAERNIALRSSLEWNSCVVQTLKEYLESLQCLESDKSDWQATNTDLLLAYANLMLLTLSTRDVQENRELLESFDSALQSAKSSLGGNDELSATFLEMKGHFYMYAGSLLLKMGQHGNNVQWRALSELAALCYLIAFQVPRPKIKLREGKAGQNLLEMMACDRLSQSGHMLLSLSRGKQDFLKEVVETFANKIGQSALYDALFSSQSPKDTSFLGSDDIGKIDVQEPELEDLARYDVGAIRAHNGSLQHLTWLGLQWNSLPALPGIRKWLKQLFHRLPHETSRLETNAPESICILDLEVFLLGVVYTSHLQLKEKCNSHHSSYQPLCLPFPVCKQLCTERQKSWWDAVCTLIHRKAVPGNLAKLRLLVQHEINTLRAQEKHGLQPALLVHWAKYLQKTGSGLNSFYGQLEYIGRSVHYWKKVLPLLKIIKKNSIPEPIDPLFKHFHSVDIQASEIVEYEEDAHITFAMLDAVNGNIEDAVTAFESIKSVVSYWNLALIFHRKAEDIENDALSPEEQEECRNYLTKTRDYLIKIIDDGDSNLSVVKKLPVPLESVKQMLNSVMQELEDYSEGGPLYKNGSLRNADSEIKHSTPSPTKYSLSPSKSYKYSPETPPRWTEDRNSLLNMICQQVEAIKKEMQELKLNSSKSASRHRWPTENYGPDSVPDGYQGSQTFHGAPLTVATTGPSVYYSQSPAYNSQYLLRPAANVTPTKGSSNTEFKSTKEGFSIPVSADGFKFGISEPGNQEKKREKPLENDTGFQAQDISGRKKGRGVIFGQTSSTFTFADVAKSTSGEGFQFGKKDLNFKGFSGAGEKLFSSRYGKMANKANTSGDFEKDDDAYKTEDSDDIHFEPVVQMPEKVELVTGEEGEKVLYSQGVKLFRFDAEVRQWKERGLGNLKILKNEVNGKLRMLMRREQVLKVCANHWITTTMNLKPLSGSDRAWMWSASDFSDGDAKLERLAAKFKTPELAEEFKQKFEECQRLLLDIPLQTPHKLVDTGRAAKLIQRAEEMKSGLKDFKTFLTNDQTKVTEEENKGSGTGVAGASDTTIKPNAENTGPTLEWDNYDLREDALDDSVSSSSVHASPLASSPVRKNLFRFDESTTGSNFSFKSALSLSKSPAKLNQSGTSVGTDEESVVTQEEERDGQYFEPVVPLPDLVEVSSGEENEQVVFSHRAEIYRYDKDVGQWKERGIGDIKILQNYDNKQVRIVMRRDQVLKLCANHRITPDMSLQNMKGTERVWVWTACDFADGERKVEHLAVRFKLQDVADSFKKIFDEAKTAQEKDSLITPHVSRSSTPRESPCGKIAVAILEETTRERTDVIQGDDVADAASEVEVSSTSETTTKAVVSPPKFVFVSESVKRIFSSEKSKPFAFGNSSATGSLFGFSFNAPLKSNNSETSSVAQSGSESKVEPKKCELSKNSDIEQSSDSKVKNLSASFPTEESSINYTFKTPEKEPPLWHAEFTKEELVQKLRSTTKSADHLNGLLREIEATNAVLMEQIKLLKSEIRRLERNQEREKSAANLEYLKNVLLQFIFLKPGSERERLLPVINTMLQLSPEEKGKLAAVAQDEEENASRSSG

SEQ ID NO: 906147 - protein, 1855 aa, Homo sapiens
MSRHPQTTGRRHEPGRVQLERRRRRGYTVLRQNAGSSQWASVGGAARSSQWASAGYAAASVACRHFPLGSGDCCGAERCSHASREPGWRRDEGSKADVERYVASVLGLTPSPRQKSMKGFYFAKLYYEAKEYDLAKKYICTYINVQERDPKAHRFLGLLYELEENTEKAVECYRRSVELNPTQKDLVLKIAELLCKNDVTDGRAKYWVERAAKLFPGSPAIYKLKEQLLDCEGEDGWNKLFDLIQSELYVRPDDVHVNIRLVELYRSTKRLKDAVAHCHEAERNIALRSSLEWNSCVVQTLKEYLESLQCLESDKSDWQATNTDLLLAYANLMLLTLSTRDVQENRELLESFDSALQSAKSSLGGNDELSATFLEMKGHFYMYAGSLLLKMGQHGNNVQWRALSELAALCYLIAFQVPRPKIKLREGKAGQNLLEMMACDRLSQSGHMLLSLSRGKQDFLKEVVETFANKIGQSALYDALFSSQSPKDTSFLGSDDIGKIDVQEPELEDLARYDVGAIRAHNGSLQHLTWLGLQWNSLPALPGIRKWLKQLFHRLPHETSRLETNAPESICILDLEVFLLGVVYTSHLQLKEKCNSHHSSYQPLCLPFPVCKQLCTERQKSWWDAVCTLIHRKAVPGNLAKLRLLVQHEINTLRAQEKHGLQPALLVHWAKYLQKTGSGLNSFYGQLEYIGRSVHYWKKVLPLLKIIKKNSIPEPIDPLFKHFHSVDIQASEIVEYEEDAHITFAMLDAVNGNIEDAVTAFESIKSVVSYWNLALIFHRKAEDIENDALSPEEQEECRNYLTKTRDYLIKIIDDGDSNLSVVKKLPVPLESVKQMLNSVMQELEDYSEGGPLYKNGSLRNADSEIKHSTPSPTKYSLSPSKSYKYSPETPPRWTEDRNSLLNMICQQVEAIKKEMQELKLNSSKSASRHRWPTENYGPDSVPDGYQGSQTFHGAPLTVATTGPSVYYSQSPAYNSQYLLRPAANVTPTKGSSNTEFKSTKEGFSIPVSADGFKFGISEPGNQEKKREKPLENDTGFQAQDISGRKKGRGVIFGQTSSTFTFADVAKSTSGEGFQFGKKDLNFKGFSGAGEKLFSSRYGKMANKANTSGDFEKDDDAYKTEDSDDIHFEPVVQMPEKVELVTGEEGEKVLYSQGVKLFRFDAEVRQWKERGLGNLKILKNEVNGKLRMLMRREQVLKVCANHWITTTMNLKPLSGSDRAWMWSASDFSDGDAKLERLAAKFKTPELAEEFKQKFEECQRLLLDIPLQTPHKLVDTGRAAKLIQRAEEMKSGLKDFKTFLTNDQTKVTEEENKGSGTGVAGASDTTIKPNAENTGPTLEWDNYDLREDALDDSVSSSSVHASPLASSPVRKNLFRFDESTTGSNFSFKSALSLSKSPAKLNQSGTSVGTDEESVVTQEEERDGQYFEPVVPLPDLVEVSSGEENEQVVFSHRAEIYRYDKDVGQWKERGIGDIKILQNYDNKQVRIVMRRDQVLKLCANHRITPDMSLQNMKGTERVWVWTACDFADGERKVEHLAVRFKLQDVADSFKKIFDEAKTAQEKDSLITPHVSRSSTPRESPCGKIAVAILEETTRERTDVIQGDDVADAASEVEVSSTSETTTKAVVSPPKFVFVSESVKRIFSSEKSKPFAFGNSSATGSLFGFSFNAPLKSNNSETSSVAQSGSESKVEPKKCELSKNSDIEQSSDSKVKNLSASFPTEESSINYTFKTPEKEPPLWHAEFTKEELVQKLRSTTKSADHLNGLLREIEATNAVLMEQIKLLKSEIRRLERNQEREKSAANLEYLKNVLLQFIFLKPGSERERLLPVINTMLQLSPEEKGKLAAVAQDEEENASRSSG

SEQ ID NO: 906148 - protein, 1110 aa, Homo sapiens
MLDAVNGNIEDAVTAFESIKSVVSYWNLALIFHRKAEDIENDALSPEEQEECRNYLTKTRDYLIKIIDDGDSNLSVVKKLPVPLESVKQMLNSVMQELEDYSEGGPLYKNGSLRNADSEIKHSTPSPTKYSLSPSKSYKYSPETPPRWTEDRNSLLNMICQQVEAIKKEMQELKLNSSKSASRHRWPTENYGPDSVPDGYQGSQTFHGAPLTVATTGPSVYYSQSPAYNSQYLLRPAANVTPTKGSSNTEFKSTKEGFSIPVSADGFKFGISEPGNQEKKREKPLENDTGFQAQDISGRKKGRGVIFGQTSSTFTFADVAKSTSGEGFQFGKKDLNFKGFSGAGEKLFSSRYGKMANKANTSGDFEKDDDAYKTEDSDDIHFEPVVQMPEKVELVTGEEGEKVLYSQGVKLFRFDAEVRQWKERGLGNLKILKNEVNGKLRMLMRREQVLKVCANHWITTTMNLKPLSGSDRAWMWSASDFSDGDAKLERLAAKFKTPELAEEFKQKFEECQRLLLDIPLQTPHKLVDTGRAAKLIQRAEEMKSGLKDFKTFLTNDQTKVTEEENKGSGTGVAGASDTTIKPNAENTGPTLEWDNYDLREDALDDSVSSSSVHASPLASSPVRKNLFRFDESTTGSNFSFKSALSLSKSPAKLNQSGTSVGTDEESVVTQEEERDGQYFEPVVPLPDLVEVSSGEENEQVVFSHRAEIYRYDKDVGQWKERGIGDIKILQNYDNKQVRIVMRRDQVLKLCANHRITPDMSLQNMKGTERVWVWTACDFADGERKVEHLAVRFKLQDVADSFKKIFDEAKTAQEKDSLITPHVSRSSTPRESPCGKIAVAILEETTRERTDVIQGDDVADAASEVEVSSTSETTTKAVVSPPKFVFVSESVKRIFSSEKSKPFAFGNSSATGSLFGFSFNAPLKSNNSETSSVAQSGSESKVEPKKCELSKNSDIEQSSDSKVKNLSASFPTEESSINYTFKTPEKEPPLWHAEFTKEELVQKLRSTTKSADHLNGLLREIEATNAVLMEQIKLLKSEIRRLERNQEREKSAANLEYLKNVLLQFIFLKPGSERERLLPVINTMLQLSPEEKGKLAAVAQDEEENASRSSG

SEQ ID NO: 906149 - protein, 1110 aa, Homo sapiens; identical to SEQ ID NO: 906148

SEQ ID NO: 906150 - protein, 1765 aa, Homo sapiens; identical to SEQ ID NO: 906146

SEQ ID NO: 906151 - protein, 1765 aa, Homo sapiens; identical to SEQ ID NO: 906146

SEQ ID NO: 906152 - protein, 1765 aa, Homo sapiens; identical to SEQ ID NO: 906146

SEQ ID NO: 906153 - protein, 1756 aa, Homo sapiens
MRRSKADVERYVASVLGLTPSPRQKSMKGFYFAKLYYEAKEYDLAKKYICTYINVQERDPKAHRFLGLLYELEENTEKAVECYRRSVELNPTQKDLVLKIAELLCKNDVTDGRAKYWVERAAKLFPGSPAIYKLKEQLLDCEGEDGWNKLFDLIQSELYVRPDDVHVNIRLVELYRSTKRLKDAVAHCHEAERNIALRSSLEWNSCVVQTLKEYLESLQCLESDKSDWQATNTDLLLAYANLMLLTLSTRDVQENRELLESFDSALQSAKSSLGGNDELSATFLEMKGHFYMYAGSLLLKMGQHGNNVQWRALSELAALCYLIAFQVPRPKIKLREGKAGQNLLEMMACDRLSQSGHMLLSLSRGKQDFLKEVVETFANKIGQSALYDALFSSQSPKDTSFLGSDDIGKIDVQEPELEDLARYDVGAIRAHNGSLQHLTWLGLQWNSLPALPGIRKWLKQLFHRLPHETSRLETNAPESICILDLEVFLLGVVYTSHLQLKEKCNSHHSSYQPLCLPFPVCKQLCTERQKSWWDAVCTLIHRKAVPGNLAKLRLLVQHEINTLRAQEKHGLQPALLVHWAKYLQKTGSGLNSFYGQLEYIGRSVHYWKKVLPLLKIIKKNSIPEPIDPLFKHFHSVDIQASEIVEYEEDAHITFAMLDAVNGNIEDAVTAFESIKSVVSYWNLALIFHRKAEDIENDALSPEEQEECRNYLTKTRDYLIKIIDDGDSNLSVVKKLPVPLESVKQMLNSVMQELEDYSEGGPLYKNGSLRNADSEIKHSTPSPTKYSLSPSKSYKYSPETPPRWTEDRNSLLNMICQQVEAIKKEMQELKLNSSKSASRHRWPTENYGPDSVPDGYQGSQTFHGAPLTVATTGPSVYYSQSPAYNSQYLLRPAANVTPTKGSSNTEFKSTKEGFSIPVSADGFKFGISEPGNQEKKREKPLENDTGFQAQDISGRKKGRGVIFGQTSSTFTFADVAKSTSGEGFQFGKKDLNFKGFSGAGEKLFSSRYGKMANKANTSGDFEKDDDAYKTEDSDDIHFEPVVQMPEKVELVTGEEGEKVLYSQGVKLFRFDAEVRQWKERGLGNLKILKNEVNGKLRMLMRREQVLKVCANHWITTTMNLKPLSGSDRAWMWSASDFSDGDAKLERLAAKFKTPELAEEFKQKFEECQRLLLDIPLQTPHKLVDTGRAAKLIQRAEEMKSGLKDFKTFLTNDQTKVTEEENKGSGTGVAGASDTTIKPNAENTGPTLEWDNYDLREDALDDSVSSSSVHASPLASSPVRKNLFRFDESTTGSNFSFKSALSLSKSPAKLNQSGTSVGTDEESVVTQEEERDGQYFEPVVPLPDLVEVSSGEENEQVVFSHRAEIYRYDKDVGQWKERGIGDIKILQNYDNKQVRIVMRRDQVLKLCANHRITPDMSLQNMKGTERVWVWTACDFADGERKVEHLAVRFKLQDVADSFKKIFDEAKTAQEKDSLITPHVSRSSTPRESPCGKIAVAILEETTRERTDVIQGDDVADAASEVEVSSTSETTTKAVVSPPKFVFVSESVKRIFSSEKSKPFAFGNSSATGSLFGFSFNAPLKSNNSETSSVAQSGSESKVEPKKCELSKNSDIEQSSDSKVKNLSASFPTEESSINYTFKTPEKEPPLWHAEFTKEELVQKLRSTTKSADHLNGLLREIEATNAVLMEQIKLLKSEIRRLERNQEREKSAANLEYLKNVLLQFIFLKPGSERERLLPVINTMLQLSPEEKGKLAAVAQGG

SEQ ID NO: 906154 - protein, 724 aa, Homo sapiens
MRRSKADVERYVASVLGLTPSPRQKSMKGFYFAKLYYEAKEYDLAKKYICTYINVQERDPKAHRFLGLLYELEENTEKAVECYRRSVELNPTQKDLVLKIAELLCKNDVTDGRAKYWVERAAKLFPGSPAIYKLKEQLLDCEGEDGWNKLFDLIQSELYVRPDDVHVNIRLVELYRSTKRLKDAVAHCHEAERNIALRSSLEWNSCVVQTLKEYLESLQCLESDKSDWQATNTDLLLAYANLMLLTLSTRDVQENRELLESFDSALQSAKSSLGGNDELSATFLEMKGHFYMYAGSLLLKMGQHGNNVQWRALSELAALCYLIAFQVPRPKIKLREGKAGQNLLEMMACDRLSQSGHMLLSLSRGKQDFLKEVVETFANKIGQSALYDALFSSQSPKDTSFLGSDDIGKIDVQEPELEDLARYDVGAIRAHNGSLQHLTWLGLQWNSLPALPGIRKWLKQLFHRLPHETSRLETNAPESICILDLEVFLLGVVYTSHLQLKEKCNSHHSSYQPLCLPFPVCKQLCTERQKSWWDAVCTLIHRKAVPGNLAKLRLLVQHEINTLRAQEKHGLQPALLVHWAKYLQKTGSGLNSFYGQLEYIGRSVHYWKKVLPLLKIIKKNSIPEPIDPLFKHFHSVDIQASEIVEYEEDAHITFAMLDAVNGNIEDAVTAFESIKSVVSYWNLALDFSQGGQKEHLNMALFSLERKQRKKCQENLSTKRTKGEL

SEQ ID NO: 906155 - protein, 151 aa, Homo sapiens
MRRSKADVERYVASVLGLTPSPRQKSMKGFYFAKLYYEAKEYDLAKKYICTYINVQERDPKAHRFLGLLYELEENTEKAVECYRRSVELNPTQKDLVLKIAELLCKNDVTDGRAKYWVERAAKLFPGSPAIYKLKVNKQNIKGENLRHNHF

SEQ ID NO: 906156 - protein, 994 aa, Homo sapiens
MSRHPQTTGRRHEPGRVQLERRRRRGYTVLRQNAGSSQWASVGGAARSSQWASAGYAAASVACRHFPLGSGDCCGAERCSHASREPGWRRDEGSKADVERYVASVLGLTPSPRQKSMKGFYFAKLYYEAKEYDLAKKYICTYINVQERDPKAHRFLGLLYELEENTEKAVECYRRSVELNPTQKDLVLKIAELLCKNDVTDGRAKYWVERAAKLFPGSPAIYKLKEQLLDCEGEDGWNKLFDLIQSELYVRPDDVHVNIRLVELYRSTKRLKDAVAHCHEAERNIALRSSLEWNSCVVQTLKEYLESLQCLESDKSDWQATNTDLLLAYANLMLLTLSTRDVQENRELLESFDSALQSAKSSLGGNDELSATFLEMKGHFYMYAGSLLLKMGQHGNNVQWRALSELAALCYLIAFQVPRPKIKLREGKAGQNLLEMMACDRLSQSGHMLLSLSRGKQDFLKEVVETFANKIGQSALYDALFSSQSPKDTSFLGSDDIGKIDVQEPELEDLARYDVGAIRAHNGSLQHLTWLGLQWNSLPALPGIRKWLKQLFHRLPHETSRLETNAPESICILDLEVFLLGVVYTSHLQLKEKCNSHHSSYQPLCLPFPVCKQLCTERQKSWWDAVCTLIHRKAVPGNLAKLRLLVQHEINTLRAQEKHGLQPALLVHWAKYLQKTGSGLNSFYGQLEYIGRSVHYWKKVLPLLKIIKKNSIPEPIDPLFKHFHSVDIQASEIVEYEEDAHITFAMLDAVNGNIEDAVTAFESIKSVVSYWNLALIFHRKAEDIENDALSPEEQEECRNYLTKTRDYLIKIIDDGDSNLSVVKKLPVPLESVKQMLNSVMQELEDYSEGGPLYKNGSLRNADSEIKHSTPSPTKYSLSPSKSYKYSPETPPRWTEDRNSLLNMICQQVEAIKKEMQELKLNSSKSASRHRWPTENYGPDSVPDGYQGSQTFHGAPLTEAAHRHFTIEKHGDSKWIIYRFTKQLCGTERARAKIS

SEQ ID NO: 906157 - protein, 1419 aa, Homo sapiens
MACDRLSQSGHMLLSLSRGKQDFLKEVVETFANKIGQSALYDALFSSQSPKDTSFLGSDDIGKIDVQEPELEDLARYDVGAIRAHNGSLQHLTWLGLQWNSLPALPGIRKWLKQLFHRLPHETSRLETNAPESICILDLEVFLLGVVYTSHLQLKEKCNSHHSSYQPLCLPFPVCKQLCTERQKSWWDAVCTLIHRKAVPGNLAKLRLLVQHEINTLRAQEKHGLQPALLVHWAKYLQKTGSGLNSFYGQLEYIGRSVHYWKKVLPLLKIIKKNSIPEPIDPLFKHFHSVDIQASEIVEYEEDAHITFAMLDAVNGNIEDAVTAFESIKSVVSYWNLALIFHRKAEDIENDALSPEEQEECRNYLTKTRDYLIKIIDDGDSNLSVVKKLPVPLESVKQMLNSVMQELEDYSEGGPLYKNGSLRNADSEIKHSTPSPTKYSLSPSKSYKYSPETPPRWTEDRNSLLNMICQQVEAIKKEMQELKLNSSKSASRHRWPTENYGPDSVPDGYQGSQTFHGAPLTVATTGPSVYYSQSPAYNSQYLLRPAANVTPTKGSSNTEFKSTKEGFSIPVSADGFKFGISEPGNQEKKREKPLENDTGFQAQDISGRKKGRGVIFGQTSSTFTFADVAKSTSGEGFQFGKKDLNFKGFSGAGEKLFSSRYGKMANKANTSGDFEKDDDAYKTEDSDDIHFEPVVQMPEKVELVTGEEGEKVLYSQGVKLFRFDAEVRQWKERGLGNLKILKNEVNGKLRMLMRREQVLKVCANHWITTTMNLKPLSGSDRAWMWSASDFSDGDAKLERLAAKFKTPELAEEFKQKFEECQRLLLDIPLQTPHKLVDTGRAAKLIQRAEEMKSGLKDFKTFLTNDQTKVTEEENKGSGTGVAGASDTTIKPNAENTGPTLEWDNYDLREDALDDSVSSSSVHASPLASSPVRKNLFRFDESTTGSNFSFKSALSLSKSPAKLNQSGTSVGTDEESVVTQEEERDGQYFEPVVPLPDLVEVSSGEENEQVVFSHRAEIYRYDKDVGQWKERGIGDIKILQNYDNKQVRIVMRRDQVLKLCANHRITPDMSLQNMKGTERVWVWTACDFADGERKVEHLAVRFKLQDVADSFKKIFDEAKTAQEKDSLITPHVSRSSTPRESPCGKIAVAILEETTRERTDVIQGDDVADAASEVEVSSTSETTTKAVVSPPKFVFVSESVKRIFSSEKSKPFAFGNSSATGSLFGFSFNAPLKSNNSETSSVAQSGSESKVEPKKCELSKNSDIEQSSDSKVKNLSASFPTEESSINYTFKTPEKEPPLWHAEFTKEELVQKLRSTTKSADHLNGLLREIEATNAVLMEQIKLLKSEIRRLERNQEREKSAANLEYLKNVLLQFIFLKPGSERERLLPVINTMLQLSPEEKGKLAAVAQDEEENASRSSG

SEQ ID NO: 906158 - protein, 1419 aa, Homo sapiens; identical to SEQ ID NO: 906157

SEQ ID NO: 906159 - protein, 756 aa, Homo sapiens
MANKANTSGDFEKDDDAYKTEDSDDIHFEPVVQMPEKVELVTGEEGEKVLYSQGVKLFRFDAEVRQWKERGLGNLKILKNEVNGKLRMLMRREQVLKVCANHWITTTMNLKPLSGSDRAWMWSASDFSDGDAKLERLAAKFKTPELAEEFKQKFEECQRLLLDIPLQTPHKLVDTGRAAKLIQRAEEMKSGLKDFKTFLTNDQTKVTEEENKGSGTGVAGASDTTIKPNAENTGPTLEWDNYDLREDALDDSVSSSSVHASPLASSPVRKNLFRFDESTTGSNFSFKSALSLSKSPAKLNQSGTSVGTDEESVVTQEEERDGQYFEPVVPLPDLVEVSSGEENEQVVFSHRAEIYRYDKDVGQWKERGIGDIKILQNYDNKQVRIVMRRDQVLKLCANHRITPDMSLQNMKGTERVWVWTACDFADGERKVEHLAVRFKLQDVADSFKKIFDEAKTAQEKDSLITPHVSRSSTPRESPCGKIAVAILEETTRERTDVIQGDDVADAASEVEVSSTSETTTKAVVSPPKFVFVSESVKRIFSSEKSKPFAFGNSSATGSLFGFSFNAPLKSNNSETSSVAQSGSESKVEPKKCELSKNSDIEQSSDSKVKNLSASFPTEESSINYTFKTPEKEPPLWHAEFTKEELVQKLRSTTKSADHLNGLLREIEATNAVLMEQIKLLKSEIRRLERNQEREKSAANLEYLKNVLLQFIFLKPGSERERLLPVINTMLQLSPEEKGKLAAVAQDEEENASRSSG

SEQ ID NO: 906160 - protein, 1765 aa, Homo sapiens; identical to SEQ ID NO: 906146

SEQ ID NO: 906161 - protein, 485 aa, Homo sapiens
MACDRLSQSGHMLLSLSRGKQDFLKEVVETFANKIGQSALYDALFSSQSPKDTSFLGSDDIGKIEVSSGEENEQVVFSHRAEIYRYDKDVGQWKERGIGDIKILQNYDNKQVRIVMRRDQVLKLCANHRITPDMSLQNMKGTERVWVWTACDFADGERKVEHLAVRFKLQDVADSFKKIFDEAKTAQEKDSLITPHVSRSSTPRESPCGKIAVAILEETTRERTDVIQGDDVADAASEVEVSSTSETTTKAVVSPPKFVFVSESVKRIFSSEKSKPFAFGNSSATGSLFGFSFNAPLKSNNSETSSVAQSGSESKVEPKKCELSKNSDIEQSSDSKVKNLSASFPTEESSINYTFKTPEKEPPLWHAEFTKEELVQKLRSTTKSADHLNGLLREIEATNAVLMEQIKLLKSEIRRLERNQEREKSAANLEYLKNVLLQFIFLKPGSERERLLPVINTMLQLSPEEKGKLAAVAQDEEENASRSSG

SEQ ID NO: 906162 - protein, 1655 aa, Homo sapiens
MRRSKADVERYVASVLGLTPSPRQKSMKGFYFAKLYYEAKEYDLAKKYICTYINVQERDPKAHRFLGLLYELEENTEKAVECYRRSVELNPTQKDLVLKIAELLCKNDVTDGRAKYWVERAAKLFPGSPAIYKLKEQLLDCEGEDGWNKLFDLIQSELYVRPDDVHVNIRLVELYRSTKRLKDAVAHCHEAERNIALRSSLEWNSCVVQTLKEYLESLQCLESDKSDWQATNTDLLLAYANLMLLTLSTRDVQENRELLESFDSALQSAKSSLGGNDELSATFLEMKGHFYMYAGSLLLKMGQHGNNVQWRALSELAALCYLIAFQVPRPKIKLREGKAGQNLLEMMACDRLSQSGHMLLSLSRGKQDFLKEVVETFANKIGQSALYDALFSSQSPKDTSFLGSDDIGKIDVQEPELEDLARYDVGAIRAHNGSLQHLTWLGLQWNSLPALPGIRKWLKQLFHRLPHETSRLETNAPESICILDLEVFLLGVVYTSHLQLKEKCNSHHSSYQPLCLPFPVCKQLCTERQKSWWDAVCTLIHRKAVPGNLAKLRLLVQHEINTLRAQEKHGLQPALLVHWAKYLQKTGSGLNSFYGQLEYIGRSVHYWKKVLPLLKIIKKNSIPEPIDPLFKHFHSVDIQASEIVEYEEDAHITFAMLDAVNGNIEDAVTAFESIKSVVSYWNLALIFHRKAEDIENDALSPEEQEECRNYLTKTRDYLIKIIDDGDSNLSVVKKLPVPLESVKQMLNSVMQELEDYSEGGPLYKNGSLRNADSEIKHSTPSPTKYSLSPSKSYKYSPETPPRWTEDRNSLLNMICQQVEAIKKEMQELKLNSSKSASRHRWPTENYGPDSVPDGYQGSQTFHGAPLTVATTGPSVYYSQSPAYNSQYLLRPAANVTPTKGSSNTEFKSTKEGFSIPVSADGFKFGISEPGNQEKKREKPLENDTGFQAQDISGRKKGRGVIFGQTSSTFTFADVAKSTSGEGFQFGKKDLNFKGFSGAGEKLFSSRYGKMANKANTSGDFEKDDDAYKTEDSDDIHFEPVVQMPEKVELVTGEEGEKVLYSQGVKLFRFDAEVRQWKERGLGNLKILKNEVNGKLRMLMRREQVLKVCANHWITTTMNLKPLSGSDRAWMWSASDFSDGDAKLERLAAKFKTPELAEEFKQKFEECQRLLLDIPLQTPHKLVDTGRAAKLIQRAEEMKSGLKDFKTFLTNDQTKVTEEENKGSGTGVAGASDTTIKPNAENTGPTLEWDNYDLREDALDDSVSSSSVHASPLASSPVRKNLFRFDESTTGSNFSFKSALSLSKSPAKLNQSGTSVGTDEESVVTQEEERDGQYFEPVVPLPDLVEVSSGEENEQVVFSHRAEIYRYDKDVGQWKERGIGDIKILQNYDNKQVRIVMRRDQVLKLCANHRITPDMSLQNMKGTERVWVWTACDFADGERKVEHLAVRFKLQDVADSFKKIFDEAKTAQEKDSLITPHVSRSSTPRESPCGKIAVAILEETTRERTDVIQGDDVADAASEVEVSSTSETTTKAVVSPPKFVFVSESVKRIFSSEKSKPFAFGNSSATGSLFGFSFNAPLKSNNSETSSVAQSGSESKVEPKKCELSKNSDIEQSSDSKVKNLSASFPTEESSINYTFKTPEKGRYFVVKVKHNFSFF

SEQ ID NO: 906163 - protein, 213 aa, Homo sapiens
MRRSKADVERYVASVLGLTPSPRQKSMKGFYFAKLYYEAKEYDLAKKYICTYINVQERDPKAHRFLGLLYELEENTEKAVECYRRSVELNPTQKDLVLKIAELLCKNDVTDGRAKYWVERAAKLFPGSPAIYKLKEQLLDCEGEDGWNKLFDLIQSELYVRPDDVHVNIRLVELYRSTKRLKDAVAHCHEAERNIALRSSLEWNSCVVQTLKF

SEQ ID NO: 906164 - protein, 567 aa, Homo sapiens
MGRGLLRGLWPLHIVLWTRIASTIPPHVQKSVNNDMIVTDNNGAVKFPQLCKFCDVRFSTCDNQKSCMSNCSITSICEKPQEVCVAVWRKNDENITLETVCHDPKLPYHDFILEDAASPKCIMKEKKKPGETFFMCSCSSDECNDNIIFSEEYNTSNPDLLLVIFQVTGISLLPPLGVAISVIIIFYCYRVNRQQKLSSTWETGKTRKLMEFSEHCAIILEDDRSDISSTCANNINHNTELLPIELDTLVGKGRFAEVYKAKLKQNTSEQFETVAVKIFPYEEYASWKTEKDIFSDINLKHENILQFLTAEERKTELGKQYWLITAFHAKGNLQEYLTRHVISWEDLRKLGSSLARGIAHLHSDHTPCGRPKMPIVHRDLKSSNILVKNDLTCCLCDFGLSLRLDPTLSVDDLANSGQVGTARYMAPEVLESRMNLENVESFKQTDVYSMALVLWEMTSRCNAVGEVKDYEPPFGSKVREHPCVESMKDNVLRDRGRPEIPSFWLNHQGIQMVCETLTECWDHDPEARLTAQCVAERFSELEHLDRLSGRSCSEEKIPEDGSLNTTK

SEQ ID NO: 906165 - protein, 478 aa, Homo sapiens
MILPLHNLGNGVRSHNFSFLYFILEDAASPKCIMKEKKKPGETFFMCSCSSDECNDNIIFSEEYNTSNPDLLLVIFQVTGISLLPPLGVAISVIIIFYCYRVNRQQKLSSTWETGKTRKLMEFSEHCAIILEDDRSDISSTCANNINHNTELLPIELDTLVGKGRFAEVYKAKLKQNTSEQFETVAVKIFPYEEYASWKTEKDIFSDINLKHENILQFLTAEERKTELGKQYWLITAFHAKGNLQEYLTRHVISWEDLRKLGSSLARGIAHLHSDHTPCGRPKMPIVHRDLKSSNILVKNDLTCCLCDFGLSLRLDPTLSVDDLANSGQVGTARYMAPEVLESRMNLENVESFKQTDVYSMALVLWEMTSRCNAVGEVKDYEPPFGSKVREHPCVESMKDNVLRDRGRPEIPSFWLNHQGIQMVCETLTECWDHDPEARLTAQCVAERFSELEHLDRLSGRSCSEEKIPEDGSLNTTK

SEQ ID NO: 906166 - protein, 547 aa, Homo sapiens
MGRGLLRGLWPLHIVLWTRIASTIPPHVQKSVNNDMIVTDNNGAVKFPQLCKFCDVRFSTCDNQKSCMSNCSITSICEKPQEVCVAVWRKNDENITLETVCHDPKLPYHDFILEDAASPKCIMKEKKKPGEKYNTSNPDLLLVIFQVTGISLLPPLGVAISVIIIFYCYRVNRQQKLSSTWETGKTRKLMEFSEHCAIILEDDRSDISSTCANNINHNTELLPIELDTLVGKGRFAEVYKAKLKQNTSEQFETVAVKIFPYEEYASWKTEKDIFSDINLKHENILQFLTAEERKTELGKQYWLITAFHAKGNLQEYLTRHVISWEDLRKLGSSLARGIAHLHSDHTPCGRPKMPIVHRDLKSSNILVKNDLTCCLCDFGLSLRLDPTLSVDDLANSGQVGTARYMAPEVLESRMNLENVESFKQTDVYSMALVLWEMTSRCNAVGEVKDYEPPFGSKVREHPCVESMKDNVLRDRGRPEIPSFWLNHQGIQMVCETLTECWDHDPEARLTAQCVAERFSELEHLDRLSGRSCSEEKIPEDGSLNTTK

SEQ ID NO: 906167 - protein, 567 aa, Homo sapiens; identical to SEQ ID NO: 906164

SEQ ID NO: 906168 - protein, 340 aa, Homo sapiens
SSRISVMLSPNTELLPIELDTLVGKGRFAEVYKAKLKQNTSEQFETVAVKIFPYEEYASWKTEKDIFSDINLKHENILQFLTAEERKTELGKQYWLITAFHAKGNLQEYLTRHVISWEDLRKLGSSLARGIAHLHSDHTPCGRPKMPIVHRDLKSSNILVKNDLTCCLCDFGLSLRLDPTLSVDDLANSGQVGTARYMAPEVLESRMNLENVESFKQTDVYSMALVLWEMTSRCNAVGEVKDYEPPFGSKVREHPCVESMKDNVLRDRGRPEIPSFWLNHQGIQMVCETLTECWDHDPEARLTAQCVAERFSELEHLDRLSGRSCSEEKIPEDGSLNTTK

SEQ ID NO: 906169 - protein, 567 aa, Homo sapiens; identical to SEQ ID NO: 906164

SEQ ID NO: 906170 - protein, 567 aa, Homo sapiens; identical to SEQ ID NO: 906164

SEQ ID NO: 906171 - protein, 592 aa, Homo sapiens
MGRGLLRGLWPLHIVLWTRIASTIPPHVQKSDVEMEAQKDEIICPSCNRTAHPLRHINNDMIVTDNNGAVKFPQLCKFCDVRFSTCDNQKSCMSNCSITSICEKPQEVCVAVWRKNDENITLETVCHDPKLPYHDFILEDAASPKCIMKEKKKPGETFFMCSCSSDECNDNIIFSEEYNTSNPDLLLVIFQVTGISLLPPLGVAISVIIIFYCYRVNRQQKLSSTWETGKTRKLMEFSEHCAIILEDDRSDISSTCANNINHNTELLPIELDTLVGKGRFAEVYKAKLKQNTSEQFETVAVKIFPYEEYASWKTEKDIFSDINLKHENILQFLTAEERKTELGKQYWLITAFHAKGNLQEYLTRHVISWEDLRKLGSSLARGIAHLHSDHTPCGRPKMPIVHRDLKSSNILVKNDLTCCLCDFGLSLRLDPTLSVDDLANSGQVGTARYMAPEVLESRMNLENVESFKQTDVYSMALVLWEMTSRCNAVGEVKDYEPPFGSKVREHPCVESMKDNVLRDRGRPEIPSFWLNHQGIQMVCETLTECWDHDPEARLTAQCVAERFSELEHLDRLSGRSCSEEKIPEDGSLNTTK

SEQ ID NO: 906172 - protein, 451 aa, Homo sapiens
RCKIRHIGSNNRLQRSTCQNTGWESAHVMKTPGFREYNTSNPDLLLVIFQVTGISLLPPLGVAISVIIIFYCYRVNRQQKLSSTWETGKTRKLMEFSEHCAIILEDDRSDISSTCANNINHNTELLPIELDTLVGKGRFAEVYKAKLKQNTSEQFETVAVKIFPYEEYASWKTEKDIFSDINLKHENILQFLTAEERKTELGKQYWLITAFHAKGNLQEYLTRHVISWEDLRKLGSSLARGIAHLHSDHTPCGRPKMPIVHRDLKSSNILVKNDLTCCLCDFGLSLRLDPTLSVDDLANSGQVGTARYMAPEVLESRMNLENVESFKQTDVYSMALVLWEMTSRCNAVGEVKDYEPPFGSKVREHPCVESMKDNVLRDRGRPEIPSFWLNHQGIQMVCETLTECWDHDPEARLTAQCVAERFSELEHLDRLSGRSCSEEKIPEDGSLNTTK

SEQ ID NO: 906173 - protein, 134 aa, Homo sapiens
MNLENVESFKQTDVYSMALVLWEMTSRCNAVGEVKDYEPPFGSKVREHPCVESMKDNVLRDRGRPEIPSFWLNHQGIQMVCETLTECWDHDPEARLTAQCVAERFSELEHLDRLSGRSCSEEKIPEDGSLNTTK

SEQ ID NO: 906174 - protein, 176 aa, Homo sapiens
MGRGLLRGLWPLHIVLWTRIASTIPPHVQKSVNNDMIVTDNNGAVKFPQLCKFCDVRFSTCDNQKSCMSNCSITSICEKPQEVCVAVWRKNDENITLETVCHDPKLPYHDFILEDAASPKCIMKEKKKPGETFFMCSCSSDECNDNIIFSEGEFSSLKGVGPEICANFLYPWSAVS

SEQ ID NO: 906175 - protein, 123 aa, Homo sapiens
RRVRSQHGHGLARRPPGPESPAPRFVAPRRRGGLDGADGADGRAGGMEAAHLLPAADVLRHFSVTAEGGLSPAQVTGARERYGPNGKSLWELVLEQFEDLLVRILLLAALVSFVSRALPAILW

SEQ ID NO: 906176 - protein, 1045 aa, Homo sapiens
RRVRSQHGHGLARRPPGPESPAPRFVAPRRRGGLDGADGADGRAGGMEAAHLLPAADVLRHFSVTAEGGLSPAQVTGARERYGPNELPSEEGKSLWELVLEQFEDLLVRILLLAALVSFVLAWFEEGEETTTAFVEPLVIMLILVANAIVGVWQERNAESAIEALKEYEPEMGKVIRSDRKGVQRIRARDIVPGDIVEVAVGDKVPADLRLIEIKSTTLRVDQSILTGESVSVTKHTEAIPDPRAVNQDKKNMLFSGTNITSGKAVGVAVATGLHTELGKIRSQMAAVEPERTPLQRKLDEFGRQLSHAISVICVAVWVINIGHFADPAHGGSWLRGAVYYFKIAVALAVAAIPEGLPAVITTCLALGTRRMARKNAIVRSLPSVETLGCTSVICSDKTGTLTTNQMSVCRMFVVAEADAGSCLLHEFTISGTTYTPEGEVRQGDQPVRCGQFDGLVELATICALCNDSALDYNEAKGVYEKVGEATETALTCLVEKMNVFDTDLQALSRVERAGACNTVIKQLMRKEFTLEFSRDRKSMSVYCTPTRPHPTGQGSKMFVKGAPESVIERCSSVRVGSRTAPLTPTSREQILAKIRDWGSGSDTLRCLALATRDAPPRKEDMELDDCSKFVQYETDLTFVGCVGMLDPPRPEVAACITRCYQAGIRVVMITGDNKGTAVAICRRLGIFGDTEDVAGKAYTGREFDDLSPEQQRQACRTARCFARVEPAHKSRIVENLQSFNEITAMTGDGVNDAPALKKAEIGIAMGSGTAVAKSAAEMVLSDDNFASIVAAVEEGRAIYSNMKQFIRYLISSNVGEVVCIFLTAILGLPEALIPVQLLWVNLVTDGLPATALGFNPPDLDIMEKLPRSPREALISGWLFFRYLAIGVYVGLATVAAATWWFVYDAEGPHINFYQLRNFLKCSEDNPLFAGIDCEVFESRFPTTMALSVLVTIEMCNALNSVSENQSLLRMPPWMNPWLLVAVAMSMALHFLILLVPPLPLIFQVTPLSGRQWVVVLQISLPVILLDEALKYLSRNHMHEEMSQK

SEQ ID NO: 906177 - protein, 1064 aa, Homo sapiens
RRVRSQHGHGLARRPPGPESPAPRFVAPRRRGGLDGADGADGRAGGMEAAHLLPAADVLRHFSVTAEGGLSPAQVTGARERYGPNELPSEEGKSLWELVLEQFEDLLVRILLLAALVSFVLAWFEEGEETTTAFVEPLVIMLILVANAIVGVWQERNAESAIEALKEYEPEMGKVIRSDRKGVQRIRARDIVPGDIVEVAVGDKVPADLRLIEIKSTTLRVDQSILTGESVSVTKHTEAIPDPRAVNQDKKNMLFSGTNITSGKAVGVAVATGLHTELGKIRSQMAAVEPERTPLQRKLDEFGRQLSHAISVICVAVWVINIGHFADPAHGGSWLRGAVYYFKIAVALAVAAIPEGLPAVITTCLALGTRRMARKNAIVRSLPSVETLGCTSVICSDKTGTLTTNQMSVCRMFVVAEADAGSCLLHEFTISGTTYTPEGEVRQGDQPVRCGQFDGLVELATICALCNDSALDYNEAKGVYEKVGEATETALTCLVEKMNVFDTDLQALSRVERAGACNTVIKQLMRKEFTLEFSRDRKSMSVYCTPTRPHPTGQGSKMFVKGAPESVIERCSSVRVGSRTAPLTPTSREQILAKIRDWGSGSDTLRCLALATRDAPPRKEDMELDDCSKFVQYETDLTFVGCVGMLDPPRPEVAACITRCYQAGIRVVMITGDNKGTAVAICRRLGIFGDTEDVAGKAYTGREFDDLSPEQQRQACRTARCFARVEPAHKSRIVENLQSFNEITAMTGDGVNDAPALKKAEIGIAMGSGTAVAKSAAEMVLSDDNFASIVAAVEEGRAIYSNMKQFIRYLISSNVGEVVCIFLTAILGLPEALIPVQLLWVNLVTDGLPATALGFNPPDLDIMEKLPRSPREALISGWLFFRYLAIGVYVGLATVAAATWWFVYDAEGPHINFYQLRNFLKCSEDNPLFAGIDCEVFESRFPTTMALSVLVTIEMCNALNSVSENQSLLRMPPWMNPWLLVAVAMSMALHFLILLVPPLPVSHPACPTALVPGHHRPWAGHWTSLAPLQWKLPGGEGAHFPGDPTERAPVGGGAPDISACHPAG

SEQ ID NO: 906178 - protein, 632 aa, Homo sapiens
RRVRSQHGHGLARRPPGPESPAPRFVAPRRRGGLDGADGADGRAGGMEAAHLLPAADVLRHFSVTAEGGLSPAQVTGARERYGPNELPSEEGKSLWELVLEQFEDLLVRILLLAALVSFVLAWFEEGEETTTAFVEPLVIMLILVANAIVGVWQERNAESAIEALKEYEPEMGKVIRSDRKGVQRIRARDIVPGDIVEVAVGDKVPADLRLIEIKSTTLRVDQSILTGESVSVTKHTEAIPDPRAVNQDKKNMLFSGTNITSGKAVGVAVATGLHTELGKIRSQMAAVEPERTPLQRKLDEFGRQLSHAISVICVAVWVINIGHFADPAHGGSWLRGAVYYFKIAVALAVAAIPEGLPAVITTCLALGTRRMARKNAIVRSLPSVETLGCTSVICSDKTGTLTTNQMSVCRMFVVAEADAGSCLLHEFTISGTTYTPEGEVRQGDQPVRCGQFDGLVELATICALCNDSALDSTVYVGLATVAAATWWFVYDAEGPHINFYQLRNFLKCSEDNPLFAGIDCEVFESRFPTTMALSVLVTIEMCNALNSVSENQSLLRMPPWMNPWLLVAVAMSMALHFLILLVPPLPLIFQVTPLSGRQWVVVLQISLPVILLDEALKYLSRNHMHEEMSQK

SEQ ID NO: 906179 - protein, 1045 aa, Homo sapiens; identical to SEQ ID NO: 906176

SEQ ID NO: 906180 - protein, 269 aa, Homo sapiens
MVPMCSPPPPTLATTLAHLPTGSRRINDRPEVRMAIPGPRPGVSVPTSFWPGRSVIPVSWTLLGSSLLCSSGPGAAGWEGAAKKPELAAYPEIRGPPTPKSRVQLELAPPCSEAGRSLGDWCLCTDGGLWGSFLPALTSLFVPGLGLGQPWGIRRGHLGPAVYSEGGQPPPLHSASTKSAPESSRLLLFICAGPGRVKGQRDGHKEPAGGRSEDVLSRETSRESLAGLPQPRAPPGLRVPRPELGRCSESHCRPVCHAEVQLATRVPGT

SEQ ID NO: 906181 - protein, 1045 aa, Homo sapiens; identical to SEQ ID NO: 906176

SEQ ID NO: 906182 - protein, 302 aa, Homo sapiens
RRVRSQHGHGLARRPPGPESPAPRFVAPRRRGGLDGADGADGRAGGMEAAHLLPAADVLRHFSVTAEGGLSPAQVTGARERYGPNELPSEEGKSLWELVLEQFEDLLVRILLLAALVSFVLAWFEEGEETTTAFVEPLVIMLILVANAIVGVWQERNAESAIEALKEYEPEMGKVIRSDRKGVQRIRARDIVPGDIVEVAVGDKVPADLRLSPARLLDSGFPVLSSGDVQSHTAARSATQRSNLPPASLVPETTDILRFLTVAPFYPAQCAAAALSAQLGASEPGGLPGLLASLLAPSPRHP

SEQ ID NO: 906183 - protein, 110 aa, Homo sapiens
LQALGPRVWQMLIDQPGPTTGIEGRCLQTTGLREEKGGSLQGIQGIIRQGKQTPENHRHSLQPVSSLPRMYVGLATVAAATWWFVYDAEGPHINFYQLVSKGWPGSLLNL

SEQ ID NO: 906184 - protein, 1045 aa, Homo sapiens; identical to SEQ ID NO: 906176

SEQ ID NO: 906185 - protein, 1145 aa, Homo sapiens
RRVRSQHGHGLARRPPGPESPAPRFVAPRRRGGLDGADGADGRAGGMEAAHLLPAADVLRHFSVTAEGGLSPAQVTGARERYGPNELPSEEGKSLWELVLEQFEDLLVRILLLAALVSFVLAWFEEGEETTTAFVEPLVIMLILVANAIVGVWQERNAESAIEALKEYEPEMGKVIRSDRKGVQRIRARDIVPGDIVEVAVGDKVPADLRLIEIKSTTLRVDQSILTGESVSVTKHTEAIPDPRAVNQDKKNMLFSGTNITSGKAVGVAVATGLHTELGKIRSQMAAVEPERTPLQRKLDEFGRQLSHAISVICVAVWVINIGHFADPAHGGSWLRGAVYYFKIAVALAVAAIPEGLPAVITTCLALGTRRMARKNAIVRSLPSVETLGCTSVICSDKTGTLTTNQMSVCRMFVVAEADAGSCLLHEFTISGTTYTPEGEVRQGDQPVRCGQFDGLVELATICALCNDSALDYNEAKGVYEKVGEATETALTCLVEKMNVFDTDLQALSRVERAGACNTVIKQLMRKEFTLEFSRDRKSMSVYCTPTRPHPTGQGSKMFVKGAPESVIERCSSVRVGSRTAPLTPTSREQILAKIRDWGSGSDTLRCLALATRDAPPRKEDMELDDCSKFVQYETDLTFVGCVGMLDPPRPEVAACITRCYQAGIRVVMITGDNKGTAVAICRRLGIFGDTEDVAGKAYTGREFDDLSPEQQRQACRTARCFARVEPAHKSRIVENLQSFNEITAMTGDGVNDAPALKKAEIGIAMGSGTAVAKSAAEMVLSDDNFASIVAAVEEGRAIYSNMKQFIRYLISSNVGEVVCIFLTAILGLPEALIPVQLLWVNLVTDGLPATALGFNPPDLDIMEKLPRSPREALISGWLFFRYLAIGVYVGLATVAAATWWFVYDAEGPHINFYQLRNFLKCSEDNPLFAGIDCEVFESRFPTTMALSVLVTIEMCNALNSVSENQSLLRMPPWMNPWLLVAVAMSMALHFLILLVPPLPLIFQVTPLSGRQWVVVLQISLPVILLDEALKYLSRNHMHGEWEAPSRLQPASPPASAPGLQWTLWVWSAEPLCLHIGEAFSDHQVEGVKGLWWLGPKVSAGSCTAGDLGSLGQQREHLLGHTASLSSPATPYMARALCALLGLSL

SEQ ID NO: 906186 - protein, 870 aa, Homo sapiens
GPPSKIRPLGRIRLGTSSHGHGEVAVGDKVPADLRLIEIKSTTLRVDQSILTGESVSVTKHTEAIPDPRAVNQDKKNMLFSGTNITSGKAVGVAVATGLHTELGKIRSQMAAVEPERTPLQRKLDEFGRQLSHAISVICVAVWVINIGHFADPAHGGSWLRGAVYYFKIAVALAVAAIPEGLPAVITTCLALGTRRMARKNAIVRSLPSVETLGCTSVICSDKTGTLTTNQMSVCRMFVVAEADAGSCLLHEFTISGTTYTPEGEVRQGDQPVRCGQFDGLVELATICALCNDSALDYNEAKGVYEKVGEATETALTCLVEKMNVFDTDLQALSRVERAGACNTVIKQLMRKEFTLEFSRDRKSMSVYCTPTRPHPTGQGSKMFVKGAPESVIERCSSVRVGSRTAPLTPTSREQILAKIRDWGSGSDTLRCLALATRDAPPRKEDMELDDCSKFVQYETDLTFVGCVGMLDPPRPEVAACITRCYQAGIRVVMITGDNKGTAVAICRRLGIFGDTEDVAGKAYTGREFDDLSPEQQRQACRTARCFARVEPAHKSRIVENLQSFNEITAMTGDGVNDAPALKKAEIGIAMGSGTAVAKSAAEMVLSDDNFASIVAAVEEGRAIYSNMKQFIRYLISSNVGEVVCIFLTAILGLPEALIPVQLLWVNLVTDGLPATALGFNPPDLDIMEKLPRSPREALISGWLFFRYLAIGVYVGLATVAAATWWFVYDAEGPHINFYQLRNFLKCSEDNPLFAGIDCEVFESRFPTTMALSVLVTIEMCNALNSVSENQSLLRMPPWMNPWLLVAVAMSMALHFLILLVPPLPLIFQVTPLSGRQWVVVLQISLPVILLDEALKYLSRNHMHEEMSQK

SEQ ID NO: 906187 - protein, 183 aa, Homo sapiens [sequence omitted]

SEQ ID NO: 906188 - protein, 1072 aa, Homo sapiens
RRVRSQHGHGLARRPPGPESPAPRFVAPRRRGGLDGADGADGRAGGMEAAHLLPAADVLRHFSVTAEGGLSPAQVTGARERYGPNELPSEEGKSLWELVLEQFEDLLVRILLLAALVSFVLAWFEEGEETTTAFVEPLVIMLILVANAIVGVWQERNAESAIEALKEYEPEMGKVIRSDRKGVQRIRARDIVPGDIVEVAVGDKVPADLRLIEIKSTTLRVDQSILTGESVSVTKHTEAIPDPRAVNQDKKNMLFSGTNITSGKAVGVAVATGLHTELGKIRSQMAAVEPERTPLQRKLDEFGRQLSHAISVICVAVWVINIGHFADPAHGGSWLRGAVYYFKIAVALAVAAIPEGLPAVITTCLALGTRRMARKNAIVRSLPSVETLGCTSVICSDKTGTLTTNQMSVCRMFVVAEADAGSCLLHEFTISGTTYTPEGEVRQGDQPVRCGQFDGLVELATICALCNDSALDYNEAKGVYEKVGEATETALTCLVEKMNVFDTDLQALSRVERAGACNTVIKQLMRKEFTLEFSRDRKSMSVYCTPTRPHPTGQGSKMFVKGAPESVIERCSSVRVGSRTAPLTPTSREQILAKIRDWGSGSDTLRCLALATRDAPPRKEDMELDDCSKFVQYETDLTFVGCVGMLDPPRPEVAACITRCYQAGIRVVMITGDNKGTAVAICRRLGIFGDTEDVAGKAYTGREFDDLSPEQQRQACRTARCFARVEPAHKSRIVENLQSFNEITAMTGDGVNDAPALKKAEIGIAMGSGTAVAKSAAEMVLSDDNFASIVAAVEEGRAIYSNMKQFIRYLISSNVGEVVCIFLTAILGLPEALIPVQLLWVNLVTDGLPATALGFNPPDLDIMEKLPRSPREALISGWLFFRYLAIGVYVGLATVAAATWWFVYDAEGPHINFYQLRNFLKCSEDNPLFAGIDCEVFESRFPTTMALSVLVTIEMCNALNSVSENQSLLRMPPWMNPWLLVAVAMSMALHFLILLVPPLPLIFQVTPLSGRQWVVVLQISLPVILLDEALKYLSRNHMHACLYPGLLRTVSQAWSRQPLTTSWTPDHTGLKK

SEQ ID NO: 906189 - protein, 940 aa, Homo sapiens
RRVRSQHGHGLARRPPGPESPAPRFVAPRRRGGLDGADGADGRAGGMEAAHLLPAADVLRHFSVTAEGGLSPAQVTGARERYGPNELPSEEGKSLWELVLEQFEDLLVRILLLAALVSFVLAWFEEGEETTTAFVEPLVIMLILVANAIVGVWQERNAESAIEALKEYEPEMGKVIRSDRKGVQRIRARDIVPGDIVEVAVGDKVPADLRLIEIKSTTLRVDQSILTGESVSVTKHTEAIPDPRAVNQDKKNMLFSGTNITSGKAVGVAVATGLHTELGKIRSQMAAVEPERTPLQRKLDEFGRQLSHAISVICVAVWVINIGHFADPAHGGSWLRGAVYYFKIAVALAVAAIPEGLPAVITTCLALGTRRMARKNAIVRSLPSVETLGCTSVICSDKTGTLTTNQMSVCRMFVVAEADAGSCLLHEFTISGTTYTPEGEVRQGDQPVRCGQFDGLVELATICALCNDSALDYNEAKGVYEKVGEATETALTCLVEKMNVFDTDLQALSRVERAGACNTVIKQLMRKEFTLEFSRDRKSMSVYCTPTRPHPTGQGSKMFVKGAPESVIERCSSVRVGSRTAPLTPTSREQILAKIRDWGSGSDTLRCLALATRDAPPRKEDMELDDCSKFVQYETDLTFVGCVGMLDPPRPEVAACITRCYQAGIRVVMITGDNKGTAVAICRRLGIFGDTEDVAGKAYTGREFDDLSPEQQRQACRTARCFARVEPAHKSRIVENLQSFNEITAMTGDGVNDAPALKKAEIGIAMGSGTAVAKSAAEMVLSDDNFASIVAAVEEGRAIYSNMKQFIRYLISSNVGEVVCIFLTAILGLPEALIPVQLLWVNLVTDGLPATALGFNPPDLDIMEKLPRSPREALISGWLFFRYLAIGVYVGLATVAAATWWFVYDAEGPHINFYQLVSKGWPGSLLNLQLELLEFQGRWV

SEQ ID NO: 906190 - protein, 820 aa, Homo sapiens
RRVRSQHGHGLARRPPGPESPAPRFVAPRRRGGLDGADGADGRAGGMEAAHLLPAADVLRHFSVTAEGGLSPAQVTGARERYGPNELPSEEGKSLWELVLEQFEDLLVRILLLAALVSFVLAWFEEGEETTTAFVEPLVIMLILVANAIVGVWQERNAESAIEALKEYEPEMGKVIRSDRKGVQRIRARDIVPGDIVEVAVGDKVPADLRLIEIKSTTLRVDQSILTGESVSVTKHTEAIPDPRAVNQDKKNMLFSGTNITSGKAVGVAVATGLHTELGKIRSQMAAVEPERTPLQRKLDEFGRQLSHAISVICVAVWVINIGHFADPAHGGSWLRGAVYYFKIAVALAVAAIPEGLPAVITTCLALGTRRMARKNAIVRSLPSVETLGCTSVICSDKTGTLTTNQMSVCRMFVVAEADAGSCLLHEFTISGTTYTPEGEVRQGDQPVRCGQFDGLVELATICALCNDSALDYNEAKGVYEKVGEATETALTCLVEKMNVFDTDLQALSRVERAGACNTVIKQLMRKEFTLEFSRDRKSMSVYCTPTRPHPTGQGSKMFVKGAPESVIERCSSVRVGSRTAPLTPTSREQILAKIRDWGSGSDTLRCLALATRDAPPRKEDMELDDCSKFVQYETDLTFVGCVGMLDPPRPEVAACITRCYQAGIRVVMITGDNKGTAVAICRRLGIFGDTEDVAGKAYTGREFDDLSPEQQRQACRTARCFARVEPAHKSRIVENLQSFNEITAMTGDGVNDAPALKKAEIGIAMGSGTAVAKSAAEMVLSDDNFASIVAAVEEGRAIYSNMKQFIRYLISSNVGEVVW

SEQ ID NO: 906191 - protein, 453 aa, Homo sapiens
CDFPFRIPRYILGTGGPVWLLYRRITGGGIHTAQNSWILLSLCQGKIPWRRPCSDMEGAALLRVSVLCIWMSALFLGVGVRAEEAGARVQQNVPSGTDTGDPQSKPLGDWAAGTMDPESSIFIEDAIKYFKEKVSTQNLLLLLTDNEAWNGFVAAAELPRNEADELRKALDNLARQMIMKDKNWHDKGQQYRNWFLKEFPRLKSKLEDNIRRLRALADGVQKVHKGTTIANVVSGSLSISSGILTLVGMGLAPFTEGGSLVLLEPGMELGITAALTGITSSTIDYGKKWWTQAQAHDLVIKSLDKLKEVKEFLGENISNFLSLAGNTYQLTRGIGKDIRALRRARANLQSVPHASASRPRVTEPISAESGEQVERVNEPSILEMSRGVKLTDVAPVSFFLVLDVVYLVYESKHLHEGAKSETAEELKKVAQELEEKLNILNNNYKILQADQEL

SEQ ID NO: 906192 - protein, 454 aa, Homo sapiens
HTVLGSEAARYILGTGGPVWLLYRRITGGGIHTAQNSWILLSLCQGKIPWRRPCSDMEGAALLRVSVLCIWMSALFLGVGVRAEEAGARVQQNVPSGTDTGDPQSKPLGDWAAGTMDPESSIFIEDAIKYFKEKVSTQNLLLLLTDNEAWNGFVAAAELPRNEADELRKALDNLARQMIMKDKNWHDKGQQYRNWFLKEFPRLKSKLEDNIRRLRALADGVQKVHKGTTIANVVSGSLSISSGILTLVGMGLAPFTEGGSLVLLEPGMELGITAALTGITSSTIDYGKKWWTQAQAHDLVIKSLDKLKEVKEFLGENISNFLSLAGNTYQLTRGIGKDIRALRRARANLQSVPHASASRPRVTEPISAESGEQVERVNEPSILEMSRGVKLTDVAPVSFFLVLDVVYLVYESKHLHEGAKSETAEELKKVAQELEEKLNILNNNYKILQADQEL

SEQ ID NO: 906193 - protein, 454 aa, Homo sapiens; identical to SEQ ID NO: 906192

SEQ ID NO: 906194 - protein, 454 aa, Homo sapiens; identical to SEQ ID NO: 906192

SEQ ID NO: 906195 - protein, 454 aa, Homo sapiens; identical to SEQ ID NO: 906192

SEQ ID NO: 906196 - protein, 357 aa, Homo sapiens
MQWLLCTPTLSSNLILSSFQLESSIFIEDAIKYFKEKVSTQNLLLLLTDNEAWNGFVAAAELPRNEADELRKALDNLARQMIMKDKNWHDKGQQYRNWFLKEFPRLKSKLEDNIRRLRALADGVQKVHKGTTIANVVSGSLSISSGILTLVGMGLAPFTEGGSLVLLEPGMELGITAALTGITSSTIDYGKKWWTQAQAHDLVIKSLDKLKEVKEFLGENISNFLSLAGNTYQLTRGIGKDIRALRRARANLQSVPHASASRPRVTEPISAESGEQVERVNEPSILEMSRGVKLTDVAPVSFFLVLDVVYLVYESKHLHEGAKSETAEELKKVAQELEEKLNILNNNYKILQADQEL

SEQ ID NO: 906197 - protein, 137 aa, Homo sapiens
MEDLGISAGNTYQLTRGIGKDIRALRRARANLQSVPHASASRPRVTEPISAESGEQVERVNEPSILEMSRGVKLTDVAPVSFFLVLDVVYLVYESKHLHEGAKSETAEELKKVAQELEEKLNILNNNYKILQADQEL

SEQ ID NO: 906198 - protein, 414 aa, Homo sapiens [sequence omitted]

SEQ ID NO: 906199 - protein, 454 aa, Homo sapiens; identical to SEQ ID NO: 906192

SEQ ID NO: 906200 - protein, 454 aa, Homo sapiens; identical to SEQ ID NO: 906192

SEQ ID NO: 906201 - protein, 398 aa, Homo sapiens
MEGAALLRVSVLCIWMSALFLGVGVRAEEAGARVQQNVPSGTDTGDPQSKPLGDWAAGTMDPESSIFIEDAIKYFKEKVSTQNLLLLLTDNEAWNGFVAAAELPRNEADELRKALDNLARQMIMKDKNWHDKGQQYRNWFLKEFPRLKSKLEDNIRRLRALADGVQKVHKGTTIANVVSGSLSISSGILTLVGMGLAPFTEGGSLVLLEPGMELGITAALTGITSSTIDYGKKWWTQAQAHDLVIKSLDKLKEVKEFLGENISNFLSLAGNTYQLTRGIGKDIRALRRARANLQSVPHASASRPRVTEPISAESGEQVERVNEPSILEMSRGVKLTDVAPVSFFLVLDVVYLVYESKHLHEGAKSETAEELKKVAQELEEKLNILNNNYKILQADQEL

SEQ ID NO: 906202 - protein, 188 aa, Homo sapiens
HTVLGSEAARYILGTGGPVWLLYRRITGGGIHTAQNSWILLSLCQGKIPWRRPCSDMEGAALLRVSVLCIWMSALFLGVGVRAEEAGARVQQNVPSGTDTGDPQSKPLGDWAAGTMDPESSIFIEDAIKYFKEKVSTQNLLLLLTDNEAWNGFVAAAELPRNEADELRKALDNELAVSRDIATALQPG

SEQ ID NO: 906203 - protein, 421 aa, Homo sapiens
MAAGFGRCCRVLRSISRFHWRSQHTKANRQREPGLGFSFEFTEQQKEFQATARKFAREEIIPVAAEYDKTGEYPVPLIRRAWELGLMNTHIPENCGGLGLGTFDACLISEELAYGCTGVQTAIEGNSLGQMPIIIAGNDQQKKKYLGRMTEEPLMCAYCVTEPGAGSDVAGIKTKAEKKGDEYIINGQKMWITNGGKANWYFLLARSDPDPKAPANKAFTGFIVEADTPGIQIGRKELNMGQRCSDTRGIVFEDVKVPKENVLIGDGAGFKVAMGAFDKTRPVVAAGAVGLAQRALDEATKYALERKTFGKLLVEHQAISFMLAEMAMKVELARMSYQRAAWEVDSGRRNTYYASIAKAFAGDIANQLATDAVQILGGNGFNTEYPVEKLMRDAKIYQIYEGTSQIQRLIVAREHIDKYKN

SEQ ID NO: 906204 - protein, 421 aa, Homo sapiens; identical to SEQ ID NO: 906203

SEQ ID NO: 906205 - protein, 385 aa, Homo sapiens
MLQEFTEQQKEFQATARKFAREEIIPVAAEYDKTGEYPVPLIRRAWELGLMNTHIPENCGGLGLGTFDACLISEELAYGCTGVQTAIEGNSLGQMPIIIAGNDQQKKKYLGRMTEEPLMCAYCVTEPGAGSDVAGIKTKAEKKGDEYIINGQKMWITNGGKANWYFLLARSDPDPKAPANKAFTGFIVEADTPGIQIGRKELNMGQRCSDTRGIVFEDVKVPKENVLIGDGAGFKVAMGAFDKTRPVVAAGAVGLAQRALDEATKYALERKTFGKLLVEHQAISFMLAEMAMKVELARMSYQRAAWEVDSGRRNTYYASIAKAFAGDIANQLATDAVQILGGNGFNTEYPVEKLMRDAKIYQIYEGTSQIQRLIVAREHIDKYKN

SEQ ID NO: 906206 - protein, 407 aa, Homo sapiens
MAAGFGRCCRVLRSISRFHWRSQHTKANRQREPGLGFSFEFTEQQKEFQATARKFAREEIIPVAAEYDKTGEMNTHIPENCGGLGLGTFDACLISEELAYGCTGVQTAIEGNSLGQMPIIIAGNDQQKKKYLGRMTEEPLMCAYCVTEPGAGSDVAGIKTKAEKKGDEYIINGQKMWITNGGKANWYFLLARSDPDPKAPANKAFTGFIVEADTPGIQIGRKELNMGQRCSDTRGIVFEDVKVPKENVLIGDGAGFKVAMGAFDKTRPVVAAGAVGLAQRALDEATKYALERKTFGKLLVEHQAISFMLAEMAMKVELARMSYQRAAWEVDSGRRNTYYASIAKAFAGDIANQLATDAVQILGGNGFNTEYPVEKLMRDAKIYQIYEGTSQIQRLIVAREHIDKYKN

SEQ ID NO: 906207 - protein, 291 aa, Homo sapiens
MPIIIAGNDQQKKKYLGRMTEEPLMCAYCVTEPGAGSDVAGIKTKAEKKGDEYIINGQKMWITNGGKANWYFLLARSDPDPKAPANKAFTGFIVEADTPGIQIGRKELNMGQRCSDTRGIVFEDVKVPKENVLIGDGAGFKVAMGAFDKTRPVVAAGAVGLAQRALDEATKYALERKTFGKLLVEHQAISFMLAEMAMKVELARMSYQRAAWEVDSGRRNTYYASIAKAFAGDIANQLATDAVQILGGNGFNTEYPVEKLMRDAKIYQIYEGTSQIQRLIVAREHIDKYKN

SEQ ID NO: 906208 - protein, 414 aa, Homo sapiens
MAAGFGRCCRVLRSISRFHWRSQHTKANRQREPGLGFSFEFTEQQKEFQATARKFAREEIIPVAAEYDKTGEYPVPLIRRAWELGLMNTHIPENCGGLGLGTFDACLISEELAYGCTGVQTAIEGNSLGQMPIIIAGNDQQKKKYLGRMTEEPLMCAYCVTEPGAGSDVAGIKTKAEKKGDEYIINGQKMWITNGGKANWYFLLARSDPDPKAPANKAFTGFIVEADTPGIQIGRKELNMGQRCSDTRGIVFEDVKVPKENVLIGDGAGFKVAMGAFDKTRPVVAAGAVGLAQRALDEATKYALERKTFGKLLVEHQAISFMLAEMAMKVELARMSYQRAAWEVDSGRRNTYYASIAKAFAGDIANQLATDAVQILGGNGFNTEYPVEKLMRDAKIYQVRLKMIFLVCKEREYS

SEQ ID NO: 906209 - protein, 421 aa, Homo sapiens; identical to SEQ ID NO: 906203

SEQ ID NO: 906210 - protein, 407 aa, Homo sapiens
MAAGFGRCCRVLRSISRFHWRSQHTKANRQREPGLGFSFEFTEQQKEFQATARKFAREEIIPVAAEYDKTGEYPVPLIRRAWELGLMNTHIPENCGGLGLGTFDACLISEELAYGCTGVQTAIEGNSLGQMPIIIAGNDQQKKKYLGRMTEEPLMCAYCVTEPGAGSDVAGIKTKAEKKGDEYIINGQKMWITNGGKANCANKAFTGFIVEADTPGIQIGRKELNMGQRCSDTRGIVFEDVKVPKENVLIGDGAGFKVAMGAFDKTRPVVAAGAVGLAQRALDEATKYALERKTFGKLLVEHQAISFMLAEMAMKVELARMSYQRAAWEVDSGRRNTYYASIAKAFAGDIANQLATDAVQILGGNGFNTEYPVEKLMRDAKIYQIYEGTSQIQRLIVAREHIDKYKN

SEQ ID NO: 906211 - protein, 201 aa, Homo sapiens
MAAGFGRCCRVLRSISRFHWRSQHTKANRQREPGLGFSFEFTEQQKEFQATARKFAREEIIPVAAEYDKTGEYPVPLIRRAWELGLMNTHIPENCGGLGLGTFDACLISEELAYGCTGVQTAIEGNSLGQMPIIIAGNDQQKKKYLGRMTEEPLMCAYCVTEPGAGSDVAGIKTKAEKKGDEYIINGQKMWITNGGKANWN

SEQ ID NO: 906212 - protein, 368 aa, Homo sapiens
MLQEFTEQQKEFQATARKFAREEIIPVAAEYDKTGEKHFDTVGGLGLGTFDACLISEELAYGCTGVQTAIEGNSLGQMPIIIAGNDQQKKKYLGRMTEEPLMCAYCVTEPGAGSDVAGIKTKAEKKGDEYIINGQKMWITNGGKANWYFLLARSDPDPKAPANKAFTGFIVEADTPGIQIGRKELNMGQRCSDTRGIVFEDVKVPKENVLIGDGAGFKVAMGAFDKTRPVVAAGAVGLAQRALDEATKYALERKTFGKLLVEHQAISFMLAEMAMKVELARMSYQRAAWEVDSGRRNTYYASIAKAFAGDIANQLATDAVQILGGNGFNTEYPVEKLMRDAKIYQIYEGTSQIQRLIVAREHIDKYKN

SEQ ID NO: 906213 - protein, 102 aa, Homo sapiens
MAAGFGRCCRVLRSISRFHWRSQHTKANRQREPGLGFSFEFTEQQKEFQATARKFAREEIIPVAAEYDKTGEYPVPLIRRAWELGLMNTHIPENCGKLSLYF

SEQ ID NO: 906214 - protein, 155 aa, Homo sapiens
KESLYHKKVLDYVICVCAASGVLFPNPRIGDHFNQFGHQENCQNEEILNSLKYVRPGGGYQPTFTLVQKCEVNGQNEHPVFAYLKDKLPYPYDDPFSLMTDPKLIIWSPVRRSDVAWNFEKFLIGPEGEPFRRYSRTFPTINIEPDIKRLLKVAI

SEQ ID NO: 906215 - protein, 126 aa, Homo sapiens
MTSVPSAWMGENCQNEEILNSLKYVRPGGGYQPTFTLVQKCEVNGQNEHPVFAYLKDKLPYPYDDPFSLMTDPKLIIWSPVRRSDVAWNFEKFLIGPEGEPFRRYSRTFPTINIEPDIKRLLKVAI

SEQ ID NO: 906216 - protein, 139 aa, Homo sapiens
AIAVFLRGLVVLGYTLIIYSRSEENCQNEEILNSLKYVRPGGGYQPTFTLVQKCEVNGQNEHPVFAYLKDKLPYPYDDPFSLMTDPKLIIWSPVRRSDVAWNFEKFLIGPEGEPFRRYSRTFPTINIEPDIKRLLKVAI

SEQ ID NO: 906217 - protein, 86 aa, Homo sapiens
MTDPKLIIWSPVRRSDVAWNFEKFLIGPEGEPFRRYSRTFPTINIEPDIKRLRSSCRIRSSCRIRSSCRIRSSCRIRSSCRIRSSC

SEQ ID NO: 906218 - protein, 226 aa, Homo sapiens
MWLRSEAQPPGTSPSSTSCNAAFPGAWWSLASLATNLDIRAGETEVANPLSRCPSSPRSTSSLTPSLQPSKLLEGVYNLPGASQPFVSRNRNLPGYQWLTPIIPALWEAKENCQNEEILNSLKYVRPGGGYQPTFTLVQKCEVNGQNEHPVFAYLKDKLPYPYDDPFSLMTDPKLIIWSPVRRSDVAWNFEKFLIGPEGEPFRRYSRTFPTINIEPDIKRLLKVAI

SEQ ID NO: 906219 - protein, 150 aa, Homo sapiens
MTLGRECRRVKEFHVVDLSLPPPTVHALCLFPPQENCQNEEILNSLKYVRPGGGYQPTFTLVQKCEVNGQNEHPVFAYLKDKLPYPYDDPFSLMTDPKLIIWSPVRRSDVAWNFEKFLIGPEGEPFRRYSRTFPTINIEPDIKRLLKVAI

SEQ ID NO: 906220 - protein, 227 aa, Homo sapiens
VVARLGVNRPRGKILSVDGNKITIMPKHEDLKDMLEFPAQELRKYFKMGDHVKVIAGRFEGDTGLIVRVEENFVILFSDLTMHELKVLPRDLQLCSETASGVDVGGQHEWGELVQLDPQTVGVIVRLERETFQVLNMYGKVVTVRHQAVTRKKDNRFAVALDSEQNNIHVKDIVKVIDGPHSGREGEIRHLFRSFAFLHCKKLVENGGMFVCKTRHLVLAGGSKPVM

SEQ ID NO: 906221 - protein, 1112 aa, Homo sapiens
RQPQSGVVRTAAGTEGGGGAREQRKMSDSEDSNFSEEEDSERSSDGEEAEVDEERRSAAGSEKEEEPEDEEEEEEEEEYDEEEEEEDDDRPPKKPRHGGFILDEADVDDEYEDEDQWEDGAEDILEKEEIEASNIDNVVLDEDRSGARRLQNLWRDQREEELGEYYMKKYAKSSVGETVYGGSDELSDDITQQQLLPGVKDPNLWTVKCKIGEERATAISLMRKFIAYQFTDTPLQIKSVVAPEHVKGYIYVEAYKQTHVKQAIEGVGNLRLGYWNQQMVPIKEMTDVLKVVKEVANLKPKSWVRLKRGIYKDDIAQVDYVEPSQNTISLKMIPRIDYDRIKARMSLKDWFAKRKKFKRPPQRLFDAEKIRSLGGDVASDGDFLIFEGNRYSRKGFLFKSFAMSAVITEGVKPTLSELEKFEDQPEGIDLEVVTESTGKEREHNFQPGDNVEVCEGELINLQGKILSVDGNKITIMPKHEDLKDMLEFPAQELRKYFKMGDHVKVIAGRFEGDTGLIVRVEENFVILFSDLTMHELKVLPRDLQLCSETASGVDVGGQHEWGELVQLDPQTVGVIVRLERETFQVLNMYGKVVTVRHQAVTRKKDNRFAVALDSEQNNIHVKDIVKVIDGPHSGREGEIRHLFRSFAFLHCKKLVENGGMFVCKTRHLVLAGGSKPRDVTNFTVGGFAPMSPRISSPMHPSAGGQRGGFGSPGGGSGGMSRGRGRRDNELIGQTVRISQGPYKGYIGVVKDATESTARVELHSTCQTISVDRQRLTTVGSRRPGGMTSTYGRTPMYGSQTPMYGSGSRTPMYGSQTPLQDGSRTPHYGSQTPLHDGSRTPAQSGAWDPNNPNTPSRAEEEYEYAFDDEPTPSPQAYGGTPNPQTPGYPDPSSPQVNPQYNPQTPGTPAMYNTDQFSPYAAPSPQGSYQPSPSPQSYHQVAPSPAGYQNTHSPASYHPTPSPMAYQASPSPSPVGYSPMTPGAPSPGGYNPHTPGSGIEQNSSDWVTTDIQVKVRDTYLDTQVVGQTGVIRSVTGGMCSVYLKDSEKVVSISSEHLEPITPTKNNKVKVILGEDREATGVLLSIDGEDGIVRMDLDEQLKILNLRFLGKLLEA

SEQ ID NO: 906222 - protein, 1145 aa, Homo sapiens
RQPQSGVVRTAAGTEGGGGAREGTSGETEARGGAQDCGTRQGCCLSQQQRKMSDSEDSNFSEEEDSERSSDGEEAEVDEERRSAAGSEKEEEPEDEEEEEEEEEYDEEEEEEDDDRPPKKPRHGGFILDEADVDDEYEDEDQWEDGAEDILEKEEIEASNIDNVVLDEDRSGARRLQNLWRDQREEELGEYYMKKYAKSSVGETVYGGSDELSDDITQQQLLPGVKDPNLWTVKCKIGEERATAISLMRKFIAYQFTDTPLQIKSVVAPEHVKGYIYVEAYKQTHVKQAIEGVGNLRLGYWNQQMVPIKEMTDVLKVVKEVANLKPKSWVRLKRGIYKDDIAQVDYVEPSQNTISLKMIPRIDYDRIKARMSLKDWFAKRKKFKRPPQRLFDAEKIRSLGGDVASDGDFLIFEGNRYSRKGFLFKSFAMSAVITEGVKPTLSELEKFEDQPEGIDLEVVTESTALQTAPAGKEREHNFQPGDNVEVCEGELINLQGKILSVDGNKITIMPKHEDLKDMLEFPAQELRKYFKMGDHVKVIAGRFEGDTGLIVRVEENFVILFSDLTMHELKVLPRDLQLCSETASGVDVGGQHEWGELVQLDPQTVGVIVRLERETFQVLNMYGKVVTVRHQAVTRKKDNRFAVALDSEQNNIHVKDIVKVIDGPHSGREGEIRHLFRSFAFLHCKKLVENGGMFVCKTRHLVLAGGSKPRDVTNFTVGGFAPMSPRISSPMHPSAGGQRGGFGSPGGGSGGMSRGRGRRDNELIGQTVRISQGPYKGYIGVVKDATESTARVELHSTCQTISVDRQRLTTVGSRRPGGMTSTYGRTPMYGSQTPMYGSGSRTPMYGSQTPLQDGSRTPHYGSQTPLHDGSRTPAQSGAWDPNNPNTPSRAEEEYEYAFDDEPTPSPQAYGGTPNPQTPGYPDPSSPQVNPQYNPQTPGTPAMYNTDQFSPYAAPSPQGSYQPSPSPQSYHQVAPSPAGYQNTHSPASYHPTPSPMAYQASPSPSPVGYSPMTPGAPSPGGYNPHTPGSGIEQNSSDWVTTDIQVKVRDTYLDTQVVGQTGVIRSVTGGMCSVYLKDSEKVVSISSEHLEPITPTKNNKVKVILGEDREATGVLLSIDGEDGIVRMDLDEQLKILNLRFLGKLLEA

SEQ ID NO: 906223 - protein, 1136 aa, Homo sapiens
TLEDPQSLMSLLGGGGGAREGTSGETEARGGAQDCGTRQGCCLSQQQRKMSDSEDSNFSEEEDSERSSDGEEAEVDEERRSAAGSEKEEEPEDEEEEEEEEEYDEEEEEEDDDRPPKKPRHGGFILDEADVDDEYEDEDQWEDGAEDILEKEEIEASNIDNVVLDEDRSGARRLQNLWRDQREEELGEYYMKKYAKSSVGETVYGGSDELSDDITQQQLLPGVKDPNLWTVKCKIGEERATAISLMRKFIAYQFTDTPLQIKSVVAPEHVKGYIYVEAYKQTHVKQAIEGVGNLRLGYWNQQMVPIKEMTDVLKVVKEVANLKPKSWVRLKRGIYKDDIAQVDYVEPSQNTISLKMIPRIDYDRIKARMSLKDWFAKRKKFKRPPQRLFDAEKIRSLGGDVASDGDFLIFEGNRYSRKGFLFKSFAMSAVITEGVKPTLSELEKFEDQPEGIDLEVVTESTGKEREHNFQPGDNVEVCEGELINLQGKILSVDGNKITIMPKHEDLKDMLEFPAQELRKYFKMGDHVKVIAGRFEGDTGLIVRVEENFVILFSDLTMHELKVLPRDLQLCSETASGVDVGGQHEWGELVQLDPQTVGVIVRLERETFQVLNMYGKVVTVRHQAVTRKKDNRFAVALDSEQNNIHVKDIVKVIDGPHSGREGEIRHLFRSFAFLHCKKLVENGGMFVCKTRHLVLAGGSKPRDVTNFTVGGFAPMSPRISSPMHPSAGGQRGGFGSPGGGSGGMSRGRGRRDNELIGQTVRISQGPYKGYIGVVKDATESTARVELHSTCQTISVDRQRLTTVGSRRPGGMTSTYGRTPMYGSQTPMYGSGSRTPMYGSQTPLQDGSRTPHYGSQTPLHDGSRTPAQSGAWDPNNPNTPSRAEEEYEYAFDDEPTPSPQAYGGTPNPQTPGYPDPSSPQVNPQYNPQTPGTPAMYNTDQFSPYAAPSPQGSYQPSPSPQSYHQVAPSPAGYQNTHSPASYHPTPSPMAYQASPSPSPVGYSPMTPGAPSPGGYNPHTPGSGIEQNSSDWVTTDIQVKVRDTYLDTQVVGQTGVIRSVTGGMCSVYLKDSEKVVSISSEHLEPITPTKNNKVKVILGEDREATGVLLSIDGEDGIVRMDLDEQLKILNLRFLGKLLEA

SEQ ID NO: 906224 - protein, 1029 aa, Homo sapiens
MRGWDFLCEDVIFLPQGQTLALLAARSYFLQAPALHLPLLTPSAHYFSASNIDNVVLDEDRSGARRLQNLWRDQREEELGEYYMKKYAKSSVGETVYGGSDELSDDITQQQLLPGVKDPNLWTVKCKIGEERATAISLMRKFIAYQFTDTPLQIKSVVAPEHVKGYIYVEAYKQTHVKQAIEGVGNLRLGYWNQQMVPIKEMTDVLKVVKEVANLKPKSWVRLKRGIYKDDIAQVDYVEPSQNTISLKMIPRIDYDRIKARMSLKDWFAKRKKFKRPPQRLFDAEKIRSLGGDVASDGDFLIFEGNRYSRKGFLFKSFAMSAVITEGVKPTLSELEKFEDQPEGIDLEVVTESTGKEREHNFQPGDNVEVCEGELINLQGKILSVDGNKITIMPKHEDLKDMLEFPAQELRKYFKMGDHVKVIAGRFEGDTGLIVRVEENFVILFSDLTMHELKVLPRDLQLCSETASGVDVGGQHEWGELVQLDPQTVGVIVRLERETFQVLNMYGKVVTVRHQAVTRKKDNRFAVALDSEQNNIHVKDIVKVIDGPHSGREGEIRHLFRSFAFLHCKKLVENGGMFVCKTRHLVLAGGSKPRDVTNFTVGGFAPMSPRISSPMHPSAGGQRGGFGSPGGGSGGMSRGRGRRDNELIGQTVRISQGPYKGYIGVVKDATESTARVELHSTCQTISVDRQRLTTVGSRRPGGMTSTYGRTPMYGSQTPMYGSGSRTPMYGSQTPLQDGSRTPHYGSQTPLHDGSRTPAQSGAWDPNNPNTPSRAEEEYEYAFDDEPTPSPQAYGGTPNPQTPGYPDPSSPQVNPQYNPQTPGTPAMYNTDQFSPYAAPSPQGSYQPSPSPQSYHQVAPSPAGYQNTHSPASYHPTPSPMAYQASPSPSPVGYSPMTPGAPSPGGYNPHTPGSGIEQNSSDWVTTDIQVKVRDTYLDTQVVGQTGVIRSVTGGMCSVYLKDSEKVVSISSEHLEPITPTKNNKVKVILGEDREATGVLLSIDGEDGIVRMDLDEQLKILNLRFLGKLLEA

SEQ ID NO: 906225 - protein, 754 aa, Homo sapiens
LSLLIFSPPSNSRSLGGDVASDGDFLIFEGNRYSRKGFLFKSFAMSAVITEGVKPTLSELEKFEDQPEGIDLEVVTESTGKEREHNFQPGDNVEVCEGELINLQGKILSVDGNKITIMPKHEDLKDMLEFPAQELRKYFKMGDHVKVIAGRFEGDTGLIVRVEENFVILFSDLTMHELKVLPRDLQLCSETASGVDVGGQHEWGELVQLDPQTVGVIVRLERETFQVLNMYGKVVTVRHQAVTRKKDNRFAVALDSEQNNIHVKDIVKVIDGPHSGREGEIRHLFRSFAFLHCKKLVENGGMFVCKTRHLVLAGGSKPRDVTNFTVGGFAPMSPRISSPMHPSAGGQRGGFGSPGGGSGGMSRGRGRRDNELIGQTVRISQGPYKGYIGVVKDATESTARVELHSTCQTISVDRQRLTTVGSRRPGGMTSTYGRTPMYGSQTPMYGSGSRTPMYGSQTPLQDGSRTPHYGSQTPLHDGSRTPAQSGAWDPNNPNTPSRAEEEYEYAFDDEPTPSPQAYGGTPNPQTPGYPDPSSPQVNPQYNPQTPGTPAMYNTDQFSPYAAPSPQGSYQPSPSPQSYHQVAPSPAGYQNTHSPASYHPTPSPMAYQASPSPSPVGYSPMTPGAPSPGGYNPHTPGSGIEQNSSDWVTTDIQVKVRDTYLDTQVVGQTGVIRSVTGGMCSVYLKDSEKVVSISSEHLEPITPTKNNKVKVILGEDREATGVLLSIDGEDGIVRMDLDEQLKILNLRFLGKLLEA

SEQ ID NO: 906226 - protein, 549 aa, Homo sapiens
RLGTRLGVEFAEVRLERETFQVLNMYGKVVTVRHQAVTRKKDNRFAVALDSEQNNIHVKDIVKVIDGPHSGREGEIRHLFRSFAFLHCKKLVENGGMFVCKTRHLVLAGGSKPRDVTNFTVGGFAPMSPRISSPMHPSAGGQRGGFGSPGGGSGGMSRGRGRRDNELIGQTVRISQGPYKGYIGVVKDATESTARVELHSTCQTISVDRQRLTTVGSRRPGGMTSTYGRTPMYGSQTPMYGSGSRTPMYGSQTPLQDGSRTPHYGSQTPLHDGSRTPAQSGAWDPNNPNTPSRAEEEYEYAFDDEPTPSPQAYGGTPNPQTPGYPDPSSPQVNPQYNPQTPGTPAMYNTDQFSPYAAPSPQGSYQPSPSPQSYHQVAPSPAGYQNTHSPASYHPTPSPMAYQASPSPSPVGYSPMTPGAPSPGGYNPHTPGSGIEQNSSDWVTTDIQVKVRDTYLDTQVVGQTGVIRSVTGGMCSVYLKDSEKVVSISSEHLEPITPTKNNKVKVILGEDREATGVLLSIDGEDGIVRMDLDEQLKILNLRFLGKLLEA

SEQ ID NO: 906227 - protein, 394 aa, Homo sapiens
MSRGRGRRDNELIGQTVRISQGPYKGYIGVVKDATESTARVELHSTCQTISVDRQRLTTVGSRRPGGMTSTYGRTPMYGSQTPMYGSGSRTPMYGSQTPLQDGSRTPHYGSQTPLHDGSRTPAQSGAWDPNNPNTPSRAEEEYEYAFDDEPTPSPQAYGGTPNPQTPGYPDPSSPQVNPQYNPQTPGTPAMYNTDQFSPYAAPSPQGSYQPSPSPQSYHQVAPSPAGYQNTHSPASYHPTPSPMAYQASPSPSPVGYSPMTPGAPSPGGYNPHTPGSGIEQNSSDWVTTDIQVKVRDTYLDTQVVGQTGVIRSVTGGMCSVYLKDSEKVVSISSEHLEPITPTKNNKVKVILGEDREATGVLLSIDGEDGIVRMDLDEQLKILNLRFLGKLLEA

SEQ ID NO: 906228 - protein, 852 aa, Homo sapiens
RQPQSGVVRTAAGTEGGGGAREGTSGETEARGGAQDCGTRQGCCLSQQQRKMSDSEDSNFSEEEDSERSSDGEEAEVDEERRSAAGSEKEEEPEDEEEEEEEEEYDEEEEEEDDDRPPKKPRHGGFILDEADVDDEYEDEDQWEDGAEDILEKEEIEASNIDNVVLDEDRSGARRLQNLWRDQREEELGEYYMKKYAKSSVGETVYGGSDELSDDITQQQLLPGVKDPNLWTVKCKIGEERATAISLMRKFIAYQFTDTPLQIKSVVAPEHVKGYIYVEAYKQTHVKQAIEGVGNLRLGYWNQQMVPIKEMTDVLKVVKEVANLKPKSWVRLKRGIYKDDIAQVDYVEPSQNTISLKMIPRIDYDRIKARMSLKDWFAKRKKFKRPPQRLFDAEKIRSLGGDVASDGDFLIFEGNRYSRKGFLFKSFAMSAVITEGVKPTLSELEKFEDQPEGIDLEVVTESTGKEREHNFQPGDNVEVCEGELINLQGKILSVDGNKITIMPKHEDLKDMLEFPAQELRKYFKMGDHVKVIAGRFEGDTGLIVRVEENFVILFSDLTMHELKVLPRDLQLCSETASGVDVGGQHEWGELVQLDPQTVGVIVRLERETFQVLNMYGKVVTVRHQAVTRKKDNRFAVALDSEQNNIHVKDIVKVIDGPHSGREGEIRHLFRSFAFLHCKKLVENGGMFVCKTRHLVLAGGSKPRDVTNFTVGGFAPMSPRISSPMHPSAGGQRGGFGSPGGGSGGMSRGRGRRDNELIGQTVRISQGPYKGYIGVVKDATESTARVELHSTCQTISVDRQRLTTVGSRRPGGMTSTYGRTPMYGSQTPMYGSGSRTPMYGSQTPLQDGECPQG

SEQ ID NO: 906229 - protein, 683 aa, Homo sapiens
RQPQSGVVRTAAGTEGGGGAREGTSGETEARGGAQDCGTRQGCCLSQQQRKMSDSEDSNFSEEEDSERSSDGEEAEVDEERRSAAGSEKEEEPEDEEEEEEEEEYDEEEEEEDDDRPPKKPRHGGFILDEADVDDEYEDEDQWEDGAEDILEKEEIEASNIDNVVLDEDRSGARRLQNLWRDQREEELGEYYMKKYAKSSVGETVYGGSDELSDDITQQQLLPGVKDPNLWTVKCKIGEERATAISLMRKFIAYQFTDTPLQIKSVVAPEHVKGYIYVEAYKQTHVKQAIEGVGNLRLGYWNQQMVPIKEMTDVLKVVKEVANLKPKSWVRLKRGIYKDDIAQVDYVEPSQNTISLKMIPRIDYDRIKARMSLKDWFAKRKKFKRPPQRLFDAEKIRSLGGDVASDGDFLIFEGNRYSRKGFLFKSFAMSAVITEGVKPTLSELEKFEDQPEGIDLEVVTESTGKEREHNFQPGDNVEVCEGELINLQGKILSVDGNKITIMPKHEDLKDMLEFPAQELRKYFKMGDHVKVIAGRFEGDTGLIVRVEENFVILFSDLTMHELKVLPRDLQLCSETASGVDVGGQHEWGELVQLDPQTVGVIVRLERETFQVLNMYGKVVTVRHQAVTRKKDNRFAVALDSEQNNIHVKDIVKVIDGPHSGREGEIRHLFRSFAFLHCKILLQG

SEQ ID NO: 906230 - protein, 432 aa, Homo sapiens
RQPQSGVVRTAAGTEGGGGAREGTSGETEARGGAQDCGTRQGCCLSQQQRKMSDSEDSNFSEEEDSERSSDGEEAEVDEERRSAAGSEKEEEPEDEEEEEEEEEYDEEEEEEDDDRPPKKPRHGGFILDEADVDDEYEDEDQWEDGAEDILEKEEIEASNIDNVVLDEDRSGARRLQNLWRDQREEELGEYYMKKYAKSSVGETVYGGSDELSDDITQQQLLPGVKDPNLWTVKCKIGEERATAISLMRKFIAYQFTDTPLQIKSVVAPEHVKGYIYVEAYKQTHVKQAIEGVGNLRLGYWNQQMVPIKEMTDVLKVVKEVANLKPKSWVRLKRGIYKDDIAQVDYVEPSQNTISLKMIPRIDYDRIKARMSLKDWFAKRKKFKRPPQRLFDAEKIRCVSLGTGWAGSPGPVCRMCLLQVPPQGWPRHRFSL

SEQ ID NO: 906231 - protein, 406 aa, Homo sapiens
RQPQSGVVRTAAGTEGGGGAREGTSGETEARGGAQDCGTRQGCCLSQQQRKMSDSEDSNFSEEEDSERSSDGEEAEVDEERRSAAGSEKEEEPEDEEEEEEEEEYDEEEEEEDDDRPPKKPRHGGFILDEADVDDEYEDEDQWEDGAEDILEKEEIEASNIDNVVLDEDRSGARRLQNLWRDQREEELGEYYMKKYAKSSVGETVYGGSDELSDDITQQQLLPGVKDPNLWTVKCKIGEERATAISLMRKFIAYQFTDTPLQIKSVVAPEHVKGYIYVEAYKQTHVKQAIEGVGNLRLGYWNQQMVPIKEMTDVLKVVKEVANLKPKSWVRLKRGIYKDDIAQVDYVEPSQNTISLKMIPRIDYDRIKARMSLKDWFAKRKKFKRPPQRLFDAEKISPGSAFLESG

SEQ ID NO: 906232 - protein, 79 aa, Homo sapiens
MPATGDTSMTTAGALTKQPASDHPDTRLNQLLGHTGVAPTKAVSNETTGTESSAAERKNPSDQQSKNTPAEEAQSATRE

SEQ ID NO: 906233 - protein, 296 aa, Homo sapiens
RQPQSGVVRTAAGTEGGGGAREGTSGETEARGGAQDCGTRQGCCLSQQQRKMSDSEDSNFSEEEDSERSSDGEEAEVDEERRSAAGSEKEEEPEDEEEEEEEEEYDEEEEEEDDDRPPKKPRHGGFILDEADVDDEYEDEDQWEDGAEDILEKEEIEASNIDNVVLDEDRSGARRLQNLWRDQREEELGEYYMKKYAKSSVGETVYGGSDELSDDITQQQLLPGVKDPNLWTVKCKIGEERATAISLMRKFIAYQFTDTVSRVDRRLGGETWQHPEGRTLSTSGVPGASVVSRAAC

SEQ ID NO: 906234 - protein, 42 aa, Homo sapiens
MSDSEDSNFSEEEDSERSSDGEEAEVCGWGAGGDIASGDRTP

SEQ ID NO: 906235 - protein, 234 aa, Homo sapiens
TLEDPQSLMSLLGGGGGAREGTSGETEARGGAQDCGTRQGCCLSQQQRKMSDSEDSNFSEEEDSERSSDGEEAEVDEERRSAAGSEKEEEPEDEEEEEEEEEYDEEEEEEDDDRPPKKPRHGGFILDEADVDDEYEDEDQWEDGAEDILEKEEIEASNIDNVVLDEDRSGARRLQNLWRDQREEELGEYYMKKYAKSSVGETVYGGSDELSDDITQQQLLPGVKGSQSVDWSNC

SEQ ID NO: 906236 - protein, 1138 aa, Homo sapiens
RQPQSGVVRTAAGTEGGGGAREGTSGETEARGGAQDCGTRQGCCLSQQQRKMSDSEDSNFSEEEDSERSSDGEEAEVDEERRSAAGSEKEEEPEDEEEEEEEEEYDEEEEEEDDDRPPKKPRHGGFILDEADVDDEYEDEDQWEDGAEDILEKEEIEASNIDNVVLDEDRSGARRLQNLWRDQREEELGEYYMKKYAKSSVGETVYGGSDELSDDITQQQLLPGVKDPNLWTVKCKIGEERATAISLMRKFIAYQFTDTPLQIKSVVAPEHVKGYIYVEAYKQTHVKQAIEGVGNLRLGYWNQQMVPIKEMTDVLKVVKEVANLKPKSWVRLKRGIYKDDIAQVDYVEPSQNTISLKMIPRIDYDRIKARMSLKDWFAKRKKFKRPPQRLFDAEKIRSLGGDVASDGDFLIFEGNRYSRKGFLFKSFAMSAVITEGVKPTLSELEKFEDQPEGIDLEVVTESTGKEREHNFQPGDNVEVCEGELINLQGKILSVDGNKITIMPKHEDLKDMLEFPAQELRKYFKMGDHVKVIAGRFEGDTGLIVRVEENFVILFSDLTMHELKVLPRDLQLCSETASGVDVGGQHEWGELVQLDPQTVGVIVRLERETFQVLNMYGKVVTVRHQAVTRKKDNRFAVALDSEQNNIHVKDIVKVIDGPHSGREGEIRHLFRSFAFLHCKKLVENGGMFVCKTRHLVLAGGSKPRDVTNFTVGGFAPMSPRISSPMHPSAGGQRGGFGSPGGGSGGMSRGRGRRDNELIGQTVRISQGPYKGYIGVVKDATESTARVELHSTCQTISVDRQRLTTVGSRRPGGMTSTYGRTPMYGSQTPMYGSGSRTPMYGSQTPLQDGSRTPHYGSQTPLHDGSRTPAQSGAWDPNNPNTPSRAEEEYEYAFDDEPTPSPQAYGGTPNPQTPGYPDPSSPQVNPQYNPQTPGTPAMYNTDQFSPYAAPSPQGSYQPSPSPQSYHQVAPSPAGYQNTHSPASYHPTPSPMAYQASPSPSPVGYSPMTPGAPSPGGYNPHTPGSGIEQNSSDWVTTDIQVKVRDTYLDTQVVGQTGVIRSVTGGMCSVYLKDSEKVVSISSEHLEPITPTKNNKVKVILGEDREATGVLLSIDGEDGIVRMDLDEQLKILNLRFLGKLLEA

SEQ ID NO: 906237 - protein, 1087 aa, Homo sapiens
MSDSEDSNFSEEEDSERSSDGEEAEVDEERRSAAGSEKEEEPEDEEEEEEEEEYDEEEEEEDDDRPPKKPRHGGFILDEADVDDEYEDEDQWEDGAEDILEKEEIEASNIDNVVLDEDRSGARRLQNLWRDQREEELGEYYMKKYAKSSVGETVYGGSDELSDDITQQQLLPGVKDPNLWTVKCKIGEERATAISLMRKFIAYQFTDTPLQIKSVVAPEHVKGYIYVEAYKQTHVKQAIEGVGNLRLGYWNQQMVPIKEMTDVLKVVKEVANLKPKSWVRLKRGIYKDDIAQVDYVEPSQNTISLKMIPRIDYDRIKARMSLKDWFAKRKKFKRPPQRLFDAEKIRSLGGDVASDGDFLIFEGNRYSRKGFLFKSFAMSAVITEGVKPTLSELEKFEDQPEGIDLEVVTESTGKEREHNFQPGDNVEVCEGELINLQGKILSVDGNKITIMPKHEDLKDMLEFPAQELRKYFKMGDHVKVIAGRFEGDTGLIVRVEENFVILFSDLTMHELKVLPRDLQLCSETASGVDVGGQHEWGELVQLDPQTVGVIVRLERETFQVLNMYGKVVTVRHQAVTRKKDNRFAVALDSEQNNIHVKDIVKVIDGPHSGREGEIRHLFRSFAFLHCKKLVENGGMFVCKTRHLVLAGGSKPRDVTNFTVGGFAPMSPRISSPMHPSAGGQRGGFGSPGGGSGGMSRGRGRRDNELIGQTVRISQGPYKGYIGVVKDATESTARVELHSTCQTISVDRQRLTTVGSRRPGGMTSTYGRTPMYGSQTPMYGSGSRTPMYGSQTPLQDGSRTPHYGSQTPLHDGSRTPAQSGAWDPNNPNTPSRAEEEYEYAFDDEPTPSPQAYGGTPNPQTPGYPDPSSPQVNPQYNPQTPGTPAMYNTDQFSPYAAPSPQGSYQPSPSPQSYHQVAPSPAGYQNTHSPASYHPTPSPMAYQASPSPSPVGYSPMTPGAPSPGGYNPHTPGSGIEQNSSDWVTTDIQVKVRDTYLDTQVVGQTGVIRSVTGGMCSVYLKDSEKVVSISSEHLEPITPTKNNKVKVILGEDREATGVLLSIDGEDGIVRMDLDEQLKILNLRFLGKLLEA

SEQ ID NO: 906238 - protein, 1155 aa, Homo sapiens
PDCLQTPKKPRHGGFILDEADVDDEYKDEDQWEDGAEDILEKEEIEASNIDNVVLDEDRSGAAACKTSGGTSEDSNFSEEEDSERSSDGEEAEVDEERRSAAGSEKEEEPEDEEEEEEEEEYDEEEEEEDDDRPPKKPRHGGFILDEADVDDEYEDEDQWEDGAEDILEKEEIEASNIDNVVLDEDRSGARRLQNLWRDQREEELGEYYMKKYAKSSVGETVYGGSDELSDDITQQQLLPGVKDPNLWTVKCKIGEERATAISLMRKFIAYQFTDTPLQIKSVVAPEHVKGYIYVEAYKQTHVKQAIEGVGNLRLGYWNQQMVPIKEMTDVLKVVKEVANLKPKSWVRLKRGIYKDDIAQVDYVEPSQNTISLKMIPRIDYDRIKARMSLKDWFAKRKKFKRPPQRLFDAEKIRSLGGDVASDGDFLIFEGNRYSRKGFLFKSFAMSAVITEGVKPTLSELEKFEDQPEGIDLEVVTESTGKEREHNFQPGDNVEVCEGELINLQGKILSVDGNKITIMPKHEDLKDMLEFPAQELRKYFKMGDHVKVIAGRFEGDTGLIVRVEENFVILFSDLTMHELKVLPRDLQLCSETASGVDVGGQHEWGELVQLDPQTVGVIVRLERETFQVLNMYGKVVTVRHQAVTRKKDNRFAVALDSEQNNIHVKDIVKVIDGPHSGREGEIRHLFRSFAFLHCKKLVENGGMFVCKTRHLVLAGGSKPRDVTNFTVGGFAPMSPRISSPMHPSAGGQRGGFGSPGGGSGGMSRGRGRRDNELIGQTVRISQGPYKGYIGVVKDATESTARVELHSTCQTISVDRQRLTTVGSRRPGGMTSTYGRTPMYGSQTPMYGSGSRTPMYGSQTPLQDGSRTPHYGSQTPLHDGSRTPAQSGAWDPNNPNTPSRAEEEYEYAFDDEPTPSPQAYGGTPNPQTPGYPDPSSPQVNPQYNPQTPGTPAMYNTDQFSPYAAPSPQGSYQPSPSPQSYHQVAPSPAGYQNTHSPASYHPTPSPMAYQASPSPSPVGYSPMTPGAPSPGGYNPHTPGSGIEQNSSDWVTTDIQVKVRDTYLDTQVVGQTGVIRSVTGGMCSVYLKDSEKVVSISSEHLEPITPTKNNKVKVILGEDREATGVLLSIDGEDGIVRMDLDEQLKILNLRFLGKLLEA

SEQ ID NO: 906239 - protein, 775 aa, Homo sapiens
VCPQNPRMSLKDWFAKRKKFKRPPQRLFDAEKIRSLGGDVASDGDFLIFEGNRYSRKGFLFKSFAMSAVITEGVKPTLSELEKFEDQPEGIDLEVVTESTGKEREHNFQPGDNVEVCEGELINLQGKILSVDGNKITIMPKHEDLKDMLEFPAQELRKYFKMGDHVKVIAGRFEGDTGLIVRVEENFVILFSDLTMHELKVLPRDLQLCSETASGVDVGGQHEWGELVQLDPQTVGVIVRLERETFQVLNMYGKVVTVRHQAVTRKKDNRFAVALDSEQNNIHVKDIVKVIDGPHSGREGEIRHLFRSFAFLHCKKLVENGGMFVCKTRHLVLAGGSKPRDVTNFTVGGFAPMSPRISSPMHPSAGGQRGGFGSPGGGSGGMSRGRGRRDNELIGQTVRISQGPYKGYIGVVKDATESTARVELHSTCQTISVDRQRLTTVGSRRPGGMTSTYGRTPMYGSQTPMYGSGSRTPMYGSQTPLQDGSRTPHYGSQTPLHDGSRTPAQSGAWDPNNPNTPSRAEEEYEYAFDDEPTPSPQAYGGTPNPQTPGYPDPSSPQVNPQYNPQTPGTPAMYNTDQFSPYAAPSPQGSYQPSPSPQSYHQVAPSPAGYQNTHSPASYHPTPSPMAYQASPSPSPVGYSPMTPGAPSPGGYNPHTPGSGIEQNSSDWVTTDIQVKVRDTYLDTQVVGQTGVIRSVTGGMCSVYLKDSEKVVSISSEHLEPITPTKNNKVKVILGEDREATGVLLSIDGEDGIVRMDLDEQLKILNLRFLGKLLEA

SEQ ID NO: 906240 - protein, 1067 aa, Homo sapiens
RQPQSGVVRTAAGTEGGGGAREGTSGETEARGGAQDCGTRQGCCLSQQQRKMSDSEDSNFSEEEDSERSSDGEEAEVDEERRSAAGSEKEEEPEDEEEEEEEEEYDEEEEEEDDDRPPKKPRHGGFILDEADVDDEYEDEDQWEDGAEDILEKEEIEASNIDNVVLDEDRSGARRLQNLWRDQREEELGEYYMKKYAKSSVGETVYGGSDELSDDITQQQLLPGVKDPNLWTVKCKIGEERATAISLMRKFIAYQFTDTPLQIKSVVAPEHVKGYIYVEAYKQTHVKQAIEGVGNLRLGYWNQQMVPIKEMTDVLKVVKEVANLKPKSWVRLKRGIYKDDIAQVDYVEPSQNTISLKMIPRIDYDRIKARMSLKDWFAKRKKFKRPPQRLFDAEKIRSLGGDVASDGDFLIFEGNRYSRKGFLFKSFAMSAVITEGVKPTLSELEKFEDQPEGIDLEVVTESTGKEREHNFQPGDNVEVCEGELINLQGKILSVDGNKITIMPKHEDLKDMLEFPAQELRKYFKMGDHVKVIAGRFEGDTGLIVRVEENFVILFSDLTMHELKVLPRDLQLCSETASGVDVGGQHEWGELVQLDPQTVGVIVRLERETFQVLNMYGKVVTVRHQAVTRKKDNRFAVALDSEQNNIHVKDIVKVIDGPHSGREGEIRHLFRSFAFLHCKKLVENGGMFVCKTRHLVLAGGSKPRDVTNFTVGGFAPMSPRISSPMHPSAGGQRGGFGSPGGGSGGMSRGRGRRDNELIGQTVRISQGPYKGYIGVVKDATESTARVELHSTCQTISVDRQRLTTVGSRRPGGMTSTYGRTPMYGSQTPMYGSGSRTPMYGSQTPLQDGSRTPHYGSQTPLHDGSRTPAQSGAWDPNNPNTPSRAEEEYEYAFDDEPTPSPQAYGGTPNPQTPGYPDPSSPQVNPQYNPQTPGTPAMYNTDQFSPYAAPSPQGSYQPSPSPQSYHQVAPSPAGYQNTHSPASYHPTPSPMAYQASPSPSPVGYSPMTPGAPSPGGYNPHTPGSGIEQNSSDWVTTDIQVKVRDTYLDTQVVGQTGVIRSVTVRGAQGGG

SEQ ID NO: 906241 - protein, 898 aa, Homo sapiens
RQPQSGVVRTAAGTEGGGGAREGTSGETEARGGAQDCGTRQGCCLSQQQRKMSDSEDSNFSEEEDSERSSDGEEAEVDEERRSAAGSEKEEEPEDEEEEEEEEEYDEEEEEEDDDRPPKKPRHGGFILDEADVDDEYEDEDQWEDGAEDILEKEEIEASNIDNVVLDEDRSGARRLQNLWRDQREEELGEYYMKKYAKSSVGETVYGGSDELSDDITQQQLLPGVKDPNLWTVKCKIGEERATAISLMRKFIAYQFTDTPLQIKSVVAPEHVKGYIYVEAYKQTHVKQAIEGVGNLRLGYWNQQMVPIKEMTDVLKVVKEVANLKPKSWVRLKRGIYKDDIAQVDYVEPSQNTISLKMIPRIDYDRIKARMSLKDWFAKRKKFKRPPQRLFDAEKIRSLGGDVASDGDFLIFEGNRYSRKGFLFKSFAMSAVITEGVKPTLSELEKFEDQPEGIDLEVVTESTGKEREHNFQPGDNVEVCEGELINLQGKILSVDGNKITIMPKHEDLKDMLEFPAQELRKYFKMGDHVKVIAGRFEGDTGLIVRVEENFVILFSDLTMHELKVLPRDLQLCSETASGVDVGGQHEWGELVQLDPQTVGVIVRLERETFQVLNMYGKVVTVRHQAVTRKKDNRFAVALDSEQNNIHVKDIVKVIDGPHSGREGEIRHLFRSFAFLHCKKLVENGGMFVCKTRHLVLAGGSKPRDVTNFTVGGFAPMSPRISSPMHPSAGGQRGGFGSPGGGSGGMSRGRGRRDNELIGQTVRISQGPYKGYIGVVKDATESTARVELHSTCQTISVDRQRLTTVGSRRPGGMTSTYGRTPMYGSQTPMYGSGSRTPMYGSQTPLQDGSRTPHYGSQTPLHDGSRTPAQSGAWDPNNPNTPSRHSGFVVSPDLVRAEFE

SEQ ID NO: 906242 - protein, 262 aa, Homo sapiens
RQPQSGVVRTAAGTEGGGGAREGTSGETEARGGAQDCGTRQGCCLSQQQRKMSDSEDSNFSEEEDSERSSDGEEAEVDEERRSAAGSEKEEEPEDEEEEEEEEEYDEEEEEEDDDRPPKKPRHGGFILDEADVDDEYEDEDQWEDGAEDILEKEEIEASNIDNVVLDEDRSGARRLQNLWRDQREEELGEYYMKKYAKSSVGETVYGGSDELSDDITQQQLLPGVKDPNLWTVKCKIGEERATAISLMRKFIAYQFTDTAPA

SEQ ID NO: 906243 - protein, 634 aa, Homo sapiens
RQPQSGVVRTAAGTEGGGGAREGTSGETEARGGAQDCGTRQGCCLSQQQRKMSDSEDSNFSEEEDSERSSDGEEAEVDEERRSAAGSEKEEEPEDEEEEEEEEEYDEEEEEEDDDRPPKKPRHGGFILDEADVDDEYEDEDQWEDGAEDILEKEEIEASNIDNVVLDEDRSGARRLQNLWRDQREEELGEYYMKKYAKSSVGETVYGGSDELSDDITQQQLLPGVKDPNLWTVKCKIGEERATAISLMRKFIAYQFTDTPLQIKSVVAPEHVKGYIYVEAYKQTHVKQAIEGVGNLRLGYWNQQMVPIKEMTDVLKVVKEVANLKPKSWVRLKRGIYKDDIAQVDYVEPSQNTISLKMIPRIDYDRIKARMSLKDWFAKRKKFKRPPQRLFDAEKIRSLGGDVASDGDFLIFEGNRYSRKGFLFKSFAMSAVITEGVKPTLSELEKFEDQPEGIDLEVVTESTALQTAPAGKEREHNFQPGDNVEVCEGELINLQGKILSVDGNKITIMPKHEDLKDMLEFPAQELRKYFKMGDHVKVIAGRFEGDTGLIVRVEENFVILFSDLTMHELKVLPRDLQLCSETASGVDVGGQHEWGELVQLDPQTVGVIVRLERETFQVLTCTGRCDCLTYIRPL

SEQ ID NO: 906244 - protein, 407 aa, Homo sapiens
RQPQSGVVRTAAGTEGGGGAREGTSGETEARGGAQDCGTRQGCCLSQQQRKMSDSEDSNFSEEEDSERSSDGEEAEVDEERRSAAGSEKEEEPEDEEEEEEEEEYDEEEEEEDDDRPPKKPRHGGFILDEADVDDEYEDEDQWEDGAEDILEKEEIEASNIDNVVLDEDRSGARRLQNLWRDQREEELGEYYMKKYAKSSVGETVYGGSDELSDDITQQQLLPGVKDPNLWTVKCKIGEERATAISLMRKFIAYQFTDTPLQIKSVVAPEHVKGYIYVEAYKQTHVKQAIEGVGNLRLGYWNQQMVPIKEMTDVLKVVKEVANLKPKSWVRLKRGIYKDDIAQVDYVEPSQNTISLKMIPRIDYDRIKARMSLVLRGICGLGGRECARSHWWPSPLPHPSHPCPFPP

SEQ ID NO: 906245 - protein, 293 aa, Homo sapiens
RQPQSGVVRTAAGTEGGGGAREGTSGETEARGGAQDCGTRQGCCLSQQQRKMSDSEDSNFSEEEDSERSSDGEEAEVDEERRSAAGSEKEEEPEDEEEEEEEEEYDEEEEEEDDDRPPKKPRHGGFILDEADVDDEYEDEDQWEDGAEDILEKEEIEASNIDNVVLDEDRSGARRLQNLWRDQREEELGEYYMKKYAKSSVGETVYGGSDELSDDITQQQLLPGVKDPNLWTVKCKIGEERATAISLMRKFIAYQFTDTPLQIKSVVAPEHVKGYIYVEGGRILEVDGGNGYA

SEQ ID NO: 906246 - protein, 79 aa, Homo sapiens
MPATGDTSMTTAGALTKQPASDHPDTRLNQLLGHTGVAPTKPVSNETTGTESSAAERKNPSDQQSKNTPAEEAQSATRE

SEQ ID NO: 906247 - protein, 515 aa, Homo sapiens
ARGGGGRGLLGAGRLRGAGKVVTNCQERIQHWKKVDNDYNALRERLSTLPDKLSYNIMVPFGPFAFMPGKLVHTNEVTVLLGDNWFAKCSAKQAVGLVEHRKEHVRKTIDDLKKVMKNFESRVEFTEDLQKMSDAAGDIVDIREEIKCDFEFKAKHRIAHKPHSKPKTSDIFEADIANDVKSKDLLADKELWARLEELERQEELLGELDSKPDTVIANGEDTTSSEEEKEDRNTNVNAMHQVTDSHTPCHKDVASSEPFSGQVNSQLNCSVNGSSSYHSDDDDDDDDDDDDNIDDDDGDNDHEALGVGDNSIPTIYFSHTVEPKRVRINTGKNTTLKFSEKKEEAKRKRKNSTGSGHSAQELPTIRTPADIYRAFVDVVNGEYVPRKSILKSRSRENSVCSDTSESSAAEFDDRRGVLRSISCEEATCSDTSESILEEEPQENQKKLLPLSVTPEAFSGTVIEKEFVSPSLTPPPAIAHPALPTIPERKEVLLEASEETGKRVSKFKAARLQQKD

SEQ ID NO: 906248 - protein, 494 aa, Homo sapiens [sequence omitted]

SEQ ID NO: 906249 - protein, 508 aa, Homo sapiens
MRLGNVDFTLGSNVPCVYLVFSVNRKKVDNDYNALRERLSTLPDKLSYNIMVPFGPFAFMPGKLVHTNEVTVLLGDNWFAKCSAKQAVGLVEHRKEHVRKTIDDLKKVMKNFESRVEFTEDLQKMSDAAGDIVDIREEIKCDFEFKAKHRIAHKPHSKPKTSDIFEADIANDVKSKDLLADKELWARLEELERQEELLGELDSKPDTVIANGEDTTSSEEEKEDRNTNVNAMHQVTDSHTPCHKDVASSEPFSGQVNSQLNCSVNGSSSYHSDDDDDDDDDDDDNIDDDDGDNDHEALGVGDNSIPTIYFSHTVEPKRVRINTGKNTTLKFSEKKEEAKRKRKNSTGSGHSAQELPTIRTPADIYRAFVDVVNGEYVPRKSILKSRSRENSVCSDTSESSAAEFDDRRGVLRSISCEEATCSDTSESILEEEPQENQKKLLPLSVTPEAFSGTVIEKEFVSPSLTPPPAIAHPALPTIPERKEVLLEASEETGKRVSKFKAARLQQKD

SEQ ID NO: 906250 - protein, 555 aa, Homo sapiens
MPPAQALVQDSHAALRPAGPSWRRPPWRRPPTPRPLRPRPLPWFRCAPRMWRGCARSRKRVVTNCQERIQHWKKVDNDYNALRERLSTLPDKLSYNIMVPFGPFAFMPGKLVHTNEVTVLLGDNWFAKCSAKQAVGLVEHRKEHVRKTIDDLKKVMKNFESRVEFTEDLQKMSDAAGDIVDIREEIKCDFEFKAKHRIAHKPHSKPKTSDIFEADIANDVKSKDLLADKELWARLEELERQEELLGELDSKPDTVIANGEDTTSSEEEKEDRNTNVNAMHQVTDSHTPCHKDVASSEPFSGQVNSQLNCSVNGSSSYHSDDDDDDDDDDDDNIDDDDGDNDHEALGVGDNSIPTIYFSHTVEPKRVRINTGKNTTLKFSEKKEEAKRKRKNSTGSGHSAQELPTIRTPADIYRAFVDVVNGEYVPRKSILKSRSRENSVCSDTSESSAAEFDDRRGVLRSISCEEATCSDTSESILEEEPQENQKKLLPLSVTPEAFSGTVIEKEFVSPSLTPPPAIAHPALPTIPERKEVLLEASEETGKRVSKFKAARLQQKD

SEQ ID NO: 906251 - protein, 534 aa, Homo sapiens
IPSGSSHSFPGSLEVTALMTTWSSLQGSHVSKRALAYALVVTNCQERIQHWKKVDNDYNALRERLSTLPDKLSYNIMVPFGPFAFMPGKLVHTNEVTVLLGDNWFAKCSAKQAVGLVEHRKEHVRKTIDDLKKVMKNFESRVEFTEDLQKMSDAAGDIVDIREEIKCDFEFKAKHRIAHKPHSKPKTSDIFEADIANDVKSKDLLADKELWARLEELERQEELLGELDSKPDTVIANGEDTTSSEEEKEDRNTNVNAMHQVTDSHTPCHKDVASSEPFSGQVNSQLNCSVNGSSSYHSDDDDDDDDDDDDNIDDDDGDNDHEALGVGDNSIPTIYFSHTVEPKRVRINTGKNTTLKFSEKKEEAKRKRKNSTGSGHSAQELPTIRTPADIYRAFVDVVNGEYVPRKSILKSRSRENSVCSDTSESSAAEFDDRRGVLRSISCEEATCSDTSESILEEEPQENQKKLLPLSVTPEAFSGTVIEKEFVSPSLTPPPAIAHPALPTIPERKEVLLEASEETGKRVSKFKAARLQQKD

SEQ ID NO: 906252 - protein, 385 aa, Homo sapiens
LVLDRERRSRSRTEEIKCDFEFKAKHRIAHKPHSKPKTSDIFEADIANDVKSKDLLADKELWARLEELERQEELLGELDSKPDTVIANGEDTTSSEEEKEDRNTNVNAMHQVTDSHTPCHKDVASSEPFSGQVNSQLNCSVNGSSSYHSDDDDDDDDDDDDNIDDDDGDNDHEALGVGDNSIPTIYFSHTVEPKRVRINTGKNTTLKFSEKKEEAKRKRKNSTGSGHSAQELPTIRTPADIYRAFVDVVNGEYVPRKSILKSRSRENSVCSDTSESSAAEFDDRRGVLRSISCEEATCSDTSESILEEEPQENQKKLLPLSVTPEAFSGTVIEKEFVSPSLTPPPAIAHPALPTIPERKEVLLEASEETGKRVSKFKAARLQQKD

SEQ ID NO: 906253 - protein, 437 aa, Homo sapiens
MWRGCARSRKRKKVDNDYNALRERLSTLPDKLSYNIMVPFGPFAFMPGKLVHTNEVTVLLGDNWFAKCSAKQAVGLVEHRKEHVRKTIDDLKKVMKNFESRVEFTEDLQKMSDAAGDIVDIREEIKCDFEFKAKHRIAHKPHSKPKTSDIFEADIANDVKSKDLLADKELWARLEELERQEELLGELDSKPDTVIANGEDTTSSEEEKEDRNTNVNAMHQVTDSHTPCHKDVASSEPFSGQVNSQLNCSVNGSSSYHSDDDDDDDDDDDDNIDDDDGDNDHEALGVGDNSIPTIYFSHTVEPKRVRINTGKNTTLKFSEKKEEAKRKRKNSTGSGHSAQELPTIRTPADIYRAFVDVVNGEYVPRKSILKSRSRENSVCSDTSESSAAEFDDRRGVLRSISCEEATCSDTSESILEEEPQENQKKLLPLSVTPELNI

SEQ ID NO: 906254 - protein, 340 aa, Homo sapiens
MWRGCARSRKRKKVDNDYNALRERLSTLPDKLSYNIMVPFGPFAFMPGKLVHTNEVTVLLGDNWFAKCSAKQAVGLVEHRKEHVRKTIDDLKKVMKNFESRVEFTEDLQKMSDAAGDIVDIREEIKCDFEFKAKHRIAHKPHSKPKTSDIFEADIANDVKSKDLLADKELWARLEELERQEELLGELDSKPDTVIANGEDTTSSEEEKEDRNTNVNAMHQVTDSHTPCHKDVASSEPFSGQVNSQLNCSVNGSSSYHSDDDDDDDDDDDDNIDDDDGDNDHEALGVGDNSIPTIYFSHTVEPKRVRINTGKNTTLKFSEKKEEAKRKRKNSTGSEPLLML

SEQ ID NO: 906255 - protein, 161 aa, Homo sapiens
HLLLLTARSCDHQDAQTFTAFVDVVNGEYVPRKSILKSRSRENSVCSDTSESSAAEFDDRRGVLRSISCEEATCSDTSESILEEEPQENQKKLLPLSVTPEAFSGTVIEKEFVSPSLTPPPAIAHPALPTIPERKEVLLEASEETGKRVSKFKAARLQQKD

SEQ ID NO: 906256 - protein, 452 aa, Homo sapiens
MWRGCARSRKRKKVDNDYNALRERLSTLPDKLSYNIMVPFGPFAFMPGKLVHTNEVTVLLGDNWFAKCSAKQAVGLVEHRKEHVRKTIDDLKKVMKNFESRVEFTEDLQKMSDAAGDIVDIREEIKCDFEFKAKHRIAHKPHSKPKTSDIFEADIANDVKSKDLLADKELWARLEELERQEELLGELDSKPDTVIANGEDTTSSEEEKEDRNTNVNAMHQVTDSHTPCHKDVASSEPFSGQVNSQLNCSVNGSSSYHSDDDDDDDDDDDDNIDDDDGDNDHEALGVGDNSIPTIYFSHTVEPKRVRINTGKNTTLKFSEKKEEAKRKRKNSTGSGHSAQELPTIRTPADIYRAFVDVVNGEYVPRKSILKSRSRENSVCSDTSESSAAEFDDRRGVLRSISCEEATCSDTSESILEEEPQENQKKLLPLSVTPEVLRLVGYSRNLAPLNVIL

SEQ ID NO: 906257 - protein, 440 aa, Homo sapiens
MWRGCARSRKRKKVDNDYNALRERLSTLPDKLSYNIMVPFGPFAFMPGKLVHTNEVTVLLGDNWFAKCSAKQAVGLVEHRKEHVRKTIDDLKKVMKNFESRVEFTEDLQKMSDAAGDIVDIREEIKCDFEFKAKHRIAHKPHSKPKTSDIFEADIANDVKSKDLLADKELWARLEELERQEELLGELDSKPDTVIANGEDTTSSEEEKEDRNTNVNAMHQVTDSHTPCHKDVASSEPFSGQVNSQLNCSVNGSSSYHSDDDDDDDDDDDDNIDDDDGDNDHEALGVGDNSIPTIYFSHTVEPKRVRINTGKNTTLKFSEKKEEAKRKRKNSTGSGHSAQELPTIRTPADIYRAFVDVVNGEYVPRKSILKSRSRENSVCSDTSESSAAEFDDRRGVLRSISCEEATCSDTSESILEEEPQENQKKLLPLSVTPEVCVCIF

SEQ ID NO: 906258 - protein, 508 aa, Homo sapiens; identical to SEQ ID NO: 906249

SEQ ID NO: 906259 - protein, 508 aa, Homo sapiens; identical to SEQ ID NO: 906249

SEQ ID NO: 906260 - protein, 506 aa, Homo sapiens
MWRGCARSRKRVVTNCQERIQHWKKVDNDYNALRERLSTLPDKLSYNIMVPFGPFAFMPGKLVHTNEVTVLLGDNWFAKCSAKQAVGLVEHRKEHVRKTIDDLKKVMKNFESRVEFTEDLQKMSDAAGDIVDIREEIKCDFEFKAKHRIAHKPHSKPKTSDIFEADIANDVKSKDLLADKELWARLEELERQEELLGELDSKPDTVIANGEDTTSSEEEKEDRNTNVNAMHQVTDSHTPCHKDVASSEPFSGQVNSQLNCSVNGSSSYHSDDDDDDDDDDDDNIDDDDGDNDHEALGVGDNSIPTIYFSHTVEPKRVRINTGKNTTLKFSEKKEEAKRKRKNSTGSGHSAQELPTIRTPADIYRAFVDVVNGEYVPRKSILKSRSRENSVCSDTSESSAAEFDDRRGVLRSISCEEATCSDTSESILEEEPQENQKKLLPLSVTPEAFSGTVIEKEFVSPSLTPPPAIAHPALPTIPERKEVLLEASEETGKRVSKFKAARLQQKD

SEQ ID NO: 906261 - protein, 437 aa, Homo sapiens; identical to SEQ ID NO: 906253

SEQ ID NO: 906262 - protein, 476 aa, Homo sapiens
MWRGCARSRKRKKVDNDYNALRERLSTLPDKLSYNIMVPFGPFAFMPGKLVHTNEVTVLLGDNWFAKCSAKQAVGLVEHRKEHVRKTIDDLKKVMKNFESRVEFTEDLQKMSDAAGDIVDIREEIKCDFEFKAKHRIAHKPHSKPKTSDIFEADIANDVKSKDLLADKELWARLEELERQEELLGELDSKPDTVIANGEDTTSSEEDTPCHKDVASSEPFSGQVNSQLNCSVNGSSSYHSDDDDDDDDDDDDNIDDDDGDNDHEALGVGDNSIPTIYFSHTVEPKRVRINTGKNTTLKFSEKKEEAKRKRKNSTGSGHSAQELPTIRTPADIYRAFVDVVNGEYVPRKSILKSRSRENSVCSDTSESSAAEFDDRRGVLRSISCEEATCSDTSESILEEEPQENQKKLLPLSVTPEAFSGTVIEKEFVSPSLTPPPAIAHPALPTIPERKEVLLEASEETGKRVSKFKAARLQQKD

SEQ ID NO: 906263 - protein, 353 aa, Homo sapiens
MIVKIQSNSSILIPTWRARFEATYQYTWQRIARDDLCFKALHDSLDSQFASIHPHYLSRNDVQENHRIHNIVDCDALALTETHHTPCHKDVASSEPFSGQVNSQLNCSVNGSSSYHSDDDDDDDDDDDDNIDDDDGDNDHEALGVGDNSIPTIYFSHTVEPKRVRINTGKNTTLKFSEKKEEAKRKRKNSTGSGHSAQELPTIRTPADIYRAFVDVVNGEYVPRKSILKSRSRENSVCSDTSESSAAEFDDRRGVLRSISCEEATCSDTSESILEEEPQENQKKLLPLSVTPEAFSGTVIEKEFVSPSLTPPPAIAHPALPTIPERKEVLLEASEETGKRVSKFKAARLQQKD

SEQ ID NO: 906264 - protein, 452 aa, Homo sapiens; identical to SEQ ID NO: 906256

SEQ ID NO: 906265 - protein, 182 aa, Homo sapiens
FYDPLPELFNSVGGGRQRAEIYCWPLPGLFHISKEVPVNPGPPFGEHGPVRPCQPCQCNNNVDPSASGNCDRLTGRCLKCIHNTAGIYCDQCKAGYFGDPLAPNPADKCRACNCNPMGSEPVGCRSDGTCVCKPGFGGPNCEHGAFSCPACWTLGAIERLTHARLWSDLICLYKCLLHAVDK

SEQ ID NO: 906266 - protein, 484 aa, Homo sapiens
FLRAIAQHFIWPGHWLSTWHWSLTEAELVEMLMFTGGRNPPYLQAASQPQEATRLAESHVESASNMEQLTRETEDYSKQALSLVRKALHEGVGSGSGSPDGAVVQGLVEKLEKTKSLAQQLTREATQAEIEADRSYQHSLRLLDSVSRLQGVSDQSFQVEEAKRIKQKADSLSSLVTRHMDEFKRTQKNLGNWKEEAQQLLQNGKSGREKSDQLLSRANLAKSRAQEALSMGNATFYEVESILKNLREFDLQVDNRKAEAEEAMKRLSYISQKVSDASDKTQQAERALGSAAADAQRAKNGAGEALEISSEIEQEIGSLNLEANVTADGALAMEKGLASLKSEMREVEGELERKELEFDTNMDAVQMVITEAQKVDTRAKNAGVTIQDTLNTLDGLLHLMDQPLSVDEEGLVLLEQKLSRAKTQINSQLRPMMSELEERARQQRGHLHLLETSIDGILADVKNLENIRDNLPPGCYNTQALEQQ

SEQ ID NO: 906267 - protein, 1150 aa, Homo sapiens
DHLIEGKGRHSGAQSENHQPRRRAATPAAETETERPGTAMPALWLGCCLCFSLLLPAARATSRREVCDCNGKSRQCIFDRELHRQTGNGFRCLNCNDNTDGIHCEKCKNGFYRHRERDRCLPCNCNSKGSLSARCDNSGRCSCKPGVTGARCDRCLPGFHMLTDAGCTQDQRLLDSKCDCDPAGIAGPCDAGRCVCKPAVTGERCDRCRSGYYNLDGGNPEGCTQCFCYGHSASCRSSAEYSVHKITSTFHQDVDGWKAVQRNGSPAKLQWSQRHQDVFSSAQRLDPVYFVAPAKFLGNQQVSYGQSLSFDYRVDRGGRHPSAHDVILEGAGLRITAPLMPLGKTLPCGLTKTYTFRLNEHPSNNWSPQLSYFEYRRLLRNLTALRIRATYGEYSTGYIDNVTLISARPVSGAPAPWVEQCICPVGYKGQFCQDCASGYKRDSARLGPFGTCIPCNCQGGGACDPDTGDCYSGDENPDIECADCPIGFYNDPHDPRSCKPCPCHNGFSCSVMPETEEVVCNNCPPGVTGARCELCADGYFGDPFGEHGPVRPCQPCQCNNNVDPSASGNCDRLTGRCLKCIHNTAGIYCDQCKAGYFGDPLAPNPADKCRACNCNPMGSEPVGCRSDGTCVCKPGFGGPNCEHGAFSCPACYNQVKIQMDQFMQQLQRMEALISKAQGGDGVVPDTELEGRMQQAEQALQDILRDAQISEGASRSLGLQLAKVRSQENSYQSRLDDLKMTVERVRALGSQYQNRVRDTHRLITQMQLSLAESEASLGNTNIPASDHYVGPNGFKSLAQEATRLAESHVESASNMEQLTRETEDYSKQALSLVRKALHEGVGSGSGSPDGAVVQGLVEKLEKTKSLAQQLTREATQAEIEADRSYQHSLRLLDSVSRLQGVSDQSFQVEEAKRIKQKADSLSSLVTRHMDEFKRTQKNLGNWKEEAQQLLQNGKSGREKSDQLLSRANLAKSRAQEALSMGNATFYEVESILKNLREFDLQVDNRKAEAEEAMKRLSYISQKVSDASDKTQQAERALGSAAADAQRAKNGAGEALEISSEIEQEIGSLNLEANVTADGALAMEKGLASLKSEMREVEGELERKELEFDTNMDAVQMVITEAQKVDTRAKNAGVTIQDTLNTLDGLLHLMGM

SEQ ID NO: 906268 - protein, 178 aa, Homo sapiens
SGEQSLEQEIGSLNLEANVTADGALAMEKGLASLKSEMREVEGELERKELEFDTNMDAVQMVITEAQKVDTRAKNAGVTIQDTLNTLDGLLHLMDQPLSVDEEGLVLLEQKLSRAKTQINSQLRPMMSELEERARQQRGHLHLLETSIDGILADVKNLENIRDNLPPGCYNTQALEQQ

SEQ ID NO: 906269 - protein, 160 aa, Homo sapiens
MTRKFVKRSIFLLASLKSEMREVEGELERKELEFDTNMDAVQMVITEAQKVDTRAKNAGVTIQDTLNTLDGLLHLMDQPLSVDEEGLVLLEQKLSRAKTQINSQLRPMMSELEERARQQRGHLHLLETSIDGILADVKNLENIRDNLPPGCYNTQALEQQ

SEQ ID NO: 906270 - protein, 1232 aa, Homo sapiens
DHLIEGKGRHSGAQSENHQPRRRAATPAAETETERPGTAMPALWLGCCLCFSLLLPAARATSRREVCDCNGKSRQCIFDRELHRQTGNGFRCLNCNDNTDGIHCEKCKNGFYRHRERDRCLPCNCNSKGSLSARCDNSGRCSCKPGVTGARCDRCLPGFHMLTDAGCTQDQRLLDSKCDCDPAGIAGPCDAGRCVCKPAVTGERCDRCRSGYYNLDGGNPEGCTQCFCYGHSASCRSSAEYSVHKITSTFHQDVDGWKAVQRNGSPAKLQWSQRHQDVFSSAQRLDPVYFVAPAKFLGNQQVSYGQSLSFDYRVDRGGRHPSAHDVILEGAGLRITAPLMPLGKTLPCGLTKTYTFRLNEHPSNNWSPQLSYFEYRRLLRNLTALRIRATYGEYSTGYIDNVTLISARPVSGAPAPWVEQCICPVGYKGQFCQDCASGYKRDSARLGPFGTCIPCNCQGGGACDPDTGDCYSGDENPDIECADCPIGFYNDPHDPRSCKPCPCHNGFSCSVMPETEEVVCNNCPPGVTGARCELCADGYFGDPFGEHGPVRPCQPCQCNNNVDPSASGNCDRLTGRCLKCIHNTAGIYCDQCKAGYFGDPLAPNPADKCRACNCNPMGSEPVGCRSDGTCVCKPGFGGPNCEHGAFSCPACYNQVKIQMDQFMQQLQRMEALISKAQGGDGVVPDTELEGRMQQAEQALQDILRDAQISEGASRSLGLQLAKVRSQENSYQSRLDDLKMTVERVRALGSQYQNRVRDTHRLITQMQLSLAESEASLGNTNIPASDHYVGPNGFKSLAQEATRLAESHVESASNMEQLTRETEDYSKQALSLVRKALHEGVGSGSGSPDGAVVQGLVEKLEKTKSLAQQLTREATQAEIEADRSYQHSLRLLDSVSRLQGVSDQSFQVEEAKRIKQKADSLSSLVTRHMDEFKRTQKNLGNWKEEAQQLLQNGKSGREKSDQLLSRANLAKSRAQEALSMGNATFYEVESILKNLREFDLQVDNRKAEAEEAMKRLSYISQKVSDASDKTQQAERALGSAAADAQRAKNGAGEALEISSEIEQEIGSLNLEANVTADGALAMEKGLASLKSEMREVEGELERKELEFDTNMDAVQMVITEAQKVDTRAKNAGVTIQDTLNTLDGLLHLMDQPLSVDEEGLVLLEQKLSRAKTQINSQLRPMMSELEERARQQRGHLHLLETSIDGILADVKNLENIRDNLPPGCYNTQALEQQ

SEQ ID NO: 906271 - protein, 1232 aa, Homo sapiens; identical to SEQ ID NO: 906270

SEQ ID NO: 906272 - protein, 1232 aa, Homo sapiens; identical to SEQ ID NO: 906270

SEQ ID NO: 906273 - protein, 1221 aa, Homo sapiens
DHLIEGKGRHSGAQSENHQPRRRAATPAAETETERPGTAMPALWLGCCLCFSLLLPAARATSRREVCDCNGKSRQCIFDRELHRQTGNGFRCLNCNDNTDGIHCEKCKNGFYRHRERDRCLPCNCNSKGSLSARCDNSGRCSCKPGVTGARCDRCLPGFHMLTDAGCTQDQRLLDSKCDCDPAGIAGPCDAGRCVCKPAVTGERCDRCRSGYYNLDGGNPEGCTQCFCYGHSASCRSSAEYSVHKITSTFHQDVDGWKAVQRNGSPAKLQWSQRHQDVFSSAQRLDPVYFVAPAKFLGNQQVSYGQSLSFDYRVDRGGRHPSAHDVILEGAGLRITAPLMPLGKTLPCGLTKTYTFRLNEHPSNNWSPQLSYFEYRRLLRNLTALRIRATYGEYSTGYIDNVTLISARPVSGAPAPWVEQCICPVGYKGQFCQDCASGYKRDSARLGPFGTCIPCNCQGGGACDPDTGDCYSGDENPDIECADCPIGFYNDPHDPRSCKPCPCHNGFSCSVMPETEEVVCNNCPPGVTGARCELCADGYFGDPFGEHGPVRPCQPCQCNNNVDPSASGNCDRLTGRCLKCIHNTAGIYCDQCKAGYFGDPLAPNPADKCRACNCNPMGSEPVGCRSDGTCVCKPGFGGPNCEHGAFSCPACYNQVKIQMDQFMQQLQRMEALISKAQGGDGVVPDTELEGRMQQAEQALQDILRDAQISEGASRSLGLQLAKVRSQENSYQSRLDDLKMTVERVRALGSQYQNRVRDTHRLITQMQLSLAESEASLGNTNIPASDHYVGPNGFKSLAQEATRLAESHVESASNMEQLTRETEDYSKQALSLVRKALHEGVGSGSGSPDGAVVQGLVEKLEKTKSLAQQLTREATQAEIEADRSYQHSLRLLDSVSRLQGVSDQSFQVEEAKRIKQKADSLSSLVTRHMDEFKRTQKNLGNWKEEAQQLLQNGKSGREKSDQLLSRANLAKSRAQEALSMGNATFYEVESILKNLREFDLQVDNRKAEAEEAMKRLSYISQKVSDASDKTQQAERALGSAAADAQRAKNGAGEALEISSEIEQEIGSLNLEANVTADGALAMEKGLASLKSEMREVEGELERKELEFDTNMDAVQMVITEAQKVDTRAKNAGVTIQDTLNTLDGLLHLMDPALDGPAGTTQINKLAYLNLRPPTQELTQCKKTASTPCDFISDQSALLAHWLPQPMKFSLKTLLPKCSGRLI

SEQ ID NO: 906274 - protein, 1140 aa, Homo sapiens
DHLIEGKGRHSGAQSENHQPRRRAATPAAETETERPGTAMPALWLGCCLCFSLLLPAARATSRREVCDCNGKSRQCIFDRELHRQTGNGFRCLNCNDNTDGIHCEKCKNGFYRHRERDRCLPCNCNSKGSLSARCDNSGRCSCKPGVTGARCDRCLPGFHMLTDAGCTQDQRLLDSKCDCDPAGIAGPCDAGRCVCKPAVTGERCDRCRSGYYNLDGGNPEGCTQCFCYGHSASCRSSAEYSVHKITSTFHQDVDGWKAVQRNGSPAKLQWSQRHQDVFSSAQRLDPVYFVAPAKFLGNQQVSYGQSLSFDYRVDRGGRHPSAHDVILEGAGLRITAPLMPLGKTLPCGLTKTYTFRLNEHPSNNWSPQLSYFEYRRLLRNLTALRIRATYGEYSTGYIDNVTLISARPVSGAPAPWVEQCICPVGYKGQFCQDCASGYKRDSARLGPFGTCIPCNCQGGGACDPDTGDCYSGDENPDIECADCPIGFYNDPHDPRSCKPCPCHNGFSCSVMPETEEVVCNNCPPGVTGARCELCADGYFGDPFGEHGPVRPCQPCQCNNNVDPSASGNCDRLTGRCLKCIHNTAGIYCDQCKAGYFGDPLAPNPADKCRACNCNPMGSEPVGCRSDGTCVCKPGFGGPNCEHGAFSCPACYNQVKIQMDQFMQQLQRMEALISKAQGGDGVVPDTELEGRMQQAEQALQDILRDAQISEGASRSLGLQLAKVRSQENSYQSRLDDLKMTVERVRALGSQYQNRVRDTHRLITQMQLSLAESEASLGNTNIPASDHYVGPNGFKSLAQEATRLAESHVESASNMEQLTRETEDYSKQALSLVRKALHEGVGSGSGSPDGAVVQGLVEKLEKTKSLAQQLTREATQAEIEADRSYQHSLRLLDSVSRLQGVSDQSFQVEEAKRIKQKADSLSSLVTRHMDEFKRTQKNLGNWKEEAQQLLQNGKSGREKSDQLLSRANLAKSRAQEALSMGNATFYEVESILKNLREFDLQVDNRKAEAEEAMKRLSYISQKVSDASDKTQQAERALGSAAADAQRAKNGAGEALEISSEIEQEIGSLNLEANVTADGALAMEKGLASLKSEMREVEGELERKELEFDTNMDAVQMVITEAQRSWLWYQPSGFCNHLGPAD

SEQ ID NO: 906275 - protein, 985 aa, Homo sapiens
DHLIEGKGRHSGAQSENHQPRRRAATPAAETETERPGTAMPALWLGCCLCFSLLLPAARATSRREVCDCNGKSRQCIFDRELHRQTGNGFRCLNCNDNTDGIHCEKCKNGFYRHRERDRCLPCNCNSKGSLSARCDNSGRCSCKPGVTGARCDRCLPGFHMLTDAGCTQDQRLLDSKCDCDPAGIAGPCDAGRCVCKPAVTGERCDRCRSGYYNLDGGNPEGCTQCFCYGHSASCRSSAEYSVHKITSTFHQDVDGWKAVQRNGSPAKLQWSQRHQDVFSSAQRLDPVYFVAPAKFLGNQQVSYGQSLSFDYRVDRGGRHPSAHDVILEGAGLRITAPLMPLGKTLPCGLTKTYTFRLNEHPSNNWSPQLSYFEYRRLLRNLTALRIRATYGEYSTGYIDNVTLISARPVSGAPAPWVEQCICPVGYKGQFCQDCASGYKRDSARLGPFGTCIPCNCQGGGACDPDTGDCYSGDENPDIECADCPIGFYNDPHDPRSCKPCPCHNGFSCSVMPETEEVVCNNCPPGVTGARCELCADGYFGDPFGEHGPVRPCQPCQCNNNVDPSASGNCDRLTGRCLKCIHNTAGIYCDQCKAGYFGDPLAPNPADKCRACNCNPMGSEPVGCRSDGTCVCKPGFGGPNCEHGAFSCPACYNQVKIQMDQFMQQLQRMEALISKAQGGDGVVPDTELEGRMQQAEQALQDILRDAQISEGASRSLGLQLAKVRSQENSYQSRLDDLKMTVERVRALGSQYQNRVRDTHRLITQMQLSLAESEASLGNTNIPASDHYVGPNGFKSLAQEATRLAESHVESASNMEQLTRETEDYSKQALSLVRKALHEGVGSGSGSPDGAVVQGLVEKLEKTKSLAQQLTREATQAEIEADRSYQHSLRLLDSVSRLQGVSDQSFQVEEAKRIKQKADSLSSLVTRHMDEFKRTQKNLGNWKEEAQQLLQNGKSGREGPARCSTSRSLASDSSTWPRRSFRNMRS

SEQ ID NO: 906276 - protein, 1232 aa, Homo sapiens; identical to SEQ ID NO: 906270

SEQ ID NO: 906277 - protein, 1232 aa, Homo sapiens; identical to SEQ ID NO: 906270

SEQ ID NO: 906278 - protein, 1147 aa, Homo sapiens
DHLIEGKGRHSGAQSENHQPRRRAATPAAETETERPGTAMPALWLGCCLCFSLLLPAARATSRREVCDCNGKSRQCIFDRELHRQTGNGFRCLNCNDNTDGIHCEKCKNGFYRHRERDRCLPCNCNSKGSLSARCDNSGRCSCKPGVTGARCDRCLPGFHMLTDAGCTQDQRLLDSKCDCDPAGIAGPCDAGRCVCKPAVTGERCDRCRSGYYNLDGGNPEGCTQCFCYGHSASCRSSAEYSVHKITSTFHQDVDGWKAVQRNGSPAKLQWSQRHQDVFSSAQRLDPVYFVAPAKFLGNQQVSYGQSLSFDYRVDRGGRHPSAHDVILEGAGLRITAPLMPLGKTLPCGLTKTYTFRLNEHPSNNWSPQLSYFEYRRLLRNLTALRIRATYGEYSTGYIDNVTLISARPVSGAPAPWVEQCICPVGYKGQFCQDCASGYKRDSARLGPFGTCIPCNCQGGGACDPDTGDCYSGDENPDIECADCPIGFYNDPHDPRSCKPCPCHNGFSCSVMPETEEVVCNNCPPGVTGARCELCADGYFGDPFGEHGPVRPCQPCQCNNNVDPSASGNCDRLTGRCLKCIHNTAGIYCDQCKAGYFGDPLAPNPADKCRACNCNPMGSEPVGCRSDGTCVCKPGFGGPNCEHGAFSCPACYNQVKIQMDQFMQQLQRMEALISKAQGGDGVVPDTELEGRMQQAEQALQDILRDAQISEGASRSLGLQLAKVRSQENSYQSRLDDLKMTVERVRALGSQYQNRVRDTHRLITQMQLSLAESEASLGNTNIPASDHYVGPNGFKSLAQEATRLAESHVESASNMEQLTRETEDYSKQALSLVRKALHEGVGSGSGSPDGAVVQGLVEKLEKTKSLAQQLTREATQAEIEADRSYQHSLRLLDSVSRLQGVSDQSFQVEEAKRIKQKADSLSSLVTRHMDEFKRTQKNLGNWKEEAQQLLQNGKSGREKSDQLLSRANLAKSRAQEALSMGNATFYEVESILKNLREFDLQVDNRKAEAEEAMKRLSYISQKVSDASDKTQQAERALGSAAADAQRAKNGAGEALEISSEIEQEIGSLNLEANVTADGALAMEKGLASLKSEMREVEGELERRARQQRGHLHLLETSIDGILADVKNLENIRDNLPPGCYNTQALEQQ

SEQ ID NO: 906279 - protein, 164 aa, Homo sapiens
LISLFREASPLAMEKGLASLKSEMREVEGELERKELEFDTNMDAVQMVITEAQKVDTRAKNAGVTIQDTLNTLDGLLHLMDQPLSVDEEGLVLLEQKLSRAKTQINSQLRPMMSELEERARQQRGHLHLLETSIDGILADVKNLENIRDNLPPGCYNTQALEQQ

SEQ ID NO: 906280 - protein, 125 aa, Homo sapiens
GQFVYTQMVITEAQKVDTRAKNAGVTIQDTLNTLDGLLHLMDQPLSVDEEGLVLLEQKLSRAKTQINSQLRPMMSELEERARQQRGHLHLLETSIDGILADVKNLENIRDNLPPGCYNTQALEQQ

SEQ ID NO: 906281 - protein, 1232 aa, Homo sapiens; identical to SEQ ID NO: 906270

SEQ ID NO: 906282 - protein, 1232 aa, Homo sapiens; identical to SEQ ID NO: 906270

SEQ ID NO: 906283 - protein, 1182 aa, Homo sapiens
DHLIEGKGRHSGAQSENHQPRRRAATPAAETETERPGTAMPALWLGCCLCFSLLLPAARATSRREVCDCNGKSRQCIFDRELHRQTGNGFRCLNCNDNTDGIHCEKCKNGFYRHRERDRCLPCNCNSKGSLSARCDNSGRCSCKPGVTGARCDRCLPGFHMLTDAGCTQDQRLLDSKCDCDPAGIAGPCDAGRCVCKPAVTGERCDRCRSGYYNLDGGNPEGCTQCFCYGHSASCRSSAEYSVHKITSTFHQDVDGWKAVQRNGSPAKLQWSQRHQDVFSSAQRLDPVYFVAPAKFLGNQQVSYGQSLSFDYRVDRGGRHPSAHDVILEGAGLRITAPLMPLGKTLPCGLTKTYTFRLNEHPSNNWSPQLSYFEYRRLLRNLTALRIRATYGEYSTGYIDNVTLISARPVSGAPAPWVEQCICPVGYKGQFCQDCASGYKRDSARLGPFGTCIPCNCQGGGACDPDTGDCYSGDENPDIECADCPIGFYNDPHDPRSCKPCPCHNGFSCSVMPETEEVVCNNCPPGVTGARCELCADGYFGDPFGEHGPVRPCQPCQCNNNVDPSASGNCDRLTGRCLKCIHNTAGIYCDQCKAGYFGDPLAPNPADKCRACNCNPMGSEPVGCRSDGTCVCKPGFGGPNCEHGAFSCPACYNQVKIQMDQFMQQLQRMEALISKAQGGDGVVPDTELEGRMQQAEQALQDILRDAQISEGASRSLGLQLAKVRSQENSYQSRLDDLKMTVERVRALGSQYQNRVRDTHRLITQMQLSLAESEASLGNTNIPASDHYVGPNGFKSLAQEATRLAESHVESASNMEQLTRETEDYSKQALSLVRKALHEGVGSGSGSPDGAVVQGLVEKLEKTKSLAQQLTREATQAEIEADRSYQHSLRLLDSVSRLQGVSDQSFQVEEAKRIKQKADSLSSLVTRHMDEFKRTQKNLGNWKEEAQQLLQNGKSGREKSDQLLSRANLAKSRAQEALSMGNATFYEVESILKNLREFDLQVDNRKAEAEEAMKRLSYISQKVSDASDKTQQAERALGSAAADAQRAKNGAGEALEISSEIEQEIGSLNLEANVTADGALAMEKGLASLKSEMREVEGELERKELEFDTNMDAVQMVITEAQKVDTRAKNAGVTIQDTLNTLDGLLHLMEQPLSVDEEGLVLAETDNYALCPSHNFRPVPNVK

SEQ ID NO: 906284 - protein, 898 aa, Homo sapiens
QPSPEPHSPTEPPAWGSSIVKVPSGIFDVNSRKSSTGSISNVLFSTQDPVEDAVFGEATNLKKNGDRGEKRQKHFPKTSLLHIARTHSFENVSCHLPDSRTCMSESTWNPEHRSSPVPEMLEESQELLEPVVDDVPKTTATVDTYESLLSDSNSNQSRDLKTVSKDLRNKRSSLYGIAKVVQREDVETGLDPLSLLATECTGGKTPDSEDKLFSPVIARNLADEIESYMNLKSPLGSKSSSMELHREENRESGMTTAFIHALERRSSLPLDHGSPAQENPESEKSSPAVSRSKTFTGRFKQQTPSRTHKERSTSLSALVRSSPHGSLGSVVNSLSGLKLDNILSGPKIDVLKSGMKQAATVASKMWVAVASAYSYSDDEEETNRDYSFPAGLEDHILGENISPNTSISGLVPSELTQSNTSLGSSSSSGDVGKLHYPTGEVPFPRGMKGQDFEKSDHGSSQNTSMSSIYQNCAMEVLMSSCSQCRACGALVYDEEIMAGWTADDSNLNTACPFCKSNFLPLLNIEFKDLRGSASFFLKPSTSGDSLQSGSIPLANESLEHKPVSSLAEPDLINFMDFPKHNQIITEETGSAVEPSDEIKRASGDVQTMKISSVPNSLSKRNVSLTRSHSVGGPLQNIDFTQRPFHGISTVSLPNSLQEVVDPLGKRPNPPPVSVPYLSPLVLRKELESLLENEGDQVIHTSSFINQHPIIFWNLVWYFRRLDLPSNLPGLILTSEHCNEGVQLPLSSLSQDSKLVYIQLLWDNINLHQEPREPLYVSWRNFNSEKKSSLLSEEQQETSTLVETIRQSIQHNNVLKPINLLSQQMKPGMKRQRSLYREILFLSLVSLGRENIDIEAFDNEYGIAYNSLSSEILERLQKIDAPPSASVEWCRKCFGAPLI

SEQ ID NO: 906285 - protein, 861 aa, Homo sapiens
QPSPEPHSPTEPPAWGSSIVKVPSGIFDVNSRKSSTGSISNVLFSTQDPVEDAVFGEATNLKKNGDRGEKRQKHFPKTSLLHIARTHSFENVSCHLPDSRTCMSESTWNPEHRSSPVPEMLEESQELLEPVVDDVPKTTATVDTYESLLSDSNSNQSRDLKTVSKDLRNKRSSLYGIAKVVQREDVETGLDPLSLLATECTGGKTPDSEDKLFSPVIARNLADEIESYMNLKSPLGSKSSSMELHREENRESGMTTAFIHALERRSSLPLDHGSPAQENPESEKSSPAVSRSKTFTGRFKQQTPSRTHKERSTSLSALVRSSPHGSLGSVVNSLSGLKLDNILSGPKIDVLKSGMKQAATVASKMWVAVASAYSYSDDEEETNRDYSFPAGLEDHILGENISPNTSISGLVPSELTQSNTSLGSSSSSGDVGKLHYPTGEVPFPRGMKGQDFEKSDHGSSQNTSMSSIYQNCAMEVLMSSCSQCRACGALVYDEEIMAGWTADDSNLNTACPFCKSNFLPLLNIEFKDLRGSASFFLKPSTSGDSLQSGSIPLANESLEHKPVSSLAEPDLINFMDFPKHNQIITEETGSAVEPSDEIKRASGDVQTMKISSVPNSLSKRNVSLTRSHSVGGPLQNIDFTQRPFHGISTVSLPNSLQEVVDPLGKRPNPPPVSVPYLSPLVLRKELESLLENEGDQVIHTSSFINQHPIIFWNLVWYFRRLDLPSNLPGLILTSEHCNEGVQLPLSSLSQDSKLVYIQLLWDNINLHQEPREPLYVSWRNFNSEKKSSLLSEEQQETSTLVETIRQSIQHNNVLKPINLLSQQMKPGMKRQRSLYREILFLSLVSLGRENIDIGKLVNKRL

SEQ ID NO: 906286 - protein, 773 aa, Homo sapiens
QPSPEPHSPTEPPAWGSSIVKVPSGIFDVNSRKSSTGSISNVLFSTQDPVEDAVFGEATNLKKNGDRGEKRQKHFPKTSLLHIARTHSFENVSCHLPDSRTCMSESTWNPEHRSSPVPEMLEESQELLEPVVDDVPKTTATVDTYESLLSDSNSNQSRDLKTVSKDLRNKRSSLYGIAKVVQREDVETGLDPLSLLATECTGGKTPDSEDKLFSPVIARNLADEIESYMNLKSPLGSKSSSMELHREENRESGMTTAFIHALERRSSLPLDHGSPAQENPESEKSSPAVSRSKTFTGRFKQQTPSRTHKERSTSLSALVRSSPHGSLGSVVNSLSGLKLDNILSGPKIDVLKSGMKQAATVASKMWVAVASAYSYSDDEEETNRDYSFPAGLEDHILGENISPNTSISGLVPSELTQSNTSLGSSSSSGDVGKLHYPTGEVPFPRGMKGQDFEKSDHGSSQNTSMSSIYQNCAMEVLMSSCSQCRACGALVYDEEIMAGWTADDSNLNTACPFCKSNFLPLLNIEFKDLRGSASFFLKPSTSGDSLQSGSIPLANESLEHKPVSSLAEPDLINFMDFPKHNQIITEETGSAVEPSDEIKRASGDVQTMKISSVPNSLSKRNVSLTRSHSVGGPLQNIDFTQRPFHGISTVSLPNSLQEVVDPLGKRPNPPPVSVPYLSPLVLRKELESLLENEGDQVIHTSSFINQHPIIFWNLVWYFRRLDLPSNLPGLILTSEHCNEGVQLPLSSLSQDSTGVYTRAVVTGAVELELCKWR

SEQ ID NO: 906287 - protein, 257 aa, Homo sapiens
KSVPASNAIAYKAGLIFRYPEEDYESFPLSESDVPLFCLPMGATIECWDPETKYPLPVFSTFVLTGSSAKKVYGAAIQFYEPYSRELLSEKQLMHLGLLTPVERKMVSKSINTNKCICLLSHWPFFEAFRKFLMFIYKLSVSGPHPLPIEKHISHFMQNIPFPSPQRPRILVQLSVHDALILSQPVSTPLPLSGANFSTLLMNLGPENCATLLLFVLLESKILLHSLRPAVLTGVAEAVVAGAVVTGAVELELCKWR

SEQ ID NO: 906288 - protein, 671 aa, Homo sapiens
KSVPASNAIAYKAGLIFRYPEEDYESFPLSESDVPLFCLPMGATIECWDPETKYPLPVFSTFVLTGSSAKKVYGAAIQFYEPYSRELLSEKQLMHLGLLTPVERKMVSKSINTNKCICLLSHWPFFEAFRKFLMFIYKLSVSGPHPLPIEKHISHFMQTSLFLHHKDHILGENISPNTSISGLVPSELTQSNTSLGSSSSSGDVGKLHYPTGEVPFPRGMKGQDFEKSDHGSSQNTSMSSIYQNCAMEVLMSSCSQCRACGALVYDEEIMAGWTADDSNLNTACPFCKSNFLPLLNIEFKDLRGSASFFLKPSTSGDSLQSGSIPLANESLEHKPVSSLAEPDLINFMDFPKHNQIITEETGSAVEPSDEIKRASGDVQTMKISSVPNSLSKRNVSLTRSHSVGGPLQNIDFTQRPFHGISTVSLPNSLQEVVDPLGKRPNPPPVSVPYLSPLVLRKELESLLENEGDQVIHTSSFINQHPIIFWNLVWYFRRLDLPSNLPGLILTSEHCNEGVQLPLSSLSQDSKLVYIQLLWDNINLHQEPREPLYVSWRNFNSEKKSSLLSEEQQETSTLVETIRQSIQHNNVLKPINLLSQQMKPGMKRQRSLYREILFLSLVSLGRENIDIEAFDNEYGIAYNSLSSEILERLQKIDAPPSASVEWCRKCFGAPLI

SEQ ID NO: 906289 - protein, 880 aa, Homo sapiens
QPSPEPHSPTEPPAWGSSIVKVPSGIFDVNSRKSSTGSISNVLFSTQDPVEDAVFGEATNLKKNGDRGEKRQKHFPERSCSFSSESRAGMLLKKSSLDSNSSEMAIMMGADAKILTAALTCPKTSLLHIARTHSFENVSCHLPDSRTCMSESTWNPEHRSSPVPEMLEESQELLEPVVDDVPKTTATVDTYESLLSDSNSNQSRDLKTVSKDLRNKRSSLYGIAKVVQREDVETGLDPLSLLATECTGGKTPDSEDKLFSPVIARNLADEIESYMNLKSPLGSKSSSMELHREENRESGMTTAFIHALERRSSLPLDHGSPAQENPESEKSSPAVSRSKTFTGRFKQQTPSRTHKERSTSLSALVRSSPHGSLGSVVNSLSGLKLDNILSGPKIDVLKSGMKQAATVASKMWVAVASAYSYSDDEEETNRDYSFPAGLEDHILGENISPNTSISGLVPSELTQSNTSLGSSSSSGDVGKLHYPTGEVPFPRGMKGQDFEKSDHGSSQNTSMSSIYQNCAMEVLMSSCSQCRACGALVYDEEIMAGWTADDSNLNTACPFCKSNFLPLLNIEFKDLRGSASFFLKPSTSGDSLQSGSIPLANESLEHKPVSSLAEPDLINFMDFPKHNQIITEETGSAVEPSDEIKRASGDVQTMKISSVPNSLSKRNVSLTRSHSVGGPLQNIDFTQRPFHGISTVSLPNSLQEVVDPLGKRPNPPPVSVPYLSPLVLRKELESLLENEGDQVIHTSSFINQHPIIFWNLVWYFRRLDLPSNLPGLILTSEHCNEGVQLPLSSLSQDSKLVYIQLLWDNINLHQEPREPLYVSWRNFNSEKKSSLLSEEQQETSTLVETIRQSIQHNNVLKPINLLSQQMKPGMKRQRGI

SEQ ID NO: 906290 - protein, 612 aa, Homo sapiens
QPSPEPHSPTEPPAWGSSIVKVPSGIFDVNSRKSSTGSISNVLFSTQDPVEDAVFGEATNLKKNGDRGEKRQKHFPKTSLLHIARTHSFENVSCHLPDSRTCMSESTWNPEHRSSPVPEMLEESQELLEPVVDDVPKTTATVDTYESLLSDSNSNQSRDLKTVSKDLRNKRSSLYGIAKVVQREDVETGLDPLSLLATECTGGKTPDSEDKLFSPVIARNLADEIESYMNLKSPLGSKSSSMELHREENRESGMTTAFIHALERRSSLPLDHGSPAQENPESEKSSPAVSRSKTFTGRFKQQTPSRTHKERSTSLSALVRSSPHGSLGSVVNSLSGLKLDNILSGPKIDVLKSGMKQAATVASKMWVAVASAYSYSDDEEETNRDYSFPAGLEDHILGENISPNTSISGLVPSELTQSNTSLGSSSSSGDVGKLHYPTGEVPFPRGMKGQDFEKSDHGSSQNTSMSSIYQNCAMEVLMSSCSQCRACGALVYDEEIMAGWTADDSNLNTACPFCKSNFLPLLNIEFKDLRGSASFFLKPSTSGDSLQSGSIPLANESLEHKPVSSLAEPDLINFMDFPKHNQIITEETGSAVEPRYQRVQRPLYVVINGVPL

SEQ ID NO: 906291 - protein, 135 aa, Homo sapiens
RRSSLPLDHGSPAQENPESEKSSPAVSRSKTFTGRFKQQTPSRTHKERSTSLSALVRSSPHGSLGSVVNSLSGLKLDNILSGPKIDVLKSGMKQAATVASKMWVAVASAYSYSDDEVRKLYVCSLSAIGVFIVSF

SEQ ID NO: 906292 - protein, 427 aa, Homo sapiens
METLCLRASFWLALVGCVISDNPERYSTNLSNHVDDFTTFRGTELSFLVTTHQPTNLVLPSNGSMHNYCPQQTKITSAFKYINTVISCTIFIVGMVGNATLLRIIYQNKCMRNGPNALIASLALGDLIYVVIDLPINVFKLLAGRWPFDHNDFGVFLCKLFPFLQKSSVGITVLNLCALSVDRYRAVASWSRVQGIGIPLVTAIEIVSIWILSFILAIPEAIGFVMVPFEYRGEQHKTCMLNATSKFMEFYQDVKDWWLFGFYFCMPLVCTAIFYTLMTCEMLNRRNGSLRIALSEHLKQRREVAKTVFCLVVIFALCWFPLHLSRILKKTVYNEMDKNRCELLSFLLLMDYIGINLATMNSCINPIALYFVSKKFKNCFQSCLCCCCYQSKSLMTSVPMNGTSIQWKNHDQNNHNTDRSSHKDSMN

SEQ ID NO: 906293 - protein, 427 aa, Homo sapiens; identical to SEQ ID NO: 906292

SEQ ID NO: 906294 - protein, 318 aa, Homo sapiens
METLCLRASFWLALVGCVISDNPERYSTNLSNHVDDFTTFRGTELSFLVTTHQPTNLVLPSNGSMHNYCPQQTKITSAFKYINTVISCTIFIVGMVGNATLLRIIYQNKCMRNGPNALIASLALGDLIYVVIDLPINVFKFYQDVKDWWLFGFYFCMPLVCTAIFYTLMTCEMLNRRNGSLRIALSEHLKQRREVAKTVFCLVVIFALCWFPLHLSRILKKTVYNEMDKNRCELLSFLLLMDYIGINLATMNSCINPIALYFVSKKFKNCFQSCLCCCCYQSKSLMTSVPMNGTSIQWKNHDQNNHNTDRSSHKDSMN

SEQ ID NO: 906295 - protein, 162 aa, Homo sapiens
MPLVCTAIFYTLMTCEMLNRRNGSLRIALSEHLKQRREVAKTVFCLVVIFALCWFPLHLSRILKKTVYNEMDKNRCELLSFLLLMDYIGINLATMNSCINPIALYFVSKKFKNCFQSCLCCCCYQSKSLMTSVPMNGTSIQWKNHDQNNHNTDRSSHKDSMN

SEQ ID NO: 906296 - protein, 155 aa, Homo sapiens [sequence omitted]

SEQ ID NO: 906297 - protein, 427 aa, Homo sapiens; identical to SEQ ID NO: 906292

SEQ ID NO: 906298 - protein, 187 aa, Homo sapiens
METLCLRASFWLALVGCVISDNPERYSTNLSNHVDDFTTFRGTELSFLVTTHQPTNLVLPSNGSMHNYCPQQTKITSAFKYINTVISCTIFIVGMVGNATLLRIIYQNKCMRNGPNALIASLALGDLIYVVIDLPINVFKLLAGRWPFDHNDFGVFLCKLFPFLQKSSVGITVLNLCALSVDSSTKM

SEQ ID NO: 906299 - protein, 256 aa, Homo sapiens
MWSLISLSMYLRYRAVASWSRVQGIGIPLVTAIEIVSIWILSFILAIPEAIGFVMVPFEYRGEQHKTCMLNATSKFMEFYQDVKDWWLFGFYFCMPLVCTAIFYTLMTCEMLNRRNGSLRIALSEHLKQRREVAKTVFCLVVIFALCWFPLHLSRILKKTVYNEMDKNRCELLSFLLLMDYIGINLATMNSCINPIALYFVSKKFKNCFQSCLCCCCYQSKSLMTSVPMNGTSIQWKNHDQNNHNTDRSSHKDSMN

SEQ ID NO: 906300 - protein, 1029 aa, Homo sapiens
SGAGGGPKVQYVGPGHSSRASATESVSFSGIVQMDEDTHYDKVEDVVGSHIEDAVTFWAQSINRNKDIMKIGCSLSEVCPQASSVLGNLDPNKIYGGLFSEDQCWYRCKVLKIISVEKCLVRYIDYGNTEILNRSDIVEIPLELQFSSVAKKYKLWGLHIPSDQEVTQFDQGTTFLGSLIFEKEIKMRIKATSEDGTVIAQAEYGSVDIGEEVLKKGFAEKCRLASRTDICEEKKLDPGQLVLRNLKSPIPLWGHRSNQSTFSRPKGHLSEKMTLDLKDENDAGNLITFPKESLAVGDFNLGSNVSLEKIKQDQKLIEENEKLKTEKDALLESYKALELKVEQIAQELQQEKAAAVDLTNHLEYTLKTYIDTRMKNLAAKMEILKEMRHVDISVRFGKDLSDAIQVLDEGCFTTPASLNGLEIIWAEYSLAQENIKTCEYVSEGNILIAQRNEMQQKLYMSVEDFILEVDESSLNKRLKTLQDLSVSLEAVYGQAKEGANSDEILKKFYDWKCDKREEFTSVRSETDASLHRLVAWFQRTLKVFDLSVEGSLISEDAMDNIDEILEKTESSVCKELEIALVDQGDADKEIISNTYSQVLQKIHSEERLIATVQAKYKDSIEFKKQLIEYLNKSPSVDHLLSIKKTLKSLKALLRWKLVEKSNLEESDDPDGSQIEKIKEEITQLRNNVFQEIYHEREEYEMLTSLAQKWFPELPLLHPEIGLLKYMNSGGLLTMSLERDLLDAEPMKELSSKRPLVRSEVNGQIILLKGYSVDVDTEAKVIERAATYHRAWREAEGDSGLLPLIFLFLCKSDPMAYLMVPYYPRANLNAVQANMPLNSEETLKVMKGVAQGLHTLHKADIIHGSLHQNNVFALNREQGIVGDFDFTKSVSQRASVNMMVGDLSLMSPELKMGKPASPGSDLYAYGCLLLWLSVQNQEFEINKDGIPKVDQFHLDDKVKSLLCSLICYRSSMTAEQVLNAECFLMPKEQSVPNPEKDTEYTLYKKEEEIKTENLDKCMEKTRNGEANFDC

SEQ ID NO: 906301 - protein, 933 aa, Homo sapiens
SGAGGGPKVQYVGPGHSSRASATESVSFSGIVQMDEDTHYDKVEDVVGSHIEDAVTFWAQSINRNKDIMKIGCSLSEVCPQASSVLGNLDPNKIYGGLFSEDQCWYRCKVLKIISVEKCLVRYIDYGNTEILNRSDIVEIPLELQFSSVAKKYKLWGLHIPSDQEVTQFDQGTTFLGSLIFEKEIKMRIKATSEDGTVIAQAEYGSVDIGEEVLKKGFAEKCRLASRTDICEEKKLDPGQLVLRNLKSPIPLWGHRSNQSTFSRPKGHLSEKMTLDLKDENDAGNLITFPKESLAVGDFNLGSNVSLEKIKQDQKLIEENEKLKTEKDALLESYKALELKVEQIAQELQQEKAAAVDLTNHLEYTLKTYIDTRMKNLAAKMEILKEMRHVDISVRFGKDLSDAIQVLDEGCFTTPASLNGLEIIWAEYSLAQENIKTCEYVSEGNILIAQRNEMQQKLYMSVEDFILEVDESSLNKRLKTLQDLSVSLEAVYGQAKEGANSDEILKKFYDWKCDKREEFTSVRSETDASLHRLVAWFQRTLKVFDLSVEGSLISEDAMDNIDEILEKTESSVCKELEIALVDQGDADKEIISNTYSQVLQKIHSEERLIATVQAKYKDSIEFKKQLIEYLNKSPSVDHLLSIKKTLKSLKALLRWKLVEKSNLEESDDPDGSQIEKIKEEITQLRNNVFQEIYHEREEYEMLTSLAQKWFPELPLLHPEIGLLKYMNSGGLLTMSLERDLLDAEPMKELSSKRPLVRSEVNGQIILLKGYSVDVDTEAKVIERAATYHRAWREAEGDSGLLPLIFLFLCKSDPMAYLMVPYYPRANLNAVQANMPLNSEETLKVMKGVAQGLHTLHKADIIHGSLHQNNVFALNREQGIVGDFDFTKSVSQRASVNMMVGDLSLMSPELKMGKPASPGSDLYAYGCLLLWFKN

SEQ ID NO: 906302 - protein, 559 aa, Homo sapiens
DAETTLLLHRYSDLSVSLEAVYGQAKEGANSDEILKKFYDWKCDKREEFTSVRSETDASLHRLVAWFQRTLKVFDLSVEGSLISEDAMDNIDEILEKTESSVCKELEIALVDQGDADKEIISNTYSQVLQKIHSEERLIATVQAKYKDSIEFKKQLIEYLNKSPSVDHLLSIKKTLKSLKALLRWKLVEKSNLEESDDPDGSQIEKIKEEITQLRNNVFQEIYHEREEYEMLTSLAQKWFPELPLLHPEIGLLKYMNSGGLLTMSLERDLLDAEPMKELSSKRPLVRSEVNGQIILLKGYSVDVDTEAKVIERAATYHRAWREAEGDSGLLPLIFLFLCKSDPMAYLMVPYYPRANLNAVQANMPLNSEETLKVMKGVAQGLHTLHKADIIHGSLHQNNVFALNREQGIVGDFDFTKSVSQRASVNMMVGDLSLMSPELKMGKPASPGSDLYAYGCLLLWLSVQNQEFEINKDGIPKVDQFHLDDKVKSLLCSLICYRSSMTAEQVLNAECFLMPKEQSVPNPEKDTEYTLYKKEEEIKTENLDKCMEKTRNGEANFDC

SEQ ID NO: 906303 - protein, 996 aa, Homo sapiens
MDEDTHYDKVEDVVGSHIEDAVTFWAQSINRNKDIMKIGCSLSEVCPQASSVLGNLDPNKIYGGLFSEDQCWYRCKVLKIISVEKCLVRYIDYGNTEILNRSDIVEIPLELQFSSVAKKYKLWGLHIPSDQEVTQFDQGTTFLGSLIFEKEIKMRIKATSEDGTVIAQAEYGSVDIGEEVLKKGFAEKCRLASRTDICEEKKLDPGQLVLRNLKSPIPLWGHRSNQSTFSRPKGHLSEKMTLDLKDENDAGNLITFPKESLAVGDFNLGSNVSLEKIKQDQKLIEENEKLKTEKDALLESYKALELKVEQIAQELQQEKAAAVDLTNHLEYTLKTYIDTRMKNLAAKMEILKEMRHVDISVRFGKDLSDAIQVLDEGCFTTPASLNGLEIIWAEYSLAQENIKTCEYVSEGNILIAQRNEMQQKLYMSVEDFILEVDESSLNKRLKTLQDLSVSLEAVYGQAKEGANSDEILKKFYDWKCDKREEFTSVRSETDASLHRLVAWFQRTLKVFDLSVEGSLISEDAMDNIDEILEKTESSVCKELEIALVDQGDADKEIISNTYSQVLQKIHSEERLIATVQAKYKDSIEFKKQLIEYLNKSPSVDHLLSIKKTLKSLKALLRWKLVEKSNLEESDDPDGSQIEKIKEEITQLRNNVFQEIYHEREEYEMLTSLAQKWFPELPLLHPEIGLLKYMNSGGLLTMSLERDLLDAEPMKELSSKRPLVRSEVNGQIILLKGYSVDVDTEAKVIERAATYHRAWREAEGDSGLLPLIFLFLCKSDPMAYLMVPYYPRANLNAVQANMPLNSEETLKVMKGVAQGLHTLHKADIIHGSLHQNNVFALNREQGIVGDFDFTKSVSQRASVNMMVGDLSLMSPELKMGKPASPGSDLYAYGCLLLWLSVQNQEFEINKDGIPKVDQFHLDDKVKSLLCSLICYRSSMTAEQVLNAECFLMPKEQSVPNPEKDTEYTLYKKEEEIKTENLDKCMEKTRNGEANFDC

SEQ ID NO: 906304 - protein, 851 aa, Homo sapiens
SGAGGGPKVQYVGPGHSSRASATESVSFSGIVQMDEDTHYDKVEDVVGSHIEDAVTFWAQSINRNKDIMKIGCSLSEVCPQASSVLGNLDPNKIYGGLFSEDQCWYRCKVLKIISVEKCLVRYIDYGNTEILNRSDIVEIPLELQFSSVAKKYKLWGLHIPSDQEVTQFDQQEKAAAVDLTNHLEYTLKTYIDTRMKNLAAKMEILKEMRHVDISVRFGKDLSDAIQVLDEGCFTTPASLNGLEIIWAEYSLAQENIKTCEYVSEGNILIAQRNEMQQKLYMSVEDFILEVDESSLNKRLKTLQDLSVSLEAVYGQAKEGANSDEILKKFYDWKCDKREEFTSVRSETDASLHRLVAWFQRTLKVFDLSVEGSLISEDAMDNIDEILEKTESSVCKELEIALVDQGDADKEIISNTYSQVLQKIHSEERLIATVQAKYKDSIEFKKQLIEYLNKSPSVDHLLSIKKTLKSLKALLRWKLVEKSNLEESDDPDGSQIEKIKEEITQLRNNVFQEIYHEREEYEMLTSLAQKWFPELPLLHPEIGLLKYMNSGGLLTMSLERDLLDAEPMKELSSKRPLVRSEVNGQIILLKGYSVDVDTEAKVIERAATYHRAWREAEGDSGLLPLIFLFLCKSDPMAYLMVPYYPRANLNAVQANMPLNSEETLKVMKGVAQGLHTLHKADIIHGSLHQNNVFALNREQGIVGDFDFTKSVSQRASVNMMVGDLSLMSPELKMGKPASPGSDLYAYGCLLLWLSVQNQEFEINKDGIPKVDQFHLDDKVKSLLCSLICYRSSMTAEQVLNAECFLMPKEQSVPNPEKDTEYTLYKKEEEIKTENLDKCMEKTRNGEANFDC

SEQ ID NO: 906305 - protein, 616 aa, Homo sapiens
MPPLETQSSLAPPSLQTPPASLTTPPLENLPSLAPPPLQTASAPLTTPHLETPPCPAPCPLQAPPSPLTTPPPETPSSIATPPPQAPPALASPPLQGLPSPPLSPLATPPPQAPPALALPPLQAPPSPPASPPLSPLATPSPQAPNALAVHLLQAPFSPPPSPPVQAPFSPPASPPVSPSATPPSQAPPSLAAPPLQVPPSPPASPPMSPSATPPPQAPPPLAAPPLQVPPSPPASPPMSPSATPPPRVPPLLAAPPLQVPPSPPASLPMSPLAKPPPQAPPALATPPLQALPSPPASFPGQAPFSPSASLPMSPLATPPPQAPPVLAAPLLQVPPSPPASPTLQAPRRPPTPGPDTSVSGPRLTLALAPGPPPPPSRSPSSTLSGPDLAGHSSSATSTPEELRGYDSGPEGGAAASPPPDAELAACHPAAWSRGPAPPLAFRGAPGAPLPWPPATGPGSADGLCTIYETEGPESATPAPGALDPGPSPGTSGGKAAAGAGAGASSRSPKQARLGELPLGALQASVVQHLLSRTLLLAAAEGAAGGSGGGPGGAEGGGVTGGARAALSDAELGRWAELLSPLDESRASITSVTSFSPDDVASPQGDWTVVEVETFH

SEQ ID NO: 906306 - protein, 460 aa, Homo sapiens
MDNKRDKAKAGAAARTPAARAPGLLTPRPPGSPRPPPPVTPAALRVLGAAGAVGRKPLAERAGGIGGATIPESAPRAGPTRSAGTSSRNPASRPPASGRGERAPPAKNTSPGPVSSPGRASGTTRPGPLGQKGLRISAEETVARGKATEAPKRSALSAGARRARSGPSARGTPRAPAHPSQPKPKGLQALRPPQVTPPRKDAAPALGPLSSSPLAHPLHRVPSPSSTLSGPDLAGHSSSATSTPEELRGYDSGPEGGAAASPPPDAELAACHPAAWSRGPAPPLAFRGAPGAPLPWPPATGPGSADGLCTIYETEGPESATPAPGALDPGPSPGTSGGKAAAGAGAGASSRSPKQARLGELPLGALQASVVQHLLSRTLLLAAAEGAAGGSGGGPGGAEGGGVTGGARAALSDAELGRWAELLSPLDESRASITSVTSFSPDDVASPQGDWTVVEVETFH

SEQ ID NO: 906307 - protein, 677 aa, Homo sapiens
ASTPPDSPPLQAPLSLPASPPLQTSLSPAVSPLSSPLTIHPLQALSSLASHSPQAPLSSLIMPPLETQSSLAPPSLQTPPASLTTPPLENLPSLAPPPLQTASAPLTTPHLETPPCPAPCPLQAPPSPLTTPPPETPSSIATPPPQAPPALASPPLQGLPSPPLSPLATPPPQAPPALALPPLQAPPSPPASPPLSPLATPSPQAPNALAVHLLQAPFSPPPSPPVQAPFSPPASPPVSPSATPPSQAPPSLAAPPLQVPPSPPASPPMSPSATPPPQAPPPLAAPPLQVPPSPPASPPMSPSATPPPRVPPLLAAPPLQVPPSPPASLPMSPLAKPPPQAPPALATPPLQALPSPPASFPGQAPFSPSASLPMSPLATPPPQAPPVLAAPLLQVPPSPPASPTLQAPRRPPTPGPDTSVSGPRLTLALAPGPPPPPSRSPSSTLSGPDLAGHSSSATSTPEELRGYDSGPEGGAAASPPPDAELAACHPAAWSRGPAPPLAFRGAPGAPLPWPPATGPGSADGLCTIYETEGPESATPAPGALDPGPSPGTSGGKAAAGAGAGASSRSPKQARLGELPLGALQASVVQHLLSRTLLLAAAEGAAGGSGGGPGGAEGGGVTGGARAALSDAELGRWAELLSPLDESRASITSVTSFSPDDVASPQGDWTVVEVETFH

SEQ ID NO: 906308 - protein, 550 aa, Homo sapiens
MDNKRDKAKAGAAARTPAARAPGLLTPRPPGSPRPPPPVTPAALRVLGAAGAVGRKPLAERAGGIGGATIPESAPRAGPTRSAGTSSRNPASRPPASGRGERAPPAKNTSPGPVSSPGRASGTTRPGPLGQKGLRISAEETVARGKATEAPKRSALSAGARRDTSGPTPGTPSPAMARRSRAAGTEVGLPRPAPSARPRPPTEGPRKSVSSASEHSTTEPSPAARRRPSAGGGLQRPASRSLSSSATPLSSPARSGPSARGTPRAPAHPSQPKPKGLQALRPPQVTPPRKDAAPALGPLSSSPLAHPLHRVPSPSSTLSGPDLAGHSSSATSTPEELRGYDSGPEGGAAASPPPDAELAACHPAAWSRGPAPPLAFRGAPGAPLPWPPATGPGSADGLCTIYETEGPESATPAPGALDPGPSPGTSGGKAAAGAGAGASSRSPKQARLGELPLGALQASVVQHLLSRTLLLAAAEGAAGGSGGGPGGAEGGGVTGGARAALSDAELGRWAELLSPLDESRASITSVTSFSPDDVASPQGDWTVVEVETFH

SEQ ID NO: 906309 - protein, 214 aa, Homo sapiens
SGQARGRSKRRKHKGPEGSRGDRWGTREAGAGRRCSHGGARPAGLGNEGLGLGGDPDHTDTGSRSKQRINNWKESKHKVIMASASARGNQDKDAHFPPPSKQSLLFCPKSKLHIHRAEISKIMRECQEESFWKRALPFSLVSMLVTQGLVYQGYLAANSRFGSLPKVALAGLLGFGLGKVSYIGVCQSKFHFFEDQLRGAGFGPQHKQALPPYL

SEQ ID NO: 906310 - protein, 186 aa, Homo sapiens
RAGEGAEQEKKTQRAGRKPGRQVGYSGSWSGPAVQSRGSEACWAWQRGTRPRRRPRPHSDSLLPSLDTGSRSKQRINNWKESKHKVIMASASARGNQDKDAHFPPPSKQSLLFCPKSKLHIHRAEISKIMRECQEESFWKRALPFSLVSMLVTQGLVYQGYLAANSRFGSLPKVARTASLPVRNAK

SEQ ID NO: 906311 - protein, 68 aa, Homo sapiens
AGRRGGGAREENTKGRKEAGETGGVLGKLERAGGAVTGERGLLGLATRDSASEATQTTQTLGQGVSRG

SEQ ID NO: 906312 - protein, 141 aa, Homo sapiens
SGQARGRSKRRKHKGPEGSRGDRWGTREAGAGRRCSHGGARPAGLGNEGLGLGGDPDHTDTGSRSKQRINNWKESKHKVIMASASARGNQDKDAHFPPPSKQSLLFCPKSKLHIHRAEISKIMRECQEESFWKRACLSPRD

SEQ ID NO: 906313 - protein, 171 aa, Homo sapiens
SGQARGRSKRRKHKGPEGSRGDRWGTREAGAGRRCSHGGARPAGLGNEGLGLGGDPDHTDTGSRSKQRINNWKESKHKVIMASASARGNQDKDAHFPPPSKQSLLFCPKSKLHIHRAEISKIMRECQEESFWKRALPFSLVSMLVTQGLVYQGYLAANSRFGSLPKVARKS

SEQ ID NO: 906314 - protein, 106 aa, Homo sapiens
CCLRQSVNHSHSPTRILLLPKSISVPSEKALLETDNCFGLPLVENTHCVTSEETSLFSSVENKVGDFSMTSVSSPYNFPYKPVVLSKIKTAHPQSRDLKDYARMSG

SEQ ID NO: 906315 - protein, 179 aa, Homo sapiens
SGQARGRSKRRKHKGPEGSRGDRWGTREAGAGRRCSHGGARPAGLGNEGLGLGGDPDHTDTGSRSKQRINNWKESKHKVIMASASARGNQDKDAHFPPPSKQSLLFCPKSKLHIHRAEISKIMRECQEESFWKRALPFSLVSMLVTQGLVYQGYLAANSRFGSLPKVARTASLPVRNAK

SEQ ID NO: 906316 - protein, 214 aa, Homo sapiens; identical to SEQ ID NO: 906309

SEQ ID NO: 906317 - protein, 214 aa, Homo sapiens; identical to SEQ ID NO: 906309

SEQ ID NO: 906318 - protein, 68 aa, Homo sapiens; identical to SEQ ID NO: 906311

SEQ ID NO: 906319 - protein, 351 aa, Homo sapiens
DQFLKPRPKPAPLALVWASVIKASGAGSEFQDQTRIRFMLETMLALKNNDMRKIPGYDPEPVEKLRKLQRALVRNAGSGSETQLRVSWDSVLSAEQTGRWWIVGSAWSGAPMIDNSHHTHLQKQLVGTVSSKILELARKQRMNTDIRRNIFCTIMTSEDFLDAFEKLLKLGLKDQQEREIIHVLMDCCLQEKTYNPFYAFLASKFCEYERRFQMTFQFSIWDKFRDLENLPATNFSNLVHLVAHLLKTKSLSLSILKVVEFSELDKPRVRFLRKVLSILLMETEVEDLSLIFTRVSDNPKLGVLREGLKLFISHFLLKNAQAHRSADEANVLREKADLATKCLQGKASLRM

SEQ ID NO: 906320 - protein, 675 aa, Homo sapiens
SRSAGEAGPGGSQGRVVRMKRRGGRGPRRGPAGGGEKALKRLKLAVEEFVHATSEGEAPGGCEGRGAPVSFRPGGRKSRKELRKEKRHLRKARRLQRTAGPEQGPGLGGRSGAEEASGHRQDTEERARPAPSRDPSPPRKPRPSRVKAKATAATAKTRPSAAATAAARKRALLAANEEEDREIRKLERCLGLNKRKKKDGSSSVPLSFARDGLDYILGALESGKNSGLYDSSGEEEEDAGQTLPESDLESDSQDESEEEEEGDVEKEKKAQEAEAQSEDDDEDTEEEQGEEKEKGAQEKRRGKRVRFAEDEEKSENSSEDGDITDKSLCGSGEKYIPPHVRQAEETVDFKKKEELERLKKHVKGLLNRLSEPNMASISGQLEELYMAHSRKDMNDTLTSALMGACVTASAMPSRLMMEHVLLVSILHHTVGIEVGAHFLEAVVRKFDAIYKYGSEGKECDNLFTVIAHLYNFHVVQSLLIFDILKKLIGTFTEKDIELILLMLKNVGFSLRKDDALSLKELITEAQTKASGAGSEFQDQTRIRFMLETMLALKNNDMRKIPGYDPEPVEKLRKLQRALVRNAGSGSETQLRVSWDSVLSAEQTGRWWIVGSAWSGAPMIDNSHHTHLQKQLVGTVSSKILELARKQRMNTDIRRNIFCTIMTSEDFLDAFEKLLK

SEQ ID NO: 906321 - protein, 675 aa, Homo sapiens; identical to SEQ ID NO: 906320

SEQ ID NO: 906322 - protein, 768 aa, Homo sapiens
SRSAGEAGPGGSQGRVVRMKRRGGRGPRRGPAGGGEKALKRLKLAVEEFVHATSEGEAPGGCEGRGAPVSFRPGGRKSRKELRKEKRHLRKARRLQRTAGPEQGPGLGGRSGAEEASGHRQDTEERARPAPSRDPSPPRKPRPSRVKAKATAATAKTRPSAAATAAARKRALLAANEEEDREIRKLERCLGLNKRKKKDGSSSVPLSFARDGLDYILGALESGKNSGLYDSSGEEEEDAGQTLPESDLESDSQDESEEEEEGDVEKEKKAQEAEAQSEDDDEDTEEEQGEEKEKGAQEKRRGKRVRFAEDEEKSENSSEDGDITDKSLCGSGEKYIPPHVRQAEETVDFKKKEELERLKKHVKGLLNRLSEPNMASISGQLEELYMAHSRKDMNDTLTSALMGACVTASAMPSRLMMEHVLLVSILHHTVGIEVGAHFLEAVVRKFDAIYKYGSEGKECDNLFTVIAHLYNFHVVQSLLIFDILKKLIGTFTEKDIELILLMLKNVGFSLRKDDALSLKELITEAQTKASGAGSEFQDQTRIRFMLETMLALKNNDMRKIPGYDPEPVEKLRKLQRALVRNAGSGSETQLRVSWDSVLSAEQTGRWWIVGSAWSGAPMIDNSHHTHLQKQLVGTVSSKILELARKQRMNTDIRRNIFCTIMTSEDFLDAFEKLLKLGLKDQQEREIIHVLMDCCLQEKTYNPFYAFLASKFCEYERRFQMTFQFSIWDKFRDLENLPATNFSNLVHLVAHLLKTKSLSLSILKLSFTF

SEQ ID NO: 906323 - protein, 857 aa, Homo sapiens
SRSAGEAGPGGSQGRVVRMKRRGGRGPRRGPAGGGEKALKRLKLAVEEFVHATSEGEAPGGCEGRGAPVSFRPGGRKSRKELRKEKRHLRKARRLQRTAGPEQGPGLGGRSGAEEASGHRQDTEERARPAPSRDPSPPRKPRPSRVKAKATAATAKTRPSAAATAAARKRALLAANEEEDREIRKLERCLGLNKRKKKDGSSSVPLSFARDGLDYILGALESGKNSGLYDSSGEEEEDAGQTLPESDLESDSQDESEEEEEGDVEKEKKAQEAEAQSEDDDEDTEEEQGEEKEKGAQEKRRGKRVRFAEDEEKSENSSEDGDITDKSLCGSGEKYIPPHVRQAEETVDFKKKEELERLKKHVKGLLNRLSEPNMASISGQLEELYMAHSRKDMNDTLTSALMGACVTASAMPSRLMMEHVLLVSILHHTVGIEVGAHFLEAVVRKFDAIYKYGSEGKECDNLFTVIAHLYNFHVVQSLLIFDILKKLIGTFTEKDIELILLMLKNVGFSLRKDDALSLKELITEAQTKASGAGSEFQDQTRIRFMLETMLALKNNDMRKIPGYDPEPVEKLRKLQRALVRNAGSGSETQLRVSWDSVLSAEQTGRWWIVGSAWSGAPMIDNSHHTHLQKQLVGTVSSKILELARKQRMNTDIRRNIFCTIMTSEDFLDAFEKLLKLGLKDQQEREIIHVLMDCCLQEKTYNPFYAFLASKFCEYERRFQMTFQFSIWDKFRDLENLPATNFSNLVHLVAHLLKTKSLSLSILKVVEFSELDKPRVRFLRKVLSILLMETEVEDLSLIFTRVSDNPKLGVLREGLKLFISHFLLKNAQAHRSADEANVLREKADLATKCLQGKASLRM

SEQ ID NO: 906324 - protein, 167 aa, Homo sapiens
MDCCLQEKTYNPFYAFLASKFCEYERRFQMTFQFSIWDKFRDLENLPATNFSNLVHLVAHLLKTKSLSLSILKVVEFSELDKPRVRFLRKVLSILLMETEVEDLSLIFTRVSDNPKLGVLREGLKLFISHFLLKNAQAHRSADEANVLREKADLATKCLQGKASLRM

SEQ ID NO: 906325 - protein, 826 aa, Homo sapiens
SRSAGEAGPGGSQGRVVRMKRRGGRGPRRGPAGGGEKALKRLKLAVEEFVHATSEGEAPGGCEGRGAPVSFRPGGRKSRKELRKEKRHLRKARRLQRTAGPEQGPGLGGRSGAEEASGHRQDTEERARPAPSRDPSPPRKPRPSRVKAKATAATAKTRPSAAATAAARKRALLAANEEEDREIRKLERCLGLNKRKKKDGSSSVPLSFARDGLDYILGALESGKNSGLYDSSGEEEEDAGQTLPESDLESDSQDESEEEEEGDVEKEKKAQEAEAQSEDDDEDTEEEQGEEKEKGAQEKRRGKRVRFAEDEEKSENSSEDGDITDKSLCGSGEKYIPPHVRQAEETVDFKKKEELERLKKHVKGLLNRLSEPNMASISGQLEELYMAHSRKDMNDTLTSALMGACVTASAMPSRLMMEHVLLVSILHHTVGIEVGAHFLEAVVRKFDAIYKYGSEGKECDNLFTVIAHLYNFHVVQSLLIFDILKKLIGTFTEKDIELILLMLKNVGFSLRKDDALSLKELITEAQTKASGAGSEFQDQTRIRFMLETMLALKNNDMRKIPGYDPEPVEKLRKLQRALVRNAGSGSETQLRVSWDSVLSAEQTGRWWIVGSAWSGAPMIDNSHHTHLQKQLVGTVSSKILELARKQRMNTDIRRNIFCTIMTSEDFLDAFEKLLKLGLKDQQEREIIHVLMDCCLQEKTYNPFYAFLASKFCEYERRFQMTFQFSIWDKFRDLENLPATNFSNLVHLVAHLLKTKSLSLSILKVVEFSELDKPRVRFLRKVLSILLMETEVEDLSLIFTRVSEPKLGVLREGALDHLGTSSIDAGN

SEQ ID NO: 906326 - protein, 669 aa, Homo sapiens
SRSAGEAGPGGSQGRVVRMKRRGGRGPRRGPAGGGEKALKRLKLAVEEFVHATSEGEAPGGCEGRGAPVSFRPGGRKSRKELRKEKRHLRKARRLQRTAGPEQGPGLGGRSGAEEASGHRQDTEERARPAPSRDPSPPRKPRPSRVKAKATAATAKTRPSAAATAAARKRALLAANEEEDREIRKLERCLGLNKRKKKDGSSSVPLSFARDGLDYILGALESGKNSGLYDSSGEEEEDAGQTLPESDLESDSQDESEEEEEGDVEKEKKAQEAEAQSEDDDEDTEEEQGEEKEKGAQEKRRGKRVRFAEDEEKSENSSEDGDITDKSLCGSGEKYIPPHVRQAEETVDFKKKEELERLKKHVKGLLNRLSEPNMASISGQLEELYMAHSRKDMNDTLTSALMGACVTASAMPSRLMMEHVLLVSILHHTVGIEVGAHFLEAVVRKFDAIYKYGSEGKECDNLFTVIAHLYNFHVVQSLLIFDILKKLIGTFTEKDIELILLMLKNVGFSLRKDDALSLKELITEAQTKASGAGSEFQDQTRIRFMLETMLALKNNDMRKIPGYDPEPVEKLRKLQRALVRNAGSGSETQLRVSWDSVLSAEQTGRWWIVGSAWSGAPMIDNSHHTHLQKQLVGTVGTPMLKAARQRHPPVWCVVLALPGAALLLFLNGH

SEQ ID NO: 906327 - protein, 79 aa, Homo sapiens
SGRLLLLNSRPRRRRRRSLSLENHAVLFPSFIRSGNPNLPLMSSHGKYPHLQPPGLTLYPVLVERTTRSSVSCSPIDRA

SEQ ID NO: 906328 - protein, 221 aa, Homo sapiens
MLSRLRDPPGCSSEGLKCMDPPAGKPKRCPRSCEIRNRRLLHGVGDKSPPQCSAEGEFMPVQCKFVNTTDMMIFDLVHSYNRFPDAFVTFSSFQRRFPEVSGYCHCADSQGRELAETGLELLLDEIYDTIFAGLDLPSTFTETTLYRILQRRFLAVQSVISGRFRCPTKCEVERFTATSFGHPYVPSCRLRRHHHLRHRARRWARTSVLGRTVVLAHGAAR

SEQ ID NO: 906329 - protein, 128 aa, Homo sapiens
ERNCLPQARDDTLVRTWSSGTCSLGSNPGSVTPSSETLGKWLQLYPGAPSKVEIILLLPSSWDCSEREAPHSPRPPSSAMRGLSSRQLLWQRRSVAPCHPAKKWCPASARSLPMSSMMPRPRMDHLSA

SEQ ID NO: 906330 - protein, 132 aa, Homo sapiens
MKFMTPFLLAWTFLPPSLKPPCTGYCRDGSSQFNQSSLADSDAPQNVKWSGLQQPALVTPMFQAAAEMATIRRCSARRKGPAGVWTPRGRKCMEPGSKGSRHLVVGFLWGLPLSASDHITLAVLQTNLSGPH

SEQ ID NO: 906331 - protein, 113 aa, Homo sapiens
MDISFFSFAQKSQLTPYEFSRKVPTFATPWPDFVPRAGGENYKEFSELLPNRQGLKKADCSFWSKYISSLKTSADGAKGGQSAESEEEELTAGSGLREDLLSLQEPGSKTYSK

SEQ ID NO: 906332 - protein, 162 aa, Homo sapiens
NYFLHKSPQEAYKSYIRAYDSPLALTSEQAGKQFEESRGRTSSKTAFYQALQNSLGGEDSDARVEAAATWYYSLEHSTDDYASFSRALENATRDYFIICPIIDMASAWAKRARGNVFMYHAPENYGHGKPGAAGGMFSLPWGFPFYPAYEGQFSLEEKKPVA

SEQ ID NO: 906333 - protein, 170 aa, Homo sapiens
FFSTPGGEVTCLTLNSLGIQMCSEENGGAWRILDCGSPDIEVHTYPFGWYQKPIAQNNAPSFCPLVVLPSLTEKVSLDSWQSLALSSVVVDPSIRHFDVAHVSTAATSNFSAVRDLCLSECSQHEACLITTLQTQPGAVRCMFYADTQSCTHSLQKKSRRGREFSSSRRP

SEQ ID NO: 906334 - protein, 1027 aa, Homo sapiens
SFRVCNPGLFPTLLSRLSKLGITAASAPGLPRPQLWQTIQTQGHFQLQLPPGKMCSADYADLLQTFQVFILDELTARGFCQIQVKTFGTLVSIPVCNNSSVQVGCLTRERLGVNVTWKSRLEDIPVASLPDLHDIERALVGKDLLGRFTDLIQSGSFQLHLDSKTFPAETIRFLQGDHFGTSPRTWFGCSEGFYQVLTSEASQDGLGCVKCPEGSYSQDEECIPCPVGFYQEQAGSLACVPCPVGRTTISAGAFSQTHCVTDCQRNEAGLQCDQNGQYRASQKDRGSGKAFCVDGEGRRLPWWETEAPLEDSQCLMMQKFEKVPESKVIFDANAPVAVRSKVPDSEFPVMQCLTDCTEDEACSFFTVSTTEPEISCDFYAWTSDNVACMTSDQKRDALGNSKATSFGSLRCQVKVRSHGQDSPAVYLKKGQGSTTTLQKRFEPTGFQNMLSGLYNPIVFSASGANLTDAHLFCLLACDRDLCCDGFVLTQVQGGAIICGLLSSPSVLLCNVKDWMDPSEAWANATCPGVTYDQESHQVILRLGDQEFIKSLTPLEGTQDTFTNFQQVYLWKDSDMGSRPESMGCRKDTVPRPASPTEAGLTTELFSPVDLNQVIVNGNQSLSSQKHWLFKHLFSAQQANLWCLSRCVQEHSFCQLAEITESASLYFTCTLYPEAQVCDDIMESNAQGCRLILPQMPKALFRKKVILEDKVKNFYTRLPFQKLMGISIRNKVPMSEKSISNGFFECERRCDADPCCTGFGFLNVSQLKGGEVTCLTLNSLGIQMCSEENGGAWRILDCGSPDIEVHTYPFGWYQKPIAQNNAPSFCPLVVLPSLTEKVSLDSWQSLALSSVVVDPSIRHFDVAHVSTAATSNFSAVRDLCLSECSQHEACLITTLQTQPGAVRCMFYADTQSCTHSLQGQNCRLLLREEATHIYRKPGISLLSYEASVPSVPISTHGPAAGQVPGHPGGYLMEASGPVPWSSICCPAPGREALPGTRALELDRLLGCQQAKGQLLAARHQNIHVSWSQ

SEQ ID NO: 906335 - protein, 2083 aa, Homo sapiens
MLSRLRDPPGCSSEGLKCMDPPAGKPKRCPRSCEIRNRRLLHGVGDKSPPQCSAEGEFMPVQCKFVNTTDMMIFDLVHSYNRFPDAFVTFSSFQRRFPEVSGYCHCADSQGRELAETGLELLLDEIYDTIFAGLDLPSTFTETTLYRILQRRFLAVQSVISGRFRCPTKCEVERFTATSFGHPYVPSCRRNGDYQAVQCQTEGPCWCVDAQGKEMHGTRQQGEPPSCAEGQSCASERQQALSRLYFGTSGYFSQHDLFSSPEKRWASPRVARFATSCPPTIKELFVDSGLLRPMVEGQSQQFSVSENLLKEAIRAIFPSRGLARLALQFTTNPKRLQQNLFGGKFLVNVGQFNLSGALGTRGTFNFSQFFQQLGLASFLNGGRQEDLAKPLSVGLDSNSSTGTPEAAKKDGTMNKPTVGSFGFEINLQENQNALKFLASLLELPEFLLFLQHAISVPEDVARDLGDVMETVLSSQTCEQTPERLFVPSCTTEGSYEDVQCFSGECWCVNSWGKELPGSRVRGGQPRCPTDCEKQRARMQSLMGSQPAGSTLFVPACTSEGHFLPVQCFNSECYCVDAEGQAIPGTRSAIGKPKKCPTPCQLQSEQAFLRTVQALLSNSSMLPTLSDTYIPQCSTDGQWRQVQCNGPPEQVFELYQRWEAQNKGQDLTPAKLLVKIMSYREAASGNFSLFIQSLYEAGQQDVFPVLSQYPSLQDVPLAALEGKRPQPRENILLEPYLFWQILNGQLSQYPGSYSDFSTPLAHFDLRNCWCVDEAGQELEGMRSEPSKLPTCPGSCEEAKLRVLQFIRETEEIVSASNSSRFPLGESFLVAKGIRLRNEDLGLPPLFPPREAFAEQFLRGSDYAIRLAAQSTLSFYQRRRFSPDDSAGASALLRSGPYMPQCDAFGSWEPVQCHAGTGHCWCVDEKGGFIPGSLTARSLQIPQCPTTCEKSRTSGLLSSWKQARSQENPSPKDLFVPACLETGEYARLQASGAGTWCVDPASGEELRPGSSSSAQCPSLCNVLKSGVLSRRVSPGYVPACRAEDGGFSPVQCDQAQGSCWCVMDSGEEVPGTRVTGGQPACESPRCPLPFNASEVVGGTILCETISGPTGSAMQQCQLLCRQGSWSVFPPGPLICSLESGRWESQLPQPRACQRPQLWQTIQTQGHFQLQLPPGKMCSADYADLLQTFQVFILDELTARGFCQIQVKTFGTLVSIPVCNNSSVQVGCLTRERLGVNVTWKSRLEDIPVASLPDLHDIERALVGKDLLGRFTDLIQSGSFQLHLDSKTFPAETIRFLQGDHFGTSPRTWFGCSEGFYQVLTSEASQDGLGCVKCPEGSYSQDEECIPCPVGFYQEQAGSLACVPCPVGRTTISAGAFSQTHCVTDCQRNEAGLQCDQNGQYRASQKDRGSGKAFCVDGEGRRLPWWETEAPLEDSQCLMMQKFEKVPESKVIFDANAPVAVRSKVPDSEFPVMQCLTDCTEDEACSFFTVSTTEPEISCDFYAWTSDNVACMTSDQKRDALGNSKATSFGSLRCQVKVRSHGQDSPAVYLKKGAIICGLLSSPSVLLCNVKDWMDPSEAWANATCPGVTYDQESHQVILRLGDQEFIKSLTPLEGTQDTFTNFQQVYLWKDSDMGSRPESMGCRKDTVPRPASPTEAGLTTELFSPVDLNQVIVNGNQSLSSQKHWLFKHLFSAQQANLWCLSRCVQEHSFCQLAEITESASLYFTCTLYPEAQVCDDIMESNAQGCRLILPQMPKALFRKKVILEDKVKNFYTRLPFQKLMGISIRNKVPMSEKSISNGFFECERRCDADPCCTGFGFLNVSQLKGGEVTCLTLNSLGIQMCSEENGGAWRILDCGSPDIEVHTYPFGWYQKPIAQNNAPSFCPLVVLPSLTEKVSLDSWQSLALSSVVVDPSIRHFDVAHVSTAATSNFSAVRDLCLSECSQHEACLITTLQTQPGAVRCMFYADTQSCTHSLQGQNCRLLLREEATHIYRKPGISLLSYEASVPSVPISTHGPAAGQVPGHPGGYLMEASGPVPWSSICCPAPGREALPGTRALELDRLLGCQQAKGQLLAARHQNIHVSWSQ

SEQ ID NO: 906336 - protein, 2101 aa, Homo sapiens
MLSRLRDPPGCSSEGLKCMDPPAGKPKRCPRSCEIRNRRLLHGVGDKSPPQCSAEGEFMPVQCKFVNTTDMMIFDLVHSYNRFPDAFVTFSSFQRRFPEVSGYCHCADSQGRELAETGLELLLDEIYDTIFAGLDLPSTFTETTLYRILQRRFLAVQSVISGRFRCPTKCEVERFTATSFGHPYVPSCRRNGDYQAVQCQTEGPCWCVDAQGKEMHGTRQQGEPPSCAEGQSCASERQQALSRLYFGTSGYFSQHDLFSSPEKRWASPRVARFATSCPPTIKELFVDSGLLRPMVEGQSQQFSVSENLLKEAIRAIFPSRGLARLALQFTTNPKRLQQNLFGGKFLVNVGQFNLSGALGTRGTFNFSQFFQQLGLASFLNGGRQEDLAKPLSVGLDSNSSTGTPEAAKKDGTMNKPTVGSFGFEINLQENQNALKFLASLLELPEFLLFLQHAISVPEDVARDLGDVMETVLSSQTCEQTPERLFVPSCTTEGSYEDVQCFSGECWCVNSWGKELPGSRVRGGQPRCPTDCEKQRARMQSLMGSQPAGSTLFVPACTSEGHFLPVQCFNSECYCVDAEGQAIPGTRSAIGKPKKCPTPCQLQSEQAFLRTVQALLSNSSMLPTLSDTYIPQCSTDGQWRQVQCNGPPEQVFELYQRWEAQNKGQDLTPAKLLVKIMSYREAASGNFSLFIQSLYEAGQQDVFPVLSQYPSLQDVPLAALEGKRPQPRENILLEPYLFWQILNGQLSQYPGSYSDFSTPLAHFDLRNCWCVDEAGQELEGMRSEPSKLPTCPGSCEEAKLRVLQFIRETEEIVSASNSSRFPLGESFLVAKGIRLRNEDLGLPPLFPPREAFAEQFLRGSDYAIRLAAQSTLSFYQRRRFSPDDSAGASALLRSGPYMPQCDAFGSWEPVQCHAGTGHCWCVDEKGGFIPGSLTARSLQIPQCPTTCEKSRTSGLLSSWKQARSQENPSPKDLFVPACLETGEYARLQASGAGTWCVDPASGEELRPGSSSSAQCPSLCNVLKSGVLSRRVSPGYVPACRAEDGGFSPVQCDQAQGSCWCVMDSGEEVPGTRVTGGQPACESPRCPLPFNASEVVGGTILCETISGPTGSAMQQCQLLCRQGSWSVFPPGPLICSLESGRWESQLPQPRACQRPQLWQTIQTQGHFQLQLPPGKMCSADYADLLQTFQVFILDELTARGFCQIQVKTFGTLVSIPVCNNSSVQVGCLTRERLGVNVTWKSRLEDIPVASLPDLHDIERALVGKDLLGRFTDLIQSGSFQLHLDSKTFPAETIRFLQGDHFGTSPRTWFGCSEGFYQVLTSEASQDGLGCVKCPEGSYSQDEECIPCPVGFYQEQAGSLACVPCPVGRTTISAGAFSQTHCVTDCQRNEAGLQCDQNGQYRASQKDRGSGKAFCVDGEGRRLPWWETEAPLEDSQCLMMQKFEKVPESKVIFDANAPVAVRSKVPDSEFPVMQCLTDCTEDEACSFFTVSTTEPEISCDFYAWTSDNVACMTSDQKRDALGNSKATSFGSLRCQVKVRSHGQDSPAVYLKKGQGSTTTLQKRFEPTGFQNMLSGLYNPIVFSASGANLTDAHLFCLLACDRDLCCDGFVLTQVQGGAIICGLLSSPSVLLCNVKDWMDPSEAWANATCPGVTYDQESHQVILRLGDQEFIKSLTPLEGTQDTFTNFQQVYLWKDSDMGSRPESMGCRKDTVPRPASPTEAGCVQEHSFCQLAEITESASLYFTCTLYPEAQVCDDIMESNAQGCRLILPQMPKALFRKKVILEDKVKNFYTRLPFQKLMGISIRNKVPMSEKSISNGFFECERRCDADPCCTGFGFLNVSQLKGGEVTCLTLNSLGIQMCSEENGGAWRILDCGSPDIEVHTYPFGWYQKPIAQNNAPSFCPLVVLPSLTEKVSLDSWQSLALSSVVVDPSIRHFDVAHVSTAATSNFSAVRDLCLSECSQHEACLITTLQTQPGAVRCMFYADTQSCTHSLQGQNCRLLLREEATHIYRKPGISLLSYEASVPSVPISTHGPAAGQVPGHPGGYLMEASGPVPWSSICCPAPGREALPGTRALELDRLLGCQQAKGQLLAARHQNIHVSWSQ

SEQ ID NO: 906337 - protein, 2147 aa, Homo sapiens
MLSRLRDPPGCSSEGLKCMDPPAGKPKRCPRSCEIRNRRLLHGVGDKSPPQCSAEGEFMPVQCKFVNTTDMMIFDLVHSYNRFPDAFVTFSSFQRRFPEVSGYCHCADSQGRELAETGLELLLDEIYDTIFAGLDLPSTFTETTLYRILQRRFLAVQSVISGRFRCPTKCEVERFTATSFGHPYVPSCRRNGDYQAVQCQTEGPCWCVDAQGKEMHGTRQQGEPPSCAEGQSCASERQQALSRLYFGTSGYFSQHDLFSSPEKRWASPRVARFATSCPPTIKELFVDSGLLRPMVEGQSQQFSVSENLLKEAIRAIFPSRGLARLALQFTTNPKRLQQNLFGGKFLVNVGQFNLSGALGTRGTFNFSQFFQQLGLASFLNGGRQEDLAKPLSVGLDSNSSTGTPEAAKKDGTMNKPTVGSFGFEINLQENQNALKFLASLLELPEFLLFLQHAISVPEDVARDLGDVMETVLSSQTCEQTPERLFVPSCTTEGSYEDVQCFSGECWCVNSWGKELPGSRVRGGQPRCPTDCEKQRARMQSLMGSQPAGSTLFVPACTSEGHFLPVQCFNSECYCVDAEGQAIPGTRSAIGKPKKCPTPCQLQSEQAFLRTVQALLSNSSMLPTLSDTYIPQCSTDGQWRQVQCNGPPEQVFELYQRWEAQNKGQDLTPAKLLVKIMSYREAASGNFSLFIQSLYEAGQQDVFPVLSQYPSLQDVPLAALEGKRPQPRENILLEPYLFWQILNGQLSQYPGSYSDFSTPLAHFDLRNCWCVDEAGQELEGMRSEPSKLPTCPGSCEEAKLRVLQFIRETEEIVSASNSSRFPLGESFLVAKGIRLRNEDLGLPPLFPPREAFAEQFLRGSDYAIRLAAQSTLSFYQRRRFSPDDSAGASALLRSGPYMPQCDAFGSWEPVQCHAGTGHCWCVDEKGGFIPGSLTARSLQIPQCPTTCEKSRTSGLLSSWKQARSQENPSPKDLFVPACLETGEYARLQASGAGTWCVDPASGEELRPGSSSSAQCPSLCNVLKSGVLSRRVSPGYVPACRAEDGGFSPVQCDQAQGSCWCVMDSGEEVPGTRVTGGQPACESPRCPLPFNASEVVGGTILCETISGPTGSAMQQCQLLCRQGSWSVFPPGPLICSLESGRWESQLPQPRACQRPQLWQTIQTQGHFQLQLPPGKMCSADYADLLQTFQVFILDELTARGFCQIQVKTFGTLVSIPVCNNSSVQVGCLTRERLGVNVTWKSRLEDIPVASLPDLHDIERALVGKDLLGRFTDLIQSGSFQLHLDSKTFPAETIRFLQGDHFGTSPRTWFGCSEGFYQVLTSEASQDGLGCVKCPEGSYSQDEECIPCPVGFYQEQAGSLACVPCPVGRTTISAGAFSQTHCVTDCQRNEAGLQCDQNGQYRASQKDRGSGKAFCVDGEGRRLPWWETEAPLEDSQCLMMQKFEKVPESKVIFDANAPVAVRSKVPDSEFPVMQCLTDCTEDEACSFFTVSTTEPEISCDFYAWTSDNVACMTSDQKRDALGNSKATSFGSLRCQVKVRSHGQDSPAVYLKKGQGSTTTLQKRFEPTGFQNMLSGLYNPIVFSASGANLTDAHLFCLLACDRDLCCDGFVLTQVQGGAIICGLLSSPSVLLCNVKDWMDPSEAWANATCPGVTYDQESHQVILRLGDQEFIKSLTPLEGTQDTFTNFQQVYLWKDSDMGSRPESMGCRKDTVPRPASPTEAGLTTELFSPVDLNQVIVNGNQSLSSQKHWLFKHLFSAQQANLWCLSRCVQEHSFCQLAEITESASLYFTCTLYPEAQVCDDIMESNAQGCRLILPQMPKALFRKKVILEDKVKNFYTRLPFQKLMGISIRNKVPMSEKSISNGFFECERRCDADPCCTGFGFLNVSQLKGGEVTCLTLNSLGIQMCSEENGGAWRILDCGSPDIEVHTYPFGWYQKPIAQNNAPSFCPLVVLPSLTEKVSLDSWQSLALSSVVVDPSIRHFDVAHVSTAATSNFSAVRDLCLSECSQHEACLITTLQTQPGAVRCMFYADTQSCTHSLQGQNCRLLLREEATHIYRKPGISLLSYEASVPSVPISTHGPAAGQVPGHPGGYLMEASGPVPWSSICCPAPGREALPGTRALELDRLLGCQQAKGQLLAARHQNIHVSWSQ

SEQ ID NO: 906338 - protein, 2126 aa, Homo sapiens
MLSRLRDPPGCSSEGLKCMDPPAGKPKRCPRSCEIRNRRLLHGVGDKSPPQCSAEGEFMPVQCKFVNTTDMMIFDLVHSYNRFPDAFVTFSSFQRRFPEVSGYCHCADSQGRELAETGLELLLDEIYDTIFAGLDLPSTFTETTLYRILQRRFLAVQSVISGRFRCPTKCEVERFTATSFGHPYVPSCRRNGDYQAVQCQTEGPCWCVDAQGKEMHGTRQQGEPPSCAEGQSCASERQQALSRLYFGTSGYFSQHDLFSSPEKRWASPRVARFATSCPPTIKELFVDSGLLRPMVEGQSQQFSVSENLLKEAIRAIFPSRGLARLALQFTTNPKRLQQNLFGGKFLVNVGQFNLSGALGTRGTFNFSQFFQQLGLASFLNGGRQEDLAKPLSVGLDSNSSTGTPEAAKKDGTMNKPTVGSFGFEINLQENQNALKFLASLLELPEFLLFLQHAISVPEDVARDLGDVMETVLSSQTCEQTPERLFVPSCTTEGSYEDVQCFSGECWCVNSWGKELPGSRVRGGQPRCPTDCEKQRARMQSLMGSQPAGSTLFVPACTSEGHFLPVQCFNSECYCVDAEGQAIPGTRSAIGKPKKCPTPCQLQSEQAFLRTVQALLSNSSMLPTLSDTYIPQCSTDGQWRQVQCNGPPEQVFELYQRWEAQNKGQDLTPAKLLVKIMSYREAASGNFSLFIQSLYEAGQQDVFPVLSQYPSLQDVPLAALEGKRPQPRENILLEPYLFWQILNGQLSQYPGSYSDFSTPLAHFDLRNCWCVDEAGQELEGMRSEPSKLPTCPGSCEEAKLRVLQFIRETEEIVSASNSSRFPLGESFLVAKGIRLRNEDLGLPPLFPPREAFAEQFLRGSDYAIRLAAQSTLSFYQRRRFSPDDSAGASALLRSGPYMPQCDAFGSWEPVQCHAGTGHCWCVDEKGGFIPGSLTARSLQIPQCPTTCEKSRTSGLLSSWKQARSQENPSPKDLFVPACLETGEYARLQASGAGTWCVDPASGEELRPGSSSSAQCPSLCNVLKSGVLSRRVSPGYVPACRAEDGGFSPVQCDQAQGSCWCVMDSGEEVPGTRVTGGQPACESPRCPLPFNASEVVGGTILCETISGPTGSAMQQCQLLCRQGSWSVFPPGPLICSLESGRWESQLPQPRACQRPQLWQTIQTQGHFQLQLPPGKMCSADYADLLQTFQVFILDELTARGFCQIQVKTFGTLVSIPVCNNSSVQVGCLTRERLGVNVTWKSRLEDIPVASLPDLHDIERALVGKDLLGRFTDLIQSGSFQLHLDSKTFPAETIRFLQGDHFGTSPRTWFGCSEGFYQVLTSEASQDGLGCVKCPEGSYSQDEECIPCPVGFYQEQAGSLACVPCPVGRTTISAGAFSQTHCVTDCQRNEAGLQCDQNGQYRASQKDRGSGKAFCVDGEGRRLPWWETEAPLEDSQCLMMQKFEKVPESKVIFDANAPVAVRSKVPDSEFPVMQCLTDCTEDEACSFFTVSTTEPEISCDFYAWTSDNVACMTSDQKRDALGNSKATSFGSLRCQVKVRSHGQDSPAVYLKKGQGSTTTLQKRFEPTGFQNMLSGLYNPIVFSASGANLTDAHLFCLLACDRDLCCDGFVLTQVQGGAIICGLLSSPSVLLCNVKDWMDPSEAWANATCPGVTYDQESHQVILRLGDQEFIKSLTPLEGTQDTFTNFQQVYLWKDSDMGSRPESMGCRKDTVPRPASPTEAGLTTELFSPVDLNQVIVNGNQSLSSQKHWLFKHLFSAQQANLWCLSRCVQEHSFCQLAEITESASLYFTCTLYPEAQVCDDIMESNAQGCRLILPQMPKALFRKKVILEDKVKNFYTRLPFQKLMGISIRNKVPMSEKSISNGFFECERRCDADPCCTGFGFLNVSQLKGGEVTCLTLNSLGIQMCSEENGGAWRILDCGSPDIEVHTYPFGWYQKPMSLDSWQSLALSSVVVDPSIRHFDVAHVSTAATSNFSAVRDLCLSECSQHEACLITTLQTQPGAVRCMFYADTQSCTHSLQGQNCRLLLREEATHIYRKPGISLLSYEASVPSVPISTHGPAAGQVPGHPGGYLMEASGPVPWSSICCPAPGREALPGTRALELDRLLGCQQAKGQLLAARHQNIHVSWSQ

SEQ ID NO: 906339 - protein, 2147 aa, Homo sapiens; identical to SEQ ID NO: 906337

SEQ ID NO: 906340 - protein, 2166 aa, Homo sapiens
MLSRLRDPPGCSSEGLKCMDPPAGKPKRCPRSCEIRNRRLLHGVGDKSPPQCSAEGEFMPVQCKFVNTTDMMIFDLVHSYNRFPDAFVTFSSFQRRFPEVSGYCHCADSQGRELAETGLELLLDEIYDTIFAGLDLPSTFTETTLYRILQRRFLAVQSVISGRFRCPTKCEVERFTATSFGHPYVPSCRRNGDYQAVQCQTEGPCWCVDAQGKEMHGTRQQGEPPSCAEGQSCASERQQALSRLYFGTSGYFSQHDLFSSPEKRWASPRVARFATSCPPTIKELFVDSGLLRPMVEGQSQQFSVSENLLKEAIRAIFPSRGLARLALQFTTNPKRLQQNLFGGKFLVNVGQFNLSGALGTRGTFNFSQFFQQLGLASFLNGGRQEDLAKPLSVGLDSNSSTGTPEAAKKDGTMNKPTVGSFGFEINLQENQNALKFLASLLELPEFLLFLQHAISVPEDVARDLGDVMETVLSSQTCEQTPERLFVPSCTTEGSYEDVQCFSGECWCVNSWGKELPGSRVRGGQPRCPTDCEKQRARMQSLMGSQPAGSTLFVPACTSEGHFLPVQCFNSECYCVDAEGQAIPGTRSAIGKPKKCPTPCQLQSEQAFLRTVQALLSNSSMLPTLSDTYIPQCSTDGQWRQVQCNGPPEQVFELYQRWEAQNKGQDLTPAKLLVKIMSYREAASGNFSLFIQSLYEAGQQDVFPVLSQYPSLQDVPLAALEGKRPQPRENILLEPYLFWQILNGQLSQYPGSYSDFSTPLAHFDLRNCWCVDEAGQELEGMRSEPSKLPTCPGSCEEAKLRVLQFIRETEEIVSASNSSRFPLGESFLVAKGIRLRNEDLGLPPLFPPREAFAEQFLRGSDYAIRLAAQSTLSFYQRRRFSPDDSAGASALLRSGPYMPQCDAFGSWEPVQCHAGTGHCWCVDEKGGFIPGSLTARSLQIPQCPTTCEKSRTSGLLSSWKQARSQENPSPKDLFVPACLETGEYARLQASGAGTWCVDPASGEELRPGSSSSAQCPSLCNVLKSGVLSRRVSPGYVPACRAEDGGFSPVQCDQAQGSCWCVMDSGEEVPGTRVTGGQPACESPRCPLPFNASEVVGGTILCETISGPTGSAMQQCQLLCRQGSWSVFPPGPLICSLESGRWESQLPQPRACQRPQLWQTIQTQGHFQLQLPPGKMCSADYADLLQTFQVFILDELTARGFCQIQVKTFGTLVSIPVCNNSSVQVGCLTRERLGVNVTWKSRLEDIPVASLPDLHDIERALVGKDLLGRFTDLIQSGSFQLHLDSKTFPAETIRFLQGDHFGTSPRTWFGCSEGFYQVLTSEASQDGLGCVKCPEGSYSQDEECIPCPVGFYQEQAGSLACVPCPVGRTTISAGAFSQTHCVTDCQRNEAGLQCDQNGQYRASQKDRGSGKAFCVDGEGRRLPWWETEAPLEDSQCLMMQKFEKVPESKVIFDANAPVAVRSKVPDSEFPVMQCLTDCTEDEACSFFTVSTTEPEISCDFYAWTSDNVACMTSDQKRDALGNSKATSFGSLRCQVKVRSHGQDSPAVYLKKGQGSTTTLQKRFEPTGFQNMLSGLYNPIVFSASGANLTDAHLFCLLACDRDLCCDGFVLTQVQGGAIICGLLSSPSVLLCNVKDWMDPSEAWANATCPGVTYDQESHQVILRLGDQEFIKSLTPLEGTQDTFTNFQQVYLWKDSDMGSRPESMGCRKDTVPRPASPTEAGLTTELFSPVDLNQVIVNGNQSLSSQKHWLFKHLFSAQQANLWCLSRCVQEHSFCQLAEITESASLYFTCTLYPEAQVCDDIMESNAQGCRLILPQMPKALFRKKVILEDKVKNFYTRLPFQKLMGISIRNKVPMSEKSISNGFFECERRCDADPCCTGFGFLNVSQLKGGEVTCLTLNSLGIQMCSEENGGAWRILDCGSPDIEVHTYPFGWYQKPIAQNNAPSFCPLVVLPSLTEKVSLDSWQSLALSSVVVDPSIRHFDVAHVSTAATSNFSAVRDLCLSEWFPTLKACLHQPLCKPMSECSQHEACLITTLQTQPGAVRCMFYADTQSCTHSLQGQNCRLLLREEATHIYRKPGISLLSYEASVPSVPISTHGPAAGQVPGHPGGYLMEASGPVPWSSICCPAPGREALPGTRALELDRLLGCQQAKGQLLAARHQNIHVSWSQ

SEQ ID NO: 906341 - protein, 2147 aa, Homo sapiens; identical to SEQ ID NO: 906337

SEQ ID NO: 906342 - protein, 2147 aa, Homo sapiens; identical to SEQ ID NO: 906337

SEQ ID NO: 906343 - protein, 2147 aa, Homo sapiens; identical to SEQ ID NO: 906337

SEQ ID NO: 906344 - protein, 2147 aa, Homo sapiens; identical to SEQ ID NO: 906337

SEQ ID NO: 906345 - protein, 2147 aa, Homo sapiens; identical to SEQ ID NO: 906337

SEQ ID NO: 906346 - protein, 2147 aa, Homo sapiens; identical to SEQ ID NO: 906337

SEQ ID NO: 906347 - protein, 2147 aa, Homo sapiens; identical to SEQ ID NO: 906337

SEQ ID NO: 906348 - protein, 2147 aa, Homo sapiens; identical to SEQ ID NO: 906337

SEQ ID NO: 906349 - protein, 2147 aa, Homo sapiens; identical to SEQ ID NO: 906337

SEQ ID NO: 906350 - protein, 150 aa, Homo sapiens
FLLADSRVSPQRAITEQAGKQFEESRGRTSSKTAFYQALQNSLGGEDSDARVEAAATWYYSLEHSTDDYASFSRALENATRDYFIICPIIDMASAWAKRARGNVFMYHAPENYGHGKPGAAGGMFSLPWGFPFYPAYEGQFSLEEKKPVA

SEQ ID NO: 906351 - protein, 2129 aa, Homo sapiens
MLSRLRDPPGCSSEGLKCMDPPAGKPKRCPRSCEIRNRRLLHGVGDKSPPQCSAEGEFMPVQCKFVNTTDMMIFDLVHSYNRFPDAFVTFSSFQRRFPEVSGYCHCADSQGRELAETGLELLLDEIYDTIFAGLDLPSTFTETTLYRILQRRFLAVQSVISGRFRCPTKCEVERFTATSFGHPYVPSCRRNGDYQAVQCQTEGPCWCVDAQGKEMHGTRQQGEPPSCAEGQSCASERQQALSRLYFGTSGYFSQHDLFSSPEKRWASPRVARFATSCPPTIKELFVDSGLLRPMVEGQSQQFSVSENLLKEAIRAIFPSRGLARLALQFTTNPKRLQQNLFGGKFLVNVGQFNLSGALGTRGTFNFSQFFQQLGLASFLNGGRQEDLAKPLSVGLDSNSSTGTPEAAKKDGTMNKPTVGSFGFEINLQENQNALKFLASLLELPEFLLFLQHAISVPEDVARDLGDVMETVLSSQTCEQTPERLFVPSCTTEGSYEDVQCFSGECWCVNSWGKELPGSRVRGGQPRCPTDCEKQRARMQSLMGSQPAGSTLFVPACTSEGHFLPVQCFNSECYCVDAEGQAIPGTRSAIGKPKKCPTPCQLQSEQAFLRTVQALLSNSSMLPTLSDTYIPQCSTDGQWRQVQCNGPPEQVFELYQRWEAQNKGQDLTPAKLLVKIMSYREAASGNFSLFIQSLYEAGQQDVFPVLSQYPSLQDVPLAALEGKRPQPRENILLEPYLFWQILNGQLSQYPGSYSDFSTPLAHFDLRNCWCVDEAGQELEGMRSEPSKLPTCPGSCEEAKLRVLQFIRETEEIVSASNSSRFPLGESFLVAKGIRLRNEDLGLPPLFPPREAFAEQFLRGSDYAIRLAAQSTLSFYQRRRFSPDDSAGASALLRSGPYMPQCDAFGSWEPVQCHAGTGHCWCVDEKGGFIPGSLTARSLQIPQCPTTCEKSRTSGLLSSWKQARSQENPSPKDLFVPACLETGEYARLQASGAGTWCVDPASGEELRPGSSSSAQCPSLCNVLKSGVLSRRVSPGYVPACRAEDGGFSPVQCDQAQGSCWCVMDSGEEVPGTRVTGGQPACESPRCPLPFNASEVVGGTILCETISGPTGSAMQQCQLLCRQGSWSVFPPGPLICSLESGRWESQLPQPRACQRPQLWQTIQTQGHFQLQLPPGKMCSADYADLLQTFQVFILDELTARGFCQIQVKTFGTLVSIPVCNNSSVQVGCLTRERLGVNVTWKSRLEDIPVASLPDLHDIERALVGKDLLGRFTDLIQSGSFQLHLDSKTFPAETIRFLQGDHFGTSPRTWFGCSEGFYQVLTSEASQDGLGCVKCPEGSYSQDEECIPCPVGFYQEQAGSLACVPCPVGRTTISAGAFSQTHCVTDCQRNEAGLQCDQNGQYRASQKDRGSGKAFCVDGEGRRLPWWETEAPLEDSQCLMMQKFEKVPESKVIFDANAPVAVRSKVPDSEFPVMQCLTDCTEDEACSFFTVSTTEPEISCDFYAWTSDNVACMTSDQKRDALGNSKATSFGSLRCQVKVRSHGQDSPAVYLKKGQGSTTTLQKRFEPTGFQNMLSGLYNPIVFSASGANLTDAHLFCLLACDRDLCCDGFVLTQVQGGAIICGLLSSPSVLLCNVKDWMDPSEAWANATCPGVTYDQESHQVILRLGDQEFIKSLTPLEGTQDTFTNFQQVYLWKDSDMGSRPESMGCRKDTVPRPASPTEAGLTTELFSPVDLNQVIVNGNQSLSSQKHWLFKHLFSAQQANLWCLSRCVQEHSFCQLAEITESASLYFTCTLYPEAQVCDDIMESNAQGCRLILPQMPKALFRKKVILEDKVKNFYTRLPFQKLMGISIRNKVPMSEKSISNGFFECERRCDADPCCTGFGFLNVSQLKGGEVTCLTLNSLGIQMCSEENGGAWRILDCGSPDIEVHTYPFGWYQKPIAQNNAPSFCPLVVLPSLTEKVSLDSWQSLALSSVVVDPSIRHFDVAHVSTAATSNFSAVRDLCLSECSQHEACLITTLQTQPGAVRCMFYADTQSCTHSLQGQNCRLLLREEATHIYRKPGISLLSYEASVPSVPISTHGPAAGQVPGHPGGYLMEASGPVPWSSICCPALQKAFSPNPDWQLWSKACEQPNI

SEQ ID NO: 906352 - protein, 123 aa, Homo sapiens
ERSRGSHPRVGQRGPEETSSCTMLLKTTAMASLELLAECSVCLGASLSTQPTRGSFLWRRRSLSLENHAVLFPSFIRSGNPNLPLMSSHGKYPHLQPPGLTLYPVLVERTTRSSVSCSPIDRA

SEQ ID NO: 906353 - protein, 2018 aa, Homo sapiens
MLSRLRDPPGCSSEGLKCMDPPAGKPKRCPRSCEIRNRRLLHGVGDKSPPQCSAEGEFMPVQCKFVNTTDMMIFDLVHSYNRFPDAFVTFSSFQRRFPEVSGYCHCADSQGRELAETGLELLLDEIYDTIFAGLDLPSTFTETTLYRILQRRFLAVQSVISGRFRCPTKCEVERFTATSFGHPYVPSCRRNGDYQAVQCQTEGPCWCVDAQGKEMHGTRQQGEPPSCAEGQSCASERQQALSRLYFGTSGYFSQHDLFSSPEKRWASPRVARFATSCPPTIKELFVDSGLLRPMVEGQSQQFSVSENLLKEAIRAIFPSRGLARLALQFTTNPKRLQQNLFGGKFLVNVGQFNLSGALGTRGTFNFSQFFQQLGLASFLNGGRQEDLAKPLSVGLDSNSSTGTPEAAKKDGTMNKPTVGSFGFEINLQENQNALKFLASLLELPEFLLFLQHAISVPEDVARDLGDVMETVLSSQTCEQTPERLFVPSCTTEGSYEDVQCFSGECWCVNSWGKELPGSRVRGGQPRCPTDCEKQRARMQSLMGSQPAGSTLFVPACTSEGHFLPVQCFNSECYCVDAEGQAIPGTRSAIGKPKKCPTPCQLQSEQAFLRTVQALLSNSSMLPTLSDTYIPQCSTDGQWRQVQCNGPPEQVFELYQRWEAQNKGQDLTPAKLLVKIMSYREAASGNFSLFIQSLYEAGQQDVFPVLSQYPSLQDVPLAALEGKRPQPRENILLEPYLFWQILNGQLSQYPGSYSDFSTPLAHFDLRNCWCVDEAGQELEGMRSEPSKLPTCPGSCEEAKLRVLQFIRETEEIVSASNSSRFPLGESFLVAKGIRLRNEDLGLPPLFPPREAFAEQFLRGSDYAIRLAAQSTLSFYQRRRFSPDDSAGASALLRSGPYMPQCDAFGSWEPVQCHAGTGHCWCVDEKGGFIPGSLTARSLQIPQCPTTCEKSRTSGLLSSWKQARSQENPSPKDLFVPACLETGEYARLQASGAGTWCVDPASGEELRPGSSSSAQCPSLCNVLKSGVLSRRVSPGYVPACRAEDGGFSPVQCDQAQGSCWCVMDSGEEVPGTRVTGGQPACESPRCPLPFNASEVVGGTILCETISGPTGSAMQQCQLLCRQGSWSVFPPGPLICSLESGRWESQLPQPRACQRPQLWQTIQTQGHFQLQLPPGKMCSADYADLLQTFQVFILDELTARGFCQIQVKTFGTLVSIPVCNNSSVQVGCLTRERLGVNVTWKSRLEDIPVASLPDLHDIERALVGKDLLGRFTDLIQSGSFQLHLDSKTFPAETIRFLQGDHFGTSPRTWFGCSEGFYQVLTSEASQDGLGCVKCPEGSYSQDEECIPCPVGFYQEQAGSLACVPCPVGRTTISAGAFSQTHCVTDCQRNEAGLQCDQNGQYRASQKDRGSGKAFCVDGEGRRLPWWETEAPLEDSQCLMMQKFEKVPESKVIFDANAPVAVRSKVPDSEFPVMQCLTDCTEDEACSFFTVSTTEPEISCDFYAWTSDNVACMTSDQKRDALGNSKATSFGSLRCQVKVRSHGQDSPAVYLKKGQGSTTTLQKRFEPTGFQNMLSGLYNPIVFSASGANLTDAHLFCLLACDRDLCCDGFVLTQVQGGAIICGLLSSPSVLLCNVKDWMDPSEAWANATCPGVTYDQESHQVILRLGDQEFIKSLTPLEGTQDTFTNFQQVYLWKDSDMGSRPESMGCRKDTVPRPASPTEAGLTTELFSPVDLNQVIVNGNQSLSSQKHWLFKHLFSAQQANLWCLSRCVQEHSFCQLAEITESASLYFTCTLYPEAQVCDDIMESNAQGCRLILPQMPKALFRKKVILEDKVKNFYTRLPFQKLMGISIRNKVPMSEKSISNGFFECERRCDADPCCTGFGFLNVSQLKGGEVTCLTLNSLGIQMCSEENGGAWRILDCGSPDIEVHTYPFGWYQKPIAQNNAPSFCPLVVLPSLTEKVSLDSWQSLALSSVVVDPSIRHFDVAHVSTAATSNFSAVRDLCLSECSQHPACFLQSGCELD

SEQ ID NO: 906354 - protein, 1972 aa, Homo sapiens
MLSRLRDPPGCSSEGLKCMDPPAGKPKRCPRSCEIRNRRLLHGVGDKSPPQCSAEGEFMPVQCKFVNTTDMMIFDLVHSYNRFPDAFVTFSSFQRRFPEVSGYCHCADSQGRELAETGLELLLDEIYDTIFAGLDLPSTFTETTLYRILQRRFLAVQSVISGRFRCPTKCEVERFTATSFGHPYVPSCRRNGDYQAVQCQTEGPCWCVDAQGKEMHGTRQQGEPPSCAEGQSCASERQQALSRLYFGTSGYFSQHDLFSSPEKRWASPRVARFATSCPPTIKELFVDSGLLRPMVEGQSQQFSVSENLLKEAIRAIFPSRGLARLALQFTTNPKRLQQNLFGGKFLVNVGQFNLSGALGTRGTFNFSQFFQQLGLASFLNGGRQEDLAKPLSVGLDSNSSTGTPEAAKKDGTMNKPTVGSFGFEINLQENQNALKFLASLLELPEFLLFLQHAISVPEDVARDLGDVMETVLSSQTCEQTPERLFVPSCTTEGSYEDVQCFSGECWCVNSWGKELPGSRVRGGQPRCPTDCEKQRARMQSLMGSQPAGSTLFVPACTSEGHFLPVQCFNSECYCVDAEGQAIPGTRSAIGKPKKCPTPCQLQSEQAFLRTVQALLSNSSMLPTLSDTYIPQCSTDGQWRQVQCNGPPEQVFELYQRWEAQNKGQDLTPAKLLVKIMSYREAASGNFSLFIQSLYEAGQQDVFPVLSQYPSLQDVPLAALEGKRPQPRENILLEPYLFWQILNGQLSQYPGSYSDFSTPLAHFDLRNCWCVDEAGQELEGMRSEPSKLPTCPGSCEEAKLRVLQFIRETEEIVSASNSSRFPLGESFLVAKGIRLRNEDLGLPPLFPPREAFAEQFLRGSDYAIRLAAQSTLSFYQRRRFSPDDSAGASALLRSGPYMPQCDAFGSWEPVQCHAGTGHCWCVDEKGGFIPGSLTARSLQIPQCPTTCEKSRTSGLLSSWKQARSQENPSPKDLFVPACLETGEYARLQASGAGTWCVDPASGEELRPGSSSSAQCPSLCNVLKSGVLSRRVSPGYVPACRAEDGGFSPVQCDQAQGSCWCVMDSGEEVPGTRVTGGQPACESPRCPLPFNASEVVGGTILCETISGPTGSAMQQCQLLCRQGSWSVFPPGPLICSLESGRWESQLPQPRACQRPQLWQTIQTQGHFQLQLPPGKMCSADYADLLQTFQVFILDELTARGFCQIQVKTFGTLVSIPVCNNSSVQVGCLTRERLGVNVTWKSRLEDIPVASLPDLHDIERALVGKDLLGRFTDLIQSGSFQLHLDSKTFPAETIRFLQGDHFGTSPRTWFGCSEGFYQVLTSEASQDGLGCVKCPEGSYSQDEECIPCPVGFYQEQAGSLACVPCPVGRTTISAGAFSQTHCVTDCQRNEAGLQCDQNGQYRASQKDRGSGKAFCVDGEGRRLPWWETEAPLEDSQCLMMQKFEKVPESKVIFDANAPVAVRSKVPDSEFPVMQCLTDCTEDEACSFFTVSTTEPEISCDFYAWTSDNVACMTSDQKRDALGNSKATSFGSLRCQVKVRSHGQDSPAVYLKKGQGSTTTLQKRFEPTGFQNMLSGLYNPIVFSASGANLTDAHLFCLLACDRDLCCDGFVLTQVQGGAIICGLLSSPSVLLCNVKDWMDPSEAWANATCPGVTYDQESHQVILRLGDQEFIKSLTPLEGTQDTFTNFQQVYLWKDSDMGSRPESMGCRKDTVPRPASPTEAGLTTELFSPVDLNQVIVNGNQSLSSQKHWLFKHLFSAQQANLWCLSRCVQEHSFCQLAEITESASLYFTCTLYPEAQVCDDIMESNAQGCRLILPQMPKALFRKKVILEDKVKNFYTRLPFQKLMGISIRNKVPMSEKSISNGFFECERRCDADPCCTGFGFLNVSQLKGGEVTCLTLNSLGIQMCSEENGGAWRILDCGSPDIEVHTYPFGWYQKPIAQNNAPSFCPLVVLPSLTEKVFKVREVRGTQLKRME

SEQ ID NO: 906355 - protein, 2047 aa, Homo sapiens
MLSRLRDPPGCSSEGLKCMDPPAGKPKRCPRSCEIRNRRLLHGVGDKSPPQCSAEGEFMPVQCKFVNTTDMMIFDLVHSYNRFPDAFVTFSSFQRRFPEVSGYCHCADSQGRELAETGLELLLDEIYDTIFAGLDLPSTFTETTLYRILQRRFLAVQSVISGRFRCPTKCEVERFTATSFGHPYVPSCRRNGDYQAVQCQTEGPCWCVDAQGKEMHGTRQQGEPPSCAEGQSCASERQQALSRLYFGTSGYFSQHDLFSSPEKRWASPRVARFATSCPPTIKELFVDSGLLRPMVEGQSQQFSVSENLLKEAIRAIFPSRGLARLALQFTTNPKRLQQNLFGGKFLVNVGQFNLSGALGTRGTFNFSQFFQQLGLASFLNGGRQEDLAKPLSVGLDSNSSTGTPEAAKKDGTMNKPTVGSFGFEINLQENQNALKFLASLLELPEFLLFLQHAISVPEDVARDLGDVMETVLSSQTCEQTPERLFVPSCTTEGSYEDVQCFSGECWCVNSWGKELPGSRVRGGQPRCPTDCEKQRARMQSLMGSQPAGSTLFVPACTSEGHFLPVQCFNSECYCVDAEGQAIPGTRSAIGKPKKCPTPCQLQSEQAFLRTVQALLSNSSMLPTLSDTYIPQCSTDGQWRQVQCNGPPEQVFELYQRWEAQNKGQDLTPAKLLVKIMSYREAASGNFSLFIQSLYEAGQQDVFPVLSQYPSLQDVPLAALEGKRPQPRENILLEPYLFWQILNGQLSQYPGSYSDFSTPLAHFDLRNCWCVDEAGQELEGMRSEPSKLPTCPGSCEEAKLRVLQFIRETEEIVSASNSSRFPLGESFLVAKGIRLRNEDLGLPPLFPPREAFAEQFLRGSDYAIRLAAQSTLSFYQRRRFSPDDSAGASALLRSGPYMPQCDAFGSWEPVQCHAGTGHCWCVDEKGGFIPGSLTARSLQIPQCPTTCEKSRTSGLLSSWKQARSQENPSPKDLFVPACLETGEYARLQASGAGTWCVDPASGEELRPGSSSSAQCPSLCNVLKSGVLSRRVSPGYVPACRAEDGGFSPVQCDQAQGSCWCVMDSGEEVPGTRVTGGQPACESPRCPLPFNASEVVGGTILCETISGPTGSAMQQCQLLCRQGSWSVFPPGPLICSLESGRWESQLPQPRACQRPQLWQTIQTQGHFQLQLPPGKMCSADYADLLQTFQVFILDELTARGFCQIQVKTFGTLVSIPVCNNSSVQVGCLTRERLGVNVTWKSRLEDIPVASLPDLHDIERALVGKDLLGRFTDLIQSGSFQLHLDSKTFPAETIRFLQGDHFGTSPRTWFGCSEGFYQVLTSEASQDGLGCVKCPEGSYSQDEECIPCPVGFYQEQAGSLACVPCPVGRTTISAGAFSQTHCVTDCQRNEAGLQCDQNGQYRASQKDRGSGKAFCVDGEGRRLPWWETEAPLEDSQCLMMQKFEKVPESKVIFDANAPVAVRSKVPDSEFPVMQCLTDCTEDEACSFFTVSTTEPEISCDFYAWTSDNVACMTSDQKRDALGNSKATSFGSLRCQVKVRSHGQDSPAVYLKKGQGSTTTLQKRFEPTGFQNMLSGLYNPIVFSASGANLTDAHLFCLLACDRDLCCDGFVLTQVQGGAIICGLLSSPSVLLCNVKDWMDPSEAWANATCPGVTYDQESHQVILRLGDQEFIKSLTPLEGTQDTFTNFQQVYLWKDSDMGSRPESMGCRKDTVPRPASPTEAGLTTELFSPVDLNQVIVNGNQSLSSQKHWLFKHLFSAQQANLWCLSRCVQEHSFCQLAEITESASLYFTCTLYPEAQVCDDIMESNAQGCRLILPQMPKALFRKKVILEDKVKNFYTRLPFQKLMGISIRNKVPMSEKSISNGFFECERRCDADPCCTGFGFLNVSQLKGGEVTCLTLNSLGIQMCSEENGGAWRILDCGSPDIEVHTYPFGWYQKPIAQNNAPSFCPLVVLPSLTEKGIMKVCWGPERLFLPERFQNVTVYPSQPVQVWKPPLLFPSYSIFRSNHLMSAEQLKEIPLGFDCGKKGEDPEDFWMPWTHCLFLMSPKKVM

SEQ ID NO: 906356 - protein, 1966 aa, Homo sapiens
MLSRLRDPPGCSSEGLKCMDPPAGKPKRCPRSCEIRNRRLLHGVGDKSPPQCSAEGEFMPVQCKFVNTTDMMIFDLVHSYNRFPDAFVTFSSFQRRFPEVSGYCHCADSQGRELAETGLELLLDEIYDTIFAGLDLPSTFTETTLYRILQRRFLAVQSVISGRFRCPTKCEVERFTATSFGHPYVPSCRRNGDYQAVQCQTEGPCWCVDAQGKEMHGTRQQGEPPSCAEGQSCASERQQALSRLYFGTSGYFSQHDLFSSPEKRWASPRVARFATSCPPTIKELFVDSGLLRPMVEGQSQQFSVSENLLKEAIRAIFPSRGLARLALQFTTNPKRLQQNLFGGKFLVNVGQFNLSGALGTRGTFNFSQFFQQLGLASFLNGGRQEDLAKPLSVGLDSNSSTGTPEAAKKDGTMNKPTVGSFGFEINLQENQNALKFLASLLELPEFLLFLQHAISVPEDVARDLGDVMETVLSSQTCEQTPERLFVPSCTTEGSYEDVQCFSGECWCVNSWGKELPGSRVRGGQPRCPTDCEKQRARMQSLMGSQPAGSTLFVPACTSEGHFLPVQCFNSECYCVDAEGQAIPGTRSAIGKPKKCPTPCQLQSEQAFLRTVQALLSNSSMLPTLSDTYIPQCSTDGQWRQVQCNGPPEQVFELYQRWEAQNKGQDLTPAKLLVKIMSYREAASGNFSLFIQSLYEAGQQDVFPVLSQYPSLQDVPLAALEGKRPQPRENILLEPYLFWQILNGQLSQYPGSYSDFSTPLAHFDLRNCWCVDEAGQELEGMRSEPSKLPTCPGSCEEAKLRVLQFIRETEEIVSASNSSRFPLGESFLVAKGIRLRNEDLGLPPLFPPREAFAEQFLRGSDYAIRLAAQSTLSFYQRRRFSPDDSAGASALLRSGPYMPQCDAFGSWEPVQCHAGTGHCWCVDEKGGFIPGSLTARSLQIPQCPTTCEKSRTSGLLSSWKQARSQENPSPKDLFVPACLETGEYARLQASGAGTWCVDPASGEELRPGSSSSAQCPSLCNVLKSGVLSRRVSPGYVPACRAEDGGFSPVQCDQAQGSCWCVMDSGEEVPGTRVTGGQPACESPRCPLPFNASEVVGGTILCETISGPTGSAMQQCQLLCRQGSWSVFPPGPLICSLESGRWESQLPQPRACQRPQLWQTIQTQGHFQLQLPPGKMCSADYADLLQTFQVFILDELTARGFCQIQVKTFGTLVSIPVCNNSSVQVGCLTRERLGVNVTWKSRLEDIPVASLPDLHDIERALVGKDLLGRFTDLIQSGSFQLHLDSKTFPAETIRFLQGDHFGTSPRTWFGCSEGFYQVLTSEASQDGLGCVKCPEGSYSQDEECIPCPVGFYQEQAGSLACVPCPVGRTTISAGAFSQTHCVTDCQRNEAGLQCDQNGQYRASQKDRGSGKAFCVDGEGRRLPWWETEAPLEDSQCLMMQKFEKVPESKVIFDANAPVAVRSKVPDSEFPVMQCLTDCTEDEACSFFTVSTTEPEISCDFYAWTSDNVACMTSDQKRDALGNSKATSFGSLRCQVKVRSHGQDSPAVYLKKGQGSTTTLQKRFEPTGFQNMLSGLYNPIVFSASGANLTDAHLFCLLACDRDLCCDGFVLTQVQGGAIICGLLSSPSVLLCNVKDWMDPSEAWANATCPGVTYDQESHQVILRLGDQEFIKSLTPLEGTQDTFTNFQQVYLWKDSDMGSRPESMGCRKDTVPRPASPTEAGLTTELFSPVDLNQVIVNGNQSLSSQKHWLFKHLFSAQQANLWCLSRCVQEHSFCQLAEITESASLYFTCTLYPEAQVCDDIMESNAQGCRLILPQMPKALFRKKVILEDKVKNFYTRLPFQKLMGISIRNKVPMSEKSISNGFFECERRCDADPCCTGFGFLNVSQLKGGEVTCLTLNSLGIQMCSEENGGAWRILDCGSPDIEVHTYPFGWYQKPIAQNNAPSFCPLVVLPSLTEKGKFIVFLSLG

SEQ ID NO: 906357 - protein, 1694 aa, Homo sapiens
MLSRLRDPPGCSSEGLKCMDPPAGKPKRCPRSCEIRNRRLLHGVGDKSPPQCSAEGEFMPVQCKFVNTTDMMIFDLVHSYNRFPDAFVTFSSFQRRFPEVSGYCHCADSQGRELAETGLELLLDEIYDTIFAGLDLPSTFTETTLYRILQRRFLAVQSVISGRFRCPTKCEVERFTATSFGHPYVPSCRRNGDYQAVQCQTEGPCWCVDAQGKEMHGTRQQGEPPSCAEGQSCASERQQALSRLYFGTSGYFSQHDLFSSPEKRWASPRVARFATSCPPTIKELFVDSGLLRPMVEGQSQQFSVSENLLKEAIRAIFPSRGLARLALQFTTNPKRLQQNLFGGKFLVNVGQFNLSGALGTRGTFNFSQFFQQLGLASFLNGGRQEDLAKPLSVGLDSNSSTGTPEAAKKDGTMNKPTVGSFGFEINLQENQNALKFLASLLELPEFLLFLQHAISVPEDVARDLGDVMETVLSSQTCEQTPERLFVPSCTTEGSYEDVQCFSGECWCVNSWGKELPGSRVRGGQPRCPTDCEKQRARMQSLMGSQPAGSTLFVPACTSEGHFLPVQCFNSECYCVDAEGQAIPGTRSAIGKPKKCPTPCQLQSEQAFLRTVQALLSNSSMLPTLSDTYIPQCSTDGQWRQVQCNGPPEQVFELYQRWEAQNKGQDLTPAKLLVKIMSYREAASGNFSLFIQSLYEAGQQDVFPVLSQYPSLQDVPLAALEGKRPQPRENILLEPYLFWQILNGQLSQYPGSYSDFSTPLAHFDLRNCWCVDEAGQELEGMRSEPSKLPTCPGSCEEAKLRVLQFIRETEEIVSASNSSRFPLGESFLVAKGIRLRNEDLGLPPLFPPREAFAEQFLRGSDYAIRLAAQSTLSFYQRRRFSPDDSAGASALLRSGPYMPQCDAFGSWEPVQCHAGTGHCWCVDEKGGFIPGSLTARSLQIPQCPTTCEKSRTSGLLSSWKQARSQENPSPKDLFVPACLETGEYARLQASGAGTWCVDPASGEELRPGSSSSAQCPSLCNVLKSGVLSRRVSPGYVPACRAEDGGFSPVQCDQAQGSCWCVMDSGEEVPGTRVTGGQPACESPRCPLPFNASEVVGGTILCETISGPTGSAMQQCQLLCRQGSWSVFPPGPLICSLESGRWESQLPQPRACQRPQLWQTIQTQGHFQLQLPPGKMCSADYADLLQTFQVFILDELTARGFCQIQVKTFGTLVSIPVCNNSSVQVGCLTRERLGVNVTWKSRLEDIPVASLPDLHDIERALVGKDLLGRFTDLIQSGSFQLHLDSKTFPAETIRFLQGDHFGTSPRTWFGCSEGFYQVLTSEASQDGLGCVKCPEGSYSQDEECIPCPVGFYQEQAGSLACVPCPVGRTTISAGAFSQTHCVTDCQRNEAGLQCDQNGQYRASQKDRGSGKAFCVDGEGRRLPWWETEAPLEDSQCLMMQKFEKVPESKVIFDANAPVAVRSKVPDSEFPVMQCLTDCTEDEACSFFTVSTTEPEISCDFYAWTSDNVACMTSDQKRDALGNSKATSFGSLRCQVKVRSHGQDSPAVYLKKGQGSTTTLQKRFEPTGFQNMLSGLYNPIVFSASGANLTDAHLFCLLACDRDLCCDGFVLTQVQGGAIICGLLSSPSVLLCNVKDWMDPSEAWANATCPGVTYDQESHQVILRLGDQEFIKSKSLPFVHILSKLLFTRARPSATFL

SEQ ID NO: 906358 - protein, 1567 aa, Homo sapiens
MLSRLRDPPGCSSEGLKCMDPPAGKPKRCPRSCEIRNRRLLHGVGDKSPPQCSAEGEFMPVQCKFVNTTDMMIFDLVHSYNRFPDAFVTFSSFQRRFPEVSGYCHCADSQGRELAETGLELLLDEIYDTIFAGLDLPSTFTETTLYRILQRRFLAVQSVISGRFRCPTKCEVERFTATSFGHPYVPSCRRNGDYQAVQCQTEGPCWCVDAQGKEMHGTRQQGEPPSCAEGQSCASERQQALSRLYFGTSGYFSQHDLFSSPEKRWASPRVARFATSCPPTIKELFVDSGLLRPMVEGQSQQFSVSENLLKEAIRAIFPSRGLARLALQFTTNPKRLQQNLFGGKFLVNVGQFNLSGALGTRGTFNFSQFFQQLGLASFLNGGRQEDLAKPLSVGLDSNSSTGTPEAAKKDGTMNKPTVGSFGFEINLQENQNALKFLASLLELPEFLLFLQHAISVPEDVARDLGDVMETVLSSQTCEQTPERLFVPSCTTEGSYEDVQCFSGECWCVNSWGKELPGSRVRGGQPRCPTDCEKQRARMQSLMGSQPAGSTLFVPACTSEGHFLPVQCFNSECYCVDAEGQAIPGTRSAIGKPKKCPTPCQLQSEQAFLRTVQALLSNSSMLPTLSDTYIPQCSTDGQWRQVQCNGPPEQVFELYQRWEAQNKGQDLTPAKLLVKIMSYREAASGNFSLFIQSLYEAGQQDVFPVLSQYPSLQDVPLAALEGKRPQPRENILLEPYLFWQILNGQLSQYPGSYSDFSTPLAHFDLRNCWCVDEAGQELEGMRSEPSKLPTCPGSCEEAKLRVLQFIRETEEIVSASNSSRFPLGESFLVAKGIRLRNEDLGLPPLFPPREAFAEQFLRGSDYAIRLAAQSTLSFYQRRRFSPDDSAGASALLRSGPYMPQCDAFGSWEPVQCHAGTGHCWCVDEKGGFIPGSLTARSLQIPQCPTTCEKSRTSGLLSSWKQARSQENPSPKDLFVPACLETGEYARLQASGAGTWCVDPASGEELRPGSSSSAQCPSLCNVLKSGVLSRRVSPGYVPACRAEDGGFSPVQCDQAQGSCWCVMDSGEEVPGTRVTGGQPACESPRCPLPFNASEVVGGTILCETISGPTGSAMQQCQLLCRQGSWSVFPPGPLICSLESGRWESQLPQPRACQRPQLWQTIQTQGHFQLQLPPGKMCSADYADLLQTFQVFILDELTARGFCQIQVKTFGTLVSIPVCNNSSVQVGCLTRERLGVNVTWKSRLEDIPVASLPDLHDIERALVGKDLLGRFTDLIQSGSFQLHLDSKTFPAETIRFLQGDHFGTSPRTWFGCSEGFYQVLTSEASQDGLGCVKCPEGSYSQDEECIPCPVGFYQEQAGSLACVPCPVGRTTISAGAFSQTHCVTDCQRNEAGLQCDQNGQYRASQKDRGSGKAFCVDGEGRRLPWWETEAPLEDSQCLMMQKFEKVPESKVIFDANAPVAVRSKVPDSEFPVMQCLTDCTEDEACSFFTVSTTEPEISCDFYAWTSDNVACMTSDQKRDALGNSKATSFGSLRCQVKVRSHGQDSPAVYLKKGPSPHLNLDGSKLCTMVT

SEQ ID NO: 906359 - protein, 1456 aa, Homo sapiens
MLSRLRDPPGCSSEGLKCMDPPAGKPKRCPRSCEIRNRRLLHGVGDKSPPQCSAEGEFMPVQCKFVNTTDMMIFDLVHSYNRFPDAFVTFSSFQRRFPEVSGYCHCADSQGRELAETGLELLLDEIYDTIFAGLDLPSTFTETTLYRILQRRFLAVQSVISGRFRCPTKCEVERFTATSFGHPYVPSCRRNGDYQAVQCQTEGPCWCVDAQGKEMHGTRQQGEPPSCAEGQSCASERQQALSRLYFGTSGYFSQHDLFSSPEKRWASPRVARFATSCPPTIKELFVDSGLLRPMVEGQSQQFSVSENLLKEAIRAIFPSRGLARLALQFTTNPKRLQQNLFGGKFLVNVGQFNLSGALGTRGTFNFSQFFQQLGLASFLNGGRQEDLAKPLSVGLDSNSSTGTPEAAKKDGTMNKPTVGSFGFEINLQENQNALKFLASLLELPEFLLFLQHAISVPEDVARDLGDVMETVLSSQTCEQTPERLFVPSCTTEGSYEDVQCFSGECWCVNSWGKELPGSRVRGGQPRCPTDCEKQRARMQSLMGSQPAGSTLFVPACTSEGHFLPVQCFNSECYCVDAEGQAIPGTRSAIGKPKKCPTPCQLQSEQAFLRTVQALLSNSSMLPTLSDTYIPQCSTDGQWRQVQCNGPPEQVFELYQRWEAQNKGQDLTPAKLLVKIMSYREAASGNFSLFIQSLYEAGQQDVFPVLSQYPSLQDVPLAALEGKRPQPRENILLEPYLFWQILNGQLSQYPGSYSDFSTPLAHFDLRNCWCVDEAGQELEGMRSEPSKLPTCPGSCEEAKLRVLQFIRETEEIVSASNSSRFPLGESFLVAKGIRLRNEDLGLPPLFPPREAFAEQFLRGSDYAIRLAAQSTLSFYQRRRFSPDDSAGASALLRSGPYMPQCDAFGSWEPVQCHAGTGHCWCVDEKGGFIPGSLTARSLQIPQCPTTCEKSRTSGLLSSWKQARSQENPSPKDLFVPACLETGEYARLQASGAGTWCVDPASGEELRPGSSSSAQCPSLCNVLKSGVLSRRVSPGYVPACRAEDGGFSPVQCDQAQGSCWCVMDSGEEVPGTRVTGGQPACESPRCPLPFNASEVVGGTILCETISGPTGSAMQQCQLLCRQGSWSVFPPGPLICSLESGRWESQLPQPRACQRPQLWQTIQTQGHFQLQLPPGKMCSADYADLLQTFQVFILDELTARGFCQIQVKTFGTLVSIPVCNNSSVQVGCLTRERLGVNVTWKSRLEDIPVASLPDLHDIERALVGKDLLGRFTDLIQSGSFQLHLDSKTFPAETIRFLQGDHFGTSPRTWFGCSEGFYQVLTSEASQDGLGCVKCPEGSYSQDEECIPCPVGFYQEQAGSLACVPCPVGRTTISAGAFSQTHLMQKFEKVPESKVIFDANAPVAVRSKVPDSEFPVMQCLTDFTEDEACSIASRVSSDGSQRYSCECYACTRMFRYRAES

SEQ ID NO: 906360 - protein, 1008 aa, Homo sapiens
MLSRLRDPPGCSSEGLKCMDPPAGKPKRCPRSCEIRNRRLLHGVGDKSPPQCSAEGEFMPVQCKFVNTTDMMIFDLVHSYNRFPDAFVTFSSFQRRFPEVSGYCHCADSQGRELAETGLELLLDEIYDTIFAGLDLPSTFTETTLYRILQRRFLAVQSVISGRFRCPTKCEVERFTATSFGHPYVPSCRRNGDYQAVQCQTEGPCWCVDAQGKEMHGTRQQGEPPSCAEGQSCASERQQALSRLYFGTSGYFSQHDLFSSPEKRWASPRVARFATSCPPTIKELFVDSGLLRPMVEGQSQQFSVSENLLKEAIRAIFPSRGLARLALQFTTNPKRLQQNLFGGKFLVNVGQFNLSGALGTRGTFNFSQFFQQLGLASFLNGGRQEDLAKPLSVGLDSNSSTGTPEAAKKDGTMNKPTVGSFGFEINLQENQNALKFLASLLELPEFLLFLQHAISVPEDVARDLGDVMETVLSSQTCEQTPERLFVPSCTTEGSYEDVQCFSGECWCVNSWGKELPGSRVRGGQPRCPTDCEKQRARMQSLMGSQPAGSTLFVPACTSEGHFLPVQCFNSECYCVDAEGQAIPGTRSAIGKPKKCPTPCQLQSEQAFLRTVQALLSNSSMLPTLSDTYIPQCSTDGQWRQVQCNGPPEQVFELYQRWEAQNKGQDLTPAKLLVKIMSYREAASGNFSLFIQSLYEAGQQDVFPVLSQYPSLQDVPLAALEGKRPQPRENILLEPYLFWQILNGQLSQYPGSYSDFSTPLAHFDLRNCWCVDEAGQELEGMRSEPSKLPTCPGSCEEAKLRVLQFIRETEEIVSASNSSRFPLGESFLVAKGIRLRNEDLGLPPLFPPREAFAEQFLRGSDYAIRLAAQSTLSFYQRRRFSPDDSAGASALLRSGPYMPQCDAFGSWEPVQCHAGTGHCWCVDEKGGFIPGSLTARSLQIPQCPTTCEKSRTSGLLSSWKQARSQENPSPKDLFVPACLEVRVWKHRIGAGTCPRWSEMIFLFVQYVQL

SEQ ID NO: 906361 - protein, 152 aa, Homo sapiens
LLSRLQPWLVPHFEEPSEQAGKQFEESRGRTSSKTAFYQALQNSLGGEDSDARVEAAATWYYSLEHSTDDYASFSRALENATRDYFIICPIIDMASAWAKRARGNVFMYHAPENYGHGKPGAAGGMFSLPWGFPFYPAYEGQFSLEEKKPVA

SEQ ID NO: 906362 - protein, 498 aa, Homo sapiens
MLSRLRDPPGCSSEGLKCMDPPAGKPKRCPRSCEIRNRRLLHGVGDKSPPQCSAEGEFMPVQCKFVNTTDMMIFDLVHSYNRFPDAFVTFSSFQRRFPEVSGYCHCADSQGRELAETGLELLLDEIYDTIFAGLDLPSTFTETTLYRILQRRFLAVQSVISGRFRCPTKCEVERFTATSFGHPYVPSCRRNGDYQAVQCQTEGPCWCVDAQGKEMHGTRQQGEPPSCAEGQSCASERQQALSRLYFGTSGYFSQHDLFSSPEKRWASPRVARFATSCPPTIKELFVDSGLLRPMVEGQSQQFSVSENLLKEAIRAIFPSRGLARLALQFTTNPKRLQQNLFGGKFLVNVGQFNLSGALGTRGTFNFSQFFQQLGLASFLNGGRQEDLAKPLSVGLDSNSSTGTPEAAKKDGTMNKPTVGSFGFEINYKEFSELLPNRQGLKKADCSFWSKYISSLKTSADGAKGGQSAESEEEELTAGSGLREDLLSLQEPGSKTYSK

SEQ ID NO: 906363 - protein, 310 aa, Homo sapiens
MLSRLRDPPGCSSEGLKCMDPPAGKPKRCPRSCEIRNRRLLHGVGDKSPPQCSAEGEFMPVQCKFVNTTDMMIFDLVHSYNRFPDAFVTFSSFQRRFPEVSGYCHCADSQGRELAETGLELLLDEIYDTIFAGLDLPSTFTETTLYRILQRRFLAVQSVISGRFRCPTKCEVERFTATSFGHPYVPSCRRNGDYQAVQCQTEGPCWCVDAQGKEMHGTRQQGEPPSCGGFPLGASSFGLGSYYFGGPPDQPLWTPLIQLPSSVPLWPFKLNLSENQFIIINFQHVSHLVSDLVAFSGSSGNIRRLIDEEK

SEQ ID NO: 906364 - protein, 126 aa, Homo sapiens
MLRCLLKLRADGLIQVEGRAERKGSRPRPGPESLTGPGKGRGGGPSVSEKETPTSRHAQSSRGWAGAHHGSTFLLPGPRCPLPFNASEVVGGTILCETISGPTGSAMQQCQLLCRQGSWSVFPPGP

SEQ ID NO: 906365 - protein, 176 aa, Homo sapiens
LVDGNGRRVKKFFTLSSSQLFRRAVLMGGSALSPAAVISHERAQQQAIALAKEVSCPMSSSQEVVSCLRQKPANVLNDAQTKLLAVSGPFHYWGPVIDGHFLREPPARALKRSLRVEVDLLIGSCHGRSFQELVHEDVSSGPLCPGTGHVDYRADDKVVPGGILQSPGEGGIVIRG

SEQ ID NO: 906366 - protein, 150 aa, Homo sapiens
NVDPLPHDYRGSRLSSWEFNEATCCPSRMKSITQFQNSQGGQLRSWLKVTGSYQKKQFKEENVRVSQEVQLFSDMIFMYHAPENYGHGSLELLAECSVCLGASLSTQPTRGSFLWRRRSLSLENHAVLFPSFIRSGNPQITLMSSQLAQV

SEQ ID NO: 906367 - protein, 2293 aa, Homo sapiens
ASSGFSSFLPGRARKMALVLEIFTLLASICWVSANIFEYQVDAQPLRPCELQRETAFLKQADYVPQCAEDGSFQTVQCQNDGRSCWCVGANGSEVLGSRQPGRPVACLSFCQLQKQQILLSGYINSTDTSYLPQCQDSGDYAPVQCDVQQVQCWCVDAEGMEVYGTRQLGRPKRCPRSCEIRNRRLLHGVGDKSPPQCSAEGEFMPVQCKFVNTTDMMIFDLVHSYNRFPDAFVTFSSFQRRFPEVSGYCHCADSQGRELAETGLELLLDEIYDTIFAGLDLPSTFTETTLYRILQRRFLAVQSVISGRFRCPTKCEVERFTATSFGHPYVPSCRRNGDYQAVQCQTEGPCWCVDAQGKEMHGTRQQGEPPSCAEGQSCASERQQALSRLYFGTSGYFSQHDLFSSPEKRWASPRVARFATSCPPTIKELFVDSGLLRPMVEGQSQQFSVSENLLKEAIRAIFPSRGLARLALQFTTNPKRLQQNLFGGKFLVNVGQFNLSGALGTRGTFNFSQFFQQLGLASFLNGGRQEDLAKPLSVGLDSNSSTGTPEAAKKDGTMNKPTVGSFGFEINLQENQNALKFLASLLELPEFLLFLQHAISVPEDVARDLGDVMETVLSSQTCEQTPERLFVPSCTTEGSYEDVQCFSGECWCVNSWGKELPGSRVRGGQPRCPTDCEKQRARMQSLMGSQPAGSTLFVPACTSEGHFLPVQCFNSECYCVDAEGQAIPGTRSAIGKPKKCPTPCQLQSEQAFLRTVQALLSNSSMLPTLSDTYIPQCSTDGQWRQVQCNGPPEQVFELYQRWEAQNKGQDLTPAKLLVKIMSYREAASGNFSLFIQSLYEAGQQDVFPVLSQYPSLQDVPLAALEGKRPQPRENILLEPYLFWQILNGQLSQYPGSYSDFSTPLAHFDLRNCWCVDEAGQELEGMRSEPSKLPTCPGSCEEAKLRVLQFIRETEEIVSASNSSRFPLGESFLVAKGIRLRNEDLGLPPLFPPREAFAEQFLRGSDYAIRLAAQSTLSFYQRRRFSPDDSAGASALLRSGPYMPQCDAFGSWEPVQCHAGTGHCWCVDEKGGFIPGSLTARSLQIPQCPTTCEKSRTSGLLSSWKQARSQENPSPKDLFVPACLETGEYARLQASGAGTWCVDPASGEELRPGSSSSAQCPSLCNVLKSGVLSRRVSPGYVPACRAEDGGFSPVQCDQAQGSCWCVMDSGEEVPGTRVTGGQPACESPRCPLPFNASEVVGGTILCETISGPTGSAMQQCQLLCRQGSWSVFPPGPLICSLESGRWESQLPQPRACQRPQLWQTIQTQGHFQLQLPPGKMCSADYADLLQTFQVFILDELTARGFCQIQVKTFGTLVSIPVCNNSSVQVGCLTRERLGVNVTWKSRLEDIPVASLPDLHDIERALVGKDLLGRFTDLIQSGSFQLHLDSKTFPAETIRFLQGDHFGTSPRTWFGCSEGFYQVLTSEASQDGLGCVKCPEGSYSQDEECIPCPVGFYQEQAGSLACVPCPVGRTTISAGAFSQTHCVTDCQRNEAGLQCDQNGQYRASQKDRGSGKAFCVDGEGRRLPWWETEAPLEDSQCLMMQKFEKVPESKVIFDANAPVAVRSKVPDSEFPVMQCLTDCTEDEACSFFTVSTTEPEISCDFYAWTSDNVACMTSDQKRDALGNSKATSFGSLRCQVKVRSHGQDSPAVYLKKGQGSTTTLQKRFEPTGFQNMLSGLYNPIVFSASGANLTDAHLFCLLACDRDLCCDGFVLTQVQGGAIICGLLSSPSVLLCNVKDWMDPSEAWANATCPGVTYDQESHQVILRLGDQEFIKSLTPLEGTQDTFTNFQQVYLWKDSDMGSRPESMGCRKDTVPRPASPTEAGLTTELFSPVDLNQVIVNGNQSLSSQKHWLFKHLFSAQQANLWCLSRCVQEHSFCQLAEITESASLYFTCTLYPEAQVCDDIMESNAQGCRLILPQMPKALFRKKVILEDKVKNFYTRLPFQKLMGISIRNKVPMSEKSISNGFFECERRCDADPCCTGFGFLNVSQLKGGEVTCLTLNSLGIQMCSEENGGAWRILDCGSPDIEVHTYPFGWYQKPIAQNNAPSFCPLVVLPSLTEKVSLDSWQSLALSSVVVDPSIRHFDVAHVSTAATSNFSAVRDLCLSECSQHEACLITTLQTQPGAVRCMFYADTQSCTHSLQGQNCRLLLREEATHIYRKPGISLLSYEASVPSVPISTHGPAAGQVPGHPGGYLMEASGPVPWSSICCPAPGREALPGTRALELDRLLGCQQAKGQLLAARHQNIHVSWSQ

SEQ ID NO: 906368 - protein, 197 aa, Homo sapiens
DAAAILEDPARGVSLALSSVVVDPSIRHFDVAHVSTAATSNFSAVRDLCLSECSQHEACLITTLQTQPGAVRCMFYADTQSCTHSLQGQNCRLLLREEATHIYRKPGISLLSYEASVPSVPISTHGPAAGQVPGHPGGYLMEASGPVPWSSICCPAPGREALPGTRALELDRLLGCQQAKGQLLAARHQNIHVSWSQ

SEQ ID NO: 906369 - protein, 2147 aa, Homo sapiens; identical to SEQ ID NO: 906337

SEQ ID NO: 906370 - protein, 974 aa, Homo sapiens
MCSADYADLLQTFQVFILDELTARGFCQIQVKTFGTLVSIPVCNNSSVQVGCLTRERLGVNVTWKSRLEDIPVASLPDLHDIERALVGKDLLGRFTDLIQSGSFQLHLDSKTFPAETIRFLQGDHFGTSPRTWFGCSEGFYQVLTSEASQDGLGCVKCPEGSYSQDEECIPCPVGFYQEQAGSLACVPCPVGRTTISAGAFSQTHCVTDCQRNEAGLQCDQNGQYRASQKDRGSGKAFCVDGEGRRLPWWETEAPLEDSQCLMMQKFEKVPESKVIFDANAPVAVRSKVPDSEFPVMQCLTDCTEDEACSFFTVSTTEPEISCDFYAWTSDNVACMTSDQKRDALGNSKATSFGSLRCQVKVRSHGQDSPAVYLKKGQGSTTTLQKRFEPTGFQNMLSGLYNPIVFSASGANLTDAHLFCLLACDRDLCCDGFVLTQVQGGAIICGLLSSPSVLLCNVKDWMDPSEAWANATCPGVTYDQESHQVILRLGDQEFIKSLTPLEGTQDTFTNFQQVYLWKDSDMGSRPESMGCRKDTVPRPASPTEAGLTTELFSPVDLNQVIVNGNQSLSSQKHWLFKHLFSAQQANLWCLSRCVQEHSFCQLAEITESASLYFTCTLYPEAQVCDDIMESNAQGCRLILPQMPKALFRKKVILEDKVKNFYTRLPFQKLMGISIRNKVPMSEKSISNGFFECERRCDADPCCTGFGFLNVSQLKGGEVTCLTLNSLGIQMCSEENGGAWRILDCGSPDIEVHTYPFGWYQKPIAQNNAPSFCPLVVLPSLTEKVSLDSWQSLALSSVVVDPSIRHFDVAHVSTAATSNFSAVRDLCLSECSQHEACLITTLQTQPGAVRCMFYADTQSCTHSLQGQNCRLLLREEATHIYRKPGISLLSYEASVPSVPISTHGPAAGQVPGHPGGYLMEASGPVPWSSICCPAPGREALPGTRALELDRLLGCQQAKGQLLAARHQNIHVSWSQ

SEQ ID NO: 906371 - protein, 498 aa, Homo sapiens
MLILKAAHIVCRVRTADFCFVKRPPTSTGSQESLCSAMRHLYLLCPFPPMGRLLGRSQAIQVGTSWKQVDQFLGVPYAAPPLAERRFQAPEPLNWTGSWDASKPRASCWQPGTRTSTSPGVSEDCLYLNVFIPQNVAPNASVLVFFHNTMDREESEGWPAIDGSFLAAVGNLIVVTASYRVGVFGFLSSGSGEVSGNWGLLDQVAALTWVQTHIRGFGGDPRRVSLAADRGGADVASIHLLTARATNSQLFRRAVLMGGSALSPAAVISHERAQQQAIALAKEVSCPMSSSQEVVSCLRQKPANVLNDAQTKLLAVSGPFHYWGPVIDGHFLREPPARALKRSLRVEVDLLIGSSQDDGLINRAKAVKQFEESRGRTSSKTAFYQALQNSLGGEDSDARVEAAATWYYSLEHSTDDYASFSRALENATRDYFIICPIIDMASAWAKRARGNVFMYHAPENYGHGKPGAAGGMFSLPWGFPFYPAYEGQFSLEEKKPVA

SEQ ID NO: 906372 - protein, 2177 aa, Homo sapiens
MLSRLRDPPGCSSEGLKCMDPPAGKPKRCPRSCEIRNRRLLHGVGDKSPPQCSAEGEFMPVQCKFVNTTDMMIFDLVHSYNRFPDAFVTFSSFQRRFPEVSGYCHCADSQGRELAETGLELLLDEIYDTIFAGLDLPSTFTETTLYRILQRRFLAVQSVISGRFRCPTKCEVERFTATSFGHPYVPSCRRNGDYQAVQCQTEGPCWCVDAQGKEMHGTRQQGEPPSCAEGQSCASERQQALSRLYFGTSGYFSQHDLFSSPEKRWASPRVARFATSCPPTIKELFVDSGLLRPMVEGQSQQFSVSENLLKEAIRAIFPSRGLARLALQFTTNPKRLQQNLFGGKFLVNVGQFNLSGALGTRGTFNFSQFFQQLGLASFLNGGRQEDLAKPLSVGLDSNSSTGTPEAAKKDGTMNKPTVGSFGFEINLQENQNALKFLASLLELPEFLLFLQHAISVPEDVARDLGDVMETVLSSQTCEQTPERLFVPSCTTEGSYEDVQCFSGECWCVNSWGKELPGSRVRGGQPRCPTDCEKQRARMQSLMGSQPAGSTLFVPACTSEGHFLPVQCFNSECYCVDAEGQAIPGTRSAIGKPKKCPTPCQLQSEQAFLRTVQALLSNSSMLPTLSDTYIPQCSTDGQWRQVQCNGPPEQVFELYQRWEAQNKGQDLTPAKLLVKIMSYREAASGNFSLFIQSLYEAGQQDVFPVLSQYPSLQDVPLAALEGKRPQPRENILLEPYLFWQILNGQLSQYPGSYSDFSTPLAHFDLRNCWCVDEAGQELEGMRSEPSKLPTCPGSCEEAKLRVLQFIRETEEIVSASNSSRFPLGESFLVAKGIRLRNEDLGLPPLFPPREAFAEQFLRGSDYAIRLAAQSTLSFYQRRRFSPDDSAGASALLRSGPYMPQCDAFGSWEPVQCHAGTGHCWCVDEKGGFIPGSLTARSLQIPQCPTTCEKSRTSGLLSSWKQARSQENPSPKDLFVPACLETGEYARLQASGAGTWCVDPASGEELRPGSSSSAQCPSLCNVLKSGVLSRRVSPGYVPACRAEDGGFSPVQCDQAQGSCWCVMDSGEEVPGTRVTGGQPACESPRCPLPFNASEVVGGTILCETISGPTGSAMQQCQLLCRQGSWSVFPPGPLICSLESGRWESQLPQPRACQRPQLWQTIQTQGHFQLQLPPGKMCSADYADLLQTFQVFILDELTARGFCQIQVKTFGTLVSIPVCNNSSVQVGCLTRERLGVNVTWKSRLEDIPVASLPDLHDIERALVGKDLLGRFTDLIQSGSFQLHLDSKTFPAETIRFLQGDHFGTSPRTWFGCSEGFYQVLTSEASQDGLGCVKCPEGSYSQDEECIPCPVGFYQEQAGSLACVPCPVGRTTISAGAFSQTHCVTDCQRNEAGLQCDQNGQYRASQKDRGSGKAFCVDGEGRRLPWWETEAPLEDSQCLMMQKFEKVPESKVIFDANAPVAVRSKVPDSEFPVMQCLTDCTEDEACSFFTVSTTEPEISCDFYAWTSDNVACMTSDQKRDALGNSKATSFGSLRCQVKVRSHGQDSPAVYLKKGQGSTTTLQKRFEPTGFQNMLSGLYNPIVFSASGANLTDAHLFCLLACDRDLCCDGFVLTQVQGGAIICGLLSSPSVLLCNVKDWMDPSEAWANATCPGVTYDQESHQVILRLGDQEFIKSLTPLEGTQDTFTNFQQVYLWKDSDMGSRPESMGCRKDTVPRPASPTEAGLTTELFSPVDLNQVIVNGNQSLSSQKHWLFKHLFSAQQANLWCLSRCVQEHSFCQLAEITESASLYFTCTLYPEAQVCDDIMESNAQGCRLILPQMPKALFRKKVILEDKVKNFYTRLPFQKLMGISIRNKVPMSEKSISNGFFECERRCDADPCCTGFGFLNVSQLKGGEVTCLTLNSLGIQMCSEENGGAWRILDCGSPDIEVHTYPFGWYQKPIAQNNAPSFCPLVVLPSLTEKVFKVREVRGTQLKRMERGLPYKLEYLVSWEVSLDSWQSLALSSVVVDPSIRHFDVAHVSTAATSNFSAVRDLCLSECSQHEACLITTLQTQPGAVRCMFYADTQSCTHSLQGQNCRLLLREEATHIYRKPGISLLSYEASVPSVPISTHGPAAGQVPGHPGGYLMEASGPVPWSSICCPAPGREALPGTRALELDRLLGCQQAKGQLLAARHQNIHVSWSQ

SEQ ID NO: 906373 - protein, 2147 aa, Homo sapiens; identical to SEQ ID NO: 906337

SEQ ID NO: 906374 - protein, 2147 aa, Homo sapiens; identical to SEQ ID NO: 906337

SEQ ID NO: 906375 - protein, 2147 aa, Homo sapiens; identical to SEQ ID NO: 906337

SEQ ID NO: 906376 - protein, 2147 aa, Homo sapiens; identical to SEQ ID NO: 906337

SEQ ID NO: 906377 - protein, 2147 aa, Homo sapiens; identical to SEQ ID NO: 906337

SEQ ID NO: 906378 - protein, 2147 aa, Homo sapiens; identical to SEQ ID NO: 906337

SEQ ID NO: 906379 - protein, 498 aa, Homo sapiens; identical to SEQ ID NO: 906371

SEQ ID NO: 906380 - protein, 211 aa, Homo sapiens
MSSSQEVVSCLRQKPANVLNDAQTKLLAVSGPFHYWGPVIDGHFLREPPARALKRSLRVEVDLLIGSSQDDGLINRAKAVKQFEESRGRTSSKTAFYQALQNSLGGEDSDARVEAAATWYYSLEHSTDDYASFSRALENATRDYFIICPIIDMASAWAKRARGNVFMYHAPENYGHGKPGAAGGMFSLPWGFPFYPAYEGQFSLEEKKPVA

SEQ ID NO: 906381 - protein, 143 aa, Homo sapiens
VRRYRGSRLSSWEQFEESRGRTSSKTAFYQALQNSLGGEDSDARVEAAATWYYSLEHSTDDYASFSRALENATRDYFIICPIIDMASAWAKRARGNVFMYHAPENYGHGKPGAAGGMFSLPWGFPFYPAYEGQFSLEEKKPVA

SEQ ID NO: 906382 - protein, 2126 aa, Homo sapiens
MLSRLRDPPGCSSEGLKCMDPPAGKPKRCPRSCEIRNRRLLHGVGDKSPPQCSAEGEFMPVQCKFVNTTDMMIFDLVHSYNRFPDAFVTFSSFQRRFPEVSGYCHCADSQGRELAETGLELLLDEIYDTIFAGLDLPSTFTETTLYRILQRRFLAVQSVISGRFRCPTKCEVERFTATSFGHPYVPSCRRNGDYQAVQCQTEGPCWCVDAQGKEMHGTRQQGEPPSCAEGQSCASERQQALSRLYFGTSGYFSQHDLFSSPEKRWASPRVARFATSCPPTIKELFVDSGLLRPMVEGQSQQFSVSENLLKEAIRAIFPSRGLARLALQFTTNPKRLQQNLFGGKFLVNVGQFNLSGALGTRGTFNFSQFFQQLGLASFLNGGRQEDLAKPLSVGLDSNSSTGTPEAAKKDGTMNKPTVGSFGFEINLQENQNALKFLASLLELPEFLLFLQHAISVPEDVARDLGDVMETVLSSQTCEQTPERLFVPSCTTEGSYEDVQCFSGECWCVNSWGKELPGSRVRGGQPRCPTDCEKQRARMQSLMGSQPAGSTLFVPACTSEGHFLPVQCFNSECYCVDAEGQAIPGTRSAIGKPKKCPTPCQLQSEQAFLRTVQALLSNSSMLPTLSDTYIPQCSTDGQWRQVQCNGPPEQVFELYQRWEAQNKGQDLTPAKLLVKIMSYREAASGNFSLFIQSLYEAGQQDVFPVLSQYPSLQDVPLAALEGKRPQPRENILLEPYLFWQILNGQLSQYPGSYSDFSTPLAHFDLRNCWCVDEAGQELEGMRSEPSKLPTCPGSCEEAKLRVLQFIRETEEIVSASNSSRFPLGESFLVAKGIRLRNEDLGLPPLFPPREAFAEQFLRGSDYAIRLAAQSTLSFYQRRRFSPDDSAGASALLRSGPYMPQCDAFGSWEPVQCHAGTGHCWCVDEKGGFIPGSLTARSLQIPQCPTTCEKSRTSGLLSSWKQARSQENPSPKDLFVPACLETGEYARLQASGAGTWCVDPASGEELRPGSSSSAQCPSLCNVLKSGVLSRRVSPGYVPACRAEDGGFSPVQCDQAQGSCWCVMDSGEEVPGTRVTGGQPACESPRCPLPFNASEVVGGTILCETISGPTGSAMQQCQLLCRQGSWSVFPPGPLICSLESGRWESQLPQPRACQRPQLWQTIQTQGHFQLQLPPGKMCSADYADLLQTFQVFILDELTARGFCQIQVKTFGTLVSIPVCNNSSVQVGCLTRERLGVNVTWKSRLEDIPVASLPDLHDIERALVGKDLLGRFTDLIQSGSFQLHLDSKTFPAETIRFLQGDHFGTSPRTWFGCSEGFYQVLTSEASQDGLGCVKCPEGSYSQDEECIPCPVGFYQEQAGSLACVPCPVGRTTISAGAFSQTHCVTDCQRNEAGLQCDQNGQYRASQKDRGSGKAFCVDGEGRRLPWWETEAPLEDSQCLMMQKFEKVPESKVIFDANAPVAVRSKVPDSEFPVMQCLTDCTEDEACSFFTVSTTEPEISCDFYAWTSDNVACMTSDQKRDALGNSKATSFGSLRCQVKVRSHGQDSPAVYLKKGQGSTTTLQKRFEPTGFQNMLSGLYNPIVFSASGANLTDAHLFCLLACDRDLCCDGFVLTQVQGGAIICGLLSSPSVLLCNVKDWMDPSEAWANATCPGVTYDQESHQVILRLGDQEFIKSLTPLEGTQDTFTNFQQVYLWKDSDMGSRPESMGCRKDTVPRPASPTEAGLTTELFSPVDLNQVIVNGNQSLSSQKHWLFKHLFSAQQANLWCLSRCVQEHSFCQLAEITESASLYFTCTLYPEAQVCDDIMESNAQGCRLILPQMPKALFRKKVILEDKVKNFYTRLPFQKLMGISIRNKVPMSEKSISNGFFECERRCDADPCCTGFGFLNVSQLKGGEVTCLTLNSLGIQMCSEENGGAWRILDCGSPDIEVHTYPFGWYQKPIAQNNAPSFCPLVVLPSLTEKVSLDSWQSLALSSVVVDPSIRHFDVAHVSTAATSNFSAVRDLCLSECSQHEACLITTLQTQPGAVRCMFYADTQSCTHSLQGQNCRLLLREEATHIYRKPGISLLSYEASVPSVPISTHGPAAGQVPGHPGGYLMEASGPVPWSSICCPAPGREALPGTREVEHREERYR

SEQ ID NO: 906383 - protein, 126 aa, Homo sapiens
RPPTTTKFAAASTGQRGPEETSSCTMLLKTTAMASLELLAECSVCLGASLSTQPTRGSFLWRRRSLSLENHAVLFPSFIRSGNPNLPLMSSHGKYPHLQPPGLTLYPVLVERTTRSSVSCSPIDRA

SEQ ID NO: 906384 - protein, 2009 aa, Homo sapiens
MLSRLRDPPGCSSEGLKCMDPPAGKPKRCPRSCEIRNRRLLHGVGDKSPPQCSAEGEFMPVQCKFVNTTDMMIFDLVHSYNRFPDAFVTFSSFQRRFPEVSGYCHCADSQGRELAETGLELLLDEIYDTIFAGLDLPSTFTETTLYRILQRRFLAVQSVISGRFRCPTKCEVERFTATSFGHPYVPSCRRNGDYQAVQCQTEGPCWCVDAQGKEMHGTRQQGEPPSCAEGQSCASERQQALSRLYFGTSGYFSQHDLFSSPEKRWASPRVARFATSCPPTIKELFVDSGLLRPMVEGQSQQFSVSENLLKEAIRAIFPSRGLARLALQFTTNPKRLQQNLFGGKFLVNVGQFNLSGALGTRGTFNFSQFFQQLGLASFLNGGRQEDLAKPLSVGLDSNSSTGTPEAAKKDGTMNKPTVGSFGFEINLQENQNALKFLASLLELPEFLLFLQHAISVPEDVARDLGDVMETVLSSQTCEQTPERLFVPSCTTEGSYEDVQCFSGECWCVNSWGKELPGSRVRGGQPRCPTDCEKQRARMQSLMGSQPAGSTLFVPACTSEGHFLPVQCFNSECYCVDAEGQAIPGTRSAIGKPKKCPTPCQLQSEQAFLRTVQALLSNSSMLPTLSDTYIPQCSTDGQWRQVQCNGPPEQVFELYQRWEAQNKGQDLTPAKLLVKIMSYREAASGNFSLFIQSLYEAGQQDVFPVLSQYPSLQDVPLAALEGKRPQPRENILLEPYLFWQILNGQLSQYPGSYSDFSTPLAHFDLRNCWCVDEAGQELEGMRSEPSKLPTCPGSCEEAKLRVLQFIRETEEIVSASNSSRFPLGESFLVAKGIRLRNEDLGLPPLFPPREAFAEQFLRGSDYAIRLAAQSTLSFYQRRRFSPDDSAGASALLRSGPYMPQCDAFGSWEPVQCHAGTGHCWCVDEKGGFIPGSLTARSLQIPQCPTTCEKSRTSGLLSSWKQARSQENPSPKDLFVPACLETGEYARLQASGAGTWCVDPASGEELRPGSSSSAQCPSLCNVLKSGVLSRRVSPGYVPACRAEDGGFSPVQCDQAQGSCWCVMDSGEEVPGTRVTGGQPACESPRCPLPFNASEVVGGTILCETISGPTGSAMQQCQLLCRQGSWSVFPPGPLICSLESGRWESQLPQPRACQRPQLWQTIQTQGHFQLQLPPGKMCSADYADLLQTFQVFILDELTARGFCQIQVKTFGTLVSIPVCNNSSVQVGCLTRERLGVNVTWKSRLEDIPVASLPDLHDIERALVGKDLLGRFTDLIQSGSFQLHLDSKTFPAETIRFLQGDHFGTSPRTWFGCSEGFYQVLTSEASQDGLGCVKCPEGSYSQDEECIPCPVGFYQEQAGSLACVPCPVGRTTISAGAFSQTHCVTDCQRNEAGLQCDQNGQYRASQKDRGSGKAFCVDGEGRRLPWWETEAPLEDSQCLMMQKFEKVPESKVIFDANAPVAVRSKVPDSEFPVMQCLTDCTEDEACSFFTVSTTEPEISCDFYAWTSDNVACMTSDQKRDALGNSKATSFGSLRCQVKVRSHGQDSPAVYLKKGQGSTTTLQKRFEPTGFQNMLSGLYNPIVFSASGANLTDAHLFCLLACDRDLCCDGFVLTQVQGGAIICGLLSSPSVLLCNVKDWMDPSEAWANATCPGVTYDQESHQVILRLGDQEFIKSLTPLEGTQDTFTNFQQVYLWKDSDMGSRPESMGCRKDTVPRPASPTEAGLTTELFSPVDLNQVIVNGNQSLSSQKHWLFKHLFSAQQANLWCLSRCVQEHSFCQLAEITESASLYFTCTLYPEAQVCDDIMESNAQGCRLILPQMPKALFRKKVILEDKVKNFYTRLPFQKLMGISIRNKVPMSEKSISNGFFECERRCDADPCCTGFGFLNVSQLKGGEVTCLTLNSLGIQMCSEENGGAWRILDCGSPDIEVHTYPFGWYQKPIAQNNAPSFCPLVVLPSLTEKDSHVPGQTNNSMFSKRLGEHTRYLSSFPLCLSFWRITGRWWFQLKGFLAIFNS

SEQ ID NO: 906385 - protein, 992 aa, Homo sapiens
MLSRLRDPPGCSSEGLKCMDPPAGKPKRCPRSCEIRNRRLLHGVGDKSPPQCSAEGEFMPVQCKFVNTTDMMIFDLVHSYNRFPDAFVTFSSFQRRFPEVSGYCHCADSQGRELAETGLELLLDEIYDTIFAGLDLPSTFTETTLYRILQRRFLAVQSVISGRFRCPTKCEVERFTATSFGHPYVPSCRRNGDYQAVQCQTEGPCWCVDAQGKEMHGTRQQGEPPSCAEGQSCASERQQALSRLYFGTSGYFSQHDLFSSPEKRWASPRVARFATSCPPTIKELFVDSGLLRPMVEGQSQQFSVSENLLKEAIRAIFPSRGLARLALQFTTNPKRLQQNLFGGKFLVNVGQFNLSGALGTRGTFNFSQFFQQLGLASFLNGGRQEDLAKPLSVGLDSNSSTGTPEAAKKDGTMNKPTVGSFGFEINLQENQNALKFLASLLELPEFLLFLQHAISVPEDVARDLGDVMETVLSSQTCEQTPERLFVPSCTTEGSYEDVQCFSGECWCVNSWGKELPGSRVRGGQPRCPTDCEKQRARMQSLMGSQPAGSTLFVPACTSEGHFLPVQCFNSECYCVDAEGQAIPGTRSAIGKPKKCPTPCQLQSEQAFLRTVQALLSNSSMLPTLSDTYIPQCSTDGQWRQVQCNGPPEQVFELYQRWEAQNKGQDLTPAKLLVKIMSYREAASGNFSLFIQSLYEAGQQDVFPVLSQYPSLQDVPLAALEGKRPQPRENILLEPYLFWQILNGQLSQYPGSYSDFSTPLAHFDLRNCWCVDEAGQELEGMRSEPSKLPTCPGSCEEAKLRVLQFIRETEEIVSASNSSRFPLGESFLVAKGIRLRNEDLGLPPLFPPREAFAEQFLRGSDYAIRLAAQSTLSFYQRRRFSPDDSAGASALLRSGPYMPQCDAFGSWEPVQCHAGTGHCWCVDEKGGFIPGSLTARSLQIPQCPTTCEKSRTSGLLSSWKQARSQENPSPKDLFPFYPAYEGQFSLEEKKPVA

SEQ ID NO: 906386 - protein, 1738 aa, Homo sapiens
MLSRLRDPPGCSSEGLKCMDPPAGKPKRCPRSCEIRNRRLLHGVGDKSPPQCSAEGEFMPVQCKFVNTTDMMIFDLVHSYNRFPDAFVTFSSFQRRFPEVSGYCHCADSQGRELAETGLELLLDEIYDTIFAGLDLPSTFTETTLYRILQRRFLAVQSVISGRFRCPTKCEVERFTATSFGHPYVPSCRRNGDYQAVQCQTEGPCWCVDAQGKEMHGTRQQGEPPSCAEGQSCASERQQALSRLYFGTSGYFSQHDLFSSPEKRWASPRVARFATSCPPTIKELFVDSGLLRPMVEGQSQQFSVSENLLKEAIRAIFPSRGLARLALQFTTNPKRLQQNLFGGKFLVNVGQFNLSGALGTRGTFNFSQFFQQLGLASFLNGGRQEDLAKPLSVGLDSNSSTGTPEAAKKDGTMNKPTVGSFGFEINLQENQNALKFLASLLELPEFLLFLQHAISVPEDVARDLGDVMETVLSSQTCEQTPERLFVPSCTTEGSYEDVQCFSGECWCVNSWGKELPGSRVRGGQPRCPTDCEKQRARMQSLMGSQPAGSTLFVPACTSEGHFLPVQCFNSECYCVDAEGQAIPGTRSAIGKPKKCPTPCQLQSEQAFLRTVQALLSNSSMLPTLSDTYIPQCSTDGQWRQVQCNGPPEQVFELYQRWEAQNKGQDLTPAKLLVKIMSYREAASGNFSLFIQSLYEAGQQDVFPVLSQYPSLQDVPLAALEGKRPQPRENILLEPYLFWQILNGQLSQYPGSYSDFSTPLAHFDLRNCWCVDEAGQELEGMRSEPSKLPTCPGSCEEAKLRVLQFIRETEEIVSASNSSRFPLGESFLVAKGIRLRNEDLGLPPLFPPREAFAEQFLRGSDYAIRLAAQSTLSFYQRRRFSPDDSAGASALLRSGPYMPQCDAFGSWEPVQCHAGTGHCWCVDEKGGFIPGSLTARSLQIPQCPTTCEKSRTSGLLSSWKQARSQENPSPKDLFVPACLETGEYARLQASGAGTWCVDPASGEELRPGSSSSAQCPSLCNVLKSGVLSRRVSPGYVPACRAEDGGFSPVQCDQAQGSCWCVMDSGEEVPGTRVTGGQPACESPRCPLPFNASEVVGGTILCETISGPTGSAMQQCQLLCRQGSWSVFPPGPLICSLESGRWESQLPQPRACQRPQLWQTIQTQGHFQLQLPPGKMCSADYADLLQTFQVFILDELTARGFCQIQVKTFGTLVSIPVCNNSSVQVGCLTRERLGVNVTWKSRLEDIPVASLPDLHDIERALVGKDLLGRFTDLIQSGSFQLHLDSKTFPAETIRFLQGDHFGTSPRTWFGCSEGFYQVLTSEASQDGLGCVKCPEGSYSQDEECIPCPVGFYQEQAGSLACVPCPVGRTTISAGAFSQTHCVTDCQRNEAGLQCDQNGQYRASQKDRGSGKAFCVDGEGRRLPWWETEAPLEDSQCLMMQKFEKVPESKVIFDANAPVAVRSKVPDSEFPVMQCLTDCTEDEACSFFTVSTTEPEISCDFYAWTSDNVACMTSDQKRDALGNSKATSFGSLRCQVKVRSHGQDSPAVYLKKGQGSTTTLQKRFEPTGFQNMLSGLYNPIVFSASGANLTDAHLFCLLACDRDLCCDGFVLTQVQGGAIICGLLSSPSVLLCNVKDWMDPSEAWANATCPGVTYDQESHQVILRLGDQEFIKSLTPLEGTQDTFTNFQQVYLWKDSDMGSRPESMGCRKDTVPRPASPTEAVTQDFSHCGPQPPSSRDPSR

SEQ ID NO: 906387 - protein, 1633 aa, Homo sapiens
MLSRLRDPPGCSSEGLKCMDPPAGKPKRCPRSCEIRNRRLLHGVGDKSPPQCSAEGEFMPVQCKFVNTTDMMIFDLVHSYNRFPDAFVTFSSFQRRFPEVSGYCHCADSQGRELAETGLELLLDEIYDTIFAGLDLPSTFTETTLYRILQRRFLAVQSVISGRFRCPTKCEVERFTATSFGHPYVPSCRRNGDYQAVQCQTEGPCWCVDAQGKEMHGTRQQGEPPSCAEGQSCASERQQALSRLYFGTSGYFSQHDLFSSPEKRWASPRVARFATSCPPTIKELFVDSGLLRPMVEGQSQQFSVSENLLKEAIRAIFPSRGLARLALQFTTNPKRLQQNLFGGKFLVNVGQFNLSGALGTRGTFNFSQFFQQLGLASFLNGGRQEDLAKPLSVGLDSNSSTGTPEAAKKDGTMNKPTVGSFGFEINLQENQNALKFLASLLELPEFLLFLQHAISVPEDVARDLGDVMETVLSSQTCEQTPERLFVPSCTTEGSYEDVQCFSGECWCVNSWGKELPGSRVRGGQPRCPTDCEKQRARMQSLMGSQPAGSTLFVPACTSEGHFLPVQCFNSECYCVDAEGQAIPGTRSAIGKPKKCPTPCQLQSEQAFLRTVQALLSNSSMLPTLSDTYIPQCSTDGQWRQVQCNGPPEQVFELYQRWEAQNKGQDLTPAKLLVKIMSYREAASGNFSLFIQSLYEAGQQDVFPVLSQYPSLQDVPLAALEGKRPQPRENILLEPYLFWQILNGQLSQYPGSYSDFSTPLAHFDLRNCWCVDEAGQELEGMRSEPSKLPTCPGSCEEAKLRVLQFIRETEEIVSASNSSRFPLGESFLVAKGIRLRNEDLGLPPLFPPREAFAEQFLRGSDYAIRLAAQSTLSFYQRRRFSPDDSAGASALLRSGPYMPQCDAFGSWEPVQCHAGTGHCWCVDEKGGFIPGSLTARSLQIPQCPTTCEKSRTSGLLSSWKQARSQENPSPKDLFVPACLETGEYARLQASGAGTWCVDPASGEELRPGSSSSAQCPSLCNVLKSGVLSRRVSPGYVPACRAEDGGFSPVQCDQAQGSCWCVMDSGEEVPGTRVTGGQPACESPRCPLPFNASEVVGGTILCETISGPTGSAMQQCQLLCRQGSWSVFPPGPLICSLESGRWESQLPQPRACQRPQLWQTIQTQGHFQLQLPPGKMCSADYADLLQTFQVFILDELTARGFCQIQVKTFGTLVSIPVCNNSSVQVGCLTRERLGVNVTWKSRLEDIPVASLPDLHDIERALVGKDLLGRFTDLIQSGSFQLHLDSKTFPAETIRFLQGDHFGTSPRTWFGCSEGFYQVLTSEASQDGLGCVKCPEGSYSQDEECIPCPVGFYQEQAGSLACVPCPVGRTTISAGAFSQTHCVTDCQRNEAGLQCDQNGQYRASQKDRGSGKAFCVDGEGRRLPWWETEAPLEDSQCLMMQKFEKVPESKVIFDANAPVAVRSKVPDSEFPVMQCLTDCTEDEACSFFTVSTTEPEISCDFYAWTSDNVACMTSDQKRDALGNSKATSFGSLRCQVKVRSHGQDSPAVYLKKGQGSTTTLQKRFEPTGFQNMLSGLYNPIVFSASGANLTDAHLFCLLACDRDLCCDGFVLTQVQGGHHLWVAELTQYPVIGDTSR

SEQ ID NO: 906388 - protein, 1497 aa, Homo sapiens
MLSRLRDPPGCSSEGLKCMDPPAGKPKRCPRSCEIRNRRLLHGVGDKSPPQCSAEGEFMPVQCKFVNTTDMMIFDLVHSYNRFPDAFVTFSSFQRRFPEVSGYCHCADSQGRELAETGLELLLDEIYDTIFAGLDLPSTFTETTLYRILQRRFLAVQSVISGRFRCPTKCEVERFTATSFGHPYVPSCRRNGDYQAVQCQTEGPCWCVDAQGKEMHGTRQQGEPPSCAEGQSCASERQQALSRLYFGTSGYFSQHDLFSSPEKRWASPRVARFATSCPPTIKELFVDSGLLRPMVEGQSQQFSVSENLLKEAIRAIFPSRGLARLALQFTTNPKRLQQNLFGGKFLVNVGQFNLSGALGTRGTFNFSQFFQQLGLASFLNGGRQEDLAKPLSVGLDSNSSTGTPEAAKKDGTMNKPTVGSFGFEINLQENQNALKFLASLLELPEFLLFLQHAISVPEDVARDLGDVMETVLSSQTCEQTPERLFVPSCTTEGSYEDVQCFSGECWCVNSWGKELPGSRVRGGQPRCPTDCEKQRARMQSLMGSQPAGSTLFVPACTSEGHFLPVQCFNSECYCVDAEGQAIPGTRSAIGKPKKCPTPCQLQSEQAFLRTVQALLSNSSMLPTLSDTYIPQCSTDGQWRQVQCNGPPEQVFELYQRWEAQNKGQDLTPAKLLVKIMSYREAASGNFSLFIQSLYEAGQQDVFPVLSQYPSLQDVPLAALEGKRPQPRENILLEPYLFWQILNGQLSQYPGSYSDFSTPLAHFDLRNCWCVDEAGQELEGMRSEPSKLPTCPGSCEEAKLRVLQFIRETEEIVSASNSSRFPLGESFLVAKGIRLRNEDLGLPPLFPPREAFAEQFLRGSDYAIRLAAQSTLSFYQRRRFSPDDSAGASALLRSGPYMPQCDAFGSWEPVQCHAGTGHCWCVDEKGGFIPGSLTARSLQIPQCPTTCEKSRTSGLLSSWKQARSQENPSPKDLFVPACLETGEYARLQASGAGTWCVDPASGEELRPGSSSSAQCPSLCNVLKSGVLSRRVSPGYVPACRAEDGGFSPVQCDQAQGSCWCVMDSGEEVPGTRVTGGQPACESPRCPLPFNASEVVGGTILCETISGPTGSAMQQCQLLCRQGSWSVFPPGPLICSLESGRWESQLPQPRACQRPQLWQTIQTQGHFQLQLPPGKMCSADYADLLQTFQVFILDELTARGFCQIQVKTFGTLVSIPVCNNSSVQVGCLTRERLGVNVTWKSRLEDIPVASLPDLHDIERALVGKDLLGRFTDLIQSGSFQLHLDSKTFPAETIRFLQGDHFGTSPRTWFGCSEGFYQVLTSEASQDGLGCVKCPEGSYSQDEECIPCPVGFYQEQAGSLACVPCPVGRTTISAGAFSQTHCVTDCQRNEAGLQCDQNGQYRASQKDRGSGKAFCVDGEGRRLPWWETEAPLEDSQCLMMQKFEKVPESKVIFDANAPVAVRSKVPDSEFPVMQCLTVTKFEKVPESVIFDANAVAVRSK

SEQ ID NO: 906389 - protein, 943 aa, Homo sapiens
MLSRLRDPPGCSSEGLKCMDPPAGKPKRCPRSCEIRNRRLLHGVGDKSPPQCSAEGEFMPVQCKFVNTTDMMIFDLVHSYNRFPDAFVTFSSFQRRFPEVSGYCHCADSQGRELAETGLELLLDEIYDTIFAGLDLPSTFTETTLYRILQRRFLAVQSVISGRFRCPTKCEVERFTATSFGHPYVPSCRRNGDYQAVQCQTEGPCWCVDAQGKEMHGTRQQGEPPSCAEGQSCASERQQALSRLYFGTSGYFSQHDLFSSPEKRWASPRVARFATSCPPTIKELFVDSGLLRPMVEGQSQQFSVSENLLKEAIRAIFPSRGLARLALQFTTNPKRLQQNLFGGKFLVNVGQFNLSGALGTRGTFNFSQFFQQLGLASFLNGGRQEDLAKPLSVGLDSNSSTGTPEAAKKDGTMNKPTVGSFGFEINLQENQNALKFLASLLELPEFLLFLQHAISVPEDVARDLGDVMETVLSSQTCEQTPERLFVPSCTTEGSYEDVQCFSGECWCVNSWGKELPGSRVRGGQPRCPTDCEKQRARMQSLMGSQPAGSTLFVPACTSEGHFLPVQCFNSECYCVDAEGQAIPGTRSAIGKPKKCPTPCQLQSEQAFLRTVQALLSNSSMLPTLSDTYIPQCSTDGQWRQVQCNGPPEQVFELYQRWEAQNKGQDLTPAKLLVKIMSYREAASGNFSLFIQSLYEAGQQDVFPVLSQYPSLQDVPLAALEGKRPQPRENILLEPYLFWQILNGQLSQYPGSYSDFSTPLAHFDLRNCWCVDEAGQELEGMRSEPSKLPTCPGSCEEAKLRVLQFIRETEEIVSASNSSRFPLGESFLVAKGIRLRNEDLGLPPLFPPREAFAEQFLRGSDYAIRLAAQSTLSFYQRRRFSPDDSAGASALLRSGPYMPQCDAFGSWEPVQCHAGTGHCWCVDEKGGFIPGSLTARSLQIPQCK

SEQ ID NO: 906390 - protein, 755 aa, Homo sapiens
MLSRLRDPPGCSSEGLKCMDPPAGKPKRCPRSCEIRNRRLLHGVGDKSPPQCSAEGEFMPVQCKFVNTTDMMIFDLVHSYNRFPDAFVTFSSFQRRFPEVSGYCHCADSQGRELAETGLELLLDEIYDTIFAGLDLPSTFTETTLYRILQRRFLAVQSVISGRFRCPTKCEVERFTATSFGHPYVPSCRRNGDYQAVQCQTEGPCWCVDAQGKEMHGTRQQGEPPSCAEGQSCASERQQALSRLYFGTSGYFSQHDLFSSPEKRWASPRVARFATSCPPTIKELFVDSGLLRPMVEGQSQQFSVSENLLKEAIRAIFPSRGLARLALQFTTNPKRLQQNLFGGKFLVNVGQFNLSGALGTRGTFNFSQFFQQLGLASFLNGGRQEDLAKPLSVGLDSNSSTGTPEAAKKDGTMNKPTVGSFGFEINLQENQNALKFLASLLELPEFLLFLQHAISVPEDVARDLGDVMETVLSSQTCEQTPERLFVPSCTTEGSYEDVQCFSGECWCVNSWGKELPGSRVRGGQPRCPTDCEKQRARMQSLMGSQPAGSTLFVPACTSEGHFLPVQCFNSECYCVDAEGQAIPGTRSAIGKPKKCPTPCQLQSEQAFLRTVQALLSNSSMLPTLSDTYIPQCSTDGQWRQVQCNGPPEQVFELYQRWEAQNKGQDLTPAKLLVKIMSYREAASGNFSLFIQSLYEAGQQDVFPVLSQYPSLQDVPLAALEGKRPQPRENILLEPYLFWQILNGQLSQCSTVLFSD

SEQ ID NO: 906391 - protein, 97 aa, Homo sapiens
SGRLLLLNSRPRRRPDFVPRAGGENYKEFSELLPNRQGLKKADCSFWSKYISSLKTSADGAKGGQSAESEEEELTAGSGLREDLLSLQEPGSKTYSK

SEQ ID NO: 906392 - protein, 38 aa, Homo sapiens
MQKFEKVPESKVIFDANAPVAVRSKVPDSEFPVMQCLT

SEQ ID NO: 906393 - protein, 124 aa, Homo sapiens
MSVAGLKKQFYKASQLVSEKVGGAEGTKLDDDFKEMEKKVDVTSKAVTEVLARTIEYLQPNPAPASRAKLTMLNTVVQGKSDRSVDAMRVTETPGYPQSEGLLGRRALTHDASGEGRTRNGTIG

SEQ ID NO: 906394 - protein, 368 aa, Homo sapiens
MSVAGLKKQFYKASQLVSEKVGGAEGTKLDDDFKEMEKKVDVTSKAVTEVLARTIEYLQPNPASRAKLTMLNTVSKIRGQVKNPGYPQSEGLLGECMIRHGKELGGESNFGDALLDAGESMKRLAEVKDSLDIEVKQNFIDPLQNLCEKDLKEIQHHLKKLEGRRLDFDYKKKRQGKIPDEELRQALEKFEESKEVAETSMHNLLETDIEQVSQLSALVDAQLDYHRQAVQILDELAEKLKRRMREASSRPKREYKPKPREPFDLGEPEQSNGGFPCTTAPKIAASSSFRSSDKPIRTPSRSMPPLDQPSCKALYDFEPENDGELGFHEGDVITLTNQIDENWYEGMLDGQSGFFPLSYVEVLVPLPQ

SEQ ID NO: 906395 - protein, 368 aa, Homo sapiens; identical to SEQ ID NO: 906394

SEQ ID NO: 906396 - protein, 368 aa, Homo sapiens; identical to SEQ ID NO: 906394

SEQ ID NO: 906397 - protein, 368 aa, Homo sapiens; identical to SEQ ID NO: 906394

SEQ ID NO: 906398 - protein, 256 aa, Homo sapiens
MVDGRVVSCGAMNQLMDSLDIEVKQNFIDPLQNLCEKDLKEIQHHLKKLEGRRLDFDYKKKRQGKIPDEELRQALEKFEESKEVAETSMHNLLETDIEQVSQLSALVDAQLDYHRQAVQILDELAEKLKRRMREASSRPKREYKPKPREPFDLGEPEQSNGGFPCTTAPKIAASSSFRSSDKPIRTPSRSMPPLDQPSCKALYDFEPENDGELGFHEGDVITLTNQIDENWYEGMLDGQSGFFPLSYVEVLVPLPQ

SEQ ID NO: 906399 - protein, 237 aa, Homo sapiens
QAGTAPRGISSTRPSVRERLKEIQHHLKKLEGRRLDFDYKKKRQGKIPDEELRQALEKFEESKEVAETSMHNLLETDIEQVSQLSALVDAQLDYHRQAVQILDELAEKLKRRMREASSRPKREYKPKPREPFDLGEPEQSNGGFPCTTAPKIAASSSFRSSDKPIRTPSRSMPPLDQPSCKALYDFEPENDGELGFHEGDVITLTNQIDENWYEGMLDGQSGFFPLSYVEVLVPLPQ

SEQ ID NO: 906400 - protein, 368 aa, Homo sapiens; identical to SEQ ID NO: 906394

SEQ ID NO: 906401 - protein, 368 aa, Homo sapiens; identical to SEQ ID NO: 906394

SEQ ID NO: 906402 - protein, 160 aa, Homo sapiens [sequence omitted]

SEQ ID NO: 906403 - protein, 368 aa, Homo sapiens; identical to SEQ ID NO: 906394

SEQ ID NO: 906404 - protein, 160 aa, Homo sapiens [sequence omitted]

SEQ ID NO: 906405 - protein, 74 aa, Homo sapiens
YSMFDAVIKLSRRGAAICSGWRRRRRRGLLRRAEGRRRPGACRWRGPGGRLGGGRQHVGGGAEEAVLQGEPAGQ

SEQ ID NO: 906406 - protein, 99 aa, Homo sapiens
LWVSGRQDPQWCRDSGSKPCVGRPSGRYWCDPCPPRLQHHLKKLEGRRLDFDYKKKRQGKIPDEELRQALEKFEESKEVAETSMHNLLETDVSSSGCHI

SEQ ID NO: 906407 - protein, 148 aa, Homo sapiens
EVAETLSSGTNALTCGSTLYIEQVSQLSALVDAQLDYHRQAVQIPATGRHSDLRKAKRARFPNNAARMQANALPVTAPQAGSIKPQGPRGAKGPPLLLHQSNGGFPCTTAPKIAASSSFRSSDKPIRTPSRSMPRPGNSRSPEKSLLG

SEQ ID NO: 906408 - protein, 368 aa, Homo sapiens; identical to SEQ ID NO: 906394

SEQ ID NO: 906409 - protein, 333 aa, Homo sapiens
MEKKVDVTSKAVTEVLARTIEYLQPNPASRAKLTMLNTVSKIRGQVKNPGYPQSEGLLGECMIRHGKELGGESNFGDALLDAGESMKRLAEVKDSLDIEVKQNFIDPLQNLCEKDLKEIQHHLKKLEGRRLDFDYKKKRQGKIPDEELRQALEKFEESKEVAETSMHNLLETDIEQVSQLSALVDAQLDYHRQAVQILDELAEKLKRRMREASSRPKREYKPKPREPFDLGEPEQSNGGFPCTTAPKIAASSSFRSSDKPIRTPSRSMPPLDQPSCKALYDFEPENDGELGFHEGDVITLTNQIDENWYEGMLDGQSGFFPLSYVEVLVPLPQ

SEQ ID NO: 906410 - protein, 333 aa, Homo sapiens; identical to SEQ ID NO: 906409

SEQ ID NO: 906411 - protein, 368 aa, Homo sapiens; identical to SEQ ID NO: 906394

SEQ ID NO: 906412 - protein, 282 aa, Homo sapiens
MKRLAEVKDSLDIEVKQNFIDPLQNLQPRHCPLGLRQAGSPVVQGQWVKAMRGGPSGRYWCDPCPPRLQHHLKKLEGRRLDFDYKKKRQGKIPDEELRQALEKFEESKEVAETSMHNLLETDIEQVSQLSALVDAQLDYHRQAVQILDELAEKLKRRMREASSRPKREYKPKPREPFDLGEPEQSNGGFPCTTAPKIAASSSFRSSDKPIRTPSRSMPPLDQPSCKALYDFEPENDGELGFHEGDVITLTNQIDENWYEGMLDGQSGFFPLSYVEVLVPLPQ

SEQ ID NO: 906413 - protein, 368 aa, Homo sapiens; identical to SEQ ID NO: 906394

SEQ ID NO: 906414 - protein, 102 aa, Homo sapiens
RKSKSYGLGARLGVYQIAASSSFRSSDKPIRTPSRSMPPLDQPSCKALYDFEPENDGELGFHEGDVITLTNQIDENWYEGMLDGQSGFFPLSYVEVLVPLPQ

SEQ ID NO: 906415 - protein, 263 aa, Homo sapiens
MSVAGLKKQFYKASQLVSEKVGGAEGTKLDDDFKEMEKKVDVTSKAVTEVLARTIEYLQPNPASRAKLTMLNTVSKIRGQVKNPGYPQSEGLLGECMIRHGKELGGESNFGDALLDAGESMKRLAEVKDSLDIEVKQNFIDPLQNLCEKDLKEIQHHLKKLEGRRLDFDYKKNRHPLLGLLHSTEPLLPGRCLSLPAPPGPRPLRYSLSRTPHLGGGAYLGGWGCLFTLALTPNGDGSLPHSMAPASSPAPQLLAQLAEAGQH

SEQ ID NO: 906416 - protein, 308 aa, Homo sapiens
MSVAGLKKQFYKASQLVSEKVGGAEGTKLDDDFKEMEKKVDVTSKAVTEVLARTIEYLQPNPASRAKLTMLNTVSKIRGQVKNPGYPQSEGLLGECMIRHGKELGGESNFGDALLDAGESMKRLAEVKDSLDIEVKQNFIDPLQNLCEKDLKEIQHHLKKLEGRRLDFDYKKKRQGKIPDEELRQALEKFEESKEVAETSMHNLLETDIEQVSQLSALVDAQLDYHRQAVQILDELAEKLKRRMREASSRPKREYKPKPREPFDLGEPEQSNGGFPCTTAPKIAASSSFRSSDKPIRTPSRSMLVRST

SEQ ID NO: 906417 - protein, 520 aa, Homo sapiens
MGSRARGGAAGPPLKETCCGSRSGTRASAAAAAAAGARVGATARRPRVPERPQGSPGRRPRCASPVRAPPRAAPMLDMSEARSQPPCSPSGTASSMSHVEDSDSDAPPSPAGSEGLGRAGVAVGGARGDPAEAADERFPACIRDAVSQVLKGYDWSLVPMPVRGGGGGALKAKPHVKRPMNAFMVWAQAARRKLADQYPHLHNAELSKTLGKLWRLLSESEKRPFVEEAERLRVQHKKDHPDYKYQPRRRKSAKAGHSDSDSGAELGPHPGGGAVYKAEAGLGDGHHHGDHTGQTHGPPTPPTTPKTELQQAGAKPELKLEGRRPVDSGRQNIDFSNVDISELSSEVMGTMDAFDVHEFDQYLPLGGPAPPEPGQAYGGAYFHAGASPVWAHKSAPSASASPTETGPPRPHIKTEQPSPGHYGDQPRGSPDYGSCSGQSSATPAAPAGPFAGSQGDYGDLQASSYYGAYPGYAPGLYQYPCFHSPRRPYASPLLNGLALPPAHSPTSHWDQPVYTTLTRP

SEQ ID NO: 906418 - protein, 981 aa, Homo sapiens
MGSRARGGAAGPPLKETCCGSRSGTRASAAAAAAAGARVGATARRPRVPERPQGSPGRRPRCASPVRAPPRAAPMLDMSEARSQPPCSPSGTASSMSHVEDSDSDAPPSPAGSEGLGRAGVAVGGARGDPAEAADERFPACIRDAVSQVLKGYDWSLVPMPVRGGGGGALKAKPHVKRPMNAFMVWAQAARRKLADQYPHLHNAELSKTLGKLWRLSAGAPGAGFGTLAAPGLGLRAGAWRAQSSRRWWPHAGSGLCTPGGCQGGSQWKNILWPAGVRRQLWESGSAEGSAWGVHPRGGCALEPVLLAGNTLRRAMAGTPTCPPAVASGPSPGRHARHDSKLHAALWRCSLLRKGSAPLAPGPPMGRECGGGWVGSRFACEYPPRSFSLSWTPSVRSREGRSGDDGVRRVHALAWWGRSVFQKLGLQSEELVAQEQAAPTECPLVGFQMVLLVWGSGSRILLLTWKKGAWSLRICTSCLLSGSRAQPRGAVDGRPLLPQVLPHRRLEVSLGKSPKECVLWLSEDGRLGPARASGCLGMEGQQPSCPPKAGTVPGKPRFCPPPAGSCPPPPPPLESPRGREQQARNRGKKKEEDGRRGACSSLAVVSIPTFPNRRRPVLPEECTAWCHGRLRSARQAGFPGQSLLARPLLPVPPVVCACAEGTVGALAIPASALCCSLLSESEKRPFVEEAERLRVQHKKDHPDYKYQPRRRKSAKAGHSDSDSGAELGPHPGGGAVYKAEAGLGDGHHHGDHTGQTHGPPTPPTTPKTELQQAGAKPELKLEGRRPVDSGRQNIDFSNVDISELSSEVMGTMDAFDVHEFDQYLPLGGPAPPEPGQAYGGAYFHAGASPVWAHKSAPSASASPTETGPPRPHIKTEQPSPGHYGDQPRGSPDYGSCSGQSSATPAAPAGPFAGSQGDYGDLQASSYYGAYPGYAPGLYQYPCFHSPRRPYASPLLNGLALPPAHSPTSHWDQPVYTTLTRP

SEQ ID NO: 906419 - protein, 776 aa, Homo sapiens
MALSSEPAEMPRQFPKLNISEVDEQVRLLAEKVFAKVLREEDSKDALSLFTVPEDCPIGQKEAKERELQKELAEQKSVETAKRKKSFKMIRSQSLSLQMPPQQDWKGPPAASPAMSPTTPVVTGATSLPTPAPYAMPEFQRVTISGDYCAGITLEDYEQAAKSLAKALMIREKYARLAYHRFPRITSQYLGHPRADTAPPEEGLPDFHPPPLPQEDPYCLDDAPPNLDYLVHMQGGILFVYDNKKMLEHQEPHSLPYPDLETYTVDMSHILALITDGPTKTYCHRRLNFLESKFSLHEMLNEMSEFKELKSNPHRDFYNVRKVDTHIHAAACMNQKHLLRFIKHTYQTEPDRTVAEKRGRKITLRQVFDGLHMDPYDLTVDSLDVHAGRQTFHRFDKFNSKYNPVGASELRDLYLKTENYLGGEYFARMVKEVARELEESKYQYSEPRLSIYGRSPEEWPNLAYWFIQHKVYSPNMRWIIQVPRIYDIFRSKKLLPNFGKMLENIFLPLFKATINPQDHRELHLFLKYVTGFDSVDDESKHSDHMFSDKSPNPDVWTSEQNPPYSYYLYYMYANIMVLNNLRRERGLSTFLFRPHCGEAGSITHLVSAFLTADNISHGLLLKKSPVLQYLYYLAQIPIAMSPLSNNSLFLEYSKNPLREFLHKGLHVSLSTDDPMQFHYTKEALMEEYAIAAQVWKLSTCDLCEIARNSVLQSGLSHQEKQKFLGQNYYKEGPEGNDIRKTNVAQIRMAFRYETLCNELSFLSDAMKSEEITALTN

SEQ ID NO: 906420 - protein, 774 aa, Homo sapiens
MEPGSAEMPRQFPKLNISEVDEQVRLLAEKVFAKVLREEDSKDALSLFTVPEDCPIGQKEAKERELQKELAEQKSVETAKRKKSFKMIRSQSLSLQMPPQQDWKGPPAASPAMSPTTPVVTGATSLPTPAPYAMPEFQRVTISGDYCAGITLEDYEQAAKSLAKALMIREKYARLAYHRFPRITSQYLGHPRADTAPPEEGLPDFHPPPLPQEDPYCLDDAPPNLDYLVHMQGGILFVYDNKKMLEHQEPHSLPYPDLETYTVDMSHILALITDGPTKTYCHRRLNFLESKFSLHEMLNEMSEFKELKSNPHRDFYNVRKVDTHIHAAACMNQKHLLRFIKHTYQTEPDRTVAEKRGRKITLRQVFDGLHMDPYDLTVDSLDVHAGRQTFHRFDKFNSKYNPVGASELRDLYLKTENYLGGEYFARMVKEVARELEESKYQYSEPRLSIYGRSPEEWPNLAYWFIQHKVYSPNMRWIIQVPRIYDIFRSKKLLPNFGKMLENIFLPLFKATINPQDHRELHLFLKYVTGFDSVDDESKHSDHMFSDKSPNPDVWTSEQNPPYSYYLYYMYANIMVLNNLRRERGLSTFLFRPHCGEAGSITHLVSAFLTADNISHGLLLKKSPVLQYLYYLAQIPIAMSPLSNNSLFLEYSKNPLREFLHKGLHVSLSTDDPMQFHYTKEALMEEYAIAAQVWKLSTCDLCEIARNSVLQSGLSHQEKQKFLGQNYYKEGPEGNDIRKTNVAQIRMAFRYETLCNELSFLSDAMKSEEITALTN

SEQ ID NO: 906421 - protein, 801 aa, Homo sapiens
SACCLLRTILEAPGRAQGSEVGATHLPPMYDTAEMPRQFPKLNISEVDEQVRLLAEKVFAKVLREEDSKDALSLFTVPEDCPIGQKEAKERELQKELAEQKSVETAKRKKSFKMIRSQSLSLQMPPQQDWKGPPAASPAMSPTTPVVTGATSLPTPAPYAMPEFQRVTISGDYCAGITLEDYEQAAKSLAKALMIREKYARLAYHRFPRITSQYLGHPRADTAPPEEGLPDFHPPPLPQEDPYCLDDAPPNLDYLVHMQGGILFVYDNKKMLEHQEPHSLPYPDLETYTVDMSHILALITDGPTKTYCHRRLNFLESKFSLHEMLNEMSEFKELKSNPHRDFYNVRKVDTHIHAAACMNQKHLLRFIKHTYQTEPDRTVAEKRGRKITLRQVFDGLHMDPYDLTVDSLDVHAGRQTFHRFDKFNSKYNPVGASELRDLYLKTENYLGGEYFARMVKEVARELEESKYQYSEPRLSIYGRSPEEWPNLAYWFIQHKVYSPNMRWIIQVPRIYDIFRSKKLLPNFGKMLENIFLPLFKATINPQDHRELHLFLKYVTGFDSVDDESKHSDHMFSDKSPNPDVWTSEQNPPYSYYLYYMYANIMVLNNLRRERGLSTFLFRPHCGEAGSITHLVSAFLTADNISHGLLLKKSPVLQYLYYLAQIPIAMSPLSNNSLFLEYSKNPLREFLHKGLHVSLSTDDPMQFHYTKEALMEEYAIAAQVWKLSTCDLCEIARNSVLQSGLSHQEKQKFLGQNYYKEGPEGNDIRKTNVAQIRMAFRYETLCNELSFLSDAMKSEEITALTN

SEQ ID NO: 906422 - protein, 829 aa, Homo sapiens
MALSSEPAEMPRQFPKLNISEVDEQVRLLAEKVFAKVLREEDSKDALSLFTVPEDCPIGQKEAKERELQKELAEQKSVETAKRKKSFKMIRSQSLSLQMPPQQDWKGPPAASPAMSPTTPVVTGATSLPTPAPYAMPEFQRVTISGDYCAGITLEDYEQAAKSLAKALMIREKYARLAYHRFPRITSQYLGHPRADTAPPEEGLPDFHPPPLPQEDPYCLDDAPPNLDYLVHMQGGILFVYDNKKMLEHQEPHSLPYPDLETYTVDMSHILALITDGPTKTYCHRRLNFLESKFSLHEMLNEMSEFKELKSNPHRDFYNVRKVDTHIHAAACMNQKHLLRFIKHTYQTEPDRTVAEKRGRKITLRQVFDGLHMDPYDLTVDSLDVHAVSELLLQCRQQTAALAGDSAPWKATMIVLAGRCYGSSFLFYLTERSCGLREYQGRQTFHRFDKFNSKYNPVGASELRDLYLKTENYLGGEYFARMVKEVARELEESKYQYSEPRLSIYGRSPEEWPNLAYWFIQHKVYSPNMRWIIQVPRIYDIFRSKKLLPNFGKMLENIFLPLFKATINPQDHRELHLFLKYVTGFDSVDDESKHSDHMFSDKSPNPDVWTSEQNPPYSYYLYYMYANIMVLNNLRRERGLSTFLFRPHCGEAGSITHLVSAFLTADNISHGLLLKKSPVLQYLYYLAQIPIAMSPLSNNSLFLEYSKNPLREFLHKGLHVSLSTDDPMQFHYTKEALMEEYAIAAQVWKLSTCDLCEIARNSVLQSGLSHQEKQKFLGQNYYKEGPEGNDIRKTNVAQIRMAFRYETLCNELSFLSDAMKSEEITALTN

SEQ ID NO: 906423 - protein, 786 aa, Homo sapiens
MALSSEPAEMPRQFPKLNISEVDEQVRLLAEKVFAKVLREEDSKDALSLFTVPEDCPIGQKEAKERELQKELAEQKSVETAKRKKSFKMIRSQSLSLQMPPQQDWKGPPAASPAMSPTTPVVTGATSLPTPAPYAMPEFQRVTISGDYCAGITLEDYEQAAKSLAKALMIREKYARLAYHRFPRITSQYLGHPRADTAPPEEGLPDFHPPPLPQEDPYCLDDAPPNLDYLVHMQGGILFVYDNKKMLEHQEPHSLPYPDLETYTVDMSHILALITDGPTLDTHIHAAACMNQKHLLRFIKHTYQTEPDRTVAEKRGRKITLRQVFDGLHMDPYDLTVDSLDVHAVSELLLQCRQQTAALAGDSAPWKATMIVLAGRCYGSSFLFYLTERSCGLREEQGRQTFHRFDKFNSKYNPVGASELRDLYLKTENYLGGEYFARMVKEVARELEESKYQYSEPRLSIYGRSPEEWPNLAYWFIQHKVYSPNMRWIIQVPRIYDIFRSKKLLPNFGKMLENIFLPLFKATINPQDHRELHLFLKYVTGFDSVDDESKHSDHMFSDKSPNPDVWTSEQNPPYSYYLYYMYANIMVLNNLRRERGLSTFLFRPHCGEAGSITHLVSAFLTADNISHGLLLKKSPVLQYLYYLAQIPIAMSPLSNNSLFLEYSKNPLREFLHKGLHVSLSTDDPMQFHYTKEALMEEYAIAAQVWKLSTCDLCEIARNSVLQSGLSHQEKQKFLGQNYYKEGPEGNDIRKTNVAQIRMAFRYETLCNELSFLSDAMKSEEITALTN

SEQ ID NO: 906424 - protein, 232 aa, Homo sapiens [sequence omitted]

SEQ ID NO: 906425 - protein, 122 aa, Homo sapiens
QGSWKFSTHISYSRENFQPRLFLLWLTAAHRYAKQRPPTPAGRQDPASCTHALTQLSLLGGRQHLTRVHHLSGIFRTSHGARLRSVSGLLQGESGKSRNQLPSYNEGISVALGFLSGGTVAP

SEQ ID NO: 906426 - protein, 63 aa, Homo sapiens
QNPPYSYYLYYMYANIMVLNNLRRCVRPALAHAWVHVLVHARMHTHAHTHACDPCVRVHLNQH

SEQ ID NO: 906427 - protein, 767 aa, Homo sapiens
MPRQFPKLNISEVDEQVRLLAEKVFAKVLREEDSKDALSLFTVPEDCPIGQKEAKERELQKELAEQKSVETAKRKKSFKMIRSQSLSLQMPPQQDWKGPPAASPAMSPTTPVVTGATSLPTPAPYAMPEFQRVTISGDYCAGITLEDYEQAAKSLAKALMIREKYARLAYHRFPRITSQYLGHPRADTAPPEEGLPDFHPPPLPQEDPYCLDDAPPNLDYLVHMQGGILFVYDNKKMLEHQEPHSLPYPDLETYTVDMSHILALITDGPTKTYCHRRLNFLESKFSLHEMLNEMSEFKELKSNPHRDFYNVRKVDTHIHAAACMNQKHLLRFIKHTYQTEPDRTVAEKRGRKITLRQVFDGLHMDPYDLTVDSLDVHAGRQTFHRFDKFNSKYNPVGASELRDLYLKTENYLGGEYFARMVKEVARELEESKYQYSEPRLSIYGRSPEEWPNLAYWFIQHKVYSPNMRWIIQVPRIYDIFRSKKLLPNFGKMLENIFLPLFKATINPQDHRELHLFLKYVTGFDSVDDESKHSDHMFSDKSPNPDVWTSEQNPPYSYYLYYMYANIMVLNNLRRERGLSTFLFRPHCGEAGSITHLVSAFLTADNISHGLLLKKSPVLQYLYYLAQIPIAMSPLSNNSLFLEYSKNPLREFLHKGLHVSLSTDDPMQFHYTKEALMEEYAIAAQVWKLSTCDLCEIARNSVLQSGLSHQEKQKFLGQNYYKEGPEGNDIRKTNVAQIRMAFRYETLCNELSFLSDAMKSEEITALTN

SEQ ID NO: 906428 - protein, 774 aa, Homo sapiens; identical to SEQ ID NO: 906420

SEQ ID NO: 906429 - protein, 767 aa, Homo sapiens; identical to SEQ ID NO: 906427

SEQ ID NO: 906430 - protein, 589 aa, Homo sapiens
LLCEHLRPVPEPVSEGLAYFHPPPLPQEDPYCLDDAPPNLDYLVHMQGGILFVYDNKKMLEHQEPHSLPYPDLETYTVDMSHILALITDGPTKTYCHRRLNFLESKFSLHEMLNEMSEFKELKSNPHRDFYNVRKVDTHIHAAACMNQKHLLRFIKHTYQTEPDRTVAEKRGRKITLRQVFDGLHMDPYDLTVDSLDVHAGRQTFHRFDKFNSKYNPVGASELRDLYLKTENYLGGEYFARMVKEVARELEESKYQYSEPRLSIYGRSPEEWPNLAYWFIQHKVYSPNMRWIIQVPRIYDIFRSKKLLPNFGKMLENIFLPLFKATINPQDHRELHLFLKYVTGFDSVDDESKHSDHMFSDKSPNPDVWTSEQNPPYSYYLYYMYANIMVLNNLRRERGLSTFLFRPHCGEAGSITHLVSAFLTADNISHGLLLKKSPVLQYLYYLAQIPIAMSPLSNNSLFLEYSKNPLREFLHKGLHVSLSTDDPMQFHYTKEALMEEYAIAAQVWKLSTCDLCEIARNSVLQSGLSHQEKQKFLGQNYYKEGPEGNDIRKTNVAQIRMAFRYETLCNELSFLSDAMKSEEITALTN

SEQ ID NO: 906431 - protein, 276 aa, Homo sapiens [sequence omitted]

SEQ ID NO: 906432 - protein, 438 aa, Homo sapiens
MALSSEPAEMPRQFPKLNISEVDEQVRLLAEKVFAKVLREEDSKDALSLFTVPEDCPIGQKEAKERELQKELAEQKSVETAKRKKSFKMIRSQSLSLQMPPQQDWKGPPAASPAMSPTTPVVTGATSLPTPAPYAMPEFQRVTISGDYCAGITLEDYEQAAKSLAKALMIREKYARLAYHRFPRITSQYLGHPRADTAPPEEGLPDFHPPPLPQEDPYCLDDAPPNLDYLVHMQGGILFVYDNKKMLEHQEPHSLPYPDLETYTVDMSHILALITDGPTKTYCHRRLNFLESKFSLHEMLNEMSEFKELKSNPHRDFYNVRKVDTHIHAAACMNQKHLLRFIKHTYQTEPDRTVAEKRGRKITLRQVFDGLHMDPYDLTVDSLDVHAVSELLLQCRQQTAALAGDSAPWKATMIVLAGRCYGSSFLFYLTERSCGLRE

SEQ ID NO: 906433 - protein, 489 aa, Homo sapiens
MALLFLLPLVMQGVSRAEMGTADLGPSSVPTPTNVTIESYNMNPIVYWEYQIMPQVPVFTVEVKNYGVKNSEWIDACINISHHYCNISDHVGDPSNSLWVRVKARVGQKESAYAKSEEFAVCRDGKIGPPKLDIRKEEKQIMIDIFHPSVFVNGDEQEVDYDPETTCYIRVYNVYVRMNGSEIQYKILTQKEDDCDEIQCQLAIPVSSLNSQYCVSAEGVLHVWGVTTEKSKEVCITIFNSSIKGSLWIPVVAALLLFLVLSLVFICFYIKKINPLKEKSIILPKSLISVVRSATLETKPESKYVSLITSYQPFSLEKEVVCEEPLSPATVPGMHTEDNPGKVEHTEELSSITEVVTTEENIPDVVPGSHLTPIERESSSPLSSNQSEPGSIALNSYHSRNCSESDHSRNGFDTDSSCLESHSSLSDSEFPPNNKGEIKTEGQELITVIKAPTSFGYDKPHVLVDLLVDDSGKESLIGYRPTEDSKEFS

SEQ ID NO: 906434 - protein, 38 aa, Homo sapiens
MRCRRTLLVNVGQRGLKDYNIVFLLYLFLWLDTQILTS

SEQ ID NO: 906435 - protein, 106 aa, Homo sapiens
MALLFLLPLVMQGVSRAEMGTADLGPSSVPTPTNVTIESYNMNPIVYWEYQIMPQVPVFTVEVKNYGLSVTLLFILFIPFLFRSLEIPQLCSFISLPTWQNILNCL

SEQ ID NO: 906436 - protein, 479 aa, Homo sapiens
MLLKSPENSLLQFQFKYGVPTPTNVTIESYNMNPIVYWEYQIMPQVPVFTVEVKNYGVKNSEWIDACINISHHYCNISDHVGDPSNSLWVRVKARVGQKESAYAKSEEFAVCRDGKIGPPKLDIRKEEKQIMIDIFHPSVFVNGDEQEVDYDPETTCYIRVYNVYVRMNGSEIQYKILTQKEDDCDEIQCQLAIPVSSLNSQYCVSAEGVLHVWGVTTEKSKEVCITIFNSSIKGSLWIPVVAALLLFLVLSLVFICFYIKKINPLKEKSIILPKSLISVVRSATLETKPESKYVSLITSYQPFSLEKEVVCEEPLSPATVPGMHTEDNPGKVEHTEELSSITEVVTTEENIPDVVPGSHLTPIERESSSPLSSNQSEPGSIALNSYHSRNCSESDHSRNGFDTDSSCLESHSSLSDSEFPPNNKGEIKTEGQELITVIKAPTSFGYDKPHVLVDLLVDDSGKESLIGYRPTEDSKEFS

SEQ ID NO: 906437 - protein, 553 aa, Homo sapiens
MALLFLLPLVMQGVSRAEMGTADLGPSSVPTPTNVTIESYNMNPIVYWEYQIMPQVPVFTVEVKNYGVKNSEWIDACINISHHYCNISDHVGDPSNSLWVRVKARVGQKESAYAKSEEFAVCRDGKIGPPKLDIRKEEKQIMIDIFHPSVFVNGDEQEVDYDPETTCYIRVYNVYVRMNGSEIQYKILTQKEDDCDEIQCQLAIPVSSLNSQYCVSAEGVLHVWGVTTEKSKEVCITIFNSSIKGSLWIPVVAALLLFLVLSLVFICFYIKKINPLKEKSIILPKSLISVVRSATLETKPESKYVSLITSYQPFSLEKEVVCEEPLSPATVPGMHTEDNPGKVEHTEELSSITEVVTTEENIPDVVPGSHLTPIERESSSPLSSNQSEPGSIALNSYHSRNCSESDHSRNGFDTDSSCLESHSSLSDSEFPPNNKGEIKTEGQELITVIKAPTSFGYDKPHVLVDLLVDDSGKESLIGYRPTEDSKDPHPAPPPPPPPPPTPDHPNPAMEPAHESKRTRGPGLQTDSPPKATHPSHPDRLPVTEQYPVLLVPR

SEQ ID NO: 906438 - protein, 189 aa, Homo sapiens
MALLFLLPLVMQGVSRAEMGTADLGPSSVPTPTNVTIESYNMNPIVYWEYQIMPQVPVFTVEVKNYGVKNSEWIDACINISHHYCNISDHVGDPSNSLWVRVKARVGQKESAYAKSEEFAVCRDGKIGPPKLDIRKEEKQIMIDIFHPSVFVNGDEQEVDYDPETTCYIRVYNVYVRMNGSEVCVSHFS

SEQ ID NO: 906439 - protein, 152 aa, Homo sapiens
MVKARVGQKESAYAKSEEFAVCRDGKIGPPKLDIRKEEKQIMIDIFHPSVFVNGDEQEVDYDPETTCYIRVYNVYVRMNGSEIQYKILTQKEDDCDEIQCQLAIPVSSLNSQYCVSAEGVLHVWGVTTEKSKEVCITIFNSSIKGKFLPFFF

SEQ ID NO: 906440 - protein, 471 aa, Homo sapiens
MALLFLLPLVMQGVSRAEMGTADLGPSSVPTPTNVTIESYNMNPIVYWEYQIMPQVPVFTVEVKNYGVKNSEWIDACINISHHYCNISDHVGDPSNSLWVRVKARVGQKESAYAKSEEFAVCRDGKIGPPKLDIRKEEKQIMIDIFHPSVFVNGDEQEVDYDPETTCYIRVYNVYVRMNGSEIQYKILTQKEDDCDEIQCQLAIPVSSLNSQYCVSAEGVLHVWGVTTEKSKEVCITIFNSSIKGSLWIPVVAALLLFLVLSLVFICFYIKKINPLKEKSIILPKSLISVVRSATLETKPESKYVSLITSYQPFSLEKEVVCEEPLSPATVPGMHTEDNPGKVEHTEELSSITEVVTTEGSSPLSSNQSEPGSIALNSYHSRNCSESDHSRNGFDTDSSCLESHSSLSDSEFPPNNKGEIKTEGQELITVIKAPTSFGYDKPHVLVDLLVDDSGKESLIGYRPTEDSKEFS

SEQ ID NO: 906441 - protein, 156 aa, Homo sapiens
MHTEDNPGKVEHTEELSSITEVVTTEENIPDVVPGSHLTPIERESSSPLSSNQSEPGSIALNSYHSRNCSESDHSRNGFDTDSSCLESHSSLSDSEFPPNNKGEIKTEGQELITVIKAPTSFGYDKPHVLVDLLVDDSGKESLIGYRPTEDSKEFS

SEQ ID NO: 906442 - protein, 252 aa, Homo sapiens
MALLFLLPLVMQGVSRAEMGTADLGPSSVPTPTNVTIESYNMNPIVYWEYQIMPQVPVFTVEVKNYGVKNSEWIDACINISHHYCNISDHVGDPSNSLWVRVKARVGQKESAYAKSEEFAVCRDGKIGPPKLDIRKEEKQIMIDIFHPSVFVNGDEQEVDYDPETTCYIRVYNVYVRMNGSEIQYKILTQKEDDCDEIQCQLAIPVSSLNSQYCVSAEGVLHVWGVTTEKSKEVCITIFNSSIKGKFLPFFF

SEQ ID NO: 906443 - protein, 120 aa, Homo sapiens
MTTPRNSVNGTFPAEPMKGPIAMQSGPKPLFRRMSSLVGPTQSFFMRESKTLGAVQIMNGLFHIALGGLLMIPAGIYAPICVTVWYPLWGGIMYIISGSLLAATEKNSRKCLASNHMSFF

SEQ ID NO: 906444 - protein, 297 aa, Homo sapiens
MTTPRNSVNGTFPAEPMKGPIAMQSGPKPLFRRMSSLVGPTQSFFMRESKTLGAVQIMNGLFHIALGGLLMIPAGIYAPICVTVWYPLWGGIMYIISGSLLAATEKNSRKCLVKGKMIMNSLSLFAAISGMILSIMDILNIKISHFLKMESLNFIRAHTPYINIYNCEPANPSEKNSPSTQYCYSIQSLFLGILSVMLIFAFFQELVIAGIVENEWKRTCSRPKSNIVLLSAEEKKEQTIEIKEEVVGLTETSSQPKNEEDIEIIPIQEEEEEETETNFPEPPQDQESSPIENDSSP

SEQ ID NO: 906445 - protein, 275 aa, Homo sapiens
MQSGPKPLFRRMSSLVGPTQSFFMRESKTLGAVQIMNGLFHIALGGLLMIPAGIYAPICVTVWYPLWGGIMYIISGSLLAATEKNSRKCLVKGKMIMNSLSLFAAISGMILSIMDILNIKISHFLKMESLNFIRAHTPYINIYNCEPANPSEKNSPSTQYCYSIQSLFLGILSVMLIFAFFQELVIAGIVENEWKRTCSRPKSNIVLLSAEEKKEQTIEIKEEVVGLTETSSQPKNEEDIEIIPIQEEEEEETETNFPEPPQDQESSPIENDSSP

SEQ ID NO: 906446 - protein, 203 aa, Homo sapiens
MFSKGKSNPINKSVSPFQVKGKMIMNSLSLFAAISGMILSIMDILNIKISHFLKMESLNFIRAHTPYINIYNCEPANPSEKNSPSTQYCYSIQSLFLGILSVMLIFAFFQELVIAGIVENEWKRTCSRPKSNIVLLSAEEKKEQTIEIKEEVVGLTETSSQPKNEEDIEIIPIQEEEEEETETNFPEPPQDQESSPIENDSSP

SEQ ID NO: 906447 - protein, 297 aa, Homo sapiens; identical to SEQ ID NO: 906444

SEQ ID NO: 906448 - protein, 297 aa, Homo sapiens; identical to SEQ ID NO: 906444

SEQ ID NO: 906449 - protein, 297 aa, Homo sapiens; identical to SEQ ID NO: 906444

SEQ ID NO: 906450 - protein, 124 aa, Homo sapiens
MFFVPLLHFHLHSSVVFQGILSVMLIFAFFQELVIAGIVENEWKRTCSRPKSNIVLLSAEEKKEQTIEIKEEVVGLTETSSQPKNEEDIEIIPIQEEEEEETETNFPEPPQDQESSPIENDSSP

SEQ ID NO: 906451 - protein, 613 aa, Homo sapiens
MRAPGALLARMSRLLLLLLLKVSASSALGVAPASRNETCLGESCAPTVIQRRGRDAWGPGNSARDVLRARAPREEQGAAFLAGPSWDLPAAPGRDPAAGRGAEASAAGPPGPPTRPPGPWRWKGARGQEPSETLGRGNPTALQLFLQISEEEEKGPRGAGISGRSQEQSVKTVPGASDLFYWPRRAGKLQGSHHKPLSKTANGLAGHEGWTIALPGRALAQNGSLGEGIHEPGGPRRGNSTNRRVRLKNPFYPLTQESYGAYAVMCLSVVIFGTGIIGNLAVMCIVCHNYYMRSISNSLLANLAFWDFLIIFFCLPLVIFHELTKKWLLEDFSCKIVPYIEVASLGVTTFTLCALCIDRFRAATNVQMYYEMIENCSSTTAKLAVIWVGALLLALPEVVLRQLSKEDLGFSGRAPAERCIIKISPDLPDTIYVLALTYDSARLWWYFGCYFCLPTLFTITCSLVTARKIRKAEKACTRGNKRQIQLESQMNCTVVALTILYGFCIIPENICNIVTAYMATGVSQQTMDLLNIISQFLLFFKSCVTPVLLFCLCKPFSRAFMECCCCCCEECIQKSSTVTSDDNDNEYTTELELSPFSTIRREMSTFASVGTHC

SEQ ID NO: 906452 - protein, 595 aa, Homo sapiens
MRAPGALLARMSRLLLLLLLKVSASSALGVAPASRNETCLGESCAPTVIQRRGRDAWGPGNSARDVLRARAPREEQGAAFLAGPSWDLPAAPGRDPAAGRGAEASAAGPPGPPTRPPGPWRWKGARGQEPSETLGRGNPTALQLFLQISEEEEKGPRGAGISGRSQEQSVKTVPGASDLFYWPRRAGKLQGSHHKPLSKTANGLAGHEGWTIALPGRALAQNGSLGEGIHEPGGPRRGNSTNRRVRLKNPFYPLTQESYGAYAVMCLSVVIFGTGIIGNLAVMCIVCHNYYMRSISNSLLANLAFWDFLIIFFCLPLVIFHELTKKWLLEDFSCKIVPYIEVASLGVTTFTLCALCIDRFRAATNVQMYYEMIENCSSTTAKLAVIWVGALLLALPEVVLRQLSKEDLGFSGRAPAERCIIKISPDLPDTIYVLALTYDSARLWWYFGCYFCLPTLFTITCSLVTARKIRKAEKACTRGNKRQIQLESQMNCTVVALTILYGFCIIQTMDLLNIISQFLLFFKSCVTPVLLFCLCKPFSRAFMECCCCCCEECIQKSSTVTSDDNDNEYTTELELSPFSTIRREMSTFASVGTHC

SEQ ID NO: 906453 - protein, 613 aa, Homo sapiens; identical to SEQ ID NO: 906451

SEQ ID NO: 906454 - protein, 268 aa, Homo sapiens
AQLPMPHSGKLFSLSLSFLFIHIFFYSFANLHLFPSALIFRGTPGINVFYVPPQVASLGVTTFTLCALCIDRFRAATNVQMYYEMIENCSSTTAKLAVIWVGALLLALPEVVLRQLSKEDLGFSGRAPAERCIIKISPDLPDTIYVLALTYDSARLWWYFGCYFCLPTLFTITCSLVTARKIRKAEKACTRGNKRQIQLESQMNCTVVALTILYGFCIIPENICNIVTAYMATGVSQQTMDLLNIISQFLLFFKSCVTPVLLFCLCKP

SEQ ID NO: 906455 - protein, 137 aa, Homo sapiens
GDNRCFLFSICPSMAVYTHTGYNDHYMYLNHGQQTIPNGLGMGGQHNYFGLWVDVDFGKGHSRAKPTCTTYNSPQLSAQENFQFDKMEVWAVGDPSEEQLAKGNKSILDADPEAQALLEISGHSRHSEGLREVPDDE

SEQ ID NO: 906456 - protein, 137 aa, Homo sapiens; identical to SEQ ID NO: 906455

SEQ ID NO: 906457 - protein, 785 aa, Homo sapiens
ASRPPPRPTAAARAPALGYKMAALSGGGGGGAEPGQALFNGDMEPEAGAGRPAASSAADPAIPEEVWNIKQMIKLTQEHIEALLDKFGGEHNPPSIYLEAYEEYTSKLDALQQREQQLLESLGNGTDFSVSSSASMDTVTSSSSSSLSVLPSSLSVFQNPTDVARSNPKSPQKPIVRVFLPNKQRTVVPARCGVTVRDSLKKALMMRGLIPECCAVYRIQDGEKKPIGWDTDISWLTGEELHVEVLENVPLTTHNFVRKTFFTLAFCDFCRKLLFQGFRCQTCGYKFHQRCSTEVPLMCVNYDQLDLLFVSKFFEHHPIPQEEASLAETALTSGSSPSAPASDSIGPQILTSPSPSKSIPIPQPFRPADEDHRNQFGQRDRSSSAPNVHINTIEPVNIDDLIRDQGFRGDGGSTTGLSATPPASLPGSLTNVKALQKSPGPQRERKSSSSSEDRNRMKTLGRRDSSDDWEIPDGQITVGQRIGSGSFGTVYKGKWHGDVAVKMLNVTAPTPQQLQAFKNEVGVLRKTRHVNILLFMGYSTKPQLAIVTQWCEGSSLYHHLHIIETKFEMIKLIDIARQTAQGMDYLHAKSIIHRDLKSNNIFLHEDLTVKIGDFGLATVKSRWSGSHQFEQLSGSILWMAPEVIRMQDKNPYSFQSDVYAFGIVLYELMTGQLPYSNINNRDQIIFMVGRGYLSPDLSKVRSNCPKAMKRLMAECLKKKRDERPLFPQILASIELLARSLPKIHRSASEPSLNRAGFQTEDFSLYACASPKTPIQAGGYGAFPVH

SEQ ID NO: 906458 - protein, 785 aa, Homo sapiens; identical to SEQ ID NO: 906457

SEQ ID NO: 906459 - protein, 594 aa, Homo sapiens
FQEKGKACGLKPVNLSAGQAFHLPLTGQTLSGSTYLNCVFFWFFVFSSSTPGSGERTFHLQHTTVVRKTFFTLAFCDFCRKLLFQGFRCQTCGYKFHQRCSTEVPLMCVNYDQLDLLFVSKFFEHHPIPQEEASLAETALTSGSSPSAPASDSIGPQILTSPSPSKSIPIPQPFRPADEDHRNQFGQRDRSSSAPNVHINTIEPVNIDDLIRDQGFRGDGGSTTGLSATPPASLPGSLTNVKALQKSPGPQRERKSSSSSEDRNRMKTLGRRDSSDDWEIPDGQITVGQRIGSGSFGTVYKGKWHGDVAVKMLNVTAPTPQQLQAFKNEVGVLRKTRHVNILLFMGYSTKPQLAIVTQWCEGSSLYHHLHIIETKFEMIKLIDIARQTAQGMDYLHAKSIIHRDLKSNNIFLHEDLTVKIGDFGLATVKSRWSGSHQFEQLSGSILWMAPEVIRMQDKNPYSFQSDVYAFGIVLYELMTGQLPYSNINNRDQIIFMVGRGYLSPDLSKVRSNCPKAMKRLMAECLKKKRDERPLFPQILASIELLARSLPKIHRSASEPSLNRAGFQTEDFSLYACASPKTPIQAGGYGAFPVH

SEQ ID NO: 906460 - protein, 786 aa, Homo sapiens
ASRPPPRPTAAARAPALGYKMAALSGGGGGGAEPGQALFNGDMEPEAGAGRPAASSAADPAIPEEVWNIKQMIKLTQEHIEALLDKFGGEHNPPSIYLEAYEEYTSKLDALQQREQQLLESLGNGTDFSVSSSASMDTVTSSSSSSLSVLPSSLSVFQNPTDVARSNPKSPQKPIVRVFLPNKQRTVVPARCGVTVRDSLKKALMMRGLIPECCAVYRIQDGEKKPIGWDTDISWLTGEELHVEVLENVPLTTHNFVRKTFFTLAFCDFCRKLLFQGFRCQTCGYKFHQRCSTEVPLMCVNYDQLDLLFVSKFFEHHPIPQEEASLAETALTSGSSPSAPASDSIGPQILTSPSPSKSIPIPQPFRPADEDHRNQFGQRDRSSSAPNVHINTIEPVNIDDLIRDQGFRGDGGSTTGLSATPPASLPGSLTNVKALQKSPGPQRERKSSSSSEDRNRMKTLGRRDSSDDWEIPDGQITVGQRIGSGSFGTVYKGKWHGDVAVKMLNVTAPTPQQLQAFKNEVGVLRKTRHVNILLFMGYSTKPQLAIVTQWCEGSSLYHHLHIIETKFEMIKLIDIARQTAQGMDYLHAKSIIHRDLKSNNIFLHEDLTVKIGDFGLATVKSRWSGSHQFEQLSGSILWMAPEVIRMQDKNPYSFQSDVYAFGIVLYELMTGQLPYSNINNRDQIIFMVGRGYLSPDLSKVRSNCPKAMKRLMAECLKKKRDERPLFPQILASIELLARSLPKIHRSASEPSLNRAGFQTEDFSLYACASPKTPIQAGGYGEFAAFK

SEQ ID NO: 906461 - protein, 717 aa, Homo sapiens
ASRPPPRPTAAARAPALGYKMAALSGGGGGGAEPGQALFNGDMEPEAGAGRPAASSAADPAIPEEVWNIKQMIKLTQEHIEALLDKFGGEHNPPSIYLEAYEEYTSKLDALQQREQQLLESLGNGTDFSVSSSASMDTVTSSSSSSLSVLPSSLSVFQNPTDVARSNPKSPQKPIVRVFLPNKQRTVVPARCGVTVRDSLKKALMMRGLIPECCAVYRIQDGEKKPIGWDTDISWLTGEELHVEVLENVPLTTHNFVRKTFFTLAFCDFCRKLLFQGFRCQTCGYKFHQRCSTEVPLMCVNYDQLDLLFVSKFFEHHPIPQEEASLAETALTSGSSPSAPASDSIGPQILTSPSPSKSIPIPQPFRPADEDHRNQFGQRDRSSSAPNVHINTIEPVNIDDLIRDQGFRGDGGSTTGLSATPPASLPGSLTNVKALQKSPGPQRERKSSSSSEDRNRMKTLGRRDSSDDWEIPDGQITVGQRIGSGSFGTVYKGKWHGDVAVKMLNVTAPTPQQLQAFKNEVGVLRKTRHVNILLFMGYSTKPQLAIVTQWCEGSSLYHHLHIIETKFEMIKLIDIARQTAQGMDYLHAKSIIHRDLKSNNIFLHEDLTVKIGDFGLATVKSRWSGSHQFEQLSGSILWMAPEVIRMQDKNPYSFQSDVYAFGIVLYELMTGQLPYSNINNRDQASPSPYVRIIDDQLRATAISIDSRAYSQSELDLD

SEQ ID NO: 906462 - protein, 239 aa, Homo sapiens
EALGQILTSPSLQNPFQFHSPSDQQMKIIEINLGNETDPHQLPNVHMNTIEPVNIDVPARCGVTVRDSLKKALMMRGLIPECCAVYRIQDGEKKPIGWDTDISWLTGEELHVEVLENVPLTTHNFVRKTFFTLAFCDFCRKLLFQGFRCQTCGYKFHQRCSTEVPLMCVNYDQLDLLFVSKFFEHHPIPQEEASLAETALTSGSSPSAPASDSIGPKFSPVVSSNHSFPAFDRNKYESL

SEQ ID NO: 906463 - protein, 786 aa, Homo sapiens; identical to SEQ ID NO: 906460

SEQ ID NO: 906464 - protein, 693 aa, Homo sapiens
ASRPPPRPTAAARAPALGYKMAALSGGGGGGAEPGQALFNGDMEPEAGAGRPAASSAADPAIPEEVWNIKQMIKLTQEHIEALLDKFGGEHNPPSIYLEAYEEYTSKLDALQQREQQLLESLGNGTDFSVSSSASMDTVTSSSSSSLSVLPSSLSVFQNPTDVARSNPKSPQKPIVRVFLPNKQRTVVPARCGVTVRDSLKKALMMRGLIPECCAVYRIQDGEKKPIGWDTDISWLTGEELHVEVLENVPLTTHNFVRKTFFTLAFCDFCRKLLFQGFRCQTCGYKFHQRCSTEVPLMCVNYDQLDLLFVSKFFEHHPIPQEEASLAETALTSGSSPSAPASDSIGPQILTSPSPSKSIPIPQPFRPADEDHRNQFGQRDRSSSAPNVHINTIEPVNIDDLIRDQGFRGDGGSTTGLSATPPASLPGSLTNVKALQKSPGPQRERKSSSSSEDRNRMKTLGRRDSSDDWEIPDGQITVGQRIGSGSFGTVYKGKWHGDVAVKMLNVTAPTPQQLQAFKNEVGVLRKTRHVNILLFMGYSTKPQLAIVTQWCEGSSLYHHLHIIETKFEMIKLIDIARQTAQGMDYLHAKSIIHRDLKSNNIFLHEDLTVKIGDFGLATVKSRWSGSHQFEQLSGSILWMAPEVIRMQDKNPYSFQSDVYAFGIVLYELMTGQLPYSNINNRDQVLCPPWEYNK

SEQ ID NO: 906465 - protein, 228 aa, Homo sapiens
ASRPPPRPTAAARAPALGYKMAALSGGGGGGAEPGQALFNGDMEPEAGAGRPAASSAADPAIPEEVWNIKQMIKLTQEHIEALLDKFGGEHNPPSIYLEAYEEYTSKLDALQQREQQLLESLGNGTDFSVSSSASMDTVTSSSSSSLSVLPSSLSVFQNPTDVARSNPKSPQKPIVRVFLPNKQRTVVPARCGVTVRDSLKKALMMRGLIPECCAVYRIQDGYGLYVT

SEQ ID NO: 906466 - protein, 562 aa, Homo sapiens
MRPEPGGCCCRRTVRANGCVANGEVRNGYVRSSAAAAAAAAAGQIHHVTQNGGLYKRPFNEAFEETPMLVAVLTYVGYGVLTLFGYLRDFLRYWRIEKCHHATEREEQKDFVSLYQDFENFYTRNLYMRIRDNWNRPICSVPGARVDIMERQSHDYNWSFKYTGNIIKGVINMGSYNYLGFARNTGSCQEAAAKVLEEYGAGVCSTRQEIGNLDKHEELEELVARFLGVEAAMAYGMGFATNSMNIPALVGKGCLILSDELNHASLVLGARLSGATIRIFKHNNMQSLEKLLKDAIVYGQPRTRRPWKKILILVEGIYSMEGSIVRLPEVIALKKKYKAYLYLDEAHSIGALGPTGRGVVEYFGLDPEDVDVMMGTFTKSFGASGGYIGGKKELIDYLRTHSHSAVYATSLSPPVVEQIITSMKCIMGQDGTSLGKECVQQLAENTRYFRRRLKEMGFIIYGNEDSPVVPLMLYMPAKIGAFGREMLKRNIGVVVVGFPATPIIESRARFCLSAAHTKEILDTALKEIDEVGDLLQLKYSRHRLVPLLDRPFDETTYEETED

SEQ ID NO: 906467 - protein, 1351 aa, Homo sapiens
MNAEFSFILDVLSQLNLALGLGSACLHIFYFFLRNSEHIDLFPKLTFSILTVSYYNQVKGLLSESFILPDQRTNLKITILKLFFQLNQSLSEEDFWHIIPRISLSFCIHQVLQEKDWEQNGKTVYESHVTGRVRWLTPVILALWEAEAGGSLEAGIQDQPGQHGETPSLLKRQKISWAWWRAPIIPPTWRLRQENRLNPGGGGCSETRLCHCTLAWVTEQNCVSKKKKSCYTFKFLKLLLLSVKILNPNSPGCVVISCDMFVHITYSRGCKQYYCLCSFVFNVLSMSYVESLSASENFNKPLRYSKVLFYFFKEQKKMNERTKERCRDYIYMYRLKYRRRLWYLNRSPIKSNTLSTFSAHLVSYHRIPLEYHIAFALQLLFTNVNVGFVKVTNLEAMNLPASLFILACMKSLQIQMSVPAFKIYLYHFVGTKLFQDKCNFVTSLFGRDKSPVIYAGPLYFLKNKMLCRHYTWLVVSSGNCNVNLGSSHILGIIIYPSTWRNTSIYKYQSLRISRFEAYKSSFLHSLTRPDVKTLIGFKQIPVNHDYQNSSSESIDRGVTSPSALFLIPLFIQHCCYLFQVYKTSFSRSHQKPGNAELGDVKSPYEELDQAAVAVSPRIFFFLSFNLAGHGLYSTFSTFCFALDKKSLPLKKASSLHNPQSTAYLFEESSHRSALVTIVNIHDRARILKQDSCFCSHQGEQKHPTQPLRALCLCHASSNTKELNMLPVICLRNAFFLYLAFLSFCTFKFLIFKIPTLEKTNIMVVLGFEDSISDALVLFVHLALHFRRRLFIEGLKLAPLAFKKNFFSNFFITSGSLHLNFSTSSAQLNFLVCNTLCFLLIGENQGDEWLPWRDFLISQGGKEVMTFTTTFMFFPFFQIDKDFWFLVIRDWATVQNCQSCRRPGRKNVSNCCFARICRVMGSCCLKHCYDLIPRYLSSLGVLGKPMSFNLYLLYTVCLEKEVRVVVFLQTVHIHEDYELLGQPGQDRPCLYKNFFLNKPGMVVPACSPTCVGESLEPGRSRLQGAMIAPLHSSLGDRVRPWLNKRGKKKLLGAGCGCSLQSQLLERLRPEDCLNPEFERSLGNTARPHLRKKCFLISLAQRGCEWGGIKSKDYFLATEAKNLQGFFFSVPEPTDTLLLASRGCSVPSSHLNTLNQFKKYLPCGEKHVFFSPQLYPHEMCAHGWAQWLMPVIPTLWEAEAGRLLEARSSRTVWPTWRNLISTKITKIEPGMVAHACNPSYVRRLRHRNCLNPRGRGCNEPRSHHCTPALATEGDSVSKKKKKGGAQAPSHCHVPSQRAKLEGWLPYHTEYMLVLANDPFAFNVIENTVVPFVISSDICFLSSSFLGRKPKGLG

SEQ ID NO: 906468 - protein, 1346 aa, Homo sapiens
MLGLLEANPLKYYSSECKFSFILDVLSQLNLASGARVCLSTYFLFFSGNSEHIDLFPKLTFSILTVFYYNQVKGLLSESFILPDQRTNLKITILKLFFQLNQSLSEEDFWHIIPRISLSFCIHQVLQEKDWEQNGKTVYESHVTGRVRWLTPVILALWEAEAGGSLEAGIQDQPGQHGETPSLLKRQKISWAWWRAPIIPPTWRLRQENRLNPGGGGCSETRLCHCTLAWVTEQNCVSKKKKSCYTFKFLKLLLLSVKILNPNSPGCVVISCDMFVHITYSRGCKQYYCLGSFVFNVLSMSYVESLSASENFNKPLRYSKVLFYFFKEQKKMNERTKEDAETIFSMYRLKYRRRLWYLNRSPIKSNTLSTFSAHLVSYHRIPLEYHIAFALQLLFTNVNVGFVKVTNLEAMNLPASLFILACMKSLQIQMSVPAFKIYLYHFVGTKLFQDKCNFVTSLFGRDKSPVIYAGPLYFLKNKMLCRHYTWLVVSSGNCNVNLGSSHILGIIIYPSTWRNTSIYKYQSLRISRFEAYKSSFLHSLTRPDFKTLIGFKQIPVNHDYQNSSSESIDRGVTSPSALFLIPLFIQHCCYLFQVYKTSFSRSHQKPGNAELGDVKSPYEELDQAAVAVSPRIFFFLSFNLAGHGLYSTFSTFCFALDKKSLPLKKASSLHNPQSTAYLFEESSHRSALVTIVNIHDRARILKQDSCFCSHQGEQKHPTQPLRALCLCHASSNTKELNMLPVICLRNAFFLYLAFLSFCTFKFLIFKIPTLEKTNIMVVLGFEDSISDALVLFVHLALHFRRRLFIEGLKLAPLAFKKNFFSNFFITSGSLHLNFSTSSAYLNFLVCNTLCFLLIGENQGDEWLPWRDFLISQGGKEVMTFTTTFMFFPFFQIDKDFWFLVIRDWATVQNCQSCRRPGRKNVSNCCFARICRVMGSCCLKHCYDLIPKVSFLSWFLGKPMSFNLYLLYTVCLEKEVRVVVFLQTVHIHEDYELLGQPGQDRPCLYKNFFLNNRAWWCLPVVPPVWENHLSLGGQGCSEAMIAPLHSSLGDRVRPWLNKRGKKKLLGAGCGCSLQSQLLERLRPEDCLNPEFERSLGNTARPHLRKKCFLISLAQRGCEWGGIKSKDYFLATKPRTYRDFFFQSQNLTDTLLLASRGCSVPSSHLNTLNQFKKYLPCGEKHVFFSPQLYPHEMCAHGWAQWLMPVIPTLWEAEAGRLLEARSSRTVWPTWRNLISTKITKIEPGMVAHACNPSYVRRLRHRNCLNPRGRGCNEPRSHHCTPALATEGDSVSKKKKKGVPRPLAIAMAQPESQIRGLASLSHRINASAEPMIPLLLMYRKYCCSFCHFQ

SEQ ID NO: 906469 - protein, 470 aa, Homo sapiens
MRPEPGGCCCRRTVRANGCVANGEVRNGYVRSSAAAAAAAAAGQIHHVTQNGGLYKRPFNEAFEETPMLVAVLTYVGYGVLTLFGYLRDFLRYWRIEKCHHATEREEQKDFVSLYQDFENFYTRNLYMRIRDNWNRPICSVPGARVDIMERQSHDYNWSFKYTGNIIKGVINMGSYNYLGFARNTGSCQEAAAKVLEEYGAGVCSTRQEIGNLDKHEELEELVARFLGVEAAMAYGMGFATNSMNIPALVGKGCLILSDELNHASLVLGARLSGATIRIFKHNNMQSLEKLLKDAIVYGQPRTRRPWKKILILVEGIYSMEGSIVRLPEVIALKKKYKAYLYLDEAHSIGALGPTGRGVVEYFGLDPEDVDVMMGTFTKSFGASGGYIGGKKELIDYLRTHSHSAVYATSLSPPVVEQIITSMKCIMGQDGTSLGNGITIHEVVQTRNTYHRFSPLSPVFSHQCLWIMLP

SEQ ID NO: 906470 - protein, 305 aa, Homo sapiens
MRPEPGGCCCRRTVRANGCVANGEVRNGYVRSSAAAAAAAAAGQIHHVTQNGGLYKRPFNEAFEETPMLVAVLTYVGYGVLTLFGYLRDFLRYWRIEKCHHATEREEQKDFVSLYQDFENFYTRNLYMRIRDNWNRPICSVPGARVDIMERQSHDYNWSFKYTGNIIKGVINMGSYNYLGFARNTGSCQEAAAKVLEEYGAGVCSTRQEIGNLDKHEELEELVARFLGVEAAMAYGMGFATNSMNIPALVGKGCLILSDELNHASLVLGARLSGATIRIFKHNNTRSLEKLLEDATPIMESRAMS

SEQ ID NO: 906471 - protein, 1351 aa, Homo sapiens; identical to SEQ ID NO: 906467

SEQ ID NO: 906472 - protein, 562 aa, Homo sapiens; identical to SEQ ID NO: 906466

SEQ ID NO: 906473 - protein, 549 aa, Homo sapiens
MRPEPGGCCCRRTVRANGCVANGEVRNGYVRSSAAAAAAAAAGQIHHVTQNGGLYKRPFNEAFEETPMLVAVLTYVGYGVLTLFGYLRDFLRYWRIEKCHHATEREEQKDFVSLYQDFENFYTRNLYMRIRDNWNRPICSVPGARVDIMERQSHDYNWSFKYTGNIIKGVINMGSYNYLGFARNTGSCQEAAAKVLEEYGAGVCSTRQEIGNLDKHEELEELVARFLGVEAAMAYGMGFATNSMNIPALVGKGCLILSDELNHASLVLGARLSGATIRIFKHNNMQSLEKLLKDAIVYGQPRTRRPWKKILILVEGIYSMEGSIVRLPEVIALKKKYKAYLYLDEAHSIGALGPTGRGVVEYFGLDPEDVDVMMGTFTKSFGASGGYIGGKKELIDYLRTHSHSAVYATSLSPPVVEQIITSMKCIMGQDGTSLGKECVQQLAENTRYFRRRLKEMGFIIYGNEDSPVVPLMLYMPAKIGAFGREMLKRNIGVVVVGFPATPIIESRARFCLSAAHTKEILDTALKEIDEVGDLLQLKYSRRLVKGPVQ

SEQ ID NO: 906474 - protein, 161 aa, Homo sapiens
MRPEPGGCCCRRTVRANGCVANGEVRNGYVRSSAAAAAAAAAGQIHHVTQNGGLYKRPFNEAFEETPMLVAVLTYVGYGVLTLFGYLRDFLRYWRIEKCHHATEREEQKDFVSLYQDFENFYTRNLYMRIRDNWNRPICSVPGARVDIMERQSHDYNWSFK

SEQ ID NO: 906475 - protein, 490 aa, Homo sapiens
MEPFVVLVLCLSFMLLFSLWRQSCRRRKLPPGPTPLPIIGNMLQIDVKDICKSFTNFSKVYGPVFTVYFGMNPIVVFHGYEAVKEALIDNGEEFSGRGNSPISQRITKGLGIISSNGKRWKEIRRFSLTTLRNFGMGKRSIEDRVQEEAHCLVEELRKTKASPCDPTFILGCAPCNVICSVVFQKRFDYKDQNFLTLMKRFNENFRILNSPWIQVCNNFPLLIDCFPGTHNKVLKNVALTRSYIREKVKEHQASLDVNNPRDFIDCFLIKMEQEKDNQKSEFNIENLVGTVADLFVAGTETTSTTLRYGLLLLLKHPEVTAKVQEEIDHVIGRHRSPCMQDRSHMPYTDAVVHEIQRYSDLVPTGVPHAVTTDTKFRNYLIPKGTTIMALLTSVLHDDKEFPNPNIFDPGHFLDKNGNFKKSDYFMPFSAGKRICAGEGLARMELFLFLTTILQNFNLKSVDDLKNLNTTAVTKGIVSLPPSYQICFIPV

SEQ ID NO: 906476 - protein, 393 aa, Homo sapiens
MEPFVVLVLCLSFMLLFSLWRQSCRRRKLPPGPTPLPIIGNMLQIDVKDICKSFTNFSKVYGPVFTVYFGMNPIVVFHGYEAVKEALIDNGEEFSGRGNSPISQRITKGLGIISSNGKRWKEIRRFSLTTLRNFGMGKRSIEDRVQEEAHCLVEELRKTKASPCDPTFILGCAPCNVICSVVFQKRFDYKDQNFLTLMKRFNENFRILNSPWIQVCNNFPLLIDCFPGTHNKVLKNVALTRSYIREKVKEHQASLDVNNPRDFIDCFLIKMEQEKDNQKSEFNIENLVGTVADLFVAGTETTSTTLRYGLLLLLKHPEVTAKVQEEIDHVIGRHRSPCMQDRSHMPYTDAVVHEIQRYSDLVPTGVPHAVTTDTKFRNYLIPKSFDNKIMLAA

SEQ ID NO: 906477 - protein, 174 aa, Homo sapiens
MEPFVVLVLCLSFMLLFSLWRQSCRRRKLPPGPTPLPIIGNMLQIDVKDICKSFTNFSKVYGPVFTVYFGMNPIVVFHGYEAVKEALIDNGEEFSGRGNSPISQRITKGLGIISSNGKRWKEIRRFSLTTLRNFGMGKRSIEDRVQEEAHCLVEELRKTKEWEPVRWFSETIDF

SEQ ID NO: 906478 - protein, 454 aa, Homo sapiens
MEPFVVLVLCLSFMLLFSLWRQSCRRRKLPPGPTPLPIIGNMLQIDVKDICKSFTNFSKVYGPVFTVYFGMNPIVVFHGYEAVKEALIDNGEEFSGRGNSPISQRITKGLGIISSNGKRWKEIRRFSLTTLRNFGMGKRSIEDRVQEEAHCLVEELRKTKASPCDPTFILGCAPCNVICSVVFQKRFDYKDQNFLTLMKRFNENFRILNSPWIQVCNNFPLLIDCFPGTHNKVLKNVALTRSYIREKVKEHQASLDVNNPRDFIDCFLIKMEQEKDNQKSEFNIDTTLRYGLLLLLKHPEVTAKVQEEIDHVIGRHRSPCMQDRSHMPYTDAVVHEIQRYSDLVPTGVPHAVTTDTKFRNYLIPKGTTIMALLTSVLHDDKEFPNPNIFDPGHFLDKNGNFKKSDYFMPFSAVTTILQNFNLKSVDDLKNLNTTAVTKGIVSLPPSYQICFIPV

SEQ ID NO: 906479 - protein, 293 aa, Homo sapiens
MKRFNENFRILNSPWIQVCNNFPLLIDCFPGTHNKVLKNVALTRSYIREKVKEHQASLDVNNPRDFIDCFLIKMEQEKDNQKSEFNIENLVGTVADLFVAGTETTSTTLRYGLLLLLKHPEVTAKVQEEIDHVIGRHRSPCMQDRSHMPYTDAVVHEIQRYSDLVPTGVPHAVTTDTKFRNYLIPKGTTIMALLTSVLHDDKEFPNPNIFDPGHFLDKNGNFKKSDYFMPFSAGKRICAGEGLARMELFLFLTTILQNFNLKSVDDLKNLNTTAVTKGIVSLPPSYQICFIPV

SEQ ID NO: 906480 - protein, 420 aa, Homo sapiens
MNPIVVFHGYEAVKEALIDNGEEFSGRGNSPISQRITKGLGIISSNGKRWKEIRRFSLTTLRNFGMGKRSIEDRVQEEAHCLVEELRKTKASPCDPTFILGCAPCNVICSVVFQKRFDYKDQNFLTLMKRFNENFRILNSPWIQVCNNFPLLIDCFPGTHNKVLKNVALTRSYIREKVKEHQASLDVNNPRDFIDCFLIKMEQEKDNQKSEFNIENLVGTVADLFVAGTETTSTTLRYGLLLLLKHPEVTAKVQEEIDHVIGRHRSPCMQDRSHMPYTDAVVHEIQRYSDLVPTGVPHAVTTDTKFRNYLIPKGTTIMALLTSVLHDDKEFPNPNIFDPGHFLDKNGNFKKSDYFMPFSAGKRICAGEGLARMELFLFLTTILQNFNLKSVDDLKNLNTTAVTKGIVSLPPSYQICFIPV

SEQ ID NO: 906481 - protein, 275 aa, Homo sapiens
MKRFNVLIDCFPGTHNKVLKNVALTRSYIREKVKEHQASLDVNNPRDFIDCFLIKMEQEKDNQKSEFNIENLVGTVADLFVAGTETTSTTLRYGLLLLLKHPEVTAKVQEEIDHVIGRHRSPCMQDRSHMPYTDAVVHEIQRYSDLVPTGVPHAVTTDTKFRNYLIPKGTTIMALLTSVLHDDKEFPNPNIFDPGHFLDKNGNFKKSDYFMPFSAGKRICAGEGLARMELFLFLTTILQNFNLKSVDDLKNLNTTAVTKGIVSLPPSYQICFIPV

SEQ ID NO: 906482 - protein, 490 aa, Homo sapiens; identical to SEQ ID NO: 906475

SEQ ID NO: 906483 - protein, 293 aa, Homo sapiens; identical to SEQ ID NO: 906479

SEQ ID NO: 906484 - protein, 293 aa, Homo sapiens; identical to SEQ ID NO: 906479

SEQ ID NO: 906485 - protein, 393 aa, Homo sapiens; identical to SEQ ID NO: 906476

SEQ ID NO: 906486 - protein, 213 aa, Homo sapiens
MEPFVVLVLCLSFMLLFSLWRQSCRRRKLPPGPTPLPIIGNMLQIDVKDICKSFTNFSKVYGPVFTVYFGMNPIVVFHGYEAVKEALIDNGEEFSGRGNSPISQRITKGLGIISSNGKRWKEIRRFSLTTLRNFGMGKRSIEDRVQEEAHCLVEELRKTKASPCDPTFILGCAPCNVICSVVFQKRFDYKDQNFLTLMKRFNVPNDLFPGNSH

SEQ ID NO: 906487 - protein, 472 aa, Homo sapiens
MEPFVVLVLCLSFMLLFSLWRQSCRRRKLPPGPTPLPIIGNMLQIDVKDICKSFTNFSKVYGPVFTVYFGMNPIVVFHGYEAVKEALIDNGEEFSGRGNSPISQRITKGLGIISSNGKRWKEIRRFSLTTLRNFGMGKRSIEDRVQEEAHCLVEELRKTKASPCDPTFILGCAPCNVICSVVFQKRFDYKDQNFLTLMKRFNENFRILNSPWIQVCNNFPLLIDCFPGTHNKVLKNVALTRSYIREKVKEHQASLDVNNPRDFIDCFLIKMEQEKDNQKSEFNIDTTLRYGLLLLLKHPEVTAKVQEEIDHVIGRHRSPCMQDRSHMPYTDAVVHEIQRYSDLVPTGVPHAVTTDTKFRNYLIPKGTTIMALLTSVLHDDKEFPNPNIFDPGHFLDKNGNFKKSDYFMPFSAGKRICAGEGLARMELFLFLTTILQNFNLKSVDDLKNLNTTAVTKGIVSLPPSYQICFIPV

SEQ ID NO: 906488 - protein, 471 aa, Homo sapiens
MEPFVVLVLCLSFMLLFSLWRQSCRRRKLPPGPTPLPIIGNMLQIDVKDICKSFTNVFHGYEAVKEALIDNGEEFSGRGNSPISQRITKGLGIISSNGKRWKEIRRFSLTTLRNFGMGKRSIEDRVQEEAHCLVEELRKTKASPCDPTFILGCAPCNVICSVVFQKRFDYKDQNFLTLMKRFNENFRILNSPWIQVCNNFPLLIDCFPGTHNKVLKNVALTRSYIREKVKEHQASLDVNNPRDFIDCFLIKMEQEKDNQKSEFNIENLVGTVADLFVAGTETTSTTLRYGLLLLLKHPEVTAKVQEEIDHVIGRHRSPCMQDRSHMPYTDAVVHEIQRYSDLVPTGVPHAVTTDTKFRNYLIPKGTTIMALLTSVLHDDKEFPNPNIFDPGHFLDKNGNFKKSDYFMPFSAGKRICAGEGLARMELFLFLTTILQNFNLKSVDDLKNLNTTAVTKGIVSLPPSYQICFIPV

SEQ ID NO: 906489 - protein, 504 aa, Homo sapiens
MEPFVVLVLCLSFMLLFSLWRQSCRRRKLPPGPTPLPIIGNMLQIDVKDICKSFTNQCKSALCSSSQLQRFSKVYGPVFTVYFGMNPIVVFHGYEAVKEALIDNGEEFSGRGNSPISQRITKGLGIISSNGKRWKEIRRFSLTTLRNFGMGKRSIEDRVQEEAHCLVEELRKTKASPCDPTFILGCAPCNVICSVVFQKRFDYKDQNFLTLMKRFNENFRILNSPWIQVCNNFPLLIDCFPGTHNKVLKNVALTRSYIREKVKEHQASLDVNNPRDFIDCFLIKMEQEKDNQKSEFNIENLVGTVADLFVAGTETTSTTLRYGLLLLLKHPEVTAKVQEEIDHVIGRHRSPCMQDRSHMPYTDAVVHEIQRYSDLVPTGVPHAVTTDTKFRNYLIPKGTTIMALLTSVLHDDKEFPNPNIFDPGHFLDKNGNFKKSDYFMPFSAGKRICAGEGLARMELFLFLTTILQNFNLKSVDDLKNLNTTAVTKGIVSLPPSYQICFIPV

SEQ ID NO: 906490 - protein, 440 aa, Homo sapiens
MERSFLEEAIPQYLKELLKDLVGAHISVSALVTGVRGMENRAPLSSLAVNSPSFCPFFLLGIISSNGKRWKEIRRFSLTTLRNFGMGKRSIEDRVQEEAHCLVEELRKTKASPCDPTFILGCAPCNVICSVVFQKRFDYKDQNFLTLMKRFNENFRILNSPWIQVCNNFPLLIDCFPGTHNKVLKNVALTRSYIREKVKEHQASLDVNNPRDFIDCFLIKMEQEKDNQKSEFNIENLVGTVADLFVAGTETTSTTLRYGLLLLLKHPEVTAKVQEEIDHVIGRHRSPCMQDRSHMPYTDAVVHEIQRYSDLVPTGVPHAVTTDTKFRNYLIPKGTTIMALLTSVLHDDKEFPNPNIFDPGHFLDKNGNFKKSDYFMPFSAGKRICAGEGLARMELFLFLTTILQNFNLKSVDDLKNLNTTAVTKGIVSLPPSYQICFIPV

SEQ ID NO: 906491 - protein, 458 aa, Homo sapiens
MERSFLEEAIPQYLKELLKDLVGAHISVSALVTGVRGMENRALKSFSAELSLSAWLPSVAALSSLAVNSPSFCPFFLLGIISSNGKRWKEIRRFSLTTLRNFGMGKRSIEDRVQEEAHCLVEELRKTKASPCDPTFILGCAPCNVICSVVFQKRFDYKDQNFLTLMKRFNENFRILNSPWIQVCNNFPLLIDCFPGTHNKVLKNVALTRSYIREKVKEHQASLDVNNPRDFIDCFLIKMEQEKDNQKSEFNIENLVGTVADLFVAGTETTSTTLRYGLLLLLKHPEVTAKVQEEIDHVIGRHRSPCMQDRSHMPYTDAVVHEIQRYSDLVPTGVPHAVTTDTKFRNYLIPKGTTIMALLTSVLHDDKEFPNPNIFDPGHFLDKNGNFKKSDYFMPFSAGKRICAGEGLARMELFLFLTTILQNFNLKSVDDLKNLNTTAVTKGIVSLPPSYQICFIPV

SEQ ID NO: 906492 - protein, 293 aa, Homo sapiens; identical to SEQ ID NO: 906479

SEQ ID NO: 906493 - protein, 360 aa, Homo sapiens
MGLLLLVPLLLLPGSYGLPFYNGFYYSNSANDQNLGNGHGKDLLNGVKLVVETPEETLFTYQGASVILPCRYRYEPALVSPRRVRVKWWKLSENGAPEKDVLVAIGLRHRSFGDYQGRVHLRQDKEHDVSLEIQDLRLEDYGRYRCEVIDGLEDESGLVELELRGVVFPYQSPNGRYQFNFHEGQQVCAEQAAVVASFEQLFRAWEEGLDWCNAGWLQDATVQYPIMLPRQPCGGPGLAPGVRSYGPRHRRLHRYDVFCFATALKGRVYYLEHPEKLTLTEAREACQEDDATIAKVGQLFAAWKFHGLDRCDAGWLADGSVRYPVVHPHPNCGPPEPGVRSFGFPDPQSRLYGVYCYRQH

SEQ ID NO: 906494 - protein, 360 aa, Homo sapiens; identical to SEQ ID NO: 906493

SEQ ID NO: 906495 - protein, 422 aa, Homo sapiens
MRKWRHREVNLPEVTQQDAVCPAPIPSPGLSAQTGLQKIWGTIHCQVCPGAPAWPGSPWHEEMGLLLLVPLLLLPGSYGLPFYNGFYYSNSANDQNLGNGHGKDLLNGVKLVVETPEETLFTYQGASVILPCRYRYEPALVSPRRVRVKWWKLSENGAPEKDVLVAIGLRHRSFGDYQGRVHLRQDKEHDVSLEIQDLRLEDYGRYRCEVIDGLEDESGLVELELRGVVFPYQSPNGRYQFNFHEGQQVCAEQAAVVASFEQLFRAWEEGLDWCNAGWLQDATVQYPIMLPRQPCGGPGLAPGVRSYGPRHRRLHRYDVFCFATALKGRVYYLEHPEKLTLTEAREACQEDDATIAKVGQLFAAWKFHGLDRCDAGWLADGSVRYPVVHPHPNCGPPEPGVRSFGFPDPQSRLYGVYCYRQH

SEQ ID NO: 906496 - protein, 384 aa, Homo sapiens
WGTVIAPWGPPRNHTPGVSSWHEEMGLLLLVPLLLLPGSYGLPFYNGFYYSNSANDQNLGNGHGKDLLNGVKLVVETPEETLFTYQGASVILPCRYRYEPALVSPRRVRVKWWKLSENGAPEKDVLVAIGLRHRSFGDYQGRVHLRQDKEHDVSLEIQDLRLEDYGRYRCEVIDGLEDESGLVELELRGVVFPYQSPNGRYQFNFHEGQQVCAEQAAVVASFEQLFRAWEEGLDWCNAGWLQDATVQYPIMLPRQPCGGPGLAPGVRSYGPRHRRLHRYDVFCFATALKGRVYYLEHPEKLTLTEAREACQEDDATIAKVGQLFAAWKFHGLDRCDAGWLADGSVRYPVVHPHPNCGPPEPGVRSFGFPDPQSRLYGVYCYRQH

SEQ ID NO: 906497 - protein, 217 aa, Homo sapiens
MFSEYCCEPAESQERGGNWTGGVVFPYQSPNGRYQFNFHEGQQVCAEQAAVVASFEQLFRAWEEGLDWCNAGWLQDATVQYPIMLPRQPCGGPGLAPGVRSYGPRHRRLHRYDVFCFATALKGRVYYLEHPEKLTLTEAREACQEDDATIAKVGQLFAAWKFHGLDRCDAGWLADGSVRYPVVHPHPNCGPPEPGVRSFGFPDPQSRLYGVYCYRQH

SEQ ID NO: 906498 - protein, 147 aa, Homo sapiens
MGLLLLVPLLLLPGSYGLPFYNGFYYSNSANDQNLGNGHGKDLLNGVKLVVETPEETLFTYQGASVILPCRYRYEPALVSPRRVRVKWWKLSENGAPEKDVLVGLGGLRSWALGLSCPPLLLCEAADPSLPTEGLGLEASSRLPGES

SEQ ID NO: 906499 - protein, 360 aa, Homo sapiens; identical to SEQ ID NO: 906493

SEQ ID NO: 906500 - protein, 372 aa, Homo sapiens
MGLLLLVPLLLLPGSYGLPFYNGFYYSNSANDQNLGNGHGKDLLNGVKLVVETPEETLFTYQGASVILPCRYRYEPALVSPRRVRVKWWKLSENGAPEKDVLVAIGLRHRSFGDYQGRVHLRQDKEHDVSLEIQDLRLEDYGRYRCEVIDGLEDESGLVELELRAESQERGGNWTGGVVFPYQSPNGRYQFNFHEGQQVCAEQAAVVASFEQLFRAWEEGLDWCNAGWLQDATVQYPIMLPRQPCGGPGLAPGVRSYGPRHRRLHRYDVFCFATALKGRVYYLEHPEKLTLTEAREACQEDDATIAKVGQLFAAWKFHGLDRCDAGWLADGSVRYPVVHPHPNCGPPEPGVRSFGFPDPQSRLYGVYCYRQH

SEQ ID NO: 906501 - protein, 360 aa, Homo sapiens; identical to SEQ ID NO: 906493

SEQ ID NO: 906502 - protein, 946 aa, Homo sapiens
MAVYCYALNSLVIMNSANEMKSGGGPGPSGSETPPPPRRAVLSPGSVFSPGRGASFLFPPAESLSPEEPRSPGGWRSGRRRLNSSSGSGSGSSGSSVSSPSWAGRLRGDRQQVVAAGTLSPPGPEEAKRKLRILQRELQNVQVNQKVGMFEAHIQAQSSAIQAPRSPRLGRARSPSPCPFRSSSQPPGRVLVQGARSEERRTKSWGEQCPETSGTDSGRKGGPSLCSSQVKKGMPPLPGRAAPTGSEAQGPSAFVRMEKGIPASPRCGSPTAMEIDKRGSPTPGTRSCLAPSLGLFGASLTMATEVAARVTSTGPHRPQDLALTEPSGRARELEDLQPPEALVERQGQFLGSETSPAPERGGPRDGEPPGKMGKGYLPCGMPGSGEPEVGKRPEETTVSVQSAESSDSLSWSRLPRALASVGPEEARSGAPVGGGRWQLSDRVEGGSPTLGLLGGSPSAQPGTGNVEAGIPSGRMLEPLPCWDAAKDLKEPQCPPGDRVGVQPGNSRVWQGTMEKAGLAWTRGTGVQSEGTWESQRQDSDALPSPELLPQDQDKPFLRKACSPSNIPAVIITDMGTQEDGALEETQGSPRGNLPLRKLSSSSASSTGFSSSYEDSEEDISSDPERTLDPNSAFLHTLDQQKPRVSKSWRKIKNMVHWSPFVMSFKKKYPWIQLAGHAGSFKAAANGRILKKHCESEQRCLDRLMVDVLRPFVPAYHGDVVKDGERYNQMDDLLADFDSPCVMDCKMGIRTYLEEELTKARKKPSLRKDMYQKMIEVDPEAPTEEEKAQRAVTKPRYMQWRETISSTATLGFRIEGIKKEDGTVNRDFKKTKTREQVTEAFREFTKGNHNILIAYRDRLKAIRTTLEVSPFFKCHEVIGSSLLFIHDKKEQAKVWMIDFGKTTPLPEGQTLQHDVPWQEGNREDGYLSGLNNLVDILTEMSQDAPLA

SEQ ID NO: 906503 - protein, 205 aa, Homo sapiens [sequence omitted]

SEQ ID NO: 906504 - protein, 879 aa, Homo sapiens
MAVYCYALNSLVIMNSANEMKSGGGPGPSGSETPPPPRRAVLSPGSVFSPGRGASFLFPPAESLSPEEPRSPGGWRSGRRRLNSSSGSGSGSSGSSVSSPSWAGRLRGDRQQVVAAGTLSPPGPEEAKRKLRILQRELQNVQVNQKVGMFEAHIQAQSSAIQAPRSPRLGRARSPSPCPFRSSSQPPGRVLVQGARSEERRTKSWGEQCPETSGTDSGRKGGPSLCSSQVKKGMPPLPGRAAPTGSEAQGPSAFVRMEKGIPASPRCGSPTAMEIDKRGSPTPGTRSCLAPSLGLFGASLTMATEVAARVTSTGPHRPQDLALTEPSGRARELEDLQPPEALVERQGQFLGSETSPAPERGGPRDGEPPGKMGKGYLPCGMPGSGEPEVGKRPEETTVSVQSAESSDSLSWSRLPRALASVGPEEARSGAPVGGGRWQLSDRVEGGSPTLGLLGGSPSAQPGTGNVEAGIPSGRMLEPLPCWDAAKDLKEPQCPPGDRVGVQPGNSRVWQGTMEKAGLAWTRGTGVQSEGTWESQRQDSDALPSPELLPQDQDKPFLRKACSPSNIPAVIITDMGTQEDGALEETQGSPRGNLPLRKLSSSSASSTGFSSSYEDSEEDISSDPERTLDPNSAFLHTLDQQKPRVSKSWRKIKNMVHWSPFVMSFKKKYPWIQLAGHAGSFKAAANGRILKKHCESEQRCLDRLMVDVLRPFVPAYHGDVVKDGERYNQMDDLLADFDSPCVMDCKMGIRTYLEEELTKARKKPSLRKDMYQKMIEVDPEAPTEEEKAQRAVTKPRYMQWRETISSTATLGFRIEGIKKEDGTVNRDFKKTKTREQVTEAFREFTKGNHNILIAYRDRLKAIRTTLEVSPFFKCHEAIKL

SEQ ID NO: 906505 - protein, 713 aa, Homo sapiens
MAVYCYALNSLVIMNSANEMKSGGGPGPSGSETPPPPRRAVLSPGSVFSPGRGASFLFPPAESLSPEEPRSPGGWRSGRRRLNSSSGSGSGSSGSSVSSPSWAGRLRGDRQQVVAAGTLSPPGPEEAKRKLRILQRELQNVQVNQKVGMFEAHIQAQSSAIQAPRSPRLGRARSPSPCPFRSSSQPPGRVLVQGARSEERRTKSWGEQCPETSGTDSGRKGGPSLCSSQVKKGMPPLPGRAAPTGSEAQGPSAFVRMEKGIPASPRCGSPTAMEIDKRGSPTPGTRSCLAPSLGLFGASLTMATEVAARVTSTGPHRPQDLALTEPSGRARELEDLQPPEALVERQGQFLGSETSPAPERGGPRDGEPPGKMGKGYLPCGMPGSGEPEVGKRPEETTVSVQSAESSDSLSWSRLPRALASVGPEEARSGAPVGGGRWQLSDRVEGGSPTLGLLGGSPSAQPGTGNVEAGIPSGRMLEPLPCWDAAKDLKEPQCPPGDRVGVQPGNSRVWQGTMEKAGLAWTRGTGVQSEGTWESQRQDSDALPSPELLPQDQDKPFLRKACSPSNIPAVIITDMGTQEDGALEETQGSPRGNLPLRKLSSSSASSTGFSSSYEDSEEDISSDPERTLDPNSAFLHTLDQQKPRVSKSWRKIKNMVHWSPFVMSFKKKYPWIQLAGHAGEFIKGKLANRARDPLNERHLVKSRRQEALPLEPGP

SEQ ID NO: 906506 - protein, 644 aa, Homo sapiens [sequence omitted]

SEQ ID NO: 906507 - protein, 946 aa, Homo sapiens; identical to SEQ ID NO: 906502

SEQ ID NO: 906508 - protein, 221 aa, Homo sapiens
MPFTPPGLSYHCSLAWGCQRHPLRSPVSGHRAGSPLLCTPPPCAIRGHLGASTGPAPGSDGARLLCGVGWVRTVSARGSLLTPSWVGCSLSQKEDGTVNRDFKKTKTREQVTEAFREFTKGNHNILIAYRDRLKAIRTTLEVSPFFKCHEVIGSSLLFIHDKKEQAKVWMIDFGKTTPLPEGQTLQHDVPWQEGNREDGYLSGLNNLVDILTEMSQDAPLA

SEQ ID NO: 906509 - protein, 761 aa, Homo sapiens
MASERGKVKHNWSSTSEGCPRKRSCLREPCDVAPSSRPAQRSASRSGGPSSPKRLKAQKEDDVACSRRLSWGSSRRRNNSSSSFSPHFLGPGVGGAASKGCLIRNTRGFLSSGGSPLRPANASLEEMASLEEEACSLKVDSKDSSHNSTNSEFAAEAEGQNDTIEEPNKVQKRKRDRLRDQGSTMIYLKAIQGILGKSMPKRKGEAATRAKPSAAEHPSHGEGPARSEGPAKTAEGAARSVTVTAAQKEKDATPEVSMEEDKTVPERSSFYDRRVVIDPQEKPSEEPLGDRRTVIDKCSPPLEFLDDSDSHLEIQKHKDREVVMEHPSSGSDWSDVEEISTVRFSQEEPVSLKPSAVPEPSSFTTDYVMYPPHLYSSPWCDYASYWTSSPKPSSYPSTGSSSNDAAQVGKSSRSRMSDYSPNSTGSVQNTSRDMEASEEGWSQNSRSFRFSRSSEEREVKEKRTFQEEMPPRPCGGHASSSLPKSHLEPSLEEGFIDTHCHLDMLYSKLSFQGTFTKFRKIYSSSFPKEFQGCISDFCDPRTLTDCLWEELLKEDLVWGAFGCHPHFARYYSESQERNLLQALRHPKAVAFGEMGLDYSYKCTTPVPEQHKVFERQLQLAVSLKKPLVIHCREADEDLLEIMKKFVPPDYKIHRHCFTGSYPVIEPLLKYFPNMSVGFTAVLTYSSAWEAREALRQIPLERIIVETDAPYFLPRQVPKSLCQYAHPGLALHTVREIARVKDQPLSLTLAALRENTSRLYSL

SEQ ID NO: 906510 - protein, 761 aa, Homo sapiens; identical to SEQ ID NO: 906509

SEQ ID NO: 906511 - protein, 761 aa, Homo sapiens; identical to SEQ ID NO: 906509

SEQ ID NO: 906512 - protein, 761 aa, Homo sapiens; identical to SEQ ID NO: 906509

SEQ ID NO: 906513 - protein, 761 aa, Homo sapiens; identical to SEQ ID NO: 906509

SEQ ID NO: 906514 - protein, 773 aa, Homo sapiens
MGSGKKRERQVPMASERGKVKHNWSSTSEGCPRKRSCLREPCDVAPSSRPAQRSASRSGGPSSPKRLKAQKEDDVACSRRLSWGSSRRRNNSSSSFSPHFLGPGVGGAASKGCLIRNTRGFLSSGGSPLRPANASLEEMASLEEEACSLKVDSKDSSHNSTNSEFAAEAEGQNDTIEEPNKVQKRKRDRLRDQGSTMIYLKAIQGILGKSMPKRKGEAATRAKPSAAEHPSHGEGPARSEGPAKTAEGAARSVTVTAAQKEKDATPEVSMEEDKTVPERSSFYDRRVVIDPQEKPSEEPLGDRRTVIDKCSPPLEFLDDSDSHLEIQKHKDREVVMEHPSSGSDWSDVEEISTVRFSQEEPVSLKPSAVPEPSSFTTDYVMYPPHLYSSPWCDYASYWTSSPKPSSYPSTGSSSNDAAQVGKSSRSRMSDYSPNSTGSVQNTSRDMEASEEGWSQNSRSFRFSRSSEEREVKEKRTFQEEMPPRPCGGHASSSLPKSHLEPSLEEGFIDTHCHLDMLYSKLSFQGTFTKFRKIYSSSFPKEFQGCISDFCDPRTLTDCLWEELLKEDLVWGAFGCHPHFARYYSESQERNLLQALRHPKAVAFGEMGLDYSYKCTTPVPEQHKVFERQLQLAVSLKKPLVIHCREADEDLLEIMKKFVPPDYKIHRHCFTGSYPVIEPLLKYFPNMSVGFTAVLTYSSAWEAREALRQIPLERIIVETDAPYFLPRQVPKSLCQYAHPGLALHTVREIARVKDQPLSLTLAALRENTSRLYSL

SEQ ID NO: 906515 - protein, 655 aa, Homo sapiens
MASERGKVKHNWSSTSEGCPRKRSCLREPCDVAPSSRPAQRSASRSGGPSSPKRLKAQKEDDVACSRRLSWGSSRRRNNSSSSFSPHFLGPGVGGAASKGCLIRNTRGFLSSGGSPLRPANASLEEMASLEEEACSLKVDSKDSSHNSTNSEFAAEAEGQNDTIEEPNKVQKKEEKPSEEPLGDRRTVIDKCSPPLEFLDDSDSHLEIQKHKDREVVMEHPSSGSDWSDVEEISTVRFSQEEPVSLKPSAVPEPSSFTTDYVMYPPHLYSSPWCDYASYWTSSPKPSSYPSTGSSSNDAAQVGKSSRSRMSDYSPNSTGSVQNTSRDMEASEEGWSQNSRSFRFSRSSEEREVKEKRTFQEEMPPRPCGGHASSSLPKSHLEPSLEEGFIDTHCHLDMLYSKLSFQGTFTKFRKIYSSSFPKEFQGCISDFCDPRTLTDCLWEELLKEDLVWGAFGCHPHFARYYSESQERNLLQALRHPKAVAFGEMGLDYSYKCTTPVPEQHKVFERQLQLAVSLKKPLVIHCREADEDLLEIMKKFVPPDYKIHRHCFTGSYPVIEPLLKYFPNMSVGFTAVLTYSSAWEAREALRQIPLERIIVETDAPYFLPRQVPKSLCQYAHPGLALHTVREIARVKDQPLSLTLAALRENTSRLYSL

SEQ ID NO: 906516 - protein, 773 aa, Homo sapiens; identical to SEQ ID NO: 906514

SEQ ID NO: 906517 - protein, 572 aa, Homo sapiens
MASERGKVKHNWSSTSEGCPRKRSCLREPCDVAPSSRPAQRSASRSGGPSSPKRLKAQKEDDVACSRRLSWGSSRRRNNSSSSFSPHFLGPGVGGAASKGCLIRNTRGFLSSGGSPLRPANASLEEMASLEEEACSLKVDSKDSSHNSTNSEFAAEAEGQNDTIEEPNKVQKRKRDRLRDQGSTMIYLKAIQGILGKSMPKRKGEAATRAKPSAAEHPSHGEGPARSEGPAKTAEGAARSVTVTAAQKEKDATPEVSMEEDKTVPERSSFYDRRVVIDPQEKPSEEPLGDRRTVIDKCSPPLEFLDDSDSHLEIQKHKDREVVMEHPSSGSDWSDVEEISTVRFSQEEPVSLKPSAVPEPSSFTTDYVMYPPHLYSSPWCDYASYWTSSPKPSSYPSTGSSSNDAAQVGKSSRSRMSDYSPNSTGSVQNTSRDMEASEEGWSQNSRSFRFSRSSEEREVKEKRTFQEEMPPRPCGGHASSSLPKSHLEPSLEEGFIDTHCHLDMLYSKLSFQGTFTKFRKIYSSSFPKEFQGCISDFCVRGGKAEMTWKSPSLCHPPAKEKHKVLSTFLSRI

SEQ ID NO: 906518 - protein, 722 aa, Homo sapiens
MASERGKVKHNWSSTSEGCPRKRSCLREPCDVAPSSRPAQRSASRSGGPSSPKRLKAQKEDDVACSRRLSWGSSRRRNNSSSSFSPHFLGPGVGGAASKGCLIRNTRGFLSSGGSPLRPANASLEEMASLEEEACSLKVDSKDSSHNSTNSEFAAEAEGQNDTIEEPNKVQKRKRDRLRDQGSTMIYLKAIQGILGKSMPKRKGEAATRAKPSAAEHPSHGEGPARSEGPAKTAEGAARSVTVTAAQKEKDATPEVSMEEDKTVPERSSFYDRRVVIDPQEKPSEEPLGDRRTVIDKCSPPLEFLDDSDSHLEIQKHKDREVVMEHPSSGSDWSDVEEISTVRFSQEEPVSLKPSAVPEPSSFTTDYVMYPPHLYSSPWCDYASYWTSSPKPSSYPSTGSSSNDAAQVGKSSRSRMSDYSPNSTGSVQNTSRDMEASEEGWSQNSRSFRFSRSSEEREVKEKRTFQEEMPPRPCGGHASSSLPKSHLEPSLEEGFIDTHCHLDMLYSKLSFQGTFTKFRKIYSSSFPKEFQGCISDFCDPRTLTDCLWEELLKEDLVWGAFGCHPHFARYYSESQERNLLQALRHPKAVAFGEMGLDYSYKCTTPVPEQHKVFERQLQLAVSLKKPLVIHCREADEDLLEIMKKFVPPDYKIHRHCFTGSYPVIEPLLKYFPNMSVGFTAVLTYSSAWEAREALRQIPLERIIVETDAPYFLPRQAVQSPTL

SEQ ID NO: 906519 - protein, 133 aa, Homo sapiens
FYSSEHEYSGLNIVRPSTGKIVNELFKEAREHGAVPLNEATRASGDDKSKSFTGGGYRLGSSFCKRSEYIYGENQLQDVQILLKLWSNGFSLDDGELRPYNEPTNAQFLESVKRGVTLIACMPEIQQLMLEIF

SEQ ID NO: 906520 - protein, 1701 aa, Homo sapiens
MKIFQRKMRYWLLPPFLAIVYFCTIVQGQVAPPTRLRYNVISHDSIQISWKAPRGKFGGYKLLVTPTSGGKTNQLNLQNTATKAIIQGLMPDQNYTVQIIAYNKDKESKPAQGQFRIKDLEKRKDPKPRVKVVDRGNGSRPSSPEEVKFVCQTPAIADIVILVDGSWSIGRFNFRLVRHFLENLVTAFDVGSEKTRIGVKNADVNELQEIASEPDSTHVYNVAEFDLMHTVVESLTRTLCSRVEEQDREIKASAHAITGPPTELITSEVTARSFMVNWTHAPGNVEKYRVVYYPTRGGKPDEVVVDGTVSSTVLKNLMSLTEYQIAVFAIYAHTASEGLRGTETTLALPMASDLLLYDVTENSMRVKWDAVPGASGYLILYAPLTEGLAGDEKEMKIGETHTDIELSGLLPNTEYTVTVYAMFGEEASDPVTGQETTLALSPPRNLRISNVGSNSARLTWDPTSRQINGYRIVYNNADGTEINEVEVDPITTFPLKGLTPLTEYTIAIFSIYDEGQSEPLTGVFTTEEVPAQQYLEIDEVTTDSFRVTWHPLSADEGLHKLMWIPVYGGKTEEVVLKEEQDSHVIEGLEPGTEYEVSLLAVLDDGSESEVVTAVGTTLDSFWTEPATTIVPTTSVTSVFQTGIRNLVVGDETTSSLRVKWDISDSDVQQFRVTYMTAQGDPEEEVIGTVMVPGSQNNLLLKPLLPDTEYKVTVTPIYTDGEGVSVSAPGKTLPSSGPQNLRVSEEWYNRLRITWDPPSSPVKGYRIVYKPVSVPGPTLETFVGADINTILITNLLSGMDYNVKIFASQASGFSDALTGMVKTLFLGVTNLQAKHVEMTSLCAHWQVHRHATAYRVVIESLQDRQKQESTVGGGTTRHCFYGLQPDSEYKISVYTKLQEIEGPSVSIMEKTQSLPTRPPTFPPTIPPAKEVCKAAKADLVFMVDGSWSIGDENFNKIISFLYSTVGALNKIGTDGTQVAMVQFTDDPRTEFKLNAYKTKETLLDAIKHISYKGGNTKTGKAIKYVRDTLFTAESGTRRGIPKVIVVITDGRSQDDVNKISREMQLDGYSIFAIGVADADYSELVSIGSKPSARHVFFVDDFDAFKKIEDELITFVCETASATCPVVHKDGIDLAGFKMMEMFGLVEKDFSSVEGVSMEPGTFNVFPCYQLHKDALVSQPTRYLHPEGLPSDYTISFLFRILPDTPQEPFALWEILNKNSDPLVGVILDNGGKTLTYFNYDQSGDFQTVTFEGPEIRKIFYGSFHKLHIVVSETLVKVVIDCKQVGEKAMNASANITSDGVEVLGKMVRSRGPGGNSAPFQLQMFDIVCSTSWANTDKCCELPGLRDDESCPDLPHSCSCSETNEVALGPAGPPGGPGLRGPKGQQGEPGPKGPDGPRGEIGLPGPQGPPGPQGPSGLSIQGMPGMPGEKGEKGDTGLPGPQGIPGGVGSPGRDGSPGQRGLPGKDGSSGPPGPPGPIGIPGTPGVPGITGSMGPQGALGPPGVPGAKGERGERGDLQSQAMVRSVARQVCEQLIQSHMARYTAILNQIPSHSSSIRTVQGPPGEPGRPGSPGAPGEQGPPGTPGFPGNAGVPGTPGERGLTGIKGEKGNPGVGTQGPRGPPGPAGPSGESRPGSPGPPGSPGPRGPPGHLGVPGPQGPSGQPGYCDPSSCSAYGVRAPHPDQPEFTPVQDELEAMELWGPGV

SEQ ID NO: 906521 - protein, 1685 aa, Homo sapiens
MKIFQRKMRYWLLPPFLAIVYFCTIVQGQVAPPTRLRYNVISHDSIQISWKAPRGKFGGYKLLVTPTSGGKTNQLNLQNTATKAIIQGLMPDQNYTVQIIAYNKDKESKPAQGQFRIKDLEKRKDPKPRVKVVDRGNGSRPSSPEEVKFVCQTPAIADIVILVDGSWSIGRFNFRLVRHFLENLVTAFDVGSEKTRIGVKNADVNELQEIASEPDSTHVYNVAEFDLMHTVVESLTRTLCSRVEEQDREIKASAHAITGPPTELITSEVTARSFMVNWTHAPGNVEKYRVVYYPTRGGKPDEVVVDGTVSSTVLKNLMSLTEYQIAVFAIYAHTASEGLRGTETTLALPMASDLLLYDVTENSMRVKWDAVPGASGYLILYAPLTEGLAGDEKEMKIGETHTDIELSGLLPNTEYTVTVYAMFGEEASDPVTGQETTLALSPPRNLRISNVGSNSARLTWDPTSRQINGYRIVYNNADGTEINEVEVDPITTFPLKGLTPLTEYTIAIFSIYDEGQSEPLTGVFTTEEVPAQQYLEIDEVTTDSFRVTWHPLSADEGLHKLMWIPVYGGKTEEVVLKEEQDSHVIEGLEPGTEYEVSLLAVLDDGSESEVVTAVGTTLDSFWTEPATTIVPTTSVTSVFQTGIRNLVVGDETTSSLRVKWDISDSDVQQFRVTYMTAQGDPEEEVIGTVMVPGSQNNLLLKPLLPDTEYKVTVTPIYTDGEGVSVSAPGKTLPSSGPQNLRVSEEWYNRLRITWDPPSSPVKGYRIVYKPVSVPGPTLETFVGADINTILITNLLSGMDYNVKIFASQASGFSDALTGMVKTLFLGVTNLQAKHVEMTSLCAHWQVHRHATAYRVVIESLQDRQKQESTVGGGTTRHCFYGLQPDSEYKISVYTKLQEIEGPSVSIMEKTQSLPTRPPTFPPTIPPAKEVCKAAKADLVFMVDGSWSIGDENFNKIISFLYSTVGALNKIGTDGTQVAMVQFTDDPRTEFKLNAYKTKETLLDAIKHISYKGGNTKTGKAIKYVRDTLFTAESGTRRGIPKVIVVITDGRSQDDVNKISREMQLDGYSIFAIGVADADYSELVSIGSKPSARHVFFVDDFDAFKKIEDELITFVCETASATCPVVHKDGIDLAGFKMMEMFGLVEKDFSSVEGVSMEPGTFNVFPCYQLHKDALVSQPTRYLHPEGLPSDYTISFLFRILPDTPQEPFALWEILNKNSDPLVGVILDNGGKTLTYFNYDQSGDFQTVTFEGPEIRKIFYGSFHKLHIVVSETLVKVVIDCKQVGEKAMNASANITSDGVEVLGKMVRSRGPGGNSAPFQLQMFDIVCSTSWANTDKCCELPGLRDDESCPDLPHSCSCSETNEVALGPAGPPGGPGLRGPKGQQGEPGPKGPDGPRGEIGLPGPQGPPGPQGPSGLSIQGMPGMPGEKGEKGDTGLPGPQGIPGGVGSPGRDGSPGQRGLPGKDGSSGPPGPPGPIGIPGTPGVPGITGSMGPQGALGPPGVPGAKGERGERGDLQSQAMVRSVARQVCEQLIQSHMARYTAILNQIPSHSSSIRTVQGPPGEPGRPGSPGAPGEQGPPGTPGFPGNAGVPGTPGERGLTGIKGEKGNPGVGTQGPRGPPGPAGPSGESRPGSPGPPGSPGPRGPPGHLGVPGPQGPSGQPGYCDPSSCSAYGVRDLIPYNDYQH

SEQ ID NO: 906522 - protein, 1030 aa, Homo sapiens
MKIFQRKMRYWLLPPFLAIVYFCTIVQGQVAPPTRLRYNVISHDSIQISWKAPRGKFGGYKLLVTPTSGGKTNQLNLQNTATKAIIQGLMPDQNYTVQIIAYNKDKESKPAQGQFRIKDLEKRKDPKPRVKVVDRGNGSRPSSPEEVKFVCQTPAIADIVILVDGSWSIGRFNFRLVRHFLENLVTAFDVGSEKTRIGLAQYSGDPRIEWHLNAFSTKDEVIEAVRNLPYKGGNTLTGLALNYIFENSFKPEAGSRTGVSKIGILITDGKSQDDIIPPSRNLRESGVELFAIGVKNADVNELQEIASEPDSTHVYNVAEFDLMHTVVESLTRTLCSRVEEQDREIKASAHAITGPPTELITSEVTARSFMVNWTHAPGNVEKYRVVYYPTRGGKPDEVVVDGTVSSTVLKNLMSLTEYQIAVFAIYAHTASEGLRGTETTLALPMASDLLLYDVTENSMRVKWDAVPGASGYLILYAPLTEGLAGDEKEMKIGETHTDIELSGLLPNTEYTVTVYAMFGEEASDPVTGQETTLALSPPRNLRISNVGSNSARLTWDPTSRQINGYRIVYNNADGTEINEVEVDPITTFPLKGLTPLTEYTIAIFSIYDEGQSEPLTGVFTTEEVPAQQYLEIDEVTTDSFRVTWHPLSADEGLHKLMWIPVYGGKTEEVVLKEEQDSHVIEGLEPGTEYEVSLLAVLDDGSESEVVTAVGTTLDSFWTEPATTIVPTTSVTSVFQTGIRNLVVGDETTSSLRVKWDISDSDVQQFRVTYMTAQGDPEEEVIGTVMVPGSQNNLLLKPLLPDTEYKVTVTPIYTDGEGVSVSAPGKTLPSSGPQNLRVSEEWYNRLRITWDPPSSPVKGYRIVYKPVSVPGPTLETFVGADINTILITNLLSGMDYNVKIFASQASGFSDALTGMVKTLFLGVTNLQAKHVEMTSLCAHWQVHRHATAYRVVIESLQDRQKQESTVGGGTTRHCFYGLQPDSEYKISVYTKLQEIEGPSVSIMEKTQSLPTRPPTFPPTIPPAKEGKRIIE

SEQ ID NO: 906523 - protein, 1653 aa, Homo sapiens
MKIFQRKMRYWLLPPFLAIVYFCTIVQGQVAPPTRLRYNVISHDSIQISWKAPRGKFGGYKLLVTPTSGGKTNQLNLQNTATKAIIQGLMPDQNYTVQIIAYNKDKESKPAQGQFRIKDLEKRKDPKPRVKVVDRGNGSRPSSPEEVKFVCQTPAIADIVILVDGSWSIGRFNFRLVRHFLENLVTAFDVGSEKTRIGVKNADVNELQEIASEPDSTHVYNVAEFDLMHTVVESLTRTLCSRVEEQDREIKASAHAITGPPTELITSEVTARSFMVNWTHAPGNVEKYRVVYYPTRGGKPDEVVVDGTVSSTVLKNLMSLTEYQIAVFAIYAHTASEGLRGTETTLALPMASDLLLYDVTENSMRVKWDAVPGASGYLILYAPLTEGLAGDEKEMKIGETHTDIELSGLLPNTEYTVTVYAMFGEEASDPVTGQETTLALSPPRNLRISNVGSNSARLTWDPTSRQINGYRIVYNNADGTEINEVEVDPITTFPLKGLTPLTEYTIAIFSIYDEGQSEPLTGVFTTEEVPAQQYLEIDEVTTDSFRVTWHPLSADEGLHKLMWIPVYGGKTEEVVLKEEQDSHVIEGLEPGTEYEVSLLAVLDDGSESEVVTAVGTTLDSFWTEPATTIVPTTSVTSVFQTGIRNLVVGDETTSSLRVKWDISDSDVQQFRVTYMTAQGDPEEEVIGTVMVPGSQNNLLLKPLLPDTEYKVTVTPIYTDGEGVSVSAPGKTLPSSGPQNLRVSEEWYNRLRITWDPPSSPVKGYRIVYKPVSVPGPTLETFVGADINTILITNLLSGMDYNVKIFASQASGFSDALTGMVKTLFLGVTNLQAKHVEMTSLCAHWQVHRHATAYRVVIESLQDRQKQESTVGGGTTRHCFYGLQPDSEYKISVYTKLQEIEGPSVSIMEKTQSLPTRPPTFPPTIPPAKEVCKAAKADLVFMVDGSWSIGDENFNKIISFLYSTVGALNKIGTDGTQVAMVQFTDDPRTEFKLNAYKTKETLLDAIKHISYKGGNTKTGKAIKYVRDTLFTAESGTRRGIPKVIVVITDGRSQDDVNKISREMQLDGYSIFAIGVADADYSELVSIGSKPSARHVFFVDDFDAFKKIEDELITFVCETASATCPVVHKDGIDLAGFKMMEMFGLVEKDFSSVEGVSMEPGTFNVFPCYQLHKDALVSQPTRYLHPEGLPSDYTISFLFRILPDTPQEPFALWEILNKNSDPLVGVILDNGGKTLTYFNYDQSGDFQTVTFEGPEIRKIFYGSFHKLHIVVSETLVKVVIDCKQVGEKAMNASANITSDGVEVLGKMVRSRGPGGNSAPFQLQMFDIVCSTSWANTDKCCELPGLRDDESCPDLPHSCSCSETNEVALGPAGPPGGPGLRGPKGQQGEPGPKGPDGPRGEIGLPGPQGPPGPQGPSGLSIQGMPGMPGEKGEKGDTGLPGPQGIPGGVGSPGRDGSPGQRGLPGKDGSSGPPGPPGPIGIPGTPGVPGITGSMGPQGALGPPGVPGAKGERGERGDLQSQAMVRSVARQVCEQLIQSHMARYTAILNQIPSHSSSIRTVQGPPGEPGRPGSPGAPGEQGPPGTPGFPGNAGVPGTPGERGLTGIEDLQGRVGLAALGPLALLDQEAHQVIWGFLDPKVLLASLDIVTPHHVLPMV

SEQ ID NO: 906524 - protein, 602 aa, Homo sapiens
MKIFQRKMRYWLLPPFLAIVYFCTIVQGQVAPPTRLRYNVISHDSIQISWKAPRGKFGGYKLLVTPTSGGKTNQLNLQNTATKAIIQGLMPDQNYTVQIIAYNKDKESKPAQGQFRIKDLEKRKDPKPRVKVVDRGNGSRPSSPEEVKFVCQTPAIADIVILVDGSWSIGRFNFRLVRHFLENLVTAFDVGSEKTRIGVKNADVNELQEIASEPDSTHVYNVAEFDLMHTVVESLTRTLCSRVEEQDREIKASAHAITGPPTELITSEVTARSFMVNWTHAPGNVEKYRVVYYPTRGGKPDEVVVDGTVSSTVLKNLMSLTEYQIAVFAIYAHTASEGLRGTETTLALPMASDLLLYDVTENSMRVKWDAVPGASGYLILYAPLTEGLAGDEKEMKIGETHTDIELSGLLPNTEYTVTVYAMFGEEASDPVTGQETTLALSPPRNLRISNVGSNSARLTWDPTSRQINGYRIVYNNADGTEINEVQILLKLWSNGFSLDDGELRPYNEPTNAQFLESVKRGLTPEIVSTPSSPEEEDKSILNAVVLIDDSVPTTKIQIRLADGSRLIQRFNSTHRILDVRNFIVQSRPEFAALDYYSCDFIS

SEQ ID NO: 906525 - protein, 628 aa, Homo sapiens
MKIFQRKMRYWLLPPFLAIVYFCTIVQGQVAPPTRLRYNVISHDSIQISWKAPRGKFGGYKLLVTPTSGGKTNQLNLQNTATKAIIQGLMPDQNYTVQIIAYNKDKESKPAQGQFRIKDLEKRKDPKPRVKVVDRGNGSRPSSPEEVKFVCQTPAIADIVILVDGSWSIGRFNFRLVRHFLENLVTAFDVGSEKTRIGVKNADVNELQEIASEPDSTHVYNVAEFDLMHTVVESLTRTLCSRVEEQDREIKASAHAITGPPTELITSEVTARSFMVNWTHAPGNVEKYRVVYYPTRGGKPDEVVVDGTVSSTVLKNLMSLTEYQIAVFAIYAHTASEGLRGTETTLALPMASDLLLYDVTENSMRVKWDAVPGASGYLILYAPLTEGLAGDEKEMKIGETHTDIELSGLLPNTEYTVTVYAMFGEEASDPVTGQETTLALSPPRNLRISNVGSNSARLTWDPTSRQINGYRIVYNNADGTEINEVQILLKLWSNGFSLDDGELRPYNEPTNAQFLESVKRGLTPEIVSTPSSPEEEDKSILNAVVLIDDSVPTTKIQIRLADGSRLIQRFNSTHRILDVRNFIVQSRPEFAALDFILVTSFPNKELTDESLTLLEADILNTVLLQQLK

SEQ ID NO: 906526 - protein, 133 aa, Homo sapiens; identical to SEQ ID NO: 906519

SEQ ID NO: 906527 - protein, 77 aa, Homo sapiens
RKMAEGGGPEPGEQERRSSGPRPPSARDLQLALAELYEDEVKCKSSKSNRPKATVFKKPTDTTSTVSFILFCCKKKL

SEQ ID NO: 906528 - protein, 250 aa, Homo sapiens
MKLLEKYSIYHSNFLPLSLNTASLHLFPRAEFGTRITGSMGPQGALGPPGVPGAKGERGERGDLQSQAMVRSVARQVCEQLIQSHMARYTAILNQIPSHSSSIRTVQGPPGEPGRPGSPGAPGEQGPPGTPGFPGNAGVPGTPGERGLTGIKGEKGNPGVGTQGPRGPPGPAGPSGESRPGSPGPPGSPGPRGPPGHLGVPGPQGPSGQPGYCDPSSCSAYGVRAPHPDQPEFTPVQDELEAMELWGPGV

SEQ ID NO: 906529 - protein, 1701 aa, Homo sapiens; identical to SEQ ID NO: 906520

SEQ ID NO: 906530 - protein, 881 aa, Homo sapiens
RLGRGWGEIGRGTAMVKTLFLGVTNLQAKHVEMTSLCAHWQVHRHATAYRVVIESLQDRQKQESTVGGGTTRHCFYGLQPDSEYKISVYTKLQEIEGPSVSIMEKTQSLPTRPPTFPPTIPPAKEVCKAAKADLVFMVDGSWSIGDENFNKIISFLYSTVGALNKIGTDGTQVAMVQFTDDPRTEFKLNAYKTKETLLDAIKHISYKGGNTKTGKAIKYVRDTLFTAESGTRRGIPKVIVVITDGRSQDDVNKISREMQLDGYSIFAIGVADADYSELVSIGSKPSARHVFFVDDFDAFKKIEDELITFVCETASATCPVVHKDGIDLAGFKMMEMFGLVEKDFSSVEGVSMEPGTFNVFPCYQLHKDALVSQPTRYLHPEGLPSDYTISFLFRILPDTPQEPFALWEILNKNSDPLVGVILDNGGKTLTYFNYDQSGDFQTVTFEGPEIRKIFYGSFHKLHIVVSETLVKVVIDCKQVGEKAMNASANITSDGVEVLGKMVRSRGPGGNSAPFQLQMFDIVCSTSWANTDKCCELPGLRDDESCPDLPHSCSCSETNEVALGPAGPPGGPGLRGPKGQQGEPGPKGPDGPRGEIGLPGPQGPPGPQGPSGLSIQGMPGMPGEKGEKGDTGLPGPQGIPGGVGSPGRDGSPGQRGLPGKDGSSGPPGPPGPIGIPGTPGVPGITGSMGPQGALGPPGVPGAKGERGERGDLQSQAMVRSVARQVCEQLIQSHMARYTAILNQIPSHSSSIRTVQGPPGEPGRPGSPGAPGEQGPPGTPGFPGNAGVPGTPGERGLTGIKGEKGNPGVGTQGPRGPPGPAGPSGESRPGSPGPPGSPGPRGPPGHLGVPGPQGPSGQPGYCDPSSCSAYGVRDLIPYNDYQH

SEQ ID NO: 906531 - protein, 1706 aa, Homo sapiens
MKIFQRKMRYWLLPPFLAIVYFCTIVQGQVAPPTRLRYNVISHDSIQISWKAPRGKFGGYKLLVTPTSGGKTNQLNLQNTATKAIIQGLMPDQNYTVQIIAYNKDKESKPAQGQFRIKDLEKRKDPKPRVKVVDRGNGSRPSSPEEVKFVCQTPAIADIVILVDGSWSIGRFNFRLVRHFLENLVTAFDVGSEKTRIGVKNADVNELQEIASEPDSTHVYNVAEFDLMHTVVESLTRTLCSRVEEQDREIKASAHAITGPPTELITSEVTARSFMVNWTHAPGNVEKYRVVYYPTRGGKPDEVVVDGTVSSTVLKNLMSLTEYQIAVFAIYAHTASEGLRGTETTLALPMASDLLLYDVTENSMRVKWDAVPGASGYLILYAPLTEGLAGDEKEMKIGETHTDIELSGLLPNTEYTVTVYAMFGEEASDPVTGQETTLALSPPRNLRISNVGSNSARLTWDPTSRQINGYRIVYNNADGTEINEVEVDPITTFPLKGLTPLTEYTIAIFSIYDEGQSEPLTGVFTTEEVPAQQYLEIDEVTTDSFRVTWHPLSADEGLHKLMWIPVYGGKTEEVVLKEEQDSHVIEGLEPGTEYEVSLLAVLDDGSESEVVTAVGTTLDSFWTEPATTIVPTTSVTSVFQTGIRNLVVGDETTSSLRVKWDISDSDVQQFRVTYMTAQGDPEEEVIGTVMVPGSQNNLLLKPLLPDTEYKVTVTPIYTDGEGVSVSAPGKTLPSSGPQNLRVSEEWYNRLRITWDPPSSPVKGYRIVYKPVSVPGPTLETFVGADINTILITNLLSGMDYNVKIFASQASGFSDALTGMVKTLFLGVTNLQAKHVEMTSLCAHWQVHRHATAYRVVIESLQDRQKQESTVGGGTTRHCFYGLQPDSEYKISVYTKLQEIEGPSVSIMEKTQSLPTRPPTFPPTIPPAKEVCKAAKADLVFMVDGSWSIGDENFNKIISFLYSTVGALNKIGTDGTQVAMVQFTDDPRTEFKLNAYKTKETLLDAIKHISYKGGNTKTGKAIKYVRDTLFTAESGTRRGIPKVIVVITDGRSQDDVNKISREMQLDGYSIFAIGVADADYSELVSIGSKPSARHVFFVDDFDAFKKIEDELITFVCETASATCPVVHKDGIDLAGFKMMEMFGLVEKDFSSVEGVSMEPGTFNVFPCYQLHKDALVSQPTRYLHPEGLPSDYTISFLFRILPDTPQEPFALWEILNKNSDPLVGVILDNGGKTLTYFNYDQSGDFQTVTFEGPEIRKIFYGSFHKLHIVVSETLVKVVIDCKQVGEKAMNASANITSDGVEVLGKMVRSRGPGGNSAPFQLQMFDIVCSTSWANTDKCCELPGLRDDESCPDLPHSCSCSETNEVALGPAGPPGGPGLRGPKGQQGEPGPKGPDGPRGEIGLPGPQGPPGPQGPSGLSIQGMPGMPGEKGEKGDTGLPGPQGIPGGVGSPGRDGSPGQRGLPGKDGSSGPPGPPGPIGIPGTPGVPGITGSMGPQGALGPPGVPGAKGERGERGDLQSQAMVRSVARQVCEQLIQSHMARYTAILNQIPSHSSSIRTVQGPPGEPGRPGSPGAPGEQGPPGTPGFPGNAGVPGTPGERGLTGIKGEKGNPGVGTQGPRGPPGPAGPSGESRPGSPGPPGSPGPRGPPGHLGVPGPQGPSGQPGYCDPSSCSAYGVREDGWASFSLTTLLSLPPLITSPPCSPLVMDF

SEQ ID NO: 906532 - protein, 698 aa, Homo sapiens
MGGSEIKLLPFFVSGKAIKYVRDTLFTAESGTRRGIPKVIVVITDGRSQDDVNKISREMQLDGYSIFAIGVADADYSELVSIGSKPSARHVFFVDDFDAFKKIEDELITFVCETASATCPVVHKDGIDLAGFKMMEMFGLVEKDFSSVEGVSMEPGTFNVFPCYQLHKDALVSQPTRYLHPEGLPSDYTISFLFRILPDTPQEPFALWEILNKNSDPLVGVILDNGGKTLTYFNYDQSGDFQTVTFEGPEIRKIFYGSFHKLHIVVSETLVKVVIDCKQVGEKAMNASANITSDGVEVLGKMVRSRGPGGNSAPFQLQMFDIVCSTSWANTDKCCELPGLRDDESCPDLPHSCSCSETNEVALGPAGPPGGPGLRGPKGQQGEPGPKGPDGPRGEIGLPGPQGPPGPQGPSGLSIQGMPGMPGEKGEKGDTGLPGPQGIPGGVGSPGRDGSPGQRGLPGKDGSSGPPGPPGPIGIPGTPGVPGITGSMGPQGALGPPGVPGAKGERGERGDLQSQAMVRSVARQVCEQLIQSHMARYTAILNQIPSHSSSIRTVQGPPGEPGRPGSPGAPGEQGPPGTPGFPGNAGVPGTPGERGLTGIKGEKGNPGVGTQGPRGPPGPAGPSGESRPGSPGPPGSPGPRGPPGHLGVPGPQGPSGQPGYCDPSSCSAYGVRAPHPDQPEFTPVQDELEAMELWGPGV

SEQ ID NO: 906533 - protein, 539 aa, Homo sapiens
MKIFQRKMRYWLLPPFLAIVYFCTIVQGQVAPPTRLRYNVISHDSIQISWKAPRGKFGGYKLLVTPTSGGKTNQLNLQNTATKAIIQGLMPDQNYTVQIIAYNKDKESKPAQGQFRIKDLEKRKDPKPRVKVVDRGNGSRPSSPEEVKFVCQTPAIADIVILVDGSWSIGRFNFRLVRHFLENLVTAFDVGSEKTRIGVKNADVNELQEIASEPDSTHVYNVAEFDLMHTVVESLTRTLCSRVEEQDREIKASAHAITGPPTELITSEVTARSFMVNWTHAPGNVEKYRVVYYPTRGGKPDEVVVDGTVSSTVLKNLMSLTEYQIAVFAIYAHTASEGLRGTETTLALPMASDLLLYDVTENSMRVKWDAVPGASGYLILYAPLTEGLAGDEKEMKIGETHTDIELSGLLPNTEYTVTVYAMFGEEASDPVTGQETTLALSPPRNLRISNVGSNSARLTWDPTSRQINGYRIVYNNADGTEINEVQILLKLWSNGFSLDDGELRPYNEPTNAQFLESVKRGVTLIACMPEIQQLMLEIF

SEQ ID NO: 906534 - protein, 283 aa, Homo sapiens
RKMAEGGGPEPGEQERRSSGPRPPSARDLQLALAELYEDEVKCKSSKSNRPKATVFKKPTDTTSTSFTGGGYRLGSSFCKRSEYIYGENQLQDVQILLKLWSNGFSLDDGELRPYNEPTNAQFLESVKRGEIPLELQRLVHGGQVNLDMEDHQDQEYIKPRLRFKAFSGEGQKLGSLTPEIVSTPSSPEEEDKSILNAVVLIDDSVPTTKIQIRLADGSRLIQRFNSTHRILDVRNFIVQSRPEFAALDFILVTSFPNKELTDESLTLLEADILNTVLLQQLK

SEQ ID NO: 906535 - protein, 886 aa, Homo sapiens
MEPPTVPSERSLSLSLPGPREGQATLKPPPQHLWRQPRTPIRIQQRGYSDSAERAERERQPHRPIERADAMDTSDRPGLRTTRMSWPSSFHGTGTGSGGAGGGSSRRFEAENGPTPSPGRSPLDSQASPGLVLHAGAATSQRRESFLYRSDSDYDMSPKTMSRNSSVTSEAHAEDLIVTPFAQVLASLRSVRSNFSLLTNVPVPSNKRSPLGGPTPVCKATLSEETCQQLARETLEELDWCLEQLETMQTYRSVSEMASHKFKRMLNRELTHLSEMSRSGNQVSEYISTTFLDKQNEVEIPSPTMKEREKQQAPRPRPSQPPPPPVPHLQPMSQITGLKKLMHSNSLNNSNIPRFGVKTDQEELLAQELENLNKWGLNIFCVSDYAGGRSLTCIMYMIFQERDLLKKFRIPVDTMVTYMLTLEDHYHADVAYHNSLHAADVLQSTHVLLATPALDAVFTDLEILAALFAAAIHDVDHPGVSNQFLINTNSELALMYNDESVLENHHLAVGFKLLQEDNCDIFQNLSKRQRQSLRKMVIDMVLATDMSKHMTLLADLKTMVETKKVTSSGVLLLDNYSDRIQVLRNMVHCADLSNPTKPLELYRQWTDRIMAEFFQQGDRERERGMEISPMCDKHTASVEKSQVGFIDYIVHPLWETWADLVHPDAQEILDTLEDNRDWYYSAIRQSPSPPPEEESRGPGHPPLPDKFQFELTLEEEEEEEISMAQIPCTAQEALTAQGLSGVEEALDATIAWEASPAQESLEVMAQEASLEAELEAVYLTQQAQSTGSAPVAPDEFSSREEFVVAVSHSSPSALALQSPLLPAWRTLSVSEHAPGLPGLPSTAAEVEAQREHQAAKRACSACAGTFGEDTSALPAPGGGGSGGDPT

SEQ ID NO: 906536 - protein, 80 aa, Homo sapiens
ARPRGLGRIPELQLVAFPVAVAAEDEAFLPEPLAPRAPRRPRSPPSSPVFFASPSPTFRRRLRLLRSCQDLGRQAWAGAG

SEQ ID NO: 906537 - protein, 825 aa, Homo sapiens
MRSGAAPRARPRPPALALPPTGPESLTHFPFSDEDTRRHPPGRSVSFEAENGPTPSPGRSPLDSQASPGLVLHAGAATSQRRESFLYRSDSDYDMSPKTMSRNSSVTSEAHAEDLIVTPFAQVLASLRSVRSNFSLLTNVPVPSNKRSPLGGPTPVCKATLSEETCQQLARETLEELDWCLEQLETMQTYRSVSEMASHKFKRMLNRELTHLSEMSRSGNQVSEYISTTFLDKQNEVEIPSPTMKEREKQQAPRPRPSQPPPPPVPHLQPMSQITGLKKLMHSNSLNNSNIPRFGVKTDQEELLAQELENLNKWGLNIFCVSDYAGGRSLTCIMYMIFQERDLLKKFRIPVDTMVTYMLTLEDHYHADVAYHNSLHAADVLQSTHVLLATPALDAVFTDLEILAALFAAAIHDVDHPGVSNQFLINTNSELALMYNDESVLENHHLAVGFKLLQEDNCDIFQNLSKRQRQSLRKMVIDMVLATDMSKHMTLLADLKTMVETKKVTSSGVLLLDNYSDRIQVLRNMVHCADLSNPTKPLELYRQWTDRIMAEFFQQGDRERERGMEISPMCDKHTASVEKSQVGFIDYIVHPLWETWADLVHPDAQEILDTLEDNRDWYYSAIRQSPSPPPEEESRGPGHPPLPDKFQFELTLEEEEEEEISMAQIPCTAQEALTAQGLSGVEEALDATIAWEASPAQESLEVMAQEASLEAELEAVYLTQQAQSTGSAPVAPDEFSSREEFVVAVSHSSPSALALQSPLLPAWRTLSVSEHAPGLPGLPSTAAEVEAQREHQAAKRACSACAGTFGEDTSALPAPGGGGSGGDPT

SEQ ID NO: 906538 - protein, 563 aa, Homo sapiens
MVLPSDQGFKLLGNVLQGPEPYRLLTSGLRLHQELENLNKWGLNIFCVSDYAGGRSLTCIMYMIFQERDLLKKFRIPVDTMVTYMLTLEDHYHADVAYHNSLHAADVLQSTHVLLATPALDAVFTDLEILAALFAAAIHDVDHPGVSNQFLINTNSELALMYNDESVLENHHLAVGFKLLQEDNCDIFQNLSKRQRQSLRKMVIDMVLATDMSKHMTLLADLKTMVETKKVTSSGVLLLDNYSDRIQVLRNMVHCADLSNPTKPLELYRQWTDRIMAEFFQQGDRERERGMEISPMCDKHTASVEKSQVQARGIVDGHRVGFIDYIVHPLWETWADLVHPDAQEILDTLEDNRDWYYSAIRQSPSPPPEEESRGPGHPPLPDKFQFELTLEEEEEEEISMAQIPCTAQEALTAQGLSGVEEALDATIAWEASPAQESLEVMAQEASLEAELEAVYLTQQAQSTGSAPVAPDEFSSREEFVVAVSHSSPSALALQSPLLPAWRTLSVSEHAPGLPGLPSTAAEVEAQREHQAAKRACSACAGTFGEDTSALPAPGGGGSGGDPT

SEQ ID NO: 906539 - protein, 804 aa, Homo sapiens
ARPRGLGRIPELQLVAFPVAVAAEDEAFLPEPLAPRAPRRPRSPPSSPVFFASPSPTFRRRLRLLRSCQDLGRQAWAGAGFEAENGPTPSPGRSPLDSQASPGLVLHAGAATSQRRESFLYRSDSDYDMSPKTMSRNSSVTSEAHAEDLIVTPFAQVLASLRSVRSNFSLLTNVPVPSNKRSPLGGPTPVCKATLSEETCQQLARETLEELDWCLEQLETMQTYRSVSEMASHKFKRMLNRELTHLSEMSRSGNQVSEYISTTFLDKQNEVEIPSPTMKEREKQQAPRPRPSQPPPPPVPHLQPMSQITGLKKLMHSNSLNNSNIPRFGVKTDQEELLAQELENLNKWGLNIFCVSDYAGGRSLTCIMYMIFQAVFTDLEILAALFAAAIHDVDHPGVSNQFLINTNSELALMYNDESVLENHHLAVGFKLLQEDNCDIFQNLSKRQRQSLRKMVIDMVLATDMSKHMTLLADLKTMVETKKVTSSGVLLLDNYSDRIQVLRNMVHCADLSNPTKPLELYRQWTDRIMAEFFQQGDRERERGMEISPMCDKHTASVEKSQVGFIDYIVHPLWETWADLVHPDAQEILDTLEDNRDWYYSAIRQSPSPPPEEESRGPGHPPLPDKFQFELTLEEEEEEEISMAQIPCTAQEALTAQGLSGVEEALDATIAWEASPAQESLEVMAQEASLEAELEAVYLTQQAQSTGSAPVAPDEFSSREEFVVAVSHSSPSALALQSPLLPAWRTLSVSEHAPGLPGLPSTAAEVEAQREHQAAKRACSACAGTFGEDTSALPAPGGGGSGGDPT

SEQ ID NO: 906540 - protein, 457 aa, Homo sapiens
MYNDESVLENHHLAVGFKLLQEDNCDIFQNLSKRQRQSLRKMVIDMVGGAGAGRSGKGSLGVEGFGEEWAESQRNPQPGQSGRLLPGENFRGPGQSGGRVSAAPVTPPCPQVLATDMSKHMTLLADLKTMVETKKVTSSGVLLLDNYSDRIQVLRNMVHCADLSNPTKPLELYRQWTDRIMAEFFQQGDRERERGMEISPMCDKHTASVEKSQVGFIDYIVHPLWETWADLVHPDAQEILDTLEDNRDWYYSAIRQSPSPPPEEESRGPGHPPLPDKFQFELTLEEEEEEEISMAQIPCTAQEALTAQGLSGVEEALDATIAWEASPAQESLEVMAQEASLEAELEAVYLTQQAQSTGSAPVAPDEFSSREEFVVAVSHSSPSALALQSPLLPAWRTLSVSEHAPGLPGLPSTAAEVEAQREHQAAKRACSACAGTFGEDTSALPAPGGGGSGGDPT

SEQ ID NO: 906541 - protein, 647 aa, Homo sapiens
MPLVDFFCETCSKPWLVGWWDQFKRMLNRELTHLSEMSRSGNQVSEYISTTFLDKQNEVEIPSPTMKEREKQQAPRPRPSQPPPPPVPHLQPMSQITGLKKLMHSNSLNNSNIPRFGVKTDQEELLAQELENLNKWGLNIFCVSDYAGGRSLTCIMYMIFQERDLLKKFRIPVDTMVTYMLTLEDHYHADVAYHNSLHAADVLQSTHVLLATPALDAVFTDLEILAALFAAAIHDVDHPGVSNQFLINTNSELALMYNDESVLENHHLAVGFKLLQEDNCDIFQNLSKRQRQSLRKMVIDMVLATDMSKHMTLLADLKTMVETKKVTSSGVLLLDNYSDRIQVLRNMVHCADLSNPTKPLELYRQWTDRIMAEFFQQGDRERERGMEISPMCDKHTASVEKSQVGFIDYIVHPLWETWADLVHPDAQEILDTLEDNRDWYYSAIRQSPSPPPEEESRGPGHPPLPDKFQFELTLEEEEEEEISMAQIPCTAQEALTAQGLSGVEEALDATIAWEASPAQESLEVMAQEASLEAELEAVYLTQQAQSTGSAPVAPDEFSSREEFVVAVSHSSPSALALQSPLLPAWRTLSVSEHAPGLPGLPSTAAEVEAQREHQAAKRACSACAGTFGEDTSALPAPGGGGSGGDPT

SEQ ID NO: 906542 - protein, 859 aa, Homo sapiens
ARPRGLGRIPELQLVAFPVAVAAEDEAFLPEPLAPRAPRRPRSPPSSPVFFASPSPTFRRRLRLLRSCQDLGRQAWAGAGFEAENGPTPSPGRSPLDSQASPGLVLHAGAATSQRRESFLYRSDSDYDMSPKTMSRNSSVTSEAHAEDLIVTPFAQVLASLRSVRSNFSLLTNVPVPSNKRSPLGGPTPVCKATLSEETCQQLARETLEELDWCLEQLETMQTYRSVSEMASHKFKRMLNRELTHLSEMSRSGNQVSEYISTTFLDKQNEVEIPSPTMKEREKQQAPRPRPSQPPPPPVPHLQPMSQITGLKKLMHSNSLNNSNIPRFGVKTDQEELLAQELENLNKWGLNIFCVSDYAGGRSLTCIMYMIFQERDLLKKFRIPVDTMVTYMLTLEDHYHADVAYHNSLHAADVLQSTHVLLATPALDAVFTDLEILAALFAAAIHDVDHPGVSNQFLINTNSELALMYNDESVLENHHLAVGFKLLQEDNCDIFQNLSKRQRQSLRKMVIDMVLATDMSKHMTLLADLKTMVETKKVTSSGVLLLDNYSDRIQVLRNMVHCADLSNPTKPLELYRQWTDRIMAEFFQQGDRERERGMEISPMCDKHTASVEKSQVGFIDYIVHPLWETWADLVHPDAQEILDTLEDNRDWYYSAIRQSPSPPPEEESRGPGHPPLPDKFQFELTLEEEEEEEISMAQIPCTAQEALTAQGLSGVEEALDATIAWEASPAQESLEVMAQEASLEAELEAVYLTQQAQSTGSAPVAPDEFSSREEFVVAVSHSSPSALALQSPLLPAWRTLSVSEHAPGLPGLPSTAAEVEAQREHQAAKRACSACAGTFGEDTSALPAPGGGGSGGDPT

SEQ ID NO: 906543 - protein, 924 aa, Homo sapiens
ARPRGLGRIPELQLVAFPVAVAAEDEAFLPEPLAPRAPRRPRSPPSSPVFFASPSPTFRRRLRLLRSCQDLGRQAWAGAGFEAENGPTPSPGRSPLDSQASPGLVLHAGAATSQRRESFLYRSDSDYDMSPKTMSRNSSVTSEAHAEDLIVTPFAQVLASLRSVRSNFSLLTNVPVPSNKRSPLGGPTPVCKATLSEETCQQLARETLEELDWCLEQLETMQTYRSVSEMASHKFKRMLNRELTHLSEMSRSGNQVSEYISTTFLDKQNEVEIPSPTMKEREKQQAPRPRPSQPPPPPVPHLQPMSQITGLKKLMHSNSLNNSNIPRFGVKTDQEELLAQELENLNKWGLNIFCVSDYAGGRSLTCIMYMIFQERDLLKKFRIPVDTMVTYMLTLEDHYHADVAYHNSLHAADVLQSTHVLLATPALDAVFTDLEILAALFAAAIHDVDHPGVSNQFLINTNSELALMYNDESVLENHHLAVGFKLLQEDNCDIFQNLSKRQRQSLRKMVIDMVGGAGAGRSGKGSLGVEGFGEEWAESQRNPQPGQSGRLLPGENFRGPGQSGGRVSAAPVTPPCPQVLATDMSKHMTLLADLKTMVETKKVTSSGVLLLDNYSDRIQVLRNMVHCADLSNPTKPLELYRQWTDRIMAEFFQQGDRERERGMEISPMCDKHTASVEKSQVGFIDYIVHPLWETWADLVHPDAQEILDTLEDNRDWYYSAIRQSPSPPPEEESRGPGHPPLPDKFQFELTLEEEEEEEISMAQIPCTAQEALTAQGLSGVEEALDATIAWEASPAQESLEVMAQEASLEAELEAVYLTQQAQSTGSAPVAPDEFSSREEFVVAVSHSSPSALALQSPLLPAWRTLSVSEHAPGLPGLPSTAAEVEAQREHQAAKRACSACAGTFGEDTSALPAPGGGGSGGDPT

SEQ ID NO: 906544 - protein, 679 aa, Homo sapiens
MPLVDFFCETCSKPWLVGWWDQFKRMLNRELTHLSEMSRSGNQVSEYISTTFLDKQNEVEIPSPTMKEREKQQAPRPRPSQPPPPPVPHLQPMSQITGLKKLMHSNSLNNSNIPRFGVKTDQEELLAQELENLNKWGLNIFCVSDYAGGRSLTCIMYMIFQVMGTAGSGPGRGAHSGALEAGGGHHPAPACSQERDLLKKFRIPVDTMVTYMLTLEDHYHADVAYHNSLHAADVLQSTHVLLATPALDAVFTDLEILAALFAAAIHDVDHPGVSNQFLINTNSELALMYNDESVLENHHLAVGFKLLQEDNCDIFQNLSKRQRQSLRKMVIDMVLATDMSKHMTLLADLKTMVETKKVTSSGVLLLDNYSDRIQVLRNMVHCADLSNPTKPLELYRQWTDRIMAEFFQQGDRERERGMEISPMCDKHTASVEKSQVGFIDYIVHPLWETWADLVHPDAQEILDTLEDNRDWYYSAIRQSPSPPPEEESRGPGHPPLPDKFQFELTLEEEEEEEISMAQIPCTAQEALTAQGLSGVEEALDATIAWEASPAQESLEVMAQEASLEAELEAVYLTQQAQSTGSAPVAPDEFSSREEFVVAVSHSSPSALALQSPLLPAWRTLSVSEHAPGLPGLPSTAAEVEAQREHQAAKRACSACAGTFGEDTSALPAPGGGGSGGDPT

SEQ ID NO: 906545 - protein, 266 aa, Homo sapiens
MSDPSQLTQNVCLTQEMELSKAFSGQRTLLSAILSMLSLSFSTTSLLSNYWFVGTQKVPKPLCEKGLAAKCFDMPVSLDGDTNTSTQEVVQYNWETGDDRFSFRSFRSGMWLSCEETVEEPALLHPQSWKQFRALRSSGTAAAKGERCRSFIELTPPAKREILWLSLGTQITYIGLQFISFLLLLTDLLLTGNPACGLKLSAFAAVSSVLSGLLGMVAHMMYSQVFQATVNLGPEDWRPHVWNYGWAFYLACSLPRPLGVAVPLPY

SEQ ID NO: 906546 - protein, 165 aa, Homo sapiens
MSDPSQLTQNVCLTQEMELSKAFSGQRTLLSAILSMLSLSFSTTSLLSNYWFVGTQKVPKPLCEKGLAAKCFDMPVSLDGDTNTSTQEVVQYNWETGDDRFSFRSFRSGMWLSCEETVEEPALLHPQSWKQFRALRSSGTAAAKGRGAQVSLNLHHHTRGGEEDL

SEQ ID NO: 906547 - protein, 321 aa, Homo sapiens
MSDPSQLTQNVCLTQEMELSKAFSGQRTLLSAILSMLSLSFSTTSLLSNYWFVGTQKVPKPLCEKGLAAKCFDMPVSLDGDTNTSTQEVVQYNWETGDDRFSFRSFRSGMWLSCEETVEEPALLHPQSWKQFRALRSSGTAAAKGERCRSFIELTPPAKRGEKGLLEFATLQGPCHPTLRFGGKRLMEKASLPSPPLGLCGKNPMVIPGNADHLHRTSIHQLPPATNRLATHWEPCLWAQTERLCCCFLCPVRSPGDGGPHDVFTSLPSDCQLGSRRLETTCLELWLGLLHGLALLHLLHGVGCHHLQHVHQDGAGVQVQA

SEQ ID NO: 906548 - protein, 362 aa, Homo sapiens
MSDPSQLTQNVCLTQEMELSKAFSGQRTLLSAILSMLSLSFSTTSLLSNYWFVGTQKVPKPLCEKGLAAKCFDMPVSLDGDTNTSTQEVVQYNWETGDDRFSFRSFRSGMWLSCEETVEEPALLHPQSWKQFRALRSSGTAAAKGERCRSFIELTPPAKREILWLSLGTQITYIGLQFISFLLLLTDLLLTGNPACGLKLSAFAAVSSVLSGLLGMVAHMMYSQVFQATVNLGPEDWRPHVWNYGWAFYMAWLSFTCCMASAVTTFNTYTRMVLEFKCKHSKSFKENPNCLPHHHQCFPRRLSSAAPTVGPLTSYHQYHNQPIHSVSEGVDFYSELRNKGFQRGASQELKEAVRSSVEEEQC

SEQ ID NO: 906549 - protein, 345 aa, Homo sapiens
MSDPSQLTQNVCLTQEMELSKAFSGQRTLLSAILSMLSLSFSTTSLLSNYWFVGTQKVPKPLCEKGLAAKCFDMPVSLDGDTNTSTQEVVQYNWETGDDRFSFRSFRSGMWLSCEETVEEPAKSEMEEELKKCVYLHLYLLLCHLALLHPQSWKQFRALRSSGTAAAKGERCRSFIELTPPAKRGEKGLLEFATLQGPCHPTLRFGGKRLMEKASLPSPPLGLCGKNPMVIPGNADHLHRTSIHQLPPATNRLATHWEPCLWAQTERLCCCFLCPVRSPGDGGPHDVFTSLPSDCQLGSRRLETTCLELWLGLLHGLALLHLLHGVGCHHLQHVHQDGAGVQVQA

SEQ ID NO: 906550 - protein, 339 aa, Homo sapiens
MSDPSQLTQNVCLTQEMELSKAFSGQRTLLSAILSMLSLSFSTTSLLSNYWFVGTQKVPKPLCEKGLAAKCFDMPVSLDGDTNTSTQEVVQYNWETGDDRFSFRSFRSGMWLSCEETVEEPGERCRSFIELTPPAKREILWLSLGTQITYIGLQFISFLLLLTDLLLTGNPACGLKLSAFAAVSSVLSGLLGMVAHMMYSQVFQATVNLGPEDWRPHVWNYGWAFYMAWLSFTCCMASAVTTFNTYTRMVLEFKCKHSKSFKENPNCLPHHHQCFPRRLSSAAPTVGPLTSYHQYHNQPIHSVSEGVDFYSELRNKGFQRGASQELKEAVRSSVEEEQC

SEQ ID NO: 906551 - protein, 386 aa, Homo sapiens
MSDPSQLTQNVCLTQEMELSKAFSGQRTLLSAILSMLSLSFSTTSLLSNYWFVGTQKVPKPLCEKGLAAKCFDMPVSLDGDTNTSTQEVVQYNWETGDDRFSFRSFRSGMWLSCEETVEEPAKSEMEEELKKCVYLHLYLLLCHLALLHPQSWKQFRALRSSGTAAAKGERCRSFIELTPPAKREILWLSLGTQITYIGLQFISFLLLLTDLLLTGNPACGLKLSAFAAVSSVLSGLLGMVAHMMYSQVFQATVNLGPEDWRPHVWNYGWAFYMAWLSFTCCMASAVTTFNTYTRMVLEFKCKHSKSFKENPNCLPHHHQCFPRRLSSAAPTVGPLTSYHQYHNQPIHSVSEGVDFYSELRNKGFQRGASQELKEAVRSSVEEEQC

SEQ ID NO: 906552 - protein, 275 aa, Homo sapiens
MAKMELSKAFSGQRTLLSAILSMLSLSFSTTSLLSNYWFVGTQKVPKPLCEKGLAAKCFDMPVSLDGDTNTSTQEVVQYNWETGDDRFSFRSFRSGMWLSCEETVEEPGERCRSFIELTPPAKRGLLGMVAHMMYSQVFQATVNLGPEDWRPHVWNYGWAFYMAWLSFTCCMASAVTTFNTYTRMVLEFKCKHSKSFKENPNCLPHHHQCFPRRLSSAAPTVGPLTSYHQYHNQPIHSVSEGVDFYSELRNKGFQRGASQELKEAVRSSVEEEQC

SEQ ID NO: 906553 - protein, 237 aa, Homo sapiens
MAKMELSKAFSGQRTLLSAILSMLSLSFSTTSLLSNYWFVGTQKVPKPLCEKGLAAKCFDMPVSLDGDTNTSTQEVVQYNWETGDDRFSFRSFRSGMWLSCEETVEEPGERCRSFIELTPPAKRGEKGLLEFATLQGPCHPTLRFGGKRLMEKASLPSPPLGLCGKTDLLLTGNPACGLKLSAFAAVSSVLSGLLGMVAHMMYSQVFQATVNLGPEDWRPHVWNYGWAFYMAGLLQL

SEQ ID NO: 906554 - protein, 285 aa, Homo sapiens
MAKMELSKAFSGQRTLLSAILSMLSLSFSTTSLLSNYWFVGTQKVPKPLCEKGLAAKCFDMPVSLDGDTNTSTQEVVQYNWETGDDRFSFRSFRSGMWLSCEETVEEPGERCRSFIELTPPAKRGEKGLLEFATLQGPCHPTLRFGGKRLMEKASLPSPPLGLCGKNPMVIPGNADHLHRTSIHQLPPATNRLATHWEPCLWAQTERLCCCFLCPVRSPGDGGPHDVFTSLPSDCQLGSRRLETTCLELWLGLLHGLALLHLLHGVGCHHLQHVHQDGAGVQVQA

SEQ ID NO: 906555 - protein, 298 aa, Homo sapiens
MSDPSQLTQNVCLTQEMELSKAFSGQRTLLSAILSMLSLSFSTTSLLSNYWFVGTQKVPKPLCEKGLAAKCFDMPVSLDGDTNTSTQEVVQYNWETGDDRFSFRSFRSGMWLSCEETVEEPGERCRSFIELTPPAKRGEKGLLEFATLQGPCHPTLRFGGKRLMEKASLPSPPLGLCGKNPMVIPGNADHLHRTSIHQLPPATNRLATHWEPCLWAQTERLCCCFLCPVRSPGDGGPHDVFTSLPSDCQLGSRRLETTCLELWLGLLHGLALLHLLHGVGCHHLQHVHQDGAGVQVQA

SEQ ID NO: 906556 - protein, 326 aa, Homo sapiens
MAKMELSKAFSGQRTLLSAILSMLSLSFSTTSLLSNYWFVGTQKVPKPLCEKGLAAKCFDMPVSLDGDTNTSTQEVVQYNWETGDDRFSFRSFRSGMWLSCEETVEEPGERCRSFIELTPPAKREILWLSLGTQITYIGLQFISFLLLLTDLLLTGNPACGLKLSAFAAVSSVLSGLLGMVAHMMYSQVFQATVNLGPEDWRPHVWNYGWAFYMAWLSFTCCMASAVTTFNTYTRMVLEFKCKHSKSFKENPNCLPHHHQCFPRRLSSAAPTVGPLTSYHQYHNQPIHSVSEGVDFYSELRNKGFQRGASQELKEAVRSSVEEEQC

SEQ ID NO: 906557 - protein, 308 aa, Homo sapiens
MAKMELSKAFSGQRTLLSAILSMLSLSFSTTSLLSNYWFVGTQKVPKPLCEKGLAAKCFDMPVSLDGDTNTSTQEVVQYNWETGDDRFSFRSFRSGMWLSCEETVEEPALLHPQSWKQFRALRSSGTAAAKGERCRSFIELTPPAKRGEKGLLEFATLQGPCHPTLRFGGKRLMEKASLPSPPLGLCGKNPMVIPGNADHLHRTSIHQLPPATNRLATHWEPCLWAQTERLCCCFLCPVRSPGDGGPHDVFTSLPSDCQLGSRRLETTCLELWLGLLHGLALLHLLHGVGCHHLQHVHQDGAGVQVQA

SEQ ID NO: 906558 - protein, 349 aa, Homo sapiens
MAKMELSKAFSGQRTLLSAILSMLSLSFSTTSLLSNYWFVGTQKVPKPLCEKGLAAKCFDMPVSLDGDTNTSTQEVVQYNWETGDDRFSFRSFRSGMWLSCEETVEEPALLHPQSWKQFRALRSSGTAAAKGERCRSFIELTPPAKREILWLSLGTQITYIGLQFISFLLLLTDLLLTGNPACGLKLSAFAAVSSVLSGLLGMVAHMMYSQVFQATVNLGPEDWRPHVWNYGWAFYMAWLSFTCCMASAVTTFNTYTRMVLEFKCKHSKSFKENPNCLPHHHQCFPRRLSSAAPTVGPLTSYHQYHNQPIHSVSEGVDFYSELRNKGFQRGASQELKEAVRSSVEEEQC

SEQ ID NO: 906559 - protein, 396 aa, Homo sapiens
MSHGWSKPKVEIDFLLDCYCFGGSHMINFLNNEMKEEIAGDYPVKRQQTEMELSKAFSGQRTLLSAILSMLSLSFSTTSLLSNYWFVGTQKVPKPLCEKGLAAKCFDMPVSLDGDTNTSTQEVVQYNWETGDDRFSFRSFRSGMWLSCEETVEEPALLHPQSWKQFRALRSSGTAAAKGERCRSFIELTPPAKREILWLSLGTQITYIGLQFISFLLLLTDLLLTGNPACGLKLSAFAAVSSVLSGLLGMVAHMMYSQVFQATVNLGPEDWRPHVWNYGWAFYMAWLSFTCCMASAVTTFNTYTRMVLEFKCKHSKSFKENPNCLPHHHQCFPRRLSSAAPTVGPLTSYHQYHNQPIHSVSEGVDFYSELRNKGFQRGASQELKEAVRSSVEEEQC

SEQ ID NO: 906560 - protein, 213 aa, Homo sapiens
MSDPSQLTQNVCLTQEMELSKAFSGQRTLLSAILSMLSLSFSTTSLLSNYWFVGTQKVPKPLCEKGLAAKCFDMPVSLDGDTNTSTQEVVQYNWETGDDRFSFRSFRSGMWLSCEETVEEPALLHPQSWKQFRSFKENPNCLPHHHQCFPRRLSSAAPTVGPLTSYHQYHNQPIHSVSEGVDFYSELRNKGFQRGASQELKEAVRSSVEEEQC

SEQ ID NO: 906561 - protein, 597 aa, Homo sapiens
KTSDSSHRPSRHGFLFLRLVGLSPFSYLCVPPSRPVPGSPRSLSAMRLLPLAPGRLRRGSPRHLPSCSPALLLLVLGGCLGVFGVAAGTRRPNVVLLLTDDQDEVLGGMTPLKKTKALIGEMGMTFSSAYVPSALCCPSRASILTGKYPHNHHVVNNTLEGNCSSKSWQKIQEPNTFPAILRSMCGYQTFFAGKYLNEYGAPDAGGLEHVPLGWSYWYALEKNSKYYNYTLSINGKARKHGENYSVDYLTDVLANVSLDFLDYKSNFEPFFMMIATPAPHSPWTAAPQYQKAFQNVFAPRNKNFNIHGTNKHWLIRQAKTPMTNSSIQFLDNAFRKRWQTLLSVDDLVEKLVKRLEFTGELNNTYIFYTSDNGYHTGQFSLPIDKRQLYEFDIKVPLLVRGPGIKPNQTSKMLVANIDLGPTILDIAGYDLNKTQMDGMSLLPILRGASNLTWRSDVLVEYQGEGRNVTDPTCPSLSPGVSQCFPDCVCEDAYNNTYACVRTMSALWNLQYCEFDDQEVFVEVYNLTADPDQITNIAKTIDPELLGKMNYRLMMLQSCSGPTCRTPGVFDPGYRFDPRLMFSNRGSVRTRRFSKHLL

SEQ ID NO: 906562 - protein, 597 aa, Homo sapiens; identical to SEQ ID NO: 906561

SEQ ID NO: 906563 - protein, 186 aa, Homo sapiens [sequence omitted]

SEQ ID NO: 906564 - protein, 597 aa, Homo sapiens; identical to SEQ ID NO: 906561

SEQ ID NO: 906565 - protein, 597 aa, Homo sapiens; identical to SEQ ID NO: 906561

SEQ ID NO: 906566 - protein, 577 aa, Homo sapiens
KTSDSSHRPSRHGFLFLRLVGLSPFSYLCVPPSRPVPGSPRSLSAMRLLPLAPGRLRRGSPRHLPSCSPALLLLVLGGCLGVFGVAAGTRRPNVVLLLTDDQDEVLGGMYVPSALCCPSRASILTGKYPHNHHVVNNTLEGNCSSKSWQKIQEPNTFPAILRSMCGYQTFFAGKYLNEYGAPDAGGLEHVPLGWSYWYALEKNSKYYNYTLSINGKARKHGENYSVDYLTDVLANVSLDFLDYKSNFEPFFMMIATPAPHSPWTAAPQYQKAFQNVFAPRNKNFNIHGTNKHWLIRQAKTPMTNSSIQFLDNAFRKRWQTLLSVDDLVEKLVKRLEFTGELNNTYIFYTSDNGYHTGQFSLPIDKRQLYEFDIKVPLLVRGPGIKPNQTSKMLVANIDLGPTILDIAGYDLNKTQMDGMSLLPILRGASNLTWRSDVLVEYQGEGRNVTDPTCPSLSPGVSQCFPDCVCEDAYNNTYACVRTMSALWNLQYCEFDDQEVFVEVYNLTADPDQITNIAKTIDPELLGKMNYRLMMLQSCSGPTCRTPGVFDPGYRFDPRLMFSNRGSVRTRRFSKHLL

SEQ ID NO: 906567 - protein, 597 aa, Homo sapiens; identical to SEQ ID NO: 906561

SEQ ID NO: 906568 - protein, 597 aa, Homo sapiens; identical to SEQ ID NO: 906561

SEQ ID NO: 906569 - protein, 622 aa, Homo sapiens
MEESEPERKRARTDEVPAGGSRSEAEDEDDEDYVPYVPLRQRRQLLLQKLLQRRRKGAAEEEQQDSGSEPRGDEDDIPLGPQSNVSLLDQHQHLKEKAEARKESAKEKQLKEEEKILESVAEGRALMSVKEMAKGITYDDPIKTSWTPPRYVLSMSEERHERVRKKYHILVEGDGIPPPIKSFKEMKFPAAILRGLKKKGIHHPTPIQIQGIPTILSGRDMIGIAFTGSGKTLVFTLPVIMFCLEQEKRLPFSKREGPYGLIICPSRELARQTHGILEYYCRLLQEDSSPLLRCALCIGGMSVKEQMETIRHGVHMMVATPGRLMDLLQKKMVSLDICRYLALDEADRMIDMGFEGDIRTIFSYFKGQRQTLLFSATMPKKIQNFAKSALVKPVTINVGRAGAASLDVIQEVEYVKEEAKMVYLLECLQKTPPPVLIFAEKKADVDAIHEYLLLKGVEAVAIHGGKDQEERTKAIEAFREGKKDVLVATDVASKGLDFPAIQHVINYDMPEEIENYVHRIGRTGRSGNTGIATTFINKACDESVLMDLKALLLEAKQKVPPVLQVLHCGDESMLDIGGERGCAFCGGLGHRITDCPKLEAMQTKQVSNIGRKDYLAHSSMDF

SEQ ID NO: 906570 - protein, 42 aa, Homo sapiens
MPKKIQNFAKSALVKPVTINVGRAGAASLDVIQVGSAPDGRS

SEQ ID NO: 906571 - protein, 683 aa, Homo sapiens
GRLLLNSRPPGRMEESEPERKRARTDEVPAGGSRSEAEDEDDEDYVPYVPLRQRRQLLLQKLLQRRRKGAAEEEQQDSGSEPRGDEDDIPLGPQSNVSLLDQHQHLKEKAEARKESAKEKQLKEEEKILESVAEGRALMSVKEMAKGITYDDPIKTSWTPPRYVLSMSEERHERVRKKYHILVEGDGIPPPIKSFKEMKFPAAILRGLKKKGIHHPTPIQIQGIPTILSGRDMIGIAFTGSGKTLVFTLPVIMFCLEQEKRLPFSKREGPYGLIICPSRELARQTHGILEYYCRLLQEDSSPLLRCALCIGGMSVKEQMETIRQWVLALPAPHLCHLRVCGKAKGPFTLATPQIFTEGCCECDPQGAPSLMGSGVHMMVATPGRLMDLLQKKMVSLDICRYLALDEADRMIDMGFEGDIRTIFSYFKGQRQTLLFSATMPKKIQNFAKSALVKPVTINVGRAGAASLDVIQEVEYVKEEAKMVYLLECLQKTPPPVLIFAEKKADVDAIHEYLLLKGVEAVAIHGGKDQEERTKAIEAFREGKKDVLVATDVASKGLDFPAIQHVINYDMPEEIENYVHRIGRTGRSGNTGIATTFINKACDESVLMDLKALLLEAKQKVPPVLQVLHCGDESMLDIGGERGCAFCGGLGHRITDCPKLEAMQTKQVSNIGRKDYLAHSSMDF

SEQ ID NO: 906572 - protein, 678 aa, Homo sapiens
GRLLLNSRPPGRMEESEPERKRARTDEVPAGGSRSEAEDEDDEDYVPYVPLRQRRQLLLQKLLQRRRKGAAEEEQQDSGSEPRGDEDDIPLGPQSNVSLLDQHQHLKEKAEARKESAKEKQLKEEEKILESVAEGRALMSVKEMAKGITYDDPIKTSWTPPRYVLSMSEERHERVRKKYHILVEGDGIPPPIKSFKEMKFPAAILRGLKKKGIHHPTPIQIQGIPTILSGRDMIGIAFTGSGKTLVFTLPVIMFCLEQEKRLPFSKREGPYGLIICPSRELARQTHGILEYYCRLLQEDSSPLLRCALCIGGMSVKEQMETIRHGVHMMVATPGRLMDLLQKKMVSLDICRYLALDEADRMIDMGFEGDIRTIFSYFKGQRQTLLFSATMPKKIQNFAKSALVKPVTINVGRAGAASLDVIQEVEYVKEEAKMVYLLECLQKTPPPVLIFAEKKADVDAIHEYLLLKGVEAVAIHGGKGQGGASTGLDPAAVAALYLMPSPAGWPATPLSHGGSDSVCLTLPNQEERTKAIEAFREGKKDVLVATDVASKGLDFPAIQHVINYDMPEEIENYVHRIGRTGRSGNTGIATTFINKACDESVLMDLKALLLEAKQKVPPVLQVLHCGDESMLDIGGERGCAFCGGLGHRITDCPKLEAMQTKQVSNIGRKDYLAHSSMDF

SEQ ID NO: 906573 - protein, 664 aa, Homo sapiens
MRRGFAVARMRAAKNGGVGTRTEGRREARPRACGSGREEGSRPCLTGVCLQRARTDEVPAGGSRSEAEDEDDEDYVPYVPLRQRRQLLLQKLLQRRRKGAAEEEQQDSGSEPRGDEDDIPLGPQSNVSLLDQHQHLKEKAEARKESAKEKQLKEEEKILESVAEGRALMSVKEMAKGITYDDPIKTSWTPPRYVLSMSEERHERVRKKYHILVEGDGIPPPIKSFKEMKFPAAILRGLKKKGIHHPTPIQIQGIPTILSGRDMIGIAFTGSGKTLVFTLPVIMFCLEQEKRLPFSKREGPYGLIICPSRELARQTHGILEYYCRLLQEDSSPLLRCALCIGGMSVKEQMETIRHGVHMMVATPGRLMDLLQKKMVSLDICRYLALDEADRMIDMGFEGDIRTIFSYFKGQRQTLLFSATMPKKIQNFAKSALVKPVTINVGRAGAASLDVIQEVEYVKEEAKMVYLLECLQKTPPPVLIFAEKKADVDAIHEYLLLKGVEAVAIHGGKDQEERTKAIEAFREGKKDVLVATDVASKGLDFPAIQHVINYDMPEEIENYVHRIGRTGRSGNTGIATTFINKACDESVLMDLKALLLEAKQKVPPVLQVLHCGDESMLDIGGERGCAFCGGLGHRITDCPKLEAMQTKQVSNIGRKDYLAHSSMDF

SEQ ID NO: 906574 - protein, 757 aa, Homo sapiens
MRRGFAVARMRAAKNGGVGTRTEGRREARPRACGSGREEGSRPCLTGVCLQRARTDEVPAGGSRSEAEDEDDEDYVPYVPLRQRRQLLVRGTRPGRDGAVTAGSQGAGVASASVEEEGSLRSELQYTRARPPDKRGTDGLICGVGQLCASGTGSSPQSQDPDADLVDSTAHPICGSRVEPQLQKLLQRRRKGAAEEEQQDSGSEPRGDEDDIPLGPQSNVSLLDQHQHLKEKAEARKESAKEKQLKEEEKILESVAEGRALMSVKEMAKGITYDDPIKTSWTPPRYVLSMSEERHERVRKKYHILVEGDGIPPPIKSFKEMKFPAAILRGLKKKGIHHPTPIQIQGIPTILSGRDMIGIAFTGSGKTLVFTLPVIMFCLEQEKRLPFSKREGPYGLIICPSRELARQTHGILEYYCRLLQEDSSPLLRCALCIGGMSVKEQMETIRHGVHMMVATPGRLMDLLQKKMVSLDICRYLALDEADRMIDMGFEGDIRTIFSYFKGQRQTLLFSATMPKKIQNFAKSALVKPVTINVGRAGAASLDVIQEVEYVKEEAKMVYLLECLQKTPPPVLIFAEKKADVDAIHEYLLLKGVEAVAIHGGKDQEERTKAIEAFREGKKDVLVATDVASKGLDFPAIQHVINYDMPEEIENYVHRIGRTGRSGNTGIATTFINKACDESVLMDLKALLLEAKQKVPPVLQVLHCGDESMLDIGGERGCAFCGGLGHRITDCPKLEAMQTKQVSNIGRKDYLAHSSMDF

SEQ ID NO: 906575 - protein, 447 aa, Homo sapiens
GRLLLNSRPPGRMEESEPERKRARTDEVPAGGSRSEAEDEDDEDYVPYVPLRQRRQLLLQKLLQRRRKGAAEEEQQDSGSEPRGDEDDIPLGPQSNVSLLDQHQHLKEKAEARKESAKEKQLKEEEKILESVAEGRALMSVKEMAKGITYDDPIKTSWTPPRYVLSMSEERHERVRKKYHILVEGDGIPPPIKSFKEMKFPAAILRGLKKKGIHHPTPIQIQGIPTILSGRDMIGIAFTGSGKTLVFTLPVIMFCLEQEKRLPFSKREGPYGLIICPSRELARQTHGILEYYCRLLQEDSSPLLRCALCIGGMSVKEQMETIRHGVHMMVATPGRLMDLLQKKMVSLDICRYLALDEADRMIDMGFEGDIRTIFSYFKGQRQTLLFSATMPKKIQNFAKSALVKPVTINVGRAGDNIMLSPNTRYESINTDIQLTSCYRAILVSLKG

SEQ ID NO: 906576 - protein, 274 aa, Homo sapiens
MIDMGFEGDIRTIFSYFKGQRQTLLFSATMPKKIQNFAKSALVKPVTINVGRAGAASLDVIQEVEYVKEEAKMVYLLECLQKTPPPVLIFAEKKADVDAIHEYLLLKGVEAVAIHGGKDQEERTKAIEAFREGKKDVLVATDVASKGLDFPAIQHVINYDMPEEIENYVHRIGRTGRSGNTGIATTFINKACDESVLMDLKALLLEAKQKVPPVLQVLHCGDESMLDIGGERGCAFCGGLGHRITDCPKLEAMQTKQVSNIGRKDYLAHSSMDF

SEQ ID NO: 906577 - protein, 114 aa, Homo sapiens
MPEEIENYVHRIGRTGRSGNTGIATTFINKACDESVLMDLKALLLEAKQKVPPVLQVLHCGDESMLDIGGERGCAFCGGLGHRITDCPKLEAMQTKQVSNIGRKDYLAHSSMDF

SEQ ID NO: 906578 - protein, 90 aa, Homo sapiens
MKTMSVGFHSHPERPEEERHSPPNTHSDPGHPHHVSVDCGPGVLEEGWNREEQWLGVLHLLLKLALGSSSPNSLSGRDMIGIAFTGSGKT

SEQ ID NO: 906579 - protein, 159 aa, Homo sapiens
ADVTVEGCTGALHILARDPMNRMEIFRLNTIPLFVQLLYSSVENIQRVAAGVLCELAQDKEAADAIDAEGASAPLMELLHSRNEGTATYAAAVLFRISEDKNPDYRKRVSVELTNSLFKHDPGCLGHRITDCPKLEAMQTKQVSNIGRKDYLAHSSMDF

SEQ ID NO: 906580 - protein, 634 aa, Homo sapiens
GRLLLNSRPPGRMEESEPERKRARTDEVPAGGSRSEAEDEDDEDYVPYVPLRQRRQLLLQKLLQRRRKGAAEEEQQDSGSEPRGDEDDIPLGPQSNVSLLDQHQHLKEKAEARKESAKEKQLKEEEKILESVAEGRALMSVKEMAKGITYDDPIKTSWTPPRYVLSMSEERHERVRKKYHILVEGDGIPPPIKSFKEMKFPAAILRGLKKKGIHHPTPIQIQGIPTILSGRDMIGIAFTGSGKTLVFTLPVIMFCLEQEKRLPFSKREGPYGLIICPSRELARQTHGILEYYCRLLQEDSSPLLRCALCIGGMSVKEQMETIRHGVHMMVATPGRLMDLLQKKMVSLDICRYLALDEADRMIDMGFEGDIRTIFSYFKGQRQTLLFSATMPKKIQNFAKSALVKPVTINVGRAGAASLDVIQEVEYVKEEAKMVYLLECLQKTPPPVLIFAEKKADVDAIHEYLLLKGVEAVAIHGGKDQEERTKAIEAFREGKKDVLVATDVASKGLDFPAIQHVINYDMPEEIENYVHRIGRTGRSGNTGIATTFINKACDESVLMDLKALLLEAKQKVPPVLQVLHCGDESMLDIGGERGCAFCGGLGHRITDCPKLEAMQTKQVSNIGRKDYLAHSSMDF

SEQ ID NO: 906581 - protein, 673 aa, Homo sapiens
GRLLLNSRPPGRMEESEPERKRARTDEVPAGGSRSEAEDEDDEDYVPYVPLRQRRQLLLQKLLQRRRKGAAEEEQQDSGSEPRGDEDDIPLGPQSNVSLLDQHQHLKEKAEARKESAKEKQLKEEEKILESVAEGRALMSVKEMAKGITYDDPIKTSWTPPRYVLSMSEERHERVRKKYHILVEGDGIPPPIKSFKEMKFPAAILRGLKKKGIHHPTPIQIQGIPTILSGRDMIGIAFTGSGKTLVFTLPVIMFCLEQEKRLPFSKREGPYGLIICPSRELARQTHGILEYYCRLLQEDSSPLLRCALCIGGMSVKEQMETIRHAVQSSADHQRPWTRPSVHRWARPHPGGLPPRTSEYVGRCGVHMMVATPGRLMDLLQKKMVSLDICRYLALDEADRMIDMGFEGDIRTIFSYFKGQRQTLLFSATMPKKIQNFAKSALVKPVTINVGRAGAASLDVIQEVEYVKEEAKMVYLLECLQKTPPPVLIFAEKKADVDAIHEYLLLKGVEAVAIHGGKDQEERTKAIEAFREGKKDVLVATDVASKGLDFPAIQHVINYDMPEEIENYVHRIGRTGRSGNTGIATTFINKACDESVLMDLKALLLEAKQKVPPVLQVLHCGDESMLDIGGERGCAFCGGLGHRITDCPKLEAMQTKQVSNIGRKDYLAHSSMDF

SEQ ID NO: 906582 - protein, 634 aa, Homo sapiens; identical to SEQ ID NO: 906580

SEQ ID NO: 906583 - protein, 402 aa, Homo sapiens
MIGIAFTGSGKTLVFTLPVIMFCLEQEKRLPFSKREGPYGLIICPSRELARQTHGILEYYCRLLQEDSSPLLRCALCIGGMSVKEQMETIRHGVHMMVATPGRLMDLLQKKMVSLDICRYLALDEADRMIDMGFEGDIRTIFSYFKGQRQTLLFSATMPKKIQNFAKSALVKPVTINVGRAGAASLDVIQEVEYVKEEAKMVYLLECLQKTPPPVLIFAEKKADVDAIHEYLLLKGVEAVAIHGGKDQEERTKAIEAFREGKKDVLVATDVASKGLDFPAIQHVINYDMPEEIENYVHRIGRTGRSGNTGIATTFINKACDESVLMDLKALLLEAKQKVPPVLQVLHCGDESMLDIGGERGCAFCGGLGHRITDCPKLEAMQTKQVSNIGRKDYLAHSSMDF

SEQ ID NO: 906584 - protein, 382 aa, Homo sapiens
MFCLEQEKRLPFSKREGPYGLIICPSRELARQTHGILEYYCRLLQEDSSPLLRCALCIGGMSVKEQMETIRHGVHMMVATPGRLMDLLQKKMVSLDICRYLALDEADRMIDMGFEGDIRTIFSYFKGQRQTLLFSATMPKKIQNFAKSALVKPVTINVGRAGAASLDVIQEVEYVKEEAKMVYLLECLQKTPPPVLIFAEKKADVDAIHEYLLLKGVEAVAIHGGKDQEERTKAIEAFREGKKDVLVATDVASKGLDFPAIQHVINYDMPEEIENYVHRIGRTGRSGNTGIATTFINKACDESVLMDLKALLLEAKQKVPPVLQVLHCGDESMLDIGGERGCAFCGGLGHRITDCPKLEAMQTKQVSNIGRKDYLAHSSMDF

SEQ ID NO: 906585 - protein, 200 aa, Homo sapiens
GRLLLNSRPPGRMEESEPERKRARTDEVPAGGSRSEAEDEDDEDYVPYVPLRQRRQLLLQKLLQRRRKGAAEEEQQDSGSEPRGDEDDIPLGPQSNVSLLDQHQHLKEKAEARKESAKEKQLKEEEKILESVAEGRALMSVKEMAKGITYDDPIKTRYVCTVCSCPCLGWYMQGCSQASYSQGSLDPCYPSTAGLHPVMF

SEQ ID NO: 906586 - protein, 368 aa, Homo sapiens
RSAGFFPARVAANAPPPASHPRRPPRPGTNGWSRRGSCRASWSRDCSGVRSRRVALGMAMDQVNALCEQLVKAVTVMMDPNSTQRYRLEALKFCEEFKEKCPICVPCGLRLAEKTQVAIVRHFGLQILEHVVKFRWNGMSRLEKVYLKNSVMELIANGTLNILEEENHIKDALSRIVVEMIKREWPQHWPDMLIELDTLSKQGETQTELVMFILLRLAEDVVTFQTLPPQRRRDIQQTLTQNMERIFSFLLNTLQENVNKYQQVKTDTSQESKAQANCRVGVAALNTLAGYIDWVSMSHITAENCKLLEILCLLLNEQELQLGAAECLLIAVSRKGKLEDRKPLMVLFGDVAMHYILSAAQTADGGGW

SEQ ID NO: 906587 - protein, 1123 aa, Homo sapiens [sequence omitted]

SEQ ID NO: 906588 - protein, 484 aa, Homo sapiens [sequence omitted]

SEQ ID NO: 906589 - protein, 1307 aa, Homo sapiens
RSAGFFPARVAANAPPPASHPRRPPRPGTNGWSRRGSCRASWSRDCSGVRSRRVALGMAMDQVNALCEQLVKAVTVMMDPNSTQRYRLEALKFCEEFKEKCPICVPCGLRLAEKTQVAIVRHFGLQILEHVVKFRWNGMSRLEKVYLKNSVMELIANGTLNILEEENHIKDALSRIVVEMIKREWPQHWPDMLIELDTLSKQGETQTELVMFILLRLAEDVVTFQTLPPQRRRDIQQTLTQNMERIFSFLLNTLQENVNKYQQVKTDTSQESKAQANCRVGVAALNTLAGYIDWVSMSHITAENCKLLEILCLLLNEQELQLGAAECLLIAVSRKGKLEDRKPLMVLFGDVAMHYILSAAQTADGGGLVEKHYVFLKRLCQVLCALGNQLCALLGADSDVETPSNFGKYLESFLAFTTHPSQFLRSSTQMTWGALFRHEILSRDPLLLAIIPKYLRASMTNLVKMGFPSKTDSPSCEYSRFDFDSDEDFNAFFNSSRAQQGEVMRLACRLDPKTSFQMAGEWLKYQLSTFLDAGSVNSCSAVGTGEGSLCSVFSPSFVQWEAMTLFLESVITQMFRTLNREEIPVNDGIELLQMVLNFDTKDPLILSCVLTNVSALFPFVTYRPEFLPQVFSKLFSSVTFETVEESKAPRTRAVRNVRRHACSSIIKMCRDYPQLVLPNFDMLYNHVKQLLSNELLLTQMEKCALMEALVLISNQFKNYERQKVFLEELMAPVASIWLSQDMHRVLSDVDAFIAYVGTDQKSCDPGLEDPCGLNRARMSFCVYSILGVVKRTCWPTDLEEAKAGGFVVGYTSSGNPIFRNPCTEQILKLLDNLLALIRTHNTLYAPEMLAKMAEPFTKALDMLDAEKSAILGLPQPLLELNDSPVFKTVLERMQRFFSTLYENCFHILGKAGPSMQQDFYTVEDLATQLLSSAFVNLNNIPDYRLRPMLRVFVKPLVLFCPPEHYEALVSPILGPLFTYLHMRLSQKWQVINQRSLLCGEDEAADENPESQEMLEEQLVRMLTREVMDLITVCCVSKKGADHSSAPPADGDDEEMMATEVTPSAMAELTDLGKCLMKHEDVCTALLITAFNSLAWKDTLSCQRTTSQLCWPLLKQVWLFTPFPCPSWKVWVMQTDYIIQKNWGAEALREAPCGPKAQLSPQVLSGTLLADAVTWLFTSVLKGLQMHGQHDGCMASLVHLAFQIYEALRPRYLEIRAVMEQIPEIQKDSLDQFDCKLLNPSLQKVADKRRKDQFKRLIAGCIGKPLGEQFRKEVHIKNLPSLFKKTKPMLETEVLDNDGGGLATIFEP

SEQ ID NO: 906590 - protein, 1261 aa, Homo sapiens
RSAGFFPARVAANAPPPASHPRRPPRPGTNGWSRRGSCRASWSRDCSGVRSRRVALGMAMDQVNALCEQLVKAVTVMMDPNSTQRYRLEALKFCEEFKEKCPICVPCGLRLAEKTQVAIVRHFGLQILEHVVKFRWNGMSRLEKVYLKNSVMELIANGTLNILEEENHIKDALSRIVVEMIKREWPQHWPDMLIELDTLSKQGETQTELVMFILLRLAEDVVTFQTLPPQRRRDIQQTLTQNMERIFSFLLNTLQENVNKYQQVKTDTSQESKAQANCRVGVAALNTLAGYIDWVSMSHITAENCKLLEILCLLLNEQELQLGAAECLLIAVSRKGKLEDRKPLMVLFGDVAMHYILSAAQTADGGGLVEKHYVFLKRLCQVLCALGNQLCALLGADSDVETPSNFGKYLESFLAFTTHPSQFLRSSTQMTWGALFRHEILSRDPLLLAIIPKYLRASMTNLVKMGFPSKTDSPSCEYSRFDFDSDEDFNAFFNSSRAQQGEVMRLACRLDPKTSFQMAGEWLKYQLSTFLDAGSVNSCSAVGTGEGSLCSVFSPSFVQWEAMTLFLESVITQMFRTLNREEIPVNDGIELLQMVLNFDTKDPLILSCVLTNVSALFPFVTYRPEFLPQVFSKLFSSVTFETVEESKAPRTRAVRNVRRHACSSIIKMCRDYPQLVLPNFDMLYNHVKQLLSNELLLTQMEKCALMEALVLISNQFKNYERQKVFLEELMAPVASIWLSQDMHRVLSDVDAFIAYVGTDQKSCDPGLEDPCGLNRARMSFCVYSILGVVKRTCWPTDLEEAKAGGFVVGYTSSGNPIFRNPCTEQILKLLDNLLALIRTHNTLYAPEMLAKMAEPFTKALDMLDAEKSAILGLPQPLLELNDSPVFKTVLERMQRFFSTLYENCFHILGKAGPSMQQDFYTVEDLATQLLSSAFVNLNNIPDYRLRPMLRVFVKPLVLFCPPEHYEALVSPILGPLFTYLHMRLSQKWQVINQRSLLCGEDEAADENPESQEMLEEQLVRMLTREVMDLITVCCVSKKGADHSSAPPADGDDEEMMATEVTPSAMAELTDLGKCLMKHEDVCTALLITAFNSLAWKDTLSCQRTTSQLCWPLLKQVLSGTLLADAVTWLFTSVLKGLQMHGQHDGCMASLVHLAFQIYEALRPRYLEIRAVMEQIPEIQKDSLDQFDCKLLNPSLQKVADKRRKDQFKRLIAGCIGKPLGEQFRKEVHIKNLPSLFKKTKPMLETEVLDNDGGGLATIFEP

SEQ ID NO: 906591 - protein, 205 aa, Homo sapiens
MCNNHQRKLCFFFHCNSSSFPVQDVCTALLITAFNSLAWKDTLSCQRTTSQLCWPLLKQVLSGTLLADAVTWLFTSVLKGLQMHGQHDGCMASLVHLAFQIYEALRPRYLEIRAVMEQIPEIQKDSLDQFDCKLLNPSLQKVADKRRKDQFKRLIAGCIGKPLGEQFRKEVHIKNLPSLFKKTKPMLETEVLDNDGGGLATIFEP

SEQ ID NO: 906592 - protein, 1238 aa, Homo sapiens
RSAGFFPARVAANAPPPASHPRRPPRPGTNGWSRRGSCRASWSRDCSGVRSRRVALGMAMDQVNALCEQLVKAVTVMMDPNSTQRYRLEALKFCEEFKEKCPICVPCGLRLAEKTQVAIVRHFGLQILEHVVKFRWNGMSRLEKVYLKNSVMELIANGTLNILEEENHIKDALSRIVVEMIKREWPQHWPDMLIELDTLSKQGETQTELVMFILLRLAEDVVTFQTLPPQRRRDIQQTLTQNMERIFSFLLNTLQENVNKYQQVKTDTSQESKAQANCRVGVAALNTLAGYIDWVSMSHITAENCKLLEILCLLLNEQELQLGAAECLLIAVSRKGKLEDRKPLMVLFGDVAMHYILSAAQTADGGGLVEKHYVFLKRLCQVLCALGNQLCALLGADSDVETPSNFGKYLESFLAFTTHPSQFLRSSTQMTWGALFRHEILSRDPLLLAIIPKYLRASMTNLVKMGFPSKTDSPSCEYSRFDFDSDEDFNAFFNSSRAQQGEVMRLACRLDPKTSFQMAGEWLKYQLSTFLDAGSVNSCSAVGTGEGSLCSVFSPSFVQWEAMTLFLESVITQMFRTLNREEIPVNDGIELLQMVLNFDTKDPLILSCVLTNVSALFPFVTYRPEFLPQVFSKLFSSVTFETVEESKAPRTRAVRNVRRHACSSIIKMCRDYPQLVLPNFDMLYNHVKQLLSNELLLTQMEKCALMEALVLISNQFKNYERQKVFLEELMAPVASIWLSQDMHRVLSDVDAFIAYVGTDQKSCDPGLEDPCGLNRARMSFCVYSILGVVKRTCWPTDLEEAKAGGFVVGYTSSGNPIFRNPCTEQILKLLDNLLALIRTHNTLYAPEMLAKMAEPFTKALDMLDAEKSAILGLPQPLLELNDSPVFKTVLERMQRFFSTLYENCFHILGKAGPSMQQDFYTVEDLATQLLSSAFVNLNNIPDYRLRPMLRVFVKPLVLFCPPEHYEALVSPILGPLFTYLHMRLSQKWQVINQRSLLCGEDEAADENPESQEMLEEQLVRMLTREVMDLITVCCVSKKGADHSSAPPADGDDEEMMATEVTPSAMAELTDLGKCLMKHEDVCTALLITAFNSLAWKDTLSCQRTTSQLCWPLLKQVLSGTLLADAVTWLFTSVLKGLQMHGQHDGCMASLVHLAFQIYEALRPRYLEIRAVMEQIPEIQKDSLDQFDCKLLNPSLQKVADKRRKDQFKRLIAGCIGKPLGEQFRKEVHIKNLPFVADL

SEQ ID NO: 906593 - protein, 74 aa, Homo sapiens
VYHGLHEYSTSILGPLFTYLHMRLSQKWQVINQRSLLCGEDEAADGEVMDLITVCCVSKKGADHSSAPPADGDE

SEQ ID NO: 906594 - protein, 176 aa, Homo sapiens
MLMLSLRMWVQIKSCDPGPGGSVQWEAMTLFLESVITQMFRTLNREEIPVNDGIELLQMVLNFDTKDPLILSCVLTNVSALFPFVTYRPEFLPQVFSKLFSSVTFETVEESKCHLTFHHCQPGKRSRSGAGENRPCAGPEVIILKYQERELGLKLFCLDVPDSSHSTWRFGFSKKS

SEQ ID NO: 906595 - protein, 1052 aa, Homo sapiens
RSAGFFPARVAANAPPPASHPRRPPRPGTNGWSRRGSCRASWSRDCSGVRSRRVALGMAMDQVNALCEQLVKAVTVMMDPNSTQRYRLEALKFCEEFKEKCPICVPCGLRLAEKTQVAIVRHFGLQILEHVVKFRWNGMSRLEKVYLKNSVMELIANGTLNILEEENHIKDALSRIVVEMIKREWPQHWPDMLIELDTLSKQGETQTELVMFILLRLAEDVVTFQTLPPQRRRDIQQTLTQNMERIFSFLLNTLQENVNKYQQVKTDTSQESKAQANCRVGVAALNTLAGYIDWVSMSHITAENCKLLEILCLLLNEQELQLGAAECLLIAVSRKGKLEDRKPLMVLFGDVAMHYILSAAQTADGGGLVEKHYVFLKRLCQVLCALGNQLCALLGADSDVETPSNFGKYLESFLAFTTHPSQFLRSSTQMTWGALFRHEILSRDPLLLAIIPKYLRASMTNLVKMGFPSKTDSPSCEYSRFDFDSDEDFNAFFNSSRAQQGEVMRLACRLDPKTSFQMAGEWLKYQLSTFLDAGSVNSCSAVGTGEGSLCSVFSPSFVQWEAMTLFLESVITQMFRTLNREEIPVNDGIELLQMVLNFDTKDPLILSCVLTNVSALFPFVTYRPEFLPQVFSKLFSSVTFETVEESKAPRTRAVRNVRRHACSSIIKMCRDYPQLVLPNFDMLYNHVKQLLSNELLLTQMEKCALMEALVLISNQFKNYERQKVFLEELMAPVASIWLSQDMHRVLSDVDAFIAYVGTDQKSCDPGLEDPCGLNRARMSFCVYSILGVVKRTCWPTDLEEAKAGGFVVGYTSSGNPIFRNPCTEQILKLLDNLLALIRTHNTLYAPEMLAKMAEPFTKALDMLDAEKSAILGLPQPLLELNDSPVFKTVLERMQRFFSTLYENCFHILGKAGPSMQQDFYTVEDLATQLLSSAFVNLNNIPDYRLRPMLRVFVKPLVLFCPPEHYEALVSPILGPLFTYLHMRLSQKWQVINQRSLLCGEDEAADENPESQEMLEEQLVRMLTREVMDLITVCCVSKKGADHSSAPPADGDE

SEQ ID NO: 906596 - protein, 757 aa, Homo sapiens
RSAGFFPARVAANAPPPASHPRRPPRPGTNGWSRRGSCRASWSRDCSGVRSRRVALGMAMDQVNALCEQLVKAVTVMMDPNSTQRYRLEALKFCEEFKEKCPICVPCGLRLAEKTQVAIVRHFGLQILEHVVKFRWNGMSRLEKVYLKNSVMELIANGTLNILEEENHIKDALSRIVVEMIKREWPQHWPDMLIELDTLSKQGETQTELVMFILLRLAEDVVTFQTLPPQRRRDIQQTLTQNMERIFSFLLNTLQENVNKYQQVKTDTSQESKAQANCRVGVAALNTLAGYIDWVSMSHITAENCKLLEILCLLLNEQELQLGAAECLLIAVSRKGKLEDRKPLMVLFGDVAMHYILSAAQTADGGGLVEKHYVFLKRLCQVLCALGNQLCALLGADSDVETPSNFGKYLESFLAFTTHPSQFLRSSTQMTWGALFRHEILSRDPLLLAIIPKYLRASMTNLVKMGFPSKTDSPSCEYSRFDFDSDEDFNAFFNSSRAQQGEVMRLACRLDPKTSFQMAGEWLKYQLSTFLDAGSVNSCSAVGTGEGSLCSVFSPSFVQWEAMTLFLESVITQMFRTLNREEIPVNDGIELLQMVLNFDTKDPLILSCVLTNVSALFPFVTYRPEFLPQVFSKLFSSVTFETVEESKAPRTRAVRNVRRHACSSIIKMCRDYPQLVLPNFDMLYNHVKQLLSNELLLTQMEKCALMEALVLISNQFKNYERQKVFLEELMAPVASIWLSQDMHRVLSDVDAGRRGTE

SEQ ID NO: 906597 - protein, 1261 aa, Homo sapiens; identical to SEQ ID NO: 906590

SEQ ID NO: 906598 - protein, 76 aa, Homo sapiens
MLYNHVKQLLSNELLLTQMEKCALMEALVLISNQFKNYERQKVFLEELMAPVASIWLSQDMHRVLSDVDAGRRGTE

SEQ ID NO: 906599 - protein, 1042 aa, Homo sapiens
RSAGFFPARVAANAPPPASHPRRPPRPGTNGWSRRGSCRASWSRDCSGVRSRRVALGMAMDQVNALCEQLVKAVTVMMDPNSTQRYRLEALKFCEEFKEKCPICVPCGLRLAEKTQVAIVRHFGLQILEHVVKFRWNGMSRLEKVYLKNSVMELIANGTLNILEEENHIKDALSRIVVEMIKREWPQHWPDMLIELDTLSKQGETQTELVMFILLRLAEDVVTFQTLPPQRRRDIQQTLTQNMERIFSFLLNTLQENVNKYQQVKTDTSQESKAQANCRVGVAALNTLAGYIDWVSMSHITAENCKLLEILCLLLNEQELQLGAAECLLIAVSRKGKLEDRKPLMVLFGDVAMHYILSAAQTADGGGLVEKHYVFLKRLCQVLCALGNQLCALLGADSDVETPSNFGKYLESFLAFTTHPSQFLRSSTQMTWGALFRHEILSRDPLLLAIIPKYLRASMTNLVKMGFPSKTDSPSCEYSRFDFDSDEDFNAFFNSSRAQQGEVMRLACRLDPKTSFQMAGEWLKYQLSTFLDAGSVNSCSAVGTGEGSLCSVFSPSFVQWEAMTLFLESVITQMFRTLNREEIPVNDGIELLQMVLNFDTKDPLILSCVLTNVSALFPFVTYRPEFLPQVFSKLFSSVTFETVEESKAPRTRAVRNVRRHACSSIIKMCRDYPQLVLPNFDMLYNHVKQLLSNELLLTQMEKCALMEALVLISNQFKNYERQKVFLEELMAPVASIWLSQDMHRVLSDVDAFIAYVGTDQKSCDPGLEDPCGLNRARMSFCVYSILGVVKRTCWPTDLEEAKAGGFVVGYTSSGNPIFRNPCTEQILKLLDNLLALIRTHNTLYAPEMLAKMAEPFTKALDMLDAEKSAILGLPQPLLELNDSPVFKTVLERMQRFFSTLYENCFHILGKAGPSMQQDFYTVEDLATQLLSSAFVNLNNIPDYRLRPMLRVFVKPLVLFCPPEHYEALVSPILGPLFTYLHMRLSQKWQVINQRSLLCGEDEAADENPESQEMLEEQLRFAVFQRRVLTTVVLPQQMETMKK

SEQ ID NO: 906600 - protein, 1261 aa, Homo sapiens; identical to SEQ ID NO: 906590

SEQ ID NO: 906601 - protein, 364 aa, Homo sapiens
TPATLYSSALFFFIAVVTTQHYVFIYVFLSYLSPMLECKLPSGKGPIVLYLLSPVTKSVSGAQIFVQQQSNFSICSILCFCLEAPISLMYSLSASLEDQPWAWALCGGGRAPSTTEPPLSLEHSALLCFLRFCQYKIFFSVLKGWSLTFYSLITDEEMMATEVTPSAMAELTDLGKCLMKHEDVCTALLITAFNSLAWKDTLSCQRTTSQLCWPLLKQVLSGTLLADAVTWLFTSVLKGLQMHGQHDGCMASLVHLAFQIYEALRPRYLEIRAVMEQIPEIQKDSLDQFDCKLLNPSLQKVADKRRKDQFKRLIAGCIGKPLGEQFRKEVHIKNLPSLFKKTKPMLETEVLDNDGGGLATIFEP

SEQ ID NO: 906602 - protein, 123 aa, Homo sapiens [sequence omitted]

SEQ ID NO: 906603 - protein, 1088 aa, Homo sapiens
RSAGFFPARVAANAPPPASHPRRPPRPGTNGWSRRGSCRASWSRDCSGVRSRRVALGMAMDQVNALCEQLVKAVTVMMDPNSTQRYRLEALKFCEEFKEKCPICVPCGLRLAEKTQVAIVRHFGLQILEHVVKFRWNGMSRLEKVYLKNSVMELIANGTLNILEEENHIKDALSRIVVEMIKREWPQHWPDMLIELDTLSKQGETQTELVMFILLRLAEDVVTFQTLPPQRRRDIQQTLTQNMERIFSFLLNTLQENVNKYQQVKTDTSQESKAQANCRVGVAALNTLAGYIDWVSMSHITAENCKLLEILCLLLNEQELQLGAAECLLIAVSRKGKLEDRKPLMVLFGDVAMHYILSAAQTADGGGLVEKHYVFLKRLCQVLCALGNQLCALLGADSDVETPSNFGKYLESFLAFTTHPSQFLRSSTQMTWGALFRHEILSRDPLLLAIIPKYLRASMTNLVKMGFPSKTDSPSCEYSRFDFDSDEDFNAFFNSSRAQQGEVMRLACRLDPKTSFQMAGEWLKYQLSTFLDAGSVNSCSAVGTGEGSLCSVFSPSFVQWEAMTLFLESVITQMFRTLNREEIPVNDGIELLQMVLNFDTKDPLILSCVLTNVSALFPFVTYRPEFLPQVFSKLFSSVTFETVEESKAPRTRAVRNVRRHACSSIIKMCRDYPQLVLPNFDMLYNHVKQLLSNELLLTQMEKCALMEALVLISNQFKNYERQKVFLEELMAPVASIWLSQDMHRVLSDVDAFIAYVGTDQKSCDPGLEDPCGLNRARMSFCVYSILGVVKRTCWPTDLEEAKAGGFVVGYTSSGNPIFRNPCTEQILKLLDNLLALIRTHNTLYAPEMLAKMAEPFTKALDMLDAEKSAILGLPQPLLELNDSPVFKTVLERMQRFFSTLYENCFHILGKAGPSMQQDFYTVEDLATQLLSSAFVNLNNIPDYRLRPMLRVFVKPLVLFCPPEHYEALVSPILGPLFTYLHMRLSQKWQVINQRSLLCGEDEAADENPESQEMLEEQLVRMLTREVMDLITVCCVSKKGADHSSAPPADGDDEEMMATEVTPSAMAELTDLLSIQSTDKRVSPRAEVD

SEQ ID NO: 906604 - protein, 1088 aa, Homo sapiens; identical to SEQ ID NO: 906603

SEQ ID NO: 906605 - protein, 838 aa, Homo sapiens
RSAGFFPARVAANAPPPASHPRRPPRPGTNGWSRRGSCRASWSRDCSGVRSRRVALGMAMDQVNALCEQLVKAVTVMMDPNSTQRYRLEALKFCEEFKEKCPICVPCGLRLAEKTQVAIVRHFGLQILEHVVKFRWNGMSRLEKVYLKNSVMELIANGTLNILEEENHIKDALSRIVVEMIKREWPQHWPDMLIELDTLSKQGETQTELVMFILLRLAEDVVTFQTLPPQRRRDIQQTLTQNMERIFSFLLNTLQENVNKYQQVKTDTSQESKAQANCRVGVAALNTLAGYIDWVSMSHITAENCKLLEILCLLLNEQELQLGAAECLLIAVSRKGKLEDRKPLMVLFGDVAMHYILSAAQTADGGGLVEKHYVFLKRLCQVLCALGNQLCALLGADSDVETPSNFGKYLESFLAFTTHPSQFLRSSTQMTWGALFRHEILSRDPLLLAIIPKYLRASMTNLVKMGFPSKTDSPSCEYSRFDFDSDEDFNAFFNSSRAQQGEVMRLACRLDPKTSFQMAGEWLKYQLSTFLDAGSVNSCSAVGTGEGSLCSVFSPSFVQWEAMTLFLESVITQMFRTLNREEIPVNDGIELLQMVLNFDTKDPLILSCVLTNVSALFPFVTYRPEFLPQVFSKLFSSVTFETVEESKAPRTRAVRNVRRHACSSIIKMCRDYPQLVLPNFDMLYNHVKQLLSNELLLTQMEKCALMEALVLISNQFKNYERQKVFLEELMAPVASIWLSQDMHRVLSDVDAFIAYVGTDQKSCDPGLEDPCGLNRARMSFCVYSILGVVKRTCWPTDLEEAKAGGFVVGYTSSGNPIFRNPCTEQILKLLDNLLALIR

SEQ ID NO: 906606 - protein, 90 aa, Homo sapiens
KNPWGGVDTFVEEIWGEVAIDLKSGSGKVYQGPAKGAADTTIILSDEDFMEVVLGKLDPQKAFFSGRLKARGNIMLSQKLQMILKDYAKL

SEQ ID NO: 906607 - protein, 762 aa, Homo sapiens
FPASSCPAVGVQRLCLFVCVSLQALFMGSPLRFDGRVVLVTGAGAGLGRAYALAFAERGALVVVNDLGGDFKGVGKGSLAADKVVEEIRRRGGKAVANYDSVEEGEKVVKTALDAFGRIDVVVNNAGILRDRSFARISDEDWDIIHRVHLRGSFQVTRAAWEHMKKQKYGRIIMTSSASGIYGNFGQANYSAAKLGLLGLANSLAIEGRKSNIHCNTIAPNAGSRMTQTVMPEDLVEALKPEYVAPLVLWLCHESCEENGGLFEVGAGWIGKLRWERTLGAIVRQKNHPMTPEAVKANWKKICDFENASKPQSIQESTGSIIEVLSKIDSEGGVSANHTSRATSTATSGFAGAIGQKLPPFSYAYTELEAIMYALGVGASIKDPKDLKFIYEGSSDFSCLPTFGVIIGQKSMMGGGLAEIPGLSINFAKVLHGEQYLELYKPLPRAGKLKCEAVVADVLDKGSGVVIIMDVYSYSEKELICHNQFSLFLVGSGGFGGKRTSDKVKVAVAIPNRPPDAVLTDTTSLNQAALYRLSGDWNPLHIDPNFASLAGFDKPILHGLCTFGFSARRVLQQFADNDVSRFKAIKARFAKPVYPGQTLQTEMWKEGNRIHFQTKVQETGDIVISNAYVDLAPTSGTSAKTPSEGGKLQSTFVFEEIGRRLKDIGPEVVKKVNAVFEWHITKGGNIGAKWTIDLKSGSGKVYQGPAKGAADTTIILSDEDFMEVVLGKLDPQKAFFSGRLKARGNIMLSQKLQMILKDYAKL

SEQ ID NO: 906608 - protein, 732 aa, Homo sapiens
SLEEEKSRKHLVSQAGLGRAYALAFAERGALVVVNDLGGDFKGVGKGSLAADKVVEEIRRRGGKAVANYDSVEEGEKVVKTALDAFGRIDVVVNNAGILRDRSFARISDEDWDIIHRVHLRGSFQVTRAAWEHMKKQKYGRIIMTSSASGIYGNFGQANYSAAKLGLLGLANSLAIEGRKSNIHCNTIAPNAGSRMTQTVMPEDLVEALKPEYVAPLVLWLCHESCEENGGLFEVGAGWIGKLRWERTLGAIVRQKNHPMTPEAVKANWKKICDFENASKPQSIQESTGSIIEVLSKIDSEGGVSANHTSRATSTATSGFAGAIGQKLPPFSYAYTELEAIMYALGVGASIKDPKDLKFIYEGSSDFSCLPTFGVIIGQKSMMGGGLAEIPGLSINFAKVLHGEQYLELYKPLPRAGKLKCEAVVADVLDKGSGVVIIMDVYSYSEKELICHNQFSLFLVGSGGFGGKRTSDKVKVAVAIPNRPPDAVLTDTTSLNQAALYRLSGDWNPLHIDPNFASLAGFDKPILHGLCTFGFSARRVLQQFADNDVSRFKAIKARFAKPVYPGQTLQTEMWKEGNRIHFQTKVQETGDIVISNAYVDLAPTSGTSAKTPSEGGKLQSTFVFEEIGRRLKDIGPEVVKKVNAVFEWHITKGGNIGAKWTIDLKSGSGKVYQGPAKGAADTTIILSDEDFMEVVLGKLDPQKAFFSGRLKARGNIMLSQKLQMILKDYAKL

SEQ ID NO: 906609 - protein, 599 aa, Homo sapiens
MKKQKYGRIIMTSSASGIYGNFGQANYSAAKLGLLGLANSLAIEGRKSNIHCNTIAPNAGSRMTQTVMPEDLVEALKPEYVAPLVLWLCHESCEENGGLFEVGAGWIGKLRWERTLGAIVRQKNHPMTPEAVKANWKKICDFENASKPQSIQESTGSIIEVLSKIDSEGGVSANHTSRATSTATSGFAGAIGQKLPPFSYAYTELEAIMYALGVGASIKDPKDLKFIYEGSSDFSCLPTFGVIIGQKSMMGGGLAEIPGLSINFAKVLHGEQYLELYKPLPRAGKLKCEAVVADVLDKGSGVVIIMDVYSYSEKELICHNQFSLFLVGSGGFGGKRTSDKVKVAVAIPNRPPDAVLTDTTSLNQAALYRLSGDWNPLHIDPNFASLAGFDKPILHGLCTFGFSARRVLQQFADNDVSRFKAIKARFAKPVYPGQTLQTEMWKEGNRIHFQTKVQETGDIVISNAYVDLAPTSGTSAKTPSEGGKLQSTFVFEEIGRRLKDIGPEVVKKVNAVFEWHITKGGNIGAKWTIDLKSGSGKVYQGPAKGAADTTIILSDEDFMEVVLGKLDPQKAFFSGRLKARGNIMLSQKLQMILKDYAKL

SEQ ID NO: 906610 - protein, 566 aa, Homo sapiens
MGSPLRFDGRVVLVTGAGAGLGRAYALAFAERGALVVDLVEALKPEYVAPLVLWLCHESCEENGGLFEVGAGWIGKLRWERTLGAIVRQKNHPMTPEAVKANWKKICDFENASKPQSIQESTGSIIEVLSKIDSEGGVSANHTSRATSTATSGFAGAIGQKLPPFSYAYTELEAIMYALGVGASIKDPKDLKFIYEGSSDFSCLPTFGVIIGQKSMMGGGLAEIPGLSINFAKVLHGEQYLELYKPLPRAGKLKCEAVVADVLDKGSGVVIIMDVYSYSEKELICHNQFSLFLVGSGGFGGKRTSDKVKVAVAIPNRPPDAVLTDTTSLNQAALYRLSGDWNPLHIDPNFASLAGFDKPILHGLCTFGFSARRVLQQFADNDVSRFKAIKARFAKPVYPGQTLQTEMWKEGNRIHFQTKVQETGDIVISNAYVDLAPTSGTSAKTPSEGGKLQSTFVFEEIGRRLKDIGPEVVKKVNAVFEWHITKGGNIGAKWTIDLKSGSGKVYQGPAKGAADTTIILSDEDFMEVVLGKLDPQKAFFSGRLKARGNIMLSQKLQMILKDYAKL

SEQ ID NO: 906611 - protein, 391 aa, Homo sapiens [sequence omitted]

SEQ ID NO: 906612 - protein, 294 aa, Homo sapiens
MDVYSYSEKELICHNQFSLFLVGSGGFGGKRTSDKVKVAVAIPNRPPDAVLTDTTSLNQAALYRLSGDWNPLHIDPNFASLAGFDKPILHGLCTFGFSARRVLQQFADNDVSRFKAIKARFAKPVYPGQTLQTEMWKEGNRIHFQTKVQETGDIVISNAYVDLAPTSGTSAKTPSEGGKLQSTFVFEEIGRRLKDIGPEVVKKVNAVFEWHITKGGNIGAKWTIDLKSGSGKVYQGPAKGAADTTIILSDEDFMEVVLGKLDPQKAFFSGRLKARGNIMLSQKLQMILKDYAKL

SEQ ID NO: 906613 - protein, 762 aa, Homo sapiens; identical to SEQ ID NO: 906607

SEQ ID NO: 906614 - protein, 719 aa, Homo sapiens
FPASSCPAVGVQRLCLFVCVSLQALFMGSPLRFDGRVVLVTGAGAGLGRAYALAFAERGALVVVNDLGGDFKGVGKGSLAADKVVEEIRRRGGKAVANYDSVEEGEKVVKTALDAFGRIDVVVNNAGILRDRSFARISDEDWDIIHRVHLRGSFQVTRAAWEHMKKQKYGRIIMTSSASGIYGNFGQANYSAAKLGLLGLANSLAIEGRKSNIHCNTIAPNAGSRMTQTVMPEDLVEALKPEYVAPLVLWLCHESCEENGGLFEVGAGWIGKLRWERTLGAIVRQKNHPMTPEAVKANWKKICDFENASKPQSIQESTGSIIEVLSKIDSEGGVSANHTSRATSTATSGFAGAIGQKLPPFSYAYTELEAIMYALGVGASIKDPKDLKFIYEGSSDFSCLPTFGVIIGQKSMMGGGLAEIPGLSINFAKVLHGEQYLELYKPLPRAGKLKCEAVVADVLDKGSGVVIIMDVYSYSEKELICHNQFSLFLVGSGGFGGKRTSDKVKVAVAIPNRPPDAVLTDTTSLNQAALYRLSGDWNPLHIDPNFASLAGFDKPILHGLCTFGFSARRVLQQFADNDVSRFKAIKARFAKPVYPGQTLQTEMWKEGNRIHFQTKVQETGDIVISNAYVDLAPTSGTSAKTPSEGGKLQSTFVFEEIGRRLKDIGPEVVKKVNAVFEWHITKGGNIGAKWTIDLKSGSGKVYQWSWASLTLRRHSLVAG

SEQ ID NO: 906615 - protein, 752 aa, Homo sapiens
FPASSCPAVGVQRLCLFVCVSLQALFMGSPLRFDGRVVLVTGAGAGLGRAYALAFAERGALVVVNDLGGDFKGVGKGSLAADKVVEEIRRRGGKAVANYDSVEEGEKVVKTALDAFGRIDVVVNNAGILRDRSFARISDEDWDIIHRVHLRGSFQVTRAAWEHMKKQKYGRIIMTSSASGIYGNFGQANYSAAKLGLLGLANSLAIEGRKSNIHCNTIAPNAGSRMTQTVMPEDLVEALKPEYVAPLVLWLCHESCEENGGLFEVGAGWIGKLRWERTLGAIVRQKNHPMTPEAVKANWKKICDFENASKPQSIQESTGSIIEVLSKIDSEGGVSANHTSRATSTATSGFAGAIGQKLPPFSYAYTELEAIMYALGVGASIKDPKDLKFIYEGSSDFSCLPTFGVIIGQKSMMGGGLAEIPGLSINFAKVLHGEQYLELYKPLPRAGKLKCEAVVADVLDKGSGVVIIMDVYSYSEKELICHNQFSLFLVGSGGFGGKRTSDKVKVAVAIPNRPPDAVLTDTTSLNQAALYRLSGDWNPLHIDPNFASLAGFDKPILHGLCTFGFSARRVLQQFADNDVSRFKAIKARFAKPVYPGQTLQTEMWKEGNRIHFQTKVQETGDIVISNAYVDLAPTSGTSAKTPSEGGKLQSTFVFEEIGRRLKDIGPEVVGEVGAGGGGRGSRGRGGAGAVGLEGAGRGQGPAGAAGAALGGDGHGGGLLGLGPAFFSGRLKARGNIMLSQKLQMILKDYAKL

SEQ ID NO: 906616 - protein, 762 aa, Homo sapiens; identical to SEQ ID NO: 906607

SEQ ID NO: 906617 - protein, 641 aa, Homo sapiens
FPASSCPAVGVQRLCLFVCVSLQALFMGSPLRFDGRVVLVTGAGAGLGRAYALAFAERGALVVVNDLGGDFKGVGKGSLAADKVVEEIRRRGGKAVANYDSVEEGEKVVKTALDAFGRIDVVVNNAGILRDRSFARISDEDWDIIHRVHLRGSFQVTRAAWEHMKKQKYGRIIMTSSASGIYGNFGQANYSAAKLGLLGLANSLAIEGRKSNIHCNTIAPNAGSRMTQTVMPEDLVEALKPEYVAPLVLWLCHESCEENGGLFEVGAGWIGKLRWERTLGAIVRQKNHPMTPEAVKANWKKICDFENASKPQSIQESTGSIIEVLSKIDSEGGVSANHTSRATSTATSGFAGAIGQKLPPFSYAYTELEAIMYALGVGASIKDPKDLKFIYEGSSDFSCLPTFGVIIGQKSMMGGGLAEIPGLSINFAKVLHGEQYLELYKPLPRAGKLKCEAVVADVLDKGSGVVIIMDVYSYSEKELICHNQFSLFLVGSGGFGGKRTSDKVKVAVAIPNRPPDAVLTDTTSLNQAALYRLSGDWNPLHIDPNFASLAGFDKPILHGLCTFGFSARRVLQQFADNDVSRFKAIKARFAKPVYPGQTLQTEMWKEGNRIHFQTKVLQLGRCHFKRICASITPVRLDSYSV

SEQ ID NO: 906618 - protein, 443 aa, Homo sapiens
FPASSCPAVGVQRLCLFVCVSLQALFMGSPLRFDGRVVLVTGAGAGLGRAYALAFAERGALVVVNDLGGDFKGVGKGSLAADKVVEEIRRRGGKAVANYDSVEEGEKVVKTALDAFGRIDVVVNNAGILRDRSFARISDEDWDIIHRVHLRGSFQVTRAAWEHMKKQKYGRIIMTSSASGIYGNFGQANYSAAKLGLLGLANSLAIEGRKSNIHCNTIAPNAGSRMTQTVMPEDLVEALKPEYVAPLVLWLCHESCEENGGLFEVGAGWIGKLRWERTLGAIVRQKNHPMTPEAVKANWKKICDFENASKPQSIQESTGSIIEVLSKIDSEGGVSANHTSRATSTATSGFAGAIGQKLPPFSYAYTELEAIMYALGVGASIKDPKDLKFIYEGSSDFSCLPTFGVIIGQKSMMGGGLAEIPGLSINFAKVCLIKNLYFAFLFL

SEQ ID NO: 906619 - protein, 114 aa, Homo sapiens
NRLRLSALVVVLDNFCVDCGAVGVQRLCLFVCVSLQALFMGSPLRFDGRVVLVTGAGADWAEPMPWLLQKIGQACNAGSEKQKVRKKSSVKTVSSSATTVADPVFLMLSILQAL

SEQ ID NO: 906620 - protein, 736 aa, Homo sapiens
MGSPLRFDGRVVLVTGAGAGLGRAYALAFAERGALVVVNDLGGDFKGVGKGSLAADKVVEEIRRRGGKAVANYDSVEEGEKVVKTALDAFGRIDVVVNNAGILRDRSFARISDEDWDIIHRVHLRGSFQVTRAAWEHMKKQKYGRIIMTSSASGIYGNFGQANYSAAKLGLLGLANSLAIEGRKSNIHCNTIAPNAGSRMTQTVMPEDLVEALKPEYVAPLVLWLCHESCEENGGLFEVGAGWIGKLRWERTLGAIVRQKNHPMTPEAVKANWKKICDFENASKPQSIQESTGSIIEVLSKIDSEGGVSANHTSRATSTATSGFAGAIGQKLPPFSYAYTELEAIMYALGVGASIKDPKDLKFIYEGSSDFSCLPTFGVIIGQKSMMGGGLAEIPGLSINFAKVLHGEQYLELYKPLPRAGKLKCEAVVADVLDKGSGVVIIMDVYSYSEKELICHNQFSLFLVGSGGFGGKRTSDKVKVAVAIPNRPPDAVLTDTTSLNQAALYRLSGDWNPLHIDPNFASLAGFDKPILHGLCTFGFSARRVLQQFADNDVSRFKAIKARFAKPVYPGQTLQTEMWKEGNRIHFQTKVQETGDIVISNAYVDLAPTSGTSAKTPSEGGKLQSTFVFEEIGRRLKDIGPEVVKKVNAVFEWHITKGGNIGAKWTIDLKSGSGKVYQGPAKGAADTTIILSDEDFMEVVLGKLDPQKAFFSGRLKARGNIMLSQKLQMILKDYAKL

SEQ ID NO: 906621 - protein, 762 aa, Homo sapiens; identical to SEQ ID NO: 906607

SEQ ID NO: 906622 - protein, 718 aa, Homo sapiens
MGSPLRFDGRVVLVTGAGAGLGRAYALAFAERGALVVVNDLGGDFKGVGKGSLAADKVVEEIRRRGGALDAFGRIDVVVNNAGILRDRSFARISDEDWDIIHRVHLRGSFQVTRAAWEHMKKQKYGRIIMTSSASGIYGNFGQANYSAAKLGLLGLANSLAIEGRKSNIHCNTIAPNAGSRMTQTVMPEDLVEALKPEYVAPLVLWLCHESCEENGGLFEVGAGWIGKLRWERTLGAIVRQKNHPMTPEAVKANWKKICDFENASKPQSIQESTGSIIEVLSKIDSEGGVSANHTSRATSTATSGFAGAIGQKLPPFSYAYTELEAIMYALGVGASIKDPKDLKFIYEGSSDFSCLPTFGVIIGQKSMMGGGLAEIPGLSINFAKVLHGEQYLELYKPLPRAGKLKCEAVVADVLDKGSGVVIIMDVYSYSEKELICHNQFSLFLVGSGGFGGKRTSDKVKVAVAIPNRPPDAVLTDTTSLNQAALYRLSGDWNPLHIDPNFASLAGFDKPILHGLCTFGFSARRVLQQFADNDVSRFKAIKARFAKPVYPGQTLQTEMWKEGNRIHFQTKVQETGDIVISNAYVDLAPTSGTSAKTPSEGGKLQSTFVFEEIGRRLKDIGPEVVKKVNAVFEWHITKGGNIGAKWTIDLKSGSGKVYQGPAKGAADTTIILSDEDFMEVVLGKLDPQKAFFSGRLKARGNIMLSQKLQMILKDYAKL

SEQ ID NO: 906623 - protein, 744 aa, Homo sapiens
FPASSCPAVGVQRLCLFVCVSLQALFMGSPLRFDGRVVLVTGAGAGLGRAYALAFAERGALVVVNDLGGDFKGVGKGSLAADKVVEEIRRRGGKAVANYDSVEEGEKVVKTALDAFGRIDVVVNNAGILRDRSFARISDEDWDIIHRVHLRGSFQVTRAAWEHMKKQKYGRIIMTSSASGIYGNFGQANYSAAKLGLLGLANSLAIEGRKSNIHCNTIAPNAGSRMTQTVMPEDLVEALKPEYVAPLVLWLCHESCEENGGLFEVGAGWIGKLRWERTLGAIVRQKNHPMTPEAVKANWKKICDFENASKPQSIQESTGSIIEVLSKIDSEGGVSANHTSRATSTATSGFAGAIGQKLPPFSYAYTELEAIMYALGVGASIKDPKDLKFIYEGSSDFSCLPTFGVIIGQKSMMGGGLAEIPGLSINFAKVLHGEQYLELYKPLPRAGKLKCEAVVADVLDKGSGVVIIMDVYSYSEKELICHNQFSLFLVGSGGFAPDAVLTDTTSLNQAALYRLSGDWNPLHIDPNFASLAGFDKPILHGLCTFGFSARRVLQQFADNDVSRFKAIKARFAKPVYPGQTLQTEMWKEGNRIHFQTKVQETGDIVISNAYVDLAPTSGTSAKTPSEGGKLQSTFVFEEIGRRLKDIGPEVVKKVNAVFEWHITKGGNIGAKWTIDLKSGSGKVYQGPAKGAADTTIILSDEDFMEVVLGKLDPQKAFFSGRLKARGNIMLSQKLQMILKDYAKL

SEQ ID NO: 906624 - protein, 473 aa, Homo sapiens [sequence omitted]

SEQ ID NO: 906625 - protein, 718 aa, Homo sapiens
FPASSCPAVGVQRLCLFVCVSLQALFMGSPLRFDGRVVLVTGAGAGLGRAYALAFAERGALVVVNDLGGDFKGVGKGSLAADKVVEEIRRRGGKAVANYDSVEEGEKVVKTALDAFGRIDVVVNNAGILRDRSFARISDEDWDIIHRVHLRGSFQVTRAAWEHMKKQKYGRIIMTSSASGIYGNFGQANYSAAKLGLLGLANSLAIEGRKSNIHCNTIAPNAGSRMTQTVMPEDLVEALKPEYVAPLVLWLCHESCEENGGLFEVGAGWIGKLRWERTLGAIVRQKNHPMTPEAVKANWKKICDFENASKPQSIQESTGSIIEVLSKIDSEGGVSANHTSRATSTATSGFAGAIGQKLPPFSYAYTELEAIMYALGVGASIKDPKDLKFIYEGSSDFSCLPTFGVIIGQKSMMGGGLAEIPGLSINFAKVLHGEQYLELYKPLPRAGKLKCEAVVADVLDKGSGVVIIMDVYSYSEKELICHNQFSLFLVGSGGFGGKRTSDKVKVAVAIPNRPPDAVLTDTTSLNQAALYRLSGDWNPLHIDPNFASLAGFDKPILHGLCTFGFSARRVLQQFADNDVSRFKAIKARFAKPVYPGQTLQTEMWKEGNRIHFQTKVQETGDIVISNAYVDLAPTSGTSAKTPSEGGKLQSTFVFEEIGRRLKDIGPEVVKKVNAVFEWHITKALQKVLLIQQSYFQMKISWRWSWASLTLRRHSLVAG

SEQ ID NO: 906626 - protein, 762 aa, Homo sapiens; identical to SEQ ID NO: 906607

SEQ ID NO: 906627 - protein, 184 aa, Homo sapiens
HDVIVHDVIVHDVIVHDVIVLQTEMWKEGNRIHFQTKVQETGDIVISNAYVDLAPTSGTSAKTPSEGGKLQSTFVFEEIGRRLKDIGPEVVKKVNAVFEWHITKGGNIGAKWTIDLKSGSGKVYQGPAKGAADTTIILSDEDFMEVVLGKLDPQKAFFSGRLKARGNIMLSQKLQMILKDYAKL

SEQ ID NO: 906628 - protein, 621 aa, Homo sapiens
FPASSCPAVGVQRLCLFVCVSLQALFMGSPLRFDGRVVLVTGAGAGLGRAYALAFAERGALVVVNDLGGDFKGVGKGSLAADKVVEEIRRRGGKAVANYDSVEEGEKVVKTALDAFGRIDVVVNNAGILRDRSFARISDEDWDIIHRVHLRGSFQVTRAAWEHMKKQKYGRIIMTSSASGIYGNFGQANYSAAKLGLLGLANSLAIEGRKSNIHCNTIAPNAGSRMTQTVMPEDLVEALKPEYVAPLVLWLCHESCEENGGLFEVGAGWIGKLRWERTLGAIVRQKNHPMTPEAVKANWKKICDFENASKPQSIQESTGSIIEVLSKIDSEGGVSANHTSRATSTATSGFAGAIGQKLPPFSYAYTELEAIMYALGVGASIKDPKDLKFIYEGSSDFSCLPTFGVIIGQKSMMGGGLAEIPGLSINFAKVLHGEQYLELYKPLPRAGKLKCEAVVADVLDKGSGVVIIMDVYSYSEKELICHNQFSLFLVGSGGFGGKRTSDKVKVAVAIPNRPPDAVLTDTTSLNQAALYRLSGDWNPLHIDPNFASLAGFDKPILHGLCTFGFSARRVLQQFADNDVSRFKAIKARFAKPVYPGQTLQTEMWKEGNRIHFQTKVQETGD

SEQ ID NO: 906629 - protein, 213 aa, Homo sapiens
FPASSCPAVGVQRLCLFVCVSLQALFMGSPLRFDGRVVLVTGAGAGLGRAYALAFAERGALVVVNDLGGDFKGVGKGSLAADKVVEEIRRRGGKAVANYDSVEEGEKVVKTALDAFGRIDVVVNNAGILRDRSFARISDEDWDIIHRVHLRGSFQVTRAAWEHMKKQKYGRIIMTSSASGIYGNFGQANYSAAKLGLLGLANSLAIEGRTRYA

SEQ ID NO: 906630 - protein, 108 aa, Homo sapiens
TRRRASLATLATAGKSVYVVGASSVAGMEASRCRLSPSGDRSDRAVAGLLLSEAEGRSEKAECLSLIRDGLTDLPVGHTPCLCASFSARGRASEKKGSKISACHFLVR

SEQ ID NO: 906631 - protein, 469 aa, Homo sapiens
TRRRASLATLATAGKSVYVVGASSVAGMEASRCRLSPSGDSVFHEEMMKMRQAKLDYQRLLLEKRQRKKRLEPFMVQPNPEARLRRAKPRASDEQTPLVNCHTPHSNVILHGIDGPAAVLKPDEVHAPSVSSSVVEEDAENTVDTASKPGLQERLQKHDISESVNFDEETDGISQSACLERPNSASSQNSTDTGTSGSATAAQPADNLLGDIDDLEDFVYSPAPQGVTVRCRIIRDKRGMDRGLFPTYYMYLEKEENQKIFLLAARKRKKSKTANYLISIDPVDLSREGESYVGKLRSNLMGTKFTVYDRGICPMKGRGLVGAAHTRQELAAISYETNVLGFKGPRKMSVIIPGMTLNHKQIPYQPQNNHDSLLSRWQNRTMENLVELHNKAPVWNSDTQSYVLNFRGRVTQASVKNFQIVHKNDPDYIVMQFGRVADDVFTLDYNYPLCAVQAFGIGLSSFDSKLACE

SEQ ID NO: 906632 - protein, 469 aa, Homo sapiens; identical to SEQ ID NO: 906631

SEQ ID NO: 906633 - protein, 169 aa, Homo sapiens
MGTKFTVYDRGICPMKGRGLVGAAHTRQELAAISYETNVLGFKGPRKMSVIIPGMTLNHKQIPYQPQNNHDSLLSRWQNRTMENLVELHNKAPVWNSDTQSYVLNFRGRVTQASVKNFQIVHKNDPDYIVMQFGRVADDVFTLDYNYPLCAVQAFGIGLSSFDSKLACE

SEQ ID NO: 906634 - protein, 470 aa, Homo sapiens
TRRRASLATLATAGKSVYVVGASSVAGMEASRCRLSPSGDSVFHEEMMKMRQAKLDYQRLLLEKRQRKKRLEPFMVQPNPEARLRRAKPRASDEQTPLVNCHTPHSNVILHGIDGPAAVLKPDEVHAPSVSSSVVEEDAENTVDTASKPGLQERLQKHDISESVNFDEETDGISQSACLERPNSASSQNSTDTGTSGSATAAQPADNLLGDIDDLEDFVYSPAPQGVTVRCRIIRDKRGMDRGLFPTYYMYLEKEENQKIFLLAARKRKKSKTANYLISIDPVDLSREGESYVGKLRSNLMGTKFTVYDRGICPMKGRGLVGAAHTRQELAAISYETNVLGFKGPRKMSVIIPGMTLNHKQIPYQPQNNHDSLLSRWQNRTMENLVELHNKAPVWNSDTQSYVLNFRGRVTQASVKNFQIVHKNDPDYIVMQFGRVADDVFTLDYNYPLCAVQAFGIGLSSFDRVPLTAI

SEQ ID NO: 906635 - protein, 297 aa, Homo sapiens
TRRRASLATLATAGKSVYVVGASSVAGMEASRCRLSPSGDSVFHEEMMKMRQAKLDYQRLLLEKRQRKKRLEPFMVQPNPEARLRRAKPRASDEQTPLVNCHTPHSNVILHGIDGPAAVLKPDEVHAPSVSSSVVEEDAENTVDTASKPGLQERLQKHDISESVNFDEETDGISQSACLERPNSASSQNSTDTGTSGSATAAQPADNLLGDIDDLEDFVYSPAPQGVTVRCRIIRDKRGMDRGLFPTYYMYLEKEENQKIFLLAARKRKKSKTANYLISIDPVDLSREGESYVGKLR

SEQ ID NO: 906636 - protein, 469 aa, Homo sapiens; identical to SEQ ID NO: 906631

SEQ ID NO: 906637 - protein, 230 aa, Homo sapiens [sequence omitted]

SEQ ID NO: 906638 - protein, 469 aa, Homo sapiens; identical to SEQ ID NO: 906631

SEQ ID NO: 906639 - protein, 468 aa, Homo sapiens
TRRRASLATLATAGKSVYVVGASSVAGMEASRCRLSPSGDSVFHEEMMKMRQAKLDYQRLLLEKRQRKKRLEPFMVQPNPEARLRRAKPRASDEQTPLVNCHTPHSNVILHGIDGPAAVLKPDEVHAPSVSSSVVEEDAENTVDTASKPGLQERLQKHDISESVNFDEETDGISQSACLERPNSASSQNSTDTGTSGSATAAQPADNLLGDIDDLEDFVYSPAPQGVTVRCRIIRDKRGMDRGLFPTYYMYLEKEENQKIFLLAARKRKKSKTANYLISIDPVDLSREGESYVGKLRSNLMGTKFTVYDRGICPMKGRGLVGAAHTRQELAAISYETNVLGFKGPRKMSVIIPGMTLNHKQIPYQPQNNHDSLLSRWQNRTMENLVELHNKAPVWNSDTQSYVLNFRGRVTQASVKNFQIVHKNDPDYIVMQFGRVADDVFTLDYNYPLCAVQAFGIGLSSFDNVSKP

SEQ ID NO: 906640 - protein, 652 aa, Homo sapiens
GELSLLSYIRPDVKGLSTLQDIEIGVQHILADMIAKDKDTLDFIRNLCQKRHVCIQSSLAKVSSKKVNEKDVDKFLLYQHFSCNIRNIHHHQILAINRGENLKVLTVKVNISDGVKDEFCRWCIQNRWRPRSFARPELMKILYNSLNDSFKRLIYPLLCREFRAKLTSDAEKESVMMFGRNLRQLLLTSPVPGRTLMGVDPGYKHGCKLAIISPTSQILHTDVVYLHCGQGFREAEKIKTLLLNFNCSTVVIGNGTACRETEAYFADLIMKNYFAPLDVVYCIVSEAGASIYSVSPEANKEMPGLDPNLRSAVSIARRVQDPLAELVKIEPKHIGVGMYQHDVSQTLLKATLDSVVEECVSFVGVDINICSEVLLRHIAGLNANRAKNIIEWREKNGPFINREQLKKVKGLGPKSFQQCAGFIRINQDYIRTFCSQQTETSGQIQGVAVTSSADVEVTNEKQGKKKSKTAVNVLLKPNPLDQTCIHPESYDIAMRFLSSIGGTLYEVGKPEMQQKINSFLEKEGMEKIAERLQTTVHTLQVIIDGLSQPESFDFRTDFDKPDFKRSIVCLEDLQIGTVLTGKVENATLFGIFVDIGVGKSGLIPIRNVTEAKLSKTKKRRSLGLGPGERVEVQVLNIDIPRSRITLDLIRVL

SEQ ID NO: 906641 - protein, 569 aa, Homo sapiens
GSSCVSGFFILAINRGENLKVLTVKVNISDGVKDEFCRWCIQNRWRPRSFARPELMKILYNSLNDSFKRLIYPLLCREFRAKLTSDAEKESVMMFGRNLRQLLLTSPVPGRTLMGVDPGYKHGCKLAIISPTSQILHTDVVYLHCGQGFREAEKIKTLLLNFNCSTVVIGNGTACRETEAYFADLIMKNYFAPLDVVYCIVSEAGASIYSVSPEANKEMPGLDPNLRSAVSIARRVQDPLAELVKIEPKHIGVGMYQHDVSQTLLKATLDSVVEECVSFVGVDINICSEVLLRHIAGLNANRAKNIIEWREKNGPFINREQLKKVKGLGPKSFQQCAGFIRINQDYIRTFCSQQTETSGQIQGVAVTSSADVEVTNEKQGKKKSKTAVNVLLKPNPLDQTCIHPESYDIAMRFLSSIGGTLYEVGKPEMQQKINSFLEKEGMEKIAERLQTTVHTLQVIIDGLSQPESFDFRTDFDKPDFKRSIVCLEDLQIGTVLTGKVENATLFGIFVDIGVGKSGLIPIRNVTEAKLSKTKKRRSLGLGPGERVEVQVLNIDIPRSRITLDLIRVL

SEQ ID NO: 906642 - protein, 200 aa, Homo sapiens
SNQRDSVGVGPSEPCAGYNLVVRRFLSRSEKRNIRVGVTLIFQFLSSIGGTLYEVGKPEMQQKINSFLEKEGMEKIAERLQTTVHTLQVIIDGLSQPESFDFRTDFDKPDFKRSIVCLEDLQIGTVLTGKVENATLFGIFVDIGVGKSGLIPIRNVTEAKLSKTKKRRSLGLGPGERVEVQVLNIDIPRSRITLDLIRVL

SEQ ID NO: 906643 - protein, 652 aa, Homo sapiens; identical to SEQ ID NO: 906640

SEQ ID NO: 906644 - protein, 631 aa, Homo sapiens
GELSLLSYIRPDVKGLSTLQDIEIGVQHILADMIAKDKDTLDFIRNLCQKRHVCIQSSLAKVSSKKVNEKDVDKFLLYQHFSCNIRNIHHHQILAINRGENLKVLTVKVNISDGVKDEFCRWCIQNRWRPRSFARPELMKILYNSLNDSFKRLIYPLLCREFRAKLTSDAEKESVMMFGRNLRQLLLTSPVPGRTLMGVDPGYKHGCKLAIISPTSQILHTDVVYLHCGQGFREAEKIKTLLLNFNCSTVVIGNGTACRETEAYFADLIMKNYFAPLDVVYCIVSEAGASIYSVSPEANKEMPGLDPNLRSAVSIARRVQDPLAELVKMSQSTLELECISFVGVDINICSEVLLRHIAGLNANRAKNIIEWREKNGPFINREQLKKVKGLGPKSFQQCAGFIRINQDYIRTFCSQQTETSGQIQGVAVTSSADVEVTNEKQGKKKSKTAVNVLLKPNPLDQTCIHPESYDIAMRFLSSIGGTLYEVGKPEMQQKINSFLEKEGMEKIAERLQTTVHTLQVIIDGLSQPESFDFRTDFDKPDFKRSIVCLEDLQIGTVLTGKVENATLFGIFVDIGVGKSGLIPIRNVTEAKLSKTKKRRSLGLGPGERVEVQVLNIDIPRSRITLDLIRVL

SEQ ID NO: 906645 - protein, 652 aa, Homo sapiens; identical to SEQ ID NO: 906640

SEQ ID NO: 906646 - protein, 371 aa, Homo sapiens
MSAQAQMRALLDQLMGTARDGDETRQRVKFTDDRVCKSHLLDCCPHDILAGTRMDLGECTKIHDLALRADYEIASKERDLFFELDAMDHLESFIAECDRRTELAKKRLAETQEEISAEVSAKAEKVHELNEEIGKLLAKAEQLGAEGNVDESQKILMEVEKVRAKKKEAEEEYRNSMPASSFQQQKLRVCEVCSAYLGLHDNDRRLADHFGGKLHLGFIQIREKLDQLRKTVAEKQEKRNQDRLRRREEREREERLSRRSGSRTRDRRRSRSRDRRRRRSRSTSRERRKLSRSRSRDRHRRHRSRSRSHSRGHRRASRDRSAKYKFSRERASREESWESGRSERGPPDWRLESSNGKMASRRSEEKEAGEI

SEQ ID NO: 906647 - protein, 371 aa, Homo sapiens; identical to SEQ ID NO: 906646

SEQ ID NO: 906648 - protein, 325 aa, Homo sapiens
MSAQAQMRALLDQLMGTARDGDETRQRVKFTDDRVCKSHLLDCCPHDILAGTRMDLGECTKIHDLALRADYEIASKERDLFFELDAMDHLESFIAECDRRTELAKKRLAETQEEISAEVSAKAEKVHELNEEIGKLLAKAEQLGAEGNVDESQKILMEVEKVRAKKKEAEEEYRNSMPASSFQQQKLRVCEVCSAYLGLHDNDRRLADHFGGKLHLGFIQIREKLDQLRKTVAEKQEKRNQDRLRRREEREREERLSRRSGSRTRDRRRSRSRDRRRRRSRSTSRERRKLSRSRSRDRHRRHRSRSRSHSRGHRRASRDRSAKYK

SEQ ID NO: 906649 - protein, 318 aa, Homo sapiens
MDLGECTKIHDLALRADYEIASKERDLFFELDAMDHLESFIAECDRRTELAKKRLAETQEEISAEVSAKAEKVHELNEEIGKLLAKAEQLGAEGNVDESQKILMEVEKVRAKKKEAEEEYRNSMPASSFQQQKLRVCEVCSAYLGLHDNDRRLADHFGGKLHLGFIQIREKLDQLRKTVAEKQEKRNQDRLRRREEREREERLSRRSGSRTRDRRRSRSRDRRRRRSRSTSRERRKLSRSRSRDRHRRHRSRSRSHSRGHRRASRDRSAKYKFSRERASREESWESGRSERGPPDWRLESSNGKMASRRSEEKEAGEI

SEQ ID NO: 906650 - protein, 318 aa, Homo sapiens; identical to SEQ ID NO: 906649

SEQ ID NO: 906651 - protein, 325 aa, Homo sapiens; identical to SEQ ID NO: 906648

SEQ ID NO: 906652 - protein, 118 aa, Homo sapiens [sequence omitted]

SEQ ID NO: 906653 - protein, 367 aa, Homo sapiens
TPSSMGQPGSGPEYRQSQGARRGVKFTDDRVCKSHLLDCCPHDILAGTRMDLGECTKIHDLALRADYEIASKERDLFFELDAMDHLESFIAECDRRTELAKKRLAETQEEISAEVSAKAEKVHELNEEIGKLLAKAEQLGAEGNVDESQKILMEVEKVRAKKKEAEEEYRNSMPASSFQQQKLRVCEVCSAYLGLHDNDRRLADHFGGKLHLGFIQIREKLDQLRKTVAEKQEKRNQDRLRRREEREREERLSRRSGSRTRDRRRSRSRDRRRRRSRSTSRERRKLSRSRSRDRHRRHRSRSRSHSRGHRRASRDRSAKYKFSRERASREESWESGRSERGPPDWRLESSNGKMASRRSEEKEAGEI

SEQ ID NO: 906654 - protein, 269 aa, Homo sapiens
MSAQAQMRALLDQLMGTARDGDETRQRVKFTDDRVCKSHLLDCCPHDILAGTRMDLGECTKIHDLALRADYEIASKERDLFFELDAMDHLESFIAECDRRTELAKKRLAETQEEISAEVSAKAEKVHELNEEIGKLLAKAEQLGAEGNVDESQKILMEVEKVRAKKKEAEEEYRNSMPASSFQQQKLRVCEVCSAYLGLHDNDRRLADHFGGKLHLGFIQIREKLDQLRKTVAEKQEKRNQDRLRRREEREREERLSRRSGSRTRDRRR

SEQ ID NO: 906655 - protein, 285 aa, Homo sapiens
MDHLESFIAECDRRTELAKKRLAETQEEISAEVSAKAEKVHELNEEIGKLLAKAEQLGAEGNVDESQKILMEVEKVRAKKKEAEEEYRNSMPASSFQQQKLRVCEVCSAYLGLHDNDRRLADHFGGKLHLGFIQIREKLDQLRKTVAEKQEKRNQDRLRRREEREREERLSRRSGSRTRDRRRSRSRDRRRRRSRSTSRERRKLSRSRSRDRHRRHRSRSRSHSRGHRRASRDRSAKYKFSRERASREESWESGRSERGPPDWRLESSNGKMASRRSEEKEAGEI

SEQ ID NO: 906656 - protein, 307 aa, Homo sapiens
GTLSTSHFFTCIERDLFFELDAMDHLESFIAECDRRTELAKKRLAETQEEISAEVSAKAEKVHELNEEIGKLLAKAEQLGAEGNVDESQKILMEVEKVRAKKKEAEEEYRNSMPASSFQQQKLRVCEVCSAYLGLHDNDRRLADHFGGKLHLGFIQIREKLDQLRKTVAEKQEKRNQDRLRRREEREREERLSRRSGSRTRDRRRSRSRDRRRRRSRSTSRERRKLSRSRSRDRHRRHRSRSRSHSRGHRRASRDRSAKYKFSRERASREESWESGRSERGPPDWRLESSNGKMASRRSEEKEAGEI

SEQ ID NO: 906657 - protein, 118 aa, Homo sapiens [sequence omitted]

SEQ ID NO: 906658 - protein, 325 aa, Homo sapiens; identical to SEQ ID NO: 906648

SEQ ID NO: 906659 - protein, 325 aa, Homo sapiens; identical to SEQ ID NO: 906648

SEQ ID NO: 906660 - protein, 325 aa, Homo sapiens; identical to SEQ ID NO: 906648

SEQ ID NO: 906661 - protein, 285 aa, Homo sapiens; identical to SEQ ID NO: 906655

SEQ ID NO: 906662 - protein, 318 aa, Homo sapiens; identical to SEQ ID NO: 906649

SEQ ID NO: 906663 - protein, 269 aa, Homo sapiens; identical to SEQ ID NO: 906654

SEQ ID NO: 906664 - protein, 326 aa, Homo sapiens
MSAQAQMRALLDQLMGTARDGDETRQRVKFTDDRVCKSHLLDCCPHDILAGTRMDLGECTKIHDLALRADYEIASKERDLFFELDAMDHLESFIAECDRRTELAKKRLAETQEEISAEVSAKAEKVHELNEEIGKLLAKAEQLGAEGNVDESQKILMEVEKVRAKKKEAEEEYRNSMPASSFQQQKLRVCEVCSAYLGLHDNDRRLADHFGGKLHLGFIQIREKLDQLRKTVAEKQEKRNQDRLRRREEREREERLSRRSGSRTRDRRRSRSRDRRRRRSRSTSREAGGASEGPRTGGLRAPTGRWLHGGQKRRRPARSEPVSRVL

SEQ ID NO: 906665 - protein, 285 aa, Homo sapiens; identical to SEQ ID NO: 906655

SEQ ID NO: 906666 - protein, 126 aa, Homo sapiens
FTKLAVFQASNMLLQLFRCLTKRRSRSRDRRRRRSRSTSRERRKLSRSRSRDRHRRHRSRSRSHSRGHRRASRDRSAKYKFSRERASREESWESGRSERGPPDWRLESSNGKMASRRSEEKEAGEI

SEQ ID NO: 906667 - protein, 817 aa, Homo sapiens
MMDGPRSDVGRWGGNPLQPPTTPSPEPEPEPDGRSRRGGGRSFWARCCGCCSCRNAADDDWGPEPSDSRGRGSSSGTRRPGSRGSDSRRPVSRGSGVNAAGDGTIREGMLVVNGVDLLSSRSDQNRREHHTDEYEYDELIVRRGQPFHMLLLLSRTYESSDRITLELLIGNNPEVGKGTHVIIPVGKGGSGGWKAQVVKASGQNLNLRVHTSPNAIIGKFQFTVRTQSDAGEFQLPFDPRNEIYILFNPWCPEDIVYVDHEDWRQEYVLNESGRIYYGTEAQIGERTWNYGQFDHGVLDACLYILDRRGMPYGGRGDPVNVSRVISAMVNSLDDNGVLIGNWSGDYSRGTNPSAWVGSVEILLSYLRTGYSVPYGQCWVFAGVTTTVLRCLGLATRTVTNFNSAHDTDTSLTMDIYFDENMKPLEHLNHDSVWNFHVWNDCWMKRPDLPSGFDGWQVVDATPQETSSGIFCCGPCSVESIKNGLVYMKYDTPFIFAEVNSDKVYWQRQDDGSFKIVYVEEKAIGTLIVTKAISSNMREDITYLYKHPEGSDAERKAVETAAAHGSKPNVYANRGSAEDVAMQVEAQDAVMGQDLMVSVMLINHSSSRRTVKLHLYLSVTFYTGVSGTIFKETKKEVELAPGASDRVTMPVAYKEYRPHLVDQGAMLLNVSGHVKESGQVLAKQHTFRLRTPDLSLTLLGAAVVGQECEVQIVFKNPLPVTLTNVVFRLEGSGLQRPKILNVGDIGGNETVTLRQSFVPVRPGPRQLIASLDSPQLSQVHGVIQVDVAPAPGDGGFFSDAGGDSHLGETIPMASRGGA

SEQ ID NO: 906668 - protein, 72 aa, Homo sapiens
IFCCGPCSVESIKNGLVYMKYDTPFIFAEVRAGLQVPSWASVMGSLVPTSPLTDQLCDPGQVTHYTSQFPHL

SEQ ID NO: 906669 - protein, 742 aa, Homo sapiens
MMDGPRSDVGRWGGNPLQPPTTPSPEPEPEPDGRSRRGGGRSFWARCCGCCSCRNAADDDWGPEPSDSRGRGSSSGTRRPGSRGSDSRRPVSRGSGVNAAGDGTIREGMLVVNGVDLLSSRSDQNRREHHTDEYEYDELIVRRGQPFHMLLLLSRTYESSDRITLELLIGNNPEVGKGTHVIIPVGKGGSGGWKAQVVKASGQNLNLRVHTSPNAIIGKFQFTVRTQSDAGEFQLPFDPRNEIYILFNPWCPEDIVYVDHEDWRQEYVLNESGRIYYGTEAQIGERTWNYGQFDHGVLDACLYILDRRGMPYGGRGDPVNVSRVISAMVNSLDDNGVLIGNWSGDYSRGTNPSAWVGSVEILLSYLRTGYSVPYGQCWVFAGVTTTVLRCLGLATRTVTNFNSAHDTDTSLTMDIYFDENMKPLEHLNHDSVWNFHVWNDCWMKRPDLPSGFDGWQVVDATPQETSSGIFCCGPCSVESIKNGLVYMKYDTPFIFAEVNSDKVYWQRQDDGSFKIVYVEEKAIGTLIVTKAISSNMREDITYLYKHPEGSDAERKAVETAAAHGSKPNVYANRGSAEDVAMQVEAQDAVMGQDLMVSVMLINHSSSRRTVKLHLYLSVTFYTGVSGTIFKETKKEVELAPGASDRVTMPVAYKEYRPHLVDQGAMLLNVSGHVKESGQVLAKQHTFRLRTPDLSLTLLGAAVVGQECEVQIVFKNPLPVTLTNVVFRLEGSGLQRPKILNVG

SEQ ID NO: 906670 - protein, 102 aa, Homo sapiens
MRSMASGGGVPTDEEQATGLEREIMLAAKKGLDPYNVLAPKGASGTREDPNLVPSISNKRIVGCICEEDNTSVVWFWLHKGEAQRCPRCGAHYKLVPQQLAH

SEQ ID NO: 906671 - protein, 129 aa, Homo sapiens
MASRLLRGAGTLAAQALRARGPSGAAAMRSMASGGGVPTDEEQATGLEREIMLAAKKGLDPYNVLAPKGASGTREDPNLVPSISNKRIVGCICEEDNTSVVWFWLHKGEAQRCPRCGAHYKLVPQQLAH

SEQ ID NO: 906672 - protein, 102 aa, Homo sapiens; identical to SEQ ID NO: 906670

SEQ ID NO: 906673 - protein, 182 aa, Homo sapiens
MRNFRPRHSLGSGRARGLGGSRKLTERRKKPAPGSPSCLCSLFPEVLLLVADAMASRLLRGAGTLAAQALRARGPSGAAAMRSMASGGGVPTDEEQATGLEREIMLAAKKGLDPYNVLAPKGASGTREDPNLVPSISNKRIVGCICEEDNTSVVWFWLHKGEAQRCPRCGAHYKLVPQQLAH

SEQ ID NO: 906674 - protein, 114 aa, Homo sapiens
RDQSVALPGWSQGGKAARLVQLLEVPVAALRSPVPQALQASPCNSGPLLLPLPELTPLRKQMSTNLPRWLEKEKLIGRARWLTTVIPALWEAEADRSPEVRSSRPAWPTWWCSH

SEQ ID NO: 906675 - protein, 182 aa, Homo sapiens; identical to SEQ ID NO: 906673

SEQ ID NO: 906676 - protein, 117 aa, Homo sapiens
RDQSVALPGWSQGGKAARLVQLLEVPVAALRSPVPQALQASPCNSGPLLLPLPELTPLRKYPKRRCRVTLGGTGAATGMGRGPASLQTCAHLKQSGFYMLLDKCRQICLGGWRKKSS

SEQ ID NO: 906677 - protein, 157 aa, Homo sapiens
MRNFRPRHSLGSGRARGLGGSRKLTERRKKPAPGSPSCLCSLFPEVLLLVADAMASRLLRGAGTLAAQALRARGPSGAAAMRSMASGGGVPTDEEQATGLEREIMLAAKKGLDPYNVLAPKGASGTREDPNLVPSISNKRIVGCICKYLTSIFYPLA

SEQ ID NO: 906678 - protein, 182 aa, Homo sapiens; identical to SEQ ID NO: 906673

SEQ ID NO: 906679 - protein, 129 aa, Homo sapiens; identical to SEQ ID NO: 906671

SEQ ID NO: 906680 - protein, 182 aa, Homo sapiens; identical to SEQ ID NO: 906673

SEQ ID NO: 906681 - protein, 117 aa, Homo sapiens; identical to SEQ ID NO: 906676

SEQ ID NO: 906682 - protein, 182 aa, Homo sapiens; identical to SEQ ID NO: 906673

SEQ ID NO: 906683 - protein, 102 aa, Homo sapiens
MVGQWRDGHGLGVSTDKSRDWLRGDHVAERRADPYNVLAPKGASGTREDPNLVPSISNKRIVGCICEEDNTSVVWFWLHKGEAQRCPRCGAHYKLVPQQLAH

SEQ ID NO: 906684 - protein, 117 aa, Homo sapiens; identical to SEQ ID NO: 906676

SEQ ID NO: 906685 - protein, 1127 aa, Homo sapiens
MSLTSAYQHKLAEKLTILNDRGQGVLIRMYNIKKTCSDPKSKPPFLLEKSMEPSLKYINKKFPNIDVRNSTQHLGPVHREKAEIIRFLTNYYQSFVDVMEFRDHVYELLNTIDACQCHFDINLNFDFTRSYLDLIVTYTSVILLLSRIEDRRILIGMYNCAHEMLHGHGDPSFARLGQMVLEYDHPLKKLTEEFGPHTKAVSGALLSLHFLFVRRNQGAEQWRSAQLLSLISNPPAMINPANSDTMACEYLSVEVMERWIIIGFLLCHGCLNSNSQCQKLWKLCLQGSLYITLIREDVLQVHKVTEDLFSSLKGYGKRVADIKESKEHVIANSGQFHCQRRQFLRMAVKELETVLADEPGLLGPKALFAFMALSFIRDEVTWLVRHTENVTKTKTPEDYADSSIAELLFLLEGIRSLVRRHIKVIQQYHLQYLARFDALVLSDIIQNLSVCPEEESIIMSSFVSILSSLNLKQVDNGEKFEFSGLRLDWFRLQAYTSVAKAPLHLHENPDLAKVMNLIVFHSRMLDSVEKLLVETSDLSTFCFHLRIFEKMFAMTLEESAMLRYAIAFPLICAHFVHCTHEMCPEEYPHLKNHGLHHCNSFLEELAKQTSNCVLEICAEQRNLSEQLLPKHCATTISKAKNKKTRKQRQTPRKGEPERDKPGAESHRKNRSIVTNMDKLHLNLTELALTMNHVYSFSVFEHTIFPSEYLSSHLEARLNRAIVWLAGYNATTQEIVRPSELLAGVKAYIGFIQSLAQFLGADASRVIRNALLQQTQPLDSCGEQTITTLYTNWYLESLLRQASSGTIILSPAMQAFVSLPREGEQNFSAEEFSDISEMRALAELLGPYGMKFLSENLMWHVTSQIVELKKLVVENMDILVQIRSNFSKPDLMASLLPQLTGAENVLKRMTIIGVILSFRAMAQEGLREVFSSHCPFLMGPIECLKEFVTPDTDIKVTLSIFELASAAGVGCDIDPALVAAIANLKADTSSPEEEYKVACLLLIFLAVSLPLLATDPSSFYSIEKDGYNNNIHCLTKAIIQVSAALFTLYNKNIETHLKEFLVVASVSLLQLGQETDKLKTRNRESISLLMRLVVEESSFLTLDMLESCFPYVLLRNAYREVSRAFHLN

SEQ ID NO: 906686 - protein, 264 aa, Homo sapiens
PRKQATYTARYEAWVVAVEVMERWIIIGFLLCHGCLNSNSQCQKLWKLCLQGSLYITLIREDVLQVHKVTEDLFSSLKGYGKRVADIKESKEHVIANSGQFHCQRRQFLRMAVKELETVLADEPGLLGPKALFAFMALSFIRDEVTWLVRHTENVTKTKTPEDYADSSIAELLFLLEGIRSLVRRHIKVIQQYHLQYLARFDALVLSDIIQNLSVCPEEESIIMSSFVSILSSLNLKQVIMGKFEFSGLAGAGPPTATYGVGPR

SEQ ID NO: 906687 - protein, 1127 aa, Homo sapiens; identical to SEQ ID NO: 906685

SEQ ID NO: 906688 - protein, 1042 aa, Homo sapiens
MSLTSAYQHKLAEKLTILNDRGQGVLIRMYNIKKTCSDPKSKPPFLLEKSMEPSLKYINKKFPNIDVRNSTQHLGPVHREKAEIIRFLTNYYQSFVDVMEFRDHVYELLNTIDACQCHFDINLNFDFTRSYLDLIVTYTSVILLLSRIEDRRILIGMYNCAHEMLHGHGDPSFARLGQMVLEYDHPLKKLTEEFGPHTKAVSGALLSLHFLFVRRNQGAEQWRSAQLLSLISNPPAMINPANSDTMACEYLSVEVMERWIIIGFLLCHGCLNSNSQCQKLWKLCLQGSLYITLIREDVLQVHKVTEDLFSSLKGYGKRVADIKESKEHVIANSGQFHCQRRQFLRMAVKELETVLADEPGLLGPKALFAFMALSFIRDEVTWLVRHTENVTKTKTPEDYADSSIAELLFLLEGIRSLVRRHIKVIQQYHLQYLARFDALVLSDIIQNLSVCPEEESIIMSSFVSILSSLNLKQVDNGEKFEFSGLRLDWFRLQAYTSVAKAPLHLHENPDLAKVMNLIVFHSRMLDSVEKLLVETSDLSTFCFHLRIFEKMFAMTLEESAMLRYAIAFPLICAHFVHCTHEMCPEEYPHLKNHGLHHCNSFLEELAKQTSNCVLEICAEQRNLSEQLLPKHCATTISKAKNKKTRKQRQTPRKGEPERDKPGAESHRKNRSIVTNMDKLHLNLTELALTMNHVYSFSVFEHTIFPSEYLSSHLEARLNRAIVWLAGYNATTQEIVRPSELLAGVKAYIGFIQSLAQFLGADASRVIRNALLQQTQPLDSCGEQTITTLYTNWYLESLLRQASSGTIILSPAMQAFVSLPREGEQNFSAEEFSDISEMRALAELLGPYGMKFLSENLMWHVTSQIVELKKLVVENMDILVQIRSNFSKPDLMASLLPQLTGAENVLKRMTIIGVILSFRAMAQEGLREVFSSHCPFLMGPIECLKEFVTPDTDIKVTLSIFELASAAGVGCDIDPALVAAIANLKAGWEHGGQLMEKVRAWGHMCEFYNEKRSNVQVYFLSSGDLSLSSDRHGPLRPSSLFLG

SEQ ID NO: 906689 - protein, 575 aa, Homo sapiens
MSLTSAYQHKLAEKLTILICAHFVHCTHEMCPEEYPHLKNHGLHHCNSFLEELAKQTSNCVLEICAEQRNLSEQLLPKHCATTISKAKNKKTRKQRQTPRKGEPERDKPGAESHRKNRSIVTNMDKLHLNLTELALTMNHVYSFSVFEHTIFPSEYLSSHLEARLNRAIVWLAGYNATTQEIVRPSELLAGVKAYIGFIQSLAQFLGADASRVIRNALLQQTQPLDSCGEQTITTLYTNWYLESLLRQASSGTIILSPAMQAFVSLPREGEQNFSAEEFSDISEMRALAELLGPYGMKFLSENLMWHVTSQIVELKKLVVENMDILVQIRSNFSKPDLMASLLPQLTGAENVLKRMTIIGVILSFRAMAQEGLREVFSSHCPFLMGPIECLKEFVTPDTDIKVTLSIFELASAAGVGCDIDPALVAAIANLKADTSSPEEEYKVACLLLIFLAVSLPLLATDPSSFYSIEKDGYNNNIHCLTKAIIQVSAALFTLYNKNIETHLKEFLVVASVSLLQLGQETDKLKTRNRESISLLMRLVVEESSFLTLDMLESCFPYVLLRNAYREVSRAFHLN

SEQ ID NO: 906690 - protein, 344 aa, Homo sapiens
MPVGARQERYLESLLRQASSGTIILSPAMQAFVSLPREGEQNFSAEEFSDISEMRALAELLGPYGMKFLSENLMWHVTSQIVELKKLVVENMDILVQIRSNFSKPDLMASLLPQLTGAENVLKRMTIIGVILSFRAMAQEGLREVFSSHCPFLMGPIECLKEFVTPDTDIKVTLSIFELASAAGVGCDIDPALVAAIANLKADTSSPEEEYKVACLLLIFLAVSLPLLATDPSSFYSIEKDGYNNNIHCLTKAIIQVSAALFTLYNKNIETHLKEFLVVASVSLLQLGQETDKLKTRNRESISLLMRLVVEESSFLTLDMLESCFPYVLLRNAYREVSRAFHLN

SEQ ID NO: 906691 - protein, 1127 aa, Homo sapiens; identical to SEQ ID NO: 906685

SEQ ID NO: 906692 - protein, 838 aa, Homo sapiens
MSLTSAYQHKLAEKLTILNDRGQGVLIRMYNIKKTCSDPKSKPPFLLEKSMEPSLKYINKKFPNIDVRNSTQHLGPVHREKAEIIRFLTNYYQSFVDVMEFRDHVYELLNTIDACQCHFDINLNFDFTRSYLDLIVTYTSVILLLSRIEDRRILIGMYNCAHEMLHGHGDPSFARLGQMVLEYDHPLKKLTEEFGPHTKAVSGALLSLHFLFVRRNQGAEQWRSAQLLSLISNPPAMINPANSDTMACEYLSVEVMERWIIIGFLLCHGCLNSNSQCQKLWKLCLQGSLYITLIREDVLQVHKVTEDLFSSLKGYGKRVADIKESKEHVIANSGQFHCQRRQFLRMAVKELETVLADEPGLLGPKALFAFMALSFIRDEVTWLVRHTENVTKTKTPEDYADSSIAELLFLLEGIRSLVRRHIKVIQQYHLQYLARFDALVLSDIIQNLSVCPEEESIIMSSFVSILSSLNLKQVDNGEKFEFSGLRLDWFRLQAYTSVAKAPLHLHENPDLAKVMNLIVFHSRMLDSVEKLLVETSDLSTFCFHLRIFEKMFAMTLEESAMLRYAIAFPLICAHFVHCTHEMCPEEYPHLKNHGLHHCNSFLEELAKQTSNCVLEICAEQRNLSEQLLPKHCATTISKAKNKKTRKQRQTPRKGEPERDKPGAESHRKNRSIVTNMDKLHLNLTELALTMNHVYSFSVFEHTIFPSEYLSSHLEARLNRAIVWLAGYNATTQEIVRPSELLAGVKAYIGFIQSLAQFLGADASRVIRNALLQQTQPLDSCGEQTITTLYTNWSVLLRLFHCLTLCWHFFLYTVGPQGPSILAPRVIDSKMEGCFSLRN

SEQ ID NO: 906693 - protein, 111 aa, Homo sapiens
MSLTSAYQHKLAEKLTILNDRGQGVLIRMYNIKKTCSDPKSKPPFLLEKSMEPSLKYINKKFPNIDVRNSTQHLGPVHREKAEIIRFLTNYYQSFVDVMEFRVSSLEPFPM

SEQ ID NO: 906694 - protein, 1127 aa, Homo sapiens; identical to SEQ ID NO: 906685

SEQ ID NO: 906695 - protein, 892 aa, Homo sapiens
PRKQATYTARYEAWVVAVEVMERWIIIGFLLCHGCLNSNSQCQKLWKLCLQGSLYITLIREDVLQVHKVTEDLFSSLKGYGKRVADIKESKEHVIANSGQFHCQRRQFLRMAVKELETVLADEPGLLGPKALFAFMALSFIRDEVTWLVRHTENVTKTKTPEDYADSSIAELLFLLEGIRSLVRRHIKVIQQYHLQYLARFDALVLSDIIQNLSVCPEEESIIMSSFVSILSSLNLKQVDNGEKFEFSGLRLDWFRLQAYTSVAKAPLHLHENPDLAKVMNLIVFHSRMLDSVEKLLVETSDLSTFCFHLRIFEKMFAMTLEESAMLRYAIAFPLICAHFVHCTHEMCPEEYPHLKNHGLHHCNSFLEELAKQTSNCVLEICAEQRNLSEQLLPKHCATTISKAKNKKTRKQRQTPRKGEPERDKPGAESHRKNRSIVTNMDKLHLNLTELALTMNHVYSFSVFEHTIFPSEYLSSHLEARLNRAIVWLAGYNATTQEIVRPSELLAGVKAYIGFIQSLAQFLGADASRVIRNALLQQTQPLDSCGEQTITTLYTNWYLESLLRQASSGTIILSPAMQAFVSLPREGEQNFSAEEFSDISEMRALAELLGPYGMKFLSENLMWHVTSQIVELKKLVVENMDILVQIRSNFSKPDLMASLLPQLTGAENVLKRMTIIGVILSFRAMAQEGLREVFSSHCPFLMGPIECLKEFVTPDTDIKVTLSIFELASAAGVGCDIDPALVAAIANLKADTSSPEEEYKVACLLLIFLAVSLPLLATDPSSFYSIEKDGYNNNIHCLTKAIIQVSAALFTLYNKNIETHLKEFLVVASVSLLQLGQETDKLKTRNRESISLLMRLVVEESSFLTLDMLESCFPYVLLRNAYREVSRAFHLN

SEQ ID NO: 906696 - protein, 1127 aa, Homo sapiens; identical to SEQ ID NO: 906685

SEQ ID NO: 906697 - protein, 1026 aa, Homo sapiens
MSLTSAYQHKLAEKLTILNDRGQGVLIRMYNIKKTCSDPKSKPPFLLEKSMEPSLKYINKKFPNIDVRNSTQHLGPVHREKAEIIRFLTNYYQSFVDVMEFRDHVYELLNTIDACQCHFDINLNFDFTRSYLDLIVTYTSVILLLSRIEDRRILIGMYNCAHEMLHGHGDPSFARLGQMVLEYDHPLKKLTEEFGPHTKAVSGALLSLHFLFVRRNQGAEQWRSAQLLSLISNPPAMINPANSDTMACEYLSVEVMERWIIIGFLLCHGCLNSNSQCQKLWKLCLQGSLYITLIREDVLQVHKVTEDLFSSLKGYGKRVADIKESKEHVIANSGQFHCQRRQFLRMAVKELETVLADEPGLLGPKALFAFMALSFIRDEVTWLVRHTENVTKTKTPEDYADSSIAELLFLLEGIRSLVRRHIKVIQQYHLQYLARFDALVLSDIIQNLSVCPEEESIIMSSFVSILSSLNLKQVDNGEKFEFSGLRLDWFRLQAYTSVAKAPLHLHENPDLAKVMNLIVFHSRMLDSVEKLLVETSDLSTFCFHLRIFEKMFAMTLEESAMLRYAIAFPLICAHFVHCTHEMCPEEYPHLKNHGLHHCNSFLEELAKQTSNCVLEICAEQRNLSEQLLPKHCATTISKAKNKKTRKQRQTPRKGEPERDKPGAESHRKNRSIVTNMDKLHLNLTELALTMNHVYSFSVFEHTIFPSEYLSSHLEARLNRAIVWLAGYNATTQEIVRPSELLAGVKAYIGFIQSLAQFLGADASRVIRNALLQQTQPLDSCGEQTITTLYTNWYLESLLRQASSGTIILSPAMQAFVSLPREGEQNFSAEEFSDISEMRALAELLGPYGMKFLSENLMWHVTSQIVELKKLVVENMDILVQIRSNFSKPDLMASLLPQLTGAENVLKRMTIIGVILSFRAMAQEGLREVFSSHCPFLMGPIECLKEFVTPDTDIKVTLSIFELASAAGVGCDIDPALVAAIANLKADTSSPEEEYKVACLLLIFLAVSLPLLATDPSSFYSIEKDGK

SEQ ID NO: 906698 - protein, 1070 aa, Homo sapiens
MSLTSAYQHKLAEKLTILNDRGQGVLIRMYNIKKTCSDPKSKPPFLLEKSMEPSLKYINKKFPNIDVRNSTQHLGPVHREKAEIIRFLTNYYQSFVDVMEFRDHVYELLNTIDACQCHFDINLNFDFTRSYLDLIVTYTSVILLLSRIEDRRILIGMYNCAHEMLHGHGDPSFARLGQMVLEYDHPLKKLTEEFGPHTKAVSGALLSLHFLFVRRNQGAEQWRSAQLLSLISNPPAMINPANSDTMACEYLSVEVMERWIIIGFLLCHGCLNSNSQCQKLWKLCLQGSLYITLIREDVLQVHKVTEDLFSSLKGYGKRVADIKESKEHVIANSGQFHCQRRQFLRMAVKELETVLADEPGLLGPKALFAFMALSFIRDEVTWLVRHTENVTKTKTPEDYADSSIAELLFLLEGIRSLVRRHIKVIQQYHLQYLARFDALVLSDIIQNLSVCPEEESIIMSSFVSILSSLNLKQVDNGEKFEFSGLRLDWFRLQAYTSVAKAPLHLHENPDLAKVMNLIVFHSRMLDSVEKLLVETSDLSTFCFHLRIFEKMFAMTLEESAMLRYAIAFPLICAHFVHCTHEMCPEEYPHLKNHGLHHCNSFLEELAKQTSNCVLEICAEQRNLSEQLLPKHCATTISKAKNKKTRKQRQTPRKGEPERDKPGAESHRKNRSIVTNMDKLHLNLTELALTMNHVYSFSVFEHTIFPSEYLSSHLEARLNRAIVWLAGYNATTQEIVRPSELLAGVKAYIGFIQSLAQFLGADASRVIRNALLQQTQPLDSCGEQTITTLYTNWYLESLLRQASSGTIILSPAMQAFVSLPREGEQNFSAEEFSDISEMRALAELLGPYGMKFLSENLMWHVTSQIVELKKLVVENMDILVQIRSNFSKPDLMASLLPQLTGAENVLKRMTIIGVILSFRAMAQEGLREVFSSHCPFLMGPIECLKEFVTPDTDIKVTLSIFELASAAGVGCDIDPALVAAIANLKADTSSPEEEYKVACLLLIFLAVSLPLLATDPSSFYSIEKDGYNNNISVKAVPLGLTRDLISVLLCIGDEQGENKCVPTATRDIGYT

SEQ ID NO: 906699 - protein, 314 aa, Homo sapiens
MSLTSAYQHKLAEKLTILNDRGQGVLIRMYNIKKTCSDPKSKPPFLLEKSMEPSLKYINKKFPNIDVRNSTQHLGPVHREKAEIIRFLTNYYQSFVDVMEFRDHVYELLNTIDACQCHFDINLNFDFTRSYLDLIVTYTSVILLLSRIEDRRILIGMYNCAHEMLHGHGDPSFARLGQMVLEYDHPLKKLTEEFGPHTKAVSGALLSLHFLFVRRNQGAEQWRSAQLLSLISNPPAMINPANSDTMACEYLSVEVMERWIIIGFLLCHGCLNSNSQCQKLWKLCLQGSLYITLIREDVLQVHKVTEDLFSSLKG

SEQ ID NO: 906700 - protein, 360 aa, Homo sapiens
DAWVDPRARKVADIGLAAWGRKALDIAENEMPGLMRMRERYSASKPLKGARIAGCLHMTVETAVLIETLVTLGAEVQWSSCNIFSTQDHAAAAIAKAGIPVYAWKGETDEEYLWCIEQTLYFKDGPLNMILDDGGDLTNLIHTKYPQLLPGIRGISEETTTGVHNLYKMMANGILKVPAINVNDSVTKSKFDNLYGCRESLIDGIKRATDVMIAGKVAVVAGYGDVGKGCAQALRGFGARVIITEIDPINALQAAMEGYEVTTMDEACQEGNIFVTTTGCIDIILGRLWALQIVPVGILALAGDRAVATGRGGGTPARDASVKGPLRGGRARGGPWGLPTWRGAPPGFHVGAGGQPGPPR

SEQ ID NO: 906701 - protein, 190 aa, Homo sapiens
VAGAAGPTRGSLDPLESQPRRVSGRAKPAGSWSSRAAMSGPFRVAVDYKSQHAPRRRGRRAVCEPQTGGVLRGRAHLATAWDGWHLPDPARGACARPPRPGPDPVQLGGPDERPPLSGPPTGTARAPRRVYEERPGKRAPGRLRSSSPLGLWASYPTCGVPHPSSRGSLAEISKKIWSGLKNPAVPPIEV

SEQ ID NO: 906702 - protein, 432 aa, Homo sapiens
MSDKLPYKVADIGLAAWGRKALDIAENEMPGLMRMRERYSASKPLKGARIAGCLHMTVETAVLIETLVTLGAEVQWSSCNIFSTQDHAAAAIAKAGIPVYAWKGETDEEYLWCIEQTLYFKDGPLNMILDDGGDLTNLIHTKYPQLLPGIRGISEETTTGVHNLYKMMANGILKVPAINVNDSVTKSKFDNLYGCRESLIDGIKRATDVMIAGKVAVVAGYGDVGKGCAQALRGFGARVIITEIDPINALQAAMEGYEVTTMDEACQEGNIFVTTTGCIDIILGRHFEQMKDDAIVCNIGHFDVEIDVKWLNENAVEKVNIKPQVDRYRLKNGRRIILLAEGRLVNLGCAMGHPSFVMSNSFTNQVMAQIELWTHPDKYPVGVHFLPKKLDEAVAEAHLGKLNVKLTKLTEKQAQYLGMSCDGPFKPDHYRY

SEQ ID NO: 906703 - protein, 432 aa, Homo sapiens; identical to SEQ ID NO: 906702

SEQ ID NO: 906704 - protein, 465 aa, Homo sapiens
MSDKLPYKVADIGLAAWGRKALDIAENEMPGLMRMRERYSASKPLKGARIAGCLHMTVETAVLIETLVTLGAEVQWSSCNIFSTQDHAAAAIAKAGIPVYAWKGETDEEYLWCIEQTLYFKDGPLNMILDDGGDLTNLIHTKYPQLLPGIRGISEETTTGVHNLYKMMANGILKVPAINVNDSVTKSKFDNLYGCRESLIDGIKRATDVMIAGKVAVVAGYGDVGKGCAQALRGFGARVIITEIDPINALQAAMEGYEVTTMDEACQEGNIFVTTTGCIDIILGRLGARWGVPGSEGGGQSWDSFLSLTISHGLGLPEHFEQMKDDAIVCNIGHFDVEIDVKWLNENAVEKVNIKPQVDRYRLKNGRRIILLAEGRLVNLGCAMGHPSFVMSNSFTNQVMAQIELWTHPDKYPVGVHFLPKKLDEAVAEAHLGKLNVKLTKLTEKQAQYLGMSCDGPFKPDHYRY

SEQ ID NO: 906705 - protein, 432 aa, Homo sapiens; identical to SEQ ID NO: 906702

SEQ ID NO: 906706 - protein, 434 aa, Homo sapiens
DAWVDPRARKVADIGLAAWGRKALDIAENEMPGLMRMRERYSASKPLKGARIAGCLHMTVETAVLIETLVTLGAEVQWSSCNIFSTQDHAAAAIAKAGIPVYAWKGETDEEYLWCIEQTLYFKDGPLNMILDDGGDLTNLIHTKYPQLLPGIRGISEETTTGVHNLYKMMANGILKVPAINVNDSVTKSKFDNLYGCRESLIDGIKRATDVMIAGKVAVVAGYGDVGKGCAQALRGFGARVIITEIDPINALQAAMEGYEVTTMDEACQEGNIFVTTTGCIDIILGRHFEQMKDDAIVCNIGHFDVEIDVKWLNENAVEKVNIKPQVDRYRLKNGRRIILLAEGRLVNLGCAMGHPSFVMSNSFTNQVMAQIELWTHPDKYPVGVHFLPKKLDEAVAEAHLGKLNVKLTKLTEKQAQYLGMSCDGPFKPDHYRY

SEQ ID NO: 906707 - protein, 249 aa, Homo sapiens
MSDKLPYKVADIGLAAWGRKALDIAENEMPGLMRMRERYSASKPLKGARIAGCLHMTVETAVLIETLVTLGAEVQWSSCNIFSTQDHAAAAIAKAGIPVYAWKGETDEEYLWCIEQTLYFKDGPLNMILDDGGDLTNLIHTKYPQLLPGIRGISEETTTGVHNLYKMMANGILKVPAINVNDSVTKSKFDNLYGCRESLIDGIKRATDVMIAGKVAVVAGYGDVGKGCAQALRGFGARVIITEIDPIAL

SEQ ID NO: 906708 - protein, 266 aa, Homo sapiens [sequence omitted]

SEQ ID NO: 906709 - protein, 432 aa, Homo sapiens; identical to SEQ ID NO: 906702

SEQ ID NO: 906710 - protein, 432 aa, Homo sapiens; identical to SEQ ID NO: 906702

SEQ ID NO: 906711 - protein, 432 aa, Homo sapiens; identical to SEQ ID NO: 906702

SEQ ID NO: 906712 - protein, 359 aa, Homo sapiens
MSDKLPYKVADIGLAAWGRKALDIAENEMPGLMRMRERYSASKPLKGARIAGCLHMTVETAVLIETLVTLGAEVQWSSCNIFSTQDHAAAAIAKAGIPVYAWKGETDEEYLWCIEQTLYFKDGPLNMILDDGGDLTNLIHTKYPQLLPGIRGISEETTTGVHNLYKMMANGILKVPAINVNDSVTKSKFDNLYGCRESLIDGIKRATDVMIAGKVAVVAGYGDVGKGCAQALRGFGARVIITEIDPINALQAAMEGYEVTTMDEACQEGNIFVTTTGCIDIILGRLWALQIVPVGILALDREIGQWPRDAGEETPARDASVKGPLRGGRARGGPWGLPTWRGAPPGFHVGAGGQPGPPR

SEQ ID NO: 906713 - protein, 285 aa, Homo sapiens
MSDKLPYKVADIGLAAWGRKALDIAENEMPGLMRMRERYSASKPLKGARIAGCLHMTVETAVLIETLVTLGAEVQWSSCNIFSTQDHAAAAIAKAGIPVYAWKGETDEEYLWCIEQTLYFKDGPLNMILDDGGDLTNLIHTKYPQLLPGIRGISEETTTGVHNLYKMMANGILKVPAINVNDSVTKSKFDNLYGCRESLIDGIKRATDVMIAGKVAVVAGYGDVGKGCAQALRGFGARVIITEIDPINALQAAMEGYEVTTMDEACQEGNIFVTTTGCIDIILGR

SEQ ID NO: 906714 - protein, 171 aa, Homo sapiens
MSDKLPYKVADIGLAAWGRKALDIAENEMPGLMRMRERYSASKPLKGARIAGCLHMTVETAVLIETLVTLGAEVQWSSCNIFSTQDHAAAAIAKAGIPVYAWKGETDEEYLWCIEQTLYFKDGPLNMILDDGGDLTNLIRFALPGIHRNASLGNGSRRMVLGGEDVAQSPC

SEQ ID NO: 906715 - protein, 432 aa, Homo sapiens; identical to SEQ ID NO: 906702

SEQ ID NO: 906716 - protein, 464 aa, Homo sapiens
GRVGRPTRSQSRSCSQTEAQPPSPVSITSAASMSDKLPYKVADIGLAAWGRKALDIAENEMPGLMRMRERYSASKPLKGARIAGCLHMTVETAVLIETLVTLGAEVQWSSCNIFSTQDHAAAAIAKAGIPVYAWKGETDEEYLWCIEQTLYFKDGPLNMILDDGGDLTNLIHTKYPQLLPGIRGISEETTTGVHNLYKMMANGILKVPAINVNDSVTKSKFDNLYGCRESLIDGIKRATDVMIAGKVAVVAGYGDVGKGCAQALRGFGARVIITEIDPINALQAAMEGYEVTTMDEACQEGNIFVTTTGCIDIILGRHFEQMKDDAIVCNIGHFDVEIDVKWLNENAVEKVNIKPQVDRYRLKNGRRIILLAEGRLVNLGCAMGHPSFVMSNSFTNQVMAQIELWTHPDKYPVGVHFLPKKLDEAVAEAHLGKLNVKLTKLTEKQAQYLGMSCDGPFKPDHYRY

SEQ ID NO: 906717 - protein, 432 aa, Homo sapiens; identical to SEQ ID NO: 906702

SEQ ID NO: 906718 - protein, 432 aa, Homo sapiens; identical to SEQ ID NO: 906702

SEQ ID NO: 906719 - protein, 404 aa, Homo sapiens
MPGLMRMRERYSASKPLKGARIAGCLHMTVETAVLIETLVTLGAEVQWSSCNIFSTQDHAAAAIAKAGIPVYAWKGETDEEYLWCIEQTLYFKDGPLNMILDDGGDLTNLIHTKYPQLLPGIRGISEETTTGVHNLYKMMANGILKVPAINVNDSVTKSKFDNLYGCRESLIDGIKRATDVMIAGKVAVVAGYGDVGKGCAQALRGFGARVIITEIDPINALQAAMEGYEVTTMDEACQEGNIFVTTTGCIDIILGRHFEQMKDDAIVCNIGHFDVEIDVKWLNENAVEKVNIKPQVDRYRLKNGRRIILLAEGRLVNLGCAMGHPSFVMSNSFTNQVMAQIELWTHPDKYPVGVHFLPKKLDEAVAEAHLGKLNVKLTKLTEKQAQYLGMSCDGPFKPDHYRY

SEQ ID NO: 906720 - protein, 404 aa, Homo sapiens; identical to SEQ ID NO: 906719

SEQ ID NO: 906721 - protein, 382 aa, Homo sapiens
MSDKLPYKVADIGLAAWGRKALDIAENEMPGLMRMRERYSASKPLKGARIAGCLHMTVETAVLIETLVTLGAEVQWSSCNIFSTQDHAAAAIAKAGIPVYAWKGETDEEYLWCIEQTLYFKDGPLNMILDDGGDLTNLIHTKYPQLLPGIRGISEETTTGVHNLYKMMANGILKVPAINVNDSVTKSKFDNLYGCRESLIDGIKRATDVMIAGKVAVVAGYGDVGKGCAQALRGFGARVIITEIDPINALQAAMEGYEVTTMDEACQEGNIFVTTTGCIDIILGRHFEQMKDDAIVCNIGHFDVEIDVKWLNENAVEKVNIKPQVMAQIELWTHPDKYPVGVHFLPKKLGKLNVKLTKLTEKQAQYLGMSCDGPFKPDHYRY

SEQ ID NO: 906722 - protein, 307 aa, Homo sapiens
PINVNDLLLVTESLTLMAGTLRIPLDIILERLWTPVVVSSEMPRMPGRSCGYYGVADSVTKSKFDNLYGCRESLIDGIKRATDVMIAGKVAVVAGYGDVGKGCAQALRGFGARVIITEIDPINALQAAMEGYEVTTMDEACQEGNIFVTTTGCIDIILGRHFEQMKDDAIVCNIGHFDVEIDVKWLNENAVEKVNIKPQVDRYRLKNGRRIILLAEGRLVNLGCAMGHPSFVMSNSFTNQVMAQIELWTHPDKYPVGVHFLPKKLDEAVAEAHLGKLNVKLTKLTEKQAQYLGMSCDGPFKPDHYRY

SEQ ID NO: 906723 - protein, 432 aa, Homo sapiens; identical to SEQ ID NO: 906702

SEQ ID NO: 906724 - protein, 166 aa, Homo sapiens
FLINIGCYFCAKPCAGGCFGAVRTPHGHCWRQRGLPDQRVGCGSGALPAFTVALPACEVDRYRLKNGRRIILLAEGRLVNLGCAMGHPSFVMSNSFTNQVMAQIELWTHPDKYPVGVHFLPKKLDEAVAEAHLGKLNVKLTKLTEKQAQYLGMSCDGPFKPDHYRY

SEQ ID NO: 906725 - protein, 424 aa, Homo sapiens
MSDKLPYKVADIGLAAWGRKALDIAENEMPGLMRMRERYSASKPLKGARIAGCLHMTVETAVLIETLVTLGAEVQWSSCNIFSTQDHAAAAIAKAGIPVYAWKGETDEEYLWCIEQTLYFKDGPLNMILDDGGDLTNLIHTKYPQLLPGIRGISEETTTGVHNLYKMMANGILKVPAINVNDSVTKSKFDNLYGCRESLIDGIKRATDVMIAGKVAVVAGYGDVGKGCAQALRGFGARVIITEIDPINALQAAMEGYEVTTMDEACQEGNIFVTTTDGLHFTLEQDIDPNELSDDPGVVAGGTMDSGRHTRTGAAKNSGGKAGANYHDAGQTECSEIRDGGNKLTQARSRQRDHNRRPMTTTEGGQETATRAEDLKSDDRTKHGGRHAAERRSDDQRKETRGEKKDEERAACLLLACSQRRVDA

SEQ ID NO: 906726 - protein, 91 aa, Homo sapiens
TALPEARPTKMSALGAVIALLLWGQLFAVDSGNDVTDIADDGCPKPPEIAHGYVEHSVRYQCKNYYKLRTEGDGVYTLNNEKQWINKAVGR

SEQ ID NO: 906727 - protein, 91 aa, Homo sapiens; identical to SEQ ID NO: 906726

SEQ ID NO: 906728 - protein, 91 aa, Homo sapiens; identical to SEQ ID NO: 906726

SEQ ID NO: 906729 - protein, 91 aa, Homo sapiens; identical to SEQ ID NO: 906726

SEQ ID NO: 906730 - protein, 101 aa, Homo sapiens
TALPEARPTKMSALGAVIALLLWGQLFAVDSGNDVTDIADDGCPKPPEIAHGYVEHSVRYQCKNYYKLRTEGDETPAMAMRAVPLPVHDPGGGHPGMRLGS

SEQ ID NO: 906731 - protein, 111 aa, Homo sapiens
TALPEARPTKMSALGAVIALLLWGQLFAVDSGNDVTDIADDGCPKPPEIAHGYVEHSVRYQCKNYYKLRTEGDGVYTLNDKKQWINKAVGDKLPECEAVTSIPGLGSEDHS

SEQ ID NO: 906732 - protein, 161 aa, Homo sapiens
MSALGAVIALLLWGQLFAVDSGNDVTDIADDGCPKPPEIAHGYVEHSVRYQCKNYYKLRTEGDEYYTFKIARRKQTLRIKKAGHLLNPWLHHKALGLGFLYLIEVFSVALGAVCLSPTPKDARKTSTISHVATFTSMPHKCLSESPNSAFPQNKPNAIRQN

SEQ ID NO: 906733 - protein, 199 aa, Homo sapiens
TEPGPQAAPCQLSSSHSRSNRLLSPMARATLSAAPSNPRLLRVALLLLLLVAASRRAAGGSRRPGVPGPDAAGVGAPRQTAPLNQRVSSSLGAPLATELRCQCLQTLQGIHLKNIQSVKVKSPGPHCAQTEVMEVSPIAAAATAGVPDSPAAPNPVLSPTSCLTRFPSLCRATLKNGQKACLNPASPMVKKIIEKMLKK

SEQ ID NO: 906734 - protein, 385 aa, Homo sapiens
MHVCVCVCVCVYMPVCVDACMCCEAGRPAFRSFLFSLCSDLGAVISLLLWGRQLFALYSGNDVTDISDDRFPKPPEIANGYVEHLFRYQCKNYYRLRTEGDGVYTLNDKKQWINKAVGDKLPECEAVCGKPKNPANPVQRILGGHLDAKGSFPWQAKMVSHHNLTTGATLINEQWLLTTAKNLFLNHSENATAKDIAPTLTLYVGKKQLVEIEKVVLHPNYHQVDIGLIKLKQKVLVNERVMPICLPSKNYAEVGRVGYVSGWGQSDNFKLTDHLKYVMLPVADQYDCITHYEGSTCPKWKAPKSPVGVQPILNEHTFCVGMSKYQEDTCYGDAGSAFAVHDLEEDTWYAAGILSFDKSCAVAEYGVYVKVTSIQHWVQKTIAEN

SEQ ID NO: 906735 - protein, 131 aa, Homo sapiens
MSALGAVIALLLWGQLFAVDSGNDVTDIADDGCPKPPEIPFFTKQIPWILISGSWILKVKGYFSYICEFSSDGARGQKRKTWTIPIHSQHFDMSWGKAYIFNLKERSIISMLNRISRSFINDFTETNKGFD

SEQ ID NO: 906736 - protein, 91 aa, Homo sapiens; identical to SEQ ID NO: 906726

SEQ ID NO: 906737 - protein, 91 aa, Homo sapiens; identical to SEQ ID NO: 906726

SEQ ID NO: 906738 - protein, 178 aa, Homo sapiens
MSALGAVIALLLWGQLFAVDSGNDVTDIADDGCPKPPEIAHGYVEHSVRYQCKNYYKLRTEGDVCGEAQESGKPSAAGSWGWDTWDCQRQLFPWQAKMVSHHNLTTGATLINEQWLLTTAKNLFLNHSENATAKDIAPTLTLYVGKKQLVEIEKVVLHPNYSQVDIGLIKLKQKVSVN

SEQ ID NO: 906739 - protein, 135 aa, Homo sapiens
MSRISQMTAARSPPRLHMAMWSTRFATSVRTTTNCAQKEMTWDCQRQLFPWQAKMVSHHNLTTGATLINEQWLLTTAKNLFLNHSENATAKDIAPTLTLYVGKKQLVEIEKVVLHPNYSQVDIGLIKLKQKVSVN

SEQ ID NO: 906740 - protein, 91 aa, Homo sapiens; identical to SEQ ID NO: 906726

SEQ ID NO: 906741 - protein, 91 aa, Homo sapiens; identical to SEQ ID NO: 906726

SEQ ID NO: 906742 - protein, 91 aa, Homo sapiens; identical to SEQ ID NO: 906726

SEQ ID NO: 906743 - protein, 110 aa, Homo sapiens
TALPEARPTKMSALGAVIALLLWGQLFAVDSGNDVTDIADDGCPKPPEIAHGYVEHSVRYQCKNYYKLRTEGDVYVGKKQLVEIEKVVLHPNYSQVDIGLIKLKQKVSVN

SEQ ID NO: 906744 - protein, 91 aa, Homo sapiens; identical to SEQ ID NO: 906726

SEQ ID NO: 906745 - protein, 91 aa, Homo sapiens; identical to SEQ ID NO: 906726

SEQ ID NO: 906746 - protein, 91 aa, Homo sapiens
TALPEARPTKMSALGAVIALLLWGQLFAVDSGNDVTDIADDGCPKPPEIAHGYVEHSVRYQCKNYYKLRTEGDAPEKKTPERSPVGVQAPY

SEQ ID NO: 906747 - protein, 91 aa, Homo sapiens; identical to SEQ ID NO: 906726

SEQ ID NO: 906748 - protein, 142 aa, Homo sapiens
MSALGAVIALLLWGQLFAVDSGNDVTDIADDGCPKPPEIAHGYVEHSVRYQCKNYYKLRTEGDGVYTLNDKKQWINKAVGDKLPECEADDGCPKPPEIAHGYVEHSVRYQCKNYYKLRTEGDGKMWTTVSMPYIQPPSLTFP

SEQ ID NO: 906749 - protein, 311 aa, Homo sapiens
MSALGAVIALLLWGQLFAVDSGNDVTDIADDGCPKPPEIAHGYVEHSVRYQCKNYYKLRTEGDGVYTLNNEKQWINKAVGRYKALFVSEEETKLTRPGGLHQEWGLQKGKLCREMLKHAPGYDKVQDISEVVTHRILMYGRSESPMQTPNNLPEVIWRPYSLHTENVDPYKHGATQHEAHSRSQHTTQHSGTKPVPATGPTLQTFNPLKLQAAGTRHPKQRIESSRRGYRAELEARHRSNVENKNNNHNDNTTCTKQPQQMASQEHHNTRRDRERKTYQTSHSIVEQGTRTMTRNTRYTDTTRRSRRIHSR

SEQ ID NO: 906750 - protein, 74 aa, Homo sapiens
TALPEARPTKMSALGAVIALLLWGQLFAVDSGNDVTDIADDGCPKPPEIAHGYVEHSVRYQCKNYYKLRTEGDE

SEQ ID NO: 906751 - protein, 140 aa, Homo sapiens
MSALGAVIALLLWGQLFAVDSGNDVTDIADDGCPKPPEIAHGYVEHSVRYQCKNYYKLRTEGDGVYTLNDKKQWINKAVGDKLPECEADDGCPKPPEIAHGYVEHSVRYQCKNYYKLRTEGDGVYTLNNEKQWINKAVGR

SEQ ID NO: 906752 - protein, 91 aa, Homo sapiens; identical to SEQ ID NO: 906726

SEQ ID NO: 906753 - protein, 101 aa, Homo sapiens; identical to SEQ ID NO: 906730

SEQ ID NO: 906754 - protein, 157 aa, Homo sapiens
MSALGAVIALLLWGQLFAVDSGNDVTDIADDGCPKPPEIAHGYVEHSVRYQCKNYYKLRTEGDASSRRAEREQLFLQSWKFDTIRFELLEIQHMLNLKYKGEKINQLLKHKNEYQGPDQISHSSFLATLSAPHAPEYPPKKIIGFKTISAPHPKNNC

SEQ ID NO: 906755 - protein, 92 aa, Homo sapiens
TALPEARPTKMSALGAVIALLLWGQLFAVDSGNDVTDIADDGCPKPPEIAHGYVEHSVRYQCKNYYKLRTEGDVPLPVHDPGGGHPGMRLGS

SEQ ID NO: 906756 - protein, 81 aa, Homo sapiens
TALPEARPTKMSALGAVIALLLWGQLFAVDSGNDVTDIADDGCPKPPEIAHGYVEHSVRYQCKNYYKLRTEGDVWLSMVCM

SEQ ID NO: 906757 - protein, 93 aa, Homo sapiens
TALPEARPTKMSALGAVIALLLWGQLFAVDSGNDVTDIADDGCPKPPEIAHGYVEHSVRYQCKNYYKLRTEGDGKMWTTVSMPYIQPPSLTFP

SEQ ID NO: 906758 - protein, 91 aa, Homo sapiens; identical to SEQ ID NO: 906726

SEQ ID NO: 906759 - protein, 91 aa, Homo sapiens; identical to SEQ ID NO: 906726

SEQ ID NO: 906760 - protein, 91 aa, Homo sapiens; identical to SEQ ID NO: 906726

SEQ ID NO: 906761 - protein, 91 aa, Homo sapiens; identical to SEQ ID NO: 906726

SEQ ID NO: 906762 - protein, 140 aa, Homo sapiens
MSALGAVIALLLWGQLFAVDSGNDVTDIADDGCPKPPEIAHGYVEHSVRYQCKNYYKLRTEGDDNLTTGATLINEQWLLTTAKNLFLNHSENATAKDIAPTLTLYVGKKQLVEIEKVVLHPNYSQVDIGLIKLKQKVSVN

SEQ ID NO: 906763 - protein, 265 aa, Homo sapiens
MPICLPSKDYAEVGRVGYVSGWGRNANFKFTFPWQAKMVSHHNLTTGATLINEQWLLTTAKNLFLNHSENATAKDIAPTLTLYVGKKQLVEIEKVVLHPNYHQVDIGLIKLKQKVLVNERVMPICLPSKNYAEVGRVGYVSGWGQSDNFKLTDHLKYVMLPVADQYDCITHYEGSTCPKWKAPKSPVGVQPILNEHTFCVGMSKYQEDTCYGDAGSAFAVHDLEEDTWYAAGILSFDKSCAVAEYGVYVKVTSIQHWVQKTIAEN

SEQ ID NO: 906764 - protein, 97 aa, Homo sapiens
TALPEARPTKMSALGAVIALLLWGQLFAVDSGNDVTDIADDGCPKPPEIAHGYVEHSVRYQCKNYYKLRTEGDATFKGLCRSRACGLCFWLGAKCQF

SEQ ID NO: 906765 - protein, 91 aa, Homo sapiens; identical to SEQ ID NO: 906726

SEQ ID NO: 906766 - protein, 91 aa, Homo sapiens; identical to SEQ ID NO: 906726

SEQ ID NO: 906767 - protein, 165 aa, Homo sapiens
MSALGAVIALLLWGQLFAVDSGNDVTDIADDGCPKPPEIAHGYVEHSVRYQCKNYYKLRTEGDGVYTLNDKKQWINKAVGDKLPECEADNLTTGATLINEQWLLTTAKNLFLNHSENATAKDIAPTLTLYVGKKQLVEIEKVVLHPNYSQVDIGLIKLKQKVSVN

SEQ ID NO: 906768 - protein, 105 aa, Homo sapiens
MSALGAVIALLLWGQLFAVDSGNDVTDIADDGCPKPPEIAHGYVEHSVRYQCKNYYKLRTEGDGVYTLNDKKQWINKAVGDKLPECEADNPGKPKYSLPRGASHR

SEQ ID NO: 906769 - protein, 713 aa, Homo sapiens
MRLLVAPLLLAWVAGATAAVPVVPWHVPCPPQCACQIRPWYTPRSSYREATTVDCNDLFLTAVPPALPAGTQTLLLQSNSIVRVDQSELGYLANLTELDLSQNSFSDARDCDFHALPQLLSLHLEENQLTRLEDHSFAGLASLQELYLNHNQLYRIAPRAFSGLSNLLRLHLNSNLLRAIDSRWFEMLPNLEILMIGGNKVDAILDMNFRPLANLRSLVLAGMNLREISDYALEGLQSLESLSFYDNQLARVPRRALEQVPGLKFLDLNKNPLQRVGPGDFANMLHLKELGLNNMEELVSIDKFALVNLPELTKLDITNNPRLSFIHPRAFHHLPQMETLMLNNNALSALHQQTVESLPNLQEVGLHGNPIRCDCVIRWANATGTRVRFIEPQSTLCAEPPDLQRLPVREVPFREMTDHCLPLISPRSFPPSLQVASGESMVLHCRALAEPEPEIYWVTPAGLRLTPAHAGRRYRVYPEGTLELRRVTAEEAGLYTCVAQNLVGADTKTVSVVVGRALLQPGRDEGQGLELRVQETHPYHILLSWVTPPNTVSTNLTWSSASSLRGQGATALARLPRGTHSYNITRLLQATEYWACLQVAFADAHTQLACVWARTKEATSCHRALGDRPGLIAILALAVLLLAAGLAAHLGTGQPRKGVGGRRPLPPAWAFWGWSAPSVRVVSAPLVLPWNPGRKLPRSSEGETLLPPLSQNS

SEQ ID NO: 906770 - protein, 713 aa, Homo sapiens; identical to SEQ ID NO: 906769

SEQ ID NO: 906771 - protein, 713 aa, Homo sapiens; identical to SEQ ID NO: 906769

SEQ ID NO: 906772 - protein, 713 aa, Homo sapiens; identical to SEQ ID NO: 906769

SEQ ID NO: 906773 - protein, 713 aa, Homo sapiens; identical to SEQ ID NO: 906769

SEQ ID NO: 906774 - protein, 790 aa, Homo sapiens
MNIMNTEQSQNSIVSRIKVFEGQTNIETSGLPKKPEITPRSLPPKPTVSSGKPSVAPKPAANRASGEWDSGTENRLKVTSKEGLTPYPPLQEAGSIPVTKPELPKKPNPGLIRSVNPEIPGRGPLAESSDSGKKVPTPAPRPLLLKKSVSSENPTYPSAPLKPVTVPPRLAGASQAKAYKSLGEGPPANPPVPVLQSKPLVDIDLISFDDDVLPTPSGNLAEESVGSEMVLDPFQLPAKTEPIKERAVQPAPTRKPTVIRIPAKPGKCLHEDPQSPPPLPAEKPIGNTFSTVSGKLSNVERTRNLESNHPGQTGGFVRVPPRLPPRPVNGKTIPTQQPPTKVPPERPPPPKLSATRRSNKKLPFNRSSSDMDLQKKQSNLATGLSKAKSQVFKNQDPVLPPRPKPGHPLYSKYMLSVPHGIANEDIVSQNPGELSCKRGDVLVMLKQTENNYLECQKGEDTGRVHLSQMKIITPLDEHLRSRPNDPSHAQKPVDSGAPHAVVLHDFPAEQVDDLNLTSGEIVYLLEKIDTDWYRGNCRNQIGIFPANYVKVIIDIPEGGNGKRECVSSHCVKGSRCVARFEYIGEQKDELSFSEGEIIILKEYVNEEWARGEVRGRTGIFPLNFVEPVEDYPTSGANVLSTKVPLKTKKEDSGSNSQVNSLPAEWCEALHSFTAETSDDLSFKRGDRIQILERLDSDWCRGRLQDREGIFPAVFVRPCPAEAKSMLAIVPKGRKAKALYDFRGENEDELSFKAGDIITELESVDDDWMSGELMGKSGIFPKNYIQFLQIS

SEQ ID NO: 906775 - protein, 790 aa, Homo sapiens; identical to SEQ ID NO: 906774

SEQ ID NO: 906776 - protein, 1109 aa, Homo sapiens
EESGSGSGKGQGLRGRRDAARRRGIGSARALPLPGRLQVEFAEVAISTAAADASSPGAAFPPARGRWLWGAGCRRSGAPGPQLAGHPAAAPRASPMAEGRRREDEEEELRERRELGGQRRARGRALSGHSAADRNERNKPEHRSSSQGPLSSIRAVIKRSSRTSIQSELHRDRRRPEITIVAAEPLRPASWFPGTPPPGLGFPTSSAAGSWRPNELVPAELPPSYEQVIKEINQVQVNTTNNNNAAATPRHTITSATQTDFSEEIDNDLPQSNATLQAPLKPLQPFSAVSSGNLPTNVAPLIVFDISEEPNCPENPSATRCPVPKPRSKSNLRPIPRDSHIKEQSQQKISPAAVGEESSPGRPQSLLDNASTSDSQAVMNIMNTEQSQNSIVSRIKVFEGQTNIETSGLPKKPEITPRSLPPKPTVSSGKPSVAPKPAANRASGEWDSGTENRLKVTSKEGLTPYPPLQEAGSIPVTKPELPKKPNPGLIRSVNPEIPGRGPLAESSDSGKKVPTPAPRPLLLKKSVSSENPTYPSAPLKPVTVPPRLAGASQAKAYKSLGEGPPANPPVPVLQSKPLVDIDLISFDDDVLPTPSGNLAEESVGSEMVLGLHEDPQSPPPLPAEKPIGNTFSTVSGKLSNVERTRNLESNHPGQTGGFVRVPPRLPPRPVNGKTIPTQQPPTKVPPERPPPPKLSATRRSNKKLPFNRSSSDMDLQKKQSNLATGLSKAKSQVFKNQDPVLPPRPKPGHPLYSKYMRGDVLVMLKQTENNYLECQKGEDTGRVHLSQMKIITPLDEHLRSRPNDPSHAQKPVDSGAPHAVVLHDFPAEQVDDLNLTSGEIVYLLEKIDTDWYRGNCRNQIGIFPANYVKVIIDIPEGGNGKRECVSSHCVKGSRCVARFEYIGEQKDELSFSEGEIIILKEYVNEEWARGEVRGRTGIFPLNFVEPVEDYPTSGANVLSTKVPLKTKKEDSGSNSQVNSLPAEWCEALHSFTAETSDDLSFKRGDRIQILERLDSDWCRGRLQDREGIFPAVFVRPCPAEAKSMLAIVPKGRKAKALYDFRGENEDELSFKAGDIITELESVDDDWMSGELMGKSGIFPKNYIQFLQIS

SEQ ID NO: 906777 - protein, 546 aa, Homo sapiens
DYPQLQHYSMKPTVIRIPAKPGKCLHEDPQSPPPLPAEKPIGNTFSTVSGKLSNVERTRNLESNHPGQTGGFVRVPPRLPPRPVNGKTIPTQQPPTKVPPERPPPPKLSATRRSNKKLPFNRSSSDMDLQKKQSNLATGLSKAKSQVFKNQDPVLPPRPKPGHPLYSKYMLSVPHGIANEDIVSQNPGELSCKRGDVLVMLKQTENNYLECQKGEDTGRVHLSQMKIITPLDEHLRSRPNDPSHAQKPVDSGAPHAVVLHDFPAEQVDDLNLTSGEIVYLLEKIDTDWYRGNCRNQIGIFPANYVKVIIDIPEGGNGKRECVSSHCVKGSRCVARFEYIGEQKDELSFSEGEIIILKEYVNEEWARGEVRGRTGIFPLNFVEPVEDYPTSGANVLSTKVPLKTKKEDSGSNSQVNSLPAEWCEALHSFTAETSDDLSFKRGDRIQILERLDSDWCRGRLQDREGIFPAVFVRPCPAEAKSMLAIVPKGRKAKALYDFRGENEDELSFKAGDIITELESVDDDWMSGELMGKSGIFPKNYIQFLQIS

SEQ ID NO: 906778 - protein, 1174 aa, Homo sapiens
EESGSGSGKGQGLRGRRDAARRRGIGSARALPLPGRLQVEFAEVAISTAAADASSPGAAFPPARGRWLWGAGCRRSGAPGPQLAGHPAAAPRASPMAEGRRREDEEEELRERRELGGQRRARGRALSGHSAADRNERNKPEHRSSSQGPLSSIRAVIKRSSRTSIQSELHRDRRRPEITIVAAEPLRPASWFPGTPPPGLGFPTSSAAGSWRPNELVPAELPPSYEQVIKEINQVQVNTTNNNNAAATPRHTITSATQTDFSEEIDNDLPQSNATLQAPLKPLQPFSAVSSGNLPTNVAPLIVFDISEEPNCPENPSATRCPVPKPRSKSNLRPIPRDSHIKEQSQQKISPAAVGEESSPGRPQSLLDNASTSDSQAVMNIMNTEQSQNSIVSRIKVFEGQTNIETSGLPKKPEITPRSLPPKPTVSSGKPSVAPKPAANRASGEWDSGTENRLKVTSKEGLTPYPPLQEAGSIPVTKPELPKKPNPGLIRSVNPEIPGRGPLAESSDSGKKVPTPAPRPLLLKKSVSSENPTYPSAPLKPVTVPPRLAGASQAKAYKSLGEGPPANPPVPVLQSKPLVDIDLISFDDDVLPTPSGNLAEESVGSEMVLDPFQLPAKTEPIKERAVQPAPTRKPTVIRIPAKPGKCLHEDPQSPPPLPAEKPIGNTFSTVSGKLSNVERTRNLESNHPGQTGGFVRVPPRLPPRPVNGKTIPTQQPPTKVPPERPPPPKLSATRRSNKKLPFNRSSSDMDLQKKQSNLATGLSKAKSQVFKNQDPVLPPRPKPGHPLYSKYMLSVPHGIANEDIVSQNPGELSCKRGDVLVMLKQTENNYLECQKGEDTGRVHLSQMKIITPLDEHLRSRPNPFSPPKDPSHAQKPVDSGAPHAVVLHDFPAEQVDDLNLTSGEIVYLLEKIDTDWYRGNCRNQIGIFPANYVKVIIDIPEGGNGKRECVSSHCVKGSRCVARFEYIGEQKDELSFSEGEIIILKEYVNEEWARGEVRGRTGIFPLNFVEPVEDYPTSGANVLSTKVPLKTKKEDSGSNSQVNSLPAEWCEALHSFTAETSDDLSFKRGDRIQILERLDSDWCRGRLQDREGIFPAVFVRPCPAEAKSMLAIVPKGRKAKALYDFRGENEDELSFKAGDIITELESVDDDWMSGELMGKSGIFPKNYIQFLQIS

SEQ ID NO: 906779 - protein, 1109 aa, Homo sapiens; identical to SEQ ID NO: 906776

SEQ ID NO: 906780 - protein, 108 aa, Homo sapiens
SGVAFHQALPPTLGIMIQLEIWWLHRSKPYQALRHSNPPYTVKHYPSLVLARAKLRLCCWHLDAIVFEYIAGDIITELESVDDDWMSGELMGKSGIFPKNYIQFLQIS

SEQ ID NO: 906781 - protein, 1078 aa, Homo sapiens
EESGSGSGKGQGLRGRRDAARRRGIGSARALPLPGRLQVEFAEVAISTAAADASSPGAAFPPARGRWLWGAGCRRSGAPGPQLAGHPAAAPRASPMAEGRRREDEEEELRERRELGGQRRARGRALSGHSAADRNERNKPEHRSSSQGPLSSIRAVIKRSSRTSIQSELHRDRRRPEITIVAAEPLRPASWFPGTPPPGLGFPTSSAAGSWRPNELVPAELPPSYEQVIKEINQVQVNTTNNNNAAATPRHTITSATQTDFSEEIDNDLPQSNATLQAPLKPLQPFSAVSSGNLPTNVAPLIVFDISEEPNCPENPSATRCPVPKPRSKSNLRPIPRDSHIKEQSQQKISPAAVGEESSPGRPQSLLDNASTSDSQAVMNIMNTEQSQNSIVSRIKVFEGQTNIETSGLPKKPEITPRSLPPKPTVSSGKPSVAPKPAANRASGEWDSGTENRLKVTSKEGLTPYPPLQEAGSIPVTKPELPKKPNPGLIRSVNPEIPGRGPLAESSDSGKKVPTPAPRPLLLKKSVSSENPTYPSAPLKPVTVPPRLAGASQAKAYKSLGEGPPANPPVPVLQSKPLVDIDLISFDDDVLPTPSGNLAEESVGSEMVLGLHEDPQSPPPLPAEKPIGNTFSTVSGKLSNVERTRNLESNHPGQTGGFVRVPPRLPPRPVNGKTIPTQQPPTKVPPERPPPPKLSATRRSNKKLPFNRSSSDMDLQKKQSNLATGLSKAKSQVFKNQDPVLPPRPKPGHPLYSKYMRGDVLVMLKQTENNYLECQKGEDTGRVHLSQMKIITPLDEHLRSRPNDPSHAQKPVDSGAPHAVVLHDFPAEQVDDLNLTSGEIVYLLEKIDTDWYRGNCRNQIGIFPANYVKVIIDIPEGGNGKRECVSSHCVKGSRCVARFEYIGEQKDELSFSEGEIIILKEYVNEEWARGEVRGRTGIFPLNFVEPVEDYPTSGANVLSTKVPLKTKKEDSGSNSQVNSLPAEWCEALHSFTAETSDDLSFKRGDRIQILERLDSDWCRGRLQDREGIFPAVFVRPCPAEAKSMLAIVPKGRKAKALYDFRGENEDELSFKVRMCISS

SEQ ID NO: 906782 - protein, 1053 aa, Homo sapiens
EESGSGSGKGQGLRGRRDAARRRGIGSARALPLPGRLQVEFAEVAISTAAADASSPGAAFPPARGRWLWGAGCRRSGAPGPQLAGHPAAAPRASPMAEGRRREDEEEELRERRELGGQRRARGRALSGHSAADRNERNKPEHRSSSQGPLSSIRAVIKRSSRTSIQSELHRDRRRPEITIVAAEPLRPASWFPGTPPPGLGFPTSSAAGSWRPNELVPAELPPSYEQVIKEINQVQVNTTNNNNAAATPRHTITSATQTDFSEEIDNDLPQSNATLQAPLKPLQPFSAVSSGNLPTNVAPLIVFDISEEPNCPENPSATRCPVPKPRSKSNLRPIPRDSHIKEQSQQKISPAAVGEESSPGRPQSLLDNASTSDSQAVMNIMNTEQSQNSIVSRIKVFEGQTNIETSGLPKKPEITPRSLPPKPTVSSGKPSVAPKPAANRASGEWDSGTENRLKVTSKEGLTPYPPLQEAGSIPVTKPELPKKPNPGLIRSVNPEIPGRGPLAESSDSGKKVPTPAPRPLLLKKSVSSENPTYPSAPLKPVTVPPRLAGASQAKAYKSLGEGPPANPPVPVLQSKPLVDIDLISFDDDVLPTPSGNLAEESVGSEMVLGLHEDPQSPPPLPAEKPIGNTFSTVSGKLSNVERTRNLESNHPGQTGGFVRVPPRLPPRPVNGKTIPTQQPPTKVPPERPPPPKLSATRRSNKKLPFNRSSSDMDLQKKQSNLATGLSKAKSQVFKNQDPVLPPRPKPGHPLYSKYMRGDVLVMLKQTENNYLECQKGEDTGRVHLSQMKIITPLDEHLRSRPNDPSHAQKPVDSGAPHAVVLHDFPAEQVDDLNLTSGEIVYLLEKIDTDWYRGNCRNQIGIFPANYVKVIIDIPEGGNGKRECVSSHCVKGSRCVARFEYIGEQKDELSFSEGEIIILKEYVNEEWARGEVRGRTGIFPLNFVEPVEDYPTSGANVLSTKVPLKTKKEDSGSNSQVNSLPAEWCEALHSFTAETSDDLSFKRGDRIQILERLDSDWCRGRLQDREGIFPAVFVRPCPAEAGGSLEPGRSRLQ

SEQ ID NO: 906783 - protein, 1168 aa, Homo sapiens
EESGSGSGKGQGLRGRRDAARRRGIGSARALPLPGRLQVEFAEVAISTAAADASSPGAAFPPARGRWLWGAGCRRSGAPGPQLAGHPAAAPRASPMAEGRRREDEEEELRERRELGGQRRARGRALSGHSAADRNERNKPEHRSSSQGPLSSIRAVIKRSSRTSIQSELHRDRRRPEITIVAAEPLRPASWFPGTPPPGLGFPTSSAAGSWRPNELVPAELPPSYEQVIKEINQVQVNTTNNNNAAATPRHTITSATQTDFSEEIDNDLPQSNATLQAPLKPLQPFSAVSSGNLPTNVAPLIVFDISEEPNCPENPSATRCPVPKPRSKSNLRPIPRDSHIKEQSQQKISPAAVGEESSPGRPQSLLDNASTSDSQAVMNIMNTEQSQNSIVSRIKVFEGQTNIETSGLPKKPEITPRSLPPKPTVSSGKPSVAPKPAANRASGEWDSGTENRLKVTSKEGLTPYPPLQEAGSIPVTKPELPKKPNPGLIRSVNPEIPGRGPLAESSDSGKKVPTPAPRPLLLKKSVSSENPTYPSAPLKPVTVPPRLAGASQAKAYKSLGEGPPANPPVPVLQSKPLVDIDLISFDDDVLPTPSGNLAEESVGSEMVLDPFQLPAKTEPIKERAVQPAPTRKPTVIRIPAKPGKCLHEDPQSPPPLPAEKPIGNTFSTVSGKLSNVERTRNLESNHPGQTGGFVRVPPRLPPRPVNGKTIPTQQPPTKVPPERPPPPKLSATRRSNKKLPFNRSSSDMDLQKKQSNLATGLSKAKSQVFKNQDPVLPPRPKPGHPLYSKYMLSVPHGIANEDIVSQNPGELSCKRGDVLVMLKQTENNYLECQKGEDTGRVHLSQMKIITPLDEHLRSRPNDPSHAQKPVDSGAPHAVVLHDFPAEQVDDLNLTSGEIVYLLEKIDTDWYRGNCRNQIGIFPANYVKVIIDIPEGGNGKRECVSSHCVKGSRCVARFEYIGEQKDELSFSEGEIIILKEYVNEEWARGEVRGRTGIFPLNFVEPVEDYPTSGANVLSTKVPLKTKKEDSGSNSQVNSLPAEWCEALHSFTAETSDDLSFKRGDRIQILERLDSDWCRGRLQDREGIFPAVFVRPCPAEAKSMLAIVPKGRKAKALYDFRGENEDELSFKAGDIITELESVDDDWMSGELMGKSGIFPKNYIQFLQIS

SEQ ID NO: 906784 - protein, 1072 aa, Homo sapiens
RARTIWLDEEEELRERRELGGQRRARGRALSGHSAADRNERNKPEHRSSSQGPLSSIRAVIKRSSRTSIQSELHRDRRRPEITIVAAEPLRPASWFPGTPPPGLGFPTSSAAGSWRPNELVPAELPPSYEQVIKEINQVQVNTTNNNNAAATPRHTITSATQTDFSEEIDNDLPQSNATLQAPLKPLQPFSAVSSGNLPTNVAPLIVFDISEEPNCPENPSATRCPVPKPRSKSNLRPIPRDSHIKEQSQQKISPAAVGEESSPGRPQSLLDNASTSDSQAVMNIMNTEQSQNSIVSRIKVFEGQTNIETSGLPKKPEITPRSLPPKPTVSSGKPSVAPKPAANRASGEWDSGTENRLKVTSKEGLTPYPPLQEAGSIPVTKPELPKKPNPGLIRSVNPEIPGRGPLAESSDSGKKVPTPAPRPLLLKKSVSSENPTYPSAPLKPVTVPPRLAGASQAKAYKSLGEGPPANPPVPVLQSKPLVDIDLISFDDDVLPTPSGNLAEESVGSEMVLDPFQLPAKTEPIKERAVQPAPTRKPTVIRIPAKPGKCLHEDPQSPPPLPAEKPIGNTFSTVSGKLSNVERTRNLESNHPGQTGGFVRVPPRLPPRPVNGKTIPTQQPPTKVPPERPPPPKLSATRRSNKKLPFNRSSSDMDLQKKQSNLATGLSKAKSQVFKNQDPVLPPRPKPGHPLYSKYMLSVPHGIANEDIVSQNPGELSCKRGDVLVMLKQTENNYLECQKGEDTGRVHLSQMKIITPLDEHLRSRPNDPSHAQKPVDSGAPHAVVLHDFPAEQVDDLNLTSGEIVYLLEKIDTDWYRGNCRNQIGIFPANYVKVIIDIPEGGNGKRECVSSHCVKGSRCVARFEYIGEQKDELSFSEGEIIILKEYVNEEWARGEVRGRTGIFPLNFVEPVEDYPTSGANVLSTKVPLKTKKEDSGSNSQVNSLPAEWCEALHSFTAETSDDLSFKRGDRIQILERLDSDWCRGRLQDREGIFPAVFVRPCPAEAKSMLAIVPKGRKAKALYDFRGENEDELSFKAGDIITELESVDDDWMSGELMGKSGIFPKNYIQFLQIS

SEQ ID NO: 906785 - protein, 1014 aa, Homo sapiens
MPRGRASRTSIQSELHRDRRRPEITIVAAEPLRPASWFPGTPPPGLGFPTSSAAGSWRPNELVPAELPPSYEQVIKEINQVQVNTTNNNNAAATPRHTITSATQTDFSEEIDNDLPQSNATLQAPLKPLQPFSAVSSGNLPTNVAPLIVFDISEEPNCPENPSATRCPVPKPRSKSNLRPIPRDSHIKEQSQQKISPAAVGEESSPGRPQSLLDNASTSDSQAVMNIMNTEQSQNSIVSRIKVFEGQTNIETSGLPKKPEITPRSLPPKPTVSSGKPSVAPKPAANRASGEWDSGTENRLKVTSKEGLTPYPPLQEAGSIPVTKPELPKKPNPGLIRSVNPEIPGRGPLAESSDSGKKVPTPAPRPLLLKKSVSSENPTYPSAPLKPVTVPPRLAGASQAKAYKSLGEGPPANPPVPVLQSKPLVDIDLISFDDDVLPTPSGNLAEESVGSEMVLDPFQLPAKTEPIKERAVQPAPTRKPTVIRIPAKPGKCLHEDPQSPPPLPAEKPIGNTFSTVSGKLSNVERTRNLESNHPGQTGGFVRVPPRLPPRPVNGKTIPTQQPPTKVPPERPPPPKLSATRRSNKKLPFNRSSSDMDLQKKQSNLATGLSKAKSQVFKNQDPVLPPRPKPGHPLYSKYMLSVPHGIANEDIVSQNPGELSCKRGDVLVMLKQTENNYLECQKGEDTGRVHLSQMKIITPLDEHLRSRPNDPSHAQKPVDSGAPHAVVLHDFPAEQVDDLNLTSGEIVYLLEKIDTDWYRGNCRNQIGIFPANYVKVIIDIPEGGNGKRECVSSHCVKGSRCVARFEYIGEQKDELSFSEGEIIILKEYVNEEWARGEVRGRTGIFPLNFVEPVEDYPTSGANVLSTKVPLKTKKEDSGSNSQVNSLPAEWCEALHSFTAETSDDLSFKRGDRIQILERLDSDWCRGRLQDREGIFPAVFVRPCPAEAKSMLAIVPKGRKAKALYDFRGENEDELSFKAGDIITELESVDDDWMSGELMGKSGIFPKNYIQFLQIS

SEQ ID NO: 906786 - protein, 1109 aa, Homo sapiens; identical to SEQ ID NO: 906776

SEQ ID NO: 906787 - protein, 1109 aa, Homo sapiens; identical to SEQ ID NO: 906776

SEQ ID NO: 906788 - protein, 1109 aa, Homo sapiens; identical to SEQ ID NO: 906776

SEQ ID NO: 906789 - protein, 1083 aa, Homo sapiens
EESGSGSGKGQGLRGRRDAARRRGIGSARALPLPGRLQVEFAEVAISTAAADASSPGAAFPPARGRWLWGAGCRRSGAPGPQLAGHPAAAPRASPMAEGRRREDEEEELRERRELGGQRRARGRALSGHSAADRNERNKPEHRSSSQGPLSSIRAVIKRSSRTSIQSELHRDRRRPEITIVAAEPLRPASWFPGTPPPGLGFPTSSAAGSWRPNELVPAELPPSYEQVIKEINQVQVNTTNNNNAAATPRHTITSATQTDFSEEIDNDLPQSNATLQAPLKPLQPFSAVSSGNLPTNVAPLIVFDISEEPNCPENPSATRCPVPKPRSKSNLRPIPRDSHIKEQSQQKISPAAVGEESSPGRPQSLLDNASTSDSQAVMNIMNTEQSQNSIVSRIKVFEGQTNIETSGLPKKPEITPRSLPPKPTVSSGKPSVAPKPAANRASGEWDSGTENRLKVTSKEGLTPYPPLQEAGSIPVTKPELPKKPNPGLIRSVNPEIPGRGPLAESSDSGKKVPTPAPRPLLLKKSVSSENPTYPSAPLKPVTVPPRLAGASQAKAYKSLGEGPPANPPVPVLQSKPLVDIDLISFDDDVLPTPSGNLAEESVGSEMVLGLHEDPQSPPPLPAEKPIGNTFSTVSGKLSNVERTRNLESNHPGQTGGFVRVPPRLPPRPVNGKTIPTQQPPTKVPPERPPPPKLSATRRSNKKLPFNRSSSDMDLQKKQSNLATGLSKAKSQVFKNQDPVLPPRPKPGHPLYSKYMRGDVLVMLKQTENNYLECQKGEDTGRVHLSQMKIITPLDEHLRSRPNDPSHAQKPVDSGAPHAVVLHDFPAEQVDDLNLTSGEIVYLLEKIDTDWYRGNCRNQIGIFPANYVKVIIDIPEGGNGKRECVSSHCVKGSRCVARFEYIGEQKDELSFSEGEIIILKEYVNEEWARGEVRGRTGIFPLNFVEPVEDYPTSGANVLSTKVPLKTKKEDSGSNSQVNSLPAEWCEALHSFTAETSDDLSFKRGDRIQILERLDSDWCRGRLQDREGIFPAVFVRPCPAEAKSMLAIVPKGRKAKALYDFRGENEDELSFKMRKRPSNSGSHL

SEQ ID NO: 906790 - protein, 996 aa, Homo sapiens
EESGSGSGKGQGLRGRRDAARRRGIGSARALPLPGRLQVEFAEVAISTAAADASSPGAAFPPARGRWLWGAGCRRSGAPGPQLAGHPAAAPRASPMAEGRRREDEEEELRERRELGGQRRARGRALSGHSAADRNERNKPEHRSSSQGPLSSIRAVIKRSSRTSIQSELHRDRRRPEITIVAAEPLRPASWFPGTPPPGLGFPTSSAAGSWRPNELVPAELPPSYEQVIKEINQVQVNTTNNNNAAATPRHTITSATQTDFSEEIDNDLPQSNATLQAPLKPLQPFSAVSSGNLPTNVAPLIVFDISEEPNCPENPSATRCPVPKPRSKSNLRPIPRDSHIKEQSQQKISPAAVGEESSPGRPQSLLDNASTSDSQAVMNIMNTEQSQNSIVSRIKVFEGQTNIETSGLPKKPEITPRSLPPKPTVSSGKPSVAPKPAANRASGEWDSGTENRLKVTSKEGLTPYPPLQEAGSIPVTKPELPKKPNPGLIRSVNPEIPGRGPLAESSDSGKKVPTPAPRPLLLKKSVSSENPTYPSAPLKPVTVPPRLAGASQAKAYKSLGEGPPANPPVPVLQSKPLVDIDLISFDDDVLPTPSGNLAEESVGSEMVLDPFQLPAKTEPIKERAVQPAPTRKPTVIRIPAKPGKCLHEDPQSPPPLPAEKPIGNTFSTVSGKLSNVERTRNLESNHPGQTGGFVRVPPRLPPRPVNGKTIPTQQPPTKVPPERPPPPKLSATRRSNKKLPFNRSSSDMDLQKKQSNLATGLSKAKSQVFKNQDPVLPPRPKPGHPLYSKYMLSVPHGIANEDIVSQNPGELSCKRGDVLVMLKQTENNYLECQKGEDTGRVHLSQMKIITPLDEHLRSRPNPFSPPKDPSHAQKPVDSGAPHAVVLHDFPAGKDVNNAVGEPQDPGVSLFPCRGLASQGHPSSFFCAYRVRDWRGHLIQDSTSRRVDCTSHSRKLSCIPLPLKLPEKEKERERDFPLQMNIANCLPVTNFLTLSK

SEQ ID NO: 906791 - protein, 250 aa, Homo sapiens
HASRTAWVDPRVRVAELLLRRLEASDGGLDSAELAAELGMEHQAVVGAVKSLQALGEVIEAELRSTKHWELTAEGEEIAREGSHEARVFRSIPPEGLAQSELMRLPSGKVGFSKAMSNKWIRVDKSAADGPRVFRVVDSMEDEVQRRLQLVRGGQAEKLGEKERSELRKRKLLAEVTLKTYWVSKGSAFSTSISKQETELSPEMISSGSWRDRPFKPYNFLAHGVLPDSGHLHPLLKVRSQFRQIFLEMG

SEQ ID NO: 906792 - protein, 467 aa, Homo sapiens
WEGVMADGQVAELLLRRLEASDGGLDSAELAAELGMEHQAVVGAVKSLQALGEVIEAELRSTKHWELTAEGEEIAREGSHEARVFRSIPPEGLAQSELMRLPSGKVGFSKAMSNKWIRVDKSAADGPRVFRVVDSMEDEVQRRLQLVRGGQAEKLGEKERSELRKRKLLAEVTLKTYWVSKGSAFSTSISKQETELSPEMISSGSWRDRPFKPYNFLAHGVLPDSGHLHPLLKVRSQFRQIFLEMGFTEMPTDNFIESSFWNFDALFQPQQHPARDQHDTFFLRDPAEALQLPMDYVQRVKRTHSQGGYGSQGYKYNWKLDEARKNLLRTHTTSASARALYRLAQKKPFTPVKYFSIDRVFRNETLDATHLAEFHQIEGVVADHGLTLGHLMGVLREFFTKLGITQLRFKPAYNPYTEPSMEVFSYHQGLKKWVEVGNSGVFRPEMLLPMGLPENVSVIAWGLSLER

SEQ ID NO: 906793 - protein, 371 aa, Homo sapiens
WEGVMADGQVAELLLRRLEASDGGLDSAELAAELGMEHQAVVGAVKSLQALGEVIEAELRSTKHWELTAEGEEIAREGSHEARVFRSIPPEGLAQSELMRLPSGKVGFSKAMSNKWIRVDKSAADGPRVFRVVDSMEDEVQRRLQLVRGGQAEKLGEKERSELRKRKLLAEVTLKTYWVSKGSAFSTSISKQETELSPEMISSGSWRDRPFKPYNFLAHGVLPDSGHLHPLLKVRSQFRQIFLEMGFTEMPTDNFIESSFWNFDALFQPQQHPARDQHDTFFLRDPAEALQLPMDYVQRVKRTHSQGGYGSQGYKYNWKLDEARKNLLRTHTTSASARALYRLAQKTTYFVTKTLLLTSLFFEFDDTPRFR

SEQ ID NO: 906794 - protein, 337 aa, Homo sapiens
WEGVMADGQVAELLLRRLEASDGGLDSAELAAELGMEHQAVVGAVKSLQALGEVIEAELRSTKHWELTAEGEEIAREGSHEARVFRSIPPEGLAQSELMRLPSGKVGFSKAMSNKWIRVDKSAADGPRVFRVVDSMEDEVQRRLQLVRGGQAEKLGEKERSELRKRKLLAEVTLKTYWVSKGSAFSTSISKQETELSPEMISSGSWRDRPFKPYNFLAHGVLPDSGHLHPLLKVRSQFRQIFLEMGFTEMPTDNFIESSFWNFDALFQPQQHPARDQHDTFFLRDPAEALQLPTMIKYGINNIRELVGHKVNLQMVYDSPLCRLDAEPRPPPTQEAA

SEQ ID NO: 906795 - protein, 449 aa, Homo sapiens
WEGVMADGQVAELLLRRLEASDGGLDSAELAAELGMEHQAVVGAVKSLQALGEVIEAELRSTKHWELTAEGEEIAREGSHEARVFRSIPPEGLAQSELMLRKRKLLAEVTLKTYWVSKGSAFSTSISKQETELSPEMISSGSWRDRPFKPYNFLAHGVLPDSGHLHPLLKVRSQFRQIFLEMGFTEMPTDNFIESSFWNFDALFQPQQHPARDQHDTFFLRDPAEALQLPMDYVQRVKRTHSQGGYGSQGYKYNWKLDEARKNLLRTHTTSASARALYRLAQKKPFTPVKYFSIDRVFRNETLDATHLAEFHQIEGVVADHGLTLGHLMGVLREFFTKLGITQLRFKPAYNPYTEPSMEVFSYHQGLKKWVEVGNSGVFRPEMLLPMGLPENVSVIAWGLSLERPTMIKYGINNIRELVGHKVNLQMVYDSPLCRLDAEPRPPPTQEAA

SEQ ID NO: 906796 - protein, 397 aa, Homo sapiens
PPISPPPPPPPALARAVGGNLAVAELLLRRLEASDGGLDSAELAAELGMEHQAVVGAVKSLQALGEVIEAELRSTKQETELSPEMISSGSWRDRPFKPYNFLAHGVLPDSGHLHPLLKVRSQFRQIFLEMGFTEMPTDNFIESSFWNFDALFQPQQHPARDQHDTFFLRDPAEALQLPMDYVQRVKRTHSQGGYGSQGYKYNWKLDEARKNLLRTHTTSASARALYRLAQKKPFTPVKYFSIDRVFRNETLDATHLAEFHQIEGVVADHGLTLGHLMGVLREFFTKLGITQLRFKPAYNPYTEPSMEVFSYHQGLKKWVEVGNSGVFRPEMLLPMGLPENVSVIAWGLSLERPTMIKYGINNIRELVGHKVNLQMVYDSPLCRLDAEPRPPPTQEAA

SEQ ID NO: 906797 - protein, 236 aa, Homo sapiens
WEGVMADGQVAELLLRRLEASDGGLDSAELAAELGMEHQAVVGAVKSLQALGEVIEAELRSTKHWELTAEGEEIAREGSHEARVFRSIPPEGLAQSELMRLPSGKVGFSKAMSNKWIRVDKSAADGPRVFRVVDSMEDEVQRRLQLVRGGQAEKLGEKERSELRKRKLLAEVTLKTYWVSKGSAFSTSISKQETELSPEMISSGSWRDRPFKPYNFLAHGVLPDSGHLHPLCIPGQ

SEQ ID NO: 906798 - protein, 236 aa, Homo sapiens; identical to SEQ ID NO: 906797

SEQ ID NO: 906799 - protein, 249 aa, Homo sapiens
PPISPPPPPPPALARAVGGNLAVAELLLRRLEASDGGLDSAELAAELGMEHQAVVGAVKSLQALGEVIEAELRSTKHWELTAEGEEIAREGSHEARVFRSIPPEGLAQSELMRLPSGKVGFSKAMSNKWIRVDKSAADGPRVFRVVDSMEDEVQRRLQLVRGGQAEKLGEKERSELRKRKLLAEVTLKTYWVSKGSAFSTSISKQETELSPEMISSGSWRDRPFKPYNFLAHGVLPDSGHLHPLCIPGQ

SEQ ID NO: 906800 - protein, 512 aa, Homo sapiens
WEGVMADGQVAELLLRRLEASDGGLDSAELAAELGMEHQAVVGAVKSLQALGEVIEAELRSTKHWELTAEGEEIAREGSHEARVFRSIPPEGLAQSELMRLPSGKVGFSKAMSNKWIRVDKSAADGPRVFRVVDSMEDEVQRRLQLVRGGQAEKLGEKERSELRKRKLLAEVTLKTYWVSKGSAFSTSISKQETELSPEMISSGSWRDRPFKPYNFLAHGVLPDSGHLHPLLKVRSQFRQIFLEMGFTEMPTDNFIESSFWNFDALFQPQQHPARDQHDTFFLRDPAEALQLPMDYVQRVKRTHSQGGYGSQGYKYNWKLDEARKNLLRTHTTSASARALYRLAQKKPFTPVKYFSIDRVFRNETLDATHLAEFHQIEGVVADHGLTLGHLMGVLREFFTKLGITQLRFKPAYNPYTEPSMEVFSYHQGLKKWVEVGNSGVFRPEMLLPMGLPENVSVIAWGLSLERPTMIKYGINNIRELVGHKVNLQMVYDSPLCRLDAEPRPPPTQEAA

SEQ ID NO: 906801 - protein, 540 aa, Homo sapiens
MADGQVAELLLRRLEASDGGLDSAELAAELGMEHQAVVGAVKSLQALGEVIEAELRSTKHWELTAEGEEIAREGSHEARVFRSIPPEGLAQSELMRLPSGKVGFSKAMSNKWIRVDKSAADGPRVFRVVDSMEDEVQRRLQLVRGGQAEKLGEKERSELRKRKLLAEVTLKTYWVSKGSAFSTSISKQETELSPEMISSGSWRDRPFKPYNFLAHGVLPDSGHLHPLLKVRSQFRQIFLEMGFTEMPTDNFIESSFWNFDALFQPQQHPARDQHDTFFLRDPAEALQLPMDYVQRVKRTHSQGGYGSQGYKYNWKLDEARKNLLRTHTTSASARALYRLAQKVRLAQAGAPVGRGCCQRDLLTHTWAWLGCHPKKPFTPVKYFSIDRVFRNETLDATHLAEFHQIEGVVADHGLTLGHLMGVLREFFTKLGITQLRFKPAYNPYTEPSMEVFSYHQGLKKWVEVGNSGVFRPEMLLPMGLPENVSVIAWGLSLERPTMIKYGINNIRELVGHKVNLQMVYDSPLCRLDAEPRPPPTQEAA

SEQ ID NO: 906802 - protein, 394 aa, Homo sapiens
WEGVMADGQVAELLLRRLEASDGGLDSAELAAELGMEHQAVVGAVKSLQALGEVIEAELRSTKHWELTAEGEEIAREGSHEARVFRSIPPEGLAQSELMRLPSGKVGFSKAMSNKWIRVDKSAADGPRVFRVVDSMEDEVQRRLQLVRGGQAEKLGEKERSELRKRKLLAEVTLKTYWVSKGSAFSTSISKQETELSPEMISSGSWRDRPFKPYNFLAHGVLPDSGHLHPLLKVRSQFRQIFLEMGFTEMPTDNFIESSFWNFDALFQPQQHPARDQHDTFFLRDPAEALQLPMDYVQRVKRTHSQGGYGSQGYKYNWKLDEARKNLLRTHTTSASARALYRLAQKAFTPVKYFSIDRFRIGALARTGCSQMGGVGLAHWRLLGLGVSQGFRIR

SEQ ID NO: 906803 - protein, 467 aa, Homo sapiens
SHTKSHTCTGVPHLVPHLHWELTAEGEEIAREGSHEARVFRSIPPEGLAQSELMRLPSGKVGFSKAMSNKWIRVDKSAADGPRVFRVVDSMEDEVQRRLQLVRGGQAEKLGEKERSELRKRKLLAEVTLKTYWVSKGSAFSTSISKQETELSPEMISSGSWRDRPFKPYNFLAHGVLPDSGHLHPLLKVRSQFRQIFLEMGFTEMPTDNFIESSFWNFDALFQPQQHPARDQHDTFFLRDPAEALQLPMDYVQRVKRTHSQGGYGSQGYKYNWKLDEARKNLLRTHTTSASARALYRLAQKKPFTPVKYFSIDRVFRNETLDATHLAEFHQIEGVVADHGLTLGHLMGVLREFFTKLGITQLRFKPAYNPYTEPSMEVFSYHQGLKKWVEVGNSGVFRPEMLLPMGLPENVSVIAWGLSLERPTMIKYGINNIRELVGHKVNLQMVYDSPLCRLDAEPRPPPTQEAA

SEQ ID NO: 906804 - protein, 246 aa, Homo sapiens
WEGVMADGQVAELLLRRLEASDGGLDSAELAAELGMEHQAVVGAVKSLQALGEVIEAELRSTKHWELTAEGEEIAREGSHEARVFRSIPPEGLAQSELMRLPSGKVGFSKAMSNKWIRVDKSAADGPRVFRVVDSMEDEVQRRLQLVRGGQAEKLGEKERSELRKRKLLAEVTLKTYWVSKGSAFSTSISKQETELSPEMISSGSWRDRPFKPYNFLAHGVLPDSGHLHPLLKVRSQFRQIFLEMG

SEQ ID NO: 906805 - protein, 260 aa, Homo sapiens
WEGVMADGQVAELLLRRLEASDGGLDSAELAAELGMEHQAVVGAVKSLQALGEVIEAELRSTKHWELTAEGEEIAREGSHEARVFRSIPPEGLAQSELMRLPSGKVGFSKAMSNKWIRVDKSAADGPRVFRVVDSMEDEVQRRLQLVRGGQAEKLGEKERSELRKRKLLAEVTLKTYWVSKGSAFSTSISKQETELSPEMISSGSWRDRPFKPYNFLAHGVLPDSGHLHPLLKVRSQFQNPRDRGLGSRFLLLSCVVCLL

SEQ ID NO: 906806 - protein, 209 aa, Homo sapiens
WEGVMADGQVAELLLRRLEASDGGLDSAELAAELGMEHQAVVGAVKSLQALGEVIEAELRSTKHWELTAEGEEIAREGSHEARVFRSIPPEGLAQSELMRLPSGKVGFSKAMSNKWIRVDKSAADGPRVFRVVDSMEDEVQRRLQLVRGGQAEKLGEKERSELRKRKLLAEVTLKTYWVSKGSAFSTSISNKNPHAIQEPQGTSRQLHT

SEQ ID NO: 906807 - protein, 609 aa, Homo sapiens
ASAMALRKELLKSIWYAFTALDVEKSGKVSKSQLKVLSHNLYTVLHIPHDPVALEEHFRDDDDGPVSSQGYMPYLNKYILDKVEEGAFVKEHFDELCWTLTAKKNYRADSNGNSMLSNQDAFRLWCLFNFLSEDKYPLIMVPDEVEYLLKKVLSSMSLEVSLGELEELLAQEAQVAQTTGGLSVWQFLELFNSGRCLRGVGRDTLSMAIHEVYQELIQDVLKQGYLWKRGHLRRNWAERWFQLQPSCLCYFGSEECKEKRGIIPLDAHCCVEVLPDRDGKRCMFCVKTATRTYEMSASDTRQRQEWTAAIQMAIRLQAEGKTSLHKDLKQKRREQREQRERRRAAKEEELLRLQQLQEEKERKLQELEPLQQALEGQLREAEQARASMQAEMELKEEEAARQRQRIKELEEMQQRLQEALQLEVKARRDEESVRIAQTRLLEEEEEKLKQLMQLKEEQERYIERAQQEKEELQQEMAQQSRSLQQAQQQLEEVRQNRQRADEDVEAAQRKLRQASTNVKHWNVQMNRLMHPIEPGDKRPVTSSSFSGFQPPLLAHRDSSLKRLTRWGSQGNRTPSPNSNEQQKSLNGGDEAPAPASTPQEDKLDPAPEN

SEQ ID NO: 906808 - protein, 597 aa, Homo sapiens
ASAMALRKELLKSIWYAFTALDVEKSGKVSKSQLKVLSHNLYTVLHIPHDPVALEEHFRDDDDGPVSSQGYMPYLNKYILDKDAFRLWCLFNFLSEDKYPLIMVPDEVEYLLKKVLSSMSLEVSLGELEELLAQEAQVAQTTGGLSVWQFLELFNSGRCLRGVGRDTLSMAIHEVYQELIQDVLKQGYLWKRGHLRRNWAERWFQLQPSCLCYFGSEECKEKRGIIPLDAHCCVEVLPDRDGKRCMFCVKTATRTYEMSASDTRQRQEWTAAIQMAIRLQAEGKTSLHKDLKQKRREQREQRERRRAAKEEELLRLQQLQEEKERKLQELELLQEAQRQAERLLQEEEERRRSQHRELQQALEGQLREAEQARASMQAEMELKEEEAARQRQRIKELEEMQQRLQEALQLEVKARRDEESVRIAQTRLLEEEEEKLKQLMQLKEEQERYIERAQQEKEELQQEMAQQSRSLQQAQQQLEEVRQNRQRADEDVEAAQRKLRQASTNVKHWNVQMNRLMHPIEPGDKRPVTSSSFSGFQPPLLAHRDSSLKRLTRWGSQGNRTPSPNSNEQQKSLNGGDEAPAPASTPQEDKLDPAPEN

SEQ ID NO: 906809 - protein, 352 aa, Homo sapiens [sequence omitted]

SEQ ID NO: 906810 - protein, 165 aa, Homo sapiens
ASAMALRKELLKSIWYAFTALDVEKSGKVSKSQLKVLSHNLYTVLHIPHDPVALEEHFRDDDDGPVSSQGYMPYLNKYILDKVEEGAFVKEHFDELCWTLTAKKNYRADSNGNSMLSNQDAFRLWCLFNFLSEDKYPLIMVPDEVRVMAAPGTESLGTRPKQNHE

SEQ ID NO: 906811 - protein, 634 aa, Homo sapiens
ASAMALRKELLKSIWYAFTALDVEKSGKVSKSQLKVLSHNLYTVLHIPHDPVALEEHFRDDDDGPVSSQGYMPYLNKYILDKVEEGAFVKEHFDELCWTLTAKKNYRADSNGNSMLSNQDAFRLWCLFNFLSEDKYPLIMVPDEVEYLLKKVLSSMSLEVSLGELEELLAQEAQVAQTTGGLSVWQFLELFNSGRCLRGVGRDTLSMAIHEVYQELIQDVLKQGYLWKRGHLRRNWAERWFQLQPSCLCYFGSEECKEKRGIIPLDAHCCVEVLPDRDGKRCMFCVKTATRTYEMSASDTRQRQEWTAAIQMAIRLQAEGKTSLHKDLKQKRREQREQRERRRAAKEEELLRLQQLQEEKERKLQELELLQEAQRQAERLLQEEEERRRSQHRELQQALEGQLREAEQARASMQAEMELKEEEAARQRQRIKELEEMQQRLQEALQLEVKARRDEESVRIAQTRLLEEEEEKLKQLMQLKEEQERYIERAQQEKEELQQEMAQQSRSLQQAQQQLEEVRQNRQRADEDVEAAQRKLRQASTNVKHWNVQMNRLMHPIEPGDKRPVTSSSFSGFQPPLLAHRDSSLKRLTRWGSQGNRTPSPNSNEQQKSLNGGDEAPAPASTPQEDKLDPAPEN

SEQ ID NO: 906812 - protein, 243 aa, Homo sapiens
IIYTWLFLSLLSRIHQALDGSPTKEMELKEEEAARQRQRIKELEEMQQRLQEALQLEVKARRDEESVRIAQTRLLEEEEEKLKQLMQLKEEQERYIERAQQEKEELQQEMAQQSRSLQQAQQQLEEVRQNRQRADEDVEAAQRKLRQASTNVKHWNVQMNRLMHPIEPGDKRPVTSSSFSGFQPPLLAHRDSSLKRLTRWGSQGNRTPSPNSNEQQKSLNGGDEAPAPASTPQEDKLDPAPEN

SEQ ID NO: 906813 - protein, 259 aa, Homo sapiens
MDPPAEKPGEAGGLQITPQLLKSRTGEFSLESILLLKLRGLGLADLGCLGECLGLEWLDLSGNALTHLGPLASLRQLAVLNVSNNRLTGLEPLATCENLQSLNAAGNLLATPGQLQCLAGLPCLEYLRLRDPLARLSNPLCANPSYWAAVRELLPGLKVIDGERVIGRGSEFYQLCRDLDSSLRPSSSPGPRATEAQPWVEPGYWESWPSRSSSILEEACRQFQDTLQECWDLDRQASDSLAQAEQVLSSAGPTSSFVF

SEQ ID NO: 906814 - protein, 205 aa, Homo sapiens
MDPPAEKPGEAGGLQITPQLLKSRTGEFSLESILLLKLRGLGLADLGCLGECLGLEWLDLSGNALTHLGPLASLRQLAVLNVSNNRLTGLEPLATCENLQSLNAAGNLLATPGQLQCLAGLPCLEYLRLRDPLARLSNPLCANPSYWAAVRELLPGLKVIDGERVIGRGSEFYQLCRDLDRQASDSLAQAEQVLSSAGPTSSFVF

SEQ ID NO: 906815 - protein, 259 aa, Homo sapiens; identical to SEQ ID NO: 906813

SEQ ID NO: 906816 - protein, 259 aa, Homo sapiens; identical to SEQ ID NO: 906813

SEQ ID NO: 906817 - protein, 259 aa, Homo sapiens; identical to SEQ ID NO: 906813

SEQ ID NO: 906818 - protein, 259 aa, Homo sapiens; identical to SEQ ID NO: 906813

SEQ ID NO: 906819 - protein, 259 aa, Homo sapiens; identical to SEQ ID NO: 906813

SEQ ID NO: 906820 - protein, 259 aa, Homo sapiens; identical to SEQ ID NO: 906813

SEQ ID NO: 906821 - protein, 259 aa, Homo sapiens; identical to SEQ ID NO: 906813

SEQ ID NO: 906822 - protein, 228 aa, Homo sapiens
MDPPAEKPGEAGGLQITPQLLKSRTGEFSLESILLLKLRGLGLADLGCLGECLGLEWLDLSGNALTHLGPLASLRQLAVLNVSNNRLTGLEPLATCENLQSLNAAGNLLATPGQLQCLAGLPCLEYLRLRDPLARLSNPLCANPSYWAAVRELLPGLKVIDGERVIGRGSEFYQLCRDLDSSLRPSSSPGPRATEAQPWVEPGYWESWPSQARKVGMGQPPVSAVGRQ

SEQ ID NO: 906823 - protein, 331 aa, Homo sapiens
MPIPPPPPPPPGPPPPPTFHQANTEQPKLSRDEQRGRGALLQDICKGTKLKKVTNINDRSAPILEKPKGSSGGYGSGGAALQPKGGLFQGGVLKLRPVGAKDGSENLAGKPALQIPSSRAAAPRPPVSAASGRPQDDTDSSRASLPELPRMQRPSLPDLSRPNTTSSTGMKHSSSAPPPPPPGRRANAPPTPLPMHSSKAPAYNREKPLPPTPGQRLHPGREGPPAPPPVKPPPSPVNIRTGPSGQSLAPPPPPYRQPPGVPNGPSSPTNESAPELPQRHNSLHRKTPGPVRGLAPPPPTSASPSLLSNRPPPPARDPPSRGGHPLLLHRP

SEQ ID NO: 906824 - protein, 331 aa, Homo sapiens; identical to SEQ ID NO: 906823

SEQ ID NO: 906825 - protein, 331 aa, Homo sapiens; identical to SEQ ID NO: 906823

SEQ ID NO: 906826 - protein, 159 aa, Homo sapiens
MPIPPPPPPPPGPPPPPTFHQANTEQPKLSRDEQRGRGALLQDICKGTKLKKVTNINDRSAPILEKPKGSSGGYGSGGAALQPKGGLFQGGVLKLRPVGAKDGSENLAGKPALQIPSSRAAAPRPPVSAASGRPQDDTDSSRASLPELPRITAGSSRTL

SEQ ID NO: 906827 - protein, 72 aa, Homo sapiens
TEQPKLSRDEQRGRGALLQDICKGTKLKKVTNINDRSAPILESESELHFLVNWQDPRSDLETWLGSYFYWAL

SEQ ID NO: 906828 - protein, 331 aa, Homo sapiens; identical to SEQ ID NO: 906823

SEQ ID NO: 906829 - protein, 110 aa, Homo sapiens
EQIHFRVGKRGGGGGGGGGGGGGGDGEKELCRGASRTGRSRSVGGRGFAPRAAAARYMNDLKVQIKTEREQCQLGAGQECQFLLPRHPHLVLLHLPHFIRHILALLPRLQ

SEQ ID NO: 906830 - protein, 486 aa, Homo sapiens [sequence omitted]

SEQ ID NO: 906831 - protein, 486 aa, Homo sapiens [sequence omitted]

SEQ ID NO: 906832 - protein, 555 aa, Homo sapiens
MGVSVSVLSPLLFPNQGLCHYCPSQLSMQEDRVAWYSYPCPSPKGSTRKLKRLKKKRVCELKKNRDSKETQNCIPLSGAIPCDGIVHSLPMVRNVHAPGAGLLKQDLCFLYILVKFSKHISSLSTDFLSRDKKNLTADCWQSFQALSHVPFLTQIPKGLHSHCESHYCPIDKAGIEAPVVILYGGRMKGYFLHCIIIAFNIMLQNHIHIRLEFRYLDMNTYLAISMAISVLFSNVFHIILAMTETEQAKIQSVLGSLSRAPSNEKPGSGMTVPLKIHNLVCKLYYATFYFPCYFIAIHFTPQSQFRTLSLTGMCSDIFGPLGFMCQYKEYLFKIDLFRGGTVLLICVTPPIFLKTFVCFSKFVVDLNIIDPTIIRQISLISYILCVRLAVKYTALILIQNSYIGSQKYMITDVRSNLNSTVKCYGSFSAKLEIKEYYTLGMGSSTFSFGRYDLYTSEQCQFHTLDLELFSSYCNTEYCQSLIYLMLLIGSGADEIRTGGKSTVFRHRQPQCIRRSYSKRLSVGCLQPGMYFPLETRLSMVVRPLEQLEKMIKPIG

SEQ ID NO: 906833 - protein, 486 aa, Homo sapiens [sequence omitted]

SEQ ID NO: 906834 - protein, 527 aa, Homo sapiens
MMHFKSGLELTELQNMTVPEDDNISNDSNDFTEVENGQINSKFISDRESRRSLTNSHLEKKKCDEYIPGTTSLGMSVFNLSNAIMGSGILGLAFALANTGILLFLVLLTSVTLLSIYSINLLLICSKETGCMVYEKLGEQVFGTTGKFVIFGATSLQNTGAMLSYLFIVKNELPSAIKFLMGKEETFSAWYVDGRVLVVIVTFGIILPLCLLKNLGYLGYTSGFSLSCMVFFLIVVIYKKFQIPCIVPELNSTISANSTNADTCTPKYVTFNSKTVYALPTIAFAFVCHPSVLPIYSELKDRSQKKMQMVSNISFFAMFVMYFLTAIFGYLTFYDNVQSDLLHKYQSKDDILILTVRLAVIVAVILTVPVLFFTDRSSLFELAKKTKFNLCRHTVVTCILLVVINLLVIFIPSMKDIFGVVGVTSANMLIFILPSSLYLKITTRMEIKELKEFGLPFSWAWGCCSPWSAFPWSSMTGPAHRVMVKATETRREKETSLLSAQSSPHTSAISHHFFCKFTEANRNVQDT

SEQ ID NO: 906835 - protein, 51 aa, Homo sapiens
MKFFVFALILALMLSMTGADSHAKRHHGYKRKFHEKHHSHRGYRSNYLYDN

SEQ ID NO: 906836 - protein, 51 aa, Homo sapiens; identical to SEQ ID NO: 906835

SEQ ID NO: 906837 - protein, 51 aa, Homo sapiens; identical to SEQ ID NO: 906835

SEQ ID NO: 906838 - protein, 264 aa, Homo sapiens [sequence omitted]

SEQ ID NO: 906839 - protein, 133 aa, Homo sapiens
MRGPSLSWAIPATHPLGAAPLGNPGPGEPIWLPCVGGAEVRAQLGSFYSWESESSLPSTPLSLLVSCGGSALTTHAFPPIGGPIPSRFPAANKYLPSSARVQGSVGISIYPATDKATYLSTWSAHSGRRERPK

SEQ ID NO: 906840 - protein, 171 aa, Homo sapiens [sequence omitted]

SEQ ID NO: 906841 - protein, 171 aa, Homo sapiens [sequence omitted]

SEQ ID NO: 906842 - protein, 171 aa, Homo sapiens [sequence omitted]

SEQ ID NO: 906843 - protein, 230 aa, Homo sapiens
MLGAETEEKLFDAPLSISKREQLEQQVGGVGQRWRQVQWPRALPELLSSQGCWAPYSTHGRCTQGLVGCPCRSLSPLTCPCLILQVPENYFYVPDLGQVPEIDVPSYLPDLPGIANDLMYIADLGPGIAPSAPGTIPELPTFHTEVAEPLKADLQDGVLTPPPPPPPPPPAPEVLASAPPLPPSTAAPVGQGARQDDSSSSASPSGGSSSLRPPDFWRAQCTRVDFLWVC

SEQ ID NO: 906844 - protein, 171 aa, Homo sapiens [sequence omitted]

SEQ ID NO: 906845 - protein, 219 aa, Homo sapiens
MLGAETEEKLFDAPLSISKREQLEQQVPENYFYVPDLGQVPEIDVPSYLPDLPGIANDLMYIADLGPGIAPSAPGTIPELPTFHTEVAEPLKADLQDGVLTPPPPPPPPPPAPEVLASAPPLPPSTAAPVGQGARQDDSSSSASPSVQGAPREVVDPSGGWATLLESIRQAGGIGKAKLRSMKERKLEKKKQKEQEQGERALELAVGGPWARSPPPLQP

SEQ ID NO: 906846 - protein, 213 aa, Homo sapiens
MLGAETEEKLFDAPLSISKREQLEQQVPENYFYVPDLGQVPEIDVPSYLPDLPGIANDLMYIADLGPGIAPSAPGTIPELPTFHTEVAEPLKADLQDGVLTPPPPPPPPPPAPEVLASAPPLPPSTAAPVGQGARQDDSSSSASPSVRATSQGGHLMSDLFNKLVMRRKGISGKGPGAGEGPGGAFARVSDSIPPLPPPQQPQAEEDEDDWES

SEQ ID NO: 906847 - protein, 171 aa, Homo sapiens [sequence omitted]

SEQ ID NO: 906848 - protein, 241 aa, Homo sapiens
MLGAETEEKLFDAPLSISKREQLEQQVPENYFYVPDLGQVPEIDVPSYLPDLPGIANDLMYIADLGPGIAPSAPGTIPELPTFHTEVAEPLKADLQDGVLTPPPPPPPPPPAPEVLASAPPLPPSTAAPVGQGARQDDSSSSASPSVQGAPREVVDPSGGWATLLESIRQAGGIGKAKLRSMKERKLEKKKQKEQEQGISGKGPGAGEGPGGAFARVSDSIPPLPPPQQPQAEEDEDDWES

SEQ ID NO: 906849 - protein, 171 aa, Homo sapiens [sequence omitted]

SEQ ID NO: 906850 - protein, 171 aa, Homo sapiens [sequence omitted]

SEQ ID NO: 906851 - protein, 133 aa, Homo sapiens; identical to SEQ ID NO: 906839

SEQ ID NO: 906852 - protein, 152 aa, Homo sapiens
MLGAETEEKLFDAPLSISKREQLEQQVPENYFYVPDLGQVPEIDVPSYLPDLPGIANDLMYIADLGPGIAPSAPGTIPELPTFHTEVAEPLKALQDGGYLNRPTRDAPKRRATATRASDATGRTAHNRPPQDGPPGHRQPPDRPHHTRPPSI

SEQ ID NO: 906853 - protein, 230 aa, Homo sapiens; identical to SEQ ID NO: 906843

SEQ ID NO: 906854 - protein, 133 aa, Homo sapiens; identical to SEQ ID NO: 906839

SEQ ID NO: 906855 - protein, 264 aa, Homo sapiens [sequence omitted]

SEQ ID NO: 906856 - protein, 171 aa, Homo sapiens [sequence omitted]

SEQ ID NO: 906857 - protein, 357 aa, Homo sapiens
MPCSTCRRSLETSSAEVEQSRSQVQAIGEKVSLAQAKIEKIKGSKKAIKVVPIPLCPEATGQSLHFPVPLRLPSLCPAAHLYLELSSRPGFQLHPLLPSNPSPLSLLGPPQTCPCVHSVLQCQVPCSRAPAGIWLHLHGRPGPWPAETPPPQDPEQAPPPGRAGPAGEAEGLSCVREHQAGARGRCRRGTWGSSQQHQLCQLLAALQHHREPVPENYFYVPDLGQVPEIDVPSYLPDLPGIANDLMYIADLGPGIAPSAPGTIPELPTFHTEVAEPLKADLQDGVLTPPPPPPPPPPAPEVLASAPPLPPSTAAPVGQGARQDDSSSSASPSGGSSSLRPPDFWRAQCTRVDFLWVC

SEQ ID NO: 906858 - protein, 227 aa, Homo sapiens
MPCSTCRRSLETSSAEVEQSRSQVQAIGEKVSLAQAKIEKIKGSKKAIKVVPIPLCPEATGQSLHFPVPLRLPSLCPAAHLYLELSSRPGFQLHPLLPSNPSPLSLLGPPQTCPCVHSVLQCQVPCSRAPAGIWLHLHGRPGPWPAETPPPQDPEQAPPPGRAGPAGEAEGLSCVREHQAGARGRCRRGTWGSSHSSSASPSGGSSSLRPPDFWRAQCTRVDFLWVC

SEQ ID NO: 906859 - protein, 171 aa, Homo sapiens [sequence omitted]

SEQ ID NO: 906860 - protein, 171 aa, Homo sapiens [sequence omitted]

SEQ ID NO: 906861 - protein, 84 aa, Homo sapiens
YYYYYGVFRRRQKGQEQVRATSQGGHLMSDLFNKLVMRRKGISGKGPGAGEGPGGAFARVSDSIPPLPPPQQPQAEEDEDDWES

SEQ ID NO: 906862 - protein, 133 aa, Homo sapiens; identical to SEQ ID NO: 906839

SEQ ID NO: 906863 - protein, 122 aa, Homo sapiens
MLGAETEEKLFDAPLSISKREQLEQQVPENYFYVPDLGQVPEIDVPSYLPDLPGIANDLMYIADLGPGIAPSAPGTIPELPTFHTEVAEPLKDLQDGVLTTADDQGNVMRVGRACNQGGGPD

SEQ ID NO: 906864 - protein, 314 aa, Homo sapiens
MLGKGGKRKFDEHEDGLEGKIVSPCDGPSKVSYTLQRQTIFNISLMKLYNHRPLTEPSLQKTVLINNMLRRIQEELKQEGSLRPMFTPSSQPTTEPSDSYREAPPAFSHLASPSSHPCDLGSTTPLEACLTPASLLEDDDDTFCTSQAMQPTAPTKLSPPALLPEKDSFSSALDEIEELCPTSTSTEAATAATDSVKGTSSEAGTQKLDGPQESRADDSKLMDSLPGNFEITTSTGFLTDLTLDDILFADIDTSMYDFDPCTSSSGTASKMAPVSADDLLKTLAPYSSQPVTPSQPFKMDLTELDHIMEVLVGS

SEQ ID NO: 906865 - protein, 314 aa, Homo sapiens; identical to SEQ ID NO: 906864

SEQ ID NO: 906866 - protein, 314 aa, Homo sapiens; identical to SEQ ID NO: 906864

SEQ ID NO: 906867 - protein, 314 aa, Homo sapiens; identical to SEQ ID NO: 906864

SEQ ID NO: 906868 - protein, 472 aa, Homo sapiens
APASEAVTMDYDFKVKLSSERERVEDLFEYEGCKVGRGTYGHVYKAKRKDGKDDKDYALKQIEGTGISMSACREIALLRELKHPNVISLQKVFLSHADRKVWLLFDYAEHDLWHIIKFHRASKANKKPVQLPRGMVKSLLYQILDGIHYLHANWVLHRDLKPANILVMGEGPERGRVKIADMGFARLFNSPLKPLADLDPVVVTFWYRAPELLLGARHYTKAIDIWAIGCIFAELLTSEPIFHCRQEDIKTSNPYHHDQLDRIFNVMGFPADKDWEDIKKMPEHSTLMKDFRRNTYTNCSLIKYMEKHKVKPDSKAFHLLQKLLTMDPIKRITSEQAMQDPYFLEDPLPTSDVFAGCQIPYPKREFLTEEEPDDKGDKKNQQQQQGNNHTNGTGHPGNQDSSHTQGPPLKKVRVVPPTTTSGGLIMTSDYQRSNPHAAYPNPGPSTSQPQSSMGYSATSQQPPQYSHQTHRY

SEQ ID NO: 906869 - protein, 453 aa, Homo sapiens
APASEAVTMDYDFKVKLSSERERVEDLFEYEGCKVGRGTYGHVYKAKRKDGKDDKDYALKQIEGTGISMSACREIALLRELKHPNVISLQKVFLSHADRKVWLLFDYAEHDLWHIIKFHRASKANKKPVQLPRGMVKSLLYQILDGIHYLHANWVLHRDFADMGFARLFNSPLKPLADLDPVVVTFWYRAPELLLGARHYTKAIDIWAIGCIFAELLTSEPIFHCRQEDIKTSNPYHHDQLDRIFNVMGFPADKDWEDIKKMPEHSTLMKDFRRNTYTNCSLIKYMEKHKVKPDSKAFHLLQKLLTMDPIKRITSEQAMQDPYFLEDPLPTSDVFAGCQIPYPKREFLTEEEPDDKGDKKNQQQQQGNNHTNGTGHPGNQDSSHTQGPPLKKVRVVPPTTTSGGLIMTSDYQRSNPHAAYPNPGPSTSQPQSSMGYSATSQQPPQYSHQTHRY

SEQ ID NO: 906870 - protein, 372 aa, Homo sapiens
APASEAVTMDYDFKVKLSSERERVEDLFEYEGCKVGRGTYGHVYKAKRKDGKDDKDYALKQIEGTGISMSACREIALLRELKHPNVISLQKVFLSHADRKVWLLFDYAEHDLWHIIKFHRASKANKKPVQLPRGMVKSLLYQILDGIHYLHANWVLHRDFADMGFARLFNSPLKPLADLDPVVVTFWYRAPELLLGARHYTKAIDIWAIGCIFAELLTSEPIFHCRQEDIKTSNPYHHDQLDRIFNVMGFPADKDWEDIKKMPEHSTLMKDFRRNTYTNCSLIKYMEKHKVKPDSKAFHLLQKLLTMDPIKRITSEQAMQDPYFLEDPLPTSDVFAGCQIPYPKREFLTDSEDYTHACPKHLDTLLTHGQYP

SEQ ID NO: 906871 - protein, 472 aa, Homo sapiens; identical to SEQ ID NO: 906868

SEQ ID NO: 906872 - protein, 424 aa, Homo sapiens
APASEAVTMDYDFKVKLSSERERVEDLFEYEGCKVGRGTYGHVYKAKRKDGKDDKDYALKQIEGTGISMSACREIALLRELKHPNVISLQKVFLSHADRKVWLLFDYAEHDLWHIIKFHRASKANKKPVQLPRGMVKSLLYQILDGIHYLHANWVLHRDLKPANILVMGEGPERGRVKIADMGFARLFNSPLKPLADLDPVVVTFWYRAPELLLGARHYTKAIDKDWEDIKKMPEHSTLMKDFRRNTYTNCSLIKYMEKHKVKPDSKAFHLLQKLLTMDPIKRITSEQAMQDPYFLEDPLPTSDVFAGCQIPYPKREFLTEEEPDDKGDKKNQQQQQGNNHTNGTGHPGNQDSSHTQGPPLKKVRVVPPTTTSGGLIMTSDYQRSNPHAAYPNPGPSTSQPQSSMGYSATSQQPPQYSHQTHRY

SEQ ID NO: 906873 - protein, 558 aa, Homo sapiens
MAKKVAVIGAGVSGLSSIKCCVDEDLEPTCFERSDDIGGLWKFTESSKDGMTRVYKSLVTNVCKEMSCYSDFPFHEDYPNFMNHEKFWDYLQEFAEHFDLLKYIQFKTTVCSITKRPDFSETGQWDVVTETEGKQNRAVFDAVMVCTGHFLNPHLPLEAFPGIHKFKGQILHSQEYKIPEGFQGKRVLVIGLGNTGGDIAVELSRTAAQVLLSTRTGTWVLGRSSDWGYPYNMMVTRRCCSFIAQVLPSRFLNWIQERKLNKRFNHEDYGLSITKGKKAKFIVNDELPNCILCGAITMKTSVIEFTETSAVFEDGTVEENIDVVIFTTGYTFSFPFFEEPLKSLCTKKIFLYKQVFPLNLERATLAIIGLIGLKGSILSGTELQARWVTRVFKGLCKIPPSQKLMMEATEKEQLIKRGVFKDTSKDKFDYIAYMDDIAACIGTKPSIPLLFLKDPRLAWEVFFGPCTPYQYRLMGPGKWDGARNAILTQWDRTLKPLKTRIVPDSSKPASMSHYLKAWGAPVLLASLLLICKSSLFLKLVRDKLQDRMSPYLVSLWRG

SEQ ID NO: 906874 - protein, 117 aa, Homo sapiens
MAKKVAVIGAGVSGLSSIKCCVDEDLEPTCFERSDDIGGLWKFTESSKDGMTRVYKSLVTNVCKEMSCYSDFPFHEDYPNFMNHEKFWDYLQEFAEHFDLLKYIQFKDSVRYLHPKN

SEQ ID NO: 906875 - protein, 558 aa, Homo sapiens; identical to SEQ ID NO: 906873

SEQ ID NO: 906876 - protein, 318 aa, Homo sapiens
MAKKVAVIGAGVSGLSSIKCCVDEDLEPTCFERSDDIGGLWKFTESSKDGMTRVYKSLVTNVCKEMSCYSDFPFHEDYPNFMNHEKFWDYLQEFAEHFDLLKYIQFKTTVCSITKRPDFSETGQWDVVTETEGKQNRAVFDAVMVCTGHFLNPHLPLEAFPGIHKFKGQILHSQEYKIPEGFQGKRVLVIGLGNTGGDIAVELSRTAAQVLLSTRTGTWVLGRSSDWGYPYNMMVTRRCCSFIAQVLPSRFLNWIQERKLNKRFNHEDYGLSITKGYLHFLFSRKNIKSIFIITFYSEFKMFNNCNIAFVYSTLNPFP

SEQ ID NO: 906877 - protein, 615 aa, Homo sapiens
MPASAARPRPGPGQPTASPFPLLLLAVLSGPVSGRVPRSVPRTSLPISEADSCLTRFAVPHTYNYSVLLVDPASHTLYVGARDTIFALSLPFSGERPRRIDWMVPEAHRQNCRKKGKKEGDLGGRKTLQQRWTTFLKADLLCPGPEHGRASSVLQDVAVLRPELGAGTPIFYGIFSSQWEGATISAVCAFRPQDIRTVLNGPFRELKHDCNRGLPVVDNDVPQPRPGECITNNMKLRHFGSSLSLPDRVLTFIRDHPLMDRPVFPADGHPLLVTTDTAYLRVVAHRVTSLSGKEYDVLYLGTEDGHLHRAVRIGAQLSVLEDLALFPEPQPVENMKLYHSWLLVGSRTEVTQVNTTNCGRLQSCSECILAQDPVCAWSFRLDECVAHAGEHRGLVQDIESADVSSLCPKEPGERPVVFEVPVATAAHVVLPCSPSSAWASCVWHQPSGVTALTPRRDGLEVVVTPGAMGAYACECQEGGAAHVVAAYSLVWGSQRDAPSRAHTVGAGLAGFFLGILAASLTLILIGRRQQRRRQRELLARDKVGLDLGAPPSGTTSYSQDPPSPSPEDERLPLALAKRGSGFGGFSPPFLLDPCPSPAHIRLTGAPLATCDETSI

SEQ ID NO: 906878 - protein, 696 aa, Homo sapiens
MPASAARPRPGPGQPTASPFPLLLLAVLSGPVSGRVPRSVPRTSLPISEADSCLTRFAVPHTYNYSVLLVDPASHTLYVGARDTIFALSLPFSGERPRRIDWMVPEAHRQNCRKKGKKEDECHNFVQILAIANASHLLTCGTFAFDPKCGVIDVSRFQQVERLESGRGKCPFEPAQRSAAVMAGGVLYAATVKNYLGTEPIITRAVGRAEDWIRTDTLPSWLNAPAFVAAVALSPAEWGDEDGDDEIYFFFTETSRAFDSYERIKVPRVARVCAGDLGGRKTLQQRWTTFLKADLLCPGPEHGRASSVLQDVAVLRPELGAGTPIFYGIFSSQWEGATISAVCAFRPQDIRTVLNGPFRELKHDCNRGLPVVDNDVPQPRPGERMDTSTEQCGSELSSAFLKIWPYSQSHSQFENMKLYHSWLLVGSRTEVTQVNTTNCGRLQSCSECILAQDPVCAWSFRLDECVAHAGEHRGLVQDIESADVSSLCPKEPGERPVVFEVPVATAAHVVLPCSPSSAWASCVWHQPSGVTALTPRRDGLEVVVTPGAMGAYACECQEGGAAHVVAAYSLVWGSQRDAPSRAHTVGAGLAGFFLGILAASLTLILIGRRQQRRRQRELLARDKVGLDLGAPPSGTTSYSQDPPSPSPEDERLPLALAKRGSGFGGFSPPFLLDPCPSPAHIRLTGAPLATCDETSI

SEQ ID NO: 906879 - protein, 503 aa, Homo sapiens
MPASAARPRPGPGQPTASPFPLLLLAVLSGPVSGRVPRSVPRTSLPISEADSCLTRFAVPHTYNYSVLLVDPASHTLYVGARDTIFALSLPFSGERPRRIDWMVPEAHRQNCRKKGKKEDECHNFVQILAIANASHLLTCGTFAFDPKCGVIDVSRFQQVERLESGRGKCPFEPAQRSAAVMAGGVLYAATVKNYLGTEPIITRAVGRAEDWIRTDTLPSWLNAPAFVAAVALSPAEWGDEDGDDEIYFFFTETSRAFDSYERIKVPRVARVCAGDLGGRKTLQQRWTTFLKADLLCPGPEHGRASSVLQDVAVLRPELGAGTPIFYGIFSSQWEGATISAVCAFRPQDIRTVLNGPFRELKHDCNRGLPVVDNDVPQPRPGECITNNMKLRHFGSSLSLPDRVLTFIRDHPLMDRPVFPADGHPLLVTTDTAYLRVVAHRVTSLSGKEYDVLYLGTGIFNGQAGCLPSAYTFSSQRGYCNTYRSESQAQGQLCNYSCSFPVP

SEQ ID NO: 906880 - protein, 770 aa, Homo sapiens
MPASAARPRPGPGQPTASPFPLLLLAVLSGPVSGRVPRSVPRTSLPISEADSCLTRFAVPHTYNYSVLLVDPASHTLYVGARDTIFALSLPFSGERPRRIDWMVPEAHRQNCRKKGKKEDECHNFVQILAIANASHLLTCGTFAFDPKCGVIDVSRFQQVERLESGRGKCPFEPAQRSAAVMAGGVLYAATVKNYLGTEPIITRAVGRAEDWIRTDTLPSWLNAPAFVAAVALSPAEWGDEDGDDEIYFFFTETSRAFDSYERIKVPRVARVCAGDLGGRKTLQQRWTTFLKADLLCPGPEHGRASSVLQDVAVLRPELGAGTPIFYGIFSSQWEGATISAVCAFRPQDIRTVLNGPFRELKHDCNRGLPVVDNDVPQPRPGECITNNMKLRHFGSSLSLPDRVLTFIRDHPLMDRPVFPADGHPLLVTTDTAYLRVVAHRVTSLSGKEYDVLYLGTEDGHLHRAVRIGAQLSVLEDLALFPEPQPVENMKLYHSWLLVGSRTEVTQVNTTNCGRLQSCSECILAQDPVCAWSFRLDECVAHAGEHRGLVQDIESADVSSLCPKEPGERPVVFEVPVATAAHVVLPCSPSSAWASCVWHQPSGVTALTPRRDGLEVVVTPGAMGAYACECQEGGAAHVVAAYSLVWGSQRDAPSRAHTVGAGLAGFFLGILAASLTLILIGRRQQRRRQRELLARDKVGLDLGAPPSGTTSYSQDPPSPSPEDERLPLALAKRGSGFGGFSPPFLLDPCPSPAHIRLTGAPLATCDETSI

SEQ ID NO: 906881 - protein, 706 aa, Homo sapiens
MPASAARPRPGPGQPTASPFPLLLLAVLSGPVSGRVPRSVPRTSLPISEADSCLTRFAVPHTYNYSVLLVDPASHTLYVGARDTIFALSLPFSGERPRRIDWMVPEAHRQNCRKKGKKEEGVLYAATVKNYLGTEPIITRAVGRAEDWIRTDTLPSWLNAPAFVAAVALSPAEWGDEDGDDEIYFFFTETSRAFDSYERIKVPRVARVCAGDLGGRKTLQQRWTTFLKADLLCPGPEHGRASSVLQDVAVLRPELGAGTPIFYGIFSSQWEGATISAVCAFRPQDIRTVLNGPFRELKHDCNRGLPVVDNDVPQPRPGECITNNMKLRHFGSSLSLPDRVLTFIRDHPLMDRPVFPADGHPLLVTTDTAYLRVVAHRVTSLSGKEYDVLYLGTEDGHLHRAVRIGAQLSVLEDLALFPEPQPVENMKLYHSWLLVGSRTEVTQVNTTNCGRLQSCSECILAQDPVCAWSFRLDECVAHAGEHRGLVQDIESADVSSLCPKEPGERPVVFEVPVATAAHVVLPCSPSSAWASCVWHQPSGVTALTPRRDGLEVVVTPGAMGAYACECQEGGAAHVVAAYSLVWGSQRDAPSRAHTVGAGLAGFFLGILAASLTLILIGRRQQRRRQRELLARDKVGLDLGAPPSGTTSYSQDPPSPSPEDERLPLALAKRGSGFGGFSPPFLLDPCPSPAHIRLTGAPLATCDETSI

SEQ ID NO: 906882 - protein, 500 aa, Homo sapiens
RDENLKFMKNRDVYSSDYFSFVLSLASLNATKLKHPYYPCMAKVSLQLAIQFLFQTYLRTKKKLRVDTEEWIATIEALLSKSFDACQWLVEYFISSEGRELIKIFLLECNVREVRVAVATILEKTLDSALFYQDKLKSLHQLLEVLLALLDKDVPENCKNCAQYFFLFNTFVQKQGIRAGDLLLRHSALRHMISFLLGASRQNNQIRRWSSAQAREFGNLHNTVALLVLHSDVSSQRNVAPGIFKQRPPISIAPSSPLLPLHEEVEALLFMSEGKPYLLEVMFALRELTGSLLALIEMVVYCCFCNEHFSFTMLHFIKNQLETAPPHELKNTFQLLHEILVIEDPIQVERVKFVFETENGLLALMHHSNHVDSSRCYQCVKFLVTLAQKCPAAKEYFKENSHHWSWAVQWLQKKMSEHYWTPQSNVSNETSTGKTFQRTISAQDTLAYATALLNEKEQSGSSNGSESSPANENGDRHLQQGSESPMMIGELRSDLDDVDP

SEQ ID NO: 906883 - protein, 238 aa, Homo sapiens
MYLAFSHHLSLSFRIFLLECNVREVRVAVATILEKTLDSALFYQDKLKSLHQLLEVLLALLDKDVPENCKNCAQYFFLFNTFVQKQGIRAGDLLLRHSALRHMISFLLGASRQNNQIRRWSSAQAREFGNLHNTVALLVLHSDVSSQRNVAPGIFKQRPPISIAPSSPLLPLHEEVEALLFMSEGKPYLLEVMFALRELTGSLLALIEMVVYCCFCNEHFSFTMLHFIKNQLGNGSTS

SEQ ID NO: 906884 - protein, 238 aa, Homo sapiens; identical to SEQ ID NO: 906883

SEQ ID NO: 906885 - protein, 238 aa, Homo sapiens; identical to SEQ ID NO: 906883

SEQ ID NO: 906886 - protein, 238 aa, Homo sapiens; identical to SEQ ID NO: 906883

SEQ ID NO: 906887 - protein, 157 aa, Homo sapiens
METSASSSQPQDNSQVHRETEDVDCPGHGEPDVLKDELQLYGDAPGEVVPSGESGLRRRGSDPASGEVEASQLRRLNIKKDDEFFHFVLLCFAIGALLVCYHYYADWFMSLGVGLLTFASLETVGIYFGLVYRIHSVLQGFIPLFQKFRLTGFRKTD

SEQ ID NO: 906888 - protein, 106 aa, Homo sapiens
VDESGNSTAQLLEYGFRAGSGRLTEATSRWAAEAGPSVTTTATPEPTRAEQHSERRTGDQARPINRTLFLPCGLNVGTSPGRGISFGQYCCATQLQGWKAEGGCGA

SEQ ID NO: 906889 - protein, 203 aa, Homo sapiens
METSASSSQPQDNSQVHRETEDVDYGETDFHKQDGKAGLFSQEQYERNKSSSSSSSSSSSSSSSSSSSSSGPGHGEPDVLKDELQLYGDAPGEVVPSGESGLRRRGSDPASGEVEASQLRRLNIKKDDEFFHFVLLCFAIGALLVCYHYYADWFMSLGVGLLTFASLETVGIYFGLVYRIHSVLQGFIPLFQKFRLTGFRKTD

SEQ ID NO: 906890 - protein, 233 aa, Homo sapiens
METSASSSQPQDNSQVHRETEDVDYGETDFHKQDGKAGLFSQEQYERNKSSSSSSSSSSSSSSSSSSSSSESNDEDQQPRATGKHRRSLGAGYPHGNGSPGPGHGEPDVLKDELQLYGDAPGEVVPSGESGLRRRGSDPASGEVEASQLRRLNIKKDDEFFHFVLLCFAIGALLVCYHYYADWFMSLGVGLLTFASLETVGIYFGLVYRIHSVLQGFIPLFQKFRLTGFRKTD

SEQ ID NO: 906891 - protein, 164 aa, Homo sapiens
METSASSSQPQDNSQVHRETEDVDYGETDFHKQDGKAGLFSQEQYERNKSSSSSSSSSSSSSSSSSSSSSGPGHGEPDVLKDELQLYGDEFFHFVLLCFAIGALLVCYHYYADWFMSLGVGLLTFASLETVGIYFGLVYRIHSVLQGFIPLFQKFRLTGFRKTD

SEQ ID NO: 906892 - protein, 118 aa, Homo sapiens [sequence omitted]

SEQ ID NO: 906893 - protein, 203 aa, Homo sapiens; identical to SEQ ID NO: 906889

SEQ ID NO: 906894 - protein, 203 aa, Homo sapiens; identical to SEQ ID NO: 906889

SEQ ID NO: 906895 - protein, 588 aa, Homo sapiens
MEAADASRSNGSSPEARDARSPSGPSGSLENGTKADGKDAKTTNGHGGEAAEGKSLGSALKPGEGRSALFAGNEWRRPIIQFVESGDDKNSNYFSMDSMEGKRSPYAGLQLGAAKKPPVTFAEKGELRKSIFSESRKPTVSIMEPGETRRNSYPRADTGLFSRSKSGSEEVLCDSCIGNKQKAVKSCLVCQASFCELHLKPHLEGAAFRDHQLLEPIRDFEARKCPVHGKTMELFCQTDQTCICYLCMFQEHKNHSTVTVEEAKAEKETELSLQKEQLQLKIIEIEDEAEKWQKEKDRIKSFTTNEKAILEQNFRDLVRDLEKQKEEVRAALEQREQDAVDQVKVIMDALDERAKVLHEDKQTREQLHSISDSVLFLQEFGALMSNYSLPPPLPTYHVLLEGEGLGQSLGNFKDDLLNVCMRHVEKMCKADLSRNFIERNHMENGGDHRYVNNYTNSFGGEWSAPDTMKRYSMYLTPKGGVRTSYQPSSPGRFTKETTQKNFNNLYGTKGNYTSRVWEYSSSIQNSDNDLPVVQGSSSFSLKGYPSLMRSQSPKAQPQTWKSGKQTMLSHYRPFYVNKGNGIGSNEAP

SEQ ID NO: 906896 - protein, 570 aa, Homo sapiens
MEAADASRSNGSSPEARDARSPSGPSGSLENGTKADGKDAKTTNGHGGEAAEGKSLGSALKPGEGRSALFAGNEWRRPIIQFVESGDDKNSNYFSMDSMEGKRSPYAGLQLGAAKKPPVTFAEKGELRKSIFSESRKPTVSIMEPGETRRNSYPRADTGLFSRSKSGSEEVLCDSCIGNKQKAVKSCLVCQASFCELHLKPHLEGAAFRDHQLLEPIRDFEARKCPVHGKTMELFCQTDQTCICYLCMFQEHKNHSTVTVEEAKAEKETELSLQKEQLQLKIIEIEDEAEKWQKEKDRIKSFTTNEKAILEQNFRDLVRDLEKQKEEVRAALEQREQDAVDQVKVIMDALDERAKVLHEDKQTREQLHSISDSVLFLQEFGALMSNYSLPPPLPTYHVLLEGEGLGQSLGNFKDDLLNVCMRHVEKMCKADLSRNFIERNHMENGGDHRYVNNYTNSFGGEWSAPDTMKRYSMYLTPKGGVRTSYQPSSPGRFTKETTQKNFNNLYGTKGNYTSRVWEYSSSIQNSDNDLPVVQGSSSFSLKGYPSLMRSQSPKAQPQTWKSGKQTMLVV

SEQ ID NO: 906897 - protein, 358 aa, Homo sapiens
MSDEPWLRVCPLSGAAPWFSGSLPSPPPASPILALSLQTELSLQKEQLQLKIIEIEDEAEKWQKEKDRIKSFTTNEKAILEQNFRDLVRDLEKQKEEVRAALEQREQDAVDQVKVIMDALDERAKVLHEDKQTREQLHSISDSVLFLQEFGALMSNYSLPPPLPTYHVLLEGEGLGQSLGNFKDDLLNVCMRHVEKMCKADLSRNFIERNHMENGGDHRYVNNYTNSFGGEWSAPDTMKRYSMYLTPKGGVRTSYQPSSPGRFTKETTQKNFNNLYGTKGNYTSRVWEYSSSIQNSDNDLPVVQGSSSFSLKGYPSLMRSQSPKAQPQTWKSGKQTMLSHYRPFYVNKGNGIGSNEAP

SEQ ID NO: 906898 - protein, 588 aa, Homo sapiens; identical to SEQ ID NO: 906895

SEQ ID NO: 906899 - protein, 622 aa, Homo sapiens
MEAADASRSNGSSPEARDARSPSGPSGSLENGTKADGKDAKTTNGHGGEAAEGKSLGSALKPGEGRSALFAGNEWRRPIIQFVESGDDKNSNYFSMDSMEGKRSPYAGLQLGAAKKPPVTFAEKGELRKSIFSESRKPTVSIMEPGETRRNSYPRADTGLFSRSKSGSEEVLCDSCIGNKQKAVKSCLVCQASFCELHLKPHLEGAAFRDHQLLEPIRDFEARKCPVHGKTMELFCQTDQTCICYLCMFQEHKNHSTVTVEEAKAEKETELSLQKEQLQLKIIEIEDEAEKWQKEKDRIKSFTTNEKAILEQNFRDLVRDLEKQKEEVRAALEQREQDAVDQVKVIMDALDERAKVLHEDKQTREQLHSISDSVLFLQEFGALMSNYSLPPPLPTYHVLLEGEGLGQSLGNFKDDLLNVCMRHVEKMCKADLSRNFIERNHMENGGDHRYVNNYTNSFGGEWSAPDTMKRYSMYLTPKGGVRTSYQPSSPGRFTKETTQKNFNNLYGTKGNYTSRVWEYSSSIQNSDNDLPVVQGSSSFSLKAGTGKTPYQFTTLGQATAEFSKPLGRSGLSKNNPGYPSLMRSQSPKAQPQTWKSGKQTMLSHYRPFYVNKGNGIGSNEAP

SEQ ID NO: 906900 - protein, 287 aa, Homo sapiens
MTELSLQKEQLQLKIIEIEDEAEKWQKEKDRIKSFTTNEKAILEQNFRDLVRDLEKQKEEVRAALEQREQDAVDQVKEFGALMSNYSLPPPLPTYHVLLEGEGLGQSLGNFKDDLLNVCMRHVEKMCKADLSRNFIERNHMENGGDHRYVNNYTNSFGGEWSAPDTMKRYSMYLTPKGGVRTSYQPSSPGRFTKETTQKNFNNLYGTKGNYTSRVWEYSSSIQNSDNDLPVVQGSSSFSLKGYPSLMRSQSPKAQPQTWKSGKQTMLSHYRPFYVNKGNGIGSNEAP

SEQ ID NO: 906901 - protein, 121 aa, Homo sapiens
MKRYSMYLTPKGGVRTSYQPSSPGRFTKETTQKNFNNLYGTKGNYTSRVWEYSSSIQNSDNDLPVVQGSSSFSLKGYPSLMRSQSPKAQPQTWKSGKQTMLSHYRPFYVNKGNGIGSNEAP

SEQ ID NO: 906902 - protein, 600 aa, Homo sapiens
MEAADASRSNGSSPEARDARSPSGPSGSLENGTKADGKDAKTTNGHGGEAAEGKSLGSALKPGEGRSALFAGNEWRRPIIQFVESGDDKNSNYFSMDSMEGKRSPYAGLQLGAAKKPPVTFAEKGELRKSIFSESRKPTVSIMEPGETRRNSYPRADTGLFSRSKSGSEEVLCDSCIGNKQKAVKSCLVCQASFCELHLKPHLEGAAFRDHQLLEPIRDFEARKCPVHGKTMELFCQTDQTCICYLCMFQEHKNHSTVTVEEAKAEKETELSLQKEQLQLKIIEIEDEAEKWQKEKDRIKSFTTNEKAILEQNFRDLVRDLEKQKEEVRAALEQREQDAVDQVKVIMDALDERAKVLHEDKQTREQLHSISDSVLFLQEFGALMSNYSLPPPLPTYHVLLEGEGLGQSLGNFKDDLLNVCMRHVEKMCKADLSRNFIERNHMENGGDHRYVNNYTNSFGGEWSAPDTMKRYSMYLTPKGGVRTSYQPSSPGRFTKETTQKNFNNLYGTKVSLPAILRQQRQRDWVQRSPMSSWRKERGATPLLFLLTLLLLPSKLLCLSGWEGAWSCTCPLQPSASLLGAVPASPTSPLATLHSDSFPAL

SEQ ID NO: 906903 - protein, 120 aa, Homo sapiens
EGPKEGEAVVLPEVEPGLTAREQEATPDPTQKNFNNLYGTKGNYTSRVWEYSSSIQNSDNDLPVVQGSSSFSLKGYPSLMRSQSPKAQPQTWKSGKQTMLSHYRPFYVNKGNGIGSNEAP

SEQ ID NO: 906904 - protein, 92 aa, Homo sapiens
DGAEGTCRRWEVPCNYTSRVWEYSSSIQNSDNDLPVVQGSSSFSLKGYPSLMRSQSPKAQPQTWKSGKQTMLSHYRPFYVNKGNGIGSNEAP

SEQ ID NO: 906905 - protein, 588 aa, Homo sapiens; identical to SEQ ID NO: 906895

SEQ ID NO: 906906 - protein, 588 aa, Homo sapiens; identical to SEQ ID NO: 906895

SEQ ID NO: 906907 - protein, 71 aa, Homo sapiens
CRIARSDGRSLVRVSLLPLCQPLGGSSGLSDFPTGHTPFRLLSCLVTSDGHHHSCAQRPTHHRGEIGWGLP

SEQ ID NO: 906908 - protein, 565 aa, Homo sapiens
MEAADASRSNGSSPEARDARSPSGPSGSLENGTKADGKDAKTTNGHGGEAAEGKSLGSALKPGEGRSALFAGNEWRRPIIQFVESGDDKNSNYFSMDSMEGKRSPYAGLQLGAAKKPPVTFAEKGELRKSIFSESRKPTVSIMEPGETRRNSYPRADTGLFSRSKSGSEEVLCDSCIGNKQKAVKSCLVCQASFCELHLKPHLEGAAFRDHQLLEPIRDFEARKCPVHGKTMELFCQTDQTCICYLCMFQEHKNHSTVTVEEAKAEKETELSLQKEQLQLKIIEIEDEAEKWQKEKDRIKSFTTNEKAILEQNFRDLVRDLEKQKEEVRAALEQREQDAVDQVKVIMDALDERAKVLHEDKQTREQLHSISDSVLFLQEFGALMSNYSLPPPLPTYHVLLEGEGLGQSLGNFKDDLLNVCMRHVEKMCKADLSRNFIERNHMENGGDHRYVNNYTNSFGGEWSAPDTMKRYSMYLTPKGGVRTSYQPSSPGRFTKETTQKNFNNLYGTKGNYTSRVWEYSSSIQNSDNERAKVLHEDRQTREQLHSISDSVLFLQEFGALMSNYS

SEQ ID NO: 906909 - protein, 445 aa, Homo sapiens
MEAADASRSNGSSPEARDARSPSGPSGSLENGTKADGKDAKTTNGHGGEAAEGKSLGSALKPGEGRSALFAGNEWRRPIIQFVESGDDKNSNYFSMDSMEGKRSPYAGLQLGAAKKPPVTFAEKGELRKSIFSESRKPTVSIMEPGETRRNSYPRADTGLFSRSKSGSEEVLCDSCIGNKQKAVKSCLVCQASFCELHLKPHLEGAAFRDHQLLEPIRDFEARKCPVHGKTMELFCQTDQTCICYLCMFQEHKNHSTVTVEEAKAEKETELSLQKEQLQLKIIEIEDEAEKWQKEKDRIKSFTTNEKAILEQNFRDLVRDLEKQKEEVRAALEQREQDAVDQVKVIMDALDERAKVLHEDKQTREQLHSISDSVLFLQEFGALMSNYSLPPPLPTYHRSSTVGTSPVSTAPGLWGLWKDGPACRGWGGRHPAWAFPFGINHWSVK

SEQ ID NO: 906910 - protein, 303 aa, Homo sapiens
MEAADASRSNGSSPEARDARSPSGPSGSLENGTKADGKDAKTTNGHGGEAAEGKSLGSALKPGEGRSALFAGNEWRRPIIQFVESGDDKNSNYFSMDSMEGKRSPYAGLQLGAAKKPPVTFAEKGELRKSIFSESRKPTVSIMEPGETRRNSYPRADTGLFSRSKSGSEEVLCDSCIGNKQKAVKSCLVCQASFCELHLKPHLEGAAFRDHQLLEPIRDFEARKCPVHGKTMELFCQTDQTCICYLCMFQEHKNHSTVTVEEAKAEKETELSLQKEQLQLKIIEIEDEAEKWQKEKDRIKYDK

SEQ ID NO: 906911 - protein, 428 aa, Homo sapiens
MEAADASRSNGSSPEARDARSPSGPSGSLENGTKADGKDAKTTNGHGGEAAEGKSLGSALKPGEGRSALFAGNEWRRPIIQFVESGDDKNSNYFSMDSMEGKRSPYAGLQLGAAKKPPVTFAEKGELRKSIFSESRKPTVSIMEPGETRRNSYPRADTGLFSRSKSGSEEVLCDSCIGNKQKAVKSCLVCQASFCELHLKPHLEGAAFRDHQLLEPIRDFEARKCPVHGKTMELFCQTDQTCICYLCMFQEHKNHSTVTVEEAKAEKETELSLQKEQLQLKIIEIEDEAEKWQKEKDRIKSFTTNEKAILEQNFRDLVRDLEKQKEEVRAALEQREQDAVDQVKVIMDALDERAKVLHEDKQTREQLHSISDSVLFLQVTSHSSVTQALDFTIHFLRPPSNIHPSTYPLIHLFVYLFIHHPAIQPSIH

SEQ ID NO: 906912 - protein, 341 aa, Homo sapiens
GTLWFRWIEVGTVGEAKAEKETELSLQKEQLQLKIIEIEDEAEKWQKEKDRIKSFTTNEKAILEQNFRDLVRDLEKQKEEVRAALEQREQDAVDQVKVIMDALDERAKVLHEDKQTREQLHSISDSVLFLQEFGALMSNYSLPPPLPTYHVLLEGEGLGQSLGNFKDDLLNVCMRHVEKMCKADLSRNFIERNHMENGGDHRYVNNYTNSFGGEWSAPDTMKRYSMYLTPKGGVRTSYQPSSPGRFTKETTQKNFNNLYGTKGNYTSRVWEYSSSIQNSDNDLPVVQGSSSFSLKGYPSLMRSQSPKAQPQTWKSGKQTMLSHYRPFYVNKGNGIGSNEAP

SEQ ID NO: 906913 - protein, 570 aa, Homo sapiens; identical to SEQ ID NO: 906896

SEQ ID NO: 906914 - protein, 588 aa, Homo sapiens; identical to SEQ ID NO: 906895

SEQ ID NO: 906915 - protein, 183 aa, Homo sapiens
WASCFSYFLSLNFLICLRGIQPQLMYGSNKKWALIAPCKGGDHRYVNNYTNSFGGEWSAPDTMKRYSMYLTPKGGVRTSYQPSSPGRFTKETTQKNFNNLYGTKGNYTSRVWEYSSSIQNSDNDLPVVQGSSSFSLKGYPSLMRSQSPKAQPQTWKSGKQTMLSHYRPFYVNKGNGIGSNEAP

SEQ ID NO: 906916 - protein, 119 aa, Homo sapiens
MREMYLRPMSGVRTSYQPSSPGRFTKETTQKNFNNLYGTKGNYTSRVWEYSSSIQNSDNDLPVVQGSSSFSLKGYPSLMRSQSPKAQPQTWKSGKQTMLSHYRPFYVNKGNGIGSNEAP

SEQ ID NO: 906917 - protein, 588 aa, Homo sapiens; identical to SEQ ID NO: 906895

SEQ ID NO: 906918 - protein, 588 aa, Homo sapiens; identical to SEQ ID NO: 906895

SEQ ID NO: 906919 - protein, 588 aa, Homo sapiens; identical to SEQ ID NO: 906895

SEQ ID NO: 906920 - protein, 526 aa, Homo sapiens
MEAADASRSNGSSPEARDARSPSGPSGSLENGTKADGKDAKTTNGHGGEAAEGKSLGSALKPGEGRSALFAGNEWRRPIIQFVESGDDKNSNYFSMDSMEGKRSPYAGLQLGAAKKPPVTFAEKGELRKSIFSESRKPTVSIMEPGETRRNSYPRADTGLFSRSKSGSEEVLCDSCIGNKQKAVKSCLVCQASFCELHLKPHLEGAAFRDHQLLEPIRDFEARKCPVHGKTMELFCQTDQTCICYLCMFQEHKNHSTVTVEEAKAEKETELSLQKEQLQLKIIEIEDEAEKWQKEKDRIKSFTTNEKAILEQNFRDLVRDLEKQKEEVRAALEQREQDAVDQVKVIMDALDERAKVLHEDKQTREQLHSISDSVLFLQEFGALMSNYSLPPPLPTYHVLLEGEGLGQSLGNFKDDLLNVCMRHVEKMCKADLSRNFIERNHMENGGDHRYVNNYTNSFGGEWSAPDTMKRYSMYLTPKGGVRTSYQPSSPGRFTKERIAHQCTKFLQKQHRVADAMQLLPGLLVLM

SEQ ID NO: 906921 - protein, 185 aa, Homo sapiens
MSGGDPSSSLSSPGTTRTPTTSAWTLWKARGRRTQGSSWGLPRSHPLPLPKRASCASPFSRSPGSPRCPSWSPGRPGGTATPGPTRAFFHGPSPAPRRCCATPASATSRRRSSPAWCARPPSASCISSPTWRAPPSETTSCSSPSGTLRPASVPCMARRWSSSARPTRPASATFACSRSTRIIAP

SEQ ID NO: 906922 - protein, 561 aa, Homo sapiens
MITSQGSVSFRDVTVGFTQEEWQHLDPAQRTLYRDVMLENYSHLVSVGYCIPKPEVILKLEKGEEPWILEEKFPSQSHLELINTSRNYSIMKFNEFNKGGKCFCDEKHEIIHSEEEPSEYNKNGNSFWLNEDLIWHQKIKNWEQSFEYNECGKAFPENSLFLVHKRGYTGQKTCKYTEHGKTCDMSFFITHQQTHPRENHYGNECGENIFEESILLEHQSVYPFSQKLNLTPIQRTHSINNIIEYNECGTFFSEKLVLHLQQRTHTGEKPYECHECGKTFTQKSAHTRHQRTHTGGKPYECHECGKTFYKNSDLIKHQRIHTGERPYGCHECGKSFSEKSTLTQHQRTHTGEKPYECHECGKTFSFKSVLTVHQKTHTGEKPYECYACGKAFLRKSDLIKHQRIHTGEKPYECNECGKSFSEKSTLTKHLRTHTGEKPYECIQCGKFFCYYSGFTEHLRRHTGEKPFGCNECGKTFRQKSALIVHQRTHIRQKPYGCNQCGKSFCVKSKLIAHHRTHTGEKPYECNVCGKSFYVKSKLTVHQRIHLGRNPINVVNEGNYSG

SEQ ID NO: 906923 - protein, 120 aa, Homo sapiens
MITSQGSVSFRDVTVGFTQEEWQHLDPAQRTLYRDVMLENYSHLVSVGYCIPKPEVILKLEKGEEPWILEEKFPSQSHLGELVCARWNLKEGRSQRVSLDNKTIEMFFRNHVLEAPDLWK

SEQ ID NO: 906924 - protein, 950 aa, Homo sapiens
MGVPAFFRWLSRKYPSIIVNCVEEKPKECNGVKIPVDASKPNPNDVEFDNLYLDMNGIIHPCTHPEDKPAPKNEDEMMVAIFEYIDRLFSIVRPRRLLYMAIDGVAPRAKMNQQRSRRFRASKEGMEAAVEKQRVREEILAKGGFLPPEEIKERFDSNCITPGTEFMDNLAKCLRYYIADRLNNDPGWKNLTVILSDASAPGEGEHKIMDYIRRQRAQPNHDPNTHHCLCGADADLIMLGLATHEPNFTIIREEFKPNKPKPCGLCNQFGHEVKDCEGLPREKKGKHDELADSLPCAEGEFIFLRLNVLREYLERELTMASLPFTFDVERSIDDWVFMCFFVGNDFLPHLPSLEIRENAIDRLVNIYKNVVHKTGGYLTESGYVNLQRVQMIMLAVGEVEDSIFKKRKDDEDSFRRRQKEKRKRMKRDQPAFTPSGILTPHALGSRNSPGSQVASNPRQAAYEMRMQNNSSPSISPNTSFTSDGSPSPLGGIKRKAEDSDSEPEPEDNVRLWEAGWKQRYYKNKFDVDAADEKFRRKVVQSYVEGLCWVLRYYYQGCASWKWYYPFHYAPFASDFEGIADMPSDFEKGTKPFKPLEQLMGVFPAASGNFLPPSWRKLMSDPDSSIIDFYPEDFAIDLNGKKYAWQGVALLPFVDERRLRAALEEVYPDLTPEETRRNSLGGDVLFVGKHHPLHDFILELYQTGSTEPVEVPPELCHGIQGKFSLDEEAILPDQIVCSPVPMLRDLTQNTVVSINFKDPQFAEDYIFKAVMLPGARKPAAVLKPSDWEKSSNGRQWKPQLGFNRDRRPVHLDQAAFRTLGHVMPRGSGTGIYSNAAPPPVTYQGNLYRPLLRGQAQIPKLMSNMRPQDSWRGPPPLFQQQRFDRGVGAEPLLPWNRMLQTQNAAFQPNQYQMLAGPGGYPPRRDDRGGRQGYPREGRKYPLPPPSGRYNWN

SEQ ID NO: 906925 - protein, 144 aa, Homo sapiens [sequence omitted]

SEQ ID NO: 906926 - protein, 950 aa, Homo sapiens; identical to SEQ ID NO: 906924

SEQ ID NO: 906927 - protein, 435 aa, Homo sapiens
MGVPAFFRWLSRKYPSIIVNCVEEKPKECNGVKIPVDASKPNPNDVEFDNLYLDMNGIIHPCTHPEDKPAPKNEDEMMVAIFEYIDRLFSIVRPRRLLYMAIDGVAPRAKMNQQRSRRFRASKEGMEAAVEKQRVREEILAKGGFLPPEEIKERFDSNCITPGTEFMDNLAKCLRYYIADRLNNDPGWKNLTVILSDASAPGEGEHKIMDYIRRQRAQPNHDPNTHHCLCGADADLIMLGLATHEPNFTIIREEFKPNKPKPCGLCNQFGHEVKDCEGLPREKKGKHDELADSLPCAEGEFIFLRLNVLREYLERELTMASLPFTFDVERSIDDWVFMCFFVGNDFLPHLPSLEIRENAIDRLVNIYKNVVHKTGGYLTESGYVNLQRVQMIMLAVGEVEDSIFKKRKDDEDSFRRRQKEKRKRMKKFTRFSSSQ

SEQ ID NO: 906928 - protein, 874 aa, Homo sapiens
MMVAIFEYIDRLFSIVRPRRLLYMAIDGVAPRAKMNQQRSRRFRASKEGMEAAVEKQRVREEILAKGGFLPPEEIKERFDSNCITPGTEFMDNLAKCLRYYIADRLNNDPGWKNLTVILSDASAPGEGEHKIMDYIRRQRAQPNHDPNTHHCLCGADADLIMLGLATHEPNFTIIREEFKPNKPKPCGLCNQFGHEVKDCEGLPREKKGKHDELADSLPCAEGEFIFLRLNVLREYLERELTMASLPFTFDVERSIDDWVFMCFFVGNDFLPHLPSLEIRENAIDRLVNIYKNVVHKTGGYLTESGYVNLQRVQMIMLAVGEVEDSIFKKRKDDEDSFRRRQKEKRKRMKRDQPAFTPSGILTPHALGSRNSPGSQVASNPRQAAYEMRMQNNSSPSISPNTSFTSDGSPSPLGGIKRKAEDSDSEPEPEDNVRLWEAGWKQRYYKNKFDVDAADEKFRRKVVQSYVEGLCWVLRYYYQGCASWKWYYPFHYAPFASDFEGIADMPSDFEKGTKPFKPLEQLMGVFPAASGNFLPPSWRKLMSDPDSSIIDFYPEDFAIDLNGKKYAWQGVALLPFVDERRLRAALEEVYPDLTPEETRRNSLGGDVLFVGKHHPLHDFILELYQTGSTEPVEVPPELCHGIQGKFSLDEEAILPDQIVCSPVPMLRDLTQNTVVSINFKDPQFAEDYIFKAVMLPGARKPAAVLKPSDWEKSSNGRQWKPQLGFNRDRRPVHLDQAAFRTLGHVMPRGSGTGIYSNAAPPPVTYQGNLYRPLLRGQAQIPKLMSNMRPQDSWRGPPPLFQQQRFDRGVGAEPLLPWNRMLQTQNAAFQPNQYQMLAGPGGYPPRRDDRGGRQGYPREGRKYPLPPPSGRYNWN

SEQ ID NO: 906929 - protein, 784 aa, Homo sapiens
MDNLAKCLRYYIADRLNNDPGWKNLTVILSDASAPGEGEHKIMDYIRRQRAQPNHDPNTHHCLCGADADLIMLGLATHEPNFTIIREEFKPNKPKPCGLCNQFGHEVKDCEGLPREKKGKHDELADSLPCAEGEFIFLRLNVLREYLERELTMASLPFTFDVERSIDDWVFMCFFVGNDFLPHLPSLEIRENAIDRLVNIYKNVVHKTGGYLTESGYVNLQRVQMIMLAVGEVEDSIFKKRKDDEDSFRRRQKEKRKRMKRDQPAFTPSGILTPHALGSRNSPGSQVASNPRQAAYEMRMQNNSSPSISPNTSFTSDGSPSPLGGIKRKAEDSDSEPEPEDNVRLWEAGWKQRYYKNKFDVDAADEKFRRKVVQSYVEGLCWVLRYYYQGCASWKWYYPFHYAPFASDFEGIADMPSDFEKGTKPFKPLEQLMGVFPAASGNFLPPSWRKLMSDPDSSIIDFYPEDFAIDLNGKKYAWQGVALLPFVDERRLRAALEEVYPDLTPEETRRNSLGGDVLFVGKHHPLHDFILELYQTGSTEPVEVPPELCHGIQGKFSLDEEAILPDQIVCSPVPMLRDLTQNTVVSINFKDPQFAEDYIFKAVMLPGARKPAAVLKPSDWEKSSNGRQWKPQLGFNRDRRPVHLDQAAFRTLGHVMPRGSGTGIYSNAAPPPVTYQGNLYRPLLRGQAQIPKLMSNMRPQDSWRGPPPLFQQQRFDRGVGAEPLLPWNRMLQTQNAAFQPNQYQMLAGPGGYPPRRDDRGGRQGYPREGRKYPLPPPSGRYNWN

SEQ ID NO: 906930 - protein, 784 aa, Homo sapiens; identical to SEQ ID NO: 906929

SEQ ID NO: 906931 - protein, 526 aa, Homo sapiens
MKRDQPAFTPSGILTPHALGSRNSPGSQVASNPRQAAYEMRMQNNSSPSISPNTSFTSDGSPSPLGGIKRKAEDSDSEPEPEDNVRLWEAGWKQRYYKNKFDVDAADEKFRRKVVQSYVEGLCWVLRYYYQGCASWKWYYPFHYAPFASDFEGIADMPSDFEKGTKPFKPLEQLMGVFPAASGNFLPPSWRKLMSDPDSSIIDFYPEDFAIDLNGKKYAWQGVALLPFVDERRLRAALEEVYPDLTPEETRRNSLGGDVLFVGKHHPLHDFILELYQTGSTEPVEVPPELCHGIQGKFSLDEEAILPDQIVCSPVPMLRDLTQNTVVSINFKDPQFAEDYIFKAVMLPGARKPAAVLKPSDWEKSSNGRQWKPQLGFNRDRRPVHLDQAAFRTLGHVMPRGSGTGIYSNAAPPPVTYQGNLYRPLLRGQAQIPKLMSNMRPQDSWRGPPPLFQQQRFDRGVGAEPLLPWNRMLQTQNAAFQPNQYQMLAGPGGYPPRRDDRGGRQGYPREGRKYPLPPPSGRYNWN

SEQ ID NO: 906932 - protein, 744 aa, Homo sapiens
MGVPAFFRWLSRKYPSIIVNCVEEKPKECNGVKIPVDASKPNPNDVEFDNLYLDMNGIIHPCTHPEDKPAPKNEDEMMVAIFEYIDRLFSIVRPRRLLYMAIDGVAPRAKMNQQRSRRFRASKEGMEAAVEKQRVREEILAKGGFLPPEEIKERFDSNCITPGTEFMDNLAKCLRYYIADRLNNDPGWKNLTVILSDASAPGEGEHKIMDYIRRQRAQPNHDPNTHHCLCGADADLIMLGLATHEPNFTIIREEFKPNKPKPCGLCNQFGHEVKDCEGLPREKKGKHDELADSLPCAEGEFIFLRLNVLREYLERELTMASLPFTFDVERSIDDWVFMCFFVGNDFLPHLPSLEIRENAIDRLVNIYKNVVHKTGGYLTESGYVNLQRVQMIMLAVGEVEDSIFKKRKDDEDSFRRRQKEKRKRMKRDQPAFTPSGILTPHALGSRNSPGSQVASNPRQAAYEMRMQNNSSPSISPNTSFTSDGSPSPLGGIKRKAEDSDSEPEPEDNVRLWEAGWKQRYYKNKFDVDAADEKFRRKVVQSYVEGLCWVLRYYYQGCASWKWYYPFHYAPFASDFEGIADMPSDFEKGTKPFKPLEQLMGVFPAASGNFLPPSWRKLMSDPDSSIIDFYPEDFAIDLNGKKYAWQGVALLPFVDERRLRAALEEVYPDLTPEENRRKGWRRCLIVGELPIHELIVEAYRKGPEPWGTPTCGDQEGSGRKPRPTKKVPASKGCTNGAVLNHGGTH

SEQ ID NO: 906933 - protein, 352 aa, Homo sapiens [sequence omitted]

SEQ ID NO: 906934 - protein, 435 aa, Homo sapiens; identical to SEQ ID NO: 906927

SEQ ID NO: 906935 - protein, 127 aa, Homo sapiens
MLRFYPRLRRVSIEAKKDIFFQTRGDQTGKGDLLPGMQSAAILCPGSRRAGAGRSRRSPGRAVAREPPQLRRARPRAPGLGPPRASCSLRHPVRRRTPPPTNSPARPFSAAPSSSEASFPASPAAAP

SEQ ID NO: 906936 - protein, 950 aa, Homo sapiens; identical to SEQ ID NO: 906924

SEQ ID NO: 906937 - protein, 950 aa, Homo sapiens; identical to SEQ ID NO: 906924

SEQ ID NO: 906938 - protein, 952 aa, Homo sapiens
MGVPAFFRWLSRKYPSIIVNCVEEKPKECNGVKIPVDASKPNPNDVEFDNLYLDMNGIIHPCTHPEDKPAPKNEDEMMVAIFEYIDRLFSIVRPRRLLYMAIDGVAPRAKMNQQRSRRFRASKEGMEAAVEKQRVREEILAKGGFLPPEEIKERFDSNCITPGTEFMDNLAKCLRYYIADRLNNDPGWKNLTVILSDASAPGEGEHKIMDYIRRQRAQPNHDPNTHHCLCGADADLIMLGLATHEPNFTIIREEFKPNKPKPCGLCNQFGHEVKDCEGLPREKKGKHTAGTDDDTCRESSFRLNVLREIFGNRYLERELTMASLPFTFDVERSIDDWVFMCFFVGNDFLPHLPSLEIRENAIDRLVNIYKNVVHKTGGYLTESGYVNLQRVQMIMLAVGEVEDSIFKKRKDDEDSFRRRQKEKRKRMKRDQPAFTPSGILTPHALGSRNSPGSQVASNPRQAAYEMRMQNNSSPSISPNTSFTSDGSPSPLGGIKRKAEDSDSEPEPEDNVRLWEAGWKQRYYKNKFDVDAADEKFRRKVVQSYVEGLCWVLRYYYQGCASWKWYYPFHYAPFASDFEGIADMPSDFEKGTKPFKPLEQLMGVFPAASGNFLPPSWRKLMSDPDSSIIDFYPEDFAIDLNGKKYAWQGVALLPFVDERRLRAALEEVYPDLTPEETRRNSLGGDVLFVGKHHPLHDFILELYQTGSTEPVEVPPELCHGIQGKFSLDEEAILPDQIVCSPVPMLRDLTQNTVVSINFKDPQFAEDYIFKAVMLPGARKPAAVLKPSDWEKSSNGRQWKPQLGFNRDRRPVHLDQAAFRTLGHVMPRGSGTGIYSNAAPPPVTYQGNLYRPLLRGQAQIPKLMSNMRPQDSWRGPPPLFQQQRFDRGVGAEPLLPWNRMLQTQNAAFQPNQYQMLAGPGGYPPRRDDRGGRQGYPREGRKYPLPPPSGRYNWN

SEQ ID NO: 906939 - protein, 977 aa, Homo sapiens
MGVPAFFRWLSRKYPSIIVNCVEEKPKECNGVKIPVDASKPNPNDVEFDNLYLDMNGIIHPCTHPEDKPAPKNEDEMMVAIFEYIDRLFSIVRPRRLLYMAIDGVAPRAKMNQQRSRRFRASKEGMEAAVEKQRVREEILAKGGFLPPEEIKERFDSNCITPGTEFMDNLAKCLRYYIADRLNNDPGWKNLTVILSDASAPGEGEHKIMDYIRRQRAQPNHDPNTHHCLCGADADLIMLGLATHEPNFTIIREEFKPNKPKPCGLCNQFGHEVKDCEGLPREKKGKHDELADSLPCAEGEFIFLRLNVLREYLERELTMASLPFTFDVERSIDDWVFMCFFVGNDFLPHLPSLEIRENAIDRLVNIYKNVVHKTGVSSFLNDFKTEVFAFIRRSFYIYFITSGYLTESGYVNLQRVQMIMLAVGEVEDSIFKKRKDDEDSFRRRQKEKRKRMKRDQPAFTPSGILTPHALGSRNSPGSQVASNPRQAAYEMRMQNNSSPSISPNTSFTSDGSPSPLGGIKRKAEDSDSEPEPEDNVRLWEAGWKQRYYKNKFDVDAADEKFRRKVVQSYVEGLCWVLRYYYQGCASWKWYYPFHYAPFASDFEGIADMPSDFEKGTKPFKPLEQLMGVFPAASGNFLPPSWRKLMSDPDSSIIDFYPEDFAIDLNGKKYAWQGVALLPFVDERRLRAALEEVYPDLTPEETRRNSLGGDVLFVGKHHPLHDFILELYQTGSTEPVEVPPELCHGIQGKFSLDEEAILPDQIVCSPVPMLRDLTQNTVVSINFKDPQFAEDYIFKAVMLPGARKPAAVLKPSDWEKSSNGRQWKPQLGFNRDRRPVHLDQAAFRTLGHVMPRGSGTGIYSNAAPPPVTYQGNLYRPLLRGQAQIPKLMSNMRPQDSWRGPPPLFQQQRFDRGVGAEPLLPWNRMLQTQNAAFQPNQYQMLAGPGGYPPRRDDRGGRQGYPREGRKYPLPPPSGRYNWN

SEQ ID NO: 906940 - protein, 914 aa, Homo sapiens
MGVPAFFRWLSRKYPSIIVNCVEEKPKECNGVKIPVDASKPNPNDVEFDNLYLDMNGIIHPCTHPEDKPAPKNEDEMMVAIFEYIDRLFSIVRPRRLLYMAIDGVAPRAKMNQQRSRRFRASKEGMEAAVEKQRVREEILAKGGFLPPEEIKERFDSNCITPGTEFMDNLAKCLRYYIADRLNNDPGWKNLTVILSDASAPGEGEHKIMDYIRRQRAQPNHDPNTHHCLCGADADLIMLGLATHEPNFTIIREEFKPNKPKPCGLCNQFGHEVKDCEGLPREKKGKHDELADSLPCAEGEFIFLRLNVLREYLERELTMASLPFTFDVERSIDDWVFMCFFVGNDFLPHLPSLEIRENAIDRLVNIYKNVVHKTGDSFRRRQKEKRKRMKRDQPAFTPSGILTPHALGSRNSPGSQVASNPRQAAYEMRMQNNSSPSISPNTSFTSDGSPSPLGGIKRKAEDSDSEPEPEDNVRLWEAGWKQRYYKNKFDVDAADEKFRRKVVQSYVEGLCWVLRYYYQGCASWKWYYPFHYAPFASDFEGIADMPSDFEKGTKPFKPLEQLMGVFPAASGNFLPPSWRKLMSDPDSSIIDFYPEDFAIDLNGKKYAWQGVALLPFVDERRLRAALEEVYPDLTPEETRRNSLGGDVLFVGKHHPLHDFILELYQTGSTEPVEVPPELCHGIQGKFSLDEEAILPDQIVCSPVPMLRDLTQNTVVSINFKDPQFAEDYIFKAVMLPGARKPAAVLKPSDWEKSSNGRQWKPQLGFNRDRRPVHLDQAAFRTLGHVMPRGSGTGIYSNAAPPPVTYQGNLYRPLLRGQAQIPKLMSNMRPQDSWRGPPPLFQQQRFDRGVGAEPLLPWNRMLQTQNAAFQPNQYQMLAGPGGYPPRRDDRGGRQGYPREGRKYPLPPPSGRYNWN

SEQ ID NO: 906941 - protein, 560 aa, Homo sapiens
MIMLAVGEVEDSIFKKRKDDEDSFRRRQKEKRKRMKRDQPAFTPSGILTPHALGSRNSPGSQVASNPRQAAYEMRMQNNSSPSISPNTSFTSDGSPSPLGGIKRKAEDSDSEPEPEDNVRLWEAGWKQRYYKNKFDVDAADEKFRRKVVQSYVEGLCWVLRYYYQGCASWKWYYPFHYAPFASDFEGIADMPSDFEKGTKPFKPLEQLMGVFPAASGNFLPPSWRKLMSDPDSSIIDFYPEDFAIDLNGKKYAWQGVALLPFVDERRLRAALEEVYPDLTPEETRRNSLGGDVLFVGKHHPLHDFILELYQTGSTEPVEVPPELCHGIQGKFSLDEEAILPDQIVCSPVPMLRDLTQNTVVSINFKDPQFAEDYIFKAVMLPGARKPAAVLKPSDWEKSSNGRQWKPQLGFNRDRRPVHLDQAAFRTLGHVMPRGSGTGIYSNAAPPPVTYQGNLYRPLLRGQAQIPKLMSNMRPQDSWRGPPPLFQQQRFDRGVGAEPLLPWNRMLQTQNAAFQPNQYQMLAGPGGYPPRRDDRGGRQGYPREGRKYPLPPPSGRYNWN

SEQ ID NO: 906942 - protein, 679 aa, Homo sapiens
MGVPAFFRWLSRKYPSIIVNCVEEKPKECNGVKIPVDASKPNPNDVEFDNLYLDMNGIIHPCTHPEDKPAPKNEDEMMVAIFEYIDRLFSIVRPRRLLYMAIDGVAPRAKMNQQRSRRFRASKEGMEAAVEKQRVREEILAKGGFLPPEEIKERFDSNCITPGTEFMDNLAKCLRYYIADRLNNDPGWKNLTVILSDASAPGEGEHKIMDYIRRQRAQPNHDPNTHHCLCGADADLIMLGLATHEPNFTIIREEFKPNKPKPCGLCNQFGHEVKDCEGLPREKKGKHDELADSLPCAEGEFIFLRLNVLREYLERELTMASLPFTFDVERSIDDWVFMCFFVGNDFLPHLPSLEIRENAIDRLVNIYKNVVHKTGGYLTESGYVNLQRVQMIMLAVGEVEDSIFKKRKDDEDSFRRRQKEKRKRMKRDQPAFTPSGILTPHALGSRNSPGSQVASNPRQAAYEMRMQNNSSPSISPNTSFTSDGSPSPLGGIKRKAEDSDSEPEPEDNVRLWEAGWKQRYYKNKFDVDAADEKFRRKVVQSYVEGLCWVLRYYYQGCASWKWYYPFHYAPFASDFEGIADMPSDFEKGTKPFKPLEQLMGVFPAASGNFLPPSWRKLMSDPDSSIIDFYPEDFAIDLNGKKYAWQVVAHCHSGMSERYECPKRLPDSIRKPKRLGDFGE

SEQ ID NO: 906943 - protein, 510 aa, Homo sapiens
MGVPAFFRWLSRKYPSIIVNCVEEKPKECNGVKIPVDASKPNPNDVEFDNLYLDMNGIIHPCTHPEDKPAPKNEDEMMVAIFEYIDRLFSIVRPRRLLYMAIDGVAPRAKMNQQRSRRFRASKEGMEAAVEKQRVREEILAKGGFLPPEEIKERFDSNCITPGTEFMDNLAKCLRYYIADRLNNDPGWKNLTVILSDASAPGEGEHKIMDYIRRQRAQPNHDPNTHHCLCGADADLIMLGLATHEPNFTIIREEFKPNKPKPCGLCNQFGHEVKDCEGLPREKKGKHDELADSLPCAEGEFIFLRLNVLREYLERELTMASLPFTFDVERSIDDWVFMCFFVGNDFLPHLPSLEIRENAIDRLVNIYKNVVHKTGGYLTESGYVNLQRVQMIMLAVGEVEDSIFKKRKDDEDSFRRRQKEKRKRMKRDQPAFTPSGILTPHALGSRNSPGSQVASNPRQAAYEMRMQNNSSPSISPNTSFTSDGSPSPLGGIKRKAEDSDSEPEPEDNVR

SEQ ID NO: 906944 - protein, 430 aa, Homo sapiens
MGVPAFFRWLSRKYPSIIVNCVEEKPKECNGVKIPVDASKPNPNDVEFDNLYLDMNGIIHPCTHPEDKPAPKNEDEMMVAIFEYIDRLFSIVRPRRLLYMAIDGVAPRAKMNQQRSRRFRASKEGMEAAVEKQRVREEILAKGGFLPPEEIKERFDSNCITPGTEFMDNLAKCLRYYIADRLNNDPGWKNLTVILSDASAPGEGEHKIMDYIRRQRAQPNHDPNTHHCLCGADADLIMLGLATHEPNFTIIREEFKPNKPKPCGLCNQFGHEVKDCEGLPREKKGKHDELADSLPCAEGEFIFLRLNVLREYLERELTMASLPFTFDVERSIDDWVFMCFFVGNDFLPHLPSLEIRENAIDRLVNIYKNVVHKTGGYLTESGYVNLQRVQMIMLAVGEVEDSIFKKRKDDEDSFRRRQKEKRKRMKVSFN

SEQ ID NO: 906945 - protein, 257 aa, Homo sapiens
MGVPAFFRWLSRKYPSIIVNCVEEKPKECNGVKIPVDASKPNPNDVEFDNLYLDMNGIIHPCTHPEDKPAPKNEDEMMVAIFEYIDRLFSIVRPRRLLYMAIDGVAPRAKMNQQRSRRFRASKEGMEAAVEKQRVREEILAKGGFLPPEEIKERFDSNCITPGTEFMDNLAKCLRYYIADRLNNDPGWKNLTVILSDASAPGEGEHKIMDYIRRQRAQETGHCDIVRWYPHQSLCSHGAVQVPSAVPLSWPPVLMPW

SEQ ID NO: 906946 - protein, 133 aa, Homo sapiens
FPPNTVTGSERVQITAIGDVLGPSINGLASLIRMPYGCGEQNMINFAPNIYILDYLTKKKQLTDNLKEKALSFMRQGYQRELLYQREDGSFSAFGNYDPSGSTCRGLCSCQRVHVSKRRLQVCHSPERGGWSL

SEQ ID NO: 906947 - protein, 273 aa, Homo sapiens
FPPNTVTGSERVQITAIGDVLGPSINGLASLIRMPYGCGEQNMINFAPNIYILDYLTKKKQLTDNLKEKALSFMRQGYQRELLYQREDGSFSAFGNYDPSGSTWLSAFVLRCFLEADPYIDIDQNVLHRTYTWLKGHQKSNGEFWDPGRVIHSELQGGNKSPVTLTAYIVTSLLGYRKYQPNIDVQESIHFLESEFSRGISDNYTLALITYALSSVGSPKAKEALNMLTWRAEQEGGMQFWVSSESKLSDSWQPRSLDIEVAAYALLSHFLQF

SEQ ID NO: 906948 - protein, 152 aa, Homo sapiens
TSTCTLIFLSPKIDIAPGNQTLPVPVRAQVHQHRAVQIIPLLIGLGVTNATGTGIAGLSPSLSYYHTLLKDLSDSLQDIAKSTLTLQSQIDSLAAVTLQNHRGLDLLTVEKGGLCTFLGEDCFSTNQSGLVRDAASQLNEKASKIRQCLSDF

SEQ ID NO: 906949 - protein, 348 aa, Homo sapiens
TCDCVRIQAMSKEIGLQMHEELLKVTNELYTVMKTYHMYHAESISAESKLKEAEKQEEKQFNKSGDLSMNLLRHEDRPQRRSSVKKIEKMKEKRQAKYSENKLKCTKARNDYLLNLAATNAAISKYYIHDVSDLIDCCDLGFHASLARTFRTYLSAEYNLETSRHEGLDVIENAVDNLDSRSDKHTVMDMCNQVFCPPLKFEFQPHMGDEVCQVSAQQPVQTELLMRYHQLQSRLATLKIENEEVRKTLDATMQTLQDMLTVEDFDVSDAFQHSRSTESVKSAASETYMSKINIAKRRANQQETEMFYFTKFKEYVNGSNLITKLQAKHDLLKQTLGEGERAECGTTR

SEQ ID NO: 906950 - protein, 118 aa, Homo sapiens
MRIQDFCQSAVFPQVRKTLDATMQTLQDMLTVEDFDVSDAFQHSRSTESVKSAASETYMSKINIAKRRANQQETEMFYFTVSGILGPDTTLSAKPLAVTFQEQPKLLRTRETTWVNWI

SEQ ID NO: 906951 - protein, 1099 aa, Homo sapiens
LGGFRGVAHVLRSCQFLAMARESDLAPQYLRFLIHYIGACPLRGTEEIRTQLVEQFKCLEQQSESRLQLLQDLQEFFRRKAEIELEYSRSLEKLAERFSSKIRSSREHQFKKDQYLLSPVNCWYLVLHQTRRESRDHATLNDIFMNNVIVRLSQISEDVIRLFKKSKEIGLQMHEELLKVTNELYTVMKTYHMYHAESISAESKLKEAEKQEEKQFNKSGDLSMNLLRHEDRPQRRSSVKKIEKMKEKRQAKYSENKLKCTKARNDYLLNLAATNAAISKYYIHDVSDLIDCCDLGFHASLARTFRTYLSAEYNLETSRHEGLDVIENAVDNLDSRSDKHTVMDMCNQVFCPPLKFEFQPHMGDEVCQVSAQQPVQTELLMRYHQLQSRLATLKIENEEVRKTLDATMQTLQDMLTVEDFDVSDAFQHSRSTESVKSAASETYMSKINIAKRRANQQETEMFYFTKFKEYVNGSNLITKLQAKHDLLKQTLGEGERAECGTTRGRRNARTRNQDSGQAIPLVVESCIRYINLYGLQQQGIFRVPGSQVEVNDIKNSFERGEDPLVDDQNERDINSVAGVLKLYFRGLENPLFPKERFQDLISTIKLENPAERVHQIQQILVTLPRVVIVVMRYLFAFLNHLSQYSDENMMDPYNLAICFGPTLMHIPDGQDPVSCQAHINEVIKTIIIHHEAIFPSPRELEGPVYEKCMAGGEEYCDSPHSEPGAIDEVDHDNGTEPHTSDEEVEQIEAIAKFDYMGRSPRELSFKKGASLLLYHRASEDWWEGRHNGVDGLIPHQYIVVQDMDDAFSDSLSQKADSEASSGPLLDDKASSKNDLQSPTEHISDYGFGGVMGRVRLRSDGAAIPRRRSGGDTHSPPRGLGPSIDTPPRAAACPSSPHKIPLTRGRIESPEKRRMATFGSAGSINYPDKKALSEGHSMRSTCGSTRHSSLGDHKSLEAEALAEDIEKTMSTALHELRELERQNTVKQAPDVVLDTLEPLKNPPGPVSSEPASPLHTIVIRDPDAAMRRSSSSSTEMMTTFKPALSARLAGAQLRPPPMRPVRPVVQHRSSSSSSSGVGSPAVTPTEKMFPNSSADKSGTM

SEQ ID NO: 906952 - protein, 82 aa, Homo sapiens
TSFLCTLFLMMDPFPFSLTDPSVPLDPISVSNSSSQIILKWKPPSDPNGNITHYLVFWERQAEDSELFELDYCLKGECRQLC

SEQ ID NO: 906953 - protein, 91 aa, Homo sapiens
LLDSEDPVKICGQDACGSNSWTVVDIDPPLRSNDPKSQNHPGWLMRGLKPWTQYAIFVKTLVTFSDERRTYGAKSDIIYVQTDATSECVLG

SEQ ID NO: 906954 - protein, 1428 aa, Homo sapiens
GGLRGRVGAHTRRTRGPQRSWGPPRSMTPAGQRRAPDPRRPRAPAAMGTGGRRGAAAAPLLVAVAALLLGAAGHLYPGEVCPGMDIRNNLTRLHELENCSVIEGHLQILLMFKTRPEDFRDLSFPKLIMITDYLLLFRVYGLESLKDLFPNLTVIRGSRLFFNYALVIFEMVHLKELGLYNLMNITRGSVRIEKNNELCYLATIDWSRILDSVEDNYIVLNKDDNEECGDICPGTAKGKTNCPATVINGQFVERCWTHSHCQKVCPTICKSHGCTAEGLCCHSECLGNCSQPDDPTKCVACRNFYLDGRCVETCPPPYYHFQDWRCVNFSFCQDLHHKCKNSRRQGCHQYVIHNNKCIPECPSGYTMNSSNLLCTPCLGPCPKVCHLLEGEKTIDSVTSAQELRGCTVINGSLIINIRGGNNLAAELEANLGLIEEISGYLKIRRSYALVSLSFFRKLRLIRGETLEIGNYSFYALDNQNLRQLWDWSKHNLTITQGKLFFHYNPKLCLSEIHKMEEVSGTKGRQERNDIALKTNGDQASCENELLKFSYIRTSFDKILLRWEPYWPPDFRDLLGFMLFYKEAPYQNVTEFDGQDACGSNSWTVVDIDPPLRSNDPKSQNHPGWLMRGLKPWTQYAIFVKTLVTFSDERRTYGAKSDIIYVQTDATNPSVPLDPISVSNSSSQIILKWKPPSDPNGNITHYLVFWERQAEDSELFELDYCLKGLKLPSRTWSPPFESEDSQKHNQSEYEDSAGECCSCPKTDSQILKELEESSFRKTFEDYLHNVVFVPRKTSSGTGAEDPRPSRKRRSLGDVGNVTVAVPTVAAFPNTSSTSVPTSPEEHRPFEKVVNKESLVISGLRHFTGYRIELQACNQDTPEERCSVAAYVSARTMPEAKADDIVGPVTHEIFENNVVHLMWQEPKEPNGLIVLYEVSYRRYGDEELHLCVSRKHFALERGCRLRGLSPGNYSVRIRATSLAGNGSWTEPTYFYVTDYLDVPSNIAKIIIGPLIFVFLFSVVIGSIYLFLRKRQPDGPLGPLYASSNPEYLSASDVFPCSVYVPDEWEVSREKITLLRELGQGSFGMVYEGNARDIIKGEAETRVAVKTVNESASLRERIEFLNEASVMKGFTCHHVVRLLGVVSKGQPTLVVMELMAHGDLKSYLRSLRPEAENNPGRPPPTLQEMIQMAAEIADGMAYLNAKKFVHRDLAARNCMVAHDFTVKIGDFGMTRDIYETDYYRKGGKGLLPVRWMAPESLKDGVFTTSSDMWSFGVVLWEITSLAEQPYQGLSNEQVLKFVMDGGYLDQPDNCPERVTDLMRMCWQFNPKMRPTFLEIVNLLKDDLHPSFPEVSFFHSEENKAPESEELEMEFEDMENVPLDRSSHCQREEAGGRDGGSSLGFKRSYEEHIPYTHMNGGKKNGRILTLPRSNPS

SEQ ID NO: 906955 - protein, 1416 aa, Homo sapiens
GGLRGRVGAHTRRTRGPQRSWGPPRSMTPAGQRRAPDPRRPRAPAAMGTGGRRGAAAAPLLVAVAALLLGAAGHLYPGEVCPGMDIRNNLTRLHELENCSVIEGHLQILLMFKTRPEDFRDLSFPKLIMITDYLLLFRVYGLESLKDLFPNLTVIRGSRLFFNYALVIFEMVHLKELGLYNLMNITRGSVRIEKNNELCYLATIDWSRILDSVEDNYIVLNKDDNEECGDICPGTAKGKTNCPATVINGQFVERCWTHSHCQKVCPTICKSHGCTAEGLCCHSECLGNCSQPDDPTKCVACRNFYLDGRCVETCPPPYYHFQDWRCVNFSFCQDLHHKCKNSRRQGCHQYVIHNNKCIPECPSGYTMNSSNLLCTPCLGPCPKVCHLLEGEKTIDSVTSAQELRGCTVINGSLIINIRGGNNLAAELEANLGLIEEISGYLKIRRSYALVSLSFFRKLRLIRGETLEIGNYSFYALDNQNLRQLWDWSKHNLTITQGKLFFHYNPKLCLSEIHKMEEVSGTKGRQERNDIALKTNGDQASCENELLKFSYIRTSFDKILLRWEPYWPPDFRDLLGFMLFYKEAPYQNVTEFDGQDACGSNSWTVVDIDPPLRSNDPKSQNHPGWLMRGLKPWTQYAIFVKTLVTFSDERRTYGAKSDIIYVQTDATNPSVPLDPISVSNSSSQIILKWKPPSDPNGNITHYLVFWERQAEDSELFELDYCLKGLKLPSRTWSPPFESEDSQKHNQSEYEDSAGECCSCPKTDSQILKELEESSFRKTFEDYLHNVVFVPRPSRKRRSLGDVGNVTVAVPTVAAFPNTSSTSVPTSPEEHRPFEKVVNKESLVISGLRHFTGYRIELQACNQDTPEERCSVAAYVSARTMPEAKADDIVGPVTHEIFENNVVHLMWQEPKEPNGLIVLYEVSYRRYGDEELHLCVSRKHFALERGCRLRGLSPGNYSVRIRATSLAGNGSWTEPTYFYVTDYLDVPSNIAKIIIGPLIFVFLFSVVIGSIYLFLRKRQPDGPLGPLYASSNPEYLSASDVFPCSVYVPDEWEVSREKITLLRELGQGSFGMVYEGNARDIIKGEAETRVAVKTVNESASLRERIEFLNEASVMKGFTCHHVVRLLGVVSKGQPTLVVMELMAHGDLKSYLRSLRPEAENNPGRPPPTLQEMIQMAAEIADGMAYLNAKKFVHRDLAARNCMVAHDFTVKIGDFGMTRDIYETDYYRKGGKGLLPVRWMAPESLKDGVFTTSSDMWSFGVVLWEITSLAEQPYQGLSNEQVLKFVMDGGYLDQPDNCPERVTDLMRMCWQFNPKMRPTFLEIVNLLKDDLHPSFPEVSFFHSEENKAPESEELEMEFEDMENVPLDRSSHCQREEAGGRDGGSSLGFKRSYEEHIPYTHMNGGKKNGRILTLPRSNPS

SEQ ID NO: 906956 - protein, 1428 aa, Homo sapiens; identical to SEQ ID NO: 906954

SEQ ID NO: 906957 - protein, 1442 aa, Homo sapiens
GGLRGRVGAHTRRTRGPQRSWGPPRSMTPAGQRRAPDPRRPRAPAAMGTGGRRGAAAAPLLVAVAALLLGAAGHLYPGEVCPGMDIRNNLTRLHELENCSVIEGHLQILLMFKTRPEDFRDLSFPKLIMITDYLLLFRVYGLESLKDLFPNLTVIRGSRLFFNYALVIFEMVHLKELGLYNLMNITRGSVRIEKNNELCYLATIDWSRILDSVEDNYIVLNKDDNEECGDICPGTAKGKTNCPATVINGQFVERCWTHSHCQKVCPTICKSHGCTAEGLCCHSECLGNCSQPDDPTKCVACRNFYLDGRCVETCPPPYYHFQDWRCVNFSFCQDLHHKCKNSRRQGCHQYVIHNNKCIPECPSGYTMNSSNLLCTPCLGPCPKVCHLLEGEKTIDSVTSAQELRGCTVINGSLIINIRGGNNLAAELEANLGLIEEISGYLKIRRSYALVSLSFFRKLRLIRGETLEIGNYSFYALDNQNLRQLWDWSKHNLTITQGKLFFHYNPKLCLSEIHKMEEVSGTKGRQERNDIALKTNGDQASCENELLKFSYIRTSFDKILLRWEPYWPPDFRDLLGFMLFYKEAPYQNVTEFDGQDACGSNSWTVVDIDPPLRSNDPKSQNHPGWLMRGLKPWTQYAIFVKTLVTFSDERRTYGAKSDIIYVQTDATNPSVPLDPISVSNSSSQIILKWKPPSDPNGNITHYLVFWERQAEDSELFELDYCLKGLKLPSRTWSPPFESEDSQKHNQSEYEDSAGECCSCPKTDSQILKELEESSFRKTFEDYLHNVVFVPRKTSSGTGAEDPRPSRKRRSLGDVGNVTVAVPTVAAFPNTSSTSVPTSPEEHRPFEKVVNKESLVISGLRHFTGYRIELQACNQDTPEERCSVAAYVSARTMPEAKADDIVGPVTHEIFENNVVHLMWQEPKEPNGLIVLYEVSYRRYGDEELHLCVSRKHFALERGCRLRGLSPGNYSVRIRATSLAGNGSWTEPTYFYVTDYLDVPSNIAKIIIGPLIFVFLFSVVIGSIYLFLRKRQPDGPLGPLYASSNPEYLSASDVFPCSVYVPDEWEVSREKITLLRELGQGSFGMVYEGNARDIIKGEAETRVAVKTVNESASLRERIEFLNEASVMKGFTCHHVVRLLGVVSKGQPTLVVMELMAHGDLKSYLRSLRPEAENNPGRPPPTLQEMIQMAAEIADGMAYLNAKKFVHRDLAARNCMVAHDFTVKIGGRLAFCFENITTQANFGMTRDIYETDYYRKGGKGLLPVRWMAPESLKDGVFTTSSDMWSFGVVLWEITSLAEQPYQGLSNEQVLKFVMDGGYLDQPDNCPERVTDLMRMCWQFNPKMRPTFLEIVNLLKDDLHPSFPEVSFFHSEENKAPESEELEMEFEDMENVPLDRSSHCQREEAGGRDGGSSLGFKRSYEEHIPYTHMNGGKKNGRILTLPRSNPS

SEQ ID NO: 906958 - protein, 509 aa, Homo sapiens
GWTLPDVQSSATLLLLLSSSQELHLCVSRKHFALERGCRLRGLSPGNYSVRIRATSLAGNGSWTEPTYFYVTDYLDVPSNIAKIIIGPLIFVFLFSVVIGSIYLFLRKRQPDGPLGPLYASSNPEYLSASDVFPCSVYVPDEWEVSREKITLLRELGQGSFGMVYEGNARDIIKGEAETRVAVKTVNESASLRERIEFLNEASVMKGFTCHHVVRLLGVVSKGQPTLVVMELMAHGDLKSYLRSLRPEAENNPGRPPPTLQEMIQMAAEIADGMAYLNAKKFVHRDLAARNCMVAHDFTVKIGDFGMTRDIYETDYYRKGGKGLLPVRWMAPESLKDGVFTTSSDMWSFGVVLWEITSLAEQPYQGLSNEQVLKFVMDGGYLDQPDNCPERVTDLMRMCWQFNPKMRPTFLEIVNLLKDDLHPSFPEVSFFHSEENKAPESEELEMEFEDMENVPLDRSSHCQREEAGGRDGGSSLGFKRSYEEHIPYTHMNGGKKNGRILTLPRSNPS

SEQ ID NO: 906959 - protein, 1428 aa, Homo sapiens; identical to SEQ ID NO: 906954

SEQ ID NO: 906960 - protein, 1384 aa, Homo sapiens
GGLRGRVGAHTRRTRGPQRSWGPPRSMTPAGQRRAPDPRRPRAPAAMGTGGRRGAAAAPLLVAVAALLLGAAGHLYPGEVCPGMDIRNNLTRLHELENCSVIEGHLQILLMFKTRPEDFRDLSFPKLIMITDYLLLFRVYGLESLKDLFPNLTVIRGSRLFFNYALVIFEMVHLKELGLYNLMNITRGSVRIEKNNELCYLATIDWSRILDSVEDNYIVLNKDDNEECGDICPGTAKGKTNCPATVINGQFVERCWTHSHCQKVCPTICKSHGCTAEGLCCHSECLGNCSQPDDPTKCVACRNFYLDGRCVETCPPPYYHFQDWRCVNFSFCQDLHHKCKNSRRQGCHQYVIHNNKCIPECPSGYTMNSSNLLCTPCLGPCPKVCHLLEGEKTIDSVTSAQELRGCTVINGSLIINIRGGNNLAAELEANLGLIEEISGYLKIRRSYALVSLSFFRKLRLIRGETLEIGNYSFYALDNQNLRQLWDWSKHNLTITQGKLFFHYNPKLCLSEIHKMEEVSGTKGRQERNDIALKTNGDQASCENELLKFSYIRTSFDKILLRWEPYWPPDFRDLLGFMLFYKEAPYQNVTEFDGQDACGSNSWTVVDIDPPLRSNDPKSQNHPGWLMRGLKPWTQYAIFVKTLVTFSDERRTYGAKSDIIYVQTDATNPSVPLDPISVSNSSSQIILKWKPPSDPNGNITHYLVFWERQAEDSELFELDYCLKGLKLPSRTWSPPFESEDSQKHNQSEYEDSAGECCSCPKTDSQILKELEESSFRKTFEDYLHNVVFVPRKTSSGTGAEDPRPSRKRRSLGDVGNVTVAVPTVAAFPNTSSTSVPTSPEEHRPFEKVVNKESLVISGLRHFTGYRIELQACNQDTPEERCSVAAYVSARTMPEAKADDIVGPVTHEIFENNVVHLMWQEPKEPNGLIVLYEVSYRRYGDEELHLCVSRKHFALERGCRLRGLSPGNYSVRIRATSLAGNGSWTEPTYFYVTDYLDVPSNIAKIIIGPLIFVFLFSVVIGSIYLFLRKRQPDGPLGPLYASSNPEYLSASDVFPCSVYVPDEWEVSREKITLLRELGQGSFGMVYEGNARDIIKGEAETRVAVKTVNESASLRERIEFLNEASVMKGFTCHHVVRLLGVVSKGQPTLVVMELMAHGDLKSYLRSLRPEAENNPGRPPPTLQEMIQMAAEIADGMAYLNAKKFVHRDLAARNCMVAHDFTVKIGDFGMTRDIYETDYYRKGGKGLLPVRWMAPESLKDGVFTTSSDMWSFGVVLWEITSLAEQPYQGLSNEQVLKFVMDGGYLDQPDNCPERVTDLMRMCWQFNPKMRPTFLEIVNLLKDDLHPSFPEVSFFHSEENKAPESEELEMEFEDMENVPLDRSSLLPSY

SEQ ID NO: 906961 - protein, 107 aa, Homo sapiens
SCNLWTLSAHHQLGEVGPWRLSLVAVNISVARQEAASSLSPTPNTDISVFGVGGEWGHELVCLLWGREGEGVRHKWPLCLVLKASISGNEAMFAANTFGCCEATWSV

SEQ ID NO: 906962 - protein, 751 aa, Homo sapiens
GGLRGRVGAHTRRTRGPQRSWGPPRSMTPAGQRRAPDPRRPRAPAAMGTGGRRGAAAAPLLVAVAALLLGAAGHLYPGEVCPGMDIRNNLTRLHELENCSVIEGHLQILLMFKTRPEDFRDLSFPKLIMITDYLLLFRVYGLESLKDLFPNLTVIRGSRLFFNYALVIFEMVHLKELGLYNLMNITRGSVRIEKNNELCYLATIDWSRILDSVEDNYIVLNKDDNEECGDICPGTAKGKTNCPATVINGQFVERCWTHSHCQKVCPTICKSHGCTAEGLCCHSECLGNCSQPDDPTKCVACRNFYLDGRCVETCPPPYYHFQDWRCVNFSFCQDLHHKCKNSRRQGCHQYVIHNNKCIPECPSGYTMNSSNLLCTPCLGPCPKVCHLLEGEKTIDSVTSAQELRGCTVINGSLIINIRGGNNLAAELEANLGLIEEISGYLKIRRSYALVSLSFFRKLRLIRGETLEIGNYSFYALDNQNLRQLWDWSKHNLTITQGKLFFHYNPKLCLSEIHKMEEVSGTKGRQERNDIALKTNGDQASCENELLKFSYIRTSFDKILLRWEPYWPPDFRDLLGFMLFYKEAPYQNVTEFDGQDACGSNSWTVVDIDPPLRSNDPKSQNHPGWLMRGLKPWTQYAIFVKTLVTFSDERRTYGAKSDIIYVQTDATNPSVPLDPISVSNSSSQIILKWKPPSDPNGNITHYLVFWERQAEDSELFELDYCLKGRSRKQGRSRKRQKQEAAEAGSGRSRKRV

SEQ ID NO: 906963 - protein, 294 aa, Homo sapiens
GGLRGRVGAHTRRTRGPQRSWGPPRSMTPAGQRRAPDPRRPRAPAAMGTGGRRGAAAAPLLVAVAALLLGAAGHLYPGEVCPGMDIRNNLTRLHELENCSVIEGHLQILLMFKTRPEDFRDLSFPKLIMITDYLLLFRVYGLESLKDLFPNLTVIRGSRLFFNYALVIFEMVHLKELGLYNLMNITRGSVRIEKNNELCYLATIDWSRILDSVEDNYIVLNKDDNEECGDICPGTAKGKTNCPATVINGQFVERCWTHSHCQKGTPGIQGSKQCLVPCSRKLKMFYGLKMLNGH

SEQ ID NO: 906964 - protein, 77 aa, Homo sapiens
DTCGLQVSEPSGLSNEVPSVLKGVGFVSTEKPLQALVPRTLGMTHLCDPWCLLRAGPAACQADASENPGVSLAFCMR

SEQ ID NO: 906965 - protein, 1428 aa, Homo sapiens; identical to SEQ ID NO: 906954

SEQ ID NO: 906966 - protein, 1428 aa, Homo sapiens; identical to SEQ ID NO: 906954

SEQ ID NO: 906967 - protein, 1428 aa, Homo sapiens; identical to SEQ ID NO: 906954

SEQ ID NO: 906968 - protein, 1082 aa, Homo sapiens
MSEGPWIPGHPPPLSLSLSLCSVLSLLCTPCLGPCPKVCHLLEGEKTIDSVTSAQELRGCTVINGSLIINIRGGNNLAAELEANLGLIEEISGYLKIRRSYALVSLSFFRKLRLIRGETLEIGNYSFYALDNQNLRQLWDWSKHNLTITQGKLFFHYNPKLCLSEIHKMEEVSGTKGRQERNDIALKTNGDQASCENELLKFSYIRTSFDKILLRWEPYWPPDFRDLLGFMLFYKEAPYQNVTEFDGQDACGSNSWTVVDIDPPLRSNDPKSQNHPGWLMRGLKPWTQYAIFVKTLVTFSDERRTYGAKSDIIYVQTDATNPSVPLDPISVSNSSSQIILKWKPPSDPNGNITHYLVFWERQAEDSELFELDYCLKGLKLPSRTWSPPFESEDSQKHNQSEYEDSAGECCSCPKTDSQILKELEESSFRKTFEDYLHNVVFVPRKTSSGTGAEDPRPSRKRRSLGDVGNVTVAVPTVAAFPNTSSTSVPTSPEEHRPFEKVVNKESLVISGLRHFTGYRIELQACNQDTPEERCSVAAYVSARTMPEAKADDIVGPVTHEIFENNVVHLMWQEPKEPNGLIVLYEVSYRRYGDEELHLCVSRKHFALERGCRLRGLSPGNYSVRIRATSLAGNGSWTEPTYFYVTDYLDVPSNIAKIIIGPLIFVFLFSVVIGSIYLFLRKRQPDGPLGPLYASSNPEYLSASDVFPCSVYVPDEWEVSREKITLLRELGQGSFGMVYEGNARDIIKGEAETRVAVKTVNESASLRERIEFLNEASVMKGFTCHHVVRLLGVVSKGQPTLVVMELMAHGDLKSYLRSLRPEAENNPGRPPPTLQEMIQMAAEIADGMAYLNAKKFVHRDLAARNCMVAHDFTVKIGDFGMTRDIYETDYYRKGGKGLLPVRWMAPESLKDGVFTTSSDMWSFGVVLWEITSLAEQPYQGLSNEQVLKFVMDGGYLDQPDNCPERVTDLMRMCWQFNPKMRPTFLEIVNLLKDDLHPSFPEVSFFHSEENKAPESEELEMEFEDMENVPLDRSSHCQREEAGGRDGGSSLGFKRSYEEHIPYTHMNGGKKNGRILTLPRSNPS

SEQ ID NO: 906969 - protein, 280 aa, Homo sapiens
MELMAHGDLKSYLRSLRPEAENNPGRPPPTLQEMIQMAAEIADGMAYLNAKKFVHRDLAARNCMVAHDFTVKIGDFGMTRDIYETDYYRKGGKGLLPVRWMAPESLKDGVFTTSSDMWSFGVVLWEITSLAEQPYQGLSNEQVLKFVMDGGYLDQPDNCPERVTDLMRMCWQFNPKMRPTFLEIVNLLKDDLHPSFPEVSFFHSEENKAPESEELEMEFEDMENVPLDRSSHCQREEAGGRDGGSSLGFKRSYEEHIPYTHMNGGKKNGRILTLPRSNPS

SEQ ID NO: 906970 - protein, 112 aa, Homo sapiens
IIAALPVCGPKVGRVTPPAPPPLFQENFKFYRLSFKMVFLVFFFSLIQAEGFFFSLQNEFLKLTNSCCFHILDKGLWSRRVLTCVCTCVCPLDTADVCAKYPCGVDALGIGS

SEQ ID NO: 906971 - protein, 1229 aa, Homo sapiens
GGLRGRVGAHTRRTRGPQRSWGPPRSMTPAGQRRAPDPRRPRAPAAMGTGGRRGAAAAPLLVAVAALLLGAAGHLYPGEVCPGMDIRNNLTRLHELENCSVIEGHLQILLMFKTRPEDFRDLSFPKLIMITDYLLLFRVYGLESLKDLFPNLTVIRGSRLFFNYALVIFEMVHLKELGLYNLMNITRGSVRIEKNNELCYLATIDWSRILDSVEDNYIVLNKDDNEECGDICPGTAKGKTNCPATVINGQFVERCWTHSHCQKVCPTICKSHGCTAEGLCCHSECLGNCSQPDDPTKCVACRNFYLDGRCVETCPPPYYHFQDWRCVNFSFCQDLHHKCKNSRRQGCHQYVIHNNKCIPECPSGYTMNSSNLLCTPCLGPCPKVCHLLEGEKTIDSVTSAQELRGCTVINGSLIINIRGGNNLAAELEANLGLIEEISGYLKIRRSYALVSLSFFRKLRLIRGETLEIGNYSFYALDNQNLRQLWDWSKHNLTITQGKLFFHYNPKLCLSEIHKMEEVSGTKGRQERNDIALKTNGDQASCENELLKFSYIRTSFDKILLRWEPYWPPDFRDLLGFMLFYKEAPYQNVTEFDGQDACGSNSWTVVDIDPPLRSNDPKSQNHPGWLMRGLKPWTQYAIFVKTLVTFSDERRTYGAKSDIIYVQTDATNPSVPLDPISVSNSSSQIILKWKPPSDPNGNITHYLVFWERQAEDSELFELDYCLKGLKLPSRTWSPPFESEDSQKHNQSEYEDSAGECCSCPKTDSQILKELEESSFRKTFEDYLHNVVFVPRKTSSGTGAEDPRPSRKRRSLGDVGNVTVAVPTVAAFPNTSSTSVPTSPEEHRPFEKVVNKESLVISGLRHFTGYRIELQACNQDTPEERCSVAAYVSARTMPEAKADDIVGPVTHEIFENNVVHLMWQEPKEPNGLIVLYEVSYRRYGDEELHLCVSRKHFALERGCRLRGLSPGNYSVRIRATSLAGNGSWTEPTYFYVTDYLDVPSNIAKIIIGPLIFVFLFSVVIGSIYLFLRKRQPDGPLGPLYASSNPEYLSASDVFPCSVYVPDEWEVSREKITLLRELGQGSFGMVYEGNARDIIKGEAETRVAVKTVNESASLRERIEFLNEASVMKGFTCHHVVRLLGVVSKGQPTLVVMELMAHGDLKSYLRSLRPEAENNPGRPPPTLQEMIQMAAEIADGMAYLNAKKFVHRDLAARNCMVAHDFTVKIGGSSGFLL

SEQ ID NO: 906972 - protein, 731 aa, Homo sapiens
GGLRGRVGAHTRRTRGPQRSWGPPRSMTPAGQRRAPDPRRPRAPAAMGTGGRRGAAAAPLLVAVAALLLGAAGHLYPGEVCPGMDIRNNLTRLHELENCSVIEGHLQILLMFKTRPEDFRDLSFPKLIMITDYLLLFRVYGLESLKDLFPNLTVIRGSRLFFNYALVIFEMVHLKELGLYNLMNITRGSVRIEKNNELCYLATIDWSRILDSVEDNYIVLNKDDNEECGDICPGTAKGKTNCPATVINGQFVERCWTHSHCQKVCPTICKSHGCTAEGLCCHSECLGNCSQPDDPTKCVACRNFYLDGRCVETCPPPYYHFQDWRCVNFSFCQDLHHKCKNSRRQGCHQYVIHNNKCIPECPSGYTMNSSNLLCTPCLGPCPKVCHLLEGEKTIDSVTSAQELRGCTVINGSLIINIRGGNNLAAELEANLGLIEEISGYLKIRRSYALVSLSFFRKLRLIRGETLEIGNYSFYALDNQNLRQLWDWSKHNLTITQGKLFFHYNPKLCLSEIHKMEEVSGTKGRQERNDIALKTNGDQASCENELLKFSYIRTSFDKILLRWEPYWPPDFRDLLGFMLFYKEAPYQNVTEFDGQDACGSNSWTVVDIDPPLRSNDPKSQNHPGWLMRGLKPWTQYAIFVKTLVTFSDERRTYGAKSDIIYVQTDATNPSVPLDPISVSNSSSQIILKWKPPSDPNGNITHYLVFWERQAEDSELFELDYCLKGRVQSSAPL

SEQ ID NO: 906973 - protein, 130 aa, Homo sapiens
MGTLQRKLLIPAGCRVYRARDENTGPRFPVHEAGSAPDPSDASTVRLLTCLAFCSFSLVVCPGMDIRNNLTRLHELENCSVIEGHLQILLMFKTRPEDFRDLSFPKLIMITDYLLLFRVYGLESLKDLFP

SEQ ID NO: 906974 - protein, 88 aa, Homo sapiens
DAWVDPRVRTVGRPQFARSLSAAPQLSDTADTMGFGDLKSPAGLQVLNDYLADKSYIEGYVPSQADVAVFEAVSSPPPADFVSCPTLV

SEQ ID NO: 906975 - protein, 111 aa, Homo sapiens
QFRRKWPQPRGRASSVISGASRAGSRHLREPWSVGRPQFARSLSAAPQLSDTADTMGFGDLKSPAGLQVLNDYLADKSYIEGYVPSQADVAVFEAVSSPPPADFVSCPTLV

SEQ ID NO: 906976 - protein, 78 aa, Homo sapiens
RSSAGSGPSLEAGRLRSSPALLGLVPVIFGSRGALGYSRHHGFRRPEKPCRPPGAQRLPGGQELHRGVCAITSRCGSI

SEQ ID NO: 906977 - protein, 69 aa, Homo sapiens
IRCSRGYNLCSDPPFAMPYVGIITSSLTKRKRPACQGVNESFGANMGPADVGKTLQESGATDSKDDDDI

SEQ ID NO: 906978 - protein, 77 aa, Homo sapiens
RSSAGSGPSLEAGRLRSSPALLGLVPVIFGSRGGTNLRHAYFINLLPNATKGPWTICGPFNSGPPIRTWRSGNAKVL

SEQ ID NO: 906979 - protein, 77 aa, Homo sapiens; identical to SEQ ID NO: 906978

SEQ ID NO: 906980 - protein, 77 aa, Homo sapiens; identical to SEQ ID NO: 906978

SEQ ID NO: 906981 - protein, 77 aa, Homo sapiens; identical to SEQ ID NO: 906978

SEQ ID NO: 906982 - protein, 77 aa, Homo sapiens; identical to SEQ ID NO: 906978

SEQ ID NO: 906983 - protein, 77 aa, Homo sapiens; identical to SEQ ID NO: 906978

SEQ ID NO: 906984 - protein, 111 aa, Homo sapiens; identical to SEQ ID NO: 906975

SEQ ID NO: 906985 - protein, 105 aa, Homo sapiens
SYAALEDTTYVLTHLLQFILLCGSAFLCSDPLLCSDPPLCSDPPQRGAPTICALSFCCSPALGYSRHHGFRRPEKPCRPPGAQRLPGGQELHRGVCAITSRCGSI

SEQ ID NO: 906986 - protein, 115 aa, Homo sapiens
LDLPFLTHRFRNDQLVPSQRLAQHNDTLEFDNLLPLIYPQSKAFKIKQLFKTLSDTADTMGFGDLKSPAGLQVLNDYLADKSYIEGYVPSQADVAVFEAVSSPPPADFVSCPTLV

SEQ ID NO: 906987 - protein, 77 aa, Homo sapiens; identical to SEQ ID NO: 906978

SEQ ID NO: 906988 - protein, 77 aa, Homo sapiens; identical to SEQ ID NO: 906978

SEQ ID NO: 906989 - protein, 77 aa, Homo sapiens; identical to SEQ ID NO: 906978

SEQ ID NO: 906990 - protein, 69 aa, Homo sapiens
RARCFLSGYGANDEAPHKVLAREVPEYIRDGTRSRKPWKRPVAVLEVAQRITVLGRVILDRCGMLLLQN

SEQ ID NO: 906991 - protein, 160 aa, Homo sapiens
EDSCPLIIVILILIQTCPFVIRCAGLRLLLLPSQELLKNLKLLNKVQAVLAKNSASETLRMSLSNGLGICVCPFLSGVWYRPRRSRYMCLWTRMFMNIQPTACRLCVMPYVGIITSSLTKRKRPACQGVNESFGANMGPADVGKTLQESGATDSKDDDDI

SEQ ID NO: 906992 - protein, 117 aa, Homo sapiens
MSLICCCLLSYCGSADDWCLGLSCKCPAGARGAHGMNWSDNELLKAYVPFISRSASDSQSCITAHRLPTVCHALRWYNHIKSYEKEKASLPGSERKLWGKYGSCRCWEDTTGKWSYR

SEQ ID NO: 906993 - protein, 77 aa, Homo sapiens; identical to SEQ ID NO: 906978

SEQ ID NO: 906994 - protein, 77 aa, Homo sapiens; identical to SEQ ID NO: 906978

SEQ ID NO: 906995 - protein, 77 aa, Homo sapiens; identical to SEQ ID NO: 906978

SEQ ID NO: 906996 - protein, 78 aa, Homo sapiens; identical to SEQ ID NO: 906976

SEQ ID NO: 906997 - protein, 78 aa, Homo sapiens; identical to SEQ ID NO: 906976

SEQ ID NO: 906998 - protein, 78 aa, Homo sapiens; identical to SEQ ID NO: 906976

SEQ ID NO: 906999 - protein, 100 aa, Homo sapiens
DVQILMTSAGYTGYIFKQDPKFGRKGQFTPHKTPQAFRCQGAWCSHMENLPPTPIPLIPDPLNPCSPFIPRLAQYESKKAKKTLHLLPKSSILLDVKPLG

SEQ ID NO: 907000 - protein, 78 aa, Homo sapiens; identical to SEQ ID NO: 906976

SEQ ID NO: 907001 - protein, 78 aa, Homo sapiens; identical to SEQ ID NO: 906976

SEQ ID NO: 907002 - protein, 69 aa, Homo sapiens
ITVLHTTRGSLKNANLMPYVGIITSSLTKRKRPACQGVNESFGANMGPADVGKTLQESGATDSKDDDDI

SEQ ID NO: 907003 - protein, 77 aa, Homo sapiens; identical to SEQ ID NO: 906978

SEQ ID NO: 907004 - protein, 77 aa, Homo sapiens; identical to SEQ ID NO: 906978

SEQ ID NO: 907005 - protein, 77 aa, Homo sapiens; identical to SEQ ID NO: 906978

SEQ ID NO: 907006 - protein, 77 aa, Homo sapiens; identical to SEQ ID NO: 906978

SEQ ID NO: 907007 - protein, 77 aa, Homo sapiens; identical to SEQ ID NO: 906978

SEQ ID NO: 907008 - protein, 95 aa, Homo sapiens
SYAALEDTTYVLTHLLHVGRPQFARSLSAAPQLSDTADTMGFGDLKSPAGLQVLNDYLADKSYIEGYVPSQADVAVFEAVSSPPPADFVSCPTLV

SEQ ID NO: 907009 - protein, 77 aa, Homo sapiens; identical to SEQ ID NO: 906978

SEQ ID NO: 907010 - protein, 77 aa, Homo sapiens; identical to SEQ ID NO: 906978

SEQ ID NO: 907011 - protein, 77 aa, Homo sapiens; identical to SEQ ID NO: 906978

SEQ ID NO: 907012 - protein, 77 aa, Homo sapiens; identical to SEQ ID NO: 906978

SEQ ID NO: 907013 - protein, 114 aa, Homo sapiens
QPPQDDRLHFLGWGQLRVPEITWSVLPSQFMPCHKPLPRCHVLRGLPAAPARQPTACRLCVMPYVGIITSSLTKRKRPACQGVNESFGANMGPADVGKTLQESGATDSKDDDDI

SEQ ID NO: 907014 - protein, 101 aa, Homo sapiens
HEGHIHGLHIVLKSSDLLLQHICSNFIIFNYTLYLKFLNQPTACRLCVMPYVGIITSSLTKRKRPACQGVNESFGANMGPADVGKTLQESGATDSKDDDDI

SEQ ID NO: 907015 - protein, 77 aa, Homo sapiens; identical to SEQ ID NO: 906978

SEQ ID NO: 907016 - protein, 77 aa, Homo sapiens; identical to SEQ ID NO: 906978

SEQ ID NO: 907017 - protein, 77 aa, Homo sapiens; identical to SEQ ID NO: 906978

SEQ ID NO: 907018 - protein, 77 aa, Homo sapiens; identical to SEQ ID NO: 906978

SEQ ID NO: 907019 - protein, 157 aa, Homo sapiens
MPLFQSHLYSRQPCGVRCTGPAYRCRKRDVLPSDKVTWLFSNTDKAPRQGTRGRRGQQLAVAADVCPQLHHSSLWLCRARGFSVRVSMCLPFRSSQLVCLAVPGLCSVSPLLRAPPPRFLSPEAVGWAPMNCSSMLRCPCCLPLYKETASEKKRKSR

SEQ ID NO: 907020 - protein, 424 aa, Homo sapiens
LGMGRGLWEAWPPAGSSAVAKGNCREEAEGAEDRQPASRRGAGTTAAMAASGPGCRSWCLCPEVPSATFFTALLSLLVSGPRLFLLQQPLAPSGLTLKSEALRNWQVYRLVTYIFVYENPISLLCGAIIIWRFAGNFERTVGTVRHCFFTVIFAIFSAIIFLSFEAVSSLSKLGEVEDARGFTPVAFAMLGVTTVRSRMRRALVFGMVVPSVLVPWLLLGASWLIPQTSFLSNVCGLSIGLAYGLTYCYSIDLSERVALKLDQTFPFSLMRRISVFKYVSGSSAERRAAQSRKLNPVPGSYPTQSCHPHLSPSHPVSQTQHASGQKLASWPSCTPGHMPTLPPYQPCLRPVLCAEPLWSKPHLLQCLPSFCGHLPGHPAPHACEQPWHGVFWGLGHTRGCRLQGVLQGPHALREFLGKSSHLAF

SEQ ID NO: 907021 - protein, 110 aa, Homo sapiens
LGMGRGLWEAWPPAGSSAVAKGNCREEAEGAEDRQPASRRGAGTTAAMAASGPGCRSWCLCPEVPSATFFTALLSLLVSGPRLFLCRLQGVLQGPHALREFLGKSSHLAF

SEQ ID NO: 907022 - protein, 182 aa, Homo sapiens
PCGVRCTGPAYRCRKRDVLPSDKVTWLFSNTDKAPRQGTRGRRGQQLAVAADVCPQLHHSSLWLCRARGFSVRVSSVRHCFFTVIFAIFSAIIFLSFEAVSSLSKLGEVEDARGFTPVAFAMLGVTTVRSRMRRALVFGMVVPSVLVPWLLLGASWLIPQTSFLSNVCGLSIGLACILPSRE

SEQ ID NO: 907023 - protein, 236 aa, Homo sapiens
MLGVTTVRSRMRRALVFGMVVPSVLVPWLLLGASWLIPQTSFLSNVCGLSIGLAYGLTYCYSIDLSERVALKLDQTFPFSLMRRISVFKYVSGSSAERRAAQSRKLNPVPGSYPTQSCHPHLSPSHPVSQTQHASGQKLASWPSCTPGHMPTLPPYQPCLRPVLCAEPLWSKPHLLQCLPSFCGHLPGHPAPHACEQPWHGVFWGLGHTRGCRLQGVLQGPHALREFLGKSSHLAF

SEQ ID NO: 907024 - protein, 339 aa, Homo sapiens
LGMGRGLWEAWPPAGSSAVAKGNCREEAEGAEDRQPASRRGAGTTAAMAASGPGCRSWCLCPEVPSATFFTALLSLLVSGPRLFLLQQPLAPSGLTLKSEALRNWQVYRLVTYIFVYENPISLLCGAIIIWRFAGNFERTVGTVRHCFFTVIFAIFSAIIFLSFEAVSSLSKLGEVEDARGFTPVAFAMLGVTTVRSRMRRALVFGMVVPSVLVPWLLLGASWLIPQTSFLSNVCGLSIGLAYGLTYCYSIDLSERVALKLDQTFPFSLMRRISVFKYVSGSSAERRAAQSRKLNPVPGSYPTQSCHPHLSPSASSKLLVKAHQDAQRHVAAGTHSGYR

SEQ ID NO: 907025 - protein, 289 aa, Homo sapiens
LGMGRGLWEAWPPAGSSAVAKGNCREEAEGAEDRQPASRRGAGTTAAMAASGPGCRSWCLCPEVPSATFFTALLSLLVSGPRLFLLQQPLAPSGLTLKSEALRNWQVYRLVTYIFVYENPISLLCGAIIIWRFAGNFERTVGTVRHCFFTVIFAIFSAIIFLSFEAVSSLSKLGEVEDARGFTPVAFAMLGVTTVRSRMRRALVFGMVVPSVLVPWLLLGASWLIPQTSFLSNVCGLSIGLAYGLTYCYSIDLSPAAGAPTPIPLPRSGGMGPHELQQHAEVSMLSAFV

SEQ ID NO: 907026 - protein, 424 aa, Homo sapiens; identical to SEQ ID NO: 907020

SEQ ID NO: 907027 - protein, 348 aa, Homo sapiens
LGMGRGLWEAWPPAGSSAVAKGNCREEAEGAEDRQPASRRGAGTTAAMAASGPGCRSWCLCPEVPSATFFTALLSLLVSGPRLFLLQQPLAPSGLTLKSEALRNWQVYRLVTYIFVYENPISLLCGAIIIWRFAGNFERTVGTVRHCFFTVIFAIFSAIIFLSFEAVSSLSKLGEVEDARGFTPVAFAMLGVTTVRSRMRRALVFGMVVPSVLVPWLLLGASWLIPQTSFLSNVCGLSIGLAYGLTYCYSIDLSERVALKLDQTFPFSLMRRISVFKYVSGSSAERRAAQSRKMNPVAGSYTKKRLQLTGSKAPVSRATAWSKAGPGLLEPGDGPCPANMHSWYRDTI

SEQ ID NO: 907028 - protein, 424 aa, Homo sapiens; identical to SEQ ID NO: 907020

SEQ ID NO: 907029 - protein, 155 aa, Homo sapiens
MRRISVFKYVSGSSAERRAAQSRKLNPVPGSYPTQSCHPHLSPSHPVSQTQHASGQKLASWPSCTPGHMPTLPPYQPCLRPVLCAEPLWSKPHLLQCLPSFCGHLPGHPAPHACEQPWHGVFWGLGHTRGCRLQGVLQGPHALREFLGKSSHLAF

SEQ ID NO: 907030 - protein, 293 aa, Homo sapiens
LGMGRGLWEAWPPAGSSAVAKGNCREEAEGAEDRQPASRRGAGTTAAMAASGPGCRSWCLCPEVPSATFFTALLSLLVSGPRLFLLQQPLAPSGLTLKSEALRNWQVYRLVTYIFVYENPISLLCGAIIIWRFAGNFERTVGTVRHCFFTVIFAIFSAIIFLSFEAVSSLSKLGEVEDARGFTPVAFAMLGVTTVRSRMRRALVFGMVVPSVLVPWLLLGASWLIPQTSFLSNVCGLSIGLAYGLTYCYSIDLSERVALKLDQTFPFSLMRRISVFKYVSGSSAERRAAQSRK

SEQ ID NO: 907031 - protein, 271 aa, Homo sapiens
MAGLEVLFASAAPAITCRQDALVCFLHWEVVTHGYCGLGVGDQPGPNDKKSELLPAGWNNNKDLYVLRYEYKDGSRKLLVKAITVESSMILNVLEYGSQQVADLTLNLDDYIDAEHLGDFHRTYKNSEELRSRIVSGIITPIHEQWEKANVSSPHREFPPATAREVDPLRIPPHHPHTSRQPPWCDPLGPFVVGGEDLDPFGPRRGGMIVDPLRSGFPRALIDPSSGLPNRLPPGAVPPGARFDPFGPIGTSPPGPNPDHLPPPGYDDMYL

SEQ ID NO: 907032 - protein, 271 aa, Homo sapiens; identical to SEQ ID NO: 907031

SEQ ID NO: 907033 - protein, 271 aa, Homo sapiens; identical to SEQ ID NO: 907031

SEQ ID NO: 907034 - protein, 271 aa, Homo sapiens; identical to SEQ ID NO: 907031

SEQ ID NO: 907035 - protein, 271 aa, Homo sapiens; identical to SEQ ID NO: 907031

SEQ ID NO: 907036 - protein, 271 aa, Homo sapiens; identical to SEQ ID NO: 907031

SEQ ID NO: 907037 - protein, 183 aa, Homo sapiens
MILNVLEYGSQQVADLTLNLDDYIDAEHLGDFHRTYKNSEELRSRIVSGIITPIHEQWEKANVSSPHREFPPATAREVDPLRIPPHHPHTSRQPPWCDPLGPFVVGGEDLDPFGPRRGGMIVDPLRSGFPRALIDPSSGLPNRLPPGAVPPGARFDPFGPIGTSPPGPNPDHLPPPGYDDMYL

SEQ ID NO: 907038 - protein, 152 aa, Homo sapiens
MCWTYKNSEELRSRIVSGIITPIHEQWEKANVSSPHREFPPATAREVDPLRIPPHHPHTSRQPPWCDPLGPFVVGGEDLDPFGPRRGGMIVDPLRSGFPRALIDPSSGLPNRLPPGAVPPGARFDPFGPIGTSPPGPNPDHLPPPGYDDMYL

SEQ ID NO: 907039 - protein, 195 aa, Homo sapiens
AWVVNRPRVESSMILNVLEYGSQQVADLTLNLDDYIDAEHLGDFHRTYKNSEELRSRIVSGIITPIHEQWEKANVSSPHREFPPATAREVDPLRIPPHHPHTSRQPPWCDPLGPFVVGGEDLDPFGPRRGGMIVDPLRSGFPRALIDPSSGLPNRLPPGAVPPGARFDPFGPIGTSPPGPNPDHLPPPGYDDMYL

SEQ ID NO: 907040 - protein, 222 aa, Homo sapiens
MPKKLGPKSQRQRGAVAPLTQVQQAACSPTYKQAKRNARSYQGRRRRRRCSQNTTSRVPSQLQAVDSSSASCRTYKNSEELRSRIVSGIITPIHEQWEKANVSSPHREFPPATAREVDPLRIPPHHPHTSRQPPWCDPLGPFVVGGEDLDPFGPRRGGMIVDPLRSGFPRALIDPSSGLPNRLPPGAVPPGARFDPFGPIGTSPPGPNPDHLPPPGYDDMYL

SEQ ID NO: 907041 - protein, 245 aa, Homo sapiens
MAGLEVLFASAAPAITCRQDALVCFLHWEVVTHGYCGLGVGDQPGPNDKKSELLPAGWNNNKDLYVLRYEYKDGSRKLLVKAITVESSMILNVLEYGSQQVADLTLNLDDYIDAEHLGDFHRTYKNSEELRSRIVSGIITPIHEQWEVDPLRIPPHHPHTSRQPPWCDPLGPFVVGGEDLDPFGPRRGGMIVDPLRSGFPRALIDPSSGLPNRLPPGAVPPGARFDPFGPIGTSPPGPRPDRRGQ

SEQ ID NO: 907042 - protein, 172 aa, Homo sapiens
MAGLEVLFASAAPAITCRQDALVCFLHWEVVTHGYCGLGVGDQPGPNDKKSELLPAGWNNNKDLYVLRYEYKDGSRKLLVKAITVESSMILNVLEYGSQQVADLTLNLDDYIDAEHLGDFHRTYKNSEELRSRIVSGIITPIHEQWEKANVSSPHREFPPATAREVDPLRIP

SEQ ID NO: 907043 - protein, 204 aa, Homo sapiens
MAGLEVLFASAAPAITCRQDALVCFLHWEVVTHGYCGLGVGDQPGPNDKKSELLPAGWNNNKDLYVLRYEYKDGSRKLLVKAITVESSMILNVLEYGSQQVADLTLNLDDYIDAEHLGDFHRTYKNSEELRSRIVSGIISNHVLAPFDLPQRMVTHQHFIHFWLTGKCLQEGTQSPRPLELFSAGALSLTAFGQGGMNKGYRLQ

SEQ ID NO: 907044 - protein, 99 aa, Homo sapiens
RGFPAPPRPRASPFWSQVWTRQEPAQEGSGVIATPAAEPAHCTTPAPFFPPDAEVAGAHGGPGGTVRIGSAGHHLQAGRARLLLALGSGDTRLLRLGCR

SEQ ID NO: 907045 - protein, 271 aa, Homo sapiens; identical to SEQ ID NO: 907031

SEQ ID NO: 907046 - protein, 271 aa, Homo sapiens; identical to SEQ ID NO: 907031

SEQ ID NO: 907047 - protein, 263 aa, Homo sapiens [sequence omitted]

SEQ ID NO: 907048 - protein, 271 aa, Homo sapiens; identical to SEQ ID NO: 907031

SEQ ID NO: 907049 - protein, 233 aa, Homo sapiens
MAGLEPGPNDKKSELLPAGWNNNKDLYVLRYEYKDGSRKLLVKAITVESSMILNVLEYGSQQVADLTLNLDDYIDAEHLGDFHRTYKNSEELRSRIVSGIITPIHEQWEKANVSSPHREFPPATAREVDPLRIPPHHPHTSRQPPWCDPLGPFVVGGEDLDPFGPRRGGMIVDPLRSGFPRALIDPSSGLPNRLPPGAVPPGARFDPFGPIGTSPPGPNPDHLPPPGYDDMYL

SEQ ID NO: 907050 - protein, 288 aa, Homo sapiens
MAGLEVLFASAAPAITCRQDALVCFLHWEVVTHGYCGLGVGDQPGPNDKKSELLPAGWNNNKDLYVLRYEYKDGSRKLLVKAITVESSMILNVLEYGSQQVADLTLNLDDYIDAEHLGDFHRTYKNSEELRSRIVSGIITPIHEQWEKANVSSPHREFPPATAREVDPLRIPPHHPHTSRQPPWCDPLGPFVVGGEDLDPFGPRRGGMIVDPLRSGFPRALIDPSSGLPNRLPPGAVPPGARFDPFGPIGTSPPGPNPDHLPPPGYDDMYLMTLASSRRRRAVPRRRR

SEQ ID NO: 907051 - protein, 253 aa, Homo sapiens
MAGLEVLFASAAPAITCRQDALVCFLHWEVVTHGYCGLGVGDQPGPNDKKSELLPAGWNNNKDLYVLRYEYKDGSRKLLVKAITVESSMILNVLEYGSQQVADLTLNLDDYIDAEHLGDFHRTYKNSEELRSRIVSGIITPIHEQWEVDPLRIPPHHPHTSRQPPWCDPLGPFVVGGEDLDPFGPRRGGMIVDPLRSGFPRALIDPSSGLPNRLPPGAVPPGARFDPFGPIGTSPPGPNPDHLPPPGYDDMYL

SEQ ID NO: 907052 - protein, 121 aa, Homo sapiens
MSTPHREFPPATAREVDPLRIPPHHPHTSRQPPWCDPLGPFVVGGEDLDPFGPRRGGMIVDPLRSGFPRALIDPSSGLPNRLPPGAVPPGARFDPFGPIGTSPPGPNPDHLPPPGYDDMYL

SEQ ID NO: 907053 - protein, 69 aa, Homo sapiens
TLYFHRYRPRRGGMIVDPLRSGFPRALIDPSSGLPNRLPPGAVPPGARFDPFGPIGTSPPGPRPDRRGQ

SEQ ID NO: 907054 - protein, 131 aa, Homo sapiens
MAGLEVLFASAAPAITCRQDALVCFLHWEVVTHGYCGLGVGDQPGPNDKKSELLPAGWNNNKDLYVLRYEYKDGSRKLLVKAITVESSMILNVLVEYRVGGFTRADTMISAIAQASLPTGASAHSAGLRVT

SEQ ID NO: 907055 - protein, 419 aa, Homo sapiens
GRVGRPTRRHASRLRHPQPHLPEGARAAASSVCGSEPELCLWLRLLTGCAQGAVTMPHSYPALSAEQKKELSDIALRIVAPGKGILAADESVGSMAKRLSQIGVENTEENRRLYRQVLFSADDRVKKCIGGVIFFHETLYQKDDNGVPFVRTIQDKGIVVGIKVDKGVVPLAGTDGETTTQGLDGLSERCAQYKKDGADFAKWRCVLKISERTPSALAILENANVLARYASICQQNGIVPIVEPEILPDGDHDLKRCQYVTEKVLAAVYKALSDHHVYLEGTLLKPNMVTPGHACPIKYTPEEIAMATVTALRRTVPPAVPGVTFLSGGQSEEEASFNLNAINRCPLPRPWALTFSYGRALQASALNAWRGQRDNAGAATEEFIKRAEVNGLAAQGKYEGSGEDGGAAAQSLYIANHAY

SEQ ID NO: 907056 - protein, 419 aa, Homo sapiens; identical to SEQ ID NO: 907055

SEQ ID NO: 907057 - protein, 364 aa, Homo sapiens
MPHSYPALSAEQKKELSDIALRIVAPGKGILAADESVGSMAKRLSQIGVENTEENRRLYRQVLFSADDRVKKCIGGVIFFHETLYQKDDNGVPFVRTIQDKGIVVGIKVDKGVVPLAGTDGETTTQGLDGLSERCAQYKKDGADFAKWRCVLKISERTPSALAILENANVLARYASICQQNGIVPIVEPEILPDGDHDLKRCQYVTEKVLAAVYKALSDHHVYLEGTLLKPNMVTPGHACPIKYTPEEIAMATVTALRRTVPPAVPGVTFLSGGQSEEEASFNLNAINRCPLPRPWALTFSYGRALQASALNAWRGQRDNAGAATEEFIKRAEVNGLAAQGKYEGSGEDGGAAAQSLYIANHAY

SEQ ID NO: 907058 - protein, 396 aa, Homo sapiens
MGRPTRRPRVADAWSTHASARAAASSVCGSEPELCLWLRLLTGCAQGAVTMPHSYPALSAEQKKELSDIALRIVAPGKGILAADESVGSMAKRLSQIGVENTEENRRLYRQVLFSADDRVKKCIGGVIFFHETLYQKDDNGVPFVRTIQDKGIVVGIKVDKGVVPLAGTDGETTTQGLDGLSERCAQYKKDGADFAKWRCVVLARYASICQQNGIVPIVEPEILPDGDHDLKRCQYVTEKVLAAVYKALSDHHVYLEGTLLKPNMVTPGHACPIKYTPEEIAMATVTALRRTVPPAVPGVTFLSGGQSEEEASFNLNAINRCPLPRPWALTFSYGRALQASALNAWRGQRDNAGAATEEFIKRAEVNGLAAQGKYEGSGEDGGAAAQSLYIANHAY

SEQ ID NO: 907059 - protein, 299 aa, Homo sapiens
GRVGRPTRRHASRLRHPQPHLPEGARAAASSVCGSEPELCLWLRLLTGCAQGAVTMPHSYPALSAEQKKELSDIALRIVAPGKGILAADESVGSMAKRLSQIGVENTEENRRLYRQVLFSADDRVKKCIGGVIFFHETLYQKDDNGVPFVRTIQDKGIVVGIKVDKGVVPLAGTDGETTTQGLDGLSERCAQYKKDGADFAKWRCVLKISERTPSALAILENANVLARYASICQQNGIVPIVEPEILPDGDHDLKRCQYVTEKVLAAVYKALSDHHVYAPGTIGWEDREPLMTEGRRNC

SEQ ID NO: 907060 - protein, 167 aa, Homo sapiens
SKGSNLVVNLKHNGEIGQAIKGMDIRKARKYLKDVILQKQCVPFRYNGGVGRCAQAKQWGWTQGWWPKKSAEFLLHMLKNAESNAELKGLDVDSLVIEHIQVNKAPKMRRRTYRAHGRINPYMSSPCHIEMILTEKEQIVPKPEEEVAQKKKISQKKLKKQKLMARE

SEQ ID NO: 907061 - protein, 419 aa, Homo sapiens; identical to SEQ ID NO: 907055

SEQ ID NO: 907062 - protein, 414 aa, Homo sapiens
MGRPTRRPRVADAWSTHASARAAASSVCGSEPELCLWLRLLTGCAQGAVTMPHSYPALSAEQKKELSDIALRIVAPGKGILAADESVGSMAKRLSQIGVENTEENRRLYRQVLFSADDRVKKCIGGVIFFHETLYQKDDNGVPFVRTIQDKGIVVGIKVDKGVVPLAGTDGETTTQGLDGLSERCAQYKKDGADFAKWRCVLKISERTPSALAILENANVLARYASICQQNGIVPIVEPEILPDGDHDLKRCQYVTEKVLAAVYKALSDHHVYLEGTLLKPNMVTPGHACPIKYTPEEIAMATVTALRRTVPPAVPGVTFLSGGQSEEEASFNLNAINRCPLPRPWALTFSYGRALQASALNAWRGQRDNAGAATEEFIKRAEVNGLAAQGKYEGSGEDGGAAAQSLYIANHAY

SEQ ID NO: 907063 - protein, 364 aa, Homo sapiens; identical to SEQ ID NO: 907057

SEQ ID NO: 907064 - protein, 197 aa, Homo sapiens
MEMMVRYVSIWQQNGIVPIVEPEILPDGDHDLKRCQYVTEKVLAAVYKALSDHHVYLEGTLLKPNMVTPGHACPIKYTPEEIAMATVTALRRTVPPAVPGVTFLSGGQSEEEASFNLNAINRCPLPRPWALTFSYGRALQASALNAWRGQRDNAGAATEEFIKRAEVNGLAAQGKYEGSGEDGGAAAQSLYIANHAY

SEQ ID NO: 907065 - protein, 82 aa, Homo sapiens
GRVGRPTRRPRVADAWSTHASARAAASSVCGSEPELCLWLRLLTGCAQCLPFSLPFPSLIAAPGTIGWEDREPLMTEGRRNC

SEQ ID NO: 907066 - protein, 391 aa, Homo sapiens
MDSLGAVSTRLGFDLFKELKKTNDGNIFFSPVGILTAIGMVLLGTRGATASQLEEVFHSEKETKSSRIKAEEKEVIENTEAVHQQFQKFLTEISKLTNDYELNITNRLFGEKTYLFLQKYLDYVEKYYHASLEPVDFVNAADESRKKINSWVESKTNEKIKDLFPDGSISSSTKLVLVNMVYFKGQWDREFKKENTKEEKFWMNKSTSKSVQMMTQSHSFSFTFLEDLQAKILGIPYKNNDLSMFVLLPNDIDGLEKIIDKISPEKLVEWTSPGHMEERKVNLHLPRFEVEDGYDLEAVLAAMGMGDAFSEHKADYSGMSSGSGLYAQKFLHSSFVAVTEEGTEAAAATGIGFTVTSAPGHENVHCNHPFLFFIRHNESNSILFFGRFSSP

SEQ ID NO: 907067 - protein, 107 aa, Homo sapiens
MDSLGAVSTRLGFDLFKELKKTNDGNIFFSPVGILTAIGMVLLGTRGATASQLEEVFHSEKETKSSRIKAEEKEVVRIKAEGKEVGRCVLQTSVELHFRCGVSGEKD

SEQ ID NO: 907068 - protein, 279 aa, Homo sapiens
MDSLGAVSTRLGFDLFKELKKTNDGNIFFSPVGILTAIGMVLLGTRGATASQLEEVFHSEKETKSSRIKAEEKEVIENTEAVHQQFQKFLTEISKLTNDYELNITNRLFGEKTYLFLQKYLDYVEKYYHASLEPVDFVNAADESRKKINSWVESKTNEKIKDLFPDGSISSSTKLVLVNMVYFKGQWDREFKKENTKEEKFWMNKSTSKSVQMMTQSHSFSFTFLEDLQAKILGIPYKNNDLSMFVLLPNDIDGLEKVNAYTSLFFLSFPKAFCLRASE

SEQ ID NO: 907069 - protein, 391 aa, Homo sapiens; identical to SEQ ID NO: 907066

SEQ ID NO: 907070 - protein, 463 aa, Homo sapiens
MDSLGAVSTRLGFDLFKELKKTNDGNIFFSPVGILTAIGMVLLGTRGATASQLEEVFHSEKETKSSRIKAEEKEVIENTEAVHQQFQKFLTEISKLTNDYELNITNRLFGEKTYLFLQKYLDYVEKYYHASLEPVDFVNAADESRKKINSWVESKTNDVETEATESLNNLPKIPQLIRGKLDANRGILTPESGLLTMNLNLSTGINEAMGKMRTSPSILPANPLSARPSEKIKDLFPDGSISSSTKLVLVNMVYFKGQWDREFKKENTKEEKFWMNKSTSKSVQMMTQSHSFSFTFLEDLQAKILGIPYKNNDLSMFVLLPNDIDGLEKIIDKISPEKLVEWTSPGHMEERKVNLHLPRFEVEDGYDLEAVLAAMGMGDAFSEHKADYSGMSSGSGLYAQKFLHSSFVAVTEEGTEAAAATGIGFTVTSAPGHENVHCNHPFLFFIRHNESNSILFFGRFSSP

SEQ ID NO: 907071 - protein, 87 aa, Homo sapiens [sequence omitted]

SEQ ID NO: 907072 - protein, 289 aa, Homo sapiens
VRWHSRNLGSSDVPGGKMSSLPRRAKVQVQDVVLKDEFSSFSELSSASEEDDKEDSAWEPQKKVPRSRKQPPPKESKPKRMPRVKKNAPQISDGSEVVVVKEELNSSVAIADTALEDRKNKLDTVQTLKTAKTKQKCAAQPHTVRRTKKLKVEEETSKASNLEGESNSSETPSTSTVWGGTCKKEENDDDFTFGQSALKKIKTETYPQGQPVKFPANANSTKEEVEMNWDMVQVLSERTNIEPWVCANIIRLFNDDNTIPFIIRYRKELINNLDADSLREVQQTLEELR

SEQ ID NO: 907073 - protein, 1151 aa, Homo sapiens
MLRRVTVAAVCATRRKLCEAGRDVAALWGIETRGRCEDSAAARPFPILAMPGRNKAKSTCSCPDLQPNGQDLGENSRVARLGADESEEEGRRGSLSNAGDPEIVKSPSDPKQYRYIKLQNGLQALLISDLSNMEGKTGNTTDDEEEEEVEEEEEDDDEDSGAEIEDDDEEGFDDEDEFDDEHDDDLDTEDNELEELEERAEARKKTTEKQSAAALCVGVGSFADPDDLPGLAHFLEHMVFMGSLKYPDENGFDAFLKKHGGSDNASTDCERTVFQFDVQRKYFKEALDRWAQFFIHPLMIRDAIDREVEAVDSEYQLARPSDANRKEMLFGSLARPGHPMGKFFWGNAETLKHEPRKNNIDTHARLREFWMRYYSSHYMTLVVQSKETLDTLEKWVTEIFSQIPNNGLPRPNFGHLTDPFDTPAFNKLYRVVPIRKIHALTITWALPPQQQHYRVKPLHYISWLVGHEGKGSILSFLRKKCWALALFGGNGETGFEQNSTYSVFSISITLTDEGYEHFYEVAYTVFLYLKMLQKLGPEKRIFEEIRKIEDNEFHYQEQTDPVEYVENMCENMQLYPLQDILTGDQLLFEYKPEVIGEALNQLVPQKANLVLLSGANEGKCDLKEKWFGTQYSIEDIENSWAELWNSNFELNPDLHLPAENKYIATDFTLKAFDCPETEYPVKIVNTPQGCLWYKKDNKFKIPKAYIRFHLISPLIQKSAANVVLFDIFVNILTHNLAEPAYEADVAQLEYKLAAGEHGLIIRVKGFNHKLPLLFQLIIDYLAEFNSTPAVFTMITEQLKKTYFNILIKPETLAKDVRLLILEYARWSMIDKYQALMDGLSLESLLSFVKEFKSQLFVEGLVQGNVTSTESMDFLKYVVDKLNFKPLEQEMPVQFQVVELPSGHHLCKVKALNKGDANSEVTVYYQSGTRSLREYTLMELLVMHMEEPCFDFLRTKQTLGYHVYPTCRNTSGILGFSVTVGTQATKYNSEVVDKKIEEFLSSFEEKIENLTEEAFNTQVTALIKLKECEDTHLGEEVDRNWNEVVTQQYLFDRLAHEIEALKSFSKSDLVNWFKAHRGPGSKMLSVHVVGYGKYELEEDGSPSSEDSNSSCEVMQLTYLPTSPLLADCIIPITDIRAFTTTLNLLPYHKIVK

SEQ ID NO: 907074 - protein, 206 aa, Homo sapiens
MEILFDFIDQEDLGYHVYPTCRNTSGILGFSVTVGTQATKYNSEVVDKKIEEFLSSFEEKIENLTEEAFNTQVTALIKLKECEDTHLGEEVDRNWNEVVTQQYLFDRLAHEIEALKSFSKSDLVNWFKAHRGPGSKMLSVHVVGYGKYELEEDGTPSSEDSNSSCEVMQLTYLPTSPLLADCIIPITDIRAFTTTLNLLPYHKIVK

SEQ ID NO: 907075 - protein, 130 aa, Homo sapiens
MLRRVTVAAVCATRRKLCEAGRELAALWGIETRGRCEDSAAARPFPILAMPGRNKAKSTCSCPDLQPNGQDLGENSRVARLGADESEEEGRRGSLSNAGDPEIVKSPSDPKQYREMISLCHPGCTAVVPS

SEQ ID NO: 907076 - protein, 540 aa, Homo sapiens
MLRRVTVAAVCATRRKLCEAGRELAALWGIETRGRCEDSAAARPFPILAMPGRNKAKSTCSCPDLQPNGQDLGENSRVARLGADESEEEGRRGSLSNAGDPEIVKSPSDPKQYRYIKLQNGLQALLISDLSNMEGKTGNTTDDEEEEEVEEEEEDDDEDSGAEIEDDDEEGFDDEDEFDDEHDDDLDTEDNELEELEERAEARKKTTEKQSAAALCVGVGSFADPDDLPGLAHFLEHMVFMGSLKYPDENGFDAFLKKHGGSDNASTDCERTVFQFDVQRKYFKEALDRWAQFFIHPLMIRDAIDREVEAVDSEYQLARPSDANRKEMLFGSLARPGHPMGKFFWGNAETLKHEPRKNNIDTHARLREFWMRYYSSHYMTLVVQSKETLDTLEKWVTEIFSQIPNNGLPRPNFGHLTDPFDTPAFNKLYRVVPIRKIHALTITWALPPQQQHYRVKPLHYISWLVGHEGKGSILSFLRKKCWALALFGGNGETGFEQNSTYSVFSISITLTDEGYEHFYEVAYTVFQYLKMLQKLGPEKR

SEQ ID NO: 907077 - protein, 786 aa, Homo sapiens
MLRRVTVAAVCATRRKLCEAGRELAALWGIETRGRCEDSAAARPFPILAMPGRNKAKSTCSCPDLQPNGQDLGENSRVARLGADESEEEGRRGSLSNAGDPEIVKSPSDPKQYRYIKLQNGLQALLISDLSNMEGKTGNTTDDEEEEEVEEEEEDDDEDSGAEIEDDDEEGFDDEDEFDDEHDDDLDTEDNELEELEERAEARKKTTEKQSAAALCVGVGSFADPDDLPGLAHFLEHMVFMGSLKYPDENGFDAFLKKHGGSDNASTDCERTVFQFDVQRKYFKEALDRWAQFFIHPLMIRDAIDREVEAVDSEYQLARPSDANRKEMLFGSLARPGHPMGKFFWGNAETLKHEPRKNNIDTHARLREFWMRYYSSHYMTLVVQSKETLDTLEKWVTEIFSQIPNNGLPRPNFGHLTDPFDTPAFNKLYRVVPIRKIHALTITWALPPQQQHYRVKPLHYISWLVGHEGKGSILSFLRKKCWALALFGGNGETGFEQNSTYSVFSISITLTDEGYEHFYEVAYTVFQYLKMLQKLGPEKRIFEEIRKIEDNEFHYQEQTDPVEYVENMCENMQLYPLQDILTGDQLLFEYKPEVIGEALNQLVPQKANLVLLSGANEGKCDLKEKWFGTQYSIEDIENSWAELWNSNFELNPDLHLPAENKYIATDFTLKAFDCPETEYPVKIVNTPQGCLWYKKDNKFKIPKAYIRFHLISPLIQKSAANVVLFDIFVNILTHNLAEPAYEADVAQLEYKLVAGEHGLIIRVKGFNHKLPRCTAFNLGICPLVYD

SEQ ID NO: 907078 - protein, 969 aa, Homo sapiens
MLRRVTVAAVCATRRKLCEAGRELAALWGIETRGRCEDSAAARPFPILAMPGRNKAKSTCSCPDLQPNGQDLGENSRVARLGADESEEEGRRGSLSNAGDPEIVKSPSDPKQYRYIKLQNGLQALLISDLSNMEGKTGNTTDDEEEEEVEEEEEDDDEDSGAEIEDDDEEGFDDEDEFDDEHDDDLDTEDNELEELEERAEARKKTTEKQSAAALCVGVGSFADPDDLPGLAHFLEHMVFMGSLKYPDENGFDAFLKKHGGSDNASTDCERTVFQFDVQRKYFKEALDRWAQFFIHPLMIRDAIDREVEAVDSEYQLARPSDANRKEMLFGSLARPGHPMGKFFWGNAETLKHEPRKNNIDTHARLREFWMRYYSSHYMTLVVQSKETLDTLEKWVTEIFSQIPNNGLPRPNFGHLTDPFDTPAFNKLYRVVPIRKIHALTITWALPPQQQHYRVKPLHYISWLVGHEGKGSILSFLRKKCWALALFGGNGETGFEQNSTYSVFSISITLTDEGYEHFYEVAYTVFQYLKMLQKLGPEKRIFEEIRKIEDNEFHYQEQTDPVEYVENMCENMQLYPLQDILTGDQLLFEYKPEVIGEALNQLVPQKANLVLLSGANEGKCDLKEKWFGTQYSIEDIENSWAELWNSNFELNPDLHLPAENKYIATDFTLKAFDCPETEYPVKIVNTPQGCLWYKKDNKFKIPKAYIRFHLISPLIQKSAANVVLFDIFVNILTHNLAEPAYEADVAQLEYKLVAGEHGLIIRVKGFNHKLPLLFQLIIDYLAEFNSTPAVFTMITEQLKKTYFNILIKPETLAKDVRLLILEYARWSMIDKYQALMDGLSLESLLSFVKEFKSQLFVEGLVQGNVTSTESMDFLKYVVDKLNFKPLEQEMPVQFQVVELPSGHHLCKVKALNKGDANSEVTVYYQSGTRSLREYTLMELLVAHGELVAYFEPADLGTMSTLPVGTHPGF

SEQ ID NO: 907079 - protein, 1180 aa, Homo sapiens
MLRRVTVAAVCATRRKLCEAGRELAALWGIETRGRCEDSAAARPFPILAMPGRNKAKSTCSCPDLQPNGQDLGENSRVARLGADESEEEGRRGSLSNAGDPEIVKSPSDPKQYRYIKLQNGLQALLISDLSNMEGKTGNTTDDEEEEEVEEEEEDDDEDSGAEIEDDDEEGFDDEDEFDDEHDDDLDTEDNELEELEERAEARKKTTEKQSAAALCVGVGSFADPDDLPGLAHFLEHMVFMGSLKYPDENGFDAFLKKHGGSDNASTDCERTVFQFDVQRKYFKEALDRWAQFFIHPLMIRDAIDREVEAVDSEYQLARPSDANRKEMLFGSLARPGHPMGKFFWGNAETLKHEPRKNNIDTHARLREFWMRYYSSHYMTLVVQSKETLDTLEKWVTEIFSQIPNNGLPRPNFGHLTDPFDTPAFNKLYRVVPIRKIHALTITWALPPQQQHYRVKPLHYISWLVGHEGKGSILSFLRKKCWALALFGGNGETGFEQNSTYSVFSISITLTDEGYEHFYEVAYTVFQYLKMLQKLGPEKRIFEEIRKIEDNEFHYQEQTDPVEYVENMCENMQLYPLQDILTGDQLLFEYKPEVIGEALNQLVPQKANLVLLSGANEGKCDLKEKWFGTQYSIEDIENSWAELWNSNFELNPDLHLPAENKYIATDFTLKAFDCPETEYPVKIVNTPQGCLWYKKDNKFKIPKAYIRFHLISPLIQKSAANVVLFDIFVNILTHNLAEPAYEADVAQLEYKLVAGEHGLIIRVKGFNHKLPLLFQLIIDYLAEFNSTPAVFTMITEQLKKTYFNILIKPETLAKDVRLLILEYARWSMIDKYQALMDGLSLESLLSFVKEFKSQLFVEGLVQGNVTSTESMDFLKYVVDKLNFKPLEQEMPVQFQVVELPSGHHLCKVKALNKGDANSEVTVYYQSGTRSLREYTLMELLVMHMEEPCFDFLRTKQTLGYHVYPTCRNTSGILGFSVTVGTQATKYNSEVVDKKIEEFLSSFEEKIENLTEEAFNTQVTALIKLKECEDTHLGEEVDRNWNEVVTQQYLFDRLAHEIEALKSFSKSDLVNWFKAHRGPGSKMLSVHVVGYGKYELEEDGTPSSEDSNSSCEVMQLTYLPTSPLLADCIIPTERASFPGTPLTAEGSLGCPSFPAGGSSCRCLGGRAGGGASSCTESTPQR

SEQ ID NO: 907080 - protein, 1084 aa, Homo sapiens
MLRRVTVAAVCATRRKLCEAGRELAALWGIETRGRCEDSAAARPFPILAMPGRNKAKSTCSCPDLQPNGQDLGENSRVARLGADESEEEGRRGSLSNAGDPEIVKSPSDPKQYRYIKLQNGLQALLISDLSNMEGKTGNTTDDEEEEEVEEEEEDDDEDSGAEIEDDDEEGFDDEDEFDDEHDDDLDTEDNELEELEERAEARKKTTEKQSAAALCVGVGSFADPDDLPGLAHFLEHMVFMGSLKYPDENGFDAFLKKHGGSDNASTDCERTVFQFDVQRKYFKEALDRWAQFFIHPLMIRDAIDREVEAVDSEYQLARPSDANRKEMLFGSLARPGHPMGKFFWGNAETLKHEPRKNNIDTHARLREFWMRYYSSHYMTLVVQSKETLDTLEKWVTEIFSQIPNNGLPRPNFGHLTDPFDTPAFNKLYRVVPIRKIHALTITWALPPQQQHYRVKPLHYISWLVGHEGKGSILSFLRKKCWALALFGGNGETGFEQNSTYSVFSISITLTDEGYEHFYEVAYTVFQYLKMLQKLGPEKRIFEEIRKIEDNEFHYQEQTDPVEYVENMCENMQLYPLQDILTGDQLLFEYKPEVIGEALNQLVPQKANLVLLSGANEGKCDLKEKWFGTQYSIEDIENSWAELWNSNFELNPDLHLPAENKYIATDFTLKAFDCPETEYPVKIVNTPQGCLWYKKDNKFKIPKAYIRFHLISPLIQKSAANVVLFDIFVNILTHNLAEPAYEADVAQLEYKLVAGEHGLIIRVKGFNHKLPLLFQLIIDYLAEFNSTPAVFTMITEQLKKTYFNILIKPETLAKDVRLLILEYARWSMIDKYQALMDGLSLESLLSFVKEFKSQLFVEGLVQGNVTSTESMDFLKYVVDKLNFKPLEQEMPVQFQVVELPSGHHLCKVKALNKGDANSEVTVYYQSGTRSLREYTLMELLVMHMEEPCFDFLRTKQTLGYHVYPTCRNTSGILGFSVTVGTQATKYNSEVVDKKIEEFLSSFEEKIENLTEEAFNTQVTALIKLKECEDTHLGEEVDRNWNEVVTQQYLFDRLAHEIEALKSFSKSDLVNWFKAHRGPGRWYPF

SEQ ID NO: 907081 - protein, 1091 aa, Homo sapiens
MLRRVTVAAVCATRRKLCEAGRELAALWGIETRGRCEDSAAARPFPILAMPGRNKAKSTCSCPDLQPNGQDLGENSRVARLGADESEEEGRRGSLSNAGDPEIVKSPSDPKQYRYIKLQNGLQALLISDLSNMEGKTGNTTDDEEEEEVEEEEEDDDEDSGAEIEDDDEEGFDDEDEFDDEHDDDLDTEDNELEELEERAEARKKTTEKQSAAALCVGVGSFADPDDLPGLAHFLEHMVFMGSLKYPDENGFDAFLKKHGGSDNASTDCERTVFQFDVQRKYFKEALDRWAQFFIHPLMIRDAIDREVEAVDSEYQLARPSDANRKEMLFGSLARPGHPMGKFFWGNAETLKHEPRKNNIDTHARLREFWMRYYSSHYMTLVVQSKETLDTLEKWVTEIFSQIPNNGLPRPNFGHLTDPFDTPAFNKLYRVVPIRKIHALTITWALPPQQQHYRVKPLHYISWLVGHEGKGSILSFLRKKCWALALFGGNGETGFEQNSTYSVFSISITLTDEGYEHFYEVAYTVFQYLKMLQKLGPEKRIFEEIRKIEDNEFHYQEQTDPVEYVENMCENMQLYPLQDILTGDQLLFEYKPEVIGEALNQLVPQKANLVLLSGANEGKCDLKEKWFGTQYSIEDIENSWAELWNSNFELNPDLHLPAENKYIATDFTLKAFDCPETEYPVKIVNTPQGCLWYKKDNKFKIPKAYIRFHLISPLIQKSAANVVLFDIFVNILTHNLAEPAYEADVAQLEYKLVAGEHGLIIRVKGFNHKLPLLFQLIIDYLAEFNSTPAVFTMITEQLKKTYFNILIKPETLAKDVRLLILEYARWSMIDKYQALMDGLSLESLLSFVKEFKSQLFVEGLVQGNVTSTESMDFLKYVVDKLNFKPLEQEMPVQFQVVELPSGHHLCKVKALNKGDANSEVTVYYQSGTRSLREYTLMELLVMHMEEPCFDFLRTKQTLGYHVYPTCRNTSGILGFSVTVGTQATKYNSEVVDKKIEEFLSSFEEKIENLTEEAFNTQVTALIKLKECEDTHLGEEVDRNWNEVVTQQYLFDRLAHEIEALKSFSKSDLVNWFKAHRGPGSKMLSVHVSMFN

SEQ ID NO: 907082 - protein, 878 aa, Homo sapiens
MLRRVTVAAVCATRRKLCEAGRELAALWGIETRGRCEDSAAARPFPILAMPGRNKAKSTCSCPDLQPNGQDLGENSRVARLGADESEEEGRRGSLSNAGDPEIVKSPSDPKQYRYIKLQNGLQALLISDLSNMEGKTGNTTDDEEEEEVEEEEEDDDEDSGAEIEDDDEEGFDDEDEFDDEHDDDLDTEDNELEELEERAEARKKTTEKQSAAALCVGVGSFADPDDLPGLAHFLEHMVFMGSLKYPDENGFDAFLKKHGGSDNASTDCERTVFQFDVQRKYFKEALDRWAQFFIHPLMIRDAIDREVEAVDSEYQLARPSDANRKEMLFGSLARPGHPMGKFFWGNAETLKHEPRKNNIDTHARLREFWMRYYSSHYMTLVVQSKETLDTLEKWVTEIFSQIPNNGLPRPNFGHLTDPFDTPAFNKLYRVVPIRKIHALTITWALPPQQQHYRVKPLHYISWLVGHEGKGSILSFLRKKCWALALFGGNGETGFEQNSTYSVFSISITLTDEGYEHFYEVAYTVFQYLKMLQKLGPEKRIFEEIRKIEDNEFHYQEQTDPVEYVENMCENMQLYPLQDILTGDQLLFEYKPEVIGEALNQLVPQKANLVLLSGANEGKCDLKEKWFGTQYSIEDIENSWAELWNSNFELNPDLHLPAENKYIATDFTLKAFDCPETEYPVKIVNTPQGCLWYKKDNKFKIPKAYIRFHLISPLIQKSAANVVLFDIFVNILTHNLAEPAYEADVAQLEYKLVAGEHGLIIRVKGFNHKLPLLFQLIIDYLAEFNSTPAVFTMITEQLKKTYFNILIKPETLAKDVRLLILEYARWSMIDKYQALMDGLSLESLLSFVKEFKSQLFVEGLVQGNVTSTVSVRCSVGQV

SEQ ID NO: 907083 - protein, 484 aa, Homo sapiens
MLRRVTVAAVCATRRKLCEAGRELAALWGIETRGRCEDSAAARPFPILAMPGRNKAKSTCSCPDLQPNGQDLGENSRVARLGADESEEEGRRGSLSNAGDPEIVKSPSDPKQYRYIKLQNGLQALLISDLSNMEGKTGNTTDDEEEEEVEEEEEDDDEDSGAEIEDDDEEGFDDEDEFDDEHDDDLDTEDNELEELEERAEARKKTTEKQSAAALCVGVGSFADPDDLPGLAHFLEHMVFMGSLKYPDENGFDAFLKKHGGSDNASTDCERTVFQFDVQRKYFKEALDRWAQFFIHPLMIRDAIDREVEAVDSEYQLARPSDANRKEMLFGSLARPGHPMGKFFWGNAETLKHEPRKNNIDTHARLREFWMRYYSSHYMTLVVQSKETLDTLEKWVTEIFSQIPNNGLPRPNFGHLTDPFDTPAFNKLYRVVPIRKIHALTITWALPPQQQHYRVKPLHYISWLVGHEGKGSILSFLRKKQVFN

SEQ ID NO: 907084 - protein, 111 aa, Homo sapiens
SGFEQNSTYSVFSISIDIDDEEGFDDEDEFDDEHDDDLDTEDNELEELEERAEARKKTTEKQQLQSLFLLWSKLTDRLWFKSTYSKMSSTLLVETRNLYGVVGAESRLGTY

SEQ ID NO: 907085 - protein, 311 aa, Homo sapiens
MLRRVTVAAVCATRRKLCEAGRELAALWGIETRGRCEDSAAARPFPILAMPGRNKAKSTCSCPDLQPNGQDLGENSRVARLGADESEEEGRRGSLSNAGDPEIVKSPSDPKQYRYIKLQNGLQALLISDLSNMEGKTGNTTDDEEEEEVEEEEEDDDEDSGAEIEDDDEEGFDDEDEFDDEHDDDLDTEDNELEELEERAEARKKTTEKQQLQSLFLLWSKLTDRLWFKSTYSKMSSTLLVETRNLYGVVGAESRSAPVQHLAGWQAEEQQGETDTVCLQRLFVLELGVSLIQMTCRGWHTFWSTWYSWVV

SEQ ID NO: 907086 - protein, 140 aa, Homo sapiens
MLRRVTVAAVCATRRKLCEAGRELAALWGIETRGRCEDSAAARPFPILAMPGRNKAKSTCSCPDLQPNGQDLGENSRVARLGADESEEEGRRGSLSNAGDPEIVKSPSDPKQYRVSICHPCWSAMAQSWLTATSSSLAQV

SEQ ID NO: 907087 - protein, 105 aa, Homo sapiens
SDEGSMNAFTGRGSPGRGQKTKVCTTPSSGHAASGKDSSSRLAVTDPTRPGATTKITTTSTYISASTLKVNKKTKGLIDGLTKFFTPSPDGRRSRGEIIDFYRSS

SEQ ID NO: 907088 - protein, 1151 aa, Homo sapiens
MLRRVTVAAVCATRRKLCEAGRELAALWGIETRGRCEDSAAARPFPILAMPGRNKAKSTCSCPDLQPNGQDLGENSRVARLGADESEEEGRRGSLSNAGDPEIVKSPSDPKQYRYIKLQNGLQALLISDLSNMEGKTGNTTDDEEEEEVEEEEEDDDEDSGAEIEDDDEEGFDDEDEFDDEHDDDLDTEDNELEELEERAEARKKTTEKQSAAALCVGVGSFADPDDLPGLAHFLEHMVFMGSLKYPDENGFDAFLKKHGGSDNASTDCERTVFQFDVQRKYFKEALDRWAQFFIHPLMIRDAIDREVEAVDSEYQLARPSDANRKEMLFGSLARPGHPMGKFFWGNAETLKHEPRKNNIDTHARLREFWMRYYSSHYMTLVVQSKETLDTLEKWVTEIFSQIPNNGLPRPNFGHLTDPFDTPAFNKLYRVVPIRKIHALTITWALPPQQQHYRVKPLHYISWLVGHEGKGSILSFLRKKCWALALFGGNGETGFEQNSTYSVFSISITLTDEGYEHFYEVAYTVFQYLKMLQKLGPEKRIFEEIRKIEDNEFHYQEQTDPVEYVENMCENMQLYPLQDILTGDQLLFEYKPEVIGEALNQLVPQKANLVLLSGANEGKCDLKEKWFGTQYSIEDIENSWAELWNSNFELNPDLHLPAENKYIATDFTLKAFDCPETEYPVKIVNTPQGCLWYKKDNKFKIPKAYIRFHLISPLIQKSAANVVLFDIFVNILTHNLAEPAYEADVAQLEYKLVAGEHGLIIRVKGFNHKLPLLFQLIIDYLAEFNSTPAVFTMITEQLKKTYFNILIKPETLAKDVRLLILEYARWSMIDKYQALMDGLSLESLLSFVKEFKSQLFVEGLVQGNVTSTESMDFLKYVVDKLNFKPLEQEMPVQFQVVELPSGHHLCKVKALNKGDANSEVTVYYQSGTRSLREYTLMELLVMHMEEPCFDFLRTKQTLGYHVYPTCRNTSGILGFSVTVGTQATKYNSEVVDKKIEEFLSSFEEKIENLTEEAFNTQVTALIKLKECEDTHLGEEVDRNWNEVVTQQYLFDRLAHEIEALKSFSKSDLVNWFKAHRGPGSKMLSVHVVGYGKYELEEDGTPSSEDSNSSCEVMQLTYLPTSPLLADCIIPITDIRAFTTTLNLLPYHKIVK

SEQ ID NO: 907089 - protein, 1091 aa, Homo sapiens; identical to SEQ ID NO: 907081

SEQ ID NO: 907090 - protein, 1032 aa, Homo sapiens
MLRRVTVAAVCATRRKLCEAGRELAALWGIETRGRCEDSAAARPFPILAMPGRNKAKSTCSCPDLQPNGQDLGENSRVARLGADESEEEGRRGSLSNAGDPEIVKSPSDPKQYRYIKLQNGLQALLISDLSNMEGKTGNTTDDEEEEEVEEEEEDDDEDSGAEIEDDDEEGFDDEDEFDDEHDDDLDTEDNELEELEERAEARKKTTEKQSAAALCVGVGSFADPDDLPGLAHFLEHMVFMGSLKYPDENGFDAFLKKHGGSDNASTDCERTVFQFDVQRKYFKEALDRWAQFFIHPLMIRDAIDREVEAVDSEYQLARPSDANRKEMLFGSLARPGHPMGKFFWGNAETLKHEPRKNNIDTHARLREFWMRYYSSHYMTLVVQSKETLDTLEKWVTEIFSQIPNNGLPRPNFGHLTDPFDTPAFNKLYRVVPIRKIHALTITWALPPQQQHYRVKPLHYISWLVGHEGKGSILSFLRKKCWALALFGGNGETGFEQNSTYSVFSISITLTDEGYEHFYEVAYTVFQYLKMLQKLGPEKRIFEEIRKIEDNEFHYQEQTDPVEYVENMCENMQLYPLQDILTGDQLLFEYKPEVIGEALNQLVPQKANLVLLSGANEGKCDLKEKWFGTQYSIEDIENSWAELWNSNFELNPDLHLPAENKYIATDFTLKAFDCPETEYPVKIVNTPQGCLWYKKDNKFKIPKAYIRFHLISPLIQKSAANVVLFDIFVNILTHNLAEPAYEADVAQLEYKLVAGEHGLIIRVKGFNHKLPLLFQLIIDYLAEFNSTPAVFTMITEQLKKTYFNILIKPETLAKDVRLLILEYARWSMIDKYQALMDGLSLESLLSFVKEFKSQLFVEGLVQGNVTSTESMDFLKYVVDKLNFKPLEQEMPVQFQVVELPSGHHLCKVKALNKGDANSEVTVYYQSGTRSLREYTLMELLVMHMEEPCFDFLRTKQTLGYHVYPTCRNTSGILGFSVTVGTQATKYNSEVVDKKIEEFLSSFEEKIENLTEEAFNTQVTALIKLKECEDTLP

SEQ ID NO: 907091 - protein, 685 aa, Homo sapiens
MLRRVTVAAVCATRRKLCEAGRELAALWGIETRGRCEDSAAARPFPILAMPGRNKAKSTCSCPDLQPNGQDLGENSRVARLGADESEEEGRRGSLSNAGDPEIVKSPSDPKQYRYIKLQNGLQALLISDLSNMEGKTGNTTDDEEEEEVEEEEEDDDEDSGAEIEDDDEEGFDDEDEFDDEHDDDLDTEDNELEELEERAEARKKTTEKQSAAALCVGVGSFADPDDLPGLAHFLEHMVFMGSLKYPDENGFDAFLKKHGGSDNASTDCERTVFQFDVQRKYFKEALDRWAQFFIHPLMIRDAIDREVEAVDSEYQLARPSDANRKEMLFGSLARPGHPMGKFFWGNAETLKHEPRKNNIDTHARLREFWMRYYSSHYMTLVVQSKETLDTLEKWVTEIFSQIPNNGLPRPNFGHLTDPFDTPAFNKLYRVVPIRKIHALTITWALPPQQQHYRVKPLHYISWLVGHEGKGSILSFLRKKCWALALFGGNGETGFEQNSTYSVFSISITLTDEGYEHFYEVAYTVFQYLKMLQKLGPEKRIFEEIRKIEDNEFHYQEQTDPVEYVENMCENMQLYPLQDILTGDQLLFEYKPEVIGEALNQLVPQKANLVLLSGANEGKCDLKEKWFGTQYSIEDIENSWAELWNSNFELNPDLHLPAENKYIATDFTLKAFDCPETEYPVKIVK

SEQ ID NO: 907092 - protein, 225 aa, Homo sapiens
MLRRVTVAAVCATRRKLCEAGRELAALWGIETRGRCEDSAAARPFPILAMPGRNKAKSTCSCPDLQPNGQDLGENSRVARLGADESEEEGRRGSLSNAGDPEIVKSPSDPKQYRYIKLQNGLQALLISDLSNMEGKTGNTTDDEEEEEVEEEEEDDDEDSGAEIEDDDEEGFDDEDEFDDEHDDDLDTEDNELEELEERAEARKKTTEKQGASHVCFLLIWEFFG

SEQ ID NO: 907093 - protein, 1411 aa, Homo sapiens
MASISEPVTFREFCPLYYLLNAIPTKIQKGFRSIVVYLTALDTNGDYIAVGSSIGMLYLYCRHLNQMRKYNFEGKTESITVVKLLSCFDDLVAAGTASGRVAVFQLVSSLPGRNKQLRRFDVTGIHKNSITALAWSPNGMKLFSGDDKGKIVYSSLDLDQGLCNSQLVLEEPSSIVQLDYSQKVLLVSTLQRSLLFYTEEKSVRQIGTQPRKSTGKFGACFIPGLCKQSDLTLYASRPGLRLWKADVHGTVQATFILKDAFAGGVKPFELHPRLESPNSGSCSLPERHLGLVSCFFQEGWVLSWNEYSIYLLDTVNQATIAGLEGSGDIVSVSCTENEIFFLKGDRNIIRISSRPEGLTSTVRDGLEMSGCSERVHVQQAEKLPGATVSETRLRGSSMASSVASEPRSRSSSLNSTDSGSGLLPPGLQATPELGKGSQPLSQRFNAISSEDFDQELVVKPIKVKRKKKKKKTEGGSRSTCHSSLESTPCSEFPGDSPQSLNTDLLSMTSSVLGSSVDQLSAESPDQESSFNGEVNGVPQENTDPETFNVLEVSGSMPDSLAEEDDIRTEMPHCHHAHGRELLNGAREDVGGSDVTGLGDEPCPADDGPNSTQLPFQEQDSSPGAHDGEDIQPIGPQSTFCEVPLLNSLTVPSSLSWAPSAEQWLPGTRADEGSPVEPSQEQDILTSMEASGHLSTNLWHAVTDDDTGQKEIPISERVLGSVGGQLTPVSALAASTHKPWLEQPPRDQTLTSSDEEDIYAHGLPSSSSETSVTELGPSCSQQDLSRLGAEDAGLLKPDQFAESWMGYSGPGYGILSLVVSEKYIWCLDYKGGLFCSALPGAGLRWQKFEDAVQQVAVSPSGALLWKIEQKSNRAFACGKVTIKGKRHWYEALPQAVFVALSDDTAWIIRTSGDLYLQTGLSVDRPCARAVKVDCPYPLSQITARNNVVWALTEQRALLYREGVSSFCPEGEQWKCDIVSERQALEPVCITLGDQQTLWALDIHGNLWFRTGIISKKPQGDDDHWWQVSITDYVVFDQCSLFQTIIHATHSVATAAQAPVEKVADKLRMAFWSQQLQCQPSLLGVNNSGVWISSGKNEFHVAKGSLIGTYWNHVVPRGTASATKWAFVLASAAPTKEGSFLWLCQSSKDLCSVSAQSAQSRPSTVQLPPEAEMRAYAACQDALWALDSLGQVFIRTLSKSCPTGMHWTRLDLSQLGAVKLTSLACGNQHIWACDSRGGVYFRVGTQPLNPSLMLPAWIMIEPPVQPAGVSLVSVHSSPNDQMLWVLDSRWNVHVRTGITEEMPVGTAWEHVPGLQACQLALSTRTVWARCPNGDLARRYGVTDKNPAGDYWKKIPGSVSCFTVTASDELWAVGPPGYLLQRLTKTFSHSHGTQKSSQAAMPHPEDLEDEWEVI

SEQ ID NO: 907094 - protein, 1411 aa, Homo sapiens; identical to SEQ ID NO: 907093

SEQ ID NO: 907095 - protein, 1267 aa, Homo sapiens [sequence omitted]

SEQ ID NO: 907096 - protein, 87 aa, Homo sapiens
WKADVHGTVQATFILKDAFAGGVKPFELHPRLESPNSGSCSLPERHLGLVSCFFQEGWVLSWNEYSIYLLDTVNQVSEGTPPYLLCL

SEQ ID NO: 907097 - protein, 1411 aa, Homo sapiens; identical to SEQ ID NO: 907093

SEQ ID NO: 907098 - protein, 56 aa, Homo sapiens
RHWYEALPQAVFVALSDDTAWIIRTSGDLYLQTGNRGPRLEACQLCRHCLCCTLLC

SEQ ID NO: 907099 - protein, 194 aa, Homo sapiens
RWERRRECTRRLPNNRQRTPLAMASNFKKANMASSSQRKRMSPKPELTEEQKQEIREAFDLFDADGTGTIDVKELKVAMRALGFEPKKEEIKKMISEIDKEGTGKMNFGDFLTVMTQKMSEKDTKEEILKAFKLFDDDETGKISFKNLKRVAKELGENLTDEELQEMIDEADRDGDGEVSEQEFLRIMKKTSLY

SEQ ID NO: 907100 - protein, 172 aa, Homo sapiens
MASNFKKANMASSSQRKRMSPKPELTEEQKQEIREAFDLFDADGTGTIDVKELKVAMRALGFEPKKEEIKKMISEIDKEGTGKMNFGDFLTVMTQKMSEKDTKEEILKAFKLFDDDETGKISFKNLKRVAKELGENLTDEELQEMIDEADRDGDGEVSEQEFLRIMKKTSLY

SEQ ID NO: 907101 - protein, 194 aa, Homo sapiens; identical to SEQ ID NO: 907099

SEQ ID NO: 907102 - protein, 202 aa, Homo sapiens
RWERRRECTRRLPNNRQRTPLAMASNFKKANMASSSQRKRMSPKPELTEEQKQEIREAFDLFDADGTGTIDVKELKVAMRALGFEPKKEEIKKMISEIDKEGTGKMNFGDFLTVMTQKMSEKDTKEEILKAFKLFDDDETGKISFKNLKRVAKELGENLTDEELQEMIDEADRDGDGEVSEQEFLRIMVTRFSACHGVKSGF

SEQ ID NO: 907103 - protein, 194 aa, Homo sapiens; identical to SEQ ID NO: 907099

SEQ ID NO: 907104 - protein, 194 aa, Homo sapiens; identical to SEQ ID NO: 907099

SEQ ID NO: 907105 - protein, 146 aa, Homo sapiens
ARSPCLGVLPSSLPAGRENWHIDVKELKVAMRALGFEPKKEEIKKMISEIDKEGTGKMNFGDFLTVMTQKMSEKDTKEEILKAFKLFDDDETGKISFKNLKRVAKELGENLTDEELQEMIDEADRDGDGEVSEQEFLRIMKKTSLY

SEQ ID NO: 907106 - protein, 108 aa, Homo sapiens
MAAAVAAAPGALGSLHAGGARLVAACSAWLCPGLRLPGSLAGRRAGPAIWAQGWVPAAGGPAPKRGYSSEMKTEDELRVRHLEEENRDRDKNMVKGSGDVNMCGVFGT

SEQ ID NO: 907107 - protein, 339 aa, Homo sapiens
MAAAVAAAPGALGSLHAGGARLVAACSAWLCPGLRLPGSLAGRRAGPAIWAQGWVPAAGGPAPKRGYSSEMKTEDELRVRHLEEENRGIVVLGINRAYGKNSLSKNLIKMLSKAVDALKSDKKVRTIIIRSEVPGIFCAGADLKERAKMSSSEVGPFVSKIRAVINDIANLPVPTIAAIDGLALGGGLELALACDIRVAASSAKMGLVETKLAIIPGGGGTQRLPRAIGMSLAKELIFSARVLDGKEAKAVGLISHVLEQNQEGDAAYRKALDLAREFLPQGPVAMRVAKLAINQGMEVDLVTGLAIEEACYAQTIPTKDRLEGLLAFKEKRPPRYKGE

SEQ ID NO: 907108 - protein, 230 aa, Homo sapiens
MLSKAVDALKSDKKVRTIIIRSEVPGIFCAGADLKERAKMSSSEVGPFVSKIRAVINDIANLPVPTIAAIDGLALGGGLELALACDIRVAASSAKMGLVETKLAIIPGGGGTQRLPRAIGMSLAKELIFSARVLDGKEAKAVGLISHVLEQNQEGDAAYRKALDLAREFLPQGPVAMRVAKLAINQGMEVDLVTGLAIEEACYAQTIPTKDRLEGLLAFKEKRPPRYKGE

SEQ ID NO: 907109 - protein, 300 aa, Homo sapiens
MAAAVAAAPGALGSLHAGGARLVAACSAWLCPGLRLPGSLAGRRAGPAIWAQGWVPAAGGPAPKRGYSSEMKTEDELRVRHLEEENRGIVVLGINRAYGKNSLSKNLIKMLSKAVDALKSDKKVRTIIIRSEVPGIFCAGADLKERAKMSSSEVGPFVSKIRAVINDIANLPVPTIAAIDGLALGGGLELALACDIRVAASSAKMGLVETKLAIIPGGGGTQRLPRAIGMSLAKELIFSARVLDGKEAKAVGLISHVLEQNQEGDAAYRKALDLAREFLPQGPVAMRVAKLAINQGMERF

SEQ ID NO: 907110 - protein, 339 aa, Homo sapiens; identical to SEQ ID NO: 907107

SEQ ID NO: 907111 - protein, 288 aa, Homo sapiens
MAAAVAAAPGALGSLHAGGARLVAACSAWLCPGLRLPGSLAGRRAGPAIWAQGWVPAAGGPAPKRGYSSEMKTEDELRVRHLEEENRGIVVLGINRAYGKNSLSKNLIKMLSKAVDALKSDKKVRTIIIRSEVPGIFCAGADLKERAKMSSSEVGPFVSKIRAVINDIANLPVPTIAAIDGLALGGGLELALACDIRVAASSAKMGLVETKLAIIPGGGGTQRLPRAIGMSLAKELIFSARVLDGKEAKAVGLISHVLEQNQEGDAAYRKALDLAREFLPQVKQIRRC

SEQ ID NO: 907112 - protein, 255 aa, Homo sapiens
MAAAVAAAPGALGSLHAGGARLVAACSAWLCPGLRLPGSLAGRRAGPAIWAQGWVPAAGGPAPKRGYSSEMKTEDELRVRHLEEENRGIVVLGINRAYGKNSLSKNLIKMLSKAVDALKSDKKVRTIIIRSEVPGIFCAGADLKERAKMSSSEVGPFVSKIRAVINDIANLPVPTIAAIDGLALGGGLELALACDIRVAASSAKMGLVETKLAIIPGGVTSSTEVLNPSKSSMKIGIIIFQTPVNIDILASSHES

SEQ ID NO: 907113 - protein, 339 aa, Homo sapiens; identical to SEQ ID NO: 907107

SEQ ID NO: 907114 - protein, 310 aa, Homo sapiens
MAAAVAAAPGALGSLHAGGARLVAACSAWLCPGLRLPGSLAGRRAGPAIWAQGWVPAAGGPAPKRGYSSEMKTEDELRVRHLEEENRGIVVLGINRAYGKNSLSKNLIKMLSKAVDALKSDKKVRTIIIRSEVPGIFCAANLPVPTIAAIDGLALGGGLELALACDIRVAASSAKMGLVETKLAIIPGGGGTQRLPRAIGMSLAKELIFSARVLDGKEAKAVGLISHVLEQNQEGDAAYRKALDLAREFLPQGPVAMRVAKLAINQGMEVDLVTGLAIEEACYAQTIPTKDRLEGLLAFKEKRPPRYKGE

SEQ ID NO: 907115 - protein, 323 aa, Homo sapiens
MAAAVAAAPGALGSLHAGGARLVAACSAWLCPGLRLPGSLAGRRAGPAIWAQGWVPAAGGPAPKRGYSSEMKTEDELRVRHLEEENRGIVVLGINRAYGKNSLSKNLIKMLSKAVDALKSDKKVRTIIIRSEVPGIFCAGADLKERAKMSSSEVGPFVSKIRAVINDIANLPVPTIAAIDGLALGGGLELALACDIRVAASSAKMGLVETKLAIIPGGGGTQRLPRAIGMSLAKELIFSARVLDGKEAKAVGLISHVLEQNQEGDAAYRKALDLAREFLPQGPVAMRVAKLAINQGMETIPTKDRLEGLLAFKEKRPPRYKGE

SEQ ID NO: 907116 - protein, 2440 aa, Homo sapiens
MSSSGYPPNQGAFSTEQSRYPPHSVQYTFPNTRHQQEFAVPDYRSSHLEVSQASQLLQQQQQQQLRRRPSLLSEFHPGSDRPQERRTSYEPFHPGPSPVDHDSLESKRPRLEQVSDSHFQRVSAAVLPLVHPLPEGLRASADAKKDPAFGGKHEAPSSPISGQPCGDDQNASPSKLSKEELIQSMDRVDREIAKVEQQILKLKKKQQQLEEEAAKPPEPEKPVSPPPVEQKHRSIVQIIYDENRKKAEEAHKIFEGLGPKVELPLYNQPSDTKVYHENIKTNQVMRKKLILFFKRRNHARKQREQKICQRYDQLMEAWEKKVDRIENNPRRKAKESKTREYYEKQFPEIRKQREQQERFQRVGQRGAGLSATIARSEHEISEIIDGLSEQENNEKQMRQLSVIPPMMFDAEQRRVKFINMNGLMEDPMKVYKDRQFMNVWTDHEKEIFKDKFIQHPKNFGLIASYLERKSVPDCVLYYYLTKKNENYKALVRRNYGKRRGRNQQIARPSQEEKVEEKEEDKAEKTEKKEEEKKDEEEKDEKEDSKENTKEKDKIDGTAEETEEREQATPRGRKTANSQGRRKGRITRSMTNEAAAASAAAAAATEEPPPPLPPPPEPISTEPVETSRWTEEEMEVAKKGLVEHGRNWAAIAKMVGTKSEAQCKNFYFNYKRRHNLDNLLQQHKQKTSRKPREERDVSQCESVASTVSAQEDEDIEASNEEENPEDSEVEAVKPSEDSPENATSRGNTEPAVELEPTTETAPSTSPSLAVPSTKPAEDESVETQVNDSISAETAEQMDVDQQEHSAEEGSVCDPPPATKADSVDVEVRVPENHASKVEGDNTKERDLDRASEKVEPRDEDLVVAQQINAQRPEPQSDNDSSATCSADEDVDGEPERQRMFPMDSKPSLLNPTGSILVSSPLKPNPLDLPQLQHRAAVIPPMVSCTPCNIPIGTPVSGYALYQRHIKAMHESALLEEQRQRQEQIDLECRSSTSPCGTSKSPNREWEVLQPAPHQVITNLPEGVRLPTTRPTRPPPPLIPSSKTTVASEKPSFIMGGSISQGTPGTYLTSHNQASYTQETPKPSVGSISLGLPRQQESAKSATLPYIKQEEFSPRSQNSQPEGLLVRAQHEGVVRGTAGAIQEGSITRGTPTSKISVESIPSLRGSITQGTPALPQTGIPTEALVKGSISRMPIEDSSPEKGREEAASKGHVIYEGKSGHILSYDNIKNAREGTRSPRTAHEISLKRSYESVEGNIKQGMSMRESPVSAPLEGLICRALPRGSPHSDLKERTVLSGSIMQGTPRATTESFEDGLKYPKQIKRESPPIRAFEGAITKGKPYDGITTIKEMGRSIHEIPRQDILTQESRKTPEVVQSTRPIIEGSISQGTPIKFDNNSGQSAIKHNVKSLITGPSKLSRGMPPLEIVPENIKVVERGKYEDVKAGETVRSRHTSVVSSGPSVLRSTLHEAPKAQLSPGIYDDTSARRTPVSYQNTMSRGSPMMNRTSDVTISSNKSTNHERKSTLTPTQRESIPAKSPVPGVDPVVSHSPFDPHHRGSTAGEVYRSHLPTHLDPAMPFHRALDPAAAAYLFQRQLSPTPGYPSQYQLYAMENTRQTILNDYITSQQMQVNLRPDVARGLSPREQPLGLPYPATRGIIDLTNMPPTILVPHPGGTSTPPMDRITYIPGTQITFPPRPYNSASMSPGHPTHLAAAASAEREREREREKERERERIAAASSDLYLRPGSEQPGRPGSHGYVRSPSPSVRTQETMLQQRPSVFQGTNGTSVITPLDPTAQLRIMPLPAGGPSISQGLPASRYNTAADALAALVDAAASAPQMDVSKTKESKHEAARLEENLRSRSAAVSEQQQLEQKTLEVEKRSVQCLYTSSAFPSGKPQPHSSVVYSEAGKDKGPPPKSRYEEELRTRGKTTITAANFIDVIITRQIASDKDARERGSQSSDSSSSLSSHRYETPSDAIEVISPASSPAPPQEKLQTYQPEVVKANQAENDPTRQYEGPLHHYRPQQESPSPQQQLPPSSQAEGMGQVPRTHRLITLADHICQIITQDFARNQVSSQTPQQPPTSTFQNSPSALVSTPVRTKTSNRYSPESQAQSVHHQRPGSRVSPENLVDKSRGSRPGKSPERSHVSSEPYEPISPPQVPVVHEKQDSLLLLSQRGAEPAEQRNDARSPGSISYLPSFFTKLENTSPMVKSKKQEIFRKLNSSGGGDSDMAAAQPGTEIFNLPAVTTSGSVSSRGHSFADPASNLGLEDIIRKALMGSFDDKVEDHGVVMSQPMGVVPGTANTSVVTSGETRREEGDPSPHSGGVCKPKLISKSNSRKSKSPIPGQGYLGTERPSSVSSVHSEGDYHRQTPGWAWEDRPSSTGSTQFPYNPLTMRMLSSTPPTPIACAPSAVNQAAPHQQNRIWEREPAPLLSAQYETLSDSDD

SEQ ID NO: 907117 - protein, 106 aa, Homo sapiens [sequence omitted]

SEQ ID NO: 907118 - protein, 2456 aa, Homo sapiens
MSSSGYPPNQGAFSTEQSRYPPHSVQYTFPNTRHQQEFAVPDYRSSHLEVSQASQLLQQQQQQQLRRRPSLLSEFHPGSDRPQERRTSYEPFHPGPSPVDHDSLESKRPRLEQVSDSHFQRVSAAVLPLVHPLPEGLRASADAKKDPAFGGKHEAPSSPISGQPCGDDQNASPSKLSKEELIQSMDRVDREIAKVEQQILKLKKKQQQLEEEAAKPPEPEKPVSPPPVEQKHRSIVQIIYDENRKKAEEAHKIFEGLGPKVELPLYNQPSDTKVYHENIKTNQVMRKKLILFFKRRNHARKQREQKICQRYDQLMEAWEKKVDRIENNPRRKAKESKTREYYEKQFPEIRKQREQQERFQRVGQRGAGLSATIARSEHEISEIIDGLSEQENNEKQMRQLSVIPPMMFDAEQRRVKFINMNGLMEDPMKVYKDRQFMNVWTDHEKEIFKDKFIQHPKNFGLIASYLERKSVPDCVLYYYLTKKNENYKALVRRNYGKRRGRNQQIARPSQEEKVEEKEEDKAEKTEKKEEEKKDEEEKDEKEDSKENTKEKDKIDGTAEETEEREQATPRGRKTANSQGRRKGRITRSMTNEAAAASAAAAAATEEPPPPLPPPPEPISTEPVETSRWTEEEMEVAKKGLVEHGRNWAAIAKMVGTKSEAQCKNFYFNYKRRHNLDNLLQQHKQKTSRKPREERDVSQCESVASTVSAQEDEDIEASNEEENPEDSEGAENSSDTESAPSPSPVEAVKPSEDSPENATSRGNTEPAVELEPTTETAPSTSPSLAVPSTKPAEDESVETQVNDSISAETAEQMDVDQQEHSAEEGSVCDPPPATKADSVDVEVRVPENHASKVEGDNTKERDLDRASEKVEPRDEDLVVAQQINAQRPEPQSDNDSSATCSADEDVDGEPERQRMFPMDSKPSLLNPTGSILVSSPLKPNPLDLPQLQHRAAVIPPMVSCTPCNIPIGTPVSGYALYQRHIKAMHESALLEEQRQRQEQIDLECRSSTSPCGTSKSPNREWEVLQPAPHQVITNLPEGVRLPTTRPTRPPPPLIPSSKTTVASEKPSFIMGGSISQGTPGTYLTSHNQASYTQETPKPSVGSISLGLPRQQESAKSATLPYIKQEEFSPRSQNSQPEGLLVRAQHEGVVRGTAGAIQEGSITRGTPTSKISVESIPSLRGSITQGTPALPQTGIPTEALVKGSISRMPIEDSSPEKGREEAASKGHVIYEGKSGHILSYDNIKNAREGTRSPRTAHEISLKRSYESVEGNIKQGMSMRESPVSAPLEGLICRALPRGSPHSDLKERTVLSGSIMQGTPRATTESFEDGLKYPKQIKRESPPIRAFEGAITKGKPYDGITTIKEMGRSIHEIPRQDILTQESRKTPEVVQSTRPIIEGSISQGTPIKFDNNSGQSAIKHNVKSLITGPSKLSRGMPPLEIVPENIKVVERGKYEDVKAGETVRSRHTSVVSSGPSVLRSTLHEAPKAQLSPGIYDDTSARRTPVSYQNTMSRGSPMMNRTSDVTISSNKSTNHERKSTLTPTQRESIPAKSPVPGVDPVVSHSPFDPHHRGSTAGEVYRSHLPTHLDPAMPFHRALDPAAAAYLFQRQLSPTPGYPSQYQLYAMENTRQTILNDYITSQQMQVNLRPDVARGLSPREQPLGLPYPATRGIIDLTNMPPTILVPHPGGTSTPPMDRITYIPGTQITFPPRPYNSASMSPGHPTHLAAAASAEREREREREKERERERIAAASSDLYLRPGSEQPGRPGSHGYVRSPSPSVRTQETMLQQRPSVFQGTNGTSVITPLDPTAQLRIMPLPAGGPSISQGLPASRYNTAADALAALVDAAASAPQMDVSKTKESKHEAARLEENLRSRSAAVSEQQQLEQKTLEVEKRSVQCLYTSSAFPSGKPQPHSSVVYSEAGKDKGPPPKSRYEEELRTRGKTTITAANFIDVIITRQIASDKDARERGSQSSDSSSSLSSHRYETPSDAIEVISPASSPAPPQEKLQTYQPEVVKANQAENDPTRQYEGPLHHYRPQQESPSPQQQLPPSSQAEGMGQVPRTHRLITLADHICQIITQDFARNQVSSQTPQQPPTSTFQNSPSALVSTPVRTKTSNRYSPESQAQSVHHQRPGSRVSPENLVDKSRGSRPGKSPERSHVSSEPYEPISPPQVPVVHEKQDSLLLLSQRGAEPAEQRNDARSPGSISYLPSFFTKLENTSPMVKSKKQEIFRKLNSSGGGDSDMAAAQPGTEIFNLPAVTTSGSVSSRGHSFADPASNLGLEDIIRKALMGSFDDKVEDHGVVMSQPMGVVPGTANTSVVTSGETRREEGDPSPHSGGVCKPKLISKSNSRKSKSPIPGQGYLGTERPSSVSSVHSEGDYHRQTPGWAWEDRPSSTGSTQFPYNPLTMRMLSSTPPTPIACAPSAVNQAAPHQQNRIWEREPAPLLSAQYETLSDSDD

SEQ ID NO: 907119 - protein, 2456 aa, Homo sapiens; identical to SEQ ID NO: 907118

SEQ ID NO: 907120 - protein, 2172 aa, Homo sapiens
MRKKLILFFKRRNHARKQREQKICQRYDQLMEAWEKKVDRIENNPRRKAKESKTREYYEKQFPEIRKQREQQERFQRVGQRGAGLSATIARSEHEISEIIDGLSEQENNEKQMRQLSVIPPMMFDAEQRRVKFINMNGLMEDPMKVYKDRQFMNVWTDHEKEIFKDKFIQHPKNFGLIASYLERKSVPDCVLYYYLTKKNENYKALVRRNYGKRRGRNQQIARPSQEEKVEEKEEDKAEKTEKKEEEKKDEEEKDEKEDSKENTKEKDKIDGTAEETEEREQATPRGRKTANSQGRRKGRITRSMTNEAAAASAAAAAATEEPPPPLPPPPEPISTEPVETSRWTEEEMEVAKKGLVEHGRNWAAIAKMVGTKSEAQCKNFYFNYKRRHNLDNLLQQHKQKTSRKPREERDVSQCESVASTVSAQEDEDIEASNEEENPEDSEGAENSSDTESAPSPSPVEAVKPSEDSPENATSRGNTEPAVELEPTTETAPSTSPSLAVPSTKPAEDESVETQVNDSISAETAEQMDVDQQEHSAEEGSVCDPPPATKADSVDVEVRVPENHASKVEGDNTKERDLDRASEKVEPRDEDLVVAQQINAQRPEPQSDNDSSATCSADEDVDGEPERQRMFPMDSKPSLLNPTGSILVSSPLKPNPLDLPQLQHRAAVIPPMVSCTPCNIPIGTPVSGYALYQRHIKAMHESALLEEQRQRQEQIDLECRSSTSPCGTSKSPNREWEVLQPAPHQVITNLPEGVRLPTTRPTRPPPPLIPSSKTTVASEKPSFIMGGSISQGTPGTYLTSHNQASYTQETPKPSVGSISLGLPRQQESAKSATLPYIKQEEFSPRSQNSQPEGLLVRAQHEGVVRGTAGAIQEGSITRGTPTSKISVESIPSLRGSITQGTPALPQTGIPTEALVKGSISRMPIEDSSPEKGREEAASKGHVIYEGKSGHILSYDNIKNAREGTRSPRTAHEISLKRSYESVEGNIKQGMSMRESPVSAPLEGLICRALPRGSPHSDLKERTVLSGSIMQGTPRATTESFEDGLKYPKQIKRESPPIRAFEGAITKGKPYDGITTIKEMGRSIHEIPRQDILTQESRKTPEVVQSTRPIIEGSISQGTPIKFDNNSGQSAIKHNVKSLITGPSKLSRGMPPLEIVPENIKVVERGKYEDVKAGETVRSRHTSVVSSGPSVLRSTLHEAPKAQLSPGIYDDTSARRTPVSYQNTMSRGSPMMNRTSDVTISSNKSTNHERKSTLTPTQRESIPAKSPVPGVDPVVSHSPFDPHHRGSTAGEVYRSHLPTHLDPAMPFHRALDPAAAAYLFQRQLSPTPGYPSQYQLYAMENTRQTILNDYITSQQMQVNLRPDVARGLSPREQPLGLPYPATRGIIDLTNMPPTILVPHPGGTSTPPMDRITYIPGTQITFPPRPYNSASMSPGHPTHLAAAASAEREREREREKERERERIAAASSDLYLRPGSEQPGRPGSHGYVRSPSPSVRTQETMLQQRPSVFQGTNGTSVITPLDPTAQLRIMPLPAGGPSISQGLPASRYNTAADALAALVDAAASAPQMDVSKTKESKHEAARLEENLRSRSAAVSEQQQLEQKTLEVEKRSVQCLYTSSAFPSGKPQPHSSVVYSEAGKDKGPPPKSRYEEELRTRGKTTITAANFIDVIITRQIASDKDARERGSQSSDSSSSLSSHRYETPSDAIEVISPASSPAPPQEKLQTYQPEVVKANQAENDPTRQYEGPLHHYRPQQESPSPQQQLPPSSQAEGMGQVPRTHRLITLADHICQIITQDFARNQVSSQTPQQPPTSTFQNSPSALVSTPVRTKTSNRYSPESQAQSVHHQRPGSRVSPENLVDKSRGSRPGKSPERSHVSSEPYEPISPPQVPVVHEKQDSLLLLSQRGAEPAEQRNDARSPGSISYLPSFFTKLENTSPMVKSKKQEIFRKLNSSGGGDSDMAAAQPGTEIFNLPAVTTSGSVSSRGHSFADPASNLGLEDIIRKALMGSFDDKVEDHGVVMSQPMGVVPGTANTSVVTSGETRREEGDPSPHSGGVCKPKLISKSNSRKSKSPIPGQGYLGTERPSSVSSVHSEGDYHRQTPGWAWEDRPSSTGSTQFPYNPLTMRMLSSTPPTPIACAPSAVNQAAPHQQNRIWEREPAPLLSAQYETLSDSDD

SEQ ID NO: 907121 - protein, 2456 aa, Homo sapiens; identical to SEQ ID NO: 907118

SEQ ID NO: 907122 - protein, 2514 aa, Homo sapiens
MSSSGYPPNQGAFSTEQSRYPPHSVQYTFPNTRHQQEFAVPDYRSSHLEVSQASQLLQQQQQQQLRRRPSLLSEFHPGSDRPQERRTSYEPFHPGPSPVDHDSLESKRPRLEQVSDSHFQRVSAAVLPLVHPLPEGLRASADAKKDPAFGGKHEAPSSPISGQPCGDDQNASPSKLSKEELIQSMDRVDREIAKVEQQILKLKKKQQQLEEEAAKPPEPEKPVSPPPVEQKHRSIVQIIYDENRKKAEEAHKIFEGLGPKVELPLYNQPSDTKVYHENIKTNQVMRKKLILFFKRRNHARKQREQKICQRYDQLMEAWEKKVDRIENNPRRKAKESKTREYYEKQFPEIRKQREQQERFQRVGQRGAGLSATIARSEHEISEIIDGLSEQENNEKQMRQLSVIPPMMFDAEQRRVKFINMNGLMEDPMKVYKDRQFMNVWTDHEKEIFKDKFIQHPKNFGLIASYLERKSVPDCVLYYYLTKKNENYKALVRRNYGKRRGRNQQIARPSQEEKVEEKEEDKAEKTEKKEEEKKDEEEKDEKEDSKENTKEKDKIDGTAEETEEREQATPRGRKTANSQGRRKGRITRSMTNEAAAASAAAAAATEEPPPPLPPPPEPISTEPVETSRWTEEEMEVAKKGLVEHGRNWAAIAKMVGTKSEAQCKNFYFNYKRRHNLDNLLQQHKQKTSRKPREERDVSQCESVASTVSAQEDEDIEASNEEENPEDSEGAENSSDTESAPSPSPVEAVKPSEDSPENATSRGNTEPAVELEPTTETAPSTSPSLAVPSTKPAEDESVETQVNDSISAETAEQMDVDQQEHSAEEGSVCDPPPATKADSVDVEVRVPENHASKVEGDNTKERDLDRASEKVEPRDEDLVVAQQINAQRPEPQSDNDSSATCSADEDVDGEPERQRMFPMDSKPSLLNPTGSILVSSPLKPNPLDLPQLQHRAAVIPPMVSCTPCNIPIGTPVSGYALYQRHIKAMHESALLEEQRQRQEQIDLECRSSTSPCGTSKSPNREWEGKSVAYMPYAEVKRALEQEAQMHNTAARSASPCRLSPREVSKAAPQPDMSAARYSVPPVLQPAPHQVITNLPEGVRLPTTRPTRPPPPLIPSSKTTVASEKPSFIMGGSISQGTPGTYLTSHNQASYTQETPKPSVGSISLGLPRQQESAKSATLPYIKQEEFSPRSQNSQPEGLLVRAQHEGVVRGTAGAIQEGSITRGTPTSKISVESIPSLRGSITQGTPALPQTGIPTEALVKGSISRMPIEDSSPEKGREEAASKGHVIYEGKSGHILSYDNIKNAREGTRSPRTAHEISLKRSYESVEGNIKQGMSMRESPVSAPLEGLICRALPRGSPHSDLKERTVLSGSIMQGTPRATTESFEDGLKYPKQIKRESPPIRAFEGAITKGKPYDGITTIKEMGRSIHEIPRQDILTQESRKTPEVVQSTRPIIEGSISQGTPIKFDNNSGQSAIKHNVKSLITGPSKLSRGMPPLEIVPENIKVVERGKYEDVKAGETVRSRHTSVVSSGPSVLRSTLHEAPKAQLSPGIYDDTSARRTPVSYQNTMSRGSPMMNRTSDVTISSNKSTNHERKSTLTPTQRESIPAKSPVPGVDPVVSHSPFDPHHRGSTAGEVYRSHLPTHLDPAMPFHRALDPAAAAYLFQRQLSPTPGYPSQYQLYAMENTRQTILNDYITSQQMQVNLRPDVARGLSPREQPLGLPYPATRGIIDLTNMPPTILVPHPGGTSTPPMDRITYIPGTQITFPPRPYNSASMSPGHPTHLAAAASAEREREREREKERERERIAAASSDLYLRPGSEQPGRPGSHGYVRSPSPSVRTQETMLQQRPSVFQGTNGTSVITPLDPTAQLRIMPLPAGGPSISQGLPASRYNTAADALAALVDAAASAPQMDVSKTKESKHEAARLEENLRSRSAAVSEQQQLEQKTLEVEKRSVQCLYTSSAFPSGKPQPHSSVVYSEAGKDKGPPPKSRYEEELRTRGKTTITAANFIDVIITRQIASDKDARERGSQSSDSSSSLSSHRYETPSDAIEVISPASSPAPPQEKLQTYQPEVVKANQAENDPTRQYEGPLHHYRPQQESPSPQQQLPPSSQAEGMGQVPRTHRLITLADHICQIITQDFARNQVSSQTPQQPPTSTFQNSPSALVSTPVRTKTSNRYSPESQAQSVHHQRPGSRVSPENLVDKSRGSRPGKSPERSHVSSEPYEPISPPQVPVVHEKQDSLLLLSQRGAEPAEQRNDARSPGSISYLPSFFTKLENTSPMVKSKKQEIFRKLNSSGGGDSDMAAAQPGTEIFNLPAVTTSGSVSSRGHSFADPASNLGLEDIIRKALMGSFDDKVEDHGVVMSQPMGVVPGTANTSVVTSGETRREEGDPSPHSGGVCKPKLISKSNSRKSKSPIPGQGYLGTERPSSVSSVHSEGDYHRQTPGWAWEDRPSSTGSTQFPYNPLTMRMLSSTPPTPIACAPSAVNQAAPHQQNRIWEREPAPLLSAQYETLSDSDD

SEQ ID NO: 907123 - protein, 2456 aa, Homo sapiens; identical to SEQ ID NO: 907118

SEQ ID NO: 907124 - protein, 2526 aa, Homo sapiens
MSSSGYPPNQGAFSTEQSRYPPHSVQYTFPNTRHQQEFAVPDYRSSHLEVSQASQLLQQQQQQQLRRRPSLLSEFHPGSDRPQERRTSYEPFHPGPSPVDHDSLESKRPRLEQVSDSHFQRVSAAVLPLVHPLPEGLRASADAKKDPAFGGKHEAPSSPISGQPCGDDQNASPSKLSKEELIQSMDRVDREIAKVEQQILKLKKKQQQLEEEAAKPPEPEKPVSPPPVEQKHRSIVQIIYDENRKKAEEAHKIFEGLGPKVELPLYNQPSDTKVYHENIKTNQVMRKKLILFFKRRNHARKQREQKICQRYDQLMEAWEKKVDRIENNPRRKAKESKTREYYEKQFPEIRKQREQQERFQRVGQRGAGLSATIARSEHEISEIIDGLSEQENNEKQMRQLSVIPPMMFDAEQRRVKFINMNGLMEDPMKVYKDRQFMNVWTDHEKEIFKDKFIQHPKNFGLIASYLERKSVPDCVLYYYLTKKNENYKALVRRNYGKRRGRNQQIARPSQEEKVEEKEEDKAEKTEKKEEEKKDEEEKDEKEDSKENTKEKDKIDGTAEETEEREQATPRGRKTANSQGRRKGRITRSMTNEAAAASAAAAAATEEPPPPLPPPPEPISTEPVETSRWTEEEMEVAKKGLVEHGRNWAAIAKMVGTKSEAQCKNFYFNYKRRHNLDNLLQQHKQKTSRKPREERDVSQCESVASTVSAQEDEDIEASNEEENPEDSEGAENSSDTESAPSPSPVEAVKPSEDSPENATSRGNTEPAVELEPTTETAPSTSPSLAVPSTKPAEDESVETQVNDSISAETAEQMDVDQQEHSAEEGSVCDPPPATKADSVDVEVRVPENHASKVEGDNTKERDLDRASEKVEPRDEDLVVAQQINAQRPEPQSDNDSSATCSADEDVDGEPERQRMFPMDSKPSLLNPTGSILVSSPLKPNPLDLPQLQHRAAVIPPMVSCTPCNIPIGTPVSGYALYQRHIKAMHESALLEEQRQRQEQIDLECRSSTSPCGTSKSPNREWEVLQPAPHQVITNLPEGVRLPTTRPTRPPPPLIPSSKTTVASEKPSFIMGGSISQGTPGTYLTSHNQASYTQETPKPSVGSISLGLPRQQESAKSATLPYIKQEEFSPRSQNSQPEGLLVRAQHEGVVRGTAGAIQEGSITRGTPTSKISVESIPSLRGSITQGTPALPQTGIPTEALVKGSISRMPIEDSSPEKGREEAASKGHVIYEGKSGHILSYDNIKNAREGTRSPRTAHEISLKRSYESVEGNIKQGMSMRESPVSAPLEGLICRALPRGSPHSDLKERTVLSGSIMQGTPRATTESFEDGLKYPKQIKRESPPIRAFEGAITKGKPYDGITTIKEMGRSIHEIPRQDILTQESRKTPEVVQSTRPIIEGSISQGTPIKFDNNSGQSAIKHNVKSLITGPSKLSRGMPPLEIVPENIKVVERGKYEDVKAGETVRSRHTSVVSSGPSVLRSTLHEAPKAQLSPGIYDDTSARRTPVSYQNTMSRGSPMMNRTSDVTISSNKSTNHERKSTLTPTQRESIPAKSPVPGVDPVVSHSPFDPHHRGSTAGEVYRSHLPTHLDPAMPFHRALDPAAAAYLFQRQLSPTPGYPSQYQLYAMENTRQTILNDYITSQQMQVNLRPDVARGLSPREQPLGLPYPATRGIIDLTNMPPTILVPHPGGTSTPPMDRITYIPGTQITFPPRPYNSASMSPGHPTHLAAAASAEREREREREKERERERIAAASSDLYLRPGSEQPGRPGSHGYVRSPSPSVRTQETMLQQRPSVFQGTNGTSVITPLDPTAQLRIMSVSCTYFDKKCLLHIHFKICDCNSLSIVMLFCPCHEGFILLLLQFVLPSPHHIPSKWSSLHRAVIWFYLQPLPAGGPSISQGLPASRYNTAADALAALVDAAASAPQMDVSKTKESKHEAARLEENLRSRSAAVSEQQQLEQKTLEVEKRSVQCLYTSSAFPSGKPQPHSSVVYSEAGKDKGPPPKSRYEEELRTRGKTTITAANFIDVIITRQIASDKDARERGSQSSDSSSSLSSHRYETPSDAIEVISPASSPAPPQEKLQTYQPEVVKANQAENDPTRQYEGPLHHYRPQQESPSPQQQLPPSSQAEGMGQVPRTHRLITLADHICQIITQDFARNQVSSQTPQQPPTSTFQNSPSALVSTPVRTKTSNRYSPESQAQSVHHQRPGSRVSPENLVDKSRGSRPGKSPERSHVSSEPYEPISPPQVPVVHEKQDSLLLLSQRGAEPAEQRNDARSPGSISYLPSFFTKLENTSPMVKSKKQEIFRKLNSSGGGDSDMAAAQPGTEIFNLPAVTTSGSVSSRGHSFADPASNLGLEDIIRKALMGSFDDKVEDHGVVMSQPMGVVPGTANTSVVTSGETRREEGDPSPHSGGVCKPKLISKSNSRKSKSPIPGQGYLGTERPSSVSSVHSEGDYHRQTPGWAWEDRPSSTGSTQFPYNPLTMRMLSSTPPTPIACAPSAVNQAAPHQQNRIWEREPAPLLSAQYETLSDSDD

SEQ ID NO: 907125 - protein, 2456 aa, Homo sapiens; identical to SEQ ID NO: 907118

SEQ ID NO: 907126 - protein, 1050 aa, Homo sapiens
KLYVLVERLVLIRQSVLTGPSKLSRGMPPLEIVPENIKVVERGKYEDVKAGETVRSRHTSVVSSGPSVLRSTLHEAPKAQLSPGIYDDTSARRTPVSYQNTMSRGSPMMNRTSDVTISSNKSTNHERKSTLTPTQRESIPAKSPVPGVDPVVSHSPFDPHHRGSTAGEVYRSHLPTHLDPAMPFHRALDPAAAAYLFQRQLSPTPGYPSQYQLYAMENTRQTILNDYITSQQMQVNLRPDVARGLSPREQPLGLPYPATRGIIDLTNMPPTILVPHPGGTSTPPMDRITYIPGTQITFPPRPYNSASMSPGHPTHLAAAASAEREREREREKERERERIAAASSDLYLRPGSEQPGRPGSHGYVRSPSPSVRTQETMLQQRPSVFQGTNGTSVITPLDPTAQLRIMPLPAGGPSISQGLPASRYNTAADALAALVDAAASAPQMDVSKTKESKHEAARLEENLRSRSAAVSEQQQLEQKTLEVEKRSVQCLYTSSAFPSGKPQPHSSVVYSEAGKDKGPPPKSRYEEELRTRGKTTITAANFIDVIITRQIASDKDARERGSQSSDSSSSLSSHRYETPSDAIEVISPASSPAPPQEKLQTYQPEVVKANQAENDPTRQYEGPLHHYRPQQESPSPQQQLPPSSQAEGMGQVPRTHRLITLADHICQIITQDFARNQVSSQTPQQPPTSTFQNSPSALVSTPVRTKTSNRYSPESQAQSVHHQRPGSRVSPENLVDKSRGSRPGKSPERSHVSSEPYEPISPPQVPVVHEKQDSLLLLSQRGAEPAEQRNDARSPGSISYLPSFFTKLENTSPMVKSKKQEIFRKLNSSGGGDSDMAAAQPGTEIFNLPAVTTSGSVSSRGHSFADPASNLGLEDIIRKALMGSFDDKVEDHGVVMSQPMGVVPGTANTSVVTSGETRREEGDPSPHSGGVCKPKLISKSNSRKSKSPIPGQGYLGTERPSSVSSVHSEGDYHRQTPGWAWEDRPSSTGSTQFPYNPLTMRMLSSTPPTPIACAPSAVNQAAPHQQNRIWEREPAPLLSAQYETLSDSDD

SEQ ID NO: 907127 - protein, 455 aa, Homo sapiens
MSEKHRHSWSKTSMCSLLDDPTRQYEGPLHHYRPQQESPSPQQQLPPSSQAEGMGQVPRTHRLITLADHICQIITQDFARNQVSSQTPQQPPTSTFQNSPSALVSTPVRTKTSNRYSPESQAQSVHHQRPGSRVSPENLVDKSRGSRPGKSPERSHVSSEPYEPISPPQVPVVHEKQDSLLLLSQRGAEPAEQRNDARSPGSISYLPSFFTKLENTSPMVKSKKQEIFRKLNSSGGGDSDMAAAQPGTEIFNLPAVTTSGSVSSRGHSFADPASNLGLEDIIRKALMGSFDDKVEDHGVVMSQPMGVVPGTANTSVVTSGETRREEGDPSPHSGGVCKPKLISKSNSRKSKSPIPGQGYLGTERPSSVSSVHSEGDYHRQTPGWAWEDRPSSTGSTQFPYNPLTMRMLSSTPPTPIACAPSAVNQAAPHQQNRIWEREPAPLLSAQYETLSDSDD

SEQ ID NO: 907128 - protein, 390 aa, Homo sapiens
FISHSQQIITQDFARNQVSSQTPQQPPTSTFQNSPSALVSTPVRTKTSNRYSPESQAQSVHHQRPGSRVSPENLVDKSRGSRPGKSPERSHVSSEPYEPISPPQVPVVHEKQDSLLLLSQRGAEPAEQRNDARSPGSISYLPSFFTKLENTSPMVKSKKQEIFRKLNSSGGGDSDMAAAQPGTEIFNLPAVTTSGSVSSRGHSFADPASNLGLEDIIRKALMGSFDDKVEDHGVVMSQPMGVVPGTANTSVVTSGETRREEGDPSPHSGGVCKPKLISKSNSRKSKSPIPGQGYLGTERPSSVSSVHSEGDYHRQTPGWAWEDRPSSTGSTQFPYNPLTMRMLSSTPPTPIACAPSAVNQAAPHQQNRIWEREPAPLLSAQYETLSDSDD

SEQ ID NO: 907129 - protein, 2380 aa, Homo sapiens
MSSSGYPPNQGAFSTEQSRYPPHSVQYTFPNTRHQQEFAVPDYRSSHLEVSQASQLLQQQQQQQLRRRPSLLSEFHPGSDRPQERRTSYEPFHPGPSPVDHDSLESKRPRLEQVSDSHFQRVSAAVLPLVHPLPEGLRASADAKKDPAFGGKHEAPSSPISGQPCGDDQNASPSKLSKEELIQSMDRVDREIAKVEQQILKLKKKQQQLEEEAAKPPEPEKPVSPPPVEQKHRSIVQIIYDENRKKAEEAHKIFEGLGPKVELPLYNQPSDTKVYHENIKTNQVMRKKLILFFKRRNHARKQREQKICQRYDQLMEAWEKKVDRIENNPRRKAKESKTREYYEKQFPEIRKQREQQERFQRVGQRGAGLSATIARSEHEISEIIDGLSEQENNEKQMRQLSVIPPMMFDAEQRRVKFINMNGLMEDPMKVYKDRQFMNVWTDHEKEIFKDKFIQHPKNFGLIASYLERKSVPDCVLYYYLTKKNENYKALVRRNYGKRRGRNQQIARPSQEEKVEEKEEDKAEKTEKKEEEKKDEEEKDEKEDSKENTKEKDKIDGTAEETEEREQATPRGRKTANSQGRRKGRITRSMTNEAAAASAAAAAATEEPPPPLPPPPEPISTEPVETSRWTEEEMEVAKKGLVEHGRNWAAIAKMVGTKSEAQCKNFYFNYKRRHNLDNLLQQHKQKTSRKPREERDVSQCESVASTVSAQEDEDIEASNEEENPEDSEGAENSSDTESAPSPSPVEAVKPSEDSPENATSRGNTEPAVELEPTTETAPSTSPSLAVPSTKPAEDESVETQVNDSISAETAEQMDVDQQEHSAEEGSVCDPPPATKADSVDVEVRVPENHASKVEGDNTKERDLDRASEKVEPRDEDLVVAQQINAQRPEPQSDNDSSATCSADEDVDGEPERQRMFPMDSKPSLLNPTGSILVSSPLKPNPLDLPQLQHRAAVIPPMVSCTPCNIPIGTPVSGYALYQRHIKAMHESALLEEQRQRQEQIDLECRSSTSPCGTSKSPNREWEVLQPAPHQVITNLPEGVRLPTTRPTRPPPPLIPSSKTTVASEKPSFIMGGSISQGTPGTYLTSHNQASYTQETPKPSVGSISLGLPRQQESAKSATLPYIKQEEFSPRSQNSQPEGLLVRAQHEGVVRGTAGAIQEGSITRGTPTSKISVESIPSLRGSITQGTPALPQTGIPTEALVKGSISRMPIEDSSPEKGREEAASKGHVIYEGKSGHILSYDNIKNAREGTRSPRTAHEISLKRSYESVEGNIKQGMSMRESPVSAPLEGLICRALPRGSPHSDLKERTVLSGSIMQGTPRATTESFEDGLKYPKQIKRESPPIRAFEGAITKGKPYDGITTIKEMGRSIHEIPRQDILTQESRKTPEVVQSTRPIIEGSISQGTPIKFDNNSGQSAIKHNVKSLITGPSKLSRGMPPLEIVPENIKVVERGKYEDVKAGETVRSRHTSVVSSGPSVLRSTLHEAPKAQLSPGIYDDTSARRTPVSYQNTMSRGSPMMNRTSDVTISSNKSTNHERKSTLTPTQRESIPAKSPVPGVDPVVSHSPFDPHHRGSTAGEVYRSHLPTHLDPAMPFHRALDPAAAAYLFQRQLSPTPGYPSQYQLYAMENTRQTILNDYITSQQMQVNLRPDVARGLSPREQPLGLPYPATRGIIDLTNMPPTILVPHPGGTSTPPMDRITYIPGTQITFPPRPYNSASMSPGHPTHLAAAASAEREREREREKERERERIAAASSDLYLRPGSEQPGRPGSHGYVRSPSPSVRTQETMLQQRPSVFQGTNGTSVITPLDPTAQLRIMPLPAGGPSISQGLPASRYNTAADALAALVDAAASAPQMDVSKTKESKHEAARLEENLRSRSAAVSEQQQLEQKTLEVEKRSVQCLYTSSAFPSGKPQPHSSVVYSEAGKDKGPPPKSRYEEELRTRGKTTITAANFIDVIITRQIASDKDARERGSQSSDSSSSLSSHRYETPSDAIEVISPASSPAPPQEKLQTYQPEVVKANQAENDPTRQYEGPLHHYRPQQESPSPQQQLPPSSQAEGMGQVPRTHRLITLADHICQIITQDFARNQVSSQTPQQPPTSTFQNSPSALVSTPVRTKTSNRYSPESQAQSVHHQRPGSRVSPENLVDKSRGSRPGKSPERSHVSSEPYEPISPPQVPVVHEKQDSLLLLSQRGAEPAEQRNDARSPGSISYLPSFFTKLENTSPMVKSKKQEIFRKLNSSGGGDSDMAAAQPGTEIFNLPAVTTSGSVSSRGHSFADPASNLGLEDIIRKALMGSFDDKVEDHGVVMSQPMGVVPGTANTSVVTSGETRREEGDPSPHSGTAFILVLFCCFSPKKPVYFPNSDASLRHFIYVFMCSESPLRVSVT

SEQ ID NO: 907130 - protein, 1934 aa, Homo sapiens
MSSSGYPPNQGAFSTEQSRYPPHSVQYTFPNTRHQQEFAVPDYRSSHLEVSQASQLLQQQQQQQLRRRPSLLSEFHPGSDRPQERRTSYEPFHPGPSPVDHDSLESKRPRLEQVSDSHFQRVSAAVLPLVHPLPEGLRASADAKKDPAFGGKHEAPSSPISGQPCGDDQNASPSKLSKEELIQSMDRVDREIAKVEQQILKLKKKQQQLEEEAAKPPEPEKPVSPPPVEQKHRSIVQIIYDENRKKAEEAHKIFEGLGPKVELPLYNQPSDTKVYHENIKTNQVMRKKLILFFKRRNHARKQREQKICQRYDQLMEAWEKKVDRIENNPRRKAKESKTREYYEKQFPEIRKQREQQERFQRVGQRGAGLSATIARSEHEISEIIDGLSEQENNEKQMRQLSVIPPMMFDAEQRRVKFINMNGLMEDPMKVYKDRQFMNVWTDHEKEIFKDKFIQHPKNFGLIASYLERKSVPDCVLYYYLTKKNENYKALVRRNYGKRRGRNQQIARPSQEEKVEEKEEDKAEKTEKKEEEKKDEEEKDEKEDSKENTKEKDKIDGTAEETEEREQATPRGRKTANSQGRRKGRITRSMTNEAAAASAAAAAATEEPPPPLPPPPEPISTEPVETSRWTEEEMEVAKKGLVEHGRNWAAIAKMVGTKSEAQCKNFYFNYKRRHNLDNLLQQHKQKTSRKPREERDVSQCESVASTVSAQEDEDIEASNEEENPEDSEGAENSSDTESAPSPSPVEAVKPSEDSPENATSRGNTEPAVELEPTTETAPSTSPSLAVPSTKPAEDESVETQVNDSISAETAEQMDVDQQEHSAEEGSVCDPPPATKADSVDVEVRVPENHASKVEGDNTKERDLDRASEKVEPRDEDLVVAQQINAQRPEPQSDNDSSATCSADEDVDGEPERQRMFPMDSKPSLLNPTGSILVSSPLKPNPLDLPQLQHRAAVIPPMVSCTPCNIPIGTPVSGYALYQRHIKAMHESALLEEQRQRQEQIDLECRSSTSPCGTSKSPNREWEVLQPAPHQVITNLPEGVRLPTTRPTRPPPPLIPSSKTTVASEKPSFIMGGSISQGTPGTYLTSHNQASYTQETPKPSVGSISLGLPRQQESAKSATLPYIKQEEFSPRSQNSQPEGLLVRAQHEGVVRGTAGAIQEGSITRGTPTSKISVESIPSLRGSITQGTPALPQTGIPTEALVKGSISRMPIEDSSPEKGREEAASKGHVIYEGKSGHILSYDNIKNAREGTRSPRTAHEISLKRSYESVEGNIKQGMSMRESPVSAPLEGLICRALPRGSPHSDLKERTVLSGSIMQGTPRATTESFEDGLKYPKQIKRESPPIRAFEGAITKGKPYDGITTIKEMGRSIHEIPRQDILTQESRKTPEVVQSTRPIIEGSISQGTPIKFDNNSGQSAIKHNVKSLITGPSKLSRGMPPLEIVPENIKVVERGKYEDVKAGETVRSRHTSVVSSGPSVLRSTLHEAPKAQLSPGIYDDTSARRTPVSYQNTMSRGSPMMNRTSDVTISSNKSTNHERKSTLTPTQRESIPAKSPVPGVDPVVSHSPFDPHHRGSTAGEVYRSHLPTHLDPAMPFHRALDPAAAAYLFQRQLSPTPGYPSQYQLYAMENTRQTILNDYITSQQMQVNLRPDVARGLSPREQPLGLPYPATRGIIDLTNMPPTILVPHPGGTSTPPMDRITYIPGTQITFPPRPYNSASMSPGHPTHLAAAASAEREREREREKERERERIAAASSDLYLRPGSEQPGRPGSHGYVRSPSPSVRTQETMLQQRPSVFQGTNGTSVITPLDPTAQLRIMSVSCTYFDKKCLLHIHFKICDCNSLSIVMLFCPCHEGFILLLLQFVLPSPHHIPSKWSSLHRAVIWFYLQATACWGPFNKPRPASLPLQHCCGCPGCSCGCCSFCTPDGCVQNKREPAWARW

SEQ ID NO: 907131 - protein, 1535 aa, Homo sapiens
MSSSGYPPNQGAFSTEQSRYPPHSVQYTFPNTRHQQEFAVPDYRSSHLEVSQASQLLQQQQQQQLRRRPSLLSEFHPGSDRPQERRTSYEPFHPGPSPVDHDSLESKRPRLEQVSDSHFQRVSAAVLPLVHPLPEGLRASADAKKDPAFGGKHEAPSSPISGQPCGDDQNASPSKLSKEELIQSMDRVDREIAKVEQQILKLKKKQQQLEEEAAKPPEPEKPVSPPPVEQKHRSIVQIIYDENRKKAEEAHKIFEGLGPKVELPLYNQPSDTKVYHENIKTNQVMRKKLILFFKRRNHARKQREQKICQRYDQLMEAWEKKVDRIENNPRRKAKESKTREYYEKQFPEIRKQREQQERFQRVGQRGAGLSATIARSEHEISEIIDGLSEQENNEKQMRQLSVIPPMMFDAEQRRVKFINMNGLMEDPMKVYKDRQFMNVWTDHEKEIFKDKFIQHPKNFGLIASYLERKSVPDCVLYYYLTKKNENYKALVRRNYGKRRGRNQQIARPSQEEKVEEKEEDKAEKTEKKEEEKKDEEEKDEKEDSKENTKEKDKIDGTAEETEEREQATPRGRKTANSQGRRKGRITRSMTNEAAAASAAAAAATEEPPPPLPPPPEPISTEPVETSRWTEEEMEVAKKGLVEHGRNWAAIAKMVGTKSEAQCKNFYFNYKRRHNLDNLLQQHKQKTSRKPREERDVSQCESVASTVSAQEDEDIEASNEEENPEDSEGAENSSDTESAPSPSPVEAVKPSEDSPENATSRGNTEPAVELEPTTETAPSTSPSLAVPSTKPAEDESVETQVNDSISAETAEQMDVDQQEHSAEEGSVCDPPPATKADSVDVEVRVPENHASKVEGDNTKERDLDRASEKVEPRDEDLVVAQQINAQRPEPQSDNDSSATCSADEDVDGEPERQRMFPMDSKPSLLNPTGSILVSSPLKPNPLDLPQLQHRAAVIPPMVSCTPCNIPIGTPVSGYALYQRHIKAMHESALLEEQRQRQEQIDLECRSSTSPCGTSKSPNREWEVLQPAPHQVITNLPEGVRLPTTRPTRPPPPLIPSSKTTVASEKPSFIMGGSISQGTPGTYLTSHNQASYTQETPKPSVGSISLGLPRQQESAKSATLPYIKQEEFSPRSQNSQPEGLLVRAQHEGVVRGTAGAIQEGSITRGTPTSKISVESIPSLRGSITQGTPALPQTGIPTEALVKGSISRMPIEDSSPEKGREEAASKGHVIYEGKSGHILSYDNIKNAREGTRSPRTAHEISLKRSYESVEGNIKQGMSMRESPVSAPLEGLICRALPRGSPHSDLKERTVLSGSIMQGTPRATTESFEDGLKYPKQIKRESPPIRAFEGAITKGKPYDGITTIKEMGRSIHEIPRQDILTQESRKTPEVVQSTRPIIEGSISQGTPIKFDNNSGQSAIKHNVKSLITGPSKLSRGMPPLEIVPENIKVVERGKYEDVKAGETVRSRHTSVVSSGPSVLRSTLHEAPKAQLSPGIYDDTSARRTPVSYQNTMSRGSPMMNRTSDGMLLLLLGLILFIAF

SEQ ID NO: 907132 - protein, 1257 aa, Homo sapiens
MSSSGYPPNQGAFSTEQSRYPPHSVQYTFPNTRHQQEFAVPDYRSSHLEVSQASQLLQQQQQQQLRRRPSLLSEFHPGSDRPQERRTSYEPFHPGPSPVDHDSLESKRPRLEQVSDSHFQRVSAAVLPLVHPLPEGLRASADAKKDPAFGGKHEAPSSPISGQPCGDDQNASPSKLSKEELIQSMDRVDREIAKVEQQILKLKKKQQQLEEEAAKPPEPEKPVSPPPVEQKHRSIVQIIYDENRKKAEEAHKIFEGLGPKVELPLYNQPSDTKVYHENIKTNQVMRKKLILFFKRRNHARKQREQKICQRYDQLMEAWEKKVDRIENNPRRKAKESKTREYYEKQFPEIRKQREQQERFQRVGQRGAGLSATIARSEHEISEIIDGLSEQENNEKQMRQLSVIPPMMFDAEQRRVKFINMNGLMEDPMKVYKDRQFMNVWTDHEKEIFKDKFIQHPKNFGLIASYLERKSVPDCVLYYYLTKKNENYKALVRRNYGKRRGRNQQIARPSQEEKVEEKEEDKAEKTEKKEEEKKDEEEKDEKEDSKENTKEKDKIDGTAEETEEREQATPRGRKTANSQGRRKGRITRSMTNEAAAASAAAAAATEEPPPPLPPPPEPISTEPVETSRWTEEEMEVAKKGLVEHGRNWAAIAKMVGTKSEAQCKNFYFNYKRRHNLDNLLQQHKQKTSRKPREERDVSQCESVASTVSAQEDEDIEASNEEENPEDSEGAENSSDTESAPSPSPVEAVKPSEDSPENATSRGNTEPAVELEPTTETAPSTSPSLAVPSTKPAEDESVETQVNDSISAETAEQMDVDQQEHSAEEGSVCDPPPATKADSVDVEVRVPENHASKVEGDNTKERDLDRASEKVEPRDEDLVVAQQINAQRPEPQSDNDSSATCSADEDVDGEPERQRMFPMDSKPSLLNPTGSILVSSPLKPNPLDLPQLQHRAAVIPPMVSCTPCNIPIGTPVSGYALYQRHIKAMHESALLEEQRQRQEQIDLECRSSTSPCGTSKSPNREWEVLQPAPHQVITNLPEGVRLPTTRPTRPPPPLIPSSKTTVASEKPSFIMGGSISQGTPGTYLTSHNQASYTQETPKPSVGSISLGLPRQQESAKSATLPYIKQEEFSPRSQNSQPEGLLVRAQHEGVVRGTAGAIQEGSITRGTPTSKISVESIPSLRGSITQGTPALPQTGIPTEALVKGSISRMPIEDSSPEKGREEAASKGHVIYEGKSGHILSYDSKYCMYAPKPVLQYVLKT

SEQ ID NO: 907133 - protein, 1065 aa, Homo sapiens
MSSSGYPPNQGAFSTEQSRYPPHSVQYTFPNTRHQQEFAVPDYRSSHLEVSQASQLLQQQQQQQLRRRPSLLSEFHPGSDRPQERRTSYEPFHPGPSPVDHDSLESKRPRLEQVSDSHFQRVSAAVLPLVHPLPEGLRASADAKKDPAFGGKHEAPSSPISGQPCGDDQNASPSKLSKEELIQSMDRVDREIAKVEQQILKLKKKQQQLEEEAAKPPEPEKPVSPPPVEQKHRSIVQIIYDENRKKAEEAHKIFEGLGPKVELPLYNQPSDTKVYHENIKTNQVMRKKLILFFKRRNHARKQREQKICQRYDQLMEAWEKKVDRIENNPRRKAKESKTREYYEKQFPEIRKQREQQERFQRVGQRGAGLSATIARSEHEISEIIDGLSEQENNEKQMRQLSVIPPMMFDAEQRRVKFINMNGLMEDPMKVYKDRQFMNVWTDHEKEIFKDKFIQHPKNFGLIASYLERKSVPDCVLYYYLTKKNENYKALVRRNYGKRRGRNQQIARPSQEEKVEEKEEDKAEKTEKKEEEKKDEEEKDEKEDSKENTKEKDKIDGTAEETEEREQATPRGRKTANSQGRRKGRITRSMTNEAAAASAAAAAATEEPPPPLPPPPEPISTEPVETSRWTEEEMEVAKKGLVEHGRNWAAIAKMVGTKSEAQCKNFYFNYKRRHNLDNLLQQHKQKTSRKPREERDVSQCESVASTVSAQEDEDIEASNEEENPEDSEGAENSSDTESAPSPSPVEAVKPSEDSPENATSRGNTEPAVELEPTTETAPSTSPSLAVPSTKPAEDESVETQVNDSISAETAEQMDVDQQEHSAEEGSVCDPPPATKADSVDVEVRVPENHASKVEGDNTKERDLDRASEKVEPRDEDLVVAQQINAQRPEPQSDNDSSATCSADEDVDGEPERQRMFPMDSKPSLLNPTGSILVSSPLKPNPLDLPQLQHRAAVIPPMVSCTPCNIPIGTPVSGYALYQRHIKAMHESALLEEQRQRQEQIDLECRSSTSPCGTSKSPNREWEVLQPAPHQVITNLPEGVRLPTTRPTRPPPPLIPSSKSNVGSVPL

SEQ ID NO: 907134 - protein, 898 aa, Homo sapiens
MSSSGYPPNQGAFSTEQSRYPPHSVQYTFPNTRHQQEFAVPDYRSSHLEVSQASQLLQQQQQQQLRRRPSLLSEFHPGSDRPQERRTSYEPFHPGPSPVDHDSLESKRPRLEQVSDSHFQRVSAAVLPLVHPLPEGLRASADAKKDPAFGGKHEAPSSPISGQPCGDDQNASPSKLSKEELIQSMDRVDREIAKVEQQILKLKKKQQQLEEEAAKPPEPEKPVSPPPVEQKHRSIVQIIYDENRKKAEEAHKIFEGLGPKVELPLYNQPSDTKVYHENIKTNQVMRKKLILFFKRRNHARKQREQKICQRYDQLMEAWEKKVDRIENNPRRKAKESKTREYYEKQFPEIRKQREQQERFQRVGQRGAGLSATIARSEHEISEIIDGLSEQENNEKQMRQLSVIPPMMFDAEQRRVKFINMNGLMEDPMKVYKDRQFMNVWTDHEKEIFKDKFIQHPKNFGLIASYLERKSVPDCVLYYYLTKKNENYKALVRRNYGKRRGRNQQIARPSQEEKVEEKEEDKAEKTEKKEEEKKDEEEKDEKEDSKENTKEKDKIDGTAEETEEREQATPRGRKTANSQGRRKGRITRSMTNEAAAASAAAAAATEEPPPPLPPPPEPISTEPVETSRWTEEEMEVAKKGLVEHGRNWAAIAKMVGTKSEAQCKNFYFNYKRRHNLDNLLQQHKQKTSRKPREERDVSQCESVASTVSAQEDEDIEASNEEENPEDSEGAENSSDTESAPSPSPVEAVKPSEDSPENATSRGNTEPAVELEPTTETAPSTSPSLAVPSTKPAEDESVETQVNDSISAETAEQMDVDQQEHSAEEGSVCDPPPATKADSVDVEVRVPENHASKVEGDNTKERDLDRASEKVEPRDEDLVVAQQINAQRPEPQSDNDSSGE

SEQ ID NO: 907135 - protein, 585 aa, Homo sapiens
MSSSGYPPNQGAFSTEQSRYPPHSVQYTFPNTRHQQEFAVPDYRSSHLEVSQASQLLQQQQQQQLRRRPSLLSEFHPGSDRPQERRTSYEPFHPGPSPVDHDSLESKRPRLEQVSDSHFQRVSAAVLPLVHPLPEGLRASADAKKDPAFGGKHEAPSSPISGQPCGDDQNASPSKLSKEELIQSMDRVDREIAKVEQQILKLKKKQQQLEEEAAKPPEPEKPVSPPPVEQKHRSIVQIIYDENRKKAEEAHKIFEGLGPKVELPLYNQPSDTKVYHENIKTNQVMRKKLILFFKRRNHARKQREQKICQRYDQLMEAWEKKVDRIENNPRRKAKESKTREYYEKQFPEIRKQREQQERFQRVGQRGAGLSATIARSEHEISEIIDGLSEQENNEKQMRQLSVIPPMMFDAEQRRVKFINMNGLMEDPMKVYKDRQFMNVWTDHEKEIFKDKFIQHPKNFGLIASYLERKSVPDCVLYYYLTKKNENYKALVRRNYGKRRGRNQQIARPSQEEKVEEKEEDKAEKTEKKEEEKKDEEEKDEKEDSKENTKEKYEEKEEDKAEKTEKKEEEKKDEEEKDEKEDSKKK

SEQ ID NO: 907136 - protein, 281 aa, Homo sapiens
MSSSGYPPNQGAFSTEQSRYPPHSVQYTFPNTRHQQEFAVPDYRSSHLEVSQASQLLQQQQQQQLRRRPSLLSEFHPGSDRPQERRTSYEPFHPGPSPVDHDSLESKRPRLEQVSDSHFQRVSAAVLPLVHPLPEGLRASADAKKDPAFGGKHEAPSSPISGQPCGDDQNASPSKLSKEELIQSMDRVDREIAKVEQQILKLKKKQQQLEEEAAKPPEPEKPVSPPPVEQKHRSIVQIIYDENRKKAEEAHKIFEGLGPKVELPLYNQPSDTKVYHENIKT

SEQ ID NO: 907137 - protein, 70 aa, Homo sapiens
RSVIGGADSVDVEVRVPENHASKVEGDNTKERDLDRASEKVEPRDEDLVVAQQINAQRPEPQSDNDSSGE

SEQ ID NO: 907138 - protein, 152 aa, Homo sapiens
VESRWRPRWRSSSRGGGGGWSERPTRRAERGPGVGPRAVAASHSSGRGARRLPRLASSRVSLLLPRLECNGTISAHRNLCLLGSSDSPASASRVAGITGMCHHAWLIFIFSVETGFHHVGQAGLELSTSGDPPASASQSAGITGVSHRTRPI

SEQ ID NO: 907139 - protein, 2456 aa, Homo sapiens; identical to SEQ ID NO: 907118

SEQ ID NO: 907140 - protein, 2198 aa, Homo sapiens
MIKDCPLYNQPSDTKVYHENIKTNQVMRKKLILFFKRRNHARKQREQKICQRYDQLMEAWEKKVDRIENNPRRKAKESKTREYYEKQFPEIRKQREQQERFQRVGQRGAGLSATIARSEHEISEIIDGLSEQENNEKQMRQLSVIPPMMFDAEQRRVKFINMNGLMEDPMKVYKDRQFMNVWTDHEKEIFKDKFIQHPKNFGLIASYLERKSVPDCVLYYYLTKKNENYKALVRRNYGKRRGRNQQIARPSQEEKVEEKEEDKAEKTEKKEEEKKDEEEKDEKEDSKENTKEKDKIDGTAEETEEREQATPRGRKTANSQGRRKGRITRSMTNEAAAASAAAAAATEEPPPPLPPPPEPISTEPVETSRWTEEEMEVAKKGLVEHGRNWAAIAKMVGTKSEAQCKNFYFNYKRRHNLDNLLQQHKQKTSRKPREERDVSQCESVASTVSAQEDEDIEASNEEENPEDSEGAENSSDTESAPSPSPVEAVKPSEDSPENATSRGNTEPAVELEPTTETAPSTSPSLAVPSTKPAEDESVETQVNDSISAETAEQMDVDQQEHSAEEGSVCDPPPATKADSVDVEVRVPENHASKVEGDNTKERDLDRASEKVEPRDEDLVVAQQINAQRPEPQSDNDSSATCSADEDVDGEPERQRMFPMDSKPSLLNPTGSILVSSPLKPNPLDLPQLQHRAAVIPPMVSCTPCNIPIGTPVSGYALYQRHIKAMHESALLEEQRQRQEQIDLECRSSTSPCGTSKSPNREWEVLQPAPHQVITNLPEGVRLPTTRPTRPPPPLIPSSKTTVASEKPSFIMGGSISQGTPGTYLTSHNQASYTQETPKPSVGSISLGLPRQQESAKSATLPYIKQEEFSPRSQNSQPEGLLVRAQHEGVVRGTAGAIQEGSITRGTPTSKISVESIPSLRGSITQGTPALPQTGIPTEALVKGSISRMPIEDSSPEKGREEAASKGHVIYEGKSGHILSYDNIKNAREGTRSPRTAHEISLKRSYESVEGNIKQGMSMRESPVSAPLEGLICRALPRGSPHSDLKERTVLSGSIMQGTPRATTESFEDGLKYPKQIKRESPPIRAFEGAITKGKPYDGITTIKEMGRSIHEIPRQDILTQESRKTPEVVQSTRPIIEGSISQGTPIKFDNNSGQSAIKHNVKSLITGPSKLSRGMPPLEIVPENIKVVERGKYEDVKAGETVRSRHTSVVSSGPSVLRSTLHEAPKAQLSPGIYDDTSARRTPVSYQNTMSRGSPMMNRTSDVTISSNKSTNHERKSTLTPTQRESIPAKSPVPGVDPVVSHSPFDPHHRGSTAGEVYRSHLPTHLDPAMPFHRALDPAAAAYLFQRQLSPTPGYPSQYQLYAMENTRQTILNDYITSQQMQVNLRPDVARGLSPREQPLGLPYPATRGIIDLTNMPPTILVPHPGGTSTPPMDRITYIPGTQITFPPRPYNSASMSPGHPTHLAAAASAEREREREREKERERERIAAASSDLYLRPGSEQPGRPGSHGYVRSPSPSVRTQETMLQQRPSVFQGTNGTSVITPLDPTAQLRIMPLPAGGPSISQGLPASRYNTAADALAALVDAAASAPQMDVSKTKESKHEAARLEENLRSRSAAVSEQQQLEQKTLEVEKRSVQCLYTSSAFPSGKPQPHSSVVYSEAGKDKGPPPKSRYEEELRTRGKTTITAANFIDVIITRQIASDKDARERGSQSSDSSSSLSSHRYETPSDAIEVISPASSPAPPQEKLQTYQPEVVKANQAENDPTRQYEGPLHHYRPQQESPSPQQQLPPSSQAEGMGQVPRTHRLITLADHICQIITQDFARNQVSSQTPQQPPTSTFQNSPSALVSTPVRTKTSNRYSPESQAQSVHHQRPGSRVSPENLVDKSRGSRPGKSPERSHVSSEPYEPISPPQVPVVHEKQDSLLLLSQRGAEPAEQRNDARSPGSISYLPSFFTKLENTSPMVKSKKQEIFRKLNSSGGGDSDMAAAQPGTEIFNLPAVTTSGSVSSRGHSFADPASNLGLEDIIRKALMGSFDDKVEDHGVVMSQPMGVVPGTANTSVVTSGETRREEGDPSPHSGGVCKPKLISKSNSRKSKSPIPGQGYLGTERPSSVSSVHSEGDYHRQTPGWAWEDRPSSTGSTQFPYNPLTMRMLSSTPPTPIACAPSAVNQAAPHQQNRIWEREPAPLLSAQYETLSDSDD

SEQ ID NO: 907141 - protein, 2456 aa, Homo sapiens; identical to SEQ ID NO: 907118

SEQ ID NO: 907142 - protein, 1645 aa, Homo sapiens [sequence omitted]

SEQ ID NO: 907143 - protein, 1616 aa, Homo sapiens
GDIVTVGECRPLSKTVRFNVLKVTKAAGTKKQFQKFEAGHRPAPHIVQRLSQTLNYATCSADEDVDGEPERQRMFPMDSKPSLLNPTGSILVSSPLKPNPLDLPQLQHRAAVIPPMVSCTPCNIPIGTPVSGYALYQRHIKAMHESALLEEQRQRQEQIDLECRSSTSPCGTSKSPNREWEVLQPAPHQVITNLPEGVRLPTTRPTRPPPPLIPSSKTTVASEKPSFIMGGSISQGTPGTYLTSHNQASYTQETPKPSVGSISLGLPRQQESAKSATLPYIKQEEFSPRSQNSQPEGLLVRAQHEGVVRGTAGAIQEGSITRGTPTSKISVESIPSLRGSITQGTPALPQTGIPTEALVKGSISRMPIEDSSPEKGREEAASKGHVIYEGKSGHILSYDNIKNAREGTRSPRTAHEISLKRSYESVEGNIKQGMSMRESPVSAPLEGLICRALPRGSPHSDLKERTVLSGSIMQGTPRATTESFEDGLKYPKQIKRESPPIRAFEGAITKGKPYDGITTIKEMGRSIHEIPRQDILTQESRKTPEVVQSTRPIIEGSISQGTPIKFDNNSGQSAIKHNVKSLITGPSKLSRGMPPLEIVPENIKVVERGKYEDVKAGETVRSRHTSVVSSGPSVLRSTLHEAPKAQLSPGIYDDTSARRTPVSYQNTMSRGSPMMNRTSDVTISSNKSTNHERKSTLTPTQRESIPAKSPVPGVDPVVSHSPFDPHHRGSTAGEVYRSHLPTHLDPAMPFHRALDPAAAAYLFQRQLSPTPGYPSQYQLYAMENTRQTILNDYITSQQMQVNLRPDVARGLSPREQPLGLPYPATRGIIDLTNMPPTILVPHPGGTSTPPMDRITYIPGTQITFPPRPYNSASMSPGHPTHLAAAASAEREREREREKERERERIAAASSDLYLRPGSEQPGRPGSHGYVRSPSPSVRTQETMLQQRPSVFQGTNGTSVITPLDPTAQLRIMPLPAGGPSISQGLPASRYNTAADALAALVDAAASAPQMDVSKTKESKHEAARLEENLRSRSAAVSEQQQLEQKTLEVEKRSVQCLYTSSAFPSGKPQPHSSVVYSEAGKDKGPPPKSRYEEELRTRGKTTITAANFIDVIITRQIASDKDARERGSQSSDSSSSLSSHRYETPSDAIEVISPASSPAPPQEKLQTYQPEVVKANQAENDPTRQYEGPLHHYRPQQESPSPQQQLPPSSQAEGMGQVPRTHRLITLADHICQIITQDFARNQVSSQTPQQPPTSTFQNSPSALVSTPVRTKTSNRYSPESQAQSVHHQRPGSRVSPENLVDKSRGSRPGKSPERSHVSSEPYEPISPPQVPVVHEKQDSLLLLSQRGAEPAEQRNDARSPGSISYLPSFFTKLENTSPMVKSKKQEIFRKLNSSGGGDSDMAAAQPGTEIFNLPAVTTSGSVSSRGHSFADPASNLGLEDIIRKALMGSFDDKVEDHGVVMSQPMGVVPGTANTSVVTSGETRREEGDPSPHSGGVCKPKLISKSNSRKSKSPIPGQGYLGTERPSSVSSVHSEGDYHRQTPGWAWEDRPSSTGSTQFPYNPLTMRMLSSTPPTPIACAPSAVNQAAPHQQNRIWEREPAPLLSAQYETLSDSDD

SEQ ID NO: 907144 - protein, 2293 aa, Homo sapiens
MSSSGYPPNQGAFSTEQSRYPPHSVQYTFPNTRHQQEFAVPDYRSSHLEVSQASQLLQQQQQQQLRRRPSLLSEFHPGSDRPQERRTSYEPFHPGPSPVDHDSLESKRPRLEQVSDSHFQRVSAAVLPLVHPLPEGLRASADAKKDPAFGGKHEAPSSPISGQPCGDDQNASPSKLSKEELIQSMDRVDREIAKVEQQILKLKKKQQQLEEEAAKPPEPEKPVSPPPVEQKHRSIVQIIYDENRKKAEEAHKIFEGLGPKVELPLYNQPSDTKVYHENIKTNQVMRKKLILFFKRRNHARKQREQKICQRYDQLMEAWEKKVDRIENNPRRKAKESKTREYYEKQFPEIRKQREQQERFQRVGQRGAGLSATIARSEHEISEIIDGLSEQENNEKQMRQLSVIPPMMFDAEQRRVKFINMNGLMEDPMKVYKDRQFMNVWTDHEKEIFKDKFIQHPKNFGLIASYLERKSVPDCVLYYYLTKKNENYKALVRRNYGKRRGRNQQIARPSQEEKVEEKEEDKAEKTEKKEEEKKDEEEKDEKEDSKENTKEKDKIDGTAEETEEREQATPRGRKTANSQGRRKGRITRSMTNEAAAASAAAAAATEEPPPPLPPPPEPISTEPVETSRWTEEEMEVAKKGLVEHGRNWAAIAKMVGTKSEAQCKNFYFNYKRRHNLDNLLQQHKQKTSRKPREERDVSQCESVASTVSAQEDEDIEASNEEENPEDSEGAENSSDTESAPSPSPVEAVKPSEDSPENATSRGNTEPAVELEPTTETAPSTSPSLAVPSTKPAEDESVETQVNDSISAETAEQMDVDQQEHSAEEGSVCDPPPATKADSVDVEVRVPENHASKVEGDNTKERDLDRASEKVEPRDEDLVVAQQINAQRPEPQSDNDSSATCSADEDVDGEPERQRMFPMDSKPSLLNPTGSILVSSPLKPNPLDLPQLQHRAAVIPPMVSCTPCNIPIGTPVSGYALYQRHIKAMHESALLEEQRQRQEQIDLECRSSTSPCGTSKSPNREWEVLQPAPHQVITNLPEGVRLPTTRPTRPPPPLIPSSKTTVASEKPSFIMGGSISQGTPGTYLTSHNQASYTQETPKPSVGSISLGLPRQQESAKSATLPYIKQEEFSPRSQNSQPEGLLVRAQHEGVVRGTAGAIQEGSITRGTPTSKISVESIPSLRGSITQGTPALPQTGIPTEALVKGSISRMPIEDSSPEKGREEAASKGHVIYEGKSGHILSYDNIKNAREGTRSPRTAHEISLKRSYESVEGNIKQGMSMRESPVSAPLEGLICRALPRGSPHSDLKERTVLSGSIMQGTPRATTESFEDGLKYPKQIKRESPPIRAFEGAITKGKPYDGITTIKEMGRSIHEIPRQDILTQESRKTPEVVQSTRPIIEGSISQGTPIKFDNNSGQSAIKHNVKSLITGPSKLSRGMPPLEIVPENIKVVERGKYEDVKAGETVRSRHTSVVSSGPSVLRSTLHEAPKAQLSPGIYDDTSARRTPVSYQNTMSRGSPMMNRTSDVTISSNKSTNHERKSTLTPTQRESIPAKSPVPGVDPVVSHSPFDPHHRGSTAGEVYRSHLPTHLDPAMPFHRALDPAAAAYLFQRQLSPTPGYPSQYQLYAMENTRQTILNDYITSQQMQVNLRPDVARGLSPREQPLGLPYPATRGIIDLTNMPPTILVPHPGGTSTPPMDRITYIPGTQITFPPRPYNSASMSPGHPTHLAAAASAEREREREREKERERERIAAASSDLYLRPGSEQPGRPGSHGYVRSPSPSVRTQETMLQQRPSVFQGTNGTSVITPLDPTAQLRIMPLPAGGPSISQGLPASRYNTAADALAALVDAAASAPQMDVSKTKESKHEAARLEENLRSRSAAVSEQQQLEQKTLEVEKRSVQCLYTSSAFPSGKPQPHSSVVYSEAGKDKGPPPKSRYEEELRTRGKTTITAANFIDVIITRQIASDKDARERGSQSSDSSSSLSSHRYETPSDAIEVISPASSPAPPQEKLQTYQPEVVKANQAENDPTRQYEGPLHHYRPQQESPSPQQQLPPSSQAEGMGQVPRTHRLITLADHICQIITQDFARNQVSSQTPQQPPTSTFQNSPSALVSTPVRTKTSNRYSPESQAQSVHHQRPGSRVSPENLVDKSRGSRPGKSPERSHVSSEPYEPISPPQVPVVHEKQDSLLLLSQRGAEPAEQRNDARSPGSISYLPSFFTKLENTSPMVKSKKQEIQLLSQELRSLICQQLLRQAQLALEAILLLILPVILGWKTLSGRLSWEALMTKLRIMELSCPSLWE

SEQ ID NO: 907145 - protein, 835 aa, Homo sapiens
MENTRQTILNDYITSQQMQVNLRPDVARGLSPREQPLGLPYPATRGIIDLTNMPPTILVPHPGGTSTPPMDRITYIPGTQITFPPRPYNSASMSPGHPTHLAAAASAEREREREREKERERERIAAASSDLYLRPGSEQPGRPGSHGYVRSPSPSVRTQETMLQQRPSVFQGTNGTSVITPLDPTAQLRIMPLPAGGPSISQGLPASRYNTAADALAALVDAAASAPQMDVSKTKESKHEAARLEENLRSRSAAVSEQQQLEQKTLEVEKRSVQCLYTSSAFPSGKPQPHSSVVYSEAGKDKGPPPKSRYEEELRTRGKTTITAANFIDVIITRQIASDKDARERGSQSSDSSSSLSSHRYETPSDAIEVISPASSPAPPQEKLQTYQPEVVKANQAENDPTRQYEGPLHHYRPQQESPSPQQQLPPSSQAEGMGQVPRTHRLITLADHICQIITQDFARNQVSSQTPQQPPTSTFQNSPSALVSTPVRTKTSNRYSPESQAQSVHHQRPGSRVSPENLVDKSRGSRPGKSPERSHVSSEPYEPISPPQVPVVHEKQDSLLLLSQRGAEPAEQRNDARSPGSISYLPSFFTKLENTSPMVKSKKQEIFRKLNSSGGGDSDMAAAQPGTEIFNLPAVTTSGSVSSRGHSFADPASNLGLEDIIRKALMGSFDDKVEDHGVVMSQPMGVVPGTANTSVVTSGETRREEGDPSPHSGGVCKPKLISKSNSRKSKSPIPGQGYLGTERPSSVSSVHSEGDYHRQTPGWAWEDRPSSTGSTQFPYNPLTMRMLSSTPPTPIACAPSAVNQAAPHQQNRIWEREPAPLLSAQYETLSDSDD

SEQ ID NO: 907146 - protein, 345 aa, Homo sapiens
GASVLGDAVPEESRASASKTGSRVSPENLVDKSRGSRPGKSPERSHVSSEPYEPISPPQVPVVHEKQDSLLLLSQRGAEPAEQRNDARSPGSISYLPSFFTKLENTSPMVKSKKQEIFRKLNSSGGGDSDMAAAQPGTEIFNLPAVTTSGSVSSRGHSFADPASNLGLEDIIRKALMGSFDDKVEDHGVVMSQPMGVVPGTANTSVVTSGETRREEGDPSPHSGGVCKPKLISKSNSRKSKSPIPGQGYLGTERPSSVSSVHSEGDYHRQTPGWAWEDRPSSTGSTQFPYNPLTMRMLSSTPPTPIACAPSAVNQAAPHQQNRIWEREPAPLLSAQYETLSDSDD

SEQ ID NO: 907147 - protein, 217 aa, Homo sapiens
MHVCFLIGLSEISGNVFDSLSGSVSSRGHSFADPASNLGLEDIIRKALMGSFDDKVEDHGVVMSQPMGVVPGTANTSVVTSGETRREEGDPSPHSGGVCKPKLISKSNSRKSKSPIPGQGYLGTERPSSVSSVHSEGDYHRQTPGWAWEDRPSSTGSTQFPYNPLTMRMLSSTPPTPIACAPSAVNQAAPHQQNRIWEREPAPLLSAQYETLSDSDD

SEQ ID NO: 907148 - protein, 1601 aa, Homo sapiens
MSSSGYPPNQGAFSTEQSRYPPHSVQYTFPNTRHQQEFAVPDYRSSHLEVSQASQLLQQQQQQQLRRRPSLLSEFHPGSDRPQERRTSYEPFHPGPSPVDHDSLESKRPRLEQVSDSHFQRVSAAVLPLVHPLPEGLRASADAKKDPAFGGKHEAPSSPISGQPCGDDQNASPSKLSKEELIQSMDRVDREIAKVEQQILKLKKKQQQLEEEAAKPPEPEKPVSPPPVEQKHRSIVQIIYDENRKKAEEAHKIFEGLGPKVELPLYNQPSDTKVYHENIKTNQVMRKKLILFFKRRNHARKQREQKICQRYDQLMEAWEKKVDRIENNPRRKAKESKTREYYEKQFPEIRKQREQQERFQRVGQRGAGLSATIARSEHEISEIIDGLSEQENNEKQMRQLSVIPPMMFDAEQRRVKFINMNGLMEDPMKVYKDRQFMNVWTDHEKEIFKDKFIQHPKNFGLIASYLERKSVPDCVLYYYLTKKNENYKALVRRNYGKRRGRNQQIARPSQEEKVEEKEEDKAEKTEKKEEEKKDEEEKDEKEDSKENTKEKDKIDGTAEETEEREQATPRGRKTANSQGRRKGRITRSMTNEAAAASAAAAAATEEPPPPLPPPPEPISTEPVETSRWTEEEMEVAKKGLVEHGRNWAAIAKMVGTKSEAQCKNFYFNYKRRHNLDNLLQQHKQKTSRKPREERDVSQCESVASTVSAQEDEDIEASNEEENPEDSEGAENSSDTESAPSPSPVEAVKPSEDSPENATSRGNTEPAVELEPTTETAPSTSPSLAVPSTKPAEDESVETQVNDSISAETAEQMDVDQQEHSAEEGSVCDPPPATKADSVDVEVRVPENHASKVEGDNTKERDLDRASEKVEPRDEDLVVAQQINAQRPEPQSDNDSSATCSADEDVDGEPERQRMFPMDSKPSLLNPTGSILVSSPLKPNPLDLPQLQHRAAVIPPMVSCTPCNIPIGTPVSGYALYQRHIKAMHESALLEEQRQRQEQIDLECRSSTSPCGTSKSPNREWEVLQPAPHQVITNLPEGVRLPTTRPTRPPPPLIPSSKTTVASEKPSFIMGGSISQGTPGTYLTSHNQASYTQETPKPSVGSISLGLPRQQESAKSATLPYIKQEEFSPRSQNSQPEGLLVRAQHEGVVRGTAGAIQEGSITRGTPTSKISVESIPSLRGSITQGTPALPQTGIPTEALVKGSISRMPIEDSSPEKGREEAASKGHVIYEGKSGHILSYDNIKNAREGTRSPRTAHEISLKRSYESVEGNIKQGMSMRESPVSAPLEGLICRALPRGSPHSDLKERTVLSGSIMQGTPRATTESFEDGLKYPKQIKRESPPIRAFEGAITKGKPYDGITTIKEMGRSIHEIPRQDILTQESRKTPEVVQSTRPIIEGSISQGTPIKFDNNSGQSAIKHNVKSLITGPSKLSRGMPPLEIVPENIKVVERGKYEDVKAGETVRSRHTSVVSSGPSVLRSTLHEAPKAQLSPGIYDDTSARRTPVSYQNTMSRGSPMMNRTSDVTISSNKSTNHERKSTLTPTQRESIPAKSPVPGVDPVVSHSPFDPHHRGSTAGEVYRSHLPTHLDPAMPFHRALDPGKHKI

SEQ ID NO: 907149 - protein, 1234 aa, Homo sapiens
MSSSGYPPNQGAFSTEQSRYPPHSVQYTFPNTRHQQEFAVPDYRSSHLEVSQASQLLQQQQQQQLRRRPSLLSEFHPGSDRPQERRTSYEPFHPGPSPVDHDSLESKRPRLEQVSDSHFQRVSAAVLPLVHPLPEGLRASADAKKDPAFGGKHEAPSSPISGQPCGDDQNASPSKLSKEELIQSMDRVDREIAKVEQQILKLKKKQQQLEEEAAKPPEPEKPVSPPPVEQKHRSIVQIIYDENRKKAEEAHKIFEGLGPKVELPLYNQPSDTKVYHENIKTNQVMRKKLILFFKRRNHARKQREQKICQRYDQLMEAWEKKVDRIENNPRRKAKESKTREYYEKQFPEIRKQREQQERFQRVGQRGAGLSATIARSEHEISEIIDGLSEQENNEKQMRQLSVIPPMMFDAEQRRVKFINMNGLMEDPMKVYKDRQFMNVWTDHEKEIFKDKFIQHPKNFGLIASYLERKSVPDCVLYYYLTKKNENYKALVRRNYGKRRGRNQQIARPSQEEKVEEKEEDKAEKTEKKEEEKKDEEEKDEKEDSKENTKEKDKIDGTAEETEEREQATPRGRKTANSQGRRKGRITRSMTNEAAAASAAAAAATEEPPPPLPPPPEPISTEPVETSRWTEEEMEVAKKGLVEHGRNWAAIAKMVGTKSEAQCKNFYFNYKRRHNLDNLLQQHKQKTSRKPREERDVSQCESVASTVSAQEDEDIEASNEEENPEDSEGAENSSDTESAPSPSPVEAVKPSEDSPENATSRGNTEPAVELEPTTETAPSTSPSLAVPSTKPAEDESVETQVNDSISAETAEQMDVDQQEHSAEEGSVCDPPPATKADSVDVEVRVPENHASKVEGDNTKERDLDRASEKVEPRDEDLVVAQQINAQRPEPQSDNDSSATCSADEDVDGEPERQRMFPMDSKPSLLNPTGSILVSSPLKPNPLDLPQLQHRAAVIPPMVSCTPCNIPIGTPVSGYALYQRHIKAMHESALLEEQRQRQEQIDLECRSSTSPCGTSKSPNREWEVLQPAPHQVITNLPEGVRLPTTRPTRPPPPLIPSSKTTVASEKPSFIMGGSISQGTPGTYLTSHNQASYTQETPKPSVGSISLGLPRQQESAKSATLPYIKQEEFSPRSQNSQPEGLLVRAQHEGVVRGTAGAIQEGSITRGTPTSKISVESIPSLRGSITQGTPALPLTNRPSGREFWLRGENSSCLEISNRDYNRDLQHDFMPLEEKYFLV

SEQ ID NO: 907150 - protein, 1023 aa, Homo sapiens
MSSSGYPPNQGAFSTEQSRYPPHSVQYTFPNTRHQQEFAVPDYRSSHLEVSQASQLLQQQQQQQLRRRPSLLSEFHPGSDRPQERRTSYEPFHPGPSPVDHDSLESKRPRLEQVSDSHFQRVSAAVLPLVHPLPEGLRASADAKKDPAFGGKHEAPSSPISGQPCGDDQNASPSKLSKEELIQSMDRVDREIAKVEQQILKLKKKQQQLEEEAAKPPEPEKPVSPPPVEQKHRSIVQIIYDENRKKAEEAHKIFEGLGPKVELPLYNQPSDTKVYHENIKTNQVMRKKLILFFKRRNHARKQREQKICQRYDQLMEAWEKKVDRIENNPRRKAKESKTREYYEKQFPEIRKQREQQERFQRVGQRGAGLSATIARSEHEISEIIDGLSEQENNEKQMRQLSVIPPMMFDAEQRRVKFINMNGLMEDPMKVYKDRQFMNVWTDHEKEIFKDKFIQHPKNFGLIASYLERKSVPDCVLYYYLTKKNENYKALVRRNYGKRRGRNQQIARPSQEEKVEEKEEDKAEKTEKKEEEKKDEEEKDEKEDSKENTKEKDKIDGTAEETEEREQATPRGRKTANSQGRRKGRITRSMTNEAAAASAAAAAATEEPPPPLPPPPEPISTEPVETSRWTEEEMEVAKKGLVEHGRNWAAIAKMVGTKSEAQCKNFYFNYKRRHNLDNLLQQHKQKTSRKPREERDVSQCESVASTVSAQEDEDIEASNEEENPEDSEGAENSSDTESAPSPSPVEAVKPSEDSPENATSRGNTEPAVELEPTTETAPSTSPSLAVPSTKPAEDESVETQVNDSISAETAEQMDVDQQEHSAEEGSVCDPPPATKADSVDVEVRVPENHASKVEGDNTKERDLDRASEKVEPRDEDLVVAQQINAQRPEPQSDNDSSATCSADEDVDGEPERQRMFPMDSKPSLLNPTGSILVSSPLKPNPLDLPQLQHRAAVIPPMVSCTPCNIPIGTPVSGYALYQRHIKAMHESALLEEQRQRQEQIDLECRSSTSPCGTSKSPNREWEGR

SEQ ID NO: 907151 - protein, 732 aa, Homo sapiens
MSSSGYPPNQGAFSTEQSRYPPHSVQYTFPNTRHQQEFAVPDYRSSHLEVSQASQLLQQQQQQQLRRRPSLLSEFHPGSDRPQERRTSYEPFHPGPSPVDHDSLESKRPRLEQVSDSHFQRVSAAVLPLVHPLPEGLRASADAKKDPAFGGKHEAPSSPISGQPCGDDQNASPSKLSKEELIQSMDRVDREIAKVEQQILKLKKKQQQLEEEAAKPPEPEKPVSPPPVEQKHRSIVQIIYDENRKKAEEAHKIFEGLGPKVELPLYNQPSDTKVYHENIKTNQVMRKKLILFFKRRNHARKQREQKICQRYDQLMEAWEKKVDRIENNPRRKAKESKTREYYEKQFPEIRKQREQQERFQRVGQRGAGLSATIARSEHEISEIIDGLSEQENNEKQMRQLSVIPPMMFDAEQRRVKFINMNGLMEDPMKVYKDRQFMNVWTDHEKEIFKDKFIQHPKNFGLIASYLERKSVPDCVLYYYLTKKNENYKALVRRNYGKRRGRNQQIARPSQEEKVEEKEEDKAEKTEKKEEEKKDEEEKDEKEDSKENTKEKDKIDGTAEETEEREQATPRGRKTANSQGRRKGRITRSMTNEAAAASAAAAAATEEPPPPLPPPPEPISTEPVETSRWTEEEMEVAKKGLVEHGRNWAAIAKMVGTKSEAQCKNFYFNYKRRHNLDNLLQQHKQKTSRKPREERDVSQCESVASTVSAQEDEDIEASNEEENPEDSEGISKF

SEQ ID NO: 907152 - protein, 141 aa, Homo sapiens
MHVCFLIGLSEISGNVFDSLSGSVSSRGHSFADPASNLGLEDIIRKALMGSFDDKVEDHGVVMSQPMGVVPGTANTSVVTSGETRREEGDPSPHSGTAFILVLFCCFSPKKPVYFPNSDASLRHFIYVFMCSESPLRVSVT

SEQ ID NO: 907153 - protein, 528 aa, Homo sapiens
MFGAAGRQPIGAPAAGNSWHFSRTMEELVHDLVSALEESSEQARGGFAETGDHSRSISCPLKRQARKRRGRKRRSYNVHHPWETGHCLSEGSDSSLEEPSKDYRENHNNNKKDHSDSDDQMLVAKRRPSSNLNNNVRGKRPLWHESDFAVDNVGNRTLRRRRKVKRMAVDLPQDISNKRTMTQPPEGCRDQDMDSDRAYQYQEFTKNKVKKRKLKIIRQGPKIQDEGVVLESEETNQTNKDKMECEEQKVSDELMSESDSSSLSSTDAGLFTNDEGRQGDDEQSDWFYEKESGGACGITGVVPWWEKEDPTELDKNVPDPVFESILTGSFPLMSHPSRRGFQARLSRLHGMSSKNIKKSGGTPTSMVPIPGPVGNKRMVHFSPDSHHHDHWFSPGARTEHDQHQLLRDNRAERGHKKNCSVRTASRQTSMHLGSLCTGDIKRRRKAAPLPGPTTAGFVGENAQPILENNIGNRMLQNMGWTPGSGLGRDGKGISEPIQAMQRPKGLGLGFPLPKSTSATTTPNAGKSA

SEQ ID NO: 907154 - protein, 376 aa, Homo sapiens
MFGAAGRQPIGAPAAGNSWHFSRTMEELVHDLVSALEESSEQARGGFAETGDHSRSISCPLKRQARKRRGRKRRSYNVHHPWETGHCLSEGSDSSLEEPSKDYRENHNNNKKDHSDSDDQMLVAKRRPSSNLNNNVRGKRPLWHESDFAVDNVGNRTLRRRRKVKRMAVDLPQDISNKRTMTQPPEGCRDQDMDSDRAYQYQEFTKNKVKKRKLKIIRQGPKIQDEGVVLESEETNQTNKDKMECEEQKVSDELMSESDSSSLSSTDAGLFTNDEGRQGDDEQSDWFYEKESGGACGITGVVPWWEKEDPTELDKNVPDPVFESILTGSFPLMSHPSRRGFQARLSRLHGMSSKNIKKSGGTPTSMATNWTSEIPL

SEQ ID NO: 907155 - protein, 418 aa, Homo sapiens
MFGAAGRQPIGAPAAGNSWHFSRTMEELVHDLVSALEESSEQARGGFAETGDHSRSISCPLKRQARKRRGRKRRSYNVHHPWETGHCLSEGSDSSLEEPSKDYRENHNNNKKDHSDSDDQMLVAKRRPSSNLNNNVRGKRPLWHESDFAVDNVGNRTLRRRRKVKRMAVDLPQDISNKRTMTQPPEGCRDQDMDSDRAYQYQEFTKNKVKKRKLKIIRQGPKIQDEGVVLESEETNQTNKDKMECEEQKVSDELMSESDSSSLSSTDAGLFTNDEGRQGDDEQSDWFYEKESGGACGITGVVPWWEKEDPTELDKNVPDPVFESILTGSFPLMSHPSRRGFQARLSRLHGMSSKNIKKSGGTPTSMVPIPGPVGNKRMVHFSPDSHHHDHWFSPGARTEHDQVTNKGIVSSFGLSPAI

SEQ ID NO: 907156 - protein, 419 aa, Homo sapiens
MFGAAGRQPIGAPAAGNSWHFSRTMEELVHDLVSALEESSEQARGGFAETGDHSRSISCPLKRQARKRRGRKRRSYNVHHPWETGHCLSEGSDSSLEEPSKDYRENHNNNKKDHSDSDDQMLVAKRRPSSNLNNNVRGKRPLWHESDFAVDNVGNRTLRRRRKVKRMAVDLPQDISNKRTMTQPPEGCRDQDMDSDRAYQYQEFTKNKVKKRKLKIIRQGPKIQDEGVVLESEETNQTNKDKMECEEQKVSDELMSESDSSSLSSTDAGLFTNDEGRQGDDEQSDWFYEKESGGACGITGVVPWWEKEDPTELDKNVPDPVFESILTGSFPLMSHPSRRGFQARLSRLHGMSSKNIKKSGGTPTSMVPIPGPVGNKRMVHFSPDSHHHDHWFSPGARTEHDQVRTIVIQKEVTQPLSSI

SEQ ID NO: 907157 - protein, 116 aa, Homo sapiens
MFGAAGRQPIGAPAAGNSWHFSRTMEELVHDLVSALEESSEQARGGFAETGDHSRSISCPLKRQARKRRGRKRRSYNVHHPWETGHCLSEGSDSSLEEQSQKKKVENNQTRTKNPR

SEQ ID NO: 907158 - protein, 528 aa, Homo sapiens; identical to SEQ ID NO: 907153

SEQ ID NO: 907159 - protein, 286 aa, Homo sapiens
MECEEQKVSDELMSESDSSSLSSTDAGLFTNDEGRQGDDEQSDWFYEKESGGACGITGVVPWWEKEDPTELDKNVPDPVFESILTGSFPLMSHPSRRGFQARLSRLHGMSSKNIKKSGGTPTSMVPIPGPVGNKRMVHFSPDSHHHDHWFSPGARTEHDQHQLLRDNRAERGHKKNCSVRTASRQTSMHLGSLCTGDIKRRRKAAPLPGPTTAGFVGENAQPILENNIGNRMLQNMGWTPGSGLGRDGKGISEPIQAMQRPKGLGLGFPLPKSTSATTTPNAGKSA

SEQ ID NO: 907160 - protein, 258 aa, Homo sapiens
MFGAAGRQPIGAPAAGNSWHFSRTMEELVHDLVSALEESSEQARGGFAETGDHSRSISCPLKRQARKRRGRKRRSYNVHHPWETGHCLSEGSDSSLEEPSKDYRENHNNNKKDHSDSDDQMLVAKRRPSSNLNNNVRGKRPLWHESDFAVDNVGNRTLRRRRKVKRMAVDLPQDISNKRTMTQPPEGCRDQDMDSDRAYQYQEFTKNKVKKRKLKIIRQGPKIQDEGVVLESEETNQTNKDKMECEEQKVSDELMSER

SEQ ID NO: 907161 - protein, 219 aa, Homo sapiens
MNNGGKAEKENTPSEANLQEEEVRTLFVSGLPLDIKPRELYLLFRPFKGYEGSLIKLTSKQPVGFVSFDSRSEAEAAKNALNGIRFDPEIPQTLRLEFAKANTKMAKNKLVGTPNPSTPLPNTVPQFIAREPYELTVPALYPSSPEVWAPYPLYPAELAPALPPPAFTYPASLHAQCFSPEAKPNTPVFCPLLQQIRFVSGNVFVTYQPTADQQRELPC

SEQ ID NO: 907162 - protein, 196 aa, Homo sapiens
MNNGGKAEKENTPSEANLQEEEVRTLFVSGLPLDIKPRELYLLFRPFKGYEGSLIKLTSKQPVGFVSFDSRSEAEAAKNALNGIRFDPEIPQTLRLEFAKANTKMAKNKLVGTPNPSTPLPNTVPQFIAREPYELTVPALYPSSPEVWAPYPLYPAELAPALPPPAFTYPASLHAQMRWLPPSEATSQGWKSRQFC

SEQ ID NO: 907163 - protein, 234 aa, Homo sapiens
GRTSGCAAHTGRHCGGGRSESPGPEPAVGSARAPRATVRTLFVSGLPLDIKPRELYLLFRPFKGYEGSLIKLTSKQPVGFVSFDSRSEAEAAKNALNGIRFDPEIPQTLRLEFAKANTKMAKNKLVGTPNPSTPLPNTVPQFIAREPYELTVPALYPSSPEVWAPYPLYPAELAPALPPPAFTYPASLHAQCFSPEAKPNTPVFCPLLQQIRFVSGNVFVTYQPTADQQRELPC

SEQ ID NO: 907164 - protein, 204 aa, Homo sapiens
MNNGGKAEKENTPSEANLQEEEVRTLFVSGLPLDIKPRELYLLFRPFKGYEGSLIKLTSKQPVGFVSFDSRSEAEAAKNALNGIRFDPEIPQTLRLEFAKANTKMAKNKLVGTPNPSTPLPNTVPQFIAREPYELTVPALYPSSPEVWAPYPLYPAELAPALPPPAFTYPASLHAQLCEGQTVRRSHPLSAPSPDSASLAWFPV

SEQ ID NO: 907165 - protein, 201 aa, Homo sapiens
MNNGGKAEKENTPSEANLQEEEVRTLFVSGLPLDIKPRELYLLFRPFKGYEGSLIKLTSKQPVGFVSFDSRSEAEAAKNALNGIRFDPEIPQTLRLEFAKANTKMAKNKLVGTPNPSTPLPNTVPQFIAREPYELTVPALYPSSPEVWAPYPLYPAELAPALPHALAPSLRGYFSGLEVPSVLLNTMSQVCDGGCNLSCGY

SEQ ID NO: 907166 - protein, 260 aa, Homo sapiens
GAGGRRGAGPGRGGGRRFRHGPCPGRSPTVWPGEGGSRERVFLCPRASAGPKLRNSKDFSETFVRTLFVSGLPLDIKPRELYLLFRPFKGYEGSLIKLTSKQPVGFVSFDSRSEAEAAKNALNGIRFDPEIPQTLRLEFAKANTKMAKNKLVGTPNPSTPLPNTVPQFIAREPYELTVPALYPSSPEVWAPYPLYPAELAPALPPPAFTYPASLHAQCFSPEAKPNTPVFCPLLQQIRFVSGNVFVTYQPTADQQRELPC

SEQ ID NO: 907167 - protein, 215 aa, Homo sapiens
QYSCCLLLVLLSDSVPFQVRTLFVSGLPLDIKPRELYLLFRPFKGYEGSLIKLTSKQPVGFVSFDSRSEAEAAKNALNGIRFDPEIPQTLRLEFAKANTKMAKNKLVGTPNPSTPLPNTVPQFIAREPYELTVPALYPSSPEVWAPYPLYPAELAPALPPPAFTYPASLHAQCFSPEAKPNTPVFCPLLQQIRFVSGNVFVTYQPTADQQRELPC

SEQ ID NO: 907168 - protein, 203 aa, Homo sapiens
LNLFFQVRTLFVSGLPLDIKPRELYLLFRPFKGYEGSLIKLTSKQPVGFVSFDSRSEAEAAKNALNGIRFDPEIPQTLRLEFAKANTKMAKNKLVGTPNPSTPLPNTVPQFIAREPYELTVPALYPSSPEVWAPYPLYPAELAPALPPPAFTYPASLHAQCFSPEAKPNTPVFCPLLQQIRFVSGNVFVTYQPTADQQRELPC

SEQ ID NO: 907169 - protein, 219 aa, Homo sapiens; identical to SEQ ID NO: 907161

SEQ ID NO: 907170 - protein, 219 aa, Homo sapiens; identical to SEQ ID NO: 907161

SEQ ID NO: 907171 - protein, 224 aa, Homo sapiens
MNNGGKAEKENTPSEANLQEEEVRTLFVSGLPLDIKPRELYLLFRPFKGYEGSLIKLTSKQPVGFVSFDSRSEAEAAKNALNGIRFDPEIPQTLRLEFAKANTKMAKNKLVGTPNPSTPLPNTVPQFIAREPYELTVPALYPSSPEVWAPYPLYPAELAPALPPPAFTYPASLHAQVIDTHRPGLHSLHHQSFQTWFPRAHHTTNTYPANRSTLKRLMIPSKSS

SEQ ID NO: 907172 - protein, 224 aa, Homo sapiens; identical to SEQ ID NO: 907171

SEQ ID NO: 907173 - protein, 179 aa, Homo sapiens
MNNGGKAEKENTPSEANLQEEEVRTLFVSGLPLDIKPRELYLLFRPFKGYEGSLIKLTSKQPVGFVSFDSRSEAEAAKNALNGIRFDPEIPQTLRLEFAKANTKMAKNKLVGTPNPSTPLPNTVPQFIAREPYELTVPALYPSSPEVWAPYPLYPAELAPALPPPAFTYPASLHAQETL

SEQ ID NO: 907174 - protein, 143 aa, Homo sapiens
MNNGGKAEKENTPSEANLQEEEVRTLFVSGLPLDIKPRELYLLFRPFKGYEGSLIKLTSKQPVGFVSFDSRSEAEAAKNALNGIRFDPEIPQTLRLEFAKANTKMAKNKLVGTPNPSTPLPNTVPQFIAREPLGGANEHGERQ

SEQ ID NO: 907175 - protein, 145 aa, Homo sapiens
MNNGGKAEKENTPSEANLQEEEVRTLFVSGLPLDIKPRELYLLFRPFKGYEGSLIKLTSKQPVGFVSFDSRSEAEAAKNALNGIRFDPEIPQTLRLEFAKANTKMAKNKLVGTPNPSTPLPNTFANAERKSIFTFSSMFVLQHFH

SEQ ID NO: 907176 - protein, 202 aa, Homo sapiens
MNNGGKAEKENTPSEANLQEEEVRTLFVSGLPLDIKPRELYLLFRPFKGYEGSLIKLTSKQPVGFVSFDSRSEAEAAKNALNGIRFDPEIPQTLRLEFAKANTKMAKNKLVGTPNPSTPLPNTGSIAYDEAYYCSVRLVPCISYATDQATDTSLERGTLGTQEDLGTRFTYIALSIRMHACHEQSRRRFYSMRAKRPEHTFV

SEQ ID NO: 907177 - protein, 196 aa, Homo sapiens; identical to SEQ ID NO: 907162

SEQ ID NO: 907178 - protein, 237 aa, Homo sapiens
SEPKLSKRDVVYKTVKTVKRGGFIMSEIEEKKLRWPEMIQVRTLFVSGLPLDIKPRELYLLFRPFKGYEGSLIKLTSKQPVGFVSFDSRSEAEAAKNALNGIRFDPEIPQTLRLEFAKANTKMAKNKLVGTPNPSTPLPNTVPQFIAREPYELTVPALYPSSPEVWAPYPLYPAELAPALPPPAFTYPASLHAQCFSPEAKPNTPVFCPLLQQIRFVSGNVFVTYQPTADQQRELPC

SEQ ID NO: 907179 - protein, 147 aa, Homo sapiens
RGPRIRDEEKGIRFDPEIPQTLRLEFAKANTKMAKNKLVGTPNPSTPLPNTVPQFIAREPYELTVPALYPSSPEVWAPYPLYPAELAPALPPPAFTYPASLHAQCFSPEAKPNTPVFCPLLQQIRFVSGNVFVTYQPTADQQRELPC

SEQ ID NO: 907180 - protein, 123 aa, Homo sapiens
PSCHSGVRLDQADESLKTGCTLVPNPAGTCASENVRAVCESWSERLGQGFLLAVTCTESRTMPSTVQLSSPGSPPPPVSPVKHRHVLASSGLSAPTHTQAAPVTPLRSTLTQCTQTHHPLLCV

SEQ ID NO: 907181 - protein, 115 aa, Homo sapiens
MAKNKLVGTPNPSTPLPNTVPQFIAREPYELTVPALYPSSPEVWAPYPLYPAELAPALPPPAFTYPASLHAQCFSPEAKPNTPVFCPLLQQIRFVSGNVFVTYQPTADQQRELPC

SEQ ID NO: 907182 - protein, 219 aa, Homo sapiens; identical to SEQ ID NO: 907161

SEQ ID NO: 907183 - protein, 219 aa, Homo sapiens; identical to SEQ ID NO: 907161

SEQ ID NO: 907184 - protein, 196 aa, Homo sapiens; identical to SEQ ID NO: 907162

SEQ ID NO: 907185 - protein, 179 aa, Homo sapiens; identical to SEQ ID NO: 907173

SEQ ID NO: 907186 - protein, 196 aa, Homo sapiens; identical to SEQ ID NO: 907162

SEQ ID NO: 907187 - protein, 136 aa, Homo sapiens
MNNGGKAEKENTPSEANLQEEEVRTLFVSGLPLDIKPRELYLLFRPFKGYEGSLIKLTSKQPVGFVSFDSRSEAEAAKNALNGIRFDPEIPQTLRLEFAKANTKMAKNKLVGTPNPSTPLPNTVPQFIAREPLFLS

SEQ ID NO: 907188 - protein, 123 aa, Homo sapiens; identical to SEQ ID NO: 907180

SEQ ID NO: 907189 - protein, 1145 aa, Homo sapiens
MTMYLWLKLLAFGFAFLDTEVFVTGQSPTPSPTDAYLNASETTTLSPSGSAVISTTTIATTPSKPTCDEKYANITVDYLYNKETKLFTAKLNVNENVECGNNTCTNNEVHNLTECKNASVSISHNSCTAPDKTLILDVPPGVEKFQLHDCTQVEKADTTICLKWKNIETFTCDTQNITYRFQCGNMIFDNKEIKLENLEPEHEYKCDSEILYNNHKFTNASKIIKTDFGSPGEPQIIFCRSEAAHQGVITWNPPQRSFHNFTLCYIKETEKDCLNLDKNLIKYDLQNLKPYTKYVLSLHAYIIAKVQRNGSAAMCHFTTKSAPPSQVWNMTVSMTSDNSMHVKCRPPRDRNGPHERYHLEVEAGNTLVRNESHKNCDFRVKDLQYSTDYTFKAYFHNGDYPGEPFILHHSTSYNSKALIAFLAFLIIVTSIALLVVLYKIYDLHKKRSCNLDEQQELVERDDEKQLMNVEPIHADILLETYKRKIADEGRLFLAEFQSIPRVFSKFPIKEARKPFNQNKNRYVDILPYDYNRVELSEINGDAGSNYINASYIDGFKEPRKYIAAQGPRDETVDDFWRMIWEQKATVIVMVTRCEEGNRNKCAEYWPSMEEGTRAFGDVVVKINQHKRCPDYIIQKLNIVNKKEKATGREVTHIQFTSWPDHGVPEDPHLLLKLRRRVNAFSNFFSGPIVVHCSAGVGRTGTYIGIDAMLEGLEAENKVDVYGYVVKLRRQRCLMVQVEAQYILIHQALVEYNQFGETEVNLSELHPYLHNMKKRDPPSEPSPLEAEFQRLPSYRSWRTQHIGNQEENKSKNRNSNVIPYDYNRVPLKHELEMSKESEHDSDESSDDDSDSEEPSKYINASFIMSYWKPEVMIAAQGPLKETIGDFWQMIFQRKVKVIVMLTELKHGDQEICAQYWGEGKQTYGDIEVDLKDTDKSSTYTLRVFELRHSKRKDSRTVYQYQYTNWSVEQLPAEPKELISMIQVVKQKLPQKNSSEGNKHHKSTPLLIHCRDGSQQTGIFCALLNLLESAETEEVVDIFQVVKALRKARPGMVSTFEQYQFLYDVIASTYPAQNGQVKKNNHQEDKIEFDNEVDKVKQDANCVNPLGAPEKLPEAKEQAEGSEPTSGTEGPEHSVNGPASPALNQGS

SEQ ID NO: 907190 - protein, 103 aa, Homo sapiens
MQPSNRRLYRLNRRAPCILCTPPLLSSPDSLALPSIYQFSRLRLHTSCLSPSPPPCDPQKVLQHAHEIIPVGIPVLYVPYRPEPFTSPRETDSRAKPNTFPHW

SEQ ID NO: 907191 - protein, 144 aa, Homo sapiens
VAPWTIICYLPSRRLLSRSNLLRVYRPLHRALSVCAVTRPNQVARAIHNPPSSPSHVQPPLFVPPSPRSITNSLFSLTGPFSHAFQALQKLFPNANGNFNGGNPRDFFGTEGPNFLAFTKKGSQGKAQHLPPLMPTLMPLKQPL

SEQ ID NO: 907192 - protein, 112 aa, Homo sapiens
MPTATIATLLALPLYIHNDQIFPNTVLPYPHLFSCLFFVLYSVGDALYHFILVLLFLFVYRAGFDKRTVNKKVLRDIYSRARNASLPPQQLDTCLSTNHGTQACIYDLTSSQ

SEQ ID NO: 907193 - protein, 104 aa, Homo sapiens
VFYCTSPYQQKEKFRNTQHLLGLNSTYPAQNGQVKKNNHQEDKIEFDNEVDKVKQDANCVNPLGAPEKLPEAKEQAEGSEPTSGTEGPEHSVNGPASPALNQGS

SEQ ID NO: 907194 - protein, 228 aa, Homo sapiens
MTAKCRGGCTKALEYLKSVPSGKMIGGEQSGSCLKYNEAKTHNNPQKGSVRRTVGINQLDGKSQGFFMSIEGPGLFKLSKRKESQVEAHNLPPLNAYHNACKTTTMSPSGSGVISTATIATTPSKPTCDEKYANITVDYLYNKETKLFTAKLNVNENVECGNNTCTNNEVHNLTECKNASVSISHNSCTAPDKTLILDVPPGVEKFQLHDCTQVEKAGGRSLISAPYR

SEQ ID NO: 907195 - protein, 309 aa, Homo sapiens
FSRRLLPHHANHLYEPSHKHPPYSWTLNLPTAALTQTFIMTTYPNHSPHTLPAPPPNNKFATRAYASITTIQERPRFLLTPCRRSLTTGRLNIYTRTKNTSVDQKERSFTTVTINPLTLTPPKIFFYKPLEELTQRALPMGFLDHKGRSLSPVQSRVYHGKAPTPCPREAHLNAYETTTMSPSGSAVISTATIATTPSKPTCDEKYANITVDYLYNKETKLFTAKLNVNENVECGNNTCTNNEVHNLTECKNASVSISHNSCTAPDKTLILDVPPGVEKFQLHDCTQVEKAVQRATPLLLLLYSPLPQH

SEQ ID NO: 907196 - protein, 188 aa, Homo sapiens
MSTVVYRYVQTPAISIIKMMDSDQDTTCAMRHPGVEKFQLHDCTQVEKADTTICLKWKNIETFTCDTQNITYRFQCGNMIFDNKEIKLENLEPEHEYKCDSEILYNNHKFTNASKIIKTDFGSPGEPQIIFCRSEAAHQGVITWNPPQRSFHNFTLCYIKETEKDCLNLDKNLMRQVSFLVSSEGYDN

SEQ ID NO: 907197 - protein, 1306 aa, Homo sapiens
MTMYLWLKLLAFGFAFLDTEVFVTGQSPTPSPTGLTTAKMPSVPLSSDPLPTHTTAFSPASTFERENDFSETTTSLSPDNTSTQVSPDSLDNASAFNTTGVSSVQTPHLPTHADSQTPSAGTDTQTFSGSAANAKLNPTPGSNAISDVPGERSTASTFPTDPVSPLTTTLSLAHHSSAALPARTSNTTITANTSDAYLNASETTTLSPSGSAVISTTTIATTPSKPTCDEKYANITVDYLYNKETKLFTAKLNVNENVECGNNTCTNNEVHNLTECKNASVSISHNSCTAPDKTLILDVPPGVEKFQLHDCTQVEKADTTICLKWKNIETFTCDTQNITYRFQCGNMIFDNKEIKLENLEPEHEYKCDSEILYNNHKFTNASKIIKTDFGSPGEPQIIFCRSEAAHQGVITWNPPQRSFHNFTLCYIKETEKDCLNLDKNLIKYDLQNLKPYTKYVLSLHAYIIAKVQRNGSAAMCHFTTKSAPPSQVWNMTVSMTSDNSMHVKCRPPRDRNGPHERYHLEVEAGNTLVRNESHKNCDFRVKDLQYSTDYTFKAYFHNGDYPGEPFILHHSTSYNSKALIAFLAFLIIVTSIALLVVLYKIYDLHKKRSCNLDEQQELVERDDEKQLMNVEPIHADILLETYKRKIADEGRLFLAEFQSIPRVFSKFPIKEARKPFNQNKNRYVDILPYDYNRVELSEINGDAGSNYINASYIDGFKEPRKYIAAQGPRDETVDDFWRMIWEQKATVIVMVTRCEEGNRNKCAEYWPSMEEGTRAFGDVVVKINQHKRCPDYIIQKLNIVNKKEKATGREVTHIQFTSWPDHGVPEDPHLLLKLRRRVNAFSNFFSGPIVVHCSAGVGRTGTYIGIDAMLEGLEAENKVDVYGYVVKLRRQRCLMVQVEAQYILIHQALVEYNQFGETEVNLSELHPYLHNMKKRDPPSEPSPLEAEFQRLPSYRSWRTQHIGNQEENKSKNRNSNVIPYDYNRVPLKHELEMSKESEHDSDESSDDDSDSEEPSKYINASFIMSYWKPEVMIAAQGPLKETIGDFWQMIFQRKVKVIVMLTELKHGDQEICAQYWGEGKQTYGDIEVDLKDTDKSSTYTLRVFELRHSKRKDSRTVYQYQYTNWSVEQLPAEPKELISMIQVVKQKLPQKNSSEGNKHHKSTPLLIHCRDGSQQTGIFCALLNLLESAETEEVVDIFQVVKALRKARPGMVSTFEQYQFLYDVIASTYPAQNGQVKKNNHQEDKIEFDNEVDKVKQDANCVNPLGAPEKLPEAKEQAEGSEPTSGTEGPEHSVNGPASPALNQGS

SEQ ID NO: 907198 - protein, 1306 aa, Homo sapiens; identical to SEQ ID NO: 907197

SEQ ID NO: 907199 - protein, 1258 aa, Homo sapiens
MTMYLWLKLLAFGFAFLDTEVFVTGQSPTPSPTGLTTAKMPSVPLSSDPLPTHTTAFSPASTFERENDFSETTTSLSPDNTSTQVSPDSLDNASAFNTTGVSSVQTPHLPTHADSQTPSAGTDTQTFSGSAANAKLNPTPGSNAISDAYLNASETTTLSPSGSAVISTTTIATTPSKPTCDEKYANITVDYLYNKETKLFTAKLNVNENVECGNNTCTNNEVHNLTECKNASVSISHNSCTAPDKTLILDVPPGVEKFQLHDCTQVEKADTTICLKWKNIETFTCDTQNITYRFQCGNMIFDNKEIKLENLEPEHEYKCDSEILYNNHKFTNASKIIKTDFGSPGEPQIIFCRSEAAHQGVITWNPPQRSFHNFTLCYIKETEKDCLNLDKNLIKYDLQNLKPYTKYVLSLHAYIIAKVQRNGSAAMCHFTTKSAPPSQVWNMTVSMTSDNSMHVKCRPPRDRNGPHERYHLEVEAGNTLVRNESHKNCDFRVKDLQYSTDYTFKAYFHNGDYPGEPFILHHSTSYNSKALIAFLAFLIIVTSIALLVVLYKIYDLHKKRSCNLDEQQELVERDDEKQLMNVEPIHADILLETYKRKIADEGRLFLAEFQSIPRVFSKFPIKEARKPFNQNKNRYVDILPYDYNRVELSEINGDAGSNYINASYIDGFKEPRKYIAAQGPRDETVDDFWRMIWEQKATVIVMVTRCEEGNRNKCAEYWPSMEEGTRAFGDVVVKINQHKRCPDYIIQKLNIVNKKEKATGREVTHIQFTSWPDHGVPEDPHLLLKLRRRVNAFSNFFSGPIVVHCSAGVGRTGTYIGIDAMLEGLEAENKVDVYGYVVKLRRQRCLMVQVEAQYILIHQALVEYNQFGETEVNLSELHPYLHNMKKRDPPSEPSPLEAEFQRLPSYRSWRTQHIGNQEENKSKNRNSNVIPYDYNRVPLKHELEMSKESEHDSDESSDDDSDSEEPSKYINASFIMSYWKPEVMIAAQGPLKETIGDFWQMIFQRKVKVIVMLTELKHGDQEICAQYWGEGKQTYGDIEVDLKDTDKSSTYTLRVFELRHSKRKDSRTVYQYQYTNWSVEQLPAEPKELISMIQVVKQKLPQKNSSEGNKHHKSTPLLIHCRDGSQQTGIFCALLNLLESAETEEVVDIFQVVKALRKARPGMVSTFEQYQFLYDVIASTYPAQNGQVKKNNHQEDKIEFDNEVDKVKQDANCVNPLGAPEKLPEAKEQAEGSEPTSGTEGPEHSVNGPASPALNQGS

SEQ ID NO: 907200 - protein, 1263 aa, Homo sapiens
APTSAHHGQPVAPRTSKYRPAHRHLHRTPRTPLHSHSAPSLRVTRSTMTQTRRSLNAPRTLSSRISASSSILRVNLVLSSPDLRPTTTTGLVHRSIFDHRSSIALENVFFRWPLAKIARGNIQGVVLAIKAGACHCPKKGIPGQSPTPSPTDAYLNASETTTLSPSGSAVISTTTIATTPSKPTCDEKYANITVDYLYNKETKLFTAKLNVNENVECGNNTCTNNEVHNLTECKNASVSISHNSCTAPDKTLILDVPPGVEKFQLHDCTQVEKADTTICLKWKNIETFTCDTQNITYRFQCGNMIFDNKEIKLENLEPEHEYKCDSEILYNNHKFTNASKIIKTDFGSPGEPQIIFCRSEAAHQGVITWNPPQRSFHNFTLCYIKETEKDCLNLDKNLIKYDLQNLKPYTKYVLSLHAYIIAKVQRNGSAAMCHFTTKSAPPSQVWNMTVSMTSDNSMHVKCRPPRDRNGPHERYHLEVEAGNTLVRNESHKNCDFRVKDLQYSTDYTFKAYFHNGDYPGEPFILHHSTSYNSKALIAFLAFLIIVTSIALLVVLYKIYDLHKKRSCNLDEQQELVERDDEKQLMNVEPIHADILLETYKRKIADEGRLFLAEFQSIPRVFSKFPIKEARKPFNQNKNRYVDILPYDYNRVELSEINGDAGSNYINASYIDGFKEPRKYIAAQGPRDETVDDFWRMIWEQKATVIVMVTRCEEGNRNKCAEYWPSMEEGTRAFGDVVVKINQHKRCPDYIIQKLNIVNKKEKATGREVTHIQFTSWPDHGVPEDPHLLLKLRRRVNAFSNFFSGPIVVHCSAGVGRTGTYIGIDAMLEGLEAENKVDVYGYVVKLRRQRCLMVQVEAQYILIHQALVEYNQFGETEVNLSELHPYLHNMKKRDPPSEPSPLEAEFQRLPSYRSWRTQHIGNQEENKSKNRNSNVIPYDYNRVPLKHELEMSKESEHDSDESSDDDSDSEEPSKYINASFIMSYWKPEVMIAAQGPLKETIGDFWQMIFQRKVKVIVMLTELKHGDQEICAQYWGEGKQTYGDIEVDLKDTDKSSTYTLRVFELRHSKRKDSRTVYQYQYTNWSVEQLPAEPKELISMIQVVKQKLPQKNSSEGNKHHKSTPLLIHCRDGSQQTGIFCALLNLLESAETEEVVDIFQVVKALRKARPGMVSTFEQYQFLYDVIASTYPAQNGQVKKNNHQEDKIEFDNEVDKVKQDANCVNPLGAPEKLPEAKEQAEGSEPTSGTEGPEHSVNGPASPALNQGS

SEQ ID NO: 907201 - protein, 1358 aa, Homo sapiens
APTSAHHGQPVAPRTSKYRPAHRHLHRTPRTPLHSHSAPSLRVTRSTMTQTRRSLNAPRTLSSRISASSSILRVNLVLSSPDLRPTTTTGLVHRSIFDHRSSIALENVFFRWPLAKIARGNIQGVVLAIKAGACHCPKKGIPGQSPTPSPTGVSSVQTPHLPTHADSQTPSAGTDTQTFSGSAANAKLNPTPGSNAISDVPGERSTASTFPTDPVSPLTTTLSLAHHSSAALPARTSNTTITANTSDAYLNASETTTLSPSGSAVISTTTIATTPSKPTCDEKYANITVDYLYNKETKLFTAKLNVNENVECGNNTCTNNEVHNLTECKNASVSISHNSCTAPDKTLILDVPPGVEKFQLHDCTQVEKADTTICLKWKNIETFTCDTQNITYRFQCGNMIFDNKEIKLENLEPEHEYKCDSEILYNNHKFTNASKIIKTDFGSPGEPQIIFCRSEAAHQGVITWNPPQRSFHNFTLCYIKETEKDCLNLDKNLIKYDLQNLKPYTKYVLSLHAYIIAKVQRNGSAAMCHFTTKSAPPSQVWNMTVSMTSDNSMHVKCRPPRDRNGPHERYHLEVEAGNTLVRNESHKNCDFRVKDLQYSTDYTFKAYFHNGDYPGEPFILHHSTSYNSKALIAFLAFLIIVTSIALLVVLYKIYDLHKKRSCNLDEQQELVERDDEKQLMNVEPIHADILLETYKRKIADEGRLFLAEFQSIPRVFSKFPIKEARKPFNQNKNRYVDILPYDYNRVELSEINGDAGSNYINASYIDGFKEPRKYIAAQGPRDETVDDFWRMIWEQKATVIVMVTRCEEGNRNKCAEYWPSMEEGTRAFGDVVVKINQHKRCPDYIIQKLNIVNKKEKATGREVTHIQFTSWPDHGVPEDPHLLLKLRRRVNAFSNFFSGPIVVHCSAGVGRTGTYIGIDAMLEGLEAENKVDVYGYVVKLRRQRCLMVQVEAQYILIHQALVEYNQFGETEVNLSELHPYLHNMKKRDPPSEPSPLEAEFQRLPSYRSWRTQHIGNQEENKSKNRNSNVIPYDYNRVPLKHELEMSKESEHDSDESSDDDSDSEEPSKYINASFIMSYWKPEVMIAAQGPLKETIGDFWQMIFQRKVKVIVMLTELKHGDQEICAQYWGEGKQTYGDIEVDLKDTDKSSTYTLRVFELRHSKRKDSRTVYQYQYTNWSVEQLPAEPKELISMIQVVKQKLPQKNSSEGNKHHKSTPLLIHCRDGSQQTGIFCALLNLLESAETEEVVDIFQVVKALRKARPGMVSTFEQYQFLYDVIASTYPAQNGQVKKNNHQEDKIEFDNEVDKVKQDANCVNPLGAPEKLPEAKEQAEGSEPTSGTEGPEHSVNGPASPALNQGS

SEQ ID NO: 907202 - protein, 1101 aa, Homo sapiens
MSPSGSGVISTATIATTPSKPTCDEKYANITVDYLYNKETKLFTAKLNVNENVECGNNTCTNNEVHNLTECKNASVSISHNSCTAPDKTLILDVPPGVEKFQLHDCTQVEKADTTICLKWKNIETFTCDTQNITYRFQCGNMIFDNKEIKLENLEPEHEYKCDSEILYNNHKFTNASKIIKTDFGSPGEPQIIFCRSEAAHQGVITWNPPQRSFHNFTLCYIKETEKDCLNLDKNLIKYDLQNLKPYTKYVLSLHAYIIAKVQRNGSAAMCHFTTKSAPPSQVWNMTVSMTSDNSMHVKCRPPRDRNGPHERYHLEVEAGNTLVRNESHKNCDFRVKDLQYSTDYTFKAYFHNGDYPGEPFILHHSTSYNSKALIAFLAFLIIVTSIALLVVLYKIYDLHKKRSCNLDEQQELVERDDEKQLMNVEPIHADILLETYKRKIADEGRLFLAEFQSIPRVFSKFPIKEARKPFNQNKNRYVDILPYDYNRVELSEINGDAGSNYINASYIDGFKEPRKYIAAQGPRDETVDDFWRMIWEQKATVIVMVTRCEEGNRNKCAEYWPSMEEGTRAFGDVVVKINQHKRCPDYIIQKLNIVNKKEKATGREVTHIQFTSWPDHGVPEDPHLLLKLRRRVNAFSNFFSGPIVVHCSAGVGRTGTYIGIDAMLEGLEAENKVDVYGYVVKLRRQRCLMVQVEAQYILIHQALVEYNQFGETEVNLSELHPYLHNMKKRDPPSEPSPLEAEFQRLPSYRSWRTQHIGNQEENKSKNRNSNVIPYDYNRVPLKHELEMSKESEHDSDESSDDDSDSEEPSKYINASFIMSYWKPEVMIAAQGPLKETIGDFWQMIFQRKVKVIVMLTELKHGDQEICAQYWGEGKQTYGDIEVDLKDTDKSSTYTLRVFELRHSKRKDSRTVYQYQYTNWSVEQLPAEPKELISMIQVVKQKLPQKNSSEGNKHHKSTPLLIHCRDGSQQTGIFCALLNLLESAETEEVVDIFQVVKALRKARPGMVSTFEQYQFLYDVIASTYPAQNGQVKKNNHQEDKIEFDNEVDKVKQDANCVNPLGAPEKLPEAKEQAEGSEPTSGTEGPEHSVNGPASPALNQGS

SEQ ID NO: 907203 - protein, 1050 aa, Homo sapiens
MNGDPNCAKAIKGNTVTEGKKAVRFPYIINHGPARVKTLRLQVPPGVEKFQLHDCTQVEKADTTICLKWKNIETFTCDTQNITYRFQCGNMIFDNKEIKLENLEPEHEYKCDSEILYNNHKFTNASKIIKTDFGSPGEPQIIFCRSEAAHQGVITWNPPQRSFHNFTLCYIKETEKDCLNLDKNLIKYDLQNLKPYTKYVLSLHAYIIAKVQRNGSAAMCHFTTKSAPPSQVWNMTVSMTSDNSMHVKCRPPRDRNGPHERYHLEVEAGNTLVRNESHKNCDFRVKDLQYSTDYTFKAYFHNGDYPGEPFILHHSTSYNSKALIAFLAFLIIVTSIALLVVLYKIYDLHKKRSCNLDEQQELVERDDEKQLMNVEPIHADILLETYKRKIADEGRLFLAEFQSIPRVFSKFPIKEARKPFNQNKNRYVDILPYDYNRVELSEINGDAGSNYINASYIDGFKEPRKYIAAQGPRDETVDDFWRMIWEQKATVIVMVTRCEEGNRNKCAEYWPSMEEGTRAFGDVVVKINQHKRCPDYIIQKLNIVNKKEKATGREVTHIQFTSWPDHGVPEDPHLLLKLRRRVNAFSNFFSGPIVVHCSAGVGRTGTYIGIDAMLEGLEAENKVDVYGYVVKLRRQRCLMVQVEAQYILIHQALVEYNQFGETEVNLSELHPYLHNMKKRDPPSEPSPLEAEFQRLPSYRSWRTQHIGNQEENKSKNRNSNVIPYDYNRVPLKHELEMSKESEHDSDESSDDDSDSEEPSKYINASFIMSYWKPEVMIAAQGPLKETIGDFWQMIFQRKVKVIVMLTELKHGDQEICAQYWGEGKQTYGDIEVDLKDTDKSSTYTLRVFELRHSKRKDSRTVYQYQYTNWSVEQLPAEPKELISMIQVVKQKLPQKNSSEGNKHHKSTPLLIHCRDGSQQTGIFCALLNLLESAETEEVVDIFQVVKALRKARPGMVSTFEQYQFLYDVIASTYPAQNGQVKKNNHQEDKIEFDNEVDKVKQDANCVNPLGAPEKLPEAKEQAEGSEPTSGTEGPEHSVNGPASPALNQGS

SEQ ID NO: 907204 - protein, 832 aa, Homo sapiens [sequence omitted]

SEQ ID NO: 907205 - protein, 838 aa, Homo sapiens
MEATPNVSFPQSQRVPPSQVWNMTVSMTSDNSMHVKCRPPRDRNGPHERYHLEVEAGNTLVRNESHKNCDFRVKDLQYSTDYTFKAYFHNGDYPGEPFILHHSTSYNSKALIAFLAFLIIVTSIALLVVLYKIYDLHKKRSCNLDEQQELVERDDEKQLMNVEPIHADILLETYKRKIADEGRLFLAEFQSIPRVFSKFPIKEARKPFNQNKNRYVDILPYDYNRVELSEINGDAGSNYINASYIDGFKEPRKYIAAQGPRDETVDDFWRMIWEQKATVIVMVTRCEEGNRNKCAEYWPSMEEGTRAFGDVVVKINQHKRCPDYIIQKLNIVNKKEKATGREVTHIQFTSWPDHGVPEDPHLLLKLRRRVNAFSNFFSGPIVVHCSAGVGRTGTYIGIDAMLEGLEAENKVDVYGYVVKLRRQRCLMVQVEAQYILIHQALVEYNQFGETEVNLSELHPYLHNMKKRDPPSEPSPLEAEFQRLPSYRSWRTQHIGNQEENKSKNRNSNVIPYDYNRVPLKHELEMSKESEHDSDESSDDDSDSEEPSKYINASFIMSYWKPEVMIAAQGPLKETIGDFWQMIFQRKVKVIVMLTELKHGDQEICAQYWGEGKQTYGDIEVDLKDTDKSSTYTLRVFELRHSKRKDSRTVYQYQYTNWSVEQLPAEPKELISMIQVVKQKLPQKNSSEGNKHHKSTPLLIHCRDGSQQTGIFCALLNLLESAETEEVVDIFQVVKALRKARPGMVSTFEQYQFLYDVIASTYPAQNGQVKKNNHQEDKIEFDNEVDKVKQDANCVNPLGAPEKLPEAKEQAEGSEPTSGTEGPEHSVNGPASPALNQGS

SEQ ID NO: 907206 - protein, 855 aa, Homo sapiens
MPDQALCPEPPPCEQDSTEKAFTWAFSPQRGPYTPVRENDRSPGDPDNSMHVKCRPPRDRNGPHERYHLEVEAGNTLVRNESHKNCDFRVKDLQYSTDYTFKAYFHNGDYPGEPFILHHSTSYNSKALIAFLAFLIIVTSIALLVVLYKIYDLHKKRSCNLDEQQELVERDDEKQLMNVEPIHADILLETYKRKIADEGRLFLAEFQSIPRVFSKFPIKEARKPFNQNKNRYVDILPYDYNRVELSEINGDAGSNYINASYIDGFKEPRKYIAAQGPRDETVDDFWRMIWEQKATVIVMVTRCEEGNRNKCAEYWPSMEEGTRAFGDVVVKINQHKRCPDYIIQKLNIVNKKEKATGREVTHIQFTSWPDHGVPEDPHLLLKLRRRVNAFSNFFSGPIVVHCSAGVGRTGTYIGIDAMLEGLEAENKVDVYGYVVKLRRQRCLMVQVEAQYILIHQALVEYNQFGETEVNLSELHPYLHNMKKRDPPSEPSPLEAEFQRLPSYRSWRTQHIGNQEENKSKNRNSNVIPYDYNRVPLKHELEMSKESEHDSDESSDDDSDSEEPSKYINASFIMSYWKPEVMIAAQGPLKETIGDFWQMIFQRKVKVIVMLTELKHGDQEICAQYWGEGKQTYGDIEVDLKDTDKSSTYTLRVFELRHSKRKDSRTVYQYQYTNWSVEQLPAEPKELISMIQVVKQKLPQKNSSEGNKHHKSTPLLIHCRDGSQQTGIFCALLNLLESAETEEVVDIFQVVKALRKARPGMVSTFEQYQFLYDVIASTYPAQNGQVKKNNHQEDKIEFDNEVDKVKQDANCVNPLGAPEKLPEAKEQAEGSEPTSGTEGPEHSVNGPASPALNQGS

SEQ ID NO: 907207 - protein, 438 aa, Homo sapiens
MLEGLEAENKVDVYGYVVKLRRQRCLMVQVEAQYILIHQALVEYNQFGETEVNLSELHPYLHNMKKRDPPSEPSPLEAEFQRLPSYRSWRTQHIGNQEENKSKNRNSNVIPYDYNRVPLKHELEMSKESEHDSDESSDDDSDSEEPSKYINASFIMSYWKPEVMIAAQGPLKETIGDFWQMIFQRKVKVIVMLTELKHGDQEICAQYWGEGKQTYGDIEVDLKDTDKSSTYTLRVFELRHSKRKDSRTVYQYQYTNWSVEQLPAEPKELISMIQVVKQKLPQKNSSEGNKHHKSTPLLIHCRDGSQQTGIFCALLNLLESAETEEVVDIFQVVKALRKARPGMVSTFEQYQFLYDVIASTYPAQNGQVKKNNHQEDKIEFDNEVDKVKQDANCVNPLGAPEKLPEAKEQAEGSEPTSGTEGPEHSVNGPASPALNQGS

SEQ ID NO: 907208 - protein, 418 aa, Homo sapiens
AAAERLREDRKAQYILIHQALVEYNQFGETEVNLSELHPYLHNMKKRDPPSEPSPLEAEFQRLPSYRSWRTQHIGNQEENKSKNRNSNVIPYDYNRVPLKHELEMSKESEHDSDESSDDDSDSEEPSKYINASFIMSYWKPEVMIAAQGPLKETIGDFWQMIFQRKVKVIVMLTELKHGDQEICAQYWGEGKQTYGDIEVDLKDTDKSSTYTLRVFELRHSKRKDSRTVYQYQYTNWSVEQLPAEPKELISMIQVVKQKLPQKNSSEGNKHHKSTPLLIHCRDGSQQTGIFCALLNLLESAETEEVVDIFQVVKALRKARPGMVSTFEQYQFLYDVIASTYPAQNGQVKKNNHQEDKIEFDNEVDKVKQDANCVNPLGAPEKLPEAKEQAEGSEPTSGTEGPEHSVNGPASPALNQGS

SEQ ID NO: 907209 - protein, 283 aa, Homo sapiens
MTMYLWLKLLAFGFAFLDTEVFVTGQSPTPSPTGVSSVQTPHLPTHADSQTPSAGTDTQTFSGSAANAKLNPTPGSNAISDVPGERSTASTFPTDPVSPLTTTLSLAHHSSAALPARTSNTTITANTSDAYLNASETTTLSPSGSAVISTTTIATTPSKPTCDEKYANITVDYLYNKETKLFTAKLNVNENVECGNNTCTNNEVHNLTECKNASVSISHNSCTAPDKTLILDVPPGVEKFQLHDCTQVEKADTTICLKWKNIETFTCDTQNITYRFQCGKNIT

SEQ ID NO: 907210 - protein, 305 aa, Homo sapiens
ENAHKHDRGTIRRAYPLYPPTNRSTFPLQTETHYSAAILVFLVPSREPRWNYSSFLPKRAAPSLSPKTIPGLVSPLPPRGFSSTKPSTFHNIQNAKPPLGILLAHLPRSPPANAKLNPTPAGNVMSDAYLNASETTTLSPSGSAVISTTTIATTPSKPTCDEKYANITVDYLYNKETKLFTAKLNVNENVECGNNTCTNNEVHNLTECKNASVSISHNSCTAPDKTLILDVPPGVEKFQLHDCTQVEKADTTICLKWKNIETFTCDTQNITYRFQCGNMIFDNKERSARHPPSLVSLHASAVIIK

SEQ ID NO: 907211 - protein, 151 aa, Homo sapiens
MTMYLWLKLLAFGFAFLDTEVFVTGQSPTPSPTGLTTAKMPSVPLSSDPLPTHTTAFSPASTFERENDFSETTTSLSPDNTSTQVSPDSLDNASAFNTTGVSSVQTPHLPTHADSQTPSAGTDTQTFSGSAANAKLNPTPGSNAISGLRVL

SEQ ID NO: 907212 - protein, 82 aa, Homo sapiens
SHAAHAPTHAAAPPRPVYFGAPSAPPRRFSIARQTPHTIRTPAGHQVRVIGHDPTAWNPPKGFSPIPLGYSPVRRSSDLFCR

SEQ ID NO: 907213 - protein, 101 aa, Homo sapiens
YLRSVCVPIAHFARRHGLYSLLPRPAISGQHAGLVVLILFVACALVMAYDLPLQTSQMFFRTPFAFTPAVDPVIFFDHKGPSPSSVQKKDSRAKPNTFPHW

SEQ ID NO: 907214 - protein, 241 aa, Homo sapiens
AINLKVSSAPAKAGMKHGLSQLKGPPSQVWNMTVSMTSDNSMHVKCRPPRDRNGPHERYHLEVEAGNTLVRNESHKNCDFRVKDLQYSTDYTFKAYFHNGDYPGEPFILHHSTSYNSKALIAFLAFLIIVTSIALLVVLYKIYDLHKKRSCNLDEQQELVERDDEKQLMNVEPIHADILLETYKRKIADEGRLFLAEFQSIPRVFSKFPIKEARKPFNQNKNRYVDILPYDNRVNLKRSER

SEQ ID NO: 907215 - protein, 307 aa, Homo sapiens
RTEVLSRYVNVAALTYRLLAYPCTSGLIRVAPVAVLVRAVNSIYRCTLLNNLLPLCFGLPQYGNVFHQALGYRTYRHAHLSLVFQSTAELYICVGKHVYVRINRKDEPVPLSKNEYSRLHGADTFPHVMQPLMPVKAATMSPSGSGVISTATIATTPSKPTCDEKYANITVDYLYNKETKLFTAKLNVNENVECGNNTCTNNEVHNLTECKNASVSISHNSCTAPDKTLILDVPPGVEKFQLHDCTQVEKADTTICLKWKNIETFTCDTQNITYRFQCGNMIFDNKERSARHPPSLVSLHASAVIIK

SEQ ID NO: 907216 - protein, 315 aa, Homo sapiens
PTSCITALNPERCTYNQLEKVRLHRRLLATLDYCLVRRALYRWRNIINCHILYPRTRLTDLDGPNYSTTHNTIYKQNLVLMSLDYRYPPLVSNTPSAKYKRMNKYRYGVELKPSLDTEPLRHISTDEVNSVPYQEKSLLIAIVMYQVFFNIWMHAVIVCPIRKRPQEKTTHLSTLKPDIISVRPTTMSPYGRAIIPSATRVMIPSNPTWNEKYANITVDYLYNKETKLFTAKLNVNENVECGNNTCTNNEVHNLTECKNASVSISHNSCTAPDKTLILDVPPGVEKFQLHDCTQVEKAGAKSRGVPYPRPNTEKN

SEQ ID NO: 907217 - protein, 107 aa, Homo sapiens
MVGSLNGFNVKIHNPVLSANEGVEFSASKVDSQLHGDITNGVVENDGGEIMGVAFSVSGKMGFENNALHTSTWDINYKHVNGTTERLCGRVVTYSSTIGDTPSKPTM

SEQ ID NO: 907218 - protein, 1306 aa, Homo sapiens; identical to SEQ ID NO: 907197

SEQ ID NO: 907219 - protein, 1306 aa, Homo sapiens; identical to SEQ ID NO: 907197

SEQ ID NO: 907220 - protein, 1240 aa, Homo sapiens
MTMYLWLKLLAFGFAFLDTEVFVTGQSPTPSPTGVSSVQTPHLPTHADSQTPSAGTDTQTFSGSAANAKLNPTPGSNAISDVPGERSTASTFPTDPVSPLTTTLSLAHHSSAALPARTSNTTITANTSDAYLNASETTTLSPSGSAVISTTTIATTPSKPTCDEKYANITVDYLYNKETKLFTAKLNVNENVECGNNTCTNNEVHNLTECKNASVSISHNSCTAPDKTLILDVPPGVEKFQLHDCTQVEKADTTICLKWKNIETFTCDTQNITYRFQCGNMIFDNKEIKLENLEPEHEYKCDSEILYNNHKFTNASKIIKTDFGSPGEPQIIFCRSEAAHQGVITWNPPQRSFHNFTLCYIKETEKDCLNLDKNLIKYDLQNLKPYTKYVLSLHAYIIAKVQRNGSAAMCHFTTKSAPPSQVWNMTVSMTSDNSMHVKCRPPRDRNGPHERYHLEVEAGNTLVRNESHKNCDFRVKDLQYSTDYTFKAYFHNGDYPGEPFILHHSTSYNSKALIAFLAFLIIVTSIALLVVLYKIYDLHKKRSCNLDEQQELVERDDEKQLMNVEPIHADILLETYKRKIADEGRLFLAEFQSIPRVFSKFPIKEARKPFNQNKNRYVDILPYDYNRVELSEINGDAGSNYINASYIDGFKEPRKYIAAQGPRDETVDDFWRMIWEQKATVIVMVTRCEEGNRNKCAEYWPSMEEGTRAFGDVVVKINQHKRCPDYIIQKLNIVNKKEKATGREVTHIQFTSWPDHGVPEDPHLLLKLRRRVNAFSNFFSGPIVVHCSAGVGRTGTYIGIDAMLEGLEAENKVDVYGYVVKLRRQRCLMVQVEAQYILIHQALVEYNQFGETEVNLSELHPYLHNMKKRDPPSEPSPLEAEFQRLPSYRSWRTQHIGNQEENKSKNRNSNVIPYDYNRVPLKHELEMSKESEHDSDESSDDDSDSEEPSKYINASFIMSYWKPEVMIAAQGPLKETIGDFWQMIFQRKVKVIVMLTELKHGDQEICAQYWGEGKQTYGDIEVDLKDTDKSSTYTLRVFELRHSKRKDSRTVYQYQYTNWSVEQLPAEPKELISMIQVVKQKLPQKNSSEGNKHHKSTPLLIHCRDGSQQTGIFCALLNLLESAETEEVVDIFQVVKALRKARPGMVSTFEQYQFLYDVIASTYPAQNGQVKKNNHQEDKIEFDNEVDKVKQDANCVNPLGAPEKLPEAKEQAEGSEPTSGTEGPEHSVNGPASPALNQGS

SEQ ID NO: 907221 - protein, 1166 aa, Homo sapiens [sequence omitted]

SEQ ID NO: 907222 - protein, 1214 aa, Homo sapiens
RLAATARNRNSRRCVRITSAKLPRQTRPRTPDSPANNGPLSSLYDVYPCEPPPSPTGVFLAMSHHPPPYPDPKTPFLALARGHTTASRPIYDHLLPRPAIFFKGLPLSFEIPTMSPSGSAVISTATIATTPSKPTCDEKYANITVDYLYNKETKLFTAKLNVNENVECGNNTCTNNEVHNLTECKNASVSISHNSCTAPDKTLILDVPPGVEKFQLHDCTQVEKADTTICLKWKNIETFTCDTQNITYRFQCGNMIFDNKEIKLENLEPEHEYKCDSEILYNNHKFTNASKIIKTDFGSPGEPQIIFCRSEAAHQGVITWNPPQRSFHNFTLCYIKETEKDCLNLDKNLIKYDLQNLKPYTKYVLSLHAYIIAKVQRNGSAAMCHFTTKSAPPSQVWNMTVSMTSDNSMHVKCRPPRDRNGPHERYHLEVEAGNTLVRNESHKNCDFRVKDLQYSTDYTFKAYFHNGDYPGEPFILHHSTSYNSKALIAFLAFLIIVTSIALLVVLYKIYDLHKKRSCNLDEQQELVERDDEKQLMNVEPIHADILLETYKRKIADEGRLFLAEFQSIPRVFSKFPIKEARKPFNQNKNRYVDILPYDYNRVELSEINGDAGSNYINASYIDGFKEPRKYIAAQGPRDETVDDFWRMIWEQKATVIVMVTRCEEGNRNKCAEYWPSMEEGTRAFGDVVVKINQHKRCPDYIIQKLNIVNKKEKATGREVTHIQFTSWPDHGVPEDPHLLLKLRRRVNAFSNFFSGPIVVHCSAGVGRTGTYIGIDAMLEGLEAENKVDVYGYVVKLRRQRCLMVQVEAQYILIHQALVEYNQFGETEVNLSELHPYLHNMKKRDPPSEPSPLEAEFQRLPSYRSWRTQHIGNQEENKSKNRNSNVIPYDYNRVPLKHELEMSKESEHDSDESSDDDSDSEEPSKYINASFIMSYWKPEVMIAAQGPLKETIGDFWQMIFQRKVKVIVMLTELKHGDQEICAQYWGEGKQTYGDIEVDLKDTDKSSTYTLRVFELRHSKRKDSRTVYQYQYTNWSVEQLPAEPKELISMIQVVKQKLPQKNSSEGNKHHKSTPLLIHCRDGSQQTGIFCALLNLLESAETEEVVDIFQVVKALRKARPGMVSTFEQYQFLYDVIASTYPAQNGQVKKNNHQEDKIEFDNEVDKVKQDANCVNPLGAPEKLPEAKEQAEGSEPTSGTEGPEHSVNGPASPALNQGS

SEQ ID NO: 907223 - protein, 849 aa, Homo sapiens
MFIIQRFTLQKSTVMKGSMGISNLKVSPSQVWNMTVSMTSDNSMHVKCRPPRDRNGPHERYHLEVEAGNTLVRNESHKNCDFRVKDLQYSTDYTFKAYFHNGDYPGEPFILHHSTSYNSKALIAFLAFLIIVTSIALLVVLYKIYDLHKKRSCNLDEQQELVERDDEKQLMNVEPIHADILLETYKRKIADEGRLFLAEFQSIPRVFSKFPIKEARKPFNQNKNRYVDILPYDYNRVELSEINGDAGSNYINASYIDGFKEPRKYIAAQGPRDETVDDFWRMIWEQKATVIVMVTRCEEGNRNKCAEYWPSMEEGTRAFGDVVVKINQHKRCPDYIIQKLNIVNKKEKATGREVTHIQFTSWPDHGVPEDPHLLLKLRRRVNAFSNFFSGPIVVHCSAGVGRTGTYIGIDAMLEGLEAENKVDVYGYVVKLRRQRCLMVQVEAQYILIHQALVEYNQFGETEVNLSELHPYLHNMKKRDPPSEPSPLEAEFQRLPSYRSWRTQHIGNQEENKSKNRNSNVIPYDYNRVPLKHELEMSKESEHDSDESSDDDSDSEEPSKYINASFIMSYWKPEVMIAAQGPLKETIGDFWQMIFQRKVKVIVMLTELKHGDQEICAQYWGEGKQTYGDIEVDLKDTDKSSTYTLRVFELRHSKRKDSRTVYQYQYTNWSVEQLPAEPKELISMIQVVKQKLPQKNSSEGNKHHKSTPLLIHCRDGSQQTGIFCALLNLLESAETEEVVDIFQVVKALRKARPGMVSTFEQYQFLYDVIASTYPAQNGQVKKNNHQEDKIEFDNEVDKVKQDANCVNPLGAPEKLPEAKEQAEGSEPTSGTEGPEHSVNGPASPALNQGS

SEQ ID NO: 907224 - protein, 847 aa, Homo sapiens
AINLKVSSAPAKAGMKHGLSQLKGPPSQVWNMTVSMTSDNSMHVKCRPPRDRNGPHERYHLEVEAGNTLVRNESHKNCDFRVKDLQYSTDYTFKAYFHNGDYPGEPFILHHSTSYNSKALIAFLAFLIIVTSIALLVVLYKIYDLHKKRSCNLDEQQELVERDDEKQLMNVEPIHADILLETYKRKIADEGRLFLAEFQSIPRVFSKFPIKEARKPFNQNKNRYVDILPYDYNRVELSEINGDAGSNYINASYIDGFKEPRKYIAAQGPRDETVDDFWRMIWEQKATVIVMVTRCEEGNRNKCAEYWPSMEEGTRAFGDVVVKINQHKRCPDYIIQKLNIVNKKEKATGREVTHIQFTSWPDHGVPEDPHLLLKLRRRVNAFSNFFSGPIVVHCSAGVGRTGTYIGIDAMLEGLEAENKVDVYGYVVKLRRQRCLMVQVEAQYILIHQALVEYNQFGETEVNLSELHPYLHNMKKRDPPSEPSPLEAEFQRLPSYRSWRTQHIGNQEENKSKNRNSNVIPYDYNRVPLKHELEMSKESEHDSDESSDDDSDSEEPSKYINASFIMSYWKPEVMIAAQGPLKETIGDFWQMIFQRKVKVIVMLTELKHGDQEICAQYWGEGKQTYGDIEVDLKDTDKSSTYTLRVFELRHSKRKDSRTVYQYQYTNWSVEQLPAEPKELISMIQVVKQKLPQKNSSEGNKHHKSTPLLIHCRDGSQQTGIFCALLNLLESAETEEVVDIFQVVKALRKARPGMVSTFEQYQFLYDVIASTYPAQNGQVKKNNHQEDKIEFDNEVDKVKQDANCVNPLGAPEKLPEAKEQAEGSEPTSGTEGPEHSVNGPASPALNQGS

SEQ ID NO: 907225 - protein, 868 aa, Homo sapiens
MYNARSIALENDNRIGNRFFCRRLIRAKVTYNIGPKWAIPNYNAPPKPGGDTWCSLVQQVRGEGGKVKASQGLLGPPRAYQFGELKLKILGLRIVCIRIANSLKKILNFDSSTFKAYFHNGDYPGEPFILHHSTSYNSKALIAFLAFLIIVTSIALLVVLYKIYDLHKKRSCNLDEQQELVERDDEKQLMNVEPIHADILLETYKRKIADEGRLFLAEFQSIPRVFSKFPIKEARKPFNQNKNRYVDILPYDYNRVELSEINGDAGSNYINASYIDGFKEPRKYIAAQGPRDETVDDFWRMIWEQKATVIVMVTRCEEGNRNKCAEYWPSMEEGTRAFGDVVVKINQHKRCPDYIIQKLNIVNKKEKATGREVTHIQFTSWPDHGVPEDPHLLLKLRRRVNAFSNFFSGPIVVHCSAGVGRTGTYIGIDAMLEGLEAENKVDVYGYVVKLRRQRCLMVQVEAQYILIHQALVEYNQFGETEVNLSELHPYLHNMKKRDPPSEPSPLEAEFQRLPSYRSWRTQHIGNQEENKSKNRNSNVIPYDYNRVPLKHELEMSKESEHDSDESSDDDSDSEEPSKYINASFIMSYWKPEVMIAAQGPLKETIGDFWQMIFQRKVKVIVMLTELKHGDQEICAQYWGEGKQTYGDIEVDLKDTDKSSTYTLRVFELRHSKRKDSRTVYQYQYTNWSVEQLPAEPKELISMIQVVKQKLPQKNSSEGNKHHKSTPLLIHCRDGSQQTGIFCALLNLLESAETEEVVDIFQVVKALRKARPGMVSTFEQYQFLYDVIASTYPAQNGQVKKNNHQEDKIEFDNEVDKVKQDANCVNPLGAPEKLPEAKEQAEGSEPTSGTEGPEHSVNGPASPALNQGS

SEQ ID NO: 907226 - protein, 102 aa, Homo sapiens
APTSAHHGQPVAPRTSKYRPAHRHLHRTPRTPLHSHSAPSLRVTRSTMTQTRRSLNAPRTLSSRISASSSILRVNLVLSSPDLRPTTTTGLVHRSISTTGHP

SEQ ID NO: 907227 - protein, 250 aa, Homo sapiens
MTMYLWLKLLAFGFAFLDTEVFVTGQSPTPSPTGVSSVQTPHLPTHADSQTPSAGTDTQTFSGSAANAKLNPTPGSNAISDVPGERSTASTFPTDPVSPLTTTLSLAHHSSAALPARTSNTTITANTSDAYLNASETTTLSPSGSAVISTTTIATTPSKPTCDEKYANITVDYLYNKETKLFTAKLNVNENVECGNNTCTNNEVHNLTECKNASVSISHNSCTAPDKTLILDVPPGKYQFISFNKFIKTV

SEQ ID NO: 907228 - protein, 102 aa, Homo sapiens; identical to SEQ ID NO: 907226

SEQ ID NO: 907229 - protein, 446 aa, Homo sapiens
MREIVHIQAGQCGNQIGAKFWEVISDEHGIDPTGSYHGDSDLQLERINVYYNEATGNKYVPRAILVDLEPGTMDSVRSGPFGQIFRPDNFVFGQSGAGNNWAKGHYTEGAELVDSVLDVVRKESESCDCLQGFQLTHSLGGGTGSGMGTLLISKIREEYPDRIMNTFSVMPSPKVSDTVVEPYNATLSVHQLVENTDETYCIDNEALYDICFRTLKLTTPTYGDLNHLVSATMSGVTTCLRFPGQLNADLRKLGRVNMVPFPRLHFFMPGFAPLTSRGSQQYRALTVPELTQQMFDSKNMMAACDPRHGRYLTVAAIFRGRMSMKEVDEQMLNVQNKNSSYFVEWIPNNVKTAVCDIPPRGLKMSATFIGNSTAIQELFKRISEQFTAMFRRKAFLHWYTGEGMDEMEFTEAESNMNDLVSEYQQYQDATADEQGEFEEEEGEDEA

SEQ ID NO: 907230 - protein, 446 aa, Homo sapiens; identical to SEQ ID NO: 907229

SEQ ID NO: 907231 - protein, 445 aa, Homo sapiens
MREIVHIQAGQCGNQIGAKFWEVISDEHGIDPTGSYHGDSDLQLERINVYYNEATGNKYVPRAILVDLEPGTMDSVRSGPFGQIFRPDNFVFGQSGAGNNWAKGHYTEGAELVDSVLDVVRKESESCDCLQGFQLTHSLGGGTGSGMGTLLISKIREEYPDRIMNTFSVMPSPKVSDTVVEPYNATLSVHQLVENTDETYCIDNEALYDICFRTLKLTTPTYGDLNHLVSATMSGVTTCLRFPGQLNADLRKLGRVNMVPFPRLHFFMPGFAPLTSRGSQQYRALTVPELTQQMFDSKNMMAACDPRHGRYLTVAAIFRGRMSMKEVDEQMLNVQNKNSSYFVEWIPNNVKTAVCDIPPRGLKMSATFIGNSTAIQELFKRISEQFTAMFRRKAFLHWYTGEGMDEMEFTEAESNMNDLVSEYQQYQDATADEQGEFEEEEGEDD

SEQ ID NO: 907232 - protein, 445 aa, Homo sapiens; identical to SEQ ID NO: 907231

SEQ ID NO: 907233 - protein, 374 aa, Homo sapiens
MDSVRSGPFGQIFRPDNFVFGQSGAGNNWAKGHYTEGAELVDSVLDVVRKESESCDCLQGFQLTHSLGGGTGSGMGTLLISKIREEYPDRIMNTFSVMPSPKVSDTVVEPYNATLSVHQLVENTDETYCIDNEALYDICFRTLKLTTPTYGDLNHLVSATMSGVTTCLRFPGQLNADLRKLGRVNMVPFPRLHFFMPGFAPLTSRGSQQYRALTVPELTQQMFDSKNMMAACDPRHGRYLTVAAIFRGRMSMKEVDEQMLNVQNKNSSYFVEWIPNNVKTAVCDIPPRGLKMSATFIGNSTAIQELFKRISEQFTAMFRRKAFLHWYTGEGMDEMEFTEAESNMNDLVSEYQQYQDATADEQGEFEEEEGEDEA

SEQ ID NO: 907234 - protein, 431 aa, Homo sapiens
MREIVHIQAGQCGNQIGAKFWEVISDEHGIDPTGSYHGDSDLQLERINVYYNEATGNKYVPRAILVDLEPGTMDSVRSGPFGQIFRPDNFVFGQSGAGNNWAKGHYTEGAELVDSVLDVVRKESESCDCLQGFQLTHSLGGGTGSGMGTLLISKIREEYPDRIMNTFSVMPLSVHQLVENTDETYCIDNEALYDICFRTLKLTTPTYGDLNHLVSATMSGVTTCLRFPGQLNADLRKLGRVNMVPFPRLHFFMPGFAPLTSRGSQQYRALTVPELTQQMFDSKNMMAACDPRHGRYLTVAAIFRGRMSMKEVDEQMLNVQNKNSSYFVEWIPNNVKTAVCDIPPRGLKMSATFIGNSTAIQELFKRISEQFTAMFRRKAFLHWYTGEGMDEMEFTEAESNMNDLVSEYQQYQDATADEQGEFEEEEGEDEA

SEQ ID NO: 907235 - protein, 125 aa, Homo sapiens
AHLTPSSASSWTDLRGRSLHAHSWRTDEVSVRAAVSAPSSAASKLELEEALRTILLILLYATVPGNGDELRTYSGVSKYERRLQVMESTEALSNMNDLVSEYQQYQDATADEQGEFEEEEGEDEA

SEQ ID NO: 907236 - protein, 446 aa, Homo sapiens; identical to SEQ ID NO: 907229

SEQ ID NO: 907237 - protein, 380 aa, Homo sapiens
MREIVHIQAGQCGNQIGAKFWEVISDEHGIDPTGSYHGDSDLQLERINVYYNEATGNKYVPRAILVDLEPGTMDSVRSGPFGQIFRPDNFVFGQSGAGNNWAKGHYTEGAELVDSVLDVVRKESESCDCLQGFQLTHSLGGGTGSGMGTLLISKIREEYPDRIMNTFSVMPSPKVSDTVVEPYNATLSVHQLVENTDETYCIDNEALYDICFRTLKLTTPTYGDLNHLVSATMSGVTTCLRFPGQLNADLRKLGRVNMVPFPRLHFFMPGFAPLTSRGSQQYRALTVPELTQQMFDSKNMMAACDRPGVLRGGIFGRCHEGGHDVRGEQTGIWEGPKTEKRGIAPAKLASRKRQGRLEEDRGHDGGKDGKTVQAQEKSQW

SEQ ID NO: 907238 - protein, 374 aa, Homo sapiens; identical to SEQ ID NO: 907233

SEQ ID NO: 907239 - protein, 425 aa, Homo sapiens
MREIVHIQAGQCGNQIGAKFWEVISDEHGIDPTGSYHGDSDLQLERINVYYNEATGNKYVPRAILVDLEPGTMDSVRSGPFGQIFRPDNFVFGQSGAGNNWAKGHYTEGAELVDSVLDVVRKESESCDCLQGFQLTHSLGGGTGSGMGTLLISKIREEYPDRIMNTFSVMPSPKVSDTVVEPYNATLSVHQLVENTDETYCIDLNHLVSATMSGVTTCLRFPGQLNADLRKLGRVNMVPFPRLHFFMPGFAPLTSRGSQQYRALTVPELTQQMFDSKNMMAACDPRHGRYLTVAAIFRGRMSMKEVDEQMLNVQNKNSSYFVEWIPNNVKTAVCDIPPRGLKMSATFIGNSTAIQELFKRISEQFTAMFRRKAFLHWYTGEGMDEMEFTEAESNMNDLVSEYQQYQDATADEQGEFEEEEGEDEA

SEQ ID NO: 907240 - protein, 171 aa, Homo sapiens
MEVRVRIAYLTQRDDAGRNRKVTLTRVWDESSEQLKVVVGSRHRGRAVNTTIGSSTGSSAVFSASVMEHAVVLAWYSVCDRVRLKKVGRDRSVIWDQSRAHLDDDERGERRQRHGEEEKLRRSRRAVETESRNAVAASKREQRDARNDEGDGNQCGHHDCRGEMKQQETKR

SEQ ID NO: 907241 - protein, 171 aa, Homo sapiens
MEVRVRIAYLTQRDDAGRNRKVTLTRVWDESSEQLKVVVGSRHRGRAVNTTIGSETGSSAVFSASVMEHAVVLAWYSVCDRVRLKKVGRDRSVIWDQSRAHLDDDERGERRQRHGEEEKLRRSRRAVETESRNAVAASKREQRDARNDEGDGNQCGHHDCRGRMKQQETKR

SEQ ID NO: 907242 - protein, 138 aa, Homo sapiens
PPPPPPPPAAPHRPARPRKLRLGTRPGVQRCDEGVGGGISPWVRLAFSLPCLLELQRKFEMAGGKAGKDSGKAKTKAVSRSQRAGLQFPVGRIHRHLKSRTTSHGRVGATAAVYSAAILGVPHRRYEYLNWQEMHQKT

SEQ ID NO: 907243 - protein, 138 aa, Homo sapiens; identical to SEQ ID NO: 907242

SEQ ID NO: 907244 - protein, 138 aa, Homo sapiens; identical to SEQ ID NO: 907242

SEQ ID NO: 907245 - protein, 138 aa, Homo sapiens; identical to SEQ ID NO: 907242

SEQ ID NO: 907246 - protein, 171 aa, Homo sapiens
MEVRVRIAYLTQRDDAGRNRKVTLTRVWDESSEQLKVVVGSRHRGRAVNTTIGSETGSSAVFSASVMEHAVVLAWYSVCDRVRLKKVGRDRSVIWDQSRAHLDDDERGERRQRHGEEEKLRRSRRAVETESRNAVAASKREQRDARNDEGDGNQCGHHDCRGEMKQQETKR

SEQ ID NO: 907247 - protein, 171 aa, Homo sapiens; identical to SEQ ID NO: 907240

SEQ ID NO: 907248 - protein, 175 aa, Homo sapiens
MIAEEVRVRIAYLTQRDDAGRNRKVTLTRVWDESSEQLKVVVGSRHRGRAVNTTIGSRRVSSAVFSASVMEHAVVLAWYSVCDRVRLKKVGRDRSVIWDQSRAHLDDDERGERRQRHGEEEKLRRSRRAVETESRNAVAASKREQRDARNDEGDGNQCGHHDCRGEMKQQETKRG

SEQ ID NO: 907249 - protein, 171 aa, Homo sapiens; identical to SEQ ID NO: 907246

SEQ ID NO: 907250 - protein, 175 aa, Homo sapiens; identical to SEQ ID NO: 907248

SEQ ID NO: 907251 - protein, 131 aa, Homo sapiens
MAGGKAGKDSGKAKTKAVSRSQRAGLQAPRGPSLKTPKNKDNQSWTSDRYCQLLQYSHPRRPNRTKTLTPGACKKRFKLSETHPKKVINSDPPPIKIPPLKNQTTTTKWERRKKPPSHATNTAQTRKNREY

SEQ ID NO: 907252 - protein, 171 aa, Homo sapiens; identical to SEQ ID NO: 907246

SEQ ID NO: 907253 - protein, 138 aa, Homo sapiens; identical to SEQ ID NO: 907242

SEQ ID NO: 907254 - protein, 171 aa, Homo sapiens; identical to SEQ ID NO: 907246

SEQ ID NO: 907255 - protein, 138 aa, Homo sapiens; identical to SEQ ID NO: 907242

SEQ ID NO: 907256 - protein, 136 aa, Homo sapiens
ARRGANGRGRPCGAPRAGDPGRVRGRARGGTRRGGGWARRLGNSIFSVPPPLAGVCAPQAGGKAGKDSGKAKTKAVSRSQRAGLQFPVGRIHRHLKSRTTSHGRVGATAAVYSAAILGVPHRRYEYLNWQEMHQKT

SEQ ID NO: 907257 - protein, 171 aa, Homo sapiens
MEVRVRIAYLTQRDDAGRNRKVTLTRVWDESSEQLKVVVGSRHRGRAVNTTIGSQTGSSAVFSASVMEHAVVLAWYSVCDRVRLKKVGRDRSVIWDQSRAHLDDDERGERRQRHGEEEKLRRSRRAVETESRNAVAASKREQRDARNDEGDGNQCGHHDCRGEMKQQETKR

SEQ ID NO: 907258 - protein, 171 aa, Homo sapiens; identical to SEQ ID NO: 907246

SEQ ID NO: 907259 - protein, 171 aa, Homo sapiens; identical to SEQ ID NO: 907246

SEQ ID NO: 907260 - protein, 40 aa, Homo sapiens
MNECGILSSRLQCAGGGVIPHHSLIGKYSTAVHVSPVTDL

SEQ ID NO: 907261 - protein, 171 aa, Homo sapiens; identical to SEQ ID NO: 907246

SEQ ID NO: 907262 - protein, 903 aa, Homo sapiens
MAIQFRSLFPLALPGMLALLGWWWFFSRKKGHVSSHDEQQVEAGAVQLRADPAIKEPLPVEDVCPKVVSTPPSVTEPPEKELSTVSKLPAEPPALLQTHPPCRRSESSGILPNTTDMRLRPGTRRDDSTKLELALTGGEAKSIPLECPLSSPKGVLFSSKSAEVCKQDSPFSRVPRKVQPGYPVVPAEKRSSGERARETGGAEGTGDAVLGEKVLEEALLSREHVLELENSKGPSLASLEGEEDKGKSSSSQVVGPVQEEEYVAEKLPSRFIESAHTELAKDDAAPAPPVADAKAQDRGVEGELGNEESLDRNEEGLDRNEEGLDRNEESLDRNEEGLDRNEEIKRAAFQIISQVISEATEQVLATTVGKVAGRVCQASQLQGQKEESCVPVHQKTVLGPDTAEPATAEAAVAPPDAGLPLPGLPAEGSPPPKTYVSCLKSLLSSPTKDSKPNISAHHISLASCLALTTPSEELPDRAGILVEDATCVTCMSDSSQSVPLVASPGHCSDSFSTSGLEDSCTETSSSPRDKAITPPLPESTVPFSNGVLKGELSDLGAEDGWTMDAEADHSGGSDRNSMDSVDSCCSLKKTESFQNAQAGSNPKKVDLIIWEIEVPKHLVGRLIGKQGRYVSFLKQTSGAKIYISTLPYTQSVQICHIEGSQHHVDKALNLIGKKFKELNLTNIYAPPLPSLALPSLPMTSWLMLPDGITVEVIVVNQVNAGHLFVQQHTHPTFHALRSLDQQMYLCYSQPGIPTLPTPVEITVICAAPGADGAWWRAQVVASYEETNEVEIRYVDYGGYKRVKVDVLRQIRSDFVTLPFQGAEVLLDSVMPLSDDDQFSPEADAAMSEMTGNTALLAQVTSYSPTGLPLIQLWSVVGDEVVLINRSLVERGLAQWVDSYYTSL

SEQ ID NO: 907263 - protein, 937 aa, Homo sapiens
MAIQFRSLFPLALPGMLALLGWWWFFSRKKGHVSSHDEQQVEAGAVQLRADPAIKEPLPVEDVCPKVVSTPPSVTEPPEKELSTVSKLPAEPPALLQTHPPCRRSESSGILPNTTDMRLRPGTRRDDSTKLELALTGGEAKSIPLECPLSSPKGVLFSSKSAEVCKQDSPFSRVPRKVQPGYPVVPAEKRSSGERARETGGAEGTGDAVLGEKVLEEALLSREHVLELENSKGPSLASLEGEEDKGKSSSSQVVGPVQEEEYVAEKLPSRFIESAHTELAKDDAAPAPPVADAKAQDRGVEGELGNEESLDRNEEGLDRNEEGLDRNEESLDRNEEGLDRNEEIKRAAFQIISQVISEATEQVLATTVGKVAGRVCQASQLQGQKEESCVPVHQKTVLGPDTAEPATAEAAVAPPDAGLPLPGLPAEGSPPPKTYVSCLKSLLSSPTKDSKPNISAHHISLASCLALTTPSEELPDRAGILVEDATCVTCMSDSSQSVPLVASPGHCSDSFSTSGLEDSCTETSSSPRDKAITPPLPESTVPFSNGVLKGELSDLGAEDGWTMDAEADHSGVAAPPPGKRGTLITRCPGFSSADPSVDSSDRYLTGSDRNSMDSVDSCCSLKKTESFQNAQAGSNPKKVDLIIWEIEVPKHLVGRLIGKQGRYVSFLKQTSGAKIYISTLPYTQSVQICHIEGSQHHVDKALNLIGKKFKELNLTNIYAPPLPSLALPSLPMTSWLMLPDGITVEVIVVNQVNAGHLFVQQHTHPTFHALRSLDQQMYLCYSQPGIPTLPTPVEITVICAAPGADGAWWRAQVVASYEETNEVEIRYVDYGGYKRVKVDVLRQIRSDFVTLPFQGAEVLLDSVMPLSDDDQFSPEADAAMSEMTGNTALLAQVTSYSPTGLPLIQLWSVVGDEVVLINRSLVERGLAQWVDSYYTSL

SEQ ID NO: 907264 - protein, 903 aa, Homo sapiens; identical to SEQ ID NO: 907262

SEQ ID NO: 907265 - protein, 937 aa, Homo sapiens; identical to SEQ ID NO: 907263

SEQ ID NO: 907266 - protein, 938 aa, Homo sapiens
MAIQFRSLFPLALPGMLALLGWWWFFSRKKGHVSSHDEQQVEAGAVQLRADPAIKEPLPVEDVCPKVVSTPPSVTEPPEKELSTVSKLPAEPPALLQTHPPCRRSESSGILPNTTDMRLRPGTRRDDSTKLELALTGGEAKSIPLECPLSSPKGVLFSSKSAEVCKQDSPFSRVPRKVQPGYPVVPAEKRSSGERARETGGAEGTGDAVLGEKVLEEALLSREHVLELENSKGPSLASLEGEEDKGKSSSSQVVGPVQEEEYVAEKLPSRFIESAHTELAKDDAAPAPPVADAKAQDRGVEGELGNEESLDRNEEGLDRNEEGLDRNEESLDRNEEGLDRNEEIKRAAFQIISQVISEATEQVLATTVGKVAGRVCQASQLQGQKEESCVPVHQKTVLGPDTAEPATAEAAVAPPDAGLPLPGLPAEGSPPPKTYVSCLKSLLSSPTKDSKPNISAHHISLASCLALTTPSEELPDRAGILVEDATCVTCMSDSSQSVPLVASPGHCSDSFSTSGLEDSCTETSSSPRDKAITPPLPESTVPFSNGVLKGELSDLGAEDGWTMDAEADHSGVAAPPPGKRGTLITRCPGFSSADPSVDSSDRYLTGSDRNSMDSVDSCCSLKKTESFQNAQAGSNPKKVDLIIWEIEVPKHLVGRLIGKQGRYVSFLKQTSGAKIYISTLPYTQSVQICHIEGSQHHVDKALNLIGKKFKELNLTNIYAPPLPSLALPSLPMTSWLMLPDGITVEVIVVNQVNAGHLFVQQHTHPTFHALRSLDQQMYLCYSQPGIPTLPTPVEITVICAAPGADGAWWRAQVVASYEETNEVEIRYVDYGGYKRVKVDVLRQIRSDFVTLPFQGAEVLLDSVMPLSDDDQFSPEADAAMSEMTGNTALLAQVTSYSPTGLPLIQLWSVVGDEVVLINRSLVERGLAQWVDSYYTSHI

SEQ ID NO: 907267 - protein, 845 aa, Homo sapiens
MAIQFRSLFPLALPGMLALLGWWWFFSRKKGHVSSHDEQQVEAGAVQLRADPAIKEPLPVEDVCPKVVSTPPSVTEPPEKELSTVSKLPAEPPALLQTHPPCRRSESSGILPNTTDMRLRPGTRRDDSTKLELALTGGEAKSIPLECPLSSPKGVLFSSKSAEVCKQDSPFSRVPRKVQPGYPVVPAEKRSSGERARETGGAEGTGDAVLGEKVLEEALLSREHVLELENSKGPSLASLEGEEDKGKSSSSQVVGPVQEEEYVAEKLPSRFIESAHTELAKDDAAPAPPVADAKAQDRGVEGELGNEESLDRNEEGLDRNEEGLDRNEESLDRNEEGLDRNEEIKRAAFQIISQVISEATEQVLATTVGKVAGRVCQASQLQGQKEESCVPVHQKTVLGPDTAEPATAEAAVAPPDAGLPLPGLPAEGSPPPKTYVSCLKSLLSSPTKDSKPNISAHHISLASCLALTTPSEELPDRAGILVEDATCVTCMSDSSQSVPLVASPGHCSDSFSTSGLEDSCTETSSSPRDKAITPPLPESTVPFSNGVLKGELSDLGAEDGWTMDAEADHSGVAAPPPGKRGTLITRCPGFSSADPSVDSSDRYLTGSDRNSMDSVDSCCSLKKTESFQNAQAGSNPKKVDLIIWEIEVPKHLVGRLIGKQGRYVSFLKQTSGAKIYISTLPYTQSVQICHIEGSQHHVDKALNLIGKKFKELNLTNIYAPPLPSLALPSLPMTSWLMLPDGITVEVIVVNQVNAGHLFVQQHTHPTFHALRSLDQQMYLCYSQPGIPTLPTPVEITVICAAPGADGAWWRAQVVASYEETNEVEIRYVDYGGYKRVKVDVLRQIS

SEQ ID NO: 907268 - protein, 821 aa, Homo sapiens
MAIQFRSLFPLALPGMLALLGWWWFFSRKKGHVSSHDEQQVEAGAVQLRADPAIKEPLPVEDVCPKVVSTPPSVTEPPEKELSTVSKLPAEPPALLQTHPPCRRSESSGILPNTTDMRLRPGTRRDDSTKLELALTGGEAKSIPLECPLSSPKGVLFSSKSAEVCKQDSPFSRVPRKVQPGYPVVPAEKRSSGERARETGGAEGTGDAVLGEKVLEEALLSREHVLELENSKGPSLASLEGEEDKGKSSSSQVVGPVQEEEYVAEKLPSRFIESAHTELAKDDAAPAPPVADAKAQDRGVEGELGNEESLDRNEEGLDRNEEGLDRNEESLDRNEEGLDRNEEIKRAAFQIISQVISEATEQVLATTVGKVAGRVCQASQLQGQKEESCVPVHQKTVLGPDTAEPATAEAAVAPPDAGLPLPGLPAEGSPPPKTYVSCLKSLLSSPTKDSKPNISAHHISLASCLALTTPSEELPDRAGILVEDATCVTCMSDSSQSVPLVASPGHCSDSFSTSGLEDSCTETSSSPRDKAITPPLPESTVPFSNGVLKGELSDLGAEDGWTMDAEADHSGGSDRNSMDSVDSCCSLKKTESFQNAQAGSNPKKVDLIIWEIEVPKETLLEIEIRDVCEVHGRARHHGDVSLRGITSGAKIYISTLPYTQSVQICHIEGSQHHVDKALNLIGKKFKELNLTNIYAPPLPSLALPSLPMTSWLMLPDGITVEVIVVNQVNAGHLFVQQHTHPTFHALRSLDQQMYLCYSQPGIPTLPTPVEITVICAAPGADGAWWRAQVVASYEETNEVEIRYVDYGGYKRVKVDVLRQIS

SEQ ID NO: 907269 - protein, 148 aa, Homo sapiens
MAIQFRSLFPLALPGMLALLGWWWFFSRKKGHVSSHDEQQVEAGAVQLRADPAIKEPLPVEDVCPKVVSTPPSVTEPPEKELSTVSKLPAEPPALLQTHPPCRRSESSGILPNTTDMTFQKKKRKKKKKKKKKNVGGILCVGGEEKKV

SEQ ID NO: 907270 - protein, 903 aa, Homo sapiens; identical to SEQ ID NO: 907262

SEQ ID NO: 907271 - protein, 896 aa, Homo sapiens
MAIQFRSLFPLALPGMLALLGWWWFFSRKKGHVSSHDEQQVEAGAVQLRADPAIKEPLPVEDVCPKVVSTPPSVTEPPEKELSTVSKLPAEPPALLQTHPPCRRSESSGILPNTTDMRLRPGTRRDDSTKLELALTGGEAKSIPLECPLSSPKGVLFSSKSAEVCKQDSPFSRVPRKVQPGYPVVPAEKRSSGERARETGGAEGTGDAVLGEKVLEEALLSREHVLELENSKGPSLASLEGEEDKGKSSSSQVVGPVQEEEYVAEKLPSRFIESAHTELAKDDAAPAPPVADAKAQDRGVEGELGNEESLDRNEEGLDRNEEGLDRNEEGLDRNEEIKRAAFQIISQVISEATEQVLATTVGKVAGRVCQASQLQGQKEESCVPVHQKTVLGPDTAEPATAEAAVAPPDAGLPLPGLPAEGSPPPKTYVSCLKSLLSSPTKDSKPNISAHHISLASCLALTTPSEELPDRAGILVEDATCVTCMSDSSQSVPLVASPGHCSDSFSTSGLEDSCTETSSSPRDKAITPPLPESTVPFSNGVLKGELSDLGAEDGWTMDAEADHSGGSDRNSMDSVDSCCSLKKTESFQNAQAGSNPKKVDLIIWEIEVPKHLVGRLIGKQGRYVSFLKQTSGAKIYISTLPYTQSVQICHIEGSQHHVDKALNLIGKKFKELNLTNIYAPPLPSLALPSLPMTSWLMLPDGITVEVIVVNQVNAGHLFVQQHTHPTFHALRSLDQQMYLCYSQPGIPTLPTPVEITVICAAPGADGAWWRAQVVASYEETNEVEIRYVDYGGYKRVKVDVLRQIRSDFVTLPFQGAEVLLDSVMPLSDDDQFSPEADAAMSEMTGNTALLAQVTSYSPTGLPLIQLWSVVGDEVVLINRSLVERGLAQWVDSYYTSL

SEQ ID NO: 907272 - protein, 812 aa, Homo sapiens
MAIQFRSLFPLALPGMLALLGWWWFFSRKKGHVSSHDEQQVEAGAVQLRADPAIKEPLPVEDVCPKVVSTPPSVTEPPEKELSTVSKLPAEPPALLQTHPPCRRSESSGILPNTTDMRLRPGTRRDDSTKLELALTGGEAKSIPLECPLSSPKGVLFSSKSAEVCKQDSPFSRVPRKVQPGYPVVPAEKRSSGERARETGGAEGTGDAVLGEKVLEEALLSREHVLELENSKGPSLASLEGEEDKGKSSSSQVVGPVQEEEYVAEKLPSRFIESAHTELAKDDAAPAPPVADAKAQDRGVEGELGNEESLDRNEEGLDRNEEGLDRNEESLDRNEEGLDRNEEIKRAAFQIISQVISEATEQVLATTVGKVAGRVCQASQLQGQKEESCVPVHQKTVLGPDTAEPATAEAAVAPPDAGLPLPGLPAEGSPPPKTYVSCLKSLLSSPTKDSKPNISAHHISLASCLALTTPSEELPDRAGILVEDATCVTCMSDSSQSVPLVASPGHCSDSFSTSGLEDSCTETSSSPRDKAITPPLPESTVPFSNGVLKGELSDLGAEDGWTMDAEADHSGVAAPPPGKRGTLITRCPGFSSADPSVDSSDRYLTGSDRNSMDSVDSCCSLKKTESFQNAQAGSNPKKVDLIIWEIEVPKHLVGRLIGKQGRYVSFLKQTSGAKIYISTLPYTQSVQICHIEGSQHHVDKALNLIGKKFKELNLTNIYAPPLPSLALPSLPMTSWLMLPDGITVEVIVVNQVNAGHLFVQQHTHPTFHALRSLDQQMYLCYSQPGIPTLPTPVESLTLSPCRFREQKSFWTV

SEQ ID NO: 907273 - protein, 924 aa, Homo sapiens
MAIQFRSLFPLALPGMLALLGWWWFFSRKKGHVSSHDEQQVEAGAVQLRADPAIKEPLPVEDVCPKVVSTPPSVTEPPEKELSTVSKLPAEPPALLQTHPPCRRSESSGILPNTTDMRLRPGTRRDDSTKLELALTGGEAKSIPLECPLSSPKGVLFSSKSAEVCKQDSPFSRVPRKVQPGYPVVPAEKRSSGERARETGGAEGTGDAVLGEKVLEEALLSREHVLELENSKGPSLASLEGEEDKGKSSSSQVVGPVQEEEYVAEKLPSRFIESAHTELAKDDAAPAPPVADAKAQDRGVEGELGNEESLDRNEEGLDRNEEGLDRNEESLDRNEEGLDRNEEIKRAAFQIISQVISEATEQVLATTVGKVAGRVCQASQLQGQKEESCVPVHQKTVLGPDTAEPATAEAAVAPPDAGLPLPGLPAEGSPPPKTYVSCLKSLLSSPTKDSKPNISAHHISLASCLALTTPSEELPDRAGILVEDATCVTCMSDSSQSVPLVASPGHCSDSFSTSGLEDSCTETSSSPRDKAITPPLPESTVPFSNGVLKGELSDLGAEDGWTMDAEADHSGVAAPPPGKRGTLITRCPGFSSADPSVDSSDRYLTGSDRNSMDSVDSCCSLKKTESFQNAQAGSNPKKVDLIIWEIEVPKHLVGRLIGKQGRYVSFLKQTSGAKIYISTLPYTQSVQICHIEGSQHHVDKALNLIGKKFKELNLTNIYAPPLPSLALPSLPMTSWLMLPDGITVEVIVVNQVNAGHLFVQQHTHPTFHALRSLDQQMYLCYSQPGIPTLPTPVEITVICAAPGADGAWWRAQVVASYEETNEVEIRYVDYGGYKRVKVDVLRQIRSDFVTLPFQGAEVLLDSVMPLSDDDQFSPEADAAMSEMTGNTALLAQVTSYSPTGLPLIQLWSVVGDETGFSIVQFKNK

SEQ ID NO: 907274 - protein, 735 aa, Homo sapiens
MAIQFRSLFPLALPGMLALLGWWWFFSRKKGHVSSHDEQQVEAGAVQLRADPAIKEPLPVEDVCPKVVSTPPSVTEPPEKELSTVSKLPAEPPALLQTHPPCRRSESSGILPNTTDMRLRPGTRRDDSTKLELALTGGEAKSIPLECPLSSPKGVLFSSKSAEVCKQDSPFSRVPRKVQPGYPVVPAEKRSSGERARETGGAEGTGDAVLGEKVLEEALLSREHVLELENSKGPSLASLEGEEDKGKSSSSQVVGPVQEEEYVAEKLPSRFIESAHTELAKDDAAPAPPVADAKAQDRGVEGELGNEESLDRNEEGLDRNEEGLDRNEESLDRNEEGLDRNEEIKRAAFQIISQVISEATEQVLATTVGKVAGRVCQASQLQGQKEESCVPVHQKTVLGPDTAEPATAEAAVAPPDAGLPLPGLPAEGSPPPKTYVSCLKSLLSSPTKDSKPNISAHHISLASCLALTTPSEELPDRAGILVEDATCVTCMSDSSQSVPLVASPGHCSDSFSTSGLEDSCTETSSSPRDKAITPPLPESTVPFSNGVLKGELSDLGAEDGWTMDAEADHSGGSDRNSMDSVDSCCSLKKTESFQNAQAGSNPKKVDLIIWEIEVPKHLVGRLIGKQGRYVSFLKQTSGAKIYISTLPYTQSVQICHIEGSQHHVDKALNLIGKKFKELNLTNIYAPPLPSLALPSLPMTSWVSVLLGDPDFLPLSPKPTPNKKLPRPQAKKAKCT

SEQ ID NO: 907275 - protein, 193 aa, Homo sapiens
MAIQFRSLFPLALPGMLALLGWWWFFSRKKGHVSSHDEQQVEAGAVQLRADPAIKEPLPVEDVCPKVVSTPPSVTEPPEKELSTVSKLPAEPPALLQTHPPCRRSESSGILPNTTDMTFQKKKRKKKKKKKKKNREGTKGGGGKKGRKGGRGQNGRPRPKFRGKRGEKGGTQKRRAENTKNPGHRVENPTKRD

SEQ ID NO: 907276 - protein, 212 aa, Homo sapiens
CVWIEKESINSVIISDAPEDLHQRMLVAASLSINATGSTMLLRETSLMPHIPGLPALLSMLFAPVIELRIDQNGKYYTGVLCGLGWNPATGASILPEHDMELAFDVQFSVEDVVEVNILRAAINKLVCDGPNGCKCLGPERVAQLQDIARQKLLGLFCQSKPREKIVPKWHEKPYEWNQVDPKLVMEQADRESSRGKNTFLYQLHKLVVLGT

SEQ ID NO: 907277 - protein, 482 aa, Homo sapiens
GGCSRGSQGLAVIAIEEFSIIPEAPMRSSQVSAWGLEAQEDEDPSYKWREEHRLSATQQSELRDVCDYAIETMPSFPKEGSADVEPNQESLVAEACDTPEHWEAVPQSLAGRQARTLAPPELWACPIQSEHLDMAPFSSDLGSEEEEVEFGPGLTSLTWGSGQAEEEEETSSDNSGQTRYYSPCEEHPAETNQNEGAESGTIRQGEELPSEELQESQGLLHPQEVQVLEEQGQQEAGFRGEGTLREDVCADGLLGEEQMIEQVNDEKGEQKQKQEQVQDVMLGRQGERMGLTGEPEGLNDGEWEQEDMERKAQGQGGPEQGEERKRELQVPEENRADSQDEKSQTFLGKSEEVTGKQEDHGIKEKGVPVSGQEAKEPESWDGGRLGAVGRARSREEENEHHGPSMPALIAPEDSPHCDLFPGASYLVTQIPGTQTESRAEELSPAALSPLLEPIRCSHQPISLLGSFLTEESPDKEKLLSVL

SEQ ID NO: 907278 - protein, 488 aa, Homo sapiens
DSALMEAEEAQHGASPPISAIEEFSIIPEAPMRSSQVSAWGLEAQEDEDPSYKWREEHRLSATQQSELRDVCDYAIETMPSFPKEGSADVEPNQESLVAEACDTPEHWEAVPQSLAGRQARTLAPPELWACPIQSEHLDMAPFSSDLGSEEEEVEFGPGLTSLTWGSGQAEEEEETSSDNSGQTRYYSPCEEHPAETNQNEGAESGTIRQGEELPSEELQESQGLLHPQEVQVLEEQGQQEAGFRGEGTLREDVCADGLLGEEQMIEQVNDEKGEQKQKQEQVQDVMLGRQGERMGLTGEPEGLNDGEWEQEDMERKAQGQGGPEQGEERKRELQVPEENRADSQDEKSQTFLGKSEEVTGKQEDHGIKEKGVPVSGQEAKEPESWDGGRLGAVGRARSREEENEHHGPSMPALIAPEDSPHCDLFPGASYLVTQIPGTQTESRAEELSPAALSPLLEPIRCSHQPISLLGSFLTEESPDKEKLLSVL

SEQ ID NO: 907279 - protein, 482 aa, Homo sapiens; identical to SEQ ID NO: 907277

SEQ ID NO: 907280 - protein, 70 aa, Homo sapiens
APQLWSVPGDGGHDGYRMGANNGKQYGSEGKGSSSISSASQSAGITVMSHYTGLSIFLVLVLYAVFGGYL

SEQ ID NO: 907281 - protein, 508 aa, Homo sapiens
APQLWSVPGDGGHDGYRMGANNGKQYGSEGKGSSSISSDVSSSTDHTPTKAQKNVATSEDSDLSMRTLSTPSPALICPPNLPGFQNGRGSSTSSSSITGETVAMVHSPPPTRLTHPLIRLASRPQKEQASIDRLPDHSMVQIFSFLPTNQLCRCARVCRRWYNLAWDPRLWRTIRLTGETINVDRALKVLTRRLCQDTPNVCLMLETVTVSGCRRLTDRGLYTIAQCCPELRRLEVSGCYNISNEAVFDVVSLCPNLEHLDVSGCSKVTCISLTREASIKLSPLHGKQISIRYLDMTDCFVLEDEGLHTIAAHCTQLTHLYLRRCVRLTDEGLRYLVIYCASIKELSVSDCRFVSDFGLREIAKLESRLRYLSIAHCGRVTDVGIRYVAKYCSKLRYLNARGCEGITDHGVEYLAKNCTKLKSLDIGKCPLVSDTGLECLALNCFNLKRLSLKSCESITGQGLQIVAANCFDLQTLNVQDCEVSVEALRFVKRHCKRCVIEHTNPAFF

SEQ ID NO: 907282 - protein, 164 aa, Homo sapiens
VVAGVFGTDIQGDEEAGGAEQRAAQRGQQAGARLLRGRGRWNGHAGLLRPRGVLAPSPLGPANMGRVRTKTVKKAARVIIEKYYTRLGNDFHTNKRVCEEIAIIPSKKRPQQDSRLCHASDEANSERPSKRYLHQAAGGGERTRRDNYVPEVSALDQEIIERRS

SEQ ID NO: 907283 - protein, 113 aa, Homo sapiens
KKPSCANSARANMGRVRTKTVKKAARVIIEKYYTRLGNDFHTNKRVCEEIAIIPSKKRPQQDSRLCHASDEANSERPSKRYLHQAAGGGERTRRDNYVPEVSALDQEIIERRS

SEQ ID NO: 907284 - protein, 164 aa, Homo sapiens; identical to SEQ ID NO: 907282

SEQ ID NO: 907285 - protein, 90 aa, Homo sapiens
RDITCYLVAELFAGDNGDLLAHALVRVEVVAQARVVLFYDDPGRLLHGFGANAAHVGWVLGTAGGGERTRRDNYVPEVSALDQEIIERRS

SEQ ID NO: 907286 - protein, 146 aa, Homo sapiens
RYNPPEHYAMLPSLSDHIGSCTLQYRRNPGRLLLLNCGRSTGPANMGRVRTKTVKKAARVIIEKYYTRLGNDFHTNKRVCEEIAIIPSKKRPQQDSRLCHASDEANSERPSKRYLHQAAGGGERTRRDNYVPEVSALDQEIIERRS

SEQ ID NO: 907287 - protein, 117 aa, Homo sapiens
PPPHPPPQLDEAGVTQMGRVRTKTVKKAARVIIEKYYTRLGNDFHTNKRVCEEIAIIPSKKRPQQDSRLCHASDEANSERPSKRYLHQAAGGGERTRRDNYVPEVSALDQEIIERRS

SEQ ID NO: 907288 - protein, 119 aa, Homo sapiens
GVAAADYVFLNWSPRPANMGRVRTKTVKKAARVIIEKYYTRLGNDFHTNKRVCEEIAIIPSKKRPQQDSRLCHASDEANSERPSKRYLHQAAGGGERTRRDNYVPEVSALDQEIIERRS

SEQ ID NO: 907289 - protein, 159 aa, Homo sapiens
HKTLIHTRKHPHVHTPIPHSPPIPQPRHHYRVFLLKKKKKKKKKKKKKKKNFYQGPANMGRVRTKTVKKAARVIIEKYYTRLGNDFHTNKRVCEEIAIIPSKKRPQQDSRLCHASDEANSERPSKRYLHQAAGGGERTRRDNYVPEVSALDQEIIERRS

SEQ ID NO: 907290 - protein, 108 aa, Homo sapiens
MLELVANMGRVRTKTVKKAARVIIEKYYTRLGNDFHTNKRVCEEIAIIPSKKRPQQDSRLCHASDEANSERPSKRYLHQAAGGGERTRRDNYVPEVSALDQEIIERRS

SEQ ID NO: 907291 - protein, 108 aa, Homo sapiens; identical to SEQ ID NO: 907290

SEQ ID NO: 907292 - protein, 109 aa, Homo sapiens
MNQGPAFMGRVRTKTVKKAARVIIEKYYTRLGNDFHTNKRVCEEIAIIPSKKRPQQDSRLCHASDEANSERPSKRYLHQDSKGPGPKGGHGARREKRTDGTPKTKKRFF

SEQ ID NO: 907293 - protein, 108 aa, Homo sapiens
MTASRKNRGRVRTKTVKKAARVIIEKYYTRLGNDFHTNKRVCEEIAIIPSKKRPQQDSRLCHASDEANSERPSKRYLHQAAGGGERTRRDNYVPEVSALDQEIIERRS

SEQ ID NO: 907294 - protein, 108 aa, Homo sapiens; identical to SEQ ID NO: 907290

SEQ ID NO: 907295 - protein, 110 aa, Homo sapiens
MCEAWVGANMGRVRTKTVKKAARVIIEKYYTRLGNDFHTNKRVCEEIAIIPSKKRPQQDSRLCHASDEANSERPSKRYLHQAAGGGERTRRDNYVPEVSALDQEIIERRS

SEQ ID NO: 907296 - protein, 110 aa, Homo sapiens; identical to SEQ ID NO: 907295

SEQ ID NO: 907297 - protein, 119 aa, Homo sapiens; identical to SEQ ID NO: 907288

SEQ ID NO: 907298 - protein, 124 aa, Homo sapiens
MGRVRTKTVKKAARVIIEKYYTRLGRVRTKTVKKAARVIIEKYYTRLGNDFHTNKRVCEEIAIIPSKKRPQQDSRLCHASDEANSERPSKRYLHQAAGGGERTRRDNYVPEVSALDQEIIERRS

SEQ ID NO: 907299 - protein, 162 aa, Homo sapiens
FFFVVPDLLKIIQHYRKNSNRSPRRSPLSPAKSVRNKIAGYVTHLMKRIQRGPVRGISIKLQEEEREHGETIMFLRSQPWIRRLLNVDPDTKGNAEAFGTSAVCPTFRSLSLQIGMNFQNASGTCFELSISGSCCTYFSNLTLLGTNSRKTEDKYLANLYRH

SEQ ID NO: 907300 - protein, 117 aa, Homo sapiens
KLRLGSEAWVAARIANMGRVRTKTVKKAARVIIEKYYTRLGNDFHTNKRVCEEIAIIPSKKRPQQDSRLCHASDEANSERPSKRYLHQAAGGGERTRRDNYVPEVSALDQEIIERRS

SEQ ID NO: 907301 - protein, 102 aa, Homo sapiens
RYNPPEHYAMLPSLSDHIGSCTLQYRRNPGRLLLLNSRPLDYPQQKAPLKISRLCHASDEANSERPSKRYLHQAAGGGERTRRDNYVPEVSALDQEIIERRS

SEQ ID NO: 907302 - protein, 124 aa, Homo sapiens
GEREREREREREREREREQGPANMGRVRTKTVKKAARVIIEKYYTRLGNDFHTNKRVCEEIAIIPSKKRPQQDSRLCHASDEANSERPSKRYLHQAAGGGERTRRDNYVPEVSALDQEIIERRS

SEQ ID NO: 907303 - protein, 113 aa, Homo sapiens; identical to SEQ ID NO: 907283

SEQ ID NO: 907304 - protein, 113 aa, Homo sapiens; identical to SEQ ID NO: 907283

SEQ ID NO: 907305 - protein, 113 aa, Homo sapiens; identical to SEQ ID NO: 907283

SEQ ID NO: 907306 - protein, 113 aa, Homo sapiens; identical to SEQ ID NO: 907283

SEQ ID NO: 907307 - protein, 113 aa, Homo sapiens; identical to SEQ ID NO: 907283

SEQ ID NO: 907308 - protein, 113 aa, Homo sapiens; identical to SEQ ID NO: 907283

SEQ ID NO: 907309 - protein, 113 aa, Homo sapiens; identical to SEQ ID NO: 907283

SEQ ID NO: 907310 - protein, 113 aa, Homo sapiens; identical to SEQ ID NO: 907283

SEQ ID NO: 907311 - protein, 113 aa, Homo sapiens; identical to SEQ ID NO: 907283

SEQ ID NO: 907312 - protein, 113 aa, Homo sapiens; identical to SEQ ID NO: 907283

SEQ ID NO: 907313 - protein, 113 aa, Homo sapiens; identical to SEQ ID NO: 907283

SEQ ID NO: 907314 - protein, 113 aa, Homo sapiens; identical to SEQ ID NO: 907283

SEQ ID NO: 907315 - protein, 113 aa, Homo sapiens; identical to SEQ ID NO: 907283

SEQ ID NO: 907316 - protein, 113 aa, Homo sapiens; identical to SEQ ID NO: 907283

SEQ ID NO: 907317 - protein, 113 aa, Homo sapiens; identical to SEQ ID NO: 907283

SEQ ID NO: 907318 - protein, 113 aa, Homo sapiens; identical to SEQ ID NO: 907283

SEQ ID NO: 907319 - protein, 113 aa, Homo sapiens; identical to SEQ ID NO: 907283

SEQ ID NO: 907320 - protein, 113 aa, Homo sapiens; identical to SEQ ID NO: 907283

SEQ ID NO: 907321 - protein, 113 aa, Homo sapiens; identical to SEQ ID NO: 907283

SEQ ID NO: 907322 - protein, 113 aa, Homo sapiens; identical to SEQ ID NO: 907283

SEQ ID NO: 907323 - protein, 102 aa, Homo sapiens
MGRVRTKTVKKAARVIIEKYYTRLGNDFHTNKRVCEEIAIIPSKKRPQQDSRLCHASDEANSERPSKRYLHQAAGGGERTRRDNYVPEGKLSGYLGFWLILK

SEQ ID NO: 907324 - protein, 97 aa, Homo sapiens
MGRVRTKTVKKAARVIIEKYYTRLGNDFHTNKRVCEEIAIIPSKKRPQQDSRLCHASDEANSERPSKRYLHQAAGGGERTRRDNYVPEDFPTEGPNV

SEQ ID NO: 907325 - protein, 102 aa, Homo sapiens
MGRVRTKTVKKAARVIIEKYYTRLGNDFHTNKRVCEEIAIIPSKKRPQQDSRLCHASDEANSERPSKRYLHQDSKGPGPKGGHGARREKRTDGTPKTKKRFF

SEQ ID NO: 907326 - protein, 113 aa, Homo sapiens; identical to SEQ ID NO: 907283

SEQ ID NO: 907327 - protein, 118 aa, Homo sapiens
KLRLGTRLGVDIGRGANMGRVRTKTVKKAARVIIEKYYTRLGNDFHTNKRVCEEIAIIPSKKRPQQDSRLCHASDEANSERPSKRYLHQAAGGGERTRRDNYVPEVSALDQEIIERRS

SEQ ID NO: 907328 - protein, 174 aa, Homo sapiens
MKRIQRGPVRGISIKLQEEEREHGETIMFLRSQPWIRRLLNVDPDTKGNAEAFGTSAVCPTFRSLSLQIGMNFQNASGTCFELSISGSCCTYFSNLTLLGTNSRKKKKKTKKKKIRGDLMGGGEKRGNGKGPWAIAVFPGPRFFGPRGKIWGVTLMGSRINRKSRVTGLGRGEK

SEQ ID NO: 907329 - protein, 121 aa, Homo sapiens
AAAYYYYYCSEFKLLTMYGDMGRVRTKTVKKAARVIIEKYYTRLGNDFHTNKRVCEEIAIIPSKKRPQQDSRLCHASDEANSERPSKRYLHQAAGGGERTRRDNYVPEVSALDQEIIERRS

SEQ ID NO: 907330 - protein, 128 aa, Homo sapiens
PPHPPPPTPTPTRPTPTKARYEAGVGNMGRVRTKTVKKAARVIIEKYYTRLGNDFHTNKRVCEEIAIIPSKKRPQQDSRLCHASDEANSERPSKRYLHQAAGGGERTRRDNYVPEVSALDQEIIERRS

SEQ ID NO: 907331 - protein, 138 aa, Homo sapiens
SRVGSERPWPGGSGFLAYALTGFACASCFLFYQGPANMGRVRTKTVKKAARVIIEKYYTRLGNDFHTNKRVCEEIAIIPSKKRPQQDSRLCHASDEANSERPSKRYLHQAAGGGERTRRDNYVPEVSALDQEIIERRS

SEQ ID NO: 907332 - protein, 119 aa, Homo sapiens; identical to SEQ ID NO: 907288

SEQ ID NO: 907333 - protein, 141 aa, Homo sapiens
RYNPPEHYAMLPSLSDHIGSCTLQYRRNPGRLLLLNSRPLDGRVRTKTVKKAARVIIEKYYTRLGNDFHTNKRVCEEIAIIPSKKRPQQDSRLCHASDEANSERPSKRYLHQAAGGGERTRRDNYVPEVSALDQEIIERRS

SEQ ID NO: 907334 - protein, 131 aa, Homo sapiens
QQKITRQVPVLYFRTQGGCGIEIDIGPAADYGRVRTKTVKKAARVIIEKYYTRLGNDFHTNKRVCEEIAIIPSKKRPQQDSRLCHASDEANSERPSKRYLHQAAGGGERTRRDNYVPEVSALDQEIIERRS

SEQ ID NO: 907335 - protein, 128 aa, Homo sapiens; identical to SEQ ID NO: 907330

SEQ ID NO: 907336 - protein, 113 aa, Homo sapiens
MRVLTSSRWPANMGRVRTKTVKKAARVIIEKYYTRLGNDFHTNKRVCEEIAIIPSKKRPQQDSRLCHASDEANSERPSKRYLHQAAGGGERTRRDNYVPEVSALDQEIIERRS

SEQ ID NO: 907337 - protein, 128 aa, Homo sapiens; identical to SEQ ID NO: 907330

SEQ ID NO: 907338 - protein, 111 aa, Homo sapiens
MRDHAVGPANMGRVRTKTVKKAARVIIEKYYTRLGNDFHTNKRVCEEIAIIPSKKRPQQDSRLCHASDEANSERPSKRYLHQAAGGGERTRRDNYVPEVSALDQEIIERRS

SEQ ID NO: 907339 - protein, 117 aa, Homo sapiens; identical to SEQ ID NO: 907300

SEQ ID NO: 907340 - protein, 113 aa, Homo sapiens; identical to SEQ ID NO: 907336

SEQ ID NO: 907341 - protein, 124 aa, Homo sapiens; identical to SEQ ID NO: 907302

SEQ ID NO: 907342 - protein, 113 aa, Homo sapiens; identical to SEQ ID NO: 907283

SEQ ID NO: 907343 - protein, 113 aa, Homo sapiens; identical to SEQ ID NO: 907283

SEQ ID NO: 907344 - protein, 113 aa, Homo sapiens; identical to SEQ ID NO: 907283

SEQ ID NO: 907345 - protein, 113 aa, Homo sapiens; identical to SEQ ID NO: 907283

SEQ ID NO: 907346 - protein, 113 aa, Homo sapiens; identical to SEQ ID NO: 907283

SEQ ID NO: 907347 - protein, 113 aa, Homo sapiens; identical to SEQ ID NO: 907283

SEQ ID NO: 907348 - protein, 113 aa, Homo sapiens; identical to SEQ ID NO: 907283

SEQ ID NO: 907349 - protein, 113 aa, Homo sapiens; identical to SEQ ID NO: 907283

SEQ ID NO: 907350 - protein, 113 aa, Homo sapiens; identical to SEQ ID NO: 907283

SEQ ID NO: 907351 - protein, 113 aa, Homo sapiens; identical to SEQ ID NO: 907283

SEQ ID NO: 907352 - protein, 113 aa, Homo sapiens; identical to SEQ ID NO: 907283

SEQ ID NO: 907353 - protein, 164 aa, Homo sapiens
MKRIQRGPVRGISIKLQEEEREHGETIMFLRSQPWIRRLLNVDPDTKGNAEAFGTSAVCPTFRSLSLQIGMNFQNASGTCFELSISGSCCTYFSNLTLLGTNSRKNKITYETQISPRPQPESVSCILQEPKRNLAFFQLRKVWGQVWHSIQTLKEDCNRLQQGQ

SEQ ID NO: 907354 - protein, 113 aa, Homo sapiens; identical to SEQ ID NO: 907283

SEQ ID NO: 907355 - protein, 113 aa, Homo sapiens; identical to SEQ ID NO: 907283

SEQ ID NO: 907356 - protein, 113 aa, Homo sapiens; identical to SEQ ID NO: 907283

SEQ ID NO: 907357 - protein, 102 aa, Homo sapiens; identical to SEQ ID NO: 907323

SEQ ID NO: 907358 - protein, 93 aa, Homo sapiens
KKPSCANSARANMGRVRTKTVKKAARVIIEKYYTRLGNDFHTNKRVCEEIAIIPSKKRPQQDSRLCHASDEANSERPSKRYLHQGLSLGSGDY

SEQ ID NO: 907359 - protein, 72 aa, Homo sapiens
GATLSWERGGCGERRTETGDVFKPGSGGFTGGCSGDEDNDSDGYAEALVPGVKPPAPALPRIQDEKTDKRRS

SEQ ID NO: 907360 - protein, 181 aa, Homo sapiens [sequence omitted]

SEQ ID NO: 907361 - protein, 2039 aa, Homo sapiens
MPKSGFTKPIQSENSDSDSNMVEKPYGRKSKDKIASYSKTPKIERSDVSKEMKEKSSMKRKLPFTISPSRNEERDSDTEKEGPEKKKTKKEAGNKKSTPVSILFGYPLSERKQMALLMQMTARDNSPDSTPNHPSQTTPAQKKTPSSSSRQKDKVNKRNERGETPLHMAAIRGDVKQVKELISLGANVNVKDFAGWTPLHEACNVGYYDVAKILIAAGADVNTQGLDDDTPLHDSASSGHRDIVKLLLRHGGNPFQANKHGERPVDVAETEELELLLKREVPLSDDDESYTDSEEAQSVNPSSVDENIDSETEKDSLICESKQILPSKTPLPSALDEYEFKDDDDEEINKMIDDRHILRKEQRKENEPEAEKTHLFAKQEKAFYPKSFKSKKQKPSRVLYSSTESSDEEALQNKKISTSCSVIPETSNSDMQTKKEYVVSGEHKQKGKVKRKLKNQNKNKENQELKQEKEGKENTRITNLTVNTGLDCSEKTREEGNFRKSFSPKDDTSLHLFHISTGKSPKHSCGLSEKQSTPLKQEHTKTCLSPGSSEMSLQPDLVRYDNTESEFLPESSSVKSCKHKEKSKHQKDFHLEFGEKSNAKIKDEDHSPTFENSDCTLKKMDKEGKTLKKHKLKHKEREKEKHKKEIEGEKEKYKTKDSAKELQRSVEFDREFWKENFFKSDETEDLFLNMEHESLTLEKKSKLEKNIKDDKSTKEKHVSKERNFKEERDKIKKESEKSFREEKIKDLKEERENIPTDKDSEFTSLGMSAIEESIGLHLVEKEIDIEKQEKHIKESKEKPEKRSQIKEKDIEKMERKTFEKEKKIKHEHKSEKDKLDLSECVDKIKEKDKLYSHHTEKCHKEGEKSKNTAAIKKTDDREKSREKMDRKHDKEKPEKERHLAESKEKHLMEKKNKQSDNSEYSKSEKGKNKEKDRELDKKEKSRDKESINITNSKHIQEEKKSSIVDGNKAQHEKPLSLKEKTKDEPLKTPDGKEKDKKDKDIDRYKERDKHKDKIQINSLLKLKSEADKPKPKSSPASKDTRPKEKRLVNDDLMQTSFERMLSLKDLEIEQWHKKHKEKIKQKEKERLRNRNCLELKIKDKEKTKHTPTESKNKELTRSKSSEVTDAYTKEKQPKDAVSNRSQSVDTKNVMTLGKSSFVSDNSLNRSPRSENEKPGLSSRSVSMISVASSEDSCHTTVTTPRPPVEYDSDFMLESSESQMSFSQSPFLSIAKSPALHERELDSLADLPERIKPPYANRLSTSHLRSSSVEDVKLIISEGRPTIEVRRCSMPSVICEHTKQFQTISEESNQGSLLTVPGDTSPSPKPEVFSNVPERDLSNVSNIHSSFATSPTGASNSKYVSADRNLIKNTAPVNTVMDSPVHLEPSSQVGVIQNKSWEMPVDRLETLSTRDFICPNSNIPDQESSLQSFCNSENKVLKENADFLSLRQTELPGNSCAQDPASFMPPQQPCSFPSQSLSDAESISKHMSLSYVANQEPGILQQKNAVQIISSALDTDNESTKDTENTFVLGDVQKTDAFVPVYSDSTIQEASPNFEKAYTLPVLPSEKDFNGSDASTQLNTHYAFSKLTYKSSSGHEVENSTTDTQVISHEKENKLESLVLTHLSRCDSDLCEMNAGMPKGNLNEQDPKHCPESEKCLLSIEDEESQQSILSSLENHSQQSTQPEMHKYGQLVKVELEENAEDDKTENQIPQRMTRNKANTMANQSKQILASCTLLSEKDSESSSPRGRIRLTEDDDPQIHHPRKRKVSRVPQPVQVSPSLLQAKEKTQQSLAAIVDSLKLDEIQPYSSERANPYFEYLHIRKKIEEKRKLLCSVIPQAPQYYDEYVTFNGSYLLDGNPLSKICIPTITPPPSLSDPLKELFRQQEVVRMKLRLQHSIEREKLIVSNEQEVLRVHYRAARTLANQTLPFSACTVLLDAEVYNVPLDSQSDDSKTSVRDRFNARQFMSWLQDVDDKFDKLKTCLLMRQQHEAAALNAVQRLEWQLKLQELDPATYKSISIYEIQEFYVPLVDVNDDFELTPI

SEQ ID NO: 907362 - protein, 1926 aa, Homo sapiens
MALLMQMTARDNSPDSTPNHPSQTTPAQKKTPSSSSRQKDKVNKRNERGETPLHMAAIRGDVKQVKELISLGANVNVKDFAGWTPLHEACNVGYYDVAKILIAAGADVNTQGLDDDTPLHDSASSGHRDIVKLLLRHGGNPFQANKHGERPVDVAETEELELLLKREVPLSDDDESYTDSEEAQSVNPSSVDENIDSETEKDSLICESKQILPSKTPLPSALDEYEFKDDDDEEINKMIDDRHILRKEQRKENEPEAEKTHLFAKQEKAFYPKSFKSKKQKPSRVLYSSTESSDEEALQNKKISTSCSVIPETSNSDMQTKKEYVVSGEHKQKGKVKRKLKNQNKNKENQELKQEKEGKENTRITNLTVNTGLDCSEKTREEGNFRKSFSPKDDTSLHLFHISTGKSPKHSCGLSEKQSTPLKQEHTKTCLSPGSSEMSLQPDLVRYDNTESEFLPESSSVKSCKHKEKSKHQKDFHLEFGEKSNAKIKDEDHSPTFENSDCTLKKMDKEGKTLKKHKLKHKEREKEKHKKEIEGEKEKYKTKDSAKELQRSVEFDREFWKENFFKSDETEDLFLNMEHESLTLEKKSKLEKNIKDDKSTKEKHVSKERNFKEERDKIKKESEKSFREEKIKDLKEERENIPTDKDSEFTSLGMSAIEESIGLHLVEKEIDIEKQEKHIKESKEKPEKRSQIKEKDIEKMERKTFEKEKKIKHEHKSEKDKLDLSECVDKIKEKDKLYSHHTEKCHKEGEKSKNTAAIKKTDDREKSREKMDRKHDKEKPEKERHLAESKEKHLMEKKNKQSDNSEYSKSEKGKNKEKDRELDKKEKSRDKESINITNSKHIQEEKKSSIVDGNKAQHEKPLSLKEKTKDEPLKTPDGKEKDKKDKDIDRYKERDKHKDKIQINSLLKLKSEADKPKPKSSPASKDTRPKEKRLVNDDLMQTSFERMLSLKDLEIEQWHKKHKEKIKQKEKERLRNRNCLELKIKDKEKTKHTPTESKNKELTRSKSSEVTDAYTKEKQPKDAVSNRSQSVDTKNVMTLGKSSFVSDNSLNRSPRSENEKPGLSSRSVSMISVASSEDSCHTTVTTPRPPVEYDSDFMLESSESQMSFSQSPFLSIAKSPALHERELDSLADLPERIKPPYANRLSTSHLRSSSVEDVKLIISEGRPTIEVRRCSMPSVICEHTKQFQTISEESNQGSLLTVPGDTSPSPKPEVFSNVPERDLSNVSNIHSSFATSPTGASNSKYVSADRNLIKNTAPVNTVMDSPVHLEPSSQVGVIQNKSWEMPVDRLETLSTRDFICPNSNIPDQESSLQSFCNSENKVLKENADFLSLRQTELPGNSCAQDPASFMPPQQPCSFPSQSLSDAESISKHMSLSYVANQEPGILQQKNAVQIISSALDTDNESTKDTENTFVLGDVQKTDAFVPVYSDSTIQEASPNFEKAYTLPVLPSEKDFNGSDASTQLNTHYAFSKLTYKSSSGHEVENSTTDTQVISHEKENKLESLVLTHLSRCDSDLCEMNAGMPKGNLNEQDPKHCPESEKCLLSIEDEESQQSILSSLENHSQQSTQPEMHKYGQLVKVELEENAEDDKTENQIPQRMTRNKANTMANQSKQILASCTLLSEKDSESSSPRGRIRLTEDDDPQIHHPRKRKVSRVPQPVQVSPSLLQAKEKTQQSLAAIVDSLKLDEIQPYSSERANPYFEYLHIRKKIEEKRKLLCSVIPQAPQYYDEYVTFNGSYLLDGNPLSKICIPTITPPPSLSDPLKELFRQQEVVRMKLRLQHSIEREKLIVSNEQEVLRVHYRAARTLANQTLPFSACTVLLDAEVYNVPLDSQSDDSKTSVRDRFNARQFMSWLQDVDDKFDKLKTCLLMRQQHEAAALNAVQRLEWQLKLQELDPATYKSISIYEIQEFYVPLVDVNDDFELTPI

SEQ ID NO: 907363 - protein, 1238 aa, Homo sapiens
DVIVVLMKTAFLGQWISQTLQMPEMLVYQKKDKLDLSECVDKIKEKDKLYSHHTEKCHKEGEKSKNTAAIKKTDDREKSREKMDRKHDKEKPEKERHLAESKEKHLMEKKNKQSDNSEYSKSEKGKNKEKDRELDKKEKSRDKESINITNSKHIQEEKKSSIVDGNKAQHEKPLSLKEKTKDEPLKTPDGKEKDKKDKDIDRYKERDKHKDKIQINSLLKLKSEADKPKPKSSPASKDTRPKEKRLVNDDLMQTSFERMLSLKDLEIEQWHKKHKEKIKQKEKERLRNRNCLELKIKDKEKTKHTPTESKNKELTRSKSSEVTDAYTKEKQPKDAVSNRSQSVDTKNVMTLGKSSFVSDNSLNRSPRSENEKPGLSSRSVSMISVASSEDSCHTTVTTPRPPVEYDSDFMLESSESQMSFSQSPFLSIAKSPALHERELDSLADLPERIKPPYANRLSTSHLRSSSVEDVKLIISEGRPTIEVRRCSMPSVICEHTKQFQTISEESNQGSLLTVPGDTSPSPKPEVFSNVPERDLSNVSNIHSSFATSPTGASNSKYVSADRNLIKNTAPVNTVMDSPVHLEPSSQVGVIQNKSWEMPVDRLETLSTRDFICPNSNIPDQESSLQSFCNSENKVLKENADFLSLRQTELPGNSCAQDPASFMPPQQPCSFPSQSLSDAESISKHMSLSYVANQEPGILQQKNAVQIISSALDTDNESTKDTENTFVLGDVQKTDAFVPVYSDSTIQEASPNFEKAYTLPVLPSEKDFNGSDASTQLNTHYAFSKLTYKSSSGHEVENSTTDTQVISHEKENKLESLVLTHLSRCDSDLCEMNAGMPKGNLNEQDPKHCPESEKCLLSIEDEESQQSILSSLENHSQQSTQPEMHKYGQLVKVELEENAEDDKTENQIPQRMTRNKANTMANQSKQILASCTLLSEKDSESSSPRGRIRLTEDDDPQIHHPRKRKVSRVPQPVQVSPSLLQAKEKTQQSLAAIVDSLKLDEIQPYSSERANPYFEYLHIRKKIEEKRKLLCSVIPQAPQYYDEYVTFNGSYLLDGNPLSKICIPTITPPPSLSDPLKELFRQQEVVRMKLRLQHSIEREKLIVSNEQEVLRVHYRAARTLANQTLPFSACTVLLDAEVYNVPLDSQSDDSKTSVRDRFNARQFMSWLQDVDDKFDKLKTCLLMRQQHEAAALNAVQRLEWQLKLQELDPATYKSISIYEIQEFYVPLVDVNDDFELTPI

SEQ ID NO: 907364 - protein, 1888 aa, Homo sapiens
MPKSGFTKPIQSENSDSDSNMVEKPYGRKSKDKIASYSKTPKIERSDVSKEMKEKSSMKRKLPFTISPSRNEERDSDTEKEGPEKKKTKKEAGNKKSTPVSILFGYPLSERKQMALLMQMTARDNSPDSTPNHPSQTTPAQKKTPSSSSRQKDKVNKRNERGETPLHMAAIRGDVKQVKELISLGANVNVKDFAGWTPLHEACNVGYYDVAKILIAAGADVNTQGLDDDTPLHDSASSGHRDIVKLLLRHGGNPFQANKHGERPVDVAETEELELLLKREVPLSDDDESYTDSEEAQSVNPSSVDENIDSETEKDSLICESKQILPSKTPLPSALDEYEFKDDDDEEINKMIDDRHILRKEQRKENEPEAEKTHLFAKQEKAFYPKSFKSKKQKPSRVLYSSTESSDEEALQNKKISTSCSVIPETSNSDMQTKKEYVVSGEHKQKGKVKRKLKNQNKNKENQELKQEKEGKENTRITNLTVNTGLDCSEKTREEGNFRKSFSPKDDTSLHLFHISTGKSPKHSCGLSEKQSTPLKQEHTKTCLSPGSSEMSLQPDLVRYDNTESEFLPESSSVKSCKHKEKSKHQKDFHLEFGEKSNAKIKDEDHSPTFENSDCTLKKMDKEGKTLKKHKLKHKEREKEKHKKEIEGEKEKYKTKDSAKELQRSVEFDREFWKENFFKSDETEDLFLNMEHESLTLEKKSKLEKNIKDDKSTKEKHVSKERNFKEERDKIKKESEKSFREEKIKDLKEERENIPTDKDSEFTSLGMSAIEESIGLHLVEKEIDIEKQEKHIKESKEKPEKRSQIKEKDIEKMERKTFEKEKKIKHEHKSEKDKLDLSECVDKIKEKDKLYSHHTEKCHKEGEKSKNTAAIKKTDDREKSREKMDRKHDKEKPEKERHLAESKEKHLMEKKNKQSDNSEYSKSEKGKNKEKDRELDKKEKSRDKESINITNSKHIQEEKKSSIVDGNKAQHEKPLSLKEKTKDEPLKTPDGKEKDKKDKDIDRYKERDKHKDKIQINSLLKLKSEADKPKPKSSPASKDTRPKEKRLVNDDLMQTSFERMLSLKDLEIEQWHKKHKEKIKQKEKERLRNRNCLELKIKDKEKTKHTPTESKNKELTRSKSSEVTDAYTKEKQPKDAVSNRSQSVDTKNVMTLGKSSFVSDNSLNRSPRSENEKPGLSSRSVSMISVASSEDSCHTTVTTPRPPVEYDSDFMLESSESQMSFSQSPFLSIAKSPALHERELDSLADLPERIKPPYANRLSTSHLRSSSVEDVKLIISEGRPTIEVRRCSMPSVICEHTKQFQTISEESNQGSLLTVPGDTSPSPKPEVFSNVPERDLSNVSNIHSSFATSPTGASNSKYVSADRNLIKNTAPVNTVMDSPVHLEPSSQVGVIQNKSWEMPVDRLETLSTRDFICPNSNIPDQESSLQSFCNSENKVLKENADFLSLRQTELPGNSCAQDPASFMPPQQPCSFPSQSLSDAESISKHMSLSYVANQEPGILQQKNAVQIISSALDTDNESTKDTENTFVLGDVQKTDAFVPVYSDSTIQEASPNFEKAYTLPVLPSEKDFNGSDASTQLNTHYAFSKLTYKSSSGHEVENSTTDTQVISHEKENKLESLVLTHLSRCDSDLCEMNAGMPKGNLNEQDPKHCPESEKCLLSIEDEESQQSILSSLENHSQQSTQPEMHKYGQLVKVELEENAEDDKTENQIPQRMTRNKANTMANQSKQILASCTLLSEKDSESSSPRGRIRLTEDDDPQIHHPRKRKVSRVPQPVQVSPSLLQAKEKTQQSLAAIVDSLKLDEIQPYSSERANPYFEYLHIRKKIEEKRKLLCSVIPQAPQYYDEYVTFNGSYLLDGNPLSKICIPTVSNIITCYTPVTLPNRSIMLATY

SEQ ID NO: 907365 - protein, 898 aa, Homo sapiens
MPKSGFTKPIQSENSDSDSNMVEKPYGRKSKDKIASYSKTPKIERSDVSKEMKEKSSMKRKLPFTISPSRNEERDSDTEKEGPEKKKTKKEAGNKKSTPVSILFGYPLSERKQMALLMQMTARDNSPDSTPNHPSQTTPAQKKTPSSSSRQKDKVNKRNERGETPLHMAAIRGDVKQVKELISLGANVNVKDFAGWTPLHEACNVGYYDVAKILIAAGADVNTQGLDDDTPLHDSASSGHRDIVKLLLRHGGNPFQANKHGERPVDVAETEELELLLKREVPLSDDDESYTDSEEAQSVNPSSVDENIDSETEKDSLICESKQILPSKTPLPSALDEYEFKDDDDEEINKMIDDRHILRKEQRKENEPEAEKTHLFAKQEKAFYPKSFKSKKQKPSRVLYSSTESSDEEALQNKKISTSCSVIPETSNSDMQTKKEYVVSGEHKQKGKVKRKLKNQNKNKENQELKQEKEGKENTRITNLTVNTGLDCSEKTREEGNFRKSFSPKDDTSLHLFHISTGKSPKHSCGLSEKQSTPLKQEHTKTCLSPGSSEMSLQPDLVRYDNTESEFLPESSSVKSCKHKEKSKHQKDFHLEFGEKSNAKIKDEDHSPTFENSDCTLKKMDKEGKTLKKHKLKHKEREKEKHKKEIEGEKEKYKTKDSAKELQRSVEFDREFWKENFFKSDETEDLFLNMEHESLTLEKKSKLEKNIKDDKSTKEKHVSKERNFKEERDKIKKESEKSFREEKIKDLKEERENIPTDKDSEFTSLGMSAIEESIGLHLVEKEIDIEKQEKHIKESKEKPEKRSQIKEKDIEKMERKTFEKEKKIKHEHKSEKDKLDLSECVDKIKERTSYIRITQKNAIKKVRRAKILLLLKKLTTERKVEKRWIGNMTKKSLKKRGI

SEQ ID NO: 907366 - protein, 294 aa, Homo sapiens [sequence omitted]

SEQ ID NO: 907367 - protein, 2062 aa, Homo sapiens
MPKSGFTKPIQSENSDSDSNMVEKPYGRKSKDKIASYSKTPKIERSDVSKEMKEKSSMKRKLPFTISPSRNEERDSDTDSDPGHTSENWGERLISSYRTYSEKEGPEKKKTKKEAGNKKSTPVSILFGYPLSERKQMALLMQMTARDNSPDSTPNHPSQTTPAQKKTPSSSSRQKDKVNKRNERGETPLHMAAIRGDVKQVKELISLGANVNVKDFAGWTPLHEACNVGYYDVAKILIAAGADVNTQGLDDDTPLHDSASSGHRDIVKLLLRHGGNPFQANKHGERPVDVAETEELELLLKREVPLSDDDESYTDSEEAQSVNPSSVDENIDSETEKDSLICESKQILPSKTPLPSALDEYEFKDDDDEEINKMIDDRHILRKEQRKENEPEAEKTHLFAKQEKAFYPKSFKSKKQKPSRVLYSSTESSDEEALQNKKISTSCSVIPETSNSDMQTKKEYVVSGEHKQKGKVKRKLKNQNKNKENQELKQEKEGKENTRITNLTVNTGLDCSEKTREEGNFRKSFSPKDDTSLHLFHISTGKSPKHSCGLSEKQSTPLKQEHTKTCLSPGSSEMSLQPDLVRYDNTESEFLPESSSVKSCKHKEKSKHQKDFHLEFGEKSNAKIKDEDHSPTFENSDCTLKKMDKEGKTLKKHKLKHKEREKEKHKKEIEGEKEKYKTKDSAKELQRSVEFDREFWKENFFKSDETEDLFLNMEHESLTLEKKSKLEKNIKDDKSTKEKHVSKERNFKEERDKIKKESEKSFREEKIKDLKEERENIPTDKDSEFTSLGMSAIEESIGLHLVEKEIDIEKQEKHIKESKEKPEKRSQIKEKDIEKMERKTFEKEKKIKHEHKSEKDKLDLSECVDKIKEKDKLYSHHTEKCHKEGEKSKNTAAIKKTDDREKSREKMDRKHDKEKPEKERHLAESKEKHLMEKKNKQSDNSEYSKSEKGKNKEKDRELDKKEKSRDKESINITNSKHIQEEKKSSIVDGNKAQHEKPLSLKEKTKDEPLKTPDGKEKDKKDKDIDRYKERDKHKDKIQINSLLKLKSEADKPKPKSSPASKDTRPKEKRLVNDDLMQTSFERMLSLKDLEIEQWHKKHKEKIKQKEKERLRNRNCLELKIKDKEKTKHTPTESKNKELTRSKSSEVTDAYTKEKQPKDAVSNRSQSVDTKNVMTLGKSSFVSDNSLNRSPRSENEKPGLSSRSVSMISVASSEDSCHTTVTTPRPPVEYDSDFMLESSESQMSFSQSPFLSIAKSPALHERELDSLADLPERIKPPYANRLSTSHLRSSSVEDVKLIISEGRPTIEVRRCSMPSVICEHTKQFQTISEESNQGSLLTVPGDTSPSPKPEVFSNVPERDLSNVSNIHSSFATSPTGASNSKYVSADRNLIKNTAPVNTVMDSPVHLEPSSQVGVIQNKSWEMPVDRLETLSTRDFICPNSNIPDQESSLQSFCNSENKVLKENADFLSLRQTELPGNSCAQDPASFMPPQQPCSFPSQSLSDAESISKHMSLSYVANQEPGILQQKNAVQIISSALDTDNESTKDTENTFVLGDVQKTDAFVPVYSDSTIQEASPNFEKAYTLPVLPSEKDFNGSDASTQLNTHYAFSKLTYKSSSGHEVENSTTDTQVISHEKENKLESLVLTHLSRCDSDLCEMNAGMPKGNLNEQDPKHCPESEKCLLSIEDEESQQSILSSLENHSQQSTQPEMHKYGQLVKVELEENAEDDKTENQIPQRMTRNKANTMANQSKQILASCTLLSEKDSESSSPRGRIRLTEDDDPQIHHPRKRKVSRVPQPVQVSPSLLQAKEKTQQSLAAIVDSLKLDEIQPYSSERANPYFEYLHIRKKIEEKRKLLCSVIPQAPQYYDEYVTFNGSYLLDGNPLSKICIPTITPPPSLSDPLKELFRQQEVVRMKLRLQHSIEREKLIVSNEQEVLRVHYRAARTLANQTLPFSACTVLLDAEVYNVPLDSQSDDSKTSVRDRFNARQFMSWLQDVDDKFDKLKTCLLMRQQHEAAALNAVQRLEWQLKLQELDPATYKSISIYEIQEFYVPLVDVNDDFELTPI

SEQ ID NO: 907368 - protein, 1956 aa, Homo sapiens
LNRSASVFAQRVDTKKNANWCGFLIASFLFGLLLLQMTARDNSPDSTPNHPSQTTPAQKKTPSSSSRQKDKVNKRNERGETPLHMAAIRGDVKQVKELISLGANVNVKDFAGWTPLHEACNVGYYDVAKILIAAGADVNTQGLDDDTPLHDSASSGHRDIVKLLLRHGGNPFQANKHGERPVDVAETEELELLLKREVPLSDDDESYTDSEEAQSVNPSSVDENIDSETEKDSLICESKQILPSKTPLPSALDEYEFKDDDDEEINKMIDDRHILRKEQRKENEPEAEKTHLFAKQEKAFYPKSFKSKKQKPSRVLYSSTESSDEEALQNKKISTSCSVIPETSNSDMQTKKEYVVSGEHKQKGKVKRKLKNQNKNKENQELKQEKEGKENTRITNLTVNTGLDCSEKTREEGNFRKSFSPKDDTSLHLFHISTGKSPKHSCGLSEKQSTPLKQEHTKTCLSPGSSEMSLQPDLVRYDNTESEFLPESSSVKSCKHKEKSKHQKDFHLEFGEKSNAKIKDEDHSPTFENSDCTLKKMDKEGKTLKKHKLKHKEREKEKHKKEIEGEKEKYKTKDSAKELQRSVEFDREFWKENFFKSDETEDLFLNMEHESLTLEKKSKLEKNIKDDKSTKEKHVSKERNFKEERDKIKKESEKSFREEKIKDLKEERENIPTDKDSEFTSLGMSAIEESIGLHLVEKEIDIEKQEKHIKESKEKPEKRSQIKEKDIEKMERKTFEKEKKIKHEHKSEKDKLDLSECVDKIKEKDKLYSHHTEKCHKEGEKSKNTAAIKKTDDREKSREKMDRKHDKEKPEKERHLAESKEKHLMEKKNKQSDNSEYSKSEKGKNKEKDRELDKKEKSRDKESINITNSKHIQEEKKSSIVDGNKAQHEKPLSLKEKTKDEPLKTPDGKEKDKKDKDIDRYKERDKHKDKIQINSLLKLKSEADKPKPKSSPASKDTRPKEKRLVNDDLMQTSFERMLSLKDLEIEQWHKKHKEKIKQKEKERLRNRNCLELKIKDKEKTKHTPTESKNKELTRSKSSEVTDAYTKEKQPKDAVSNRSQSVDTKNVMTLGKSSFVSDNSLNRSPRSENEKPGLSSRSVSMISVASSEDSCHTTVTTPRPPVEYDSDFMLESSESQMSFSQSPFLSIAKSPALHERELDSLADLPERIKPPYANRLSTSHLRSSSVEDVKLIISEGRPTIEVRRCSMPSVICEHTKQFQTISEESNQGSLLTVPGDTSPSPKPEVFSNVPERDLSNVSNIHSSFATSPTGASNSKYVSADRNLIKNTAPVNTVMDSPVHLEPSSQVGVIQNKSWEMPVDRLETLSTRDFICPNSNIPDQESSLQSFCNSENKVLKENADFLSLRQTELPGNSCAQDPASFMPPQQPCSFPSQSLSDAESISKHMSLSYVANQEPGILQQKNAVQIISSALDTDNESTKDTENTFVLGDVQKTDAFVPVYSDSTIQEASPNFEKAYTLPVLPSEKDFNGSDASTQLNTHYAFSKLTYKSSSGHEVENSTTDTQVISHEKENKLESLVLTHLSRCDSDLCEMNAGMPKGNLNEQDPKHCPESEKCLLSIEDEESQQSILSSLENHSQQSTQPEMHKYGQLVKVELEENAEDDKTENQIPQRMTRNKANTMANQSKQILASCTLLSEKDSESSSPRGRIRLTEDDDPQIHHPRKRKVSRVPQPVQVSPSLLQAKEKTQQSLAAIVDSLKLDEIQPYSSERANPYFEYLHIRKKIEEKRKLLCSVIPQAPQYYDEYVTFNGSYLLDGNPLSKICIPTITPPPSLSDPLKELFRQQEVVRMKLRLQHSIEREKLIVSNEQEVLRVHYRAARTLANQTLPFSACTVLLDAEVYNVPLDSQSDDSKTSVRDRFNARQFMSWLQDVDDKFDKLKTCLLMRQQHEAAALNAVQRLEWQLKLQELDPATYKSISIYEIQEFYVPLVDVNDDFELTPI

SEQ ID NO: 907369 - protein, 1203 aa, Homo sapiens
KSALFYIYTTPDKLYSHHTEKCHKEGEKSKNTAAIKKTDDREKSREKMDRKHDKEKPEKERHLAESKEKHLMEKKNKQSDNSEYSKSEKGKNKEKDRELDKKEKSRDKESINITNSKHIQEEKKSSIVDGNKAQHEKPLSLKEKTKDEPLKTPDGKEKDKKDKDIDRYKERDKHKDKIQINSLLKLKSEADKPKPKSSPASKDTRPKEKRLVNDDLMQTSFERMLSLKDLEIEQWHKKHKEKIKQKEKERLRNRNCLELKIKDKEKTKHTPTESKNKELTRSKSSEVTDAYTKEKQPKDAVSNRSQSVDTKNVMTLGKSSFVSDNSLNRSPRSENEKPGLSSRSVSMISVASSEDSCHTTVTTPRPPVEYDSDFMLESSESQMSFSQSPFLSIAKSPALHERELDSLADLPERIKPPYANRLSTSHLRSSSVEDVKLIISEGRPTIEVRRCSMPSVICEHTKQFQTISEESNQGSLLTVPGDTSPSPKPEVFSNVPERDLSNVSNIHSSFATSPTGASNSKYVSADRNLIKNTAPVNTVMDSPVHLEPSSQVGVIQNKSWEMPVDRLETLSTRDFICPNSNIPDQESSLQSFCNSENKVLKENADFLSLRQTELPGNSCAQDPASFMPPQQPCSFPSQSLSDAESISKHMSLSYVANQEPGILQQKNAVQIISSALDTDNESTKDTENTFVLGDVQKTDAFVPVYSDSTIQEASPNFEKAYTLPVLPSEKDFNGSDASTQLNTHYAFSKLTYKSSSGHEVENSTTDTQVISHEKENKLESLVLTHLSRCDSDLCEMNAGMPKGNLNEQDPKHCPESEKCLLSIEDEESQQSILSSLENHSQQSTQPEMHKYGQLVKVELEENAEDDKTENQIPQRMTRNKANTMANQSKQILASCTLLSEKDSESSSPRGRIRLTEDDDPQIHHPRKRKVSRVPQPVQVSPSLLQAKEKTQQSLAAIVDSLKLDEIQPYSSERANPYFEYLHIRKKIEEKRKLLCSVIPQAPQYYDEYVTFNGSYLLDGNPLSKICIPTITPPPSLSDPLKELFRQQEVVRMKLRLQHSIEREKLIVSNEQEVLRVHYRAARTLANQTLPFSACTVLLDAEVYNVPLDSQSDDSKTSVRDRFNARQFMSWLQDVDDKFDKLKTCLLMRQQHEAAALNAVQRLEWQLKLQELDPATYKSISIYEIQEFYVPLVDVNDDFELTPI

SEQ ID NO: 907370 - protein, 526 aa, Homo sapiens
MPKSGFTKPIQSENSDSDSNMVEKPYGRKSKDKIASYSKTPKIERSDVSKEMKEKSSMKRKLPFTISPSRNEERDSDTEKEGPEKKKTKKEAGNKKSTPVSILFGYPLSERKQMALLMQMTARDNSPDSTPNHPSQTTPAQKKTPSSSSRQKDKVNKRNERGETPLHMAAIRGDVKQVKELISLGANVNVKDFAGWTPLHEACNVGYYDVAKILIAAGADVNTQGLDDDTPLHDSASSGHRDIVKLLLRHGGNPFQANKHGERPVDVAETEELELLLKREVPLSDDDESYTDSEEAQSVNPSSVDENIDSETEKDSLICESKQILPSKTPLPSALDEYEFKDDDDEEINKMIDDRHILRKEQRKENEPEAEKTHLFAKQEKAFYPKSFKSKKQKPSRVLYSSTESSDEEALQNKKISTSCSVIPETSNSDMQTKKEYVVSGEHKQKGKVKRKLKNQNKNKENQELKQEKEGKENTRITNLTVNTGLDVQKRPERRGTLGNLLAQKMILHYIYFIFPLVNLPNILVD

SEQ ID NO: 907371 - protein, 776 aa, Homo sapiens
SWPRDSLHSCLACGDGTALSHSLFPLPLLPAAPTMGGRVFLAFCVWLTLPGAETQDSRGCARWCPQNSSCVNATACRCNPGFSSFSEIITTPTETCDDINECATPSKVSCGKFSDCWNTEGSYDCVCSPGYEPVSGAKTFKNESENTCQDVDECSSGQHQCDSSTVCFNTVGSYSCRCRPGWKPRHGIPNNQKDTVCEDMTFSTWTPPPGVHSQTLSRFFDKVQDLGRDSKTSSAEVTIQNVIKLVDELMEAPGDVEALAPPVRHLIATQLLSNLEDIMRILAKSLPKGPFTYISPSNTELTLMIQERGDKNVTMGQSSARMKLNWAVAAGAEDPGPAVAGILSIQNMTTLLANASLNLHSKKQAELEEIYESSIRGVQLRRLSAVNSIFLSHNNTKELNSPILFAFSHLESSDGEAGRDPPAKDVMPGPRQELLCAFWKSDSDRGGHWATEGCQVLGSKNGSTTCQCSHLSSFAILMAHYDVEDWKLTLITRVGLALSLFCLLLCILTFLLVRPIQGSRTTIHLHLCICLFVGSTIFLAGIENEGGQVGLRCRLVAGLLHYCFLAAFCWMSLEGLELYFLVVRVFQGQGLSTRWLCLIGYGVPLLIVGVSAAIYSKGYGRPRYCWLDFEQGFLWSFLGPVTFIILCNAVIFVTTVWKLTQKFSEINPDMKKLKKARALTITAIAQLFLLGCTWVFGLFIFDDRSLVLTYVFTILNCLQGAFLYLLHCLLNKKVREEYRKWACLVAGGSKYSEFTSTTSGTGHNQTRALRASESGI

SEQ ID NO: 907372 - protein, 75 aa, Homo sapiens
KSYPPELSVSRCSLVTSHLTHLCQLPSAAVFARQTLSRFFDKVQDLGRDSKTSSAEVTIQVRAGCWGTPGQCRIS

SEQ ID NO: 907373 - protein, 820 aa, Homo sapiens
SWPRDSLHSCLACGDGTALSHSLFPLPLLPAAPTMGGRVFLAFCVWLTLPGAETQDSRGCARWCPQNSSCVNATACRCNPGFSSFSEIITTPTETCDDINECATPSKVSCGKFSDCWNTEGSYDCVCSPGYEPVSGAKTFKNESENTCQDVDECQQNPRLCKSYGTCVNTLGSYTCQCLPGFKFIPEDPKVCTDVDECSSGQHQCDSSTVCFNTVGSYSCRCRPGWKPRHGIPNNQKDTVCEDMTFSTWTPPPGVHSQTLSRFFDKVQDLGRDSKTSSAEVTIQNVIKLVDELMEAPGDVEALAPPVRHLIATQLLSNLEDIMRILAKSLPKGPFTYISPSNTELTLMIQERGDKNVTMGQSSARMKLNWAVAAGAEDPGPAVAGILSIQNMTTLLANASLNLHSKKQAELEEIYESSIRGVQLRRLSAVNSIFLSHNNTKELNSPILFAFSHLESSDGEAGRDPPAKDVMPGPRQELLCAFWKSDSDRGGHWATEGCQVLGSKNGSTTCQCSHLSSFAILMAHYDVEDWKLTLITRVGLALSLFCLLLCILTFLLVRPIQGSRTTIHLHLCICLFVGSTIFLAGIENEGGQVGLRCRLVAGLLHYCFLAAFCWMSLEGLELYFLVVRVFQGQGLSTRWLCLIGYGVPLLIVGVSAAIYSKGYGRPRYCWLDFEQGFLWSFLGPVTFIILCNAVIFVTTVWKLTQKFSEINPDMKKLKKARALTITAIAQLFLLGCTWVFGLFIFDDRSLVLTYVFTILNCLQGAFLYLLHCLLNKKVREEYRKWACLVAGGSKYSEFTSTTSGTGHNQTRALRASESGI

SEQ ID NO: 907374 - protein, 577 aa, Homo sapiens
MTFSTWTPPPGVHSQTLSRFFDKVQDLGRDSKTSSAEVTIQNVIKLVDELMEAPGDVEALAPPVRHLIATQLLSNLEDIMRILAKSLPKGPFTYISPSNTELTLMIQERGDKNVTMGQSSARMKLNWAVAAGAEDPGPAVAGILSIQNMTTLLANASLNLHSKKQAELEEIYESSIRGVQLRRLSAVNSIFLSHNNTKELNSPILFAFSHLESSDGEAGRDPPAKDVMPGPRQELLCAFWKSDSDRGGHWATEGCQVLGSKNGSTTCQCSHLSSFAILMAHYDVEDWKLTLITRVGLALSLFCLLLCILTFLLVRPIQGSRTTIHLHLCICLFVGSTIFLAGIENEGGQVGLRCRLVAGLLHYCFLAAFCWMSLEGLELYFLVVRVFQGQGLSTRWLCLIGYGVPLLIVGVSAAIYSKGYGRPRYCWLDFEQGFLWSFLGPVTFIILCNAVIFVTTVWKLTQKFSEINPDMKKLKKARALTITAIAQLFLLGCTWVFGLFIFDDRSLVLTYVFTILNCLQGAFLYLLHCLLNKKVREEYRKWACLVAGGSKYSEFTSTTSGTGHNQTRALRASESGI

SEQ ID NO: 907375 - protein, 350 aa, Homo sapiens [sequence omitted]

SEQ ID NO: 907376 - protein, 106 aa, Homo sapiens
RGLVGAPYMLVHEGSGRIPEVGLPSCWGEQVLRIHLHHVWHWPQSDPGPQGIRVRHMKAHGSGRPSSSCGHSSFVHEDHPSSLRPPLYSLHPPSLIPCATRREWQL

SEQ ID NO: 907377 - protein, 348 aa, Homo sapiens
SWPRDSLHSCLACGDGTALSHSLFPLPLLPAAPTMGGRVFLAFCVWLTLPGAETQDSRGCARWCPQNSSCVNATACRCNPGFSSFSEIITTPTETCDDINECATPSKVSCGKFSDCWNTEGSYDCVCSPGYEPVSGAKTFKNESENTCQDVDECQQNPRLCKSYGTCVNTLGSYTCQCLPGFKFIPEDPKVCTDVNECTSGQNPCHSSTHCLNNVGSYQCRCRPGWQPIPGSPNGPNNTVCEDVDECSSGQHQCDSSTVCFNTVGSYSCRCRPGWKPRHGIPNNQKDTVCEDMTFSTWTPPPGVHSQTLSRFFDKVQDLGRDSKTSSAEVTIQVRAGCWGTPGQCRIS

SEQ ID NO: 907378 - protein, 296 aa, Homo sapiens
SWPRDSLHSCLACGDGTALSHSLFPLPLLPAAPTMGGRVFLAFCVWLTLPGAETQDSRGCARWCPQNSSCVNATACRCNPGFSSFSEIITTPTETCDDINECATPSKVSCGKFSDCWNTEGSYDCVCSPGYEPVSGAKTFKNESENTCQDVDECQQNPRLCKSYGTCVNTLGSYTCQCLPGFKFIPEDPKVCTDVNECTSGQNPCHSSTHCLNNVGSYQCRCRPGWQPIPGSPNGPNNTVCEDVDECSSGQHQCDSSTVCFNTVGSYSCRCRPGWKPRHGIPNNQKDTVCEGMTWP

SEQ ID NO: 907379 - protein, 296 aa, Homo sapiens; identical to SEQ ID NO: 907378

SEQ ID NO: 907380 - protein, 112 aa, Homo sapiens
VRGMKLEVRWGPTLQPRSSRALTITAIAQLFLLGCTWVFGLFIFDDRSLVLTYVFTILNCLQGAFLYLLHCLLNKKVGAWAQWRTPVILPPIWEAEVGGLLEPRSWRPAWAT

SEQ ID NO: 907381 - protein, 869 aa, Homo sapiens
SWPRDSLHSCLACGDGTALSHSLFPLPLLPAAPTMGGRVFLAFCVWLTLPGAETQDSRGCARWCPQNSSCVNATACRCNPGFSSFSEIITTPTETCDDINECATPSKVSCGKFSDCWNTEGSYDCVCSPGYEPVSGAKTFKNESENTCQDVDECQQNPRLCKSYGTCVNTLGSYTCQCLPGFKFIPEDPKVCTDVNECTSGQNPCHSSTHCLNNVGSYQCRCRPGWQPIPGSPNGPNNTVCEDVDECSSGQHQCDSSTVCFNTVGSYSCRCRPGWKPRHGIPNNQKDTVCEDMTFSTWTPPPGVHSQTLSRFFDKVQDLGRDSKTSSAEVTIQNVIKLVDELMEAPGDVEALAPPVRHLIATQLLSNLEDIMRILAKSLPKGPFTYISPSNTELTLMIQERGDKNVTMGQSSARMKLNWAVAAGAEDPGPAVAGILSIQNMTTLLANASLNLHSKKQAELEEIYESSIRGVQLRRLSAVNSIFLSHNNTKELNSPILFAFSHLESSDGEAGRDPPAKDVMPGPRQELLCAFWKSDSDRGGHWATEGCQVLGSKNGSTTCQCSHLSSFAILMAHYDVEDWKLTLITRVGLALSLFCLLLCILTFLLVRPIQGSRTTIHLHLCICLFVGSTIFLAGIENEGGQVGLRCRLVAGLLHYCFLAAFCWMSLEGLELYFLVVRVFQGQGLSTRWLCLIGYGVPLLIVGVSAAIYSKGYGRPRYCWLDFEQGFLWSFLGPVTFIILCNAVIFVTTVWKLTQKFSEINPDMKKLKKARALTITAIAQLFLLGCTWVFGLFIFDDRSLVLTYVFTILNCLQGAFLYLLHCLLNKKVREEYRKWACLVAGGSKYSEFTSTTSGTGHNQTRALRASESGI

SEQ ID NO: 907382 - protein, 776 aa, Homo sapiens; identical to SEQ ID NO: 907371

SEQ ID NO: 907383 - protein, 794 aa, Homo sapiens
MGVSALTELTSLGGDSLSCCVPDINECATPSKVSCGKFSDCWNTEGSYDCVCSPGYEPVSGAKTFKNESENTCQDVDECQQNPRLCKSYGTCVNTLGSYTCQCLPGFKFIPEDPKVCTDVNECTSGQNPCHSSTHCLNNVGSYQCRCRPGWQPIPGSPNGPNNTVCEDVDECSSGQHQCDSSTVCFNTVGSYSCRCRPGWKPRHGIPNNQKDTVCEDMTFSTWTPPPGVHSQTLSRFFDKVQDLGRDSKTSSAEVTIQNVIKLVDELMEAPGDVEALAPPVRHLIATQLLSNLEDIMRILAKSLPKGPFTYISPSNTELTLMIQERGDKNVTMGQSSARMKLNWAVAAGAEDPGPAVAGILSIQNMTTLLANASLNLHSKKQAELEEIYESSIRGVQLRRLSAVNSIFLSHNNTKELNSPILFAFSHLESSDGEAGRDPPAKDVMPGPRQELLCAFWKSDSDRGGHWATEGCQVLGSKNGSTTCQCSHLSSFAILMAHYDVEDWKLTLITRVGLALSLFCLLLCILTFLLVRPIQGSRTTIHLHLCICLFVGSTIFLAGIENEGGQVGLRCRLVAGLLHYCFLAAFCWMSLEGLELYFLVVRVFQGQGLSTRWLCLIGYGVPLLIVGVSAAIYSKGYGRPRYCWLDFEQGFLWSFLGPVTFIILCNAVIFVTTVWKLTQKFSEINPDMKKLKKARALTITAIAQLFLLGCTWVFGLFIFDDRSLVLTYVFTILNCLQGAFLYLLHCLLNKKVREEYRKWACLVAGGSKYSEFTSTTSGTGHNQTRALRASESGI

SEQ ID NO: 907384 - protein, 527 aa, Homo sapiens
MEAPGDVEALAPPVRHLIATQLLSNLEDIMRILAKSLPKGPFTYISPSNTELTLMIQERGDKNVTMGQSSARMKLNWAVAAGAEDPGPAVAGILSIQNMTTLLANASLNLHSKKQAELEEIYESSIRGVQLRRLSAVNSIFLSHNNTKELNSPILFAFSHLESSDGEAGRDPPAKDVMPGPRQELLCAFWKSDSDRGGHWATEGCQVLGSKNGSTTCQCSHLSSFAILMAHYDVEDWKLTLITRVGLALSLFCLLLCILTFLLVRPIQGSRTTIHLHLCICLFVGSTIFLAGIENEGGQVGLRCRLVAGLLHYCFLAAFCWMSLEGLELYFLVVRVFQGQGLSTRWLCLIGYGVPLLIVGVSAAIYSKGYGRPRYCWLDFEQGFLWSFLGPVTFIILCNAVIFVTTVWKLTQKFSEINPDMKKLKKARALTITAIAQLFLLGCTWVFGLFIFDDRSLVLTYVFTILNCLQGAFLYLLHCLLNKKVREEYRKWACLVAGGSKYSEFTSTTSGTGHNQTRALRASESGI

SEQ ID NO: 907385 - protein, 450 aa, Homo sapiens
SWPRDSLHSCLACGDGTALSHSLFPLPLLPAAPTMGGRVFLAFCVWLTLPGAETQDSRGCARWCPQNSSCVNATACRCNPGFSSFSEIITTPTETCDDINECATPSKVSCGKFSDCWNTEGSYDCVCSPGYEPVSGAKTFKNESENTCQDVDECSSGQHQCDSSTVCFNTVGSYSCRCRPGWKPRHGIPNNQKDTVCEDMTFSTWTPPPGVHSQTLSRFFDKVQDLGRDSKTSSAEVTIQNVIKLVDELMEAPGDVEALAPPVRHLIATQLLSNLEDIMRILAKSLPKGPFTYISPSNTELTLMIQERGDKNVTMGQSSARMKLNWAVAAGAEDPGPAVAGILSIQNMTTLLANASLNLHSKKQAELEEIYESSIRGVQLRRLSAVNSIFLSHNNTKELNSPILFAFSHLESSDGEAGRDPPAKDVMPGPRQELLCAFWKSTFLIPGPLS

SEQ ID NO: 907386 - protein, 440 aa, Homo sapiens
SWPRDSLHSCLACGDGTALSHSLFPLPLLPAAPTMGGRVFLAFCVWLTLPGAETQDSRGCARWCPQNSSCVNATACRCNPGFSSFSEIITTPTETCDDINECATPSKVSCGKFSDCWNTEGSYDCVCSPGYEPVSGAKTFKNESENTCQDVDECSSGQHQCDSSTVCFNTVGSYSCRCRPGWKPRHGIPNNQKDTVCEDMTFSTWTPPPGVHSQTLSRFFDKVQDLGRDSKTSSAEVTIQNVIKLVDELMEAPGDVEALAPPVRHLIATQLLSNLEDIMRILAKSLPKGPFTYISPSNTELTLMIQERGDKNVTMGQSSARMKLNWAVAAGAEDPGPAVAGILSIQNMTTLLANASLNLHSKKQAELEEIYESSIRGVQLRRLSAVNSIFLSHNNTKELNSPILFAFSHLESSDGEAGRDPPAKLAGQEVLTVVKVVDVV

SEQ ID NO: 907387 - protein, 329 aa, Homo sapiens
SWPRDSLHSCLACGDGTALSHSLFPLPLLPAAPTMGGRVFLAFCVWLTLPGAETQDSRGCARWCPQNSSCVNATACRCNPGFSSFSEIITTPTETCDDINECATPSKVSCGKFSDCWNTEGSYDCVCSPGYEPVSGAKTFKNESENTCQDVDECQQNPRLCKSYGTCVNTLGSYTCQCLPGFKFIPEDPKVCTDVNECTSGQNPCHSSTHCLNNVGSYQCRCRPGWQPIPGSPNGPNNTVCEDVDECSSGQHQCDSSTVCFNTVGSYSCRCRPGWKPRHGIPNNQKDTVCEDAFPILRQSPGPGQRLQDKLSRGHHPGKGRMLGDPRTV

SEQ ID NO: 907388 - protein, 106 aa, Homo sapiens
MEAPGDVEALAPPVRHLIATQLLSNLEDIMRILAKSLPKGPFTYISPSNTGEALAWPALPQTLGPTWYLGSLITTAPLPSELTLMIQERGDKNVTMGQSSARMKLN

SEQ ID NO: 907389 - protein, 110 aa, Homo sapiens
TEWAEAGACRREGGRGAGLPSSCSALSSCSRRRCSGRPCPPRPRGAPRKVRPPLCSLPPGSFPFAEVPSRSRPCPEQSVPGTPAAVMAGLGWGAPLSGPGLEDSPAPELE

SEQ ID NO: 907390 - protein, 406 aa, Homo sapiens
MGGGGGVPTGGRPRRGAPFLVLGVELLQPPPLQWSSLPSPAPGCTPQGNKPRVRSIRFAAGHDAEGSHSHVHFDEKLHDSVVMVTQESDSSFLVKVGFLKILHRYEITFTLPPVHRLSKDVREAPVPSLHLKLLSVVPVPEGYSVKCEYSAHKEGVLKEEILLACEGGTGTCVRVTVQARVMGESVRLLVGGGMHKLDCEGFCPPQGTKAEQGILARLRGSQPPWQTGTTARPCCWMVSSVWAPSWNTTQSTATGTALTEARGPACPGPLSLKPRLVPPTCCVMVWLPRPSLGWVWGWSGLAHASHLCLHLCCHPAPPSSSSPTSSSLCASVSCRKKWVEPERRLSEEGRGRAWGGSPTPHPKPQGLPPGSGRGRSWLCGVVAPLLLPCFSHLSCPSLVPTAVHHE

SEQ ID NO: 907391 - protein, 174 aa, Homo sapiens
MAAANKGNKPRVRSIRFAAGHDAEGSHSHVHFDEKLHDSVVMVTQESDSSFLVKVGFLKILHRYEITFTLPPVHRLSKDVREAPVPSLHLKLLSVVPVPEGYSVKCEYSAHKEGVLKEEILLACEGGTGTCVRVTVQARVMDRHHGTPMLLDGVKCVGAELEYDSEHSDWHGFD

SEQ ID NO: 907392 - protein, 199 aa, Homo sapiens
MAAANKGKCLPGVVGLAQALPVGPGRRAIAAGNKPRVRSIRFAAGHDAEGSHSHVHFDEKLHDSVVMVTQESDSSFLVKVGFLKILHRYEITFTLPPVHRLSKDVREAPVPSLHLKLLSVVPVPEGYSVKCEYSAHKEGVLKEEILLACEGGTGTCVRVTVQARVMDRHHGTPMLLDGVKCVGAELEYDSEHSDWHGFD

SEQ ID NO: 907393 - protein, 290 aa, Homo sapiens
MDLTRDKMCSMVKKWQTMIEAHVDVKTTDGYLLRLFCVGFTKKRNNQIRKTSYAQHQQVRQIRKKMMAHTHDPRGADNSDFAHTNVGQLTHLDSRTGPFGAHTPTIYAHTGLCPKSIFISLFHWIVFPGSRTHTVTHTLGLEKEKGPKAFGTLRGEKSLQWGRPFQWGRTRGHGKVPLGTQKANLGGEPHAPRGGPHTRFWNPKGLGFADYMKTQRQVPSKSLVVHRVPETSKLGGGTFTKCAIVEQKKKTRDLIRGRTKESYSARAIRVLTTLFTGKLRSQRGETQTVV

SEQ ID NO: 907394 - protein, 321 aa, Homo sapiens
MDLTRDKMCSMVKKWQTMIEAHVDVKTTDGYLLRLFCVGFTKKRNNQIRKTSYAQHQQVRQIRKKMMAHTHDPRGADNSDFAHTNVGQLTHLDSRTGPFGAHTPTIYAHTGLCPKSIFISLFHWIVFPGSRTHTVTHTLGLEKEKGPKAFGTLRGEKSLQWGRPFQWGRTRGHGKVPLGTQKANLGGEPHAPRGGPHTRFWNPKGLGFADYMKTQRQVPSKSLVVHRVPETSKLGGGTFTKCAIVEQKKKITGRLGENKKKEKPENYRGKKIKGKSKAATFKGIGTWSKTRRKKTTTTREKKKRYRRDKQSDTENNQYPLR

SEQ ID NO: 907395 - protein, 212 aa, Homo sapiens
MDLTRDKMCSMVKKWQTMIEAHVDVKTTDGYLLRLFCVGFTKKRNNQIRKTSYAQHQQVRQIRKKMMAHTHDPRGADNSDFAHTNVGQLTHLDSRTGPFGAHTPTIYAHTGLGPKSIFISLFHWMVLPGSRTHTVTHTLGLEKEKGPKVFGTLRGEKSLQWGRPFQWGRTRGHGKVPLGTQKANLGGEPHAPRGGPHTRFWNPKGLGFADYM

SEQ ID NO: 907396 - protein, 352 aa, Homo sapiens
MDLTRDKMCSMVKKWQTMIEAHVDVKTTDGYLLRLFCVGFTKKRNNQIRKTSYAQHQQVRQIRKKMMAHTHDPRGADNSDFAHTNVGQLTHLDSRTGPFGAHTPTIYAHTGLCPKSIFISLFHWIVFPGSRTHTVTHTLGLEKEKGPKAFGTLRGEKSLQWGRPFQWGRTRGHGKVPLGTQKANLGGEPHAPRGGPHTRFWNPKGLGFADYMKTQRQVPSKSLVVHRVPETSKLGGGTFTKCAIVEQKKKRHPPTQKQHKKPAGDNNSGGRRKEDIHKARSVKQVHAPPFVQQRGIARPPRGGSQIEDGHQNIENTNADTTRHSTGHHSQRDKHRRDAYQTSITTRTDHYRP

SEQ ID NO: 907397 - protein, 262 aa, Homo sapiens
MDLTRDKMCSMVKKWQTMIEAHVDVKTTDGYLLRLFCVGFTKKRNNQIRKTSYAQHQQVRQIRKKMMAHTHDPRGADNSDFAHTNVGQLTHLDSRTGPFGAHTPTIYAHTGLCPKSIFISLFHWIVFPGSRTHTVTHTLGLEKEKGPKAFGTLRGEKSLQWGRPFQWGRTRGHGKVPLGTQKANLGGEPHAPRGGPHTRFWNPKGLGFADYMKTQRQVPSKSLVVHRVPETSKLGGGTFTKCAIVEQKKKIVEKGLGTKKRG

SEQ ID NO: 907398 - protein, 304 aa, Homo sapiens
MDLTRDKMCSMVKKWQTMIEAHVDVKTTDGYLLRLFCVGFTKKRNNQIRKTSYAQHQQVRQIRKKMMAHTHDPRGADNSDFAHTNVGQLTHLDSRTGPFGAHTPTIYAHTGLCPKSIFISLFHWIVFPGSRTHTVTHTLGLEKEKGPKAFGTLRGEKSLQWGRPFQWGRTRGHGKVPLGTQKANLGGEPHAPRGGPHTRFWNPKGLGFADYMKTQRQVPSKSLVVHRVPETSKLGGGTFTKCAIVEQKKKSEWYTTKHNSPGIYDGLGQSDSKGKGTTDAHRSARTARTTQAKGGTHQRPKQRQ

SEQ ID NO: 907399 - protein, 283 aa, Homo sapiens
MDLTRDKMCSMVKKWQTMIEAHVDVKTTDGYLLRLFCVGFTKKRNNQIRKTSYAQHQQVRQIRKKMMAHTHDPRGADNSDFAHTNVGQLTHLDSRTGPFGAHTPTIYAHTGLCPKSIFISLFHWIVFPGSRTHTVTHTLGLEKEKGPKAFGTLRGEKSLQWGRPFQWGRTRGHGKVPLGTQKANLGGEPHAPRGGPHTRFWNPKGLGFADYMKTQRQVPSKSLVVHRVPETSKLGGGTFTKCAIVEQKKKIKRPCAHTKKPGLFRAERKGGVRPLREGPRIDK

SEQ ID NO: 907400 - protein, 262 aa, Homo sapiens; identical to SEQ ID NO: 907397

SEQ ID NO: 907401 - protein, 289 aa, Homo sapiens
MDLTRDKMCSMVKKWQTMIEAHVDVKTTDGYLLRLFCVGFTKKRNNQIRKTSYAQHQQVRQIRKKMMAHTHDPRGADNSDFAHTNVGQLTHLDSRTGPFGAHTPTIYAHTGLCPKSIFISLFHWIVFPGSRTHTVTHTLGLEKEKGPKAFGTLRGEKSLQWGRPFQWGRTRGHGKVPLGTQKANLGGEPHAPRGGPHTRFWNPKGLGFADYMKTQRQVPSKSLVVHRVPETSKLGGGTFTKCAIVEQKKKTGAFSCGKRLEGCYFPALCPGTPAHKGYERLIHTIKTKR

SEQ ID NO: 907402 - protein, 212 aa, Homo sapiens
MDLTRDKMCSMVKKWQTMIEAHVDVKTTDGYLLRLFCVGFTKKRNNQIRKTSYAQHQQVRQIRKKMMAHTHDPRGADNSDFAHTNVGQLTHLDSRTGPFGAHTPTIYAHTGLGPKSIFISLFHWMVFPGSRTHTVTHTLGLEKEKGPKVFGTLRGEKSLQWGRPFQWGRTRGHGKVPLGTQKANLGGEPHAPRGGPHTRFWNPKGLGFADYM

SEQ ID NO: 907403 - protein, 212 aa, Homo sapiens; identical to SEQ ID NO: 907402

SEQ ID NO: 907404 - protein, 212 aa, Homo sapiens; identical to SEQ ID NO: 907402

SEQ ID NO: 907405 - protein, 206 aa, Homo sapiens
MDLTRDKMCSMVKKWQTMIEAHVDVKTTDGYLLRLFCVGFTKKRNNQIRKTSYAQHQQVRQIRKKMMAHTHDPRGADNSDFAHTNVGQLTHLDSRTGPFGAHTPTIYAHTGLGPKSIFISLFHWMVFPGSRTHTVTHTLGLEKEKGPKVFGTLRGEKSLQWGRPFQWGRTRGHGKVPLGTQKANLGGEPHAPRGGPHTRFWSDECG

SEQ ID NO: 907406 - protein, 222 aa, Homo sapiens
MDLTRDKMCSMVKKWQTMIEAHVDVKTTDGYLLRLFCVGFTKKRNNQIRKTSYAQHQQVRQIRKKMMAHTHDPRGADNSDFAHTNVGQLTHLDSRTGPFGAHTPTIYAHTGLGPKSIFISLFHWMVFPGSRTHTVTHTLGLEKEKGPKVFGTLRGEKSLQWGRPFQWGRTRGHGKVPLGTQKANLGGEPHAPRGGPHTRFWMWFDTVRIVSSIMWLKGLGKQ

SEQ ID NO: 907407 - protein, 193 aa, Homo sapiens
MDLTRDKMCSMVKKWQTMIEAHVDVKTTDGYLLRLFCVGFTKKRNNQIRKTSYAQHQQVRQIRKKMMAHTHDPRGADNSDFAHTNVGQLTHLDSRTGPFGAHTPTIYAHTGLGPKSIFISLFHWMVFPGSRTHTVTHTLGLEKEKGPKVFGTLRGEKSLQWGRPFQWGIWKPGANRASDGVVTPHCCPSLEKV

SEQ ID NO: 907408 - protein, 272 aa, Homo sapiens
MDLTRDKMCSMVKKWQTMIEAHVDVKTTDGYLLRLFCVGFTNQIRKKMMAHTHDPRGADNSDFAHTNVGQLTHLDSRTGPFGAHTPTIYAHTGLGPKSIFISLFHWMVFPGSRTHTVTHTLGLEKEKGPKVFGTLRGEKSLQWGRPFQWGRTRGHGKVPLGTQKANLGGEPHAPRGGPHTRFWNPKGLGFADYMKTQHQVPRKSLVVHRVPETSKLGGGTFTKCAIVEQKKKTRDLIRGRTKESDSARAIRVLTTFFTGKLRSQRGETQTVV

SEQ ID NO: 907409 - protein, 212 aa, Homo sapiens; identical to SEQ ID NO: 907402

SEQ ID NO: 907410 - protein, 212 aa, Homo sapiens
MDLTRDKMCSMVKKWQTMIEAHVDVKTTDGYLLRLFCVGFTKKRNNQIRKTSYAQHQQVRQIRKKMMAHTHDPRGADNSDFAHTNVGQLTHLDSRTGPLRAHTPTIYAHTGLGPKSIFISLFHWMVFPGSRTHTVTHTLGLEKEKGPKVFGTLRGEKSLQWGRPFQWGRTRGHGKVPLGTQKANLGGEPHAPRGGPHTRFWNPKGLGFADYM

SEQ ID NO: 907411 - protein, 304 aa, Homo sapiens
MDLTRDKMCSMVKKWQTMIEAHVDVKTTDGYLLRLFCVGFTKKRNNQIRKTSYAQHQQVRQIRKKMMAHTHDPRGADNSDFAHTNVGQLTHLDSRTGPLRAHTPTIYAHTGLGPKSIFISLFHWMVFPGSRTHTVTHTLGLEKEKGPKVFGTLRGEKSLQWGRPFQWGRTRGHGKVPLGTQKANLGGEPHAPRGGPHTRFWNPKGLGFADYMKTQHQVPSKSLVVHRVPETSKLGGGTFTKCAIVEQKKKSEWYTTKHNSPGIYDGLGQSDSKGKGTTDAHRSARTARTTQAKGGTHQRPKQRQ

SEQ ID NO: 907412 - protein, 296 aa, Homo sapiens
MDLTRDKMCSMVKKWQTMIEAHVDVKTTDGYLLRLFCVGFTKKRNNQIRKTSYAQHQQVRQIRKKMMAHTHDPRGADNSDFAHTNVGQLTHLDSRTGPFGAHTPTIYAHTGLCPKSIFISLFHWIVFPGSRTHTVTHTLGLEKEKGPKAFGTLRGEKSLQWGRPFQWGRTRGHGKVPLGTQKANLGGEPHAPRGGPHTRFWNPKGLGFADYMKTQRQVPSKSLVVHRVPETSKLGGGTFTKCAIVEQKKKSTYKGPLAKHNTKTREQREKKKRGGEKNTQKGAKKPHRMKKGPQGQ

SEQ ID NO: 907413 - protein, 206 aa, Homo sapiens; identical to SEQ ID NO: 907405

SEQ ID NO: 907414 - protein, 352 aa, Homo sapiens; identical to SEQ ID NO: 907396

SEQ ID NO: 907415 - protein, 296 aa, Homo sapiens; identical to SEQ ID NO: 907412

SEQ ID NO: 907416 - protein, 321 aa, Homo sapiens; identical to SEQ ID NO: 907394

SEQ ID NO: 907417 - protein, 212 aa, Homo sapiens; identical to SEQ ID NO: 907402

SEQ ID NO: 907418 - protein, 212 aa, Homo sapiens; identical to SEQ ID NO: 907402

SEQ ID NO: 907419 - protein, 222 aa, Homo sapiens
MDLTRDKMCSMVKKWQTMIEAHVDVKTTDGYLLRLFCVGFTKKRNNQIRKTSYAQHQQVRQIRKKMMAHTHDPRGADNSDFAHTNVGQLTHLDSRTGPFGAHTPTIYAHTGLGPKSIFISLFHWMVFPGSRTHTVTHTLGLEKEKGPKVFGTLRGEKSLQWGRPFQWGRTRGHGKVPLGTQKANLGGEPHAPRGGPHTRFWKRGINPSKLVVRFCASGLGKK

SEQ ID NO: 907420 - protein, 216 aa, Homo sapiens
MDLTRDKMCSMVKKWQTMIEAHVDVKTTDGYLLRLFCVGFTKKRNNQIRKTSYAQHQQVRQIRKKMMAHTHDPRGIPEQGHFGHTHRPFTHTQGFAPNLFLFPSSNGLSFPVHAHTRSHTHLAWKKKKAPKFLAHFGGKKASNGEGLSNGVAQGATVKFLGGHKRPTWGGNRTHHGVGLTQGFGTRKASDLRIICNPNTRSQGNPWFYTGFQKLPN

SEQ ID NO: 907421 - protein, 182 aa, Homo sapiens
MDLTRDKMCSMVKKWQTMIETSYAQHQQVRQIRKKMMAHTHDPRGADNSDFAHTNVGQLTHLDSRTGPFGAHTPTIYAHTGLCPKSIFISLFHWIVFPGSRTHTVTHTLGLEKEKGPKAFGTLRGEKSLQWGRPFQWGRTRGHGKVPLGTQKANLGGEPHAPRGGPHTRFWNPKGLGFADYM

SEQ ID NO: 907422 - protein, 1405 aa, Homo sapiens
MRGFLARPFLSTNQHLAQWGSPLPQGKGLVQLPSQHTRHSRPFHELCSKEENSATVPKLISLVVSSETIDFSNKTMDSRRDWEREKRILEGKLQLPKALARTQRARDEGRAWTSRWLQRRRSPESCEAPLSAPLWGPQRGLPGREPLRSRSASAIALRTIGHILALLLRLLHLGLGSGGCREDVPPSGRGKKEEKMKKHRRALALVSCLFLCSLVWLPSWRVCCKESSSASASSYYSQDDNCALENEDVQFQKKNTESKKLSPPVVETLPTVDLHEESSNAVVDSETVENISSSSTSEITPISKLDEIEKSGTIPIAKPSETEQSETDCDVGEALDASAPIEQPSFVSPPDSLVGQHIENVSSSHGKGKITKSEFESKVSASEQGGGDPKSALNASDNLKNESSDYTKPGDIDPTSVASPKDPEDIPTFDEWKKKVMEVEKEKSQSMHASSNGGSHATKKVQKNRNNYASVECGAKILAANPEAKSTSAILIENMDLYMLNPCSTKIWFVIELCEPIQVKQLDIANYELFSSTPKDFLVSISDRYPTNKWIKLGTFHGRDERNVQSFPLDEQMYAKYVKVELLSHFGSEHFCPLSLIRVFGTSMVEEYEEIADSQYHSERQELFDEDYDYPLDYNTGEDKSSKNLLGSATNAILNMVNIAANILGAKTEDLTEGNKSISENATATAAPKMPESTPVSTPVPSPEYVTTEVHTHDMEPSTPDTPKESPIVQLVQEEEEEASPSTVTLLGSGEQEDESSPWFESETQIFCSELTTICCISSFSEYIYKWCSVRVALYRQRSRTALSKGKDYLVLAQPPLLLPAESVDVSVLQPLSGELENTNIEREAETVVLGDLSSSMHQDDLVNHTVDAVELEPSHSQTLSQSLLLDITPEINPLPKIEVSESVEYEAGHIPSPVIPQESSVEIDNETEQKSESFSSIEKPSITYETNKVNELMDNIIKEDVNSMQIFTKLSETIVPPINTATVPDNEDGEAKMNIADTAKQTLISVVDSSSLPEVKEEEQSPEDALLRGLQRTATDFYAELQNSTDLGYANGNLVHGSNQKESVFMRLNNRIKALEVNMSLSGRYLEELSQRYRKQMEEMQKAFNKTIVKLQNTSRIAEEQDQRQTEAIQLLQAQLTNMTQLVSNLSATVAELKREVSDRQSYLVISLVLCVVLGLMLCMQRCRNTSQFDGDYISKLPKSNQYPSPKRCFSSYDDMNLKRRTSFPLMRSKSLQLTGKEVDPNDLYIVEPLKFSPEKKKKRCKYKIEKIETIKPEEPLHPIANGDIKGRKPFTNQRDFSNMGEVYHSSYKGPPSEGSSETSSQSEESYFCGISACTSLCNGQSQKTKTEKRALKRRRSKVQDQGKLIKTLIQTKSGSLPSLHDIIKGNKEITVGTFGVTAVSGHI

SEQ ID NO: 907423 - protein, 266 aa, Homo sapiens [sequence omitted]

SEQ ID NO: 907424 - protein, 1210 aa, Homo sapiens
MKKHRRALALVSCLFLCSLVWLPSWRVCCKESSSASASSYYSQDDNCALENEDVQFQKKNTESKKLSPPVVETLPTVDLHEESSNAVVDSETVENISSSSTSEITPISKLDEIEKSGTIPIAKPSETEQSETDCDVGEALDASAPIEQPSFVSPPDSLVGQHIENVSSSHGKGKITKSEFESKVSASEQGGGDPKSALNASDNLKNESSDYTKPGDIDPTSVASPKDPEDIPTFDEWKKKVMEVEKEKSQSMHASSNGGSHATKKVQKNRNNYASVECGAKILAANPEAKSTSAILIENMDLYMLNPCSTKIWFVIELCEPIQVKQLDIANYELFSSTPKDFLVSISDRYPTNKWIKLGTFHGRDERNVQSFPLDEQMYAKYVKVELLSHFGSEHFCPLSLIRVFGTSMVEEYEEIADSQYHSERQELFDEDYDYPLDYNTGEDKSSKNLLGSATNAILNMVNIAANILGAKTEDLTEGNKSISENATATAAPKMPESTPVSTPVPSPEYVTTEVHTHDMEPSTPDTPKESPIVQLVQEEEEEASPSTVTLLGSGEQEDESSPWFESETQIFCSELTTICCISSFSEYIYKWCSVRVALYRQRSRTALSKGKDYLVLAQPPLLLPAESVDVSVLQPLSGELENTNIEREAETVVLGDLSSSMHQDDLVNHTVDAVELEPSHSQTLSQSLLLDITPEINPLPKIEVSESVEYEAGHIPSPVIPQESSVEIDNETEQKSESFSSIEKPSITYETNKVNELMDNIIKEDVNSMQIFTKLSETIVPPINTATVPDNEDGEAKMNIADTAKQTLISVVDSSSLPEVKEEEQSPEDALLRGLQRTATDFYAELQNSTDLGYANGNLVHGSNQKESVFMRLNNRIKALEVNMSLSGRYLEELSQRYRKQMEEMQKAFNKTIVKLQNTSRIAEEQDQRQTEAIQLLQAQLTNMTQLVSNLSATVAELKREVSDRQSYLVISLVLCVVLGLMLCMQRCRNTSQFDGDYISKLPKSNQYPSPKRCFSSYDDMNLKRRTSFPLMRSKSLQLTGKEVDPNDLYIVEPLKFSPEKKKKRCKYKIEKIETIKPEEPLHPIANGDIKGRKPFTNQRDFSNMGEVYHSSYKGPPSEGSSETSSQSEESYFCGISACTSLCNGQSQKTKTEKRALKRRRSKVQDQGKLIKTLIQTKSGSLPSLHDIIKGNKEITVGTFGVTAVSGHI

SEQ ID NO: 907425 - protein, 1254 aa, Homo sapiens
MKKHRRALALVSCLFLCSLVWLPSWRVCCKESSSASASSYYSQDDNCALENEDVQFQKKDEREGPINAESLGKSGSNLPISPKEHKLKDDSIVDVQNTESKKLSPPVVETLPTVDLHEESSNAVVDSETVENISSSSTSEITPISKLDEIEKSGTIPIAKPSETEQSETDCDVGEALDASAPIEQPSFVSPPDSLVGQHIENVSSSHGKGKITKSEFESKVSASEQGGGDPKSALNASDNLKNESSDYTKPGDIDPTSVASPKDPEDIPTFDEWKKKVMEVEKEKSQSMHASSNGGSHATKKVQKNRNNYASVECGAKILAANPEAKSTSAILIENMDLYMLNPCSTKIWFVIELCEPIQVKQLDIANYELFSSTPKDFLVSISDRYPTNKWIKLGTFHGRDERNVQSFPLDEQMYAKYVKMFIKYIKVELLSHFGSEHFCPLSLIRVFGTSMVEEYEEIADSQYHSERQELFDEDYDYPLDYNTGEDKSSKNLLGSATNAILNMVNIAANILGAKTEDLTEGNKSISENATATAAPKMPESTPVSTPVPSPEYVTTEVHTHDMEPSTPDTPKESPIVQLVQEEEEEASPSTVTLLGSGEQEDESSPWFESETQIFCSELTTICCISSFSEYIYKWCSVRVALYRQRSRTALSKGKDYLVLAQPPLLLPAESVDVSVLQPLSGELENTNIEREAETVVLGDLSSSMHQDDLVNHTVDAVELEPSHSQTLSQSLLLDITPEINPLPKIEVSESVEYEAGHIPSPVIPQESSVEIDNETEQKSESFSSIEKPSITYETNKVNELMDNIIKEDVNSMQIFTKLSETIVPPINTATVPDNEDGEAKMNIADTAKQTLISVVDSSSLPEVKEEEQSPEDALLRGLQRTATDFYAELQNSTDLGYANGNLVHGSNQKESVFMRLNNRIKALEVNMSLSGRYLEELSQRYRKQMEEMQKAFNKTIVKLQNTSRIAEEQDQRQTEAIQLLQAQLTNMTQLVSNLSATVAELKREVSDRQSYLVISLVLCVVLGLMLCMQRCRNTSQFDGDYISKLPKSNQYPSPKRCFSSYDDMNLKRRTSFPLMRSKSLQLTGKEVDPNDLYIVEPLKFSPEKKKKRCKYKIEKIETIKPEEPLHPIANGDIKGRKPFTNQRDFSNMGEVYHSSYKGPPSEGSSETSSQSEESYFCGISACTSLCNGQSQKTKTEKRALKRRRSKVQDQGKLIKTLIQTKSGSLPSLHDIIKGNKEITVGTFGVTAVSGHI

SEQ ID NO: 907426 - protein, 1210 aa, Homo sapiens; identical to SEQ ID NO: 907424

SEQ ID NO: 907427 - protein, 1055 aa, Homo sapiens
MKKHRRALALVSCLFLCSLVWLPSWRVCCKESSSASASSYYSQDDNCALENEDVQFQKKNTESKKLSPPVVETLPTVDLHEESSNAVVDSETVENISSSSTSEITPISKLDEIEKSGTIPIAKPSETEQSETDCDVGEALDASAPIEQPSFVSPPDSLVGQHIENVSSSHGKGKITKSEFESKVSASEQGGGDPKSALNASDNLKNESSDYTKPGDIDPTSVASPKDPEDIPTFDEWKKKVMEVEKEKSQSMHASSNGGSHATKKVQKNRNNYASVECGAKILAANPEAKSTSAILIENMDLYMLNPCSTKIWFVIELCEPIQVKQLDIANYELFSSTPKDFLVSISDRYPTNKWIKLGTFHGRDERNVQSFPLDEQMYAKYVKVELLSHFGSEHFCPLSLIRVFGTSMVEEYEEIADSQYHSERQELFDEDYDYPLDYNTGEDKSSKNLLGSATNAILNMVNIAANILGAKTEDLTEGNKSISENATATAAPKMPESTPVSTPVPSPEYVTTEVHTHDMEPSTPDTPKESPIVQLVQEEEEEASPSTVTLLGSGEQEDESSPWFESETQIFCSELTTICCISSFSEYIYKWCSVRVALYRQRSRTALSKGKDYLVLAQPPLLLPAESVDVSVLQPLSGELENTNIEREAETVVLGDLSSSMHQDDLVNHTVDAVELEPSHSQTLSQSLLLDITPEINPLPKIEVSESVEYEAGHIPSPVIPQESSVEIDNETEQKSESFSSIEKPSITYETNKVNELMDNIIKEDVNSMQIFTKLSETIVPPINTATVPDNEDGEAKMNIADTAKQTLISVVDSSSLPEVKEEEQSPEDALLRGLQRTATDFYAELQNSTDLGYANGNLVHGSNQKESVFMRLNNRIKALEVNMSLSGRYLEELSQRYRKQMEEMQKAFNKTIVKLQNTSRIAEEQDQRQTEAIQLLQAQLTNMTQLVSNLSATVAELKREVSDRQSYLVISLVLCVVLGLMLCMQRCRNTSQFDGDYISKLPKSNQYPSPKRCFSSYDDMNLKRRTSFPLMRSKSLQLTGKEGRFLWIYNMYI

SEQ ID NO: 907428 - protein, 316 aa, Homo sapiens
MAAPEAPPLDRVFRTTWLSTECDSHPLPPSYRKFLFETQAADLAGGTTVAAGNLLNESEKDCGQDRRAPGVQPCRLVTMTSVVKTVYSLQPPSALSGGQPADTQTRATSKSLLPVRSKEVDVSKQLHSGGPENDVTKITKLRRENGQMKATDTATRRNVRKGYKPLSKQKSEEELKDKNQLLEAVNKQLHQKLTETQGELKDLTQKVELLEKFRDNCLAILESKGLDPALGSETLASRQESTTDHMDSMLLLETLQEELKLFNETAKKQMEELQALKVKLEMKEERVRFLEQQTLCNNQVNDLTTALKEMEQLLEM

SEQ ID NO: 907429 - protein, 240 aa, Homo sapiens
PGIRPLWPGESEIDCGQDRRAPGVQPCRLVTMTSVVKTVYSLQPPSALSGGQPADTQTRATSKSLLPVRSKEVDVSKQLHSGGPENDVTKITKLRRENGQMKATDTATRRNVRKGYKPLSKQKSEEELKDKNQLLEAVNKQLHQKLTETQGELKDLTQKVELLEKFRDNCLAILESKGLDPALGSETLASRQESTTDHMDSMLLLETLQEELKLFNETANRVRFLERIPYLQLMNVLQHA

SEQ ID NO: 907430 - protein, 316 aa, Homo sapiens; identical to SEQ ID NO: 907428

SEQ ID NO: 907431 - protein, 316 aa, Homo sapiens; identical to SEQ ID NO: 907428

SEQ ID NO: 907432 - protein, 316 aa, Homo sapiens; identical to SEQ ID NO: 907428

SEQ ID NO: 907433 - protein, 286 aa, Homo sapiens
MAAPEAPPLDRVFRTTWLSTECDSHPLPPSYRKFLFETQAADLAGGTTVAAGNLLNESEKDCGQDRRAPGVQPCRLVTMTSVVKTVYSLQPPSALSGGQPADTQTRATSKSLLPVRSKEVDVSKQLHSGGPENDVTKITKLRRENGQMKATDTATRRNVRKGYKPLSKQKSEEELKDKNQLLEAVNKQLHQKLTETQGELKDLTQKVELLEKFRDNCLAILESKGLDPALGSETLASRQESTTDHMDSMLLLETLQEELKLFNETAKKQMEELQIAWMNHGILHQM

SEQ ID NO: 907434 - protein, 337 aa, Homo sapiens
MAAPEAPPLDRVFRTTWLSTECDSHPLPPSYRKFLFETQAADLAGGTTVAAGNLLNESEKDCGQDRRAPGVQPCRLVTMTSVVKTVYSLQPPSALSGGQPAEHLNGNPGTSGDEELLEELEPDTQTRATSKSLLPVRSKEVDVSKQLHSGGPENDVTKITKLRRENGQMKATDTATRRNVRKGYKPLSKQKSEEELKDKNQLLEAVNKQLHQKLTETQGELKDLTQKVELLEKFRDNCLAILESKGLDPALGSETLASRQESTTDHMDSMLLLETLQEELKLFNETAKKQMEELQALKVKLEMKEERVRFLEQQTLCNNQVNDLTTALKEMEQLLEM

SEQ ID NO: 907435 - protein, 241 aa, Homo sapiens
MAAPEAPPLDRVFRTTWLSTECDSHPLPPSYRKFLFETQAADLAGGTTVAAGNLLNESEKDCGQDRRAPGVQPCRLVTMTSVVKTVYSLQPPSALSGGQPADTQTRATSKSLLPVRSKEVDVSKQLHSGGPENDVTKITKLRRENGQMKATDTATRRNVRKGYKPLSKQKSEEELKDKNQLLEAVNKQLHQKLTETQGELKDLTQKVELLEKFRDNCLAILESKGLDPVAVRNFARGAEAF

SEQ ID NO: 907436 - protein, 144 aa, Homo sapiens
EKDCGQDRRAPGFGSPGARDWAGWEEGRNELGKEDFLFSNPEPGPVGSRYPRALHSLGPSGPALGNIHPVPSRVQPCRLVTMTSVVKTVYSLQPPSALSGGQPAGEGPSHARGTAAWPGMVSGVWRSNGWRGHGEGRPVGPENL

SEQ ID NO: 907437 - protein, 113 aa, Homo sapiens
MAAPEAPPLDRVFRTTWLSTECDSHPLPPSYRKFLFETQAADLAGGTTVAAGNLLNESEKDCGQDRRAPGVQPCRLVTMTSVVKTVYSLQPPSALSGGQPAEHLNGNPGTSGD

SEQ ID NO: 907438 - protein, 316 aa, Homo sapiens; identical to SEQ ID NO: 907428

SEQ ID NO: 907439 - protein, 316 aa, Homo sapiens; identical to SEQ ID NO: 907428

SEQ ID NO: 907440 - protein, 286 aa, Homo sapiens; identical to SEQ ID NO: 907433

SEQ ID NO: 907441 - protein, 358 aa, Homo sapiens
MAAPEAPPLDRVFRTTWLSTECDSHPLPPSYRKFLFETQAADLAGGTTVAAGNLLNESEKDCGQDRRAPGVQPCRLVTMTSVVKTVYSLQPPSALSGGQPADTQTRATSKSLLPVRSKEVDVSKQLHSGGPENDVTKITKLRRENGQMKATDTATRRNVRKGRSFALVATQAGVQWRNLSSPQPPPPGFKRLSCLSLPNTWDYSYKPLSKQKSEEELKDKNQLLEAVNKQLHQKLTETQGELKDLTQKVELLEKFRDNCLAILESKGLDPALGSETLASRQESTTDHMDSMLLLETLQEELKLFNETAKKQMEELQALKVKLEMKEERVRFLEQQTLCNNQVNDLTTALKEMEQLLEM

SEQ ID NO: 907442 - protein, 105 aa, Homo sapiens
MAAPEAPPLDRVFRTTWLSTECDSHPLPPSYRKFLFETQAADLAGGTTVAAGNLLNESEKDCGQDRRAPGVQPCRLVTMTSVVKTVYSLQPPSALSGGQPAATNH

SEQ ID NO: 907443 - protein, 82 aa, Homo sapiens
KNARNTPPFASYNRERGRQVVYLHNNNISVVGSSDFCPPGHNTKKASYSGVSLFSNPVPVLGDTAIHLQMCLRALCHSTRKL

SEQ ID NO: 907444 - protein, 82 aa, Homo sapiens; identical to SEQ ID NO: 907443

SEQ ID NO: 907445 - protein, 359 aa, Homo sapiens
MKATIILLLLAQVSWAGPFQQRGLFDFMLEDEASGIGPEVPDDRDFEPSLGPVCPFRCQCHLRVVQCSDLGLDKVPKDLPPDTTLLDLQNNKITEIKDGDFKNLKNLHALILVNNKISKVSPGAFTPLVKLERLYLSKNQLKELPEKMPKTLQELRAHENEITKVRKVTFNGLNQMIVIELGTNPLKSSGIENGAFQGMKKLSYIRIADTNITSIPQGLPPSLTELHLDGNKISRVDAASLKGLNNLAKLGLSFNSISAVDNGSLANTPHLRELHLDNNKLTRVPGGLAEHKYIQVVYLHNNNISVVGSSDFCPPGHNTKKASYSGVSLFSNPVQYWEIQPSTFRCVYVRSAIQLGNYK

SEQ ID NO: 907446 - protein, 359 aa, Homo sapiens; identical to SEQ ID NO: 907445

SEQ ID NO: 907447 - protein, 184 aa, Homo sapiens
MIVIELGHQSAEELKELKMGAFQGMKKLSYIRIADTNITSIPQGLPPSLTELHLDGNKISRVDAASLKGLNNLAKLGLSFNSISAVDNGSLANTPHLRELHLDNNKLTRVPGGLAEHKYIQVVYLHNNNISVVGSSDFCPPGHNTKKASYSGVSLFSNPVPVLGDTAIHLQMCLRALCHSTRKL

SEQ ID NO: 907448 - protein, 359 aa, Homo sapiens; identical to SEQ ID NO: 907445

SEQ ID NO: 907449 - protein, 122 aa, Homo sapiens
TEVISPEVVYKQQLGLSFNSISAVDNGSLANTPHLRELHLDNNKLTRVPGGLAEHKYIQVVYLHNNNISVVGSSDFCPPGHNTKKASYSGVSLFSNPVPVLGDTAIHLQMCLRALCHSTRKL

SEQ ID NO: 907450 - protein, 112 aa, Homo sapiens
FYYTDNTLFLSVCTMRLSGPSMPHLRELHLDNNKLTRVPGGLAEHKYIQVVYLHNNNISVVGSSDFCPPGHNTKKASYSGVSLFSNPVPVLGDTAIHLQMCLRALCHSTRKL

SEQ ID NO: 907451 - protein, 80 aa, Homo sapiens
DIKKLGAPPIKYKRERRVVYLHNNNISVVGSSDFCPPGHNTKKASYSGVSLFSNPVPVLGDTAIHLQMCLRALCHSTRKL

SEQ ID NO: 907452 - protein, 184 aa, Homo sapiens; identical to SEQ ID NO: 907447

SEQ ID NO: 907453 - protein, 82 aa, Homo sapiens; identical to SEQ ID NO: 907443

SEQ ID NO: 907454 - protein, 250 aa, Homo sapiens
MKATIILLLLAQVSWAGPFQQRGLFDFMLEDEASGIGPEVPDDRDFEPSLGPVCPFRCQCHLRVVQCSDLELGHQSAEELKELKMGAFQGMKKLSYIRIADTNITSIPQGLPPSLTELHLDGNKISRVDAASLKGLNNLAKLGLSFNSISAVDNGSLANTPHLRELHLDNNKLTRVPGGLAEHKYIQVVYLHNNNISVVGSSDFCPPGHNTKKASYSGVSLFSNPVPVLGDTAIHLQMCLRALCHSTRKL

SEQ ID NO: 907455 - protein, 125 aa, Homo sapiens
EVNTYSEIFSNQIELALGLSFNSISAVDNGSLANTPHLRELHLDNNKLTRVPGGLAEHKYIQVVYLHNNNISVVGSSDFCPPGHNTKKASYSGVSLFSNPVPVLGDTAIHLQMCLRALCHSTRKL

SEQ ID NO: 907456 - protein, 84 aa, Homo sapiens
PRLPAYRTNVPASKKELWCVTVVYLHNNNISVVGSSDFCPPGHNTKKASYSGVSLFSNPVPVLGDTAIHLQMCLRALCHSTRKL

SEQ ID NO: 907457 - protein, 359 aa, Homo sapiens; identical to SEQ ID NO: 907445

SEQ ID NO: 907458 - protein, 359 aa, Homo sapiens; identical to SEQ ID NO: 907445

SEQ ID NO: 907459 - protein, 359 aa, Homo sapiens; identical to SEQ ID NO: 907445

SEQ ID NO: 907460 - protein, 342 aa, Homo sapiens
SRPLGQRHRHESPGRGKDRKEEEEAPVAMGLEAARELECAALGTLLRDPREAERTLLLDCRPFLAFCRRHVRAARPVPWNALLRRRARGPPAAVLACLLPDRALRTRLVRGELARAVVLDEGSASVAELRPDSPAHVLLAALLHETRAGPTAVYFLRGGFDGFQGCCPDLCSEAPAPALPPTGDKTSRSDSRAPVYDQGGPVEILPYLFLGSCSHSSDLQGLQACGITAVLNVSASCPNHFEGLFRYKSIPVEDNQMVEISAWFQEAIGFIDWVKNSGGRVLVHCQAGISRSATICLAYLMQSRRVRLDEAFDFVKQRRGVISPNFSFMGQLLQFETQVLCH

SEQ ID NO: 907461 - protein, 342 aa, Homo sapiens; identical to SEQ ID NO: 907460

SEQ ID NO: 907462 - protein, 342 aa, Homo sapiens; identical to SEQ ID NO: 907460

SEQ ID NO: 907463 - protein, 237 aa, Homo sapiens
HESPGRGKDRKEEEEAPVAMGLEAARELECAALGTLLRDPREAERTLLLDCRPFLAFCRRHVRAARPVPWNALLRRRARGPPAAVLACLLPDRALRTRLVRGELARAVVLDEGSASVAELRPDSPAHVLLAALLHETRAGPTAVYFLRGEQAGRPWPAPPDSSPAFPADRALPLLAGGFDGFQGCCPDLCSEAPAPALPPTGDKTSRSDSRAPVYDQVSIDPPPPNLPLSPPRTGRL

SEQ ID NO: 907464 - protein, 274 aa, Homo sapiens
GVDRSGSATATRARDAGKTERKRKRHRWPWGWRRRASWSARRWARCCGIRGRRNARCCWTAAPSWPSAGATCALLHETRAGPTAVYFLRGGFDGFQGCCPDLCSEAPAPALPPTGDKTSRSDSRAPVYDQGGPVEILPYLFLGSCSHSSDLQGLQACGITAVLNVSASCPNHFEGLFRYKSIPVEDNQMVEISAWFQEAIGFIDWVKNSGGRVLVHCQAGISRSATICLAYLMQSRRVRLDEAFDFVKQRRGVISPNFSFMGQLLQFETQVLCH

SEQ ID NO: 907465 - protein, 175 aa, Homo sapiens
YLFLGSCSHSSDLQGLQACGITAVLNVSASCPNHFEGLFRYKSIPVEDNQMVEISAWFQEAIGFIGKGAPLPRNPEGLQRRGLGAPVSWAVHIPSDTTAPISLADWVKNSGGRVLVHCQAGISRSATICLAYLMQSRRVRLDEAFDFVKQRRGVISPNFSFMGQLLQFETQVLCH

SEQ ID NO: 907466 - protein, 580 aa, Homo sapiens
MGDLSSLTPGGSMGLQVNRGSQSSLEGAPATAPEPHSLGILHASYSVSHRVRPWWDITSCRQQWTRQILKDVSLYVESGQIMCILGSSGSGKTTLLDAMSGRLGRAGTFLGEVYVNGRALRREQFQDCFSYVLQSDTLLSSLTVRETLHYTALLAIRRGNPGSFQKKVEAVMAELSLSHVADRLIGNYSLGGISTGERRRVSIAAQLLQDPKVMLFDEPTTGLDCMTANQIVVLLVELARRNRIVVLTIHQPRSELFQLFDKIAILSFGELIFCGTPAEMLDFFNDCGYPCPEHSNPFDFYMDLTSVDTQSKEREIETSKRVQMIESAYKKSAICHKTLKNIERMKHLKTLPMVPFKTKDSPGVFSKLGVLLRRVTRNLVRNKLAVITRLLQNLIMGLFLLFFVLRVRSNVLKGAIQDRVGLLYQFVGATPYTGMLNAVNLFPVLRAVSDQESQDGLYQKWQMMLAYALHVLPFSVVATMIFSSVCYWTLGLHPEVARFGYFSAALLAPHLIGEFLTLVLLGIVQNPNIVNSVVALLSIAGVLVGSGFLRNIQEMPIPFNEFYGLDFTCGSSVSVTTSLC

SEQ ID NO: 907467 - protein, 651 aa, Homo sapiens
MGDLSSLTPGGSMGLQVNRGSQSSLEGAPATAPEPHSLGILHASYSVSHRVRPWWDITSCRQQWTRQILKDVSLYVESGQIMCILGSSGSGKTTLLDAMSGRLGRAGTFLGEVYVNGRALRREQFQDCFSYVLQSDTLLSSLTVRETLHYTALLAIRRGNPGSFQKKVEAVMAELSLSHVADRLIGNYSLGGISTGERRRVSIAAQLLQDPKVMLFDEPTTGLDCMTANQIVVLLVELARRNRIVVLTIHQPRSELFQLFDKIAILSFGELIFCGTPAEMLDFFNDCGYPCPEHSNPFDFYMDLTSVDTQSKEREIETSKRVQMIESAYKKSAICHKTLKNIERMKHLKTLPMVPFKTKDSPGVFSKLGVLLRRVTRNLVRNKLAVITRLLQNLIMGLFLLFFVLRVRSNVLKGAIQDRVGLLYQFVGATPYTGMLNAVNLFPVLRAVSDQESQDGLYQKWQMMLAYALHVLPFSVVATMIFSSVCYWTLGLHPEVARFGYFSAALLAPHLIGEFLTLVLLGIVQNPNIVNSVVALLSIAGVLVGSGFLRNIQEMPIPFKIISYFTFQKYCSEILVVNEFYGLNFTCGSSNVSVTTNPMCAFTQGIQFIEKTCPGATSRFTMNFLILYSFIPALVILGIVVFKIRDHLISR

SEQ ID NO: 907468 - protein, 256 aa, Homo sapiens
MLWQKPTAPEQAPAPARPYQGVRVKEPVKELLRRKRGHASSGAAPAPTAVVLPHQPLATYTTVGPSCLDMEGSVSAVTEEAALCAGWLSQPTPATLQPLAPWTPYTEYVPHEAVSCPYSADMYVQPVCPSYTVVGPSSVLTYASPPLITNVTTRSSATPAVGPPLEGPEHQAPLTYFPWPQPLSTLPTSTLQYQPPAPALPGPQFVQLPISIPEPVLQDMEDPRRAASSLTIDKLLLEEEDSDAYALNHTLSVEGF

SEQ ID NO: 907469 - protein, 256 aa, Homo sapiens; identical to SEQ ID NO: 907468

SEQ ID NO: 907470 - protein, 456 aa, Homo sapiens
IPAGAHGGLSPAHALVAWKPAWAPCKDQRFPEELLGSSLAWGGLDTGFPQLAPHHLHTHTQQVPAGPVQAVAARAALLLCPGWLAPSVERSGPGPLGRAQWGDRRPGCRNVAPVPEVGGCDDAAHAAGTQAFKKPRKQPQLKRWLHWRKTHPGLTLKKPNCRLQREKATSCHRPCSGKNAMEQRQPILSGTMAADPVVSAVWMRAATAPEQAPAPARPYQGVRVKEPVKELLRRKRGHASSGAAPAPTAVVLPHQPLATYTTVGPSCLDMEGSVSAVTEEAALCAGWLSQPTPATLQPLAPWTPYTEYVPHEAVSCPYSADMYVQPVCPSYTVVGPSSVLTYASPPLITNVTTRSSATPAVGPPLEGPEHQAPLTYFPWPQPLSTLPTSTLQYQPPAPALPGPQFVQLPISIPEPVLQDMEDPRRAASSLTIDKLLLEEEDSDAYALNHTLSVEGF

SEQ ID NO: 907471 - protein, 256 aa, Homo sapiens; identical to SEQ ID NO: 907468

SEQ ID NO: 907472 - protein, 256 aa, Homo sapiens; identical to SEQ ID NO: 907468

SEQ ID NO: 907473 - protein, 197 aa, Homo sapiens
IPAGAHGGLSPAHALVAWKPAWAPCKDQRFPEELLGSSLAWGGLDTGFPQLAPHHLHTHTQQVPAGPVQAVAARAALLLCPGWLAPSVERSGPGPLGRAQWGDRRPGCRNVAPVPEVGGCDDAAHAAGTQAFKKPRKQPQLKRWLHWRKTHPGLTLKKPNCRLQREKATSCHRPCSGKNPQLRSKPQPRPGHTRASV

SEQ ID NO: 907474 - protein, 477 aa, Homo sapiens
MVLMQDKGSSQQWPGLGGEGGGTGPLSMLRAALLLISLPWGAQGTASTSLSTAGGHTVPPTGGRYLSIGDGSVMEFEFPEDSEGIIVISSQYPGQANRTAPGPMLRVTSLDTEVLTIKNVSAITWGGGGGFVVSIHSGLAGLAPLHIQLVDAHEAPPTLIEERRDFCIKVSPAEDTPATLSADLAHFSENPILYLLLPLIFVNKCSFGCKVELEVLKGLMQSPQPMLLGLLGQFLVMPLYAFLMAKVFMLPKALALGLIITCSSPGGGGSYLFSLLLGGDVTLAISMTFLSTVAATGFLPLSSAIYSRLLSIHETLHVPISKILGTLLFIAIPIAVGVLIKSKLPKFSQLLLQVVKPFSFVLLLGGLFLAYRMGVFILAGIRLPIVLVGITVPLVGLLVGYCLATCLKLPVAQRRTVSIEVGVQNSLLALAMLQLSLRRLQADYASQAPFIVALSGTSEMLALVIGHFIYSSLFPVP

SEQ ID NO: 907475 - protein, 448 aa, Homo sapiens
MVLMQDKGSSQQWPGLGGEGGGTGPLSMLRAALLLISLPWGAQGTASTSLSTAGGHTVPPTGGRYLSIGDGSVMEFEFPEDSEGIIVISSQYPGQANRTAPGPMLRVTSLDTEVLTIKNLVDAHEAPPTLIEERRDFCIKVSPAEDTPATLSADLAHFSENPILYLLLPLIFVNKCSFGCKVELEVLKGLMQSPQPMLLGLLGQFLVMPLYAFLMAKVFMLPKALALGLIITCSSPGGGGSYLFSLLLGGDVTLAISMTFLSTVAATGFLPLSSAIYSRLLSIHETLHVPISKILGTLLFIAIPIAVGVLIKSKLPKFSQLLLQVVKPFSFVLLLGGLFLAYRMGVFILAGIRLPIVLVGITVPLVGLLVGYCLATCLKLPVAQRRTVSIEVGVQNSLLALAMLQLSLRRLQADYASQAPFIVALSGTSEMLALVIGHFIYSSLFPVP

SEQ ID NO: 907476 - protein, 560 aa, Homo sapiens
MCWYTEYLDIVDPSGALPTATGPADAAAKLRGGCGRDSPAIKEDSTGLGPTHEPFSGQPNSTSGDVLLSRRGPGHAIRPPGRAMVLMQDKGSSQQWPGLGGEGGGTGPLSMLRAALLLISLPWGAQGTASTSLSTAGGHTVPPTGGRYLSIGDGSVMEFEFPEDSEGIIVISSQYPGQANRTAPGPMLRVTSLDTEVLTIKNVSAITWGGGGGFVVSIHSGLAGLAPLHIQLVDAHEAPPTLIEERRDFCIKVSPAEDTPATLSADLAHFSENPILYLLLPLIFVNKCSFGCKVELEVLKGLMQSPQPMLLGLLGQFLVMPLYAFLMAKVFMLPKALALGLIITCSSPGGGGSYLFSLLLGGDVTLAISMTFLSTVAATGFLPLSSAIYSRLLSIHETLHVPISKILGTLLFIAIPIAVGVLIKSKLPKFSQLLLQVVKPFSFVLLLGGLFLAYRMGVFILAGIRLPIVLVGITVPLVGLLVGYCLATCLKLPVAQRRTVSIEVGVQNSLLALAMLQLSLRRLQADYASQAPFIVALSGTSEMLALVIGHFIYSSLFPVP

SEQ ID NO: 907477 - protein, 532 aa, Homo sapiens
MAGPRPPGDSPAIKEDSTGLGPTHEPFSGQPNSTSGDVLLSRRGPGHAIRPPGRAMVLMQDKGSSQQWPGLGGEGGGTGPLSMLRAALLLISLPWGAQGTASTSLSTAGGHTVPPTGGRYLSIGDGSVMEFEFPEDSEGIIVISSQYPGQANRTAPGPMLRVTSLDTEVLTIKNVSAITWGGGGGFVVSIHSGLAGLAPLHIQLVDAHEAPPTLIEERRDFCIKVSPAEDTPATLSADLAHFSENPILYLLLPLIFVNKCSFGCKVELEVLKGLMQSPQPMLLGLLGQFLVMPLYAFLMAKVFMLPKALALGLIITCSSPGGGGSYLFSLLLGGDVTLAISMTFLSTVAATGFLPLSSAIYSRLLSIHETLHVPISKILGTLLFIAIPIAVGVLIKSKLPKFSQLLLQVVKPFSFVLLLGGLFLAYRMGVFILAGIRLPIVLVGITVPLVGLLVGYCLATCLKLPVAQRRTVSIEVGVQNSLLALAMLQLSLRRLQADYASQAPFIVALSGTSEMLALVIGHFIYSSLFPVP

SEQ ID NO: 907478 - protein, 122 aa, Homo sapiens
HVLVPPGVFGYRRSQRRSAHCVRGRQTLQLSCAVAVAGESLRKGGGLWPRPCSAIAHSGARPGLAGKGRRRRRAFARPGGAAGPRNGVRGPPRLRDGPSGSPAVGRRRALPFLPPRFAPELC

SEQ ID NO: 907479 - protein, 448 aa, Homo sapiens; identical to SEQ ID NO: 907475

SEQ ID NO: 907480 - protein, 448 aa, Homo sapiens; identical to SEQ ID NO: 907475

SEQ ID NO: 907481 - protein, 242 aa, Homo sapiens
MVLMQDKGSSQQWPGLGGEGGGTGPLSMLRAALLLISLPWGAQGTASTSLSTAGGHTVPPTGGRYLSIGDGSVMEFEFPEDSEGIIVISSQYPGQANRTAPGPMLRVTSLDTEVLTIKNVSAITWGGGGGFVVSIHSGLAGLAPLHIQLVDAHEAPPTLIEERRDFCIKVSPAEDTPATLSADLAHFSENPILYLLLPLIFVNKCSQFPEASGSSFHQPQPPHSTKVLMHYALRKIQAYFFY

SEQ ID NO: 907482 - protein, 234 aa, Homo sapiens
MNHLPEDMENALTGSQSSHASLRNIHSINPTQLMARIESYEGREKKGISDVRRTFCLFVTFDLLFVTLLWIIELNVNGGIENTLEKEVMQYDYYSSYFDIFLLAVFRFKVLILAYAVCRLRHWWAIALTTAVTSAFLLAKVILSKLFSQGAFGYVLPIISFILAWIETWFLDFKVLPQEAEEENRLLIVQDASERAALIPGGLSDGQFYSPPESEAGSEEAEEKQDSEKPLLEL

SEQ ID NO: 907483 - protein, 176 aa, Homo sapiens
MNHLPEDMENALTGSQSSHASLRNIHSINPTQLMARIESYEGREKKGISDVRRTFCLFVTFDLLFVTLLWIIELNVNGGIENTLEKEVMQYDYYSSYFDIFLLAVFRFKVLILAYAVCRLRHWWAIAVSMPCMSGSSPPVLVAKSCSQQAWAGRRYSSNAGGIPPAFLSPVSSILK

SEQ ID NO: 907484 - protein, 234 aa, Homo sapiens; identical to SEQ ID NO: 907482

SEQ ID NO: 907485 - protein, 234 aa, Homo sapiens; identical to SEQ ID NO: 907482

SEQ ID NO: 907486 - protein, 146 aa, Homo sapiens
MQYDYYSSYFDIFLLAVFRFKVLILAYAVCRLRHWWAIALTTAVTSAFLLAKVILSKLFSQGAFGYVLPIISFILAWIETWFLDFKVLPQEAEEENRLLIVQDASERAALIPGGLSDGQFYSPPESEAGSEEAEEKQDSEKPLLEL

SEQ ID NO: 907487 - protein, 216 aa, Homo sapiens
MNHLPEDMENALTGSQSSHASLRNIHSINPTQLMARIESYEGREKKGISDVRRTFCLFVTFDLLFVTLLWIIELNVNGGIENTLEKEVMQYDYYSSYFDIFLLAVFRFKVLILAYAVCRLRHWWAIALFSQGAFGYVLPIISFILAWIETWFLDFKVLPQEAEEENRLLIVQDASERAALIPGGLSDGQFYSPPESEAGSEEAEEKQDSEKPLLEL

SEQ ID NO: 907488 - protein, 123 aa, Homo sapiens
QCEMPSVNSAGLCVLQLTTAVTSAFLLAKVILSKLFSQGAFGYVLPIISFILAWIETWFLDFKVLPQEAEEENRLLIVQDASERAALIPGGLSDGQFYSPPESEAGSEEAEEKQDSEKPLLEL

SEQ ID NO: 907489 - protein, 103 aa, Homo sapiens
MNHLPEDMENALTGSQSSHASLRNIHSINPTQLMARIESYEGREKKGISDVRRTFCLFVTFDLLFVTLLWIIELNVNGGIENTLEKELRIHVKCHQTFVLFLS

SEQ ID NO: 907490 - protein, 123 aa, Homo sapiens; identical to SEQ ID NO: 907488

SEQ ID NO: 907491 - protein, 234 aa, Homo sapiens; identical to SEQ ID NO: 907482

SEQ ID NO: 907492 - protein, 234 aa, Homo sapiens; identical to SEQ ID NO: 907482

SEQ ID NO: 907493 - protein, 234 aa, Homo sapiens; identical to SEQ ID NO: 907482

SEQ ID NO: 907494 - protein, 66 aa, Homo sapiens
MTLEDPECLQEAEEENRLLIVQDASERAALIPGGLSDGQFYSPPESEAGSEEAEEKQDSEKPLLEL

SEQ ID NO: 907495 - protein, 105 aa, Homo sapiens
MNHLPEDMENALTGSQSSHASLRNIHSINPTQLMARIESYEGREKKGISDVRRTFCLFVTFDLLFVTLLWIIELNVSWWFFHNFLRSVSRDNRVFLFVSLIICFI

SEQ ID NO: 907496 - protein, 413 aa, Homo sapiens
AACATRREATRRRWEGGRSRPKGGEEGRRRTRVPGLVTASGPGNPLPDRLGEMAGGRHRRVVGTLHLLLLVAALPWASRGVSPSASAWPEEKNYHQPAILNSSALRQIAEGTSISEMWQNDLQPLLIERYPGSPGSYAARQHIMQRIQRLQADWVLEIDTFLSQTPYGYRSFSNIISTLNPTAKRHLVLACHYDSKYFSHWNNRVFVGATDSAVPCAMMLELARALDKKLLSLKTVSDSKPDLSLQLIFFDGEEAFLHWSPQDSLYGSRHLAAKMASTPHPPGARGTSQLHGMDLLVLLDLIGAPNPTFPNFFPNSARWFERLQAIEHELHELGLLKDHSLEGRYFQNYSYGGVIQDDHIPFLRRGVPVLHLIPSPFPEVWHTMDDNEENLDESTIDNLNKILQVFVLEYLHL

SEQ ID NO: 907497 - protein, 141 aa, Homo sapiens
AACATRREATRRRWEGGRSRPKGGEEGRRRTRVPGLVTASGPGNPLPDRLGEMAGGRHRRVVGTLHLLLLVAALPWASRGVSPSASAWPEEKNYHQPAILNSSALRQIAEGTSISEMWQNDLQPLLIERYPGSPGSYAARQ

SEQ ID NO: 907498 - protein, 413 aa, Homo sapiens; identical to SEQ ID NO: 907496

SEQ ID NO: 907499 - protein, 364 aa, Homo sapiens
AACATRREATRRRWEGGRSRPKGGEEGRRRTRVPGLVTASGPGNPLPDRLGEMAGGRHRRVVGTLHLLLLVAALPWASRGVSPSASAWPEEKHIMQRIQRLQADWVLEIDTFLSQTPYGYRSFSNIISTLNPTAKRHLVLACHYDSKYFSHWNNRVFVGATDSAVPCAMMLELARALDKKLLSLKTVSDSKPDLSLQLIFFDGEEAFLHWSPQDSLYGSRHLAAKMASTPHPPGARGTSQLHGMDLLVLLDLIGAPNPTFPNFFPNSARWFERLQAIEHELHELGLLKDHSLEGRYFQNYSYGGVIQDDHIPFLRRGVPVLHLIPSPFPEVWHTMDDNEENLDESTIDNLNKILQVFVLEYLHL

SEQ ID NO: 907500 - protein, 270 aa, Homo sapiens
MQRIQRLQADWVLEIDTFLSQTPYGYRSFSNIISTLNPTAKRHLVLACHYDSKYFSHWNNRVFVGATDSAVPCAMMLELARALDKKLLSLKTVSDSKPDLSLQLIFFDGEEAFLHWSPQDSLYGSRHLAAKMASTPHPPGARGTSQLHGMDLLVLLDLIGAPNPTFPNFFPNSARWFERLQAIEHELHELGLLKDHSLEGRYFQNYSYGGVIQDDHIPFLRRGVPVLHLIPSPFPEVWHTMDDNEENLDESTIDNLNKILQVFVLEYLHL

SEQ ID NO: 907501 - protein, 422 aa, Homo sapiens
AACATRREATRRRWEGGRSRPKGGEEGRRRTRVPGLVTASGPGNPLPDRLGEMAGGRHRRVVGTLHLLLLVAALPWASRGVSPSASAWPEEKNYHQPAILNSSALRQIAEGTSISEMWQNDLQPLLIERYPGSPGSYAARQHIMQRIQRLQADWVLEIDTFLSQTPYGYRSFSNIISTLNPTAKRHLVLACHYDSKYFSHWNNRVFVGATDSAVPCAMMLELARALDKKLLSLKTVSDSKPDLSLQLIFFDGEEAFLHWSPQDSLYGSRHLAAKMASTPHPPGARGTSQLHGMDLLVLLDLIGAPNPTFPNFFPNSARWFERLQAIEHELHELGLLKDHSLEGRYFQNYSYGGVIQDDHIPFLRRGVPVLHLIPSPFPEVWHTMDDNEVWHTMDDNEENLDESTIDNLNKILQVFVLEYLHL

SEQ ID NO: 907502 - protein, 413 aa, Homo sapiens; identical to SEQ ID NO: 907496

SEQ ID NO: 907503 - protein, 188 aa, Homo sapiens
LCFYCCFYQTVSDSKPDLSLQLIFFDGEEAFLHWSPQDSLYGSRHLAAKMASTPHPPGARGTSQLHGMDLLVLLDLIGAPNPTFPNFFPNSARWFERLQAIEHELHELGLLKDHSLEGRYFQNYSYGGVIQDDHIPFLRRGVPVLHLIPSPFPEVWHTMDDNEENLDESTIDNLNKILQVFVLEYLHL

SEQ ID NO: 907504 - protein, 126 aa, Homo sapiens
MGQGNVDLLVLLDLIGAPNPTFPNFFPNSARWFERLQAIEHELHELGLLKDHSLEGRYFQNYSYGGVIQDDHIPFLRRGVPVLHLIPSPFPEVWHTMDDNEENLDESTIDNLNKILQVFVLEYLHL

SEQ ID NO: 907505 - protein, 413 aa, Homo sapiens; identical to SEQ ID NO: 907496

SEQ ID NO: 907506 - protein, 297 aa, Homo sapiens
MWQNDLQPLLIERYPGSPGSYAARQHIMQRIQRLQADWVLEIDTFLSQTPYGYRSFSNIISTLNPTAKRHLVLACHYDSKYFSHWNNRVFVGATDSAVPCAMMLELARALDKKLLSLKTVSDSKPDLSLQLIFFDGEEAFLHWSPQDSLYGSRHLAAKMASTPHPPGARGTSQLHGMDLLVLLDLIGAPNPTFPNFFPNSARWFERLQAIEHELHELGLLKDHSLEGRYFQNYSYGGVIQDDHIPFLRRGVPVLHLIPSPFPEVWHTMDDNEENLDESTIDNLNKILQVFVLEYLHL

SEQ ID NO: 907507 - protein, 270 aa, Homo sapiens; identical to SEQ ID NO: 907500

SEQ ID NO: 907508 - protein, 413 aa, Homo sapiens; identical to SEQ ID NO: 907496

SEQ ID NO: 907509 - protein, 413 aa, Homo sapiens; identical to SEQ ID NO: 907496

SEQ ID NO: 907510 - protein, 395 aa, Homo sapiens
AACATRREATRRRWEGGRSRPKGGEEGRRRTRVPGLVTASGPGNPLPDRLGEMAGGRHRRVVGTLHLLLLVAALPWASRGVSPSASAWPEEKNYHQPAILNSSALRQIAEGTSISEMWQNDLQPLLIERYPGSPGSYAARQHIMQRIQRLQADWVLEIDTFLSQTPYGYRSFSNIISTLNPTAKRHLVLACHYDSKYFSHWNNRVFVGATDSAVPCAMMLELARALDKKLLSLKTVSDSKPDLSLQLIFFDGEAAKMASTPHPPGARGTSQLHGMDLLVLLDLIGAPNPTFPNFFPNSARWFERLQAIEHELHELGLLKDHSLEGRYFQNYSYGGVIQDDHIPFLRRGVPVLHLIPSPFPEVWHTMDDNEENLDESTIDNLNKILQVFVLEYLHL

SEQ ID NO: 907511 - protein, 53 aa, Homo sapiens
MAGGRHRRVVGTLHLLLLVAALPWASRGVSPSASAWPEEKVRGCFCVVVLERL

SEQ ID NO: 907512 - protein, 930 aa, Homo sapiens
AAGATMERDGCAGGGSRGGEGGRAPREGPAGNGRDRGRSHAAEAPGDPQAAASLLAPMDVGEEPLEKAARARTAKDPNTYKVLSLVLSVCVLTTILGCIFGLKPSCAKEVKSCKGRCFERTFGNCRCDAACVELGNCCLDYQETCIEPEHIWTCNKFRCGEKRLTRSLCACSDDCKDKGDCCINYSSVCQGEKSWVEEPCESINEPQCPAGFETPPTLLFSLDGFRAEYLHTWGGLLPVISKLKKCGTYTKNMRPVYPTKTFPNHYSIVTGLYPESHGIIDNKMYDPKMNASFSLKSKEKFNPEWYKGEPIWVTAKYQGLKSGTFFWPGSDVEINGIFPDIYKMYNGSVPFEERILAVLQWLQLPKDERPHFYTLYLEEPDSSGHSYGPVSSEVIKALQRVDGMVGMLMDGLKELNLHRCLNLILISDHGMEQGSCKKYIYLNKYLGDVKNIKVIYGPAARLRPSDVPDKYYSFNYEGIARNLSCREPNQHFKPYLKHFLPKRLHFAKSDRIEPLTFYLDPQWQLALNPSERKYCGSGFHGSDNVFSNMQALFVGYGPGFKHGIEADTFENIEVYNLMCDLLNLTPAPNNGTHGSLNHLLKNPVYTPKHPKEVHPLVQCPFTRNPRDNLGCSCNPSILPIEDFQTQFNLTVAEEKIIKHETLPYGRPRVLQKENTICLLSQHQFMSGYSQDILMPLWTSYTVDRNDSFSTEDFSNCLYQDFRIPLSPVHKCSFYKNNTKVSYGFLSPPQLNKNSSGIYSEALLTTNIVPMYQSFQVIWRYFHDTLLRKYAEERNGVNVVSGPVFDFDYDGRCDSLENLRQKRRVIRNQEILIPTHFFIVLTSCKDTSQTPLHCENLDTLAFILPHRTDNSESCVHGKHDSSWVEELLMLHRARITDVEHITGLSFYQQRKEPVSDILKLKTHLPTFSQED

SEQ ID NO: 907513 - protein, 161 aa, Homo sapiens [sequence omitted]

SEQ ID NO: 907514 - protein, 647 aa, Homo sapiens
AAGATMERDGCAGGGSRGGEGGRAPREGPAGNGRDRGRSHAAEAPGDPQAAASLLAPMDVGEEPLEKAARARTAKDPNTYKVLSLVLSVCVLTTILGCIFGLKPSCAKEVKSCKGRCFERTFGNCRCDAACVELGNCCLDYQETCIEPEHIWTCNKFRCGEKRLTRSLCACSDDCKDKGDCCINYSSVCQGEKSWVEEPCESINEPQCPAGFETPPTLLFSLDGFRAEYLHTWGGLLPVISKLKKCGTYTKNMRPVYPTKTFPNHYSIVTGLYPESHGIIDNKMYDPKMNASFSLKSKEKFNPEWYKGEPIWVTAKYQGLKSGTFFWPGSDVEINGIFPDIYKMYNGSVPFEERILAVLQWLQLPKDERPHFYTLYLEEPDSSGHSYGPVSSEVIKALQRVDGMVGMLMDGLKELNLHRCLNLILISDHGMEQGSCKKYIYLNKYLGDVKNIKVIYGPAARLRPSDVPDKYYSFNYEGIARNLSCREPNQHFKPYLKHFLPKRLHFAKSDRIEPLTFYLDPQWQLALNPSERKYCGSGFHGSDNVFSNMQALFVGYGPGFKHGIEADTFENIEVYNLMCDLLNLTPAPNNGTHGSLNHLLKNPVYTPKHPKEVHPLVQCPFTRNPRDNWVVSYLRIADGVSPFLLGV

SEQ ID NO: 907515 - protein, 930 aa, Homo sapiens; identical to SEQ ID NO: 907512

SEQ ID NO: 907516 - protein, 911 aa, Homo sapiens
AAGATMERDGCAGGGSRGGEGGRAPREGPAGNGRDRGRSHAAEAPGDPQAAASLLAPMDVGEEPLEKAARARTAKDPNTYKVLSLVLSVCVLTTILGCIFGLKPSCAKEVKSCKGRCFERTFGNCRCDAACVELGNCCLDYQETCIEPEHIWTCNKFRCGEKRLTRSLCACSDDCKDKGDCCINYSSVCQGEKSWVEEPCESINEPQCPAGFETPPTLLFSLDGFRAEYLHTWGGLLPVISKLKKCGTYTKNMRPVYPTKTFPNHYSIVTGLYPESHGIIDNKMYDPKMNASFSLKSKEKFNPEWYKGEPIWVTAKYQGLKSGTFFWPGSDVEINGIFPDIYKMYNGSVPFEERILAVLQWLQLPKDERPHFYTLYLEEPDSSGHSYGPVSSEVIKALQRVDGMVGMLMDGLKELNLHRCLNLILISDHGMEQGSCKKYIYLNKYLGDVKNIKLFNYEGIARNLSCREPNQHFKPYLKHFLPKRLHFAKSDRIEPLTFYLDPQWQLALNPSERKYCGSGFHGSDNVFSNMQALFVGYGPGFKHGIEADTFENIEVYNLMCDLLNLTPAPNNGTHGSLNHLLKNPVYTPKHPKEVHPLVQCPFTRNPRDNLGCSCNPSILPIEDFQTQFNLTVAEEKIIKHETLPYGRPRVLQKENTICLLSQHQFMSGYSQDILMPLWTSYTVDRNDSFSTEDFSNCLYQDFRIPLSPVHKCSFYKNNTKVSYGFLSPPQLNKNSSGIYSEALLTTNIVPMYQSFQVIWRYFHDTLLRKYAEERNGVNVVSGPVFDFDYDGRCDSLENLRQKRRVIRNQEILIPTHFFIVLTSCKDTSQTPLHCENLDTLAFILPHRTDNSESCVHGKHDSSWVEELLMLHRARITDVEHITGLSFYQQRKEPVSDILKLKTHLPTFSQED

SEQ ID NO: 907517 - protein, 492 aa, Homo sapiens
AAGATMERDGCAGGGSRGGEGGRAPREGPAGNGRDRGRSHAAEAPGDPQAAASLLAPMDVGEEPLEKAARARTAKDPNTYKVLSLVLSVCVLTTILGCIFGLKPSCAKEVKSCKGRCFERTFGNCRCDAACVELGNCCLDYQETCIEPEHIWTCNKFRCGEKRLTRSLCACSDDCKDKGDCCINYSSVCQGEKSWVEEPCESINEPQCPAGFETPPTLLFSLDGFRAEYLHTWGGLLPVISKLKKCGTYTKNMRPVYPTKTFPNHYSIVTGLYPESHGIIDNKMYDPKMNASFSLKSKEKFNPEWYKGEPIWVTAKYQGLKSGTFFWPGSDVEINGIFPDIYKMYNGSVPFEERILAVLQWLQLPKDERPHFYTLYLEEPDSSGHSYGPVSSEVIKALQRVDGMVGMLMDGLKELNLHRCLNLILISDHGMEQGSCKKYIYLNKYLGDVKNIKVIYGPAARLRPSDVPDKYYSLKALPEIFQQGHHGVTSSQ

SEQ ID NO: 907518 - protein, 70 aa, Homo sapiens
DLSQFGSSLFHQLAKNANTLRIQRTISLKGFLQDTGSQLSSFHKPFLLLCFKTMGGPEESLWMPSPSPTM

SEQ ID NO: 907519 - protein, 201 aa, Homo sapiens
RFVTVWKQSIPSTSQKCKHPEDSENNFFEGFPSRYWLPAFFFPQAFLAAVLQDYGRSRGIAVDALTFTHHVISNTTDKDEKFSVFMPKKLNIVRRAFKGSASSHTGVYIFGLFIEGARWNREQKILEDSLPLEMCCDFPDIYFLPTKISTKTPNASNQTDSELYAFECPVSSPPSLFFFFFFSLPPLPHPPPLFFPTEETS

SEQ ID NO: 907520 - protein, 218 aa, Homo sapiens
RFVTVWKQSIPSTSQKCKHPEDSENNFFEGFPSRYWLPAFFFPQAFLAAVLQDYGRSRGIAVDALTFTHHVISNTTDKDEKFSVFMPKKLNIVRRAFKGSASSHTGVYIFGLFIEGARWNREQKILEDSLPLEMCCDFPDIYFLPTKISTKTPNASNQTDSELYAFECPVYQTPERSRILATTGLPTNFLTSVYLSTKKPPSHWITMRVALLCEKNEK

SEQ ID NO: 907521 - protein, 1267 aa, Homo sapiens
MGDMKTPDFDDLLAAFDIPDPTSLDAKEAIQTPSEENESPLKPPGICMDESVSLSHSGSAPDVPAVSVIVKNTSRQESFEAEKDHITPSLLHNGFRGSDLPPDPHNCGKFDSTFMNGDSARSFPGKLEPPKSEPLPTFNQFSPISSPEPEDPIKDNGFGIKPKHSDSYFPPPLGCGAVGGPVLEALAKFPVPELHMFDHFCKKEPKPEPLPLGSQQEHEQSGQNTVEPHKDPDATRFFGEALEFNSHPSNSIGESKGLARELGTCSSVPPRQRLKPAHSKLSSCVAALVALQAKRVASVTKEDQPGHTKDLSGPTKESSKGSPKMPKSPKSPRSPLEATRKSIKPSDSPRSICSDSSSKGSPSVAASSPPAIPKVRIKTIKTSSGEIKRTVTRILPDPDDPSKSPVGSPLGSAIAEAPSEMPGDEVPVEEHFPEAGTNSGSPQGARKGDESMTKASDSSSPSCSSGPRVPKGAAPGSQTGKKQQSTALQASTLAPANLLPKAVHLANLNLVPHSVAASVTAKSSVQRRSQPQLTQMSVPLVHQVKKAAPLIVEVFNKVLHSSNPVPLYAPNLSPPADSRIHVPASGYCCLECGDAFALEKSLSQHYGRRSVHIEVLCTLCSKTLLFFNKCSLLRHARDHKSKGLVMQCSQLLVKPISADQMFVSAPVNSTAPAAPAPSSSPKHGLTSGSASPPPPALPLYPDPVRLIRYSIKCLECHKQMRDYMVLAAHFQRTTEETEGLTCQVCQMLLPNQCSFCAHQRIHAHKSPYCCPECGVLCRSAYFQTHVKENCLHYARKVGYRCIHCGVVHLTLALLKSHIQERHCQVFHKCAFCPMAFKTASSTADHSATQHPTQPHRPSQLIYKCSCEMVFNKKRHIQQHFYQNVSKTQVGVFKCPECPLLFVQKPELMQHVKSTHGVPRNVDELSSLQSSADTSSSRPGSRVPTEPPATSVAARSSSLPSGRWGRPEAHRRVEARPRLRNTGWTCQECQEWVPDRESYVSHMKKSHGRTLKRYPCRQCEQSFHTPNSLRKHIRNNHDTVKKFYTCGYCTEDSPSFPRPSLLESHISLMHGIRNPDLSQTSKVKPPGGHSPQVNHLKRPVSGVGDAPGTSNGATVSSTKRHKSLFQCAKCSFATDSGLEFQSHIPQHQVDSSTAQCLLCGLCYTSASSLSRHLFIVHKVRDQEEEEEEEAAAAEMAVEVAEPEEGSGEEVPMETRENGLEECAGEPLSADPEARRLLGPAPEDDGGHNDHSQPQASQDQDSHTLSPQV

SEQ ID NO: 907522 - protein, 1267 aa, Homo sapiens; identical to SEQ ID NO: 907521

SEQ ID NO: 907523 - protein, 1267 aa, Homo sapiens; identical to SEQ ID NO: 907521

SEQ ID NO: 907524 - protein, 758 aa, Homo sapiens [sequence omitted]

SEQ ID NO: 907525 - protein, 1214 aa, Homo sapiens
GGARVWYSRRQAAATTTKNTSRQESFEAEKDHITPSLLHNGFRGSDLPPDPHNCGKFDSTFMNGDSARSFPGKLEPPKSEPLPTFNQFSPISSPEPEDPIKDNGFGIKPKHSDSYFPPPLGCGAVGGPVLEALAKFPVPELHMFDHFCKKEPKPEPLPLGSQQEHEQSGQNTVEPHKDPDATRFFGEALEFNSHPSNSIGESKGLARELGTCSSVPPRQRLKPAHSKLSSCVAALVALQAKRVASVTKEDQPGHTKDLSGPTKESSKGSPKMPKSPKSPRSPLEATRKSIKPSDSPRSICSDSSSKGSPSVAASSPPAIPKVRIKTIKTSSGEIKRTVTRILPDPDDPSKSPVGSPLGSAIAEAPSEMPGDEVPVEEHFPEAGTNSGSPQGARKGDESMTKASDSSSPSCSSGPRVPKGAAPGSQTGKKQQSTALQASTLAPANLLPKAVHLANLNLVPHSVAASVTAKSSVQRRSQPQLTQMSVPLVHQVKKAAPLIVEVFNKVLHSSNPVPLYAPNLSPPADSRIHVPASGYCCLECGDAFALEKSLSQHYGRRSVHIEVLCTLCSKTLLFFNKCSLLRHARDHKSKGLVMQCSQLLVKPISADQMFVSAPVNSTAPAAPAPSSSPKHGLTSGSASPPPPALPLYPDPVRLIRYSIKCLECHKQMRDYMVLAAHFQRTTEETEGLTCQVCQMLLPNQCSFCAHQRIHAHKSPYCCPECGVLCRSAYFQTHVKENCLHYARKVGYRCIHCGVVHLTLALLKSHIQERHCQVFHKCAFCPMAFKTASSTADHSATQHPTQPHRPSQLIYKCSCEMVFNKKRHIQQHFYQNVSKTQVGVFKCPECPLLFVQKPELMQHVKSTHGVPRNVDELSSLQSSADTSSSRPGSRVPTEPPATSVAARSSSLPSGRWGRPEAHRRVEARPRLRNTGWTCQECQEWVPDRESYVSHMKKSHGRTLKRYPCRQCEQSFHTPNSLRKHIRNNHDTVKKFYTCGYCTEDSPSFPRPSLLESHISLMHGIRNPDLSQTSKVKPPGGHSPQVNHLKRPVSGVGDAPGTSNGATVSSTKRHKSLFQCAKCSFATDSGLEFQSHIPQHQVDSSTAQCLLCGLCYTSASSLSRHLFIVHKVRDQEEEEEEEAAAAEMAVEVAEPEEGSGEEVPMETRENGLEECAGEPLSADPEARRLLGPAPEDDGGHNDHSQPQASQDQDSHTLSPQV

SEQ ID NO: 907526 - protein, 1267 aa, Homo sapiens; identical to SEQ ID NO: 907521

SEQ ID NO: 907527 - protein, 707 aa, Homo sapiens
MGDMKTPDFDDLLAAFDIPDPTSLDAKEAIQTPSEENESPLKPPGICMDESVSLSHSGSAPDVPAVSVIVKNTSRQESFEAEKDHITPSLLHNGFRGSDLPPDPHNCGKFDSTFMNGDSARSFPGKLEPPKSEPLPTFNQFSPISSPEPEDPIKDNGFGIKPKHSDSYFPPPLGCGAVGGPVLEALAKFPVPELHMFDHFCKKEPKPEPLPLGSQQEHEQSGQNTVEPHKDPDATRFFGEALEFNSHPSNSIGESKGLARELGTCSSVPPRQRLKPAHSKLSSCVAALVALQAKRVASVTKEDQPGHTKDLSGPTKESSKGSPKMPKSPKSPRSPLEATRKSIKPSDSPRSICSDSSSKGSPSVAASSPPAIPKVRIKTIKTSSGEIKRTVTRILPDPDDPSKSPVGSPLGSAIAEAPSEMPGDEVPVEEHFPEAGTNSGSPQGARKGDESMTKASDSSSPSCSSGPRVPKGAAPGSQTGKKQQSTALQASTLAPANLLPKAVHLANLNLVPHSVAASVTAKSSVQRRSQPQLTQMSVPLVHQVKKAAPLIVEVFNKVLHSSNPVPLYAPNLSPPADSRIHVPASGYCCLECGDAFALEKSLSQHYGRRSVHIEVLCTLCSKTLLFFNKCSLLRHARDHKSKGLVMQCSQLLVKPISADQMFVSAPVNSTAPAAPAPSSSPKHGLTSGSASPPPPALPLYPDPVSPL

SEQ ID NO: 907528 - protein, 216 aa, Homo sapiens
MAGRGGAARPNGPAAGNKICQFKLVLLGESAVGKSSLVLRFVKGQFHEYQESTIGAAFLTQTVCLDDTTVKFEIWDTAGQERYHSLAPMYYRGAQAAIVVYDITNTDTFARAKNWVKELQRQASPNIVIALAGNKADLASKRAVEFQEAQAYADDNSLLFMETSAKTAMNVNEIFMAIAKKLPKNEPQNATGAPGRNRGVDLQENNPASRSQCCSN

SEQ ID NO: 907529 - protein, 187 aa, Homo sapiens
SGSGAAERRKWRPEPGTPPAGREADPVRAPAPSNAAAPEPPWRSPSPLSASLHSTSPHPHALWTTTAGRAMAGRGGAARPNGPAAGNKICQFKLVLLGESAVGKSSLVLRFVKGQFHEYQESTIGAAFLTQTVCLDDTTVKFEIWDTAGQERYHSLAPMYYRGAQAAIVVYDITNTDTFACVPRTVC

SEQ ID NO: 907530 - protein, 286 aa, Homo sapiens
SGSGAAERRKWRPEPGTPPAGREADPVRAPAPSNAAAPEPPWRSPSPLSASLHSTSPHPHALWTTTAGRAMAGRGGAARPNGPAAGNKICQFKLVLLGESAVGKSSLVLRFVKGQFHEYQESTIGAAFLTQTVCLDDTTVKFEIWDTAGQERYHSLAPMYYRGAQAAIVVYDITNTDTFARAKNWVKELQRQASPNIVIALAGNKADLASKRAVEFQEAQAYADDNSLLFMETSAKTAMNVNEIFMAIAKKLPKNEPQNATGAPGRNRGVDLQENNPASRSQCCSN

SEQ ID NO: 907531 - protein, 196 aa, Homo sapiens
RLGTRRVVNRPRGKSSLVLRFVKGQFHEYQESTIGAAFLTQTVCLDDTTVKFEIWDTAGQERYHSLAPMYYRGAQAAIVVYDITNTDTFARAKNWVKELQRQASPNIVIALAGNKADLASKRAVEFQEAQAYADDNSLLFMETSAKTAMNVNEIFMAIAKKLPKNEPQNATGAPGRNRGVDLQENNPASRSQCCSN

SEQ ID NO: 907532 - protein, 286 aa, Homo sapiens; identical to SEQ ID NO: 907530

SEQ ID NO: 907533 - protein, 286 aa, Homo sapiens; identical to SEQ ID NO: 907530

SEQ ID NO: 907534 - protein, 325 aa, Homo sapiens
SGSGAAERRKWRPEPGTPPAGREADPVRAPAPSNAAAPEPPWRSPSPLSASLHSTSPHPHALWTTTAGRAMAGRGGAARPNGPAAGNKICQFKLVLLGESAVGKSSLVLRFVKGQFHEYQESTIGAAFLTQTVCLDDTTVKFEIWDTAGQERYHSLAPMYYRGAQAAIVVYDITNTDTFARAKNWVKELQRQASPNIVIALAGNKADLASKRAVEFQEAQAYADDNSLLFMETSAKTAMNVNEIFMAIAKKLPKQQKAPEKLAKLGVAFPKGARKKTPNGLVGNPVPQRGKEKTKTAPKGPKGAPGERPPRVWPLGQGPKTLWER

SEQ ID NO: 907535 - protein, 286 aa, Homo sapiens; identical to SEQ ID NO: 907530

SEQ ID NO: 907536 - protein, 208 aa, Homo sapiens
SGSGAAERRKWRPEPGTPPAGREADPVRAPAPSNAAAPEPPWRSPSPLSASLHSTSPHPHALWTTTAGRAMAGRGGAARPNGPAAGNKICQFKLVLLGESAVGKSSLVLRFVKGQFHEYQESTIGAAFLTQTVCLDDTTVKFEIWDTAGQERYHSLAPMYYRGAQAAIVVYDITNTVKISPCFFLCPSSSQSPRDWVIRALISGRLTL

SEQ ID NO: 907537 - protein, 325 aa, Homo sapiens
SGSGAAERRKWRPEPGTPPAGREADPVRAPAPSNAAAPEPPVSLSRQAGVQWHYLSSVQPLPPGFKRFSCLSLPSSWDYSWRSPSPLSASLHSTSPHPHALWTTTAGRAMAGRGGAARPNGPAAGNKICQFKLVLLGESAVGKSSLVLRFVKGQFHEYQESTIGAAFLTQTVCLDDTTVKFEIWDTAGQERYHSLAPMYYRGAQAAIVVYDITNTDTFARAKNWVKELQRQASPNIVIALAGNKADLASKRAVEFQEAQAYADDNSLLFMETSAKTAMNVNEIFMAIAKKLPKNEPQNATGAPGRNRGVDLQENNPASRSQCCSN

SEQ ID NO: 907538 - protein, 162 aa, Homo sapiens
MSLSRCRGVRGSCYSDLTGCMWLKVEVYKEGNSWAPGEGAETSDQKAGPAICDTFARAKNWVKELQRQASPNIVIALAGNKADLASKRAVEFQEAQAYADDNSLLFMETSAKTAMNVNEIFMAIAKKLPKNEPQNATGAPGRNRGVDLQENNPASRSQCCSN

SEQ ID NO: 907539 - protein, 127 aa, Homo sapiens
MTNTKGKRRGTRYMFSRPLRKHGVVPLATYMRIYKKGDIVDIKGMGTVQKGMPHKCYHGKTGRVYNVTQHAVGIVVNKQVKGKILAKRINVRIEHIKHSKSRDSFLKRVKENESFHLHLSVQILIQF

SEQ ID NO: 907540 - protein, 211 aa, Homo sapiens
MSPFFAHRKFVNSAWGWTCTFLGGFVLLVVFLATRRVAVTARHLSRLVVGAAVWRGAGRAFLLIEDLTGSCFEPLPQGLLLHELPDRRSCLAAGHQWRGYTVSSHTFLLTFCCLLMAEEAAVFAKYLAHGLPAGAPLRLVFLLNVLLLGLWNFLLLCTVIYFHQYTHKVVGAAVGTFAWYLTYGSWYHQPWSPGSPGHGLFPRPHSSRKHN

SEQ ID NO: 907541 - protein, 292 aa, Homo sapiens
MERGPVVGAGLGAGARIQALLGCLLKVLLWVASALLYFGSEQAARLLGSPCLRRLYHAWLAAVVIFGPLLQFHVNPRTIFASHGNFFNIKFVNSAWGWTCTFLGGFVLLVVFLATRRVAVTARHLSRLVVGAAVWRGAGRAFLLIEDLTGSCFEPLPQGLLLHELPDRRSCLAAGHQWRGYTVSSHTFLLTFCCLLMAEEAAVFAKYLAHGLPAGAPLRLVFLLNVLLLGLWNFLLLCTVIYFHQYTHKVVGAAVGTFAWYLTYGSWYHQPWSPGSPGHGLFPRPHSSRKHN

SEQ ID NO: 907542 - protein, 54 aa, Homo sapiens
MPGKKARKNAQPSPARAPAELEVECATQLRRFGDKLNFRQKLLNLISKLFCSGT

SEQ ID NO: 907543 - protein, 111 aa, Homo sapiens
MPGKKARKNAQPSPARAPAGPAGTAGTARDQAGFAIGMQLRFTRAKSSFPPLFPPRHLPFPGATRNKCKCRRLSLGESHCRGRRGRREPRGPPGLPALPETAPQGPLCSGA

SEQ ID NO: 907544 - protein, 63 aa, Homo sapiens
LALYQSYVPCTIYLTTLHSVHRSPTYIESALRDLLLRSPHMNPIGLATCEPANSAIMADITLL

SEQ ID NO: 907545 - protein, 737 aa, Homo sapiens
MRCYLSWDRWTSPPLSSIIFISVDYILNVTREIDNFFPGLFAYHNIRVYDEETTDLLAHWNEAYHFINKAKRNHSKCLVHCKMGVSRSASTVIAYAMKEFGWPLEKAYNYVKQKRSITRPNAGFMRQLSEYEGILDASKQRHNKLWRQQTDSSLQQPVDDPAGPGDFLPETPDGTPESQLPFLDDAAQPGLGPPLPCCFRRLSDPLLPSPEDETGSLVHLEDPEREALLEEAAPPAEVHRPARQPQQGSGLCEKDVKKKLEFGSPKGRSGSLLQVEETEREEGLGAGRWGQLPTQLDQNLLNSENLNNNSKRSCPNGMEDDAIFGILNKVKPSYKSCADCMYPTASGAPEASRERCEDPNAPAICTQPAFLPHITSSPVAHLASRSRVPEKPASGPTEPPPFLPPAGSRRADTSGPGAGAALEPPASLLEPSRETPKVLPKSLLLKNSHCDKNPPSTEVVIKEESSPKKDMKPAKDLRLLFSNESEKPTTNSYLMQHQESIIQLQKAGLVRKHTKELERLKSVPADPAPPSRDGPASRLEASIPEESQDPAALHELGPLVMPSQAGSDEKSEAAPASLEGGSLKSPPPFFYRLDHTSSFSKDFLKTICYTPTSSSMSSNLTRSSSSDSIHSVRGKPGLVKQRTQEIETRLRLAGLTVSSPLKRSHSLAKLGSLTFSTEDLSSEADPSTVADSQDTTLSESSFLHEPQGTPRDPAATSKPSGKPAPENLKSPSWMSKS

SEQ ID NO: 907546 - protein, 380 aa, Homo sapiens
MRCYLSWDRWTSPPLSSIIFISVDYILNVTREIDNFFPGLFAYHNIRVYDEETTDLLAHWNEAYHFINKAKRNHSKCLVHCKMGVSRSASTVIAYAMKEFGWPLEKAYNYVKQKRSITRPNAGFMRQLSEYEGILDASKQRHNKLWRQQTDSSLQQPVDDPAGPGDFLPETPDGTPESQLPFLDDAAQPGLGPPLPCCFRRLSDPLLPSPEDETGSLVHLEDPEREALLEEAAPPAEVHRPARQPQQGSGLCEKDVKKKLEFGSPKGRSGSLLQVEETEREEGLGAGRWGQLPTQLDQNLLNSENLNNNSKRSCPNGMEVGRARPAGWHTPSLPSHSNWPTSASVVGTTGTRHHTQLIFFYCLLWAPSSHLQGPEGSFTG

SEQ ID NO: 907547 - protein, 737 aa, Homo sapiens; identical to SEQ ID NO: 907545

SEQ ID NO: 907548 - protein, 147 aa, Homo sapiens
MGISEEFNGKPDSLFFNDGQRRIDFVLVYEDESRKETNKKGTNEKQRRKRQAYESNLICHGLQLEATRSVSTGPFFSPRLTTVLGQLRATWNTWVTLETCSPGHILVIDWERSQSKSALCRMYSFFLIKTSRSFLIANEFYNECMYE

SEQ ID NO: 907549 - protein, 275 aa, Homo sapiens
GRTGHAQSPGSARQARGVLRLWAPVGGCLGSAFPGAGWAQRPLSPSDTRPAVPDPAPGRAAPFWNPGAPNFAPSSEPPSEGDMKKMSRNVLLQMEEEEDDDDGDIVLENLGQTIVPDLGSLESQHDFRTPEFEEFNGKPDSLFFNDGQRRIDFVLVYEDESRKETNKKGTNEKQRRKRQAYESNLICHGLQLEATRSVSTGPFFSPRLTTVLGQLRATWNTWVTLETCSPGHILVIDWERSQSKSALCRMYSFFLIKTSRSFLIANEFYNECMYE

SEQ ID NO: 907550 - protein, 108 aa, Homo sapiens
GRTGHAQSPGSARQARGVLRLWAPVGGCLGSAFPGAGWAQRPLSPSDTRPAVPDPAPGRAAPFWNPGAPNFAPSSEPPSEGDMKKMSRNVLLQMEEEEDDDDGDIGRI

SEQ ID NO: 907551 - protein, 296 aa, Homo sapiens
GRTGHAQSPGSARQARGVLRLWAPVGGCLGSAFPGAGWAQRPLSPSDTRPAVPDPAPGRAAPFWNPGAPNFAPSSEPPSEGDMKKMSRNVLLQMEEEEDDDDGDIGDVPASRRPFLTPHTHLPSSLVLENLGQTIVPDLGSLESQHDFRTPEFEEFNGKPDSLFFNDGQRRIDFVLVYEDESRKETNKKGTNEKQRRKRQAYESNLICHGLQLEATRSVSTGPFFSPRLTTVLGQLRATWNTWVTLETCSPGHILVIDWERSQSKSALCRMYSFFLIKTSRSFLIANEFYNECMYE

SEQ ID NO: 907552 - protein, 235 aa, Homo sapiens
MDGHHYRRVARVDLRKKTETFSTRRVKSGLCKESQLPSTSALGKGEQVEVTFPVLRLAPCDLSLIPNSACGCLSSENTRCVWIGSSVGLFVFNLANLEVEAALYYKDFQSLSILLAGSCALRNRTADQKVLCLLASLFGGKIAVLEINPAALVRAQQCPSMGQSLSVPASSCVLPTSPLYLGIAKEKSTKAASEQRRATCPRLTAVPLVPVAVGVQSGPSAITDCENIFFPFFLC

SEQ ID NO: 907553 - protein, 235 aa, Homo sapiens; identical to SEQ ID NO: 907552

SEQ ID NO: 907554 - protein, 295 aa, Homo sapiens
MDGHHYRRVARVDLRKKTETFSTRRVKSGLCKESQLPSTSALGKGEQVEVTFPVLRLAPCDLSLIPNSACGCLSSENTRCVWIGSSVGLFVFNLANLEVEAALYYKDFQSLSILLAGSCALRNRTADQKVLCLLASLFGGKIAVLEINPAALVRAQQCPSMGQSLSVPASSCVLPTSPLYLGIAKEKSTKAASEQRRAARNVMKDQRLVFHSKVRSSGYASAPHVTMFSPKTNIKSEGKGSSRSRSTCAREAYPVECAVPTKPGPQVVPPPPAHVYAASSTQVRHVLRELGSISL

SEQ ID NO: 907555 - protein, 198 aa, Homo sapiens
MDGHHYRRVARVDLRKKTETFSTRRVKSGLCKESQLPSTSALGKGEQVEVTFPVLRLAPCDLSLIPNSACGCLSSENTRCVWIGSSVGLFVFNLANLEVEAALYYKDFQSLSILLAGSCALRNRTADQKVLCLLASLFGGKIAVLEINPAALVRAQQCPSMGQSLSVPASSCVLPTSPLYLGIAKEKSTKAASEQRRV

SEQ ID NO: 907556 - protein, 109 aa, Homo sapiens
WAFLFWRSKARLLSDKMPEYPGKLSLLLSVETHPRTSGVGRARTALSIQRDLGVRHTWPHGQVLSTCAARECQGPCVLPSDGFLLVNEAGTRPHSYSIDGAGVRPRSTA

SEQ ID NO: 907557 - protein, 235 aa, Homo sapiens; identical to SEQ ID NO: 907552

SEQ ID NO: 907558 - protein, 203 aa, Homo sapiens
MDGHHYRRVARVDLRKKTETFSTRRVKSGLCKESQLPSTSALGKGEQVEVTFPVLRLAPCDLSLIPNSACGCLSSENTRCVWIGSSVGLFVFNLANLEVEAALYYKDFQSLSILLAGSCALRNRTADQKVLCLLASLFGGKIAVLEINPAALVRAQQCPSMGQSLSVPASSCVLPTSPLYLGIAKEKSTKAASEQRRGQYRVL

SEQ ID NO: 907559 - protein, 303 aa, Homo sapiens
MDGHHYRRVARVDLRKKTETFSTRRVKSGLCKESQLPSTSALGKGEQVEVTFPVLRLAPCDLSLIPNSACGCLSSENTRCVWIGSSVGLFVFNLANLEVEAALYYKDFQSLSILLAGSCALRNRTADQKVLCLLASLFGGKIAVLEINPAALVRAQQCPSMGQSLSVPASSCVLPTSPLYLGIAKEKSTKAASEQRRAARNVMKDQRLVFHSKVRSSGYASAPHVTMFSPKTNIKSEGKGSSRSRSTCAREAYPVECAVPTKPGPQVVPPPPAHVYAASSTQEMGSGWPVGWPTICYSFLMPA

SEQ ID NO: 907560 - protein, 285 aa, Homo sapiens
MGTPGEGLGRCSHALIRGVPESLASGEGAGAGLPALDLAKAQREHGVLGGKLRQRLGLQLLELPPEESLPLGPLLGDTAVIQGDTALITRPWSPARRPEVDGVRKALQDLGLRIVEIGDENATLDGTDVLFTGREFFVGLSKWTNHRGAEIVADTFRDFAVSTVPVSGPSHLRGLCGMGGPRTVVAGSSDAAQKAVRAMAVLTDHPYASLTLPDDAAADCLFLRPGLPGVPPFLLHRGGGDLPNSQEALQKLSDVTLVPVSCSELEKAGAGLSSLCLVLSTRPHS

SEQ ID NO: 907561 - protein, 285 aa, Homo sapiens; identical to SEQ ID NO: 907560

SEQ ID NO: 907562 - protein, 285 aa, Homo sapiens; identical to SEQ ID NO: 907560

SEQ ID NO: 907563 - protein, 108 aa, Homo sapiens [sequence omitted]

SEQ ID NO: 907564 - protein, 108 aa, Homo sapiens [sequence omitted]

SEQ ID NO: 907565 - protein, 200 aa, Homo sapiens
MGTPGEGLGRCSHALIRGVPESLASGEGAGAGLPALDLAKAQREHGVLGGKLRQRLGLQLLELPPEESLPLGPLLGDTAVIQGDTALITRPWSPARRPEVDGVRKALQDLGLRIVEIGDENATLDGTDVLFTGREFFVGLSKWTNHRGAEIVADTFRDFAVSTVPVSGPSHLRGLCGMGGPRTVVAGSSDAAQKAVRPPR

SEQ ID NO: 907566 - protein, 154 aa, Homo sapiens
MGTPGEGLGRCSHALIRGVPESLASGEGAGAGLPALDLAKAQREHGVLGGKLRQRLGLQLLELPPEESLPLGPLLGDTAVIQGDTALITRPWSPARRPEVDGVRKALQDLGLRIVEIGDENATLDGTDVLFTGREFFVGLSKWTNHRGGTAEAL

SEQ ID NO: 907567 - protein, 285 aa, Homo sapiens; identical to SEQ ID NO: 907560

SEQ ID NO: 907568 - protein, 285 aa, Homo sapiens; identical to SEQ ID NO: 907560

SEQ ID NO: 907569 - protein, 291 aa, Homo sapiens
MLCVDGMGTPGEGLGRCSHALIRGVPESLASGEGAGAGLPALDLAKAQREHGVLGGKLRQRLGLQLLELPPEESLPLGPLLGDTAVIQGDTALITRPWSPARRPEVDGVRKALQDLGLRIVEIGDENATLDGTDVLFTGREFFVGLSKWTNHRGAEIVADTFRDFAVSTVPVSGPSHLRGLCGMGGPRTVVAGSSDAAQKAVRAMAVLTDHPYASLTLPDDAAADCLFLRPGLPGVPPFLLHRGGGDLPNSQEALQKLSDVTLVPVSCSELEKAGAGLSSLCLVLSTRPHS

SEQ ID NO: 907570 - protein, 325 aa, Homo sapiens
MGTPGEGLGRCSHALIRGVPESLASGEGAGAGLPALDLAKAQREHGVLGGKLRQRLGLQLLELPPEESLPLGPLLGDTAVIQGDTALITRPWSPARRPEVDGVRKALQDLGLRIVEIGDENATLDGTDVLFTGEAGGRHRSWHREVEFGRLGRLEPCSNSLPPSNLRGLPDSGREFFVGLSKWTNHRGAEIVADTFRDFAVSTVPVSGPSHLRGLCGMGGPRTVVAGSSDAAQKAVRAMAVLTDHPYASLTLPDDAAADCLFLRPGLPGVPPFLLHRGGGDLPNSQEALQKLSDVTLVPVSCSELEKAGAGLSSLCLVLSTRPHS

SEQ ID NO: 907571 - protein, 136 aa, Homo sapiens [sequence omitted]

SEQ ID NO: 907572 - protein, 501 aa, Homo sapiens
MFTLPQKDFRAPTTCLGPTCMQDLGSSHGEDLEGECSRKLDQKLPELRGVGDPAMISSDTSYLSSRGRMIKWFWDSAEEGYRTYHMDEYDEDKNPSGIINLGTSENKLCFDLLSWRLSQRDMQRVEPSLLQYADWRGHLFLREEVAKFLSFYCKSPVPLRPENVVVLNGGASLFSALATVLCEAGEAFLIPTPYYGAITQHVCLYGNIRLAYVYLDSEVTGLDTRPFQLTVEKLEMALREAHSEGVKVKGLILISPQNPLGDVYSPEELQEYLVFAKRHRLHVIVDEVYMLSVFEKSVGYRSVLSLERLPDPQRTHVMWATSKDFGMSGLRFGTLYTENQDVATAVASLCRYHGLSGLVQYQMAQLLRDRDWINQVYLPENHARLKAAHTYVSEELRALGIPFLSRGAGFFIWVDLRKYLPKGTFEEEMLLWRRFLDNKVLLSFGKAFECKEPGWFRFVFSDQVHRLCLGMQRVQQVLAGKSQVAEDPRPSQSQEPSDQRR

SEQ ID NO: 907573 - protein, 501 aa, Homo sapiens; identical to SEQ ID NO: 907572

SEQ ID NO: 907574 - protein, 475 aa, Homo sapiens
MFTLPQKDFRAPTTCLGPTCMQDLGSSHGEDLEGECSRKLDQKLPELRGVGDPAMISSDTSYLSSRGRMIKWFWDSAEEGYRTYHMDEYDEDKNPSGIINLGTSENKLCFDLLSWRLSQRDMQRVEPSLLQYADWRGHLFLREEVAKFLSFYCKSPVPLRPENVVVLNGGASLFSALATVLCEAGEAFLIPTPYYGAITQHVCLYGNIRLAYVYLDSEVTGLDTRPFQLTVEKLEMALREAHSEGVKVKGLILISPQNPLGDVYSPEELQEYLVFAKRHRLHVIVDEVYMLSVFEKSVGYRSVLSLERLPDPQRTHVMWATSKDFGMSGLRFGTLYTENQDVATAVASLCRYHGLSGLVQYQMAQLLRDRDWINQVYLPENHARLKAAHTYVSEELRALGIPFLSRGAGFFIWVDLRKGCRGSSRCLQANPKWQKTPVPLRARSQVTNAGELVIVSWPEGPAATVDLGRSGAAED

SEQ ID NO: 907575 - protein, 557 aa, Homo sapiens
LHLWRFPFLPSLSSYPPSASEHHIISSYPLHHKTPRTPRQYSALTQEILTWHLVIEMFTLPQKDFRAPTTCLGPTCMQDLGSSHGEDLEGECSRKLDQKLPELRGVGDPAMISSDTSYLSSRGRMIKWFWDSAEEGYRTYHMDEYDEDKNPSGIINLGTSENKLCFDLLSWRLSQRDMQRVEPSLLQYADWRGHLFLREEVAKFLSFYCKSPVPLRPENVVVLNGGASLFSALATVLCEAGEAFLIPTPYYGAITQHVCLYGNIRLAYVYLDSEVTGLDTRPFQLTVEKLEMALREAHSEGVKVKGLILISPQNPLGDVYSPEELQEYLVFAKRHRLHVIVDEVYMLSVFEKSVGYRSVLSLERLPDPQRTHVMWATSKDFGMSGLRFGTLYTENQDVATAVASLCRYHGLSGLVQYQMAQLLRDRDWINQVYLPENHARLKAAHTYVSEELRALGIPFLSRGAGFFIWVDLRKYLPKGTFEEEMLLWRRFLDNKVLLSFGKAFECKEPGWFRFVFSDQVHRLCLGMQRVQQVLAGKSQVAEDPRPSQSQEPSDQRR

SEQ ID NO: 907576 - protein, 308 aa, Homo sapiens
MFTLPQKDFRAPTTCLGPTCMQDLGSSHGEDLEGECSRKLDQKLPELRGVGDPAMISSDTSYLSSRGRMIKWFWDSAEEGYRTYHMDEYDEDKNPSGIINLGTSENKLCFDLLSWRLSQRDMQRVEPSLLQYADWRGHLFLREEVAKFLSFYCKSPVPLRPENVVVLNGGASLFSALATVLCEAGEAFLIPTPYYGAITQHVCLYGNIRLAYVYLDSEVTGLDTRPFQLTVEKLEMALREAHSEGVKVKGLILISPQNPLGDVYSPEELQEYLVFAKRHRLHVIVDEVYMLSVFEKSVGYRSVLSLER

SEQ ID NO: 907577 - protein, 158 aa, Homo sapiens
MFTLPQKDFRAPTTCLGPTCMQDLGSSHGEDLEGECSRKLDQKLPELRGVGDPAMISSDTSYLSSRGRMIKWFWDSAEEGYRTYHMDEYDEDKNPSGIINLGTSENKLCFDLLSWRPPGGSGQVPVFLLQEPSTPQTRECGCPEWWCLALLCSGHGAV

SEQ ID NO: 907578 - protein, 67 aa, Homo sapiens
DIDLLASFTQTDWINQVYLPENHARLKAAHTYVSEELRALGIPFLSRGAGFFIWVDLRKVMLVEVRA

SEQ ID NO: 907579 - protein, 119 aa, Homo sapiens
HLLCMCGFLFEKNRRKNGVLGITSPPCGTHLPYTLSLSSPPLPHSRHRLHVIVDEVYMLSVFEKSVGYRSVLSLERLHDPQEDPCDVTTSMDSGCLKSVCTLDTRNTMCHLRALICRST

SEQ ID NO: 907580 - protein, 132 aa, Homo sapiens
MYWINQVYLPENHARLKAAHTYVSEELRALGIPFLSRGAGFFIWVDLRKYLPKGTFEEEMLLWRRFLDNKVLLSFGKAFECKEPGWFRFVFSDQVHRLCLGMQRVQQVLAGKSQVAEDPRPSQSQEPSDQRR

SEQ ID NO: 907581 - protein, 238 aa, Homo sapiens
MLSVFEKSVGYRSVLSLERLPDPQRTHVMWATSKDFGMSGLRFGTLYTENQDVATAVASLCRYHGLSGLVQYQMAQLLRDRDEENEDQILPQLTIVAKSFKNSDNIKYWINQVYLPENHARLKAAHTYVSEELRALGIPFLSRGAGFFIWVDLRKYLPKGTFEEEMLLWRRFLDNKVLLSFGKAFECKEPGWFRFVFSDQVHRLCLGMQRVQQVLAGKSQVAEDPRPSQSQEPSDQRR

SEQ ID NO: 907582 - protein, 430 aa, Homo sapiens
MFTLPQKDFRAPTTCLGPTCMQDLGSSHGEDLEGECSRKLDQKLPELRGVGDPAMISSDTSYLSSRGRMIKWFWDSAEEGYRTYHMDEYDEDKNPSGIINLGTSENKLCFDLLSWRLSQRDMQRVEPSLLQYADWRGHLFLREEVAKFLSFYCKSPVPLRPENVVVLNGGASLFSALATVLCEAGEAFLIPTPYYGAITQHVCLYGNIRLAYVYLDSEVTGLDTRPFQLTVEKLEMALREAHSEGVKVKGLILISPQNPLGDVYSPEELQEYLVFAKRHRLHVIVDEVYMLSVFEKSVGYRSVLSLERLPDPQRTHVMWATSKDFGMSGLRFGTLYTENQDVATAVASLCRYHGLSGLVQYQMAQLLRDRDWINQVYLPENHARLKAAHTYVSEELRALGIPFLSRGAGFFIWVDLRKIQRSSTMQHGTA

SEQ ID NO: 907583 - protein, 69 aa, Homo sapiens
KGLERDWGQWTEGLGCSGQKVTGPRPLLPPEAFLIPTPYYGAITQHVCLYGNIRLAYVYLDSEVRVLTS

SEQ ID NO: 907584 - protein, 932 aa, Homo sapiens
RSAALQRPRPGPARPRRRQFRLKKLIDQEIKSQEEKEQEKEKRVTTLKEELTKLKSFALMVVDEQQRLTAQLTLQRQKIQELTTNAKETHTKLALAEARVQEEEQKATRLEKELQTQTTKFHQDQDTIMAKLTNEDSQNRQLQQKLAALSRQIDELEETNRSLRKAEEELQDIKEKISKGEYGNAGIMAEVEELIKMEEQCRDLNKRLERETLQSKDFKLEVEKLSKRIMALEKLEDAFNKSKQECYSLKCNLEKERMTTKQLSQELESLKVRIKELEAIESRLEKTEFTLKEDLTKLKTLTVMFVDERKTMSEKLKKTEDKLQAASSQLQVEQNKVTTVTEKLIEETKRALKSKTDVEEKMYSVTKERDDLKNKLKAEEEKGNDLLSRVNMLKNRLQSLEAIEKDFLKNKLNQDSGKSTTALHQENNKIKELSQEVERLKLKLKDMKAIEDDLMKTEDEYETLERRYANERDKAQFLSKELEHVKMELAKYKLAEKTETSHEQWLFKRLQEEEAKSGHLSREVDALKEKIHEYMATEDLICHLQGDHSVLQKKLNQQENRNRDLGREIENLTKELERYRHFSKSLRPSLNGRRISDPQVFSKEVQTEAVDNEPPDYKSLIPLERAVINGQLYEESENQDEDPNDEGSVLSFKCSQSTPCPVNRKLWIPWMKSKEGHLQNGKMQTKPNANFVQPGDLVLSHTPGQPLHIKVTPDHVQNTATLEITSPTTESPHSYTSTAVIPNCGTPKQRITILQNASITPVKSKTSTEDLMNLEQGMSPITMATFARAQTPESCGSLTPERTMSPIQVLAVTGSASSPEQGRSPEPTEISAKHAIFRVSPDRQSSWQFQRSNSNSSSVITTEDNKIHIHLGSPYMQAVASPSAPLQDNRTQGLINGALNKTTNKVTSSITITPTATPLPRQSQITVSNIYN

SEQ ID NO: 907585 - protein, 121 aa, Homo sapiens
IRAPISSGPNNEHSAKHAIFRVSPDRQSSWQFQRSNSNSSSVITTEDNKIHIHLGSPYMQAVASPVRPASPSAPLQDNRTQGLINGALNKTTNKVTSSITITPTATPLPRQSQITVSNIYN

SEQ ID NO: 907586 - protein, 938 aa, Homo sapiens
AARHYSGPGPAPARPRRRQFRLKKLIDQEIKSQEEKEQEKEKRVTTLKEELTKLKSFALMVVDEQQRLTAQLTLQRQKIQELTTNAKETHTKLALAEARVQEEEQKATRLEKELQTQTTKFHQDQDTIMAKLTNEDSQNRQLQQKLAALSRQIDELEETNRSLRKAEEELQDIKEKISKGEYGNAGIMAEVEELRKRVLDMEGKDEELIKMEEQCRDLNKRLERETLQSKDFKLEVEKLSKRIMALEKLEDAFNKSKQECYSLKCNLEKERMTTKQLSQELESLKVRIKELEAIESRLEKTEFTLKEDLTKLKTLTVMFVDERKTMSEKLKKTEDKLQAASSQLQVEQNKVTTVTEKLIEETKRALKSKTDVEEKMYSVTKERDDLKNKLKAEEEKGNDLLSRVNMLKNRLQSLEAIEKDFLKNKLNQDSGKSTTALHQENNKIKELSQEVERLKLKLKDMKAIEDDLMKTEDEYETLERRYANERDKAQFLSKELEHVKMELAKYKLAEKTETSHEQWLFKRLQEEEAKSGHLSREVDALKEKIHEYMATEDLICHLQGDHSVLQKKLNQQENRNRDLGREIENLTKELERYRHFSKSLRPSLNGRRISDPQVFSKEVQTEAVDNEPPDYKSLIPLERAVINGQLYEESENQDEDPNDEGSVLSFKCSQSTPCPVNRKLWIPWMKSKEGHLQNGKMQTKPNANFVQPGDLVLSHTPGQPLHIKVTPDHVQNTATLEITSPTTESPHSYTSTAVIPNCGTPKQRITILQNASITPVKSKTSTEDLMNLEQGMSPITMATFARAQTPESCGSLTPERTMSPIQVLAVTGSASSPEQGRSPEPTEISAKHAIFRVSPDRQSSWQFQRSNSNSSSVITTEDNKIHIHLGSPYMQAVASPVRPASPSAPLQDNRTQGSWTMTEAYNALSKARDRTHIRNGYY

SEQ ID NO: 907587 - protein, 932 aa, Homo sapiens; identical to SEQ ID NO: 907584

SEQ ID NO: 907588 - protein, 952 aa, Homo sapiens
AARHYSGPGPAPARPRRRQFRLKKLIDQEIKSQEEKEQEKEKRVTTLKEELTKLKSFALMVVDEQQRLTAQLTLQRQKIQELTTNAKETHTKLALAEARVQEEEQKATRLEKELQTQTTKFHQDQDTIMAKLTNEDSQNRQLQQKLAALSRQIDELEETNRSLRKAEEELQDIKEKISKGEYGNAGIMAEVEELRKRVLDMEGKDEELIKMEEQCRDLNKRLERETLQSKDFKLEVEKLSKRIMALEKLEDAFNKSKQECYSLKCNLEKERMTTKQLSQELESLKVRIKELEAIESRLEKTEFTLKEDLTKLKTLTVMFVDERKTMSEKLKKTEDKLQAASSQLQVEQNKVTTVTEKLIEETKRALKSKTDVEEKMYSVTKERDDLKNKLKAEEEKGNDLLSRVNMLKNRLQSLEAIEKDFLKNKLNQDSGKSTTALHQENNKIKELSQEVERLKLKLKDMKAIEDDLMKTEDEYETLERRYANERDKAQFLSKELEHVKMELAKYKLAEKTETSHEQWLFKRLQEEEAKSGHLSREVDALKEKIHEYMATEDLICHLQGDHSVLQKKLNQQENRNRDLGREIENLTKELERYRHFSKSLRPSLNGRRISDPQVFSKEVQTEAVDNEPPDYKSLIPLERAVINGQLYEESENQDEDPNDEGSVLSFKCSQSTPCPVNRKLWIPWMKSKEGHLQNGKMQTKPNANFVQPGDLVLSHTPGQPLHIKVTPDHVQNTATLEITSPTTESPHSYTSTAVIPNCGTPKQRITILQNASITPVKSKTSTEDLMNLEQGMSPITMATFARAQTPESCGSLTPERTMSPIQVLAVTGSASSPEQGRSPEPTEISAKHAIFRVSPDRQSSWQFQRSNSNSSSVITTEDNKIHIHLGSPYMQAVASPVRPASPSAPLQDNRTQGLINGALNKTTNKVTSSITITPTATPLPRQSQITVSNIYN

SEQ ID NO: 907589 - protein, 327 aa, Homo sapiens
AARHYSGPGPAPARPRRRQFRLKKLIDQEIKSQEEKEQEKEKRVTTLKEELTKLKSFALMVVDEQQRLTAQLTLQRQKIQELTTNAKETHTKLALAEARVQEEEQKATRLEKELQTQTTKFHQDQDTIMAKLTNEDSQNRQLQQKLAALSRQIDELEETNRSLRKAEEELQDIKEKISKGEYGNAGIMAEVEELRKRVLDMEGKDEELIKMEEQCRDLNKRLERETLQSKDFKLEVEKLSKRIMALEKLEDAFNKSKQECYSLKCNLEKERMTTKQLSQELESLKVRIKELEAIESRLEKTEFTLKEDLTKLKTLTVMFVDELYKSI

SEQ ID NO: 907590 - protein, 329 aa, Homo sapiens
MVRTKTWTLKKHFVGYPTNSDFELKTSELPPLKNGEVLLEALFLTVDPYMRVAAKRLKEGDTMMGQQVAKVVESKNVALPKGTIVLASPGWTTHSISDGKDLEKLLTEWPDTIPLSLALGTVGMPGLTAYFGLLEICGVKGGETVMVNAAAGAVGSVVGQIAKLKGCKVVGAVGSDEKVAYLQKLGFDVVFNYKTVESLEETLKKASPDGYDCYFDNVGGEFSNTVIGQMKKFGRIAICGAISTYNRTGPLPPGPPPEIVIYQELRMEAFVVYRWQGDARQKALKDLLKWVLEGKIQYKEYIIEGFENMPAAFMGMLKGDNLGKTIVKA

SEQ ID NO: 907591 - protein, 293 aa, Homo sapiens
MVRTKTWTLKKHFVGYPTNSDFELKTSELPPLKNGEVLLEALFLTVDPYMRVAAKRLKEGDTMMGQQVAKVVESKNVALPKGTIVLASPGWTTHSISDGKDLEKLLTEWPDTIPLSLALGTVGMPGLTAYFGLLEICGVKGGETVMVNAAAGAVGSVVGQIAKLKGCKVVGAVGSDEKVAYLQKLGFDVVFNYKTVESLEETLKKASPDGYDCYFDNVGGEFSNTVIGQMKKFGRIAICGAISTYNRTGPLPPGPPPEIVIYQELRMEAFVVYRWQGDARQKALKDLLKWVLE

SEQ ID NO: 907592 - protein, 274 aa, Homo sapiens
MVRTKTWTLKKHFVGYPTNSDFELKTSELPPLKNGEVLLEALFLTVDPYMRVVESKNVALPKGTIVLASPGWTTHSISDGKDLEKLLTEWPDTIPLSLALGTVGMPGLTAYFGLLEICGVKGGETVMVNAAAGAVGSVVGQIAKLKGCKVVGAVGSDEKVAYLQKLGFDVVFNYKTVESLEETLKKASPDGYDCYFDNVGGEFSNTVIGQMKKFGRIAICGAISTYNRTGPLPPGPPPEIVIYQELRMEAFVVYRWQGDARQKALKDLLKWVLE

SEQ ID NO: 907593 - protein, 170 aa, Homo sapiens
MPGLTAYFGLLEICGVKGGETVMVNAAAGAVGSVVGQIAKLKGCKVVGAVGSDEKVAYLQKLGFDVVFNYKTVESLEETLKKASPDGYDCYFDNVGGEFSNTVIGQMKKFGRIAICGAISTYNRTGPLPPGPPPEIVIYQELRMEAFVVYRWQGDARQKALKDLLKWVLE

SEQ ID NO: 907594 - protein, 68 aa, Homo sapiens
ILTVCPIRSIPLLNIVKIYFSPPPEIVIYQELRMEAFVVYRWQGDARQKALKDLLKWVLEQLPYFVID

SEQ ID NO: 907595 - protein, 329 aa, Homo sapiens; identical to SEQ ID NO: 907590

SEQ ID NO: 907596 - protein, 170 aa, Homo sapiens; identical to SEQ ID NO: 907593

SEQ ID NO: 907597 - protein, 148 aa, Homo sapiens
MVNAAAGAVGSVVGQIAKLKGCKVVGAVGSDEKVAYLQKLGFDVVFNYKTVESLEETLKKASPDGYDCYFDNVGGEFSNTVIGQMKKFGRIAICGAISTYNRTGPLPPGPPPEIVIYQELRMEAFVVYRWQGDARQKALKDLLKWVLE

SEQ ID NO: 907598 - protein, 493 aa, Homo sapiens
MNRTKGDEEEYWNSSKFKAFTFDDEDDELSQLKESKRAVNSLRDFVDDDDDDDLERVSWSGEPVGSISWSIRETAGNSGSTHEGREQLKSRNSFSSYAQLPKPTSTYSLSSFFRGRTRPGSFQSLSDALSDTPAKSYAPELGRPKGEYRDYSNDWSPSDTVRRLRKGKVCSLERFRSLQDKLQLLEEAVSMHDGNVITAVLIFLKRTLSKEILFRELEVRQVALRHLIHFLKEIGDQKLLLDLFRFLDRTEELALSHYREHLNIQDPDKRKEFLKTCVGLPFSAEDSAHIQDHYTLLERQIIIEANDRHLESAGQTEIFRKHPRKASILNMPLVTTLFYSCFYHYTEAEGTFSSPVNLKKTFKIPDKQYVLTALAARAKLRAWNDVDALFTTKNWLGYTKKRAPIGFHRVVEILHKNNAPVQILQEYVNLVEDVDTKLNLATKFKCHDVVIDTYRDLKDRQQLLAYRSKVDKGSAEEEKIDALLSSSQIRWKN

SEQ ID NO: 907599 - protein, 493 aa, Homo sapiens; identical to SEQ ID NO: 907598

SEQ ID NO: 907600 - protein, 493 aa, Homo sapiens; identical to SEQ ID NO: 907598

SEQ ID NO: 907601 - protein, 493 aa, Homo sapiens; identical to SEQ ID NO: 907598

SEQ ID NO: 907602 - protein, 273 aa, Homo sapiens [sequence omitted]

SEQ ID NO: 907603 - protein, 133 aa, Homo sapiens
NVTQDTATHMTAKTMTAHPSSLPPKWLRRTAFVVDEVSNIVKEAIESAIGGNAYQHSKVNQWTTNVVEQTLSQLTKLGKPFKYIVTCVIMQKNGAGLHTASSCFWDSSTDGSCTVRWENKTMYCIVSAFGLSI

SEQ ID NO: 907604 - protein, 129 aa, Homo sapiens
RSPRHSGSRRRRAGGKMEDYQAAEETAFVVDEVSNIVKEAIESAIGGNAYQHSKVNQWTTNVVEQTLSQLTKLGKPFKYIVTCVIMQKNGAGLHTASSCFWDSSTDGSCTVRWENKTMYCIVSAFGLSI

SEQ ID NO: 907605 - protein, 108 aa, Homo sapiens
RSPRHSGSRRRRAGGKMEDYQAAEETAFVVDEVSNIVKEAIESAIGGNAYQHSKVNQWTTNVVEQTLSQLTKLGKPFKYIGNGVLFLLYLRDGFLTLIRGASSTRNNS

SEQ ID NO: 907606 - protein, 129 aa, Homo sapiens; identical to SEQ ID NO: 907604

SEQ ID NO: 907607 - protein, 129 aa, Homo sapiens; identical to SEQ ID NO: 907604

SEQ ID NO: 907608 - protein, 108 aa, Homo sapiens; identical to SEQ ID NO: 907605

SEQ ID NO: 907609 - protein, 129 aa, Homo sapiens; identical to SEQ ID NO: 907604

SEQ ID NO: 907610 - protein, 115 aa, Homo sapiens
RSPRHSGSRRRRAGGKMEDYQAAEEAIESAIGGNAYQHSKVNQWTTNVVEQTLSQLTKLGKPFKYIVTCVIMQKNGAGLHTASSCFWDSSTDGSCTVRWENKTMYCIVSAFGLSI

SEQ ID NO: 907611 - protein, 111 aa, Homo sapiens
RSPRHSGSRRRRAGGKMEDYQAAEETAFVVDEVSNIVKEAIESAIGGNAYQHSKVNQWTTNVVEQTLSQLTKLGLHTASSCFWDSSTDGSCTVRWENKTMYCIVSAFGLSI

SEQ ID NO: 907612 - protein, 156 aa, Homo sapiens
NVTQDTATHMTAKTMTAHPSSLPPKWLRRTAFVVDEVSNIVKEAIESAIGGNAYQHSKVNQWTTNVVEQTLSQLTKLGKPFKYIVTCVIMQKNGAGLHTASSCFWDSSTDGMIFIHVCEVLLCEIYDWKFPIFECNACLSPFKTFNNRLAKVLCVA

SEQ ID NO: 907613 - protein, 129 aa, Homo sapiens; identical to SEQ ID NO: 907604

SEQ ID NO: 907614 - protein, 132 aa, Homo sapiens
SACITREGARGAGSCRTCGEPSRRRSTRALSRDPRDHVTPGRGAAHVTSAAGRGVFFVPASQWPGLLRLVTPLAGTFLNIKMGVIFIFFCKVIFGLLLTFGVILFCAVYNVRSVRSPDVLPWLGDCTRDQLT

SEQ ID NO: 907615 - protein, 417 aa, Homo sapiens
MAAPGSARRPLLLLLLLLLLGLMHCASAAMFMVKNGNGTACIMANFSAAFSVNYDTKSGPKNMTFDLPSDATVVLNRSSCGKENTSDPSLVIAFGRGHTLTLNFTRNATRYSVQLMSFVYNLSDTHLFPNASSKEIKTVESITDIRADIDKKYRCVSGTQVHMNNVTVTLHDATIQAYLSNSSFSRGETRCEQDRPSPTTAPPAPPSPSPSPVPKSPSVDKYNVSGTNGTCLLASMGLQLNLTYERKDNTTVTRLLNINPNKTSASGSCGAHLVTLELHSEGTTVLLFQFGMNASSSRFFLQGIQLNTILPDARDPAFKAANGSLRALQATVGNSYKCNAEEHVRVTKAFSVNIFKVWVQAFKVEGGQFGSVEECLLDENSMLIPIAVGGALAGLVLIVLIAYLVGRKRSHAGYQTI

SEQ ID NO: 907616 - protein, 393 aa, Homo sapiens
AGAAGGPPWREAAGYACIMANFSAAFSVNYDTKSGPKNMTFDLPSDATVVLNRSSCGKENTSDPSLVIAFGRGHTLTLNFTRNATRYSVQLMSFVYNLSDTHLFPNASSKEIKTVESITDIRADIDKKYRCVSGTQVHMNNVTVTLHDATIQAYLSNSSFSRGETRCEQDRPSPTTAPPAPPSPSPSPVPKSPSVDKYNVSGTNGTCLLASMGLQLNLTYERKDNTTVTRLLNINPNKTSASGSCGAHLVTLELHSEGTTVLLFQFGMNASSSRFFLQGIQLNTILPDARDPAFKAANGSLRALQATVGNSYKCNAEEHVRVTKAFSVNIFKVWVQAFKVEGGQFGSVEECLLDENSMLIPIAVGGALAGLVLIVLIAYLVGRKRSHAGYQTI

SEQ ID NO: 907617 - protein, 252 aa, Homo sapiens
DHNYSRVVRIFPTGVDEGEGETRGEDERPCPIRMKAPPAPPSPSPSPVPKSPSVDKYNVSGTNGTCLLASMGLQLNLTYERKDNTTVTRLLNINPNKTSASGSCGAHLVTLELHSEGTTVLLFQFGMNASSSRFFLQGIQLNTILPDARDPAFKAANGSLRALQATVGNSYKCNAEEHVRVTKAFSVNIFKVWVQAFKVEGGQFGSVEECLLDENSMLIPIAVGGALAGLVLIVLIAYLVGRKRSHAGYQTI

SEQ ID NO: 907618 - protein, 417 aa, Homo sapiens; identical to SEQ ID NO: 907615

SEQ ID NO: 907619 - protein, 186 aa, Homo sapiens
MACITLSNSLNDEPTVEAGVTVDAHLMVISGCMHQRMGHLARIPCVLSMILAIVDCHMFLSTFCSYEGMSRLKYLILFHEAQDDPAFKAANGSLRALQATVGNSYKCNAEEHVRVTKAFSVNIFKVWVQAFKVEGGQFGSVEECLLDENSMLIPIAVGGALAGLVLIVLIAYLVGRKRSHAGYQTI

SEQ ID NO: 907620 - protein, 83 aa, Homo sapiens
TCFRLRLWTFSRFRVGWGDAPVPLQGAVSSCRSEILEVEECLLDENSMLIPIAVGGALAGLVLIVLIAYLVGRKRSHAGYQTI

SEQ ID NO: 907621 - protein, 417 aa, Homo sapiens; identical to SEQ ID NO: 907615

SEQ ID NO: 907622 - protein, 417 aa, Homo sapiens; identical to SEQ ID NO: 907615

SEQ ID NO: 907623 - protein, 417 aa, Homo sapiens; identical to SEQ ID NO: 907615

SEQ ID NO: 907624 - protein, 417 aa, Homo sapiens; identical to SEQ ID NO: 907615

SEQ ID NO: 907625 - protein, 417 aa, Homo sapiens; identical to SEQ ID NO: 907615

SEQ ID NO: 907626 - protein, 417 aa, Homo sapiens; identical to SEQ ID NO: 907615

SEQ ID NO: 907627 - protein, 417 aa, Homo sapiens; identical to SEQ ID NO: 907615

SEQ ID NO: 907628 - protein, 393 aa, Homo sapiens
MAAPGSARRPLLLLLLLLLLGLMHCASAAMFMVKNGNGTACIMANFSAAFSVNYDTKSGPKNMTFDLPSDATVVLNRSSCGKENTSDPSLVIAFGRGHTLTLNFTRNATRYSVQLMSFVYNLSDTHLFPNASSKEIKTVESITDIRADIDKKYRCVSGTQVHMNNVTVTLHDATIQAYLSNSSFSRGETRCEQDRPSPTTAPPAPPSPSPSPVPKSPSVDKYNVSGTNGTCLLASMGLQLNLTYERKDNTTVTRLLNINPNKTSASGSCGAHLVTLELHSEGTTVLLFQFGMNASSSRFFLQGIQLNTILPDARDPAFKAANGSLRALQATVGNSYKCNAEEHVRVTKAFSVNIFKVWVQAFKVEGGQFGSVEECLLTRQIQIPCRRDPQSHL

SEQ ID NO: 907629 - protein, 168 aa, Homo sapiens
SACITREGARGAGSCRTCGEPSRRRSTRALSRDPRDHVTPGRGAAHVTSAAGRGVFFVPASQWPGLLRLVTPLSLTPALGARAPPPQRPAVRGPTAARAPALRTVPGRLAPWRPPAAPGDPCCCYCCCCCSVSCIVRQQQCVMAMNYDTKSGPKNMNFDLSLDATGCS

SEQ ID NO: 907630 - protein, 133 aa, Homo sapiens
PGGAAVLVVLLLLLLLLGLMHCASAAMFMVKNGNGTACIMANFSAAFSVNYDTKSGPKNMTFDLPSDATVVLNRSSCGKENTSDPSLVIAFGRGHTLTLNFTRNATRYSTSTNSLSTSTNSLSTSTIAPARIP

SEQ ID NO: 907631 - protein, 414 aa, Homo sapiens
PGGAAVLVVLLLLLLLLGLMHCASAAMFMVKNGNGTACIMANFSAAFSVNYDTKSGPKNMTFDLPSDATVVLNRSSCGKENTSDPSLVIAFGRGHTLTLNFTRNATRYSVQLMSFVYNLSDTHLFPNASSKEIKTVESITDIRADIDKKYRCVSGTQVHMNNVTVTLHDATIQAYLSNSSFSRGETRCEQDRPSPTTAPPAPPSPSPSPVPKSPSVDKYNVSGTNGTCLLASMGLQLNLTYERKDNTTVTRLLNINPNKTSASGSCGAHLVTLELHSEGTTVLLFQFGMNASSSRFFLQGIQLNTILPDARDPAFKAANGSLRALQATVGNSYKCNAEEHVRVTKAFSVNIFKVWVQAFKVEGGQFGSVEECLLDENSMLIPIAVGGALAGLVLIVLIAYLVGRKRSHAGYQTI

SEQ ID NO: 907632 - protein, 222 aa, Homo sapiens
MQLDAEVIKDPLAKTSPVPKSPSVDKYNVSGTNGTCLLASMGLQLNLTYERKDNTTVTRLLNINPNKTSASGSCGAHLVTLELHSEGTTVLLFQFGMNASSSRFFLQGIQLNTILPDARDPAFKAANGSLRALQATVGNSYKCNAEEHVRVTKAFSVNIFKVWVQAFKVEGGQFGSVEECLLDENSMLIPIAVGGALAGLVLIVLIAYLVGRKRSHAGYQTI

SEQ ID NO: 907633 - protein, 244 aa, Homo sapiens
MAAPGSARRPLLLLLLLLLLGLMHCASAAMFMVKNGNGTACIMANFSAAFSVNYDTKSGPKNMTFDLPSDATVVLNRSSCGKENTSDPSLVIAFGRGHTLTLNFTRNATRYSVQLMSFVYNLSDTHLFPNASSKEIKTVESITDIRADIDKKYRCVSGTQVHMNNVTVTLHDATIQAYLSNSSFSRGETRCEQDRPSPTTAPPAPPSPSPSPVPKSPSVDKYNVSGTNGTCLLASMGLQLNLWA

SEQ ID NO: 907634 - protein, 417 aa, Homo sapiens; identical to SEQ ID NO: 907615

SEQ ID NO: 907635 - protein, 417 aa, Homo sapiens; identical to SEQ ID NO: 907615

SEQ ID NO: 907636 - protein, 417 aa, Homo sapiens; identical to SEQ ID NO: 907615

SEQ ID NO: 907637 - protein, 417 aa, Homo sapiens; identical to SEQ ID NO: 907615

SEQ ID NO: 907638 - protein, 417 aa, Homo sapiens; identical to SEQ ID NO: 907615

SEQ ID NO: 907639 - protein, 417 aa, Homo sapiens; identical to SEQ ID NO: 907615

SEQ ID NO: 907640 - protein, 257 aa, Homo sapiens
MAAPGSARRPLLLLLLLLLLGLMHCASAAMFMVKNGNGTACIMANFSAAFSVNYDTKSGPKNMTFDLPSDATVVLNRSSCGKENTSDPSLVIAFGRGHTLTLNFTRNATRYSVQLMSFVYNLSDTHLFPNASSKEIKTVESITDIRADIDKKYRCVSGTQVHMNNVTVTLHDATIQAYLSNSSFSRGETRCEQDRPSPTTAPPAPPSPSPSPVPKSPSVDKYNVSGTNGTCLLASMGLQLNLTYERKDNTVGLGPHL

SEQ ID NO: 907641 - protein, 74 aa, Homo sapiens
MWGSGGERGLFAGPCVSRALTPSVCLGSGGVSAGREQHADPHRCGWCPGGAGPHRPHRLPRRQEEESRRLPDYL

SEQ ID NO: 907642 - protein, 431 aa, Homo sapiens
MYRTKVGLKDRQQLYKLIISQLLYDGYISIANGLINEIKPQSVCAPSEQLLHLIKLGMENDDTAVQYAIGRSDTVAPGTGIDLEFDADVQTMSPEASEYETCYVTSHKGPCRVATYSRDGQLIATGSADASIKILDTERMLAKSAMPIEVMMNETAQQNMENHPVIRTLYDHVDEVTCLAFHPTEQILASGSRDYTLKLFDYSKPSAKRAFKYIQEAEMLRSISFHPSGDFILVGTQHPTLRLYDINTFQCFVSCNPQDQHTDAICSVNYNSSANMYVTGSKDGCIKLWDGVSNRCITTFEKAHDGAEVCSAIFSKNSKYILSSGKDSVAKLWEISTGRTLVRYTGAGLSGRQVHRTQAVFNHTEDYVLLPDERTISLCCWDSRTAERRNLLSLGHNNIVRCIVHSPTNPGFMTCSDDFRARFWYRRSTTD

SEQ ID NO: 907643 - protein, 431 aa, Homo sapiens; identical to SEQ ID NO: 907642

SEQ ID NO: 907644 - protein, 431 aa, Homo sapiens; identical to SEQ ID NO: 907642

SEQ ID NO: 907645 - protein, 431 aa, Homo sapiens; identical to SEQ ID NO: 907642

SEQ ID NO: 907646 - protein, 431 aa, Homo sapiens; identical to SEQ ID NO: 907642

SEQ ID NO: 907647 - protein, 431 aa, Homo sapiens; identical to SEQ ID NO: 907642

SEQ ID NO: 907648 - protein, 431 aa, Homo sapiens; identical to SEQ ID NO: 907642

SEQ ID NO: 907649 - protein, 431 aa, Homo sapiens; identical to SEQ ID NO: 907642

SEQ ID NO: 907650 - protein, 292 aa, Homo sapiens [sequence omitted]

SEQ ID NO: 907651 - protein, 302 aa, Homo sapiens
MGTRVNLVNPVSGSEAGWREVMMNETAQQNMENHPVIRTLYDHVDEVTCLAFHPTEQILASGSRDYTLKLFDYSKPSAKRAFKYIQEAEMLRSISFHPSGDFILVGTQHPTLRLYDINTFQCFVSCNPQDQHTDAICSVNYNSSANMYVTGSKDGCIKLWDGVSNRCITTFEKAHDGAEVCSAIFSKNSKYILSSGKDSVAKLWEISTGRTLVRYTGAGLSGRQVHRTQAVFNHTEDYVLLPDERTISLCCWDSRTAERRNLLSLGHNNIVRCIVHSPTNPGFMTCSDDFRARFWYRRSTTD

SEQ ID NO: 907652 - protein, 261 aa, Homo sapiens
MRPHNKIWLAFHPTEQILASGSRDYTLKLFDYSKPSAKRAFKYIQEAEMLRSISFHPSGDFILVGTQHPTLRLYDINTFQCFVSCNPQDQHTDAICSVNYNSSANMYVTGSKDGCIKLWDGVSNRCITTFEKAHDGAEVCSAIFSKNSKYILSSGKDSVAKLWEISTGRTLVRYTGAGLSGRQVHRTQAVFNHTEDYVLLPDERTISLCCWDSRTAERRNLLSLGHNNIVRCIVHSPTNPGFMTCSDDFRARFWYRRSTTD

SEQ ID NO: 907653 - protein, 431 aa, Homo sapiens; identical to SEQ ID NO: 907642

SEQ ID NO: 907654 - protein, 421 aa, Homo sapiens
MYRTKVGLKDRQQLYKLIISQLLYDGYISIANGLINEIKPQSVCAPSEQLLHLIKLGMENDDTAVQYAIGRSDTVAPGTGIDLEFDADVQTMSPEASEYETCYVTSHKGPCRVATYSRDGQLIATGSADASIKILDTERMLAKSAMPIEVMMNETAQQNMENHPVIRTLYDHVDEVTCLAFHPTEQILASGSRDYTLKLFDYSKPSAKRAFKYIQHPSGDFILVGTQHPTLRLYDINTFQCFVSCNPQDQHTDAICSVNYNSSANMYVTGSKDGCIKLWDGVSNRCITTFEKAHDGAEVCSAIFSKNSKYILSSGKDSVAKLWEISTGRTLVRYTGAGLSGRQVHRTQAVFNHTEDYVLLPDERTISLCCWDSRTAERRNLLSLGHNNIVRCIVHSPTNPGFMTCSDDFRARFWYRRSTTD

SEQ ID NO: 907655 - protein, 431 aa, Homo sapiens; identical to SEQ ID NO: 907642

SEQ ID NO: 907656 - protein, 431 aa, Homo sapiens; identical to SEQ ID NO: 907642

SEQ ID NO: 907657 - protein, 179 aa, Homo sapiens
MYRTKVGLKDRQQLYKLIISQLLYDGYISIANGLINEIKPQSVCAPSEQLLHLIKLGMENDDTAVQYAIGRSDTVAPGTGIDLEFDADVQTMSPEASEYETCYVTSHKGPCRVATYSRDGQLIATGSADASIKILDTERMLAKSAMPIEVMMNETAQQNMACFPPNRTDPGFWFKGLYS

SEQ ID NO: 907658 - protein, 444 aa, Homo sapiens
MYRTKVGLKDRQQLYKLIISQLLYDGYISIANGLINEIKPQSVCAPSEQLLHLIKLGEIVNTNPYVPWQGMENDDTAVQYAIGRSDTVAPGTGIDLEFDADVQTMSPEASEYETCYVTSHKGPCRVATYSRDGQLIATGSADASIKILDTERMLAKSAMPIEVMMNETAQQNMENHPVIRTLYDHVDEVTCLAFHPTEQILASGSRDYTLKLFDYSKPSAKRAFKYIQEAEMLRSISFHPSGDFILVGTQHPTLRLYDINTFQCFVSCNPQDQHTDAICSVNYNSSANMYVTGSKDGCIKLWDGVSNRCITTFEKAHDGAEVCSAIFSKNSKYILSSGKDSVAKLWEISTGRTLVRYTGAGLSGRQVHRTQAVFNHTEDYVLLPDERTISLCCWDSRTAERRNLLSLGHNNIVRCIVHSPTNPGFMTCSDDFRARFWYRRSTTD

SEQ ID NO: 907659 - protein, 388 aa, Homo sapiens
MTATSASPMASSMKSSLSLCVHPRSSSCISSNSPGTGIDLEFDADVQTMSPEASEYETCYVTSHKGPCRVATYSRDGQLIATGSADASIKILDTERMLAKSAMPIEVMMNETAQQNMENHPVIRTLYDHVDEVTCLAFHPTEQILASGSRDYTLKLFDYSKPSAKRAFKYIQEAEMLRSISFHPSGDFILVGTQHPTLRLYDINTFQCFVSCNPQDQHTDAICSVNYNSSANMYVTGSKDGCIKLWDGVSNRCITTFEKAHDGAEVCSAIFSKNSKYILSSGKDSVAKLWEISTGRTLVRYTGAGLSGRQVHRTQAVFNHTEDYVLLPDERTISLCCWDSRTAERRNLLSLGHNNIVRCIVHSPTNPGFMTCSDDFRARFWYRRSTTD

SEQ ID NO: 907660 - protein, 66 aa, Homo sapiens
RARYRLIVYWRGALGGLGRLFVRPFGGSLGHNNIVRCIVHSPTNPGFMTCSDDFRARFWYRRSTTD

SEQ ID NO: 907661 - protein, 1274 aa, Homo sapiens
MGHLTLEDYQIWSVKNVLANEFLNLLFQVCHIVLGLRPATPEEEGQIIRGWLERESRYGLQAGHNWFIISMQWWQQWKEYVKYDANPVVIEPSSVLNGGKYSFGTAAHPMEQVEDRIGSSLSYVNTTEEKFSDNISTASEASETAGSGFLYSATPGADVCFARQHNTSDNNNQCLLGANGNILLHLNPQKPGAIDNQPLVTQEPVKATSLTLEGGRLKRTPQLIHGRDYEMVPEPVWRALYHWYGANLALPRPVIKNSKTDIPELELFPRYLLFLRQQPATRTQQSNIWVNMGNVPSPNAPLKRVLAYTGCFSRMQTIKEIHEYLSQRLRIKEEDMRLWLYNSENYLTLLDDEDHKLEYLKIQDEQHLVIEVRNKDMSWPEEMSFIANSSKIDRHKVPTEKGATGLSNLGNTCFMNSSIQCVSNTQPLTQYFISGRHLYELNRTNPIGMKGHMAKCYGDLVQELWSGTQKNVAPLKLRWTIAKYAPRFNGFQQQDSQELLAFLLDGLHEDLNRVHEKPYVELKDSDGRPDWEVAAEAWDNHLRRNRSIVVDLFHGQLRSQVKCKTCGHISVRFDPFNFLSLPLPMDSYMHLEITVIKLDGTTPVRYGLRLNMDEKYTGLKKQLSDLCGLNSEQILLAEVHGSNIKNFPQDNQKVRLSVSGFLCAFEIPVPVSPISASSPTQTDFSSSPSTNEMFTLTTNGDLPRPIFIPNGMPNTVVPCGTEKNFTNGMVNGHMPSLPDSPFTGYIIAVHRKMMRTELYFLSSQKNRPSLFGMPLIVPCTVHTRKKDLYDAVWIQVSRLASPLPPQEASNHAQDCDDSMGYQYPFTLRVVQKDGNSCAWCPWYRFCRGCKIDCGEDRAFIGNAYIAVDWDPTALHLRYQTSQERVVDEHESVEQSRRAQAEPINLDSCLRAFTSEEELGENEMYYCSKCKTHCLATKKLDLWRLPPILIIHLKRFQFVNGRWIKSQKIVKFPRESFDPSAFLVPRDPALCQHKPLTPQGDELSEPRILAREVKKVDAQSSAGEEDVLLSKSPSSLSANIISSPKGSPSSSRKSGTSCPSSKNSSPNSSPRTLGRSKGRLRLPQIGSKNKLSSSKENLDASKENGAGQICELADALSRGHVLGGSQPELVTPQDHEVALANGFLYEHEACGNGYSNGQLGNHSEEDSTDDQREDTRIKPIYNLYAISCHSGILGGGHYVTYAKNPNCKWYCYNDSSCKELHPDEIDTDSAYILFYEQQGIDYAQFLPKTDGKKMADTSSMDEDFESDYKKYCVLQ

SEQ ID NO: 907662 - protein, 1308 aa, Homo sapiens
MGAKESRIGFLSYEEALRRVTDVELKRLKDAFKRTCGLSYYMGQHCFIREVLGDGVPPKVAEVCHIVLGLRPATPEEEGQIIRGWLERESRYGLQAGHNWFIISMQWWQQWKEYVKYDANPVVIEPSSVLNGGKYSFGTAAHPMEQVEDRIGSSLSYVNTTEEKFSDNISTASEASETAGSGFLYSATPGADVCFARQHNTSDNNNQCLLGANGNILLHLNPQKPGAIDNQPLVTQEPVKATSLTLEGGRLKRTPQLIHGRDYEMVPEPVWRALYHWYGANLALPRPVIKNSKTDIPELELFPRYLLFLRQQPATRTQQSNIWVNMGNVPSPNAPLKRVLAYTGCFSRMQTIKEIHEYLSQRLRIKEEDMRLWLYNSENYLTLLDDEDHKLEYLKIQDEQHLVIEVRNKDMSWPEEMSFIANSSKIDRHKVPTEKGATGLSNLGNTCFMNSSIQCVSNTQPLTQYFISGRHLYELNRTNPIGMKGHMAKCYGDLVQELWSGTQKNVAPLKLRWTIAKYAPRFNGFQQQDSQELLAFLLDGLHEDLNRVHEKPYVELKDSDGRPDWEVAAEAWDNHLRRNRSIVVDLFHGQLRSQVKCKTCGHISVRFDPFNFLSLPLPMDSYMHLEITVIKLDGTTPVRYGLRLNMDEKYTGLKKQLSDLCGLNSEQILLAEVHGSNIKNFPQDNQKVRLSVSGFLCAFEIPVPVSPISASSPTQTDFSSSPSTNEMFTLTTNGDLPRPIFIPNGMPNTVVPCGTEKNFTNGMVNGHMPSLPDSPFTGYIIAVHRKMMRTELYFLSSQKNRPSLFGMPLIVPCTVHTRKKDLYDAVWIQVSRLASPLPPQEASNHAQDCDDSMGYQYPFTLRVVQKDGNSCAWCPWYRFCRGCKIDCGEDRAFIGNAYIAVDWDPTALHLRYQTSQERVVDEHESVEQSRRAQAEPINLDSCLRAFTSEEELGENEMYYCSKCKTHCLATKKLDLWRLPPILIIHLKRFQFVNGRWIKSQKIVKFPRESFDPSAFLVPRDPALCQHKPLTPQGDELSEPRILAREVKKVDAQSSAGEEDVLLSKSPSSLSANIISSPKGSPSSSRKSGTSCPSSKNSSPNSSPRTLGRSKGRLRLPQIGSKNKLSSSKENLDASKENGAGQICELADALSRGHVLGGSQPELVTPQDHEVALANGFLYEHEACGNGYSNGQLGNHSEEDSTDDQREDTRIKPIYNLYAISCHSGILGGGHYVTYAKNPNCKWYCYNDSSCKELHPDEIDTDSAYILFYEQQGIDYAQFLPKTDGKKMADTSSMDEDFESDYKKYCVLQ

SEQ ID NO: 907663 - protein, 1252 aa, Homo sapiens
MGAKESRIGFLSYEEALRRVTDVELKRLKDAFKRTCGLSYYMGQHCFIREVLGDGVPPKVAEVCHIVLGLRPATPEEEGQIIRGWLERESRYGLQAGHNWFIISMQWWQQWKEYVKYDANPVVIEPSSVLNGGKYSFGTAAHPMEQVEDRIGSSLSYVNTTEEKFSDNISTASEASETAGSGFLYSATPGADVCFARQHNTSDNNNQCLLGANGNILLHLNPQKPGAIDNQPLVTQEPVKATSLTLEGGRLKRTPQLIHGRDYEMVPEPVWRALYHWYGANLALPRPVIKNSKTDIPELELFPRYLLFLRQQPATRTQQSNIWVNMGNVPSPNAPLKRVLAYTGCFSRMQTIKEIHEYLSQRLRIKEEDMRLWLYNSENYLTLLDDEDHKLEYLKIQDEQHLVIEVRNKDMSWPEEMSFIANSSKIDRHKVPTEKGATGLSNLGNTCFMNSSIQCVSNTQPLTQYFISGRHLYELNRTNPIGMKGHMAKCYGDLVQELWSGTQKNVAPLKLRWTIAKYAPRFNGFQQQDSQELLAFLLDGLHEDLNRVHEKPYVELKDSDGRPDWEVAAEAWDNHLRRNRSIVVDLFHGQLRSQVKCKTCGHISVRFDPFNFLSLPLPMDSYMHLEITVIKLDGTTPVRYGLRLNMDEKYTGLKKQLSDLCGLNSEQILLAEVHGSNIKNFPQDNQKVRLSVSGFLCAFEIPVPVSPISASSPTQTDFSSSPSTNEMFTLTTNGDLPRPIFIPNGMPNTVVPCGTEKNFTNGMVNGHMPSLPDSPFTGYIIAVHRKMMRTELYFLSSQKNRPSLFGMPLIVPCTVHTRKKDLYDAVWIQVSRLASPLPPQEASNHAQDCDDSMGYQYPFTLRVVQKDGNSCAWCPWYRFCRGCKIDCGEDRAFIGNAYIAVDWDPTALHLRYQTSQERVVDEHESVEQSRRAQAEPINLDSCLRAFTSEEELGENEMYYCSKCKTHCLATKKLDLWRLPPILIIHLKRFQFVNGRWIKSQKIVKFPRESFDPSAFLVPRDPALCQHKPLTPQGDELSEPRILAREVKKVDAQSSAGEEDVLLSKSPSSLSANIISSPKGSPSSSRKSGTSCPSSKNSSPNSSPRTLGRSKGRLRLPQIGSKNKLSSSKENLDASKENGAGQICELADALSRGHVLGGSQPELVTPQDHEVALANGFLYEHEACGNGYSNGQLGNHSEEDSTDDQREDTRIKPIYNLYAISSHWHSGASRSVPGCSCPMTTGPSLYSVSQGMM

SEQ ID NO: 907664 - protein, 960 aa, Homo sapiens
MQTIKEIHEYLSQRLRIKEEDMRLWLYNSENYLTLLDDEDHKLEYLKIQDEQHLVIEVRNKDMSWPEEMSFIANSSKIDRHKVPTEKGATGLSNLGNTCFMNSSIQCVSNTQPLTQYFISGRHLYELNRTNPIGMKGHMAKCYGDLVQELWSGTQKNVAPLKLRWTIAKYAPRFNGFQQQDSQELLAFLLDGLHEDLNRVHEKPYVELKDSDGRPDWEVAAEAWDNHLRRNRSIVVDLFHGQLRSQVKCKTCGHISVRFDPFNFLSLPLPMDSYMHLEITVIKLDGTTPVRYGLRLNMDEKYTGLKKQLSDLCGLNSEQILLAEVHGSNIKNFPQDNQKVRLSVSGFLCAFEIPVPVSPISASSPTQTDFSSSPSTNEMFTLTTNGDLPRPIFIPNGMPNTVVPCGTEKNFTNGMVNGHMPSLPDSPFTGYIIAVHRKMMRTELYFLSSQKNRPSLFGMPLIVPCTVHTRKKDLYDAVWIQVSRLASPLPPQEASNHAQDCDDSMGYQYPFTLRVVQKDGNSCAWCPWYRFCRGCKIDCGEDRAFIGNAYIAVDWDPTALHLRYQTSQERVVDEHESVEQSRRAQAEPINLDSCLRAFTSEEELGENEMYYCSKCKTHCLATKKLDLWRLPPILIIHLKRFQFVNGRWIKSQKIVKFPRESFDPSAFLVPRDPALCQHKPLTPQGDELSEPRILAREVKKVDAQSSAGEEDVLLSKSPSSLSANIISSPKGSPSSSRKSGTSCPSSKNSSPNSSPRTLGRSKGRLRLPQIGSKNKLSSSKENLDASKENGAGQICELADALSRGHVLGGSQPELVTPQDHEVALANGFLYEHEACGNGYSNGQLGNHSEEDSTDDQREDTRIKPIYNLYAISCHSGILGGGHYVTYAKNPNCKWYCYNDSSCKELHPDEIDTDSAYILFYEQQGIDYAQFLPKTDGKKMADTSSMDEDFESDYKKYCVLQ

SEQ ID NO: 907665 - protein, 1046 aa, Homo sapiens
MGAKESRIGFLSYEEALRRVTDVELKRLKDAFKRTCGLSYYMGQHCFIREVLGDGVPPKVAEVCHIVLGLRPATPEEEGQIIRGWLERESRYGLQAGHNWFIISMQWWQQWKEYVKYDANPVVIEPSSVLNGGKYSFGTAAHPMEQVEDRIGSSLSYVNTTEEKFSDNISTASEASETAGSGFLYSATPGADVCFARQHNTSDNNNQCLLGANGNILLHLNPQKPGAIDNQPLVTQEPVKATSLTLEGGRLKRTPQLIHGRDYEMVPEPVWRALYHWYGANLALPRPVIKNSKTDIPELELFPRYLLFLRQQPATRTQQSNIWVNMGNVPSPNAPLKRVLAYTGCFSRMQTIKEIHEYLSQRLRIKEEDMRLWLYNSENYLTLLDDEDHKLEYLKIQDEQHLVIEVRNKDMSWPEEMSFIANSSKIDRHKVPTEKGATGLSNLGNTCFMNSSIQCVSNTQPLTQYFISGRHLYELNRTNPIGMKGHMAKCYGDLVQELWSGTQKNVAPLKLRWTIAKYAPRFNGFQQQDSQELLAFLLDGLHEDLNRVHEKPYVELKDSDGRPDWEVAAEAWDNHLRRNRSIVVDLFHGQLRSQVKCKTCGHISVRFDPFNFLSLPLPMDSYMHLEITVIKLDGTTPVRYGLRLNMDEKYTGLKKQLSDLCGLNSEQILLAEVHGSNIKNFPQDNQKVRLSVSGFLCAFEIPVPVSPISASSPTQTDFSSSPSTNEMFTLTTNGDLPRPIFIPNGMPNTVVPCGTEKNFTNGMVNGHMPSLPDSPFTGYIIAVHRKMMRTELYFLSSQKNRPSLFGMPLIVPCTVHTRKKDLYDAVWIQVSRLASPLPPQEASNHAQDCDDSMGYQYPFTLRVVQKDGNSCAWCPWYRFCRGCKIDCGEDRAFIGNAYIAVDWDPTALHLRYQTSQERVVDEHESVEQSRRAQAEPINLDSCLRAFTSEEELGENEMYYCSKCKTHCLATKKLDLWRLPPILIIHLKRFQFVNGRWIKSQKIVKFPRESFDPSAFLVPRDPALCASTFFTSLARILGSESSSPWGV

SEQ ID NO: 907666 - protein, 907 aa, Homo sapiens
MGAKESRIGFLSYEEALRRVTDVELKRLKDAFKRTCGLSYYMGQHCFIREVLGDGVPPKVAEVCHIVLGLRPATPEEEGQIIRGWLERESRYGLQAGHNWFIISMQWWQQWKEYVKYDANPVVIEPSSVLNGGKYSFGTAAHPMEQVEDRIGSSLSYVNTTEEKFSDNISTASEASETAGSGFLYSATPGADVCFARQHNTSDNNNQCLLGANGNILLHLNPQKPGAIDNQPLVTQEPVKATSLTLEGGRLKRTPQLIHGRDYEMVPEPVWRALYHWYGANLALPRPVIKNSKTDIPELELFPRYLLFLRQQPATRTQQSNIWVNMGNVPSPNAPLKRVLAYTGCFSRMQTIKEIHEYLSQRLRIKEEDMRLWLYNSENYLTLLDDEDHKLEYLKIQDEQHLVIEVRNKDMSWPEEMSFIANSSKIDRHKVPTEKGATGLSNLGNTCFMNSSIQCVSNTQPLTQYFISGRHLYELNRTNPIGMKGHMAKCYGDLVQELWSGTQKNVAPLKLRWTIAKYAPRFNGFQQQDSQELLAFLLDGLHEDLNRVHEKPYVELKDSDGRPDWEVAAEAWDNHLRRNRSIVVDLFHGQLRSQVKCKTCGHISVRFDPFNFLSLPLPMDSYMHLEITVIKLDGTTPVRYGLRLNMDEKYTGLKKQLSDLCGLNSEQILLAEVHGSNIKNFPQDNQKVRLSVSGFLCAFEIPVPVSPISASSPTQTDFSSSPSTNEMFTLTTNGDLPRPIFIPNGMPNTVVPCGTEKNFTNGMVNGHMPSLPDSPFTGYIIAVHRKMMRTELYFLSSQKNRPSLFGMPLIVPCTVHTRKKDLYDAVWIQVSRLASPLPPQEASNHAQDCDDSMGYQYPFTSAYILFYEQQGIDYAQFLPKTDGKKMADTSSMDEDFESDYKKYCVLQ

SEQ ID NO: 907667 - protein, 204 aa, Homo sapiens
MGAKESRIGFLSYEEALRRVTDVELKRLKDAFKRTCGLSYYMGQHCFIREVLGDGVPPKVAEVCHIVLGLRPATPEEEGQIIRGWLERESRYGLQAGHNWFIISMQWWQQWKEYVKYDANPVVIEPSSVLNGGKYSFGTAAHPMEQVEDRIGSSLSYVNTTEEKFSDNISTASEASETAGSGYIINTRRRTIKTNSTADSWKRL

SEQ ID NO: 907668 - protein, 119 aa, Homo sapiens
MGAKESRIGFLSYEEALRRVTDVELKRLKDAFKRTCGLSYYMGQHCFIREVLGDGVPPKVAEVCHIVLGLRPATPEEEGQIIRGWLERESRYGLQAGHNWFIISMQWWQQWKEYVKYVS

SEQ ID NO: 907669 - protein, 111 aa, Homo sapiens
MGAKESRIGFLSYEEALRRVTDVELKRLKDAFKRTCGLSYYMGQHCFIREVLGDGVPPKVAEVIYCSFGGTSKGLHFNNLIVGLVLLTRGKDEEKAKYIFSLFSSESGNYV

SEQ ID NO: 907670 - protein, 1274 aa, Homo sapiens; identical to SEQ ID NO: 907661

SEQ ID NO: 907671 - protein, 1044 aa, Homo sapiens
MVPEPVWRALYHWYGANLALPRPVIKNSKTDIPELELFPRYLLFLRQQPATRTQQSNIWVNMGNVPSPNAPLKRVLAYTGCFSRMQTIKEIHEYLSQRLRIKEEDMRLWLYNSENYLTLLDDEDHKLEYLKIQDEQHLVIEVRNKDMSWPEEMSFIANSSKIDRHKVPTEKGATGLSNLGNTCFMNSSIQCVSNTQPLTQYFISGRHLYELNRTNPIGMKGHMAKCYGDLVQELWSGTQKNVAPLKLRWTIAKYAPRFNGFQQQDSQELLAFLLDGLHEDLNRVHEKPYVELKDSDGRPDWEVAAEAWDNHLRRNRSIVVDLFHGQLRSQVKCKTCGHISVRFDPFNFLSLPLPMDSYMHLEITVIKLDGTTPVRYGLRLNMDEKYTGLKKQLSDLCGLNSEQILLAEVHGSNIKNFPQDNQKVRLSVSGFLCAFEIPVPVSPISASSPTQTDFSSSPSTNEMFTLTTNGDLPRPIFIPNGMPNTVVPCGTEKNFTNGMVNGHMPSLPDSPFTGYIIAVHRKMMRTELYFLSSQKNRPSLFGMPLIVPCTVHTRKKDLYDAVWIQVSRLASPLPPQEASNHAQDCDDSMGYQYPFTLRVVQKDGNSCAWCPWYRFCRGCKIDCGEDRAFIGNAYIAVDWDPTALHLRYQTSQERVVDEHESVEQSRRAQAEPINLDSCLRAFTSEEELGENEMYYCSKCKTHCLATKKLDLWRLPPILIIHLKRFQFVNGRWIKSQKIVKFPRESFDPSAFLVPRDPALCQHKPLTPQGDELSEPRILAREVKKVDAQSSAGEEDVLLSKSPSSLSANIISSPKGSPSSSRKSGTSCPSSKNSSPNSSPRTLGRSKGRLRLPQIGSKNKLSSSKENLDASKENGAGQICELADALSRGHVLGGSQPELVTPQDHEVALANGFLYEHEACGNGYSNGQLGNHSEEDSTDDQREDTRIKPIYNLYAISCHSGILGGGHYVTYAKNPNCKWYCYNDSSCKELHPDEIDTDSAYILFYEQQGIDYAQFLPKTDGKKMADTSSMDEDFESDYKKYCVLQ

SEQ ID NO: 907672 - protein, 209 aa, Homo sapiens
LVEVHGSGMNTGARNATGQGDKNKLSSSKENLDASKENGAGQICELADALSRGHVLGGSQPELVTPQDHEVALANGFLYEHEACGNGYSNGQLGNHSEEDSTDDQREDTRIKPIYNLYAISCHSGILGGGHYVTYAKNPNCKWYCYNDSSCKELHPDEIDTDSAYILFYEQQGIDYAQFLPKTDGKKMADTSSMDEDFESDYKKYCVLQ

SEQ ID NO: 907673 - protein, 1013 aa, Homo sapiens
MGAKESRIGFLSYEEALRRVTDVELKRLKDAFKRTCGLSYYMGQHCFIREVLGDGVPPKVAEVCHIVLGLRPATPEEEGQIIRGWLERESRYGLQAGHNWFIISMQWWQQWKEYVKYDANPVVIEPSSVLNGGKYSFGTAAHPMEQVEDRIGSSLSYVNTTEEKFSDNISTASEASETAGSGFLYSATPGADVCFARQHNTSDNNNQCLLGANGNILLHLNPQKPGAIDNQPLVTQEPVKATSLTLEGGRLKRTPQLIHGRDYEMVPEPVWRALYHWYGANLALPRPVIKNSKTDIPELELFPRYLLFLRQQPATRTQQSNIWVNMGNVPSPNAPLKRVLAYTGCFSRMQTIKEIHEYLSQRLRIKEEDMRLWLYNSENYLTLLDDEDHKLEYLKIQDEQHLVIEVRNKDMSWPEEMSFIANSSKIDRHKVPTEKGATGLSNLGNTCFMNSSIQCVSNTQPLTQYFISGRHLYELNRTNPIGMKGHMAKCYGDLVQELWSGTQKNVAPLKLRWTIAKYAPRFNGFQQQDSQELLAFLLDGLHEDLNRVHEKPYVELKDSDGRPDWEVAAEAWDNHLRRNRSIVVDLFHGQLRSQVKCKTCGHISVRFDPFNFLSLPLPMDSYMHLEITVIKLDGTTPVRYGLRLNMDEKYTGLKKQLSDLCGLNSEQILLAEVHGSNIKNFPQDNQKVRLSVSGFLCAFEIPVPVSPISASSPTQTDFSSSPSTNEMFTLTTNGDLPRPIFIPNGMPNTVVPCGTEKNFTNGMVNGHMPSLPDSPFTGYIIAVHRKMMRTELYFLSSQKNRPSLFGMPLIVPCTVHTRKKDLYDAVWIQVSRLASPLPPQEASNHAQDCDDSMGYQYPFTLRVVQKDGNSCAWCPWYRFCRGCKIDCGEDRAFIGNAYIAVDWDPTALHLRYQTSQERVVDEHESVEQSRRAQAEPINLDSCLRAFTSEEELGENEMYYCSKCKTHCLATKKLDLWRLPPILIIHLKRFQFVNGRWIKLSRGNLTIFCDFIVD

SEQ ID NO: 907674 - protein, 789 aa, Homo sapiens
MGAKESRIGFLSYEEALRRVTDVELKRLKDAFKRTCGLSYYMGQHCFIREVLGDGVPPKVAEVCHIVLGLRPATPEEEGQIIRGWLERESRYGLQAGHNWFIISMQWWQQWKEYVKYDANPVVIEPSSVLNGGKYSFGTAAHPMEQVEDRIGSSLSYVNTTEEKFSDNISTASEASETAGSGFLYSATPGADVCFARQHNTSDNNNQCLLGANGNILLHLNPQKPGAIDNQPLVTQEPVKATSLTLEGGRLKRTPQLIHGRDYEMVPEPVWRALYHWYGANLALPRPVIKNSKTDIPELELFPRYLLFLRQQPATRTQQSNIWVNMGNVPSPNAPLKRVLAYTGCFSRMQTIKEIHEYLSQRLRIKEEDMRLWLYNSENYLTLLDDEDHKLEYLKIQDEQHLVIEVRNKDMSWPEEMSFIANSSKIDRHKVPTEKGATGLSNLGNTCFMNSSIQCVSNTQPLTQYFISGRHLYELNRTNPIGMKGHMAKCYGDLVQELWSGTQKNVAPLKLRWTIAKYAPRFNGFQQQDSQELLAFLLDGLHEDLNRVHEKPYVELKDSDGRPDWEVAAEAWDNHLRRNRSIVVDLFHGQLRSQVKCKTCGHISVRFDPFNFLSLPLPMDSYMHLEITVIKLDGTTPVRYGLRLNMDEKYTGLKKQLSDLCGLNSEQILLAEVHGSNIKNFPQDNQKVRLSVSGFLCAFEIPVPVSPISASSPTQTDFSSSPSTNEMFTLTTNGDLPRPIFIPNGMPNTVVPCGTEKNFTNGMVNGHMPSLPDSPFTGYIIAVHRKMVS

SEQ ID NO: 907675 - protein, 138 aa, Homo sapiens [sequence omitted]

SEQ ID NO: 907676 - protein, 120 aa, Homo sapiens
MGSYFVARAGCKLLGLKGTSHFSLPKCRNCRREPLPGLFFLFFVFFFLRRSLALSPRLECSGAIVAHCKLGLPGSLHSPASASQVAGTIGTCHNTRIIFCILVETGFHRVSQDGVDLLTL

SEQ ID NO: 907677 - protein, 561 aa, Homo sapiens
ARGCGCGRRGRVAAPGARANRVRRGPTRGDRVSLRKRAMQRAAALVRRGCGPRTPSSWGRSQSSAAAEASAVLKVRPERSRRERILTLESMNPQVKAVEYAVRGPIVLKAGEIELELQRGIKKPFTEVIRANIGDAQAMGQQPITFLRQVMALCTYPNLLDSPSFPEDAKKRARRILQACGGNSLGSYSASQGVNCIREDVAAYITRRDGGVPADPDNIYLTTGASDGISTILKILVSGGGKSRTGVMIPIPQYPLYSAVISELDAIQVNYYLDEENCWALNVNELRRAVQEAKDHCDPKVLCIINPGNPTGQVQSRKCIEDVIHFAWEEKLFLLADEVYQDNVYSPDCRFHSFKKVLYEMGPEYSSNVELASFHSTSKGYMGECGYRGGYMEVINLHPEIKGQLVKLLSVRLCPPVSGQAAMDIVVNPPVAGEESFEQFSREKESVLGNLAKKAKLTEDLFNQVPGIHCNPLQGAMYAFPRIFIPAKAVEAAQAHQMAPDMFYCMKLLEETGICVVPGSGFGQREGTYHFRMTILPPVEKLKTVLQKVKDFHINFLEKYA

SEQ ID NO: 907678 - protein, 594 aa, Homo sapiens
ARGCGCGRRGRVAAPGARANRVRRGPTRGDRVSLRKRAMQRAAALVRRGCGPRTPSSWGRSQSSAAAEASAVLKVRPERSRRERILTLESMNPQVKAVEYAVRGPIVLKAGEIELELQRAGVQWCSYSSLWPQIPGLKVILLPQPLQKLGLQGIKKPFTEVIRANIGDAQAMGQQPITFLRQVMALCTYPNLLDSPSFPEDAKKRARRILQACGGNSLGSYSASQGVNCIREDVAAYITRRDGGVPADPDNIYLTTGASDGISTILKILVSGGGKSRTGVMIPIPQYPLYSAVISELDAIQVNYYLDEENCWALNVNELRRAVQEAKDHCDPKVLCIINPGNPTGQVQSRKCIEDVIHFAWEEKLFLLADEVYQDNVYSPDCRFHSFKKVLYEMGPEYSSNVELASFHSTSKGYMGECGYRGGYMEVINLHPEIKGQLVKLLSVRLCPPVSGQAAMDIVVNPPVAGEESFEQFSREKESVLGNLAKKAKLTEDLFNQVPGIHCNPLQGAMYAFPRIFIPAKAVEAAQAHQMAPDMFYCMKLLEETGICVVPGSGFGQREGTYHFRMTILPPVEKLKTVLQKVKDFHINFLEKYA

SEQ ID NO: 907679 - protein, 346 aa, Homo sapiens [sequence omitted]

SEQ ID NO: 907680 - protein, 246 aa, Homo sapiens
ARGCGCGRRGRVAAPGARANRVRRGPTRGDRVSLRKRAMQRAAALVRRGCGPRTPSSWGRSQSSAAAEASAVLKVRPERSRRERILTLESMNPQVKAVEYAVRGPIVLKAGEIELELQRGIKKPFTEVIRANIGDAQAMGQQPITFLRQVMALCTYPNLLDSPSFPEDAKKRARRILQACGGNSLGSYSASQGVNCIREDVAAYITRRDGGVPADPDNIYLTTGASDGISPGDVFLCALMLRAPLF

SEQ ID NO: 907681 - protein, 561 aa, Homo sapiens; identical to SEQ ID NO: 907677

SEQ ID NO: 907682 - protein, 279 aa, Homo sapiens
ARGCGCGRRGRVAAPGARANRVRRGPTRGDRVSLRKRAMQRAAALVRRGCGPRTPSSWGRSQSSAAAEASAVLKVRPERSRRERILTLESMNPQVKAVEYAVRGPIVLKAGEIELELQRGIKKPFTEVIRANIGDAQAMGQQPITFLRQVMALCTYPNLLDSPSFPEDAKKRARRILQACGGNSLGSYSASQGVNCIREDVAAYITSSLYAVISTPGPCRGNRNSQLSLPTDITAPMKKVATISNNKRECSKTFSSLKNGENCTCACCVVYKPGLVPGS

SEQ ID NO: 907683 - protein, 471 aa, Homo sapiens
ARGCGCGRRGRVAAPGARANRVRRGPTRGDRVSLRKRAMQRAAALVRRGCGPRTPSSWGRSQSSAAAEASAVLKVRPERSRRERILTLESMNPQVKAVEYAVRGPIVLKAGEIELELQRGIKKPFTEVIRANIGDAQAMGQQPITFLRQVMALCTYPNLLDSPSFPEDAKKRARRILQACGGNSLGSYSASQGVNCIREDVAAYITRRDGGVPADPDNIYLTTGASDGISTILKILVSGGGKSRTGVMIPIPQYPLYSAVISELDAIQVNYYLDEENCWALNVNELRRAVQEAKDHCDPKVLCIINPGNPTGQVQSRKCIEDVIHFAWEEKLFLLADEVYQDNVYSPDCRFHSFKKVLYEMGPEYSSNVELASFHSTSKGYMGECGYRGGYMEVINLHPEIKGQLVKLLSVRLCPPVSGQAAMDIVVNPPVAGEESFEQFSREKESVLGNRGSRWLFLSDQFPLRRDWLLG

SEQ ID NO: 907684 - protein, 108 aa, Homo sapiens
MHALGAAFAKAGWVCVGASAAPWRVRVAGGWAPAPKPGWHRSLKEPLAGLVWGSAARLGSARRVCSFSLFVPGFLSASARCSGRRRWSGGAVVPGPPAPGAAARAARP

SEQ ID NO: 907685 - protein, 465 aa, Homo sapiens
KRVRTKGPLRVWPDNVQCNQYETGIKKPFTEVIRANIGDAQAMGQQPITFLRQVMALCTYPNLLDSPSFPEDAKKRARRILQACGGNSLGSYSASQGVNCIREDVAAYITRRDGGVPADPDNIYLTTGASDGISTILKILVSGGGKSRTGVMIPIPQYPLYSAVISELDAIQVNYYLDEENCWALNVNELRRAVQEAKDHCDPKVLCIINPGNPTGQVQSRKCIEDVIHFAWEEKLFLLADEVYQDNVYSPDCRFHSFKKVLYEMGPEYSSNVELASFHSTSKGYMGECGYRGGYMEVINLHPEIKGQLVKLLSVRLCPPVSGQAAMDIVVNPPVAGEESFEQFSREKESVLGNLAKKAKLTEDLFNQVPGIHCNPLQGAMYAFPRIFIPAKAVEAAQAHQMAPDMFYCMKLLEETGICVVPGSGFGQREGTYHFRMTILPPVEKLKTVLQKVKDFHINFLEKYA

SEQ ID NO: 907686 - protein, 201 aa, Homo sapiens
MGPEYSSNVELASFHSTSKGYMGECGYRGGYMEVINLHPEIKGQLVKLLSVRLCPPVSGQAAMDIVVNPPVAGEESFEQFSREKESVLGNLAKKAKLTEDLFNQVPGIHCNPLQGAMYAFPRIFIPAKAVEAAQAHQMAPDMFYCMKLLEETGICVVPGSGFGQREGTYHFRMTILPPVEKLKTVLQKVKDFHINFLEKYA

SEQ ID NO: 907687 - protein, 561 aa, Homo sapiens; identical to SEQ ID NO: 907677

SEQ ID NO: 907688 - protein, 175 aa, Homo sapiens
ARGCGCGRRGRVAAPGARANRVRRGPTRGDRVSLRKRAMQRAAALVRRGCGPRTPSSWGRSQSSAAAEASAVLKVRPERSRRERILTLESMNPQVKAVEYAVRGPIVLKAGEIELELQRGIKKPFTEVIRANIGDAQAMGQQPITFLRQVMALCTYPNLLDSPTSPSSLPSPVGS

SEQ ID NO: 907689 - protein, 561 aa, Homo sapiens; identical to SEQ ID NO: 907677

SEQ ID NO: 907690 - protein, 182 aa, Homo sapiens
ARGCGCGRRGRVAAPGARANRVRRGPTRGDRVSLRKRAMQRAAALVRRGCGPRTPSSWGRSQSSAAAEASAVLKVRPERSRRERILTLESMNPQVKAVEYAVRGPIVLKAGEIELELQRVSARWAPGRLGPLSKGKTAAAPAGVLPTTSTPMASSSVSQAWLKRENAPSRPFTYWCPAPGTQ

SEQ ID NO: 907691 - protein, 195 aa, Homo sapiens
MVAVRRPRLSAGRHDLPISQRPVWEILRLCPYRPQTRACRLEAQFYVMMTPQDVLQTGTQRTIAPRTHPYSPKIDGTRTPRDERRRAQHNEVERRRRDKINNWIVQLSKIIPDCNADNSKTGASKGGILSKACDYIRELRQTNQRMQETFKEAERLQMDNELLRQQIEELKNENALLRAQLQQHNLEMVGEGTRQ

SEQ ID NO: 907692 - protein, 195 aa, Homo sapiens; identical to SEQ ID NO: 907691

SEQ ID NO: 907693 - protein, 195 aa, Homo sapiens; identical to SEQ ID NO: 907691

SEQ ID NO: 907694 - protein, 195 aa, Homo sapiens; identical to SEQ ID NO: 907691

SEQ ID NO: 907695 - protein, 147 aa, Homo sapiens
MTPQDVLQTGTQRTIAPRTHPYSPKIDGTRTPRDERRRAQHNEVERRRRDKINNWIVQLSKIIPDCNADNSKTGASKGGILSKACDYIRELRQTNQRMQETFKEAERLQMDNELLRQQIEELKNENALLRAQLQQHNLEMVGEGTRQ

SEQ ID NO: 907696 - protein, 195 aa, Homo sapiens; identical to SEQ ID NO: 907691

SEQ ID NO: 907697 - protein, 195 aa, Homo sapiens; identical to SEQ ID NO: 907691

SEQ ID NO: 907698 - protein, 225 aa, Homo sapiens
MDMLDPGLDPAASATAAAAASHDKGPEAEEGVELQEGGDGPGAEEQTAVAITSVQQAAFGDHNIQYQFRTETNGGQVTYRVVQVTDGQLDGQGDTAGAVSVVSTAAFAGGQQAVTQVGVDGAAQRPGPAAASVPPGPAAPFPLAVIQNPFSNGGSPAAEAVSGEARFAYFPASSVGDTTAVSVQTTDQSLQAGGAVLRHDDAPGCASDRNTEDDRPPDTPLLSKN

SEQ ID NO: 907699 - protein, 225 aa, Homo sapiens; identical to SEQ ID NO: 907698

SEQ ID NO: 907700 - protein, 225 aa, Homo sapiens; identical to SEQ ID NO: 907698

SEQ ID NO: 907701 - protein, 183 aa, Homo sapiens
MPVLKACVALEGPRFFVPLEKLGWGPAGLRVRPLTSQGCGLGGACTVPGCPRAEPLPCEDGRSGMSRQRTRGCDSVFLQLERRRRDKINNWIVQLSKIIPDCNADNSKTGASKGGILSKACDYIRELRQTNQRMQETFKEAERLQMDNELLRQQIEELKNENALLRAQLQQHNLEMVGEGTRQ

SEQ ID NO: 907702 - protein, 153 aa, Homo sapiens
PRRPLQPPSPAPRTHPYSPKIAGTRTPRDERRRSPVNQNPDKKFGGIERLERRRRDKINNWIVQLSKIIPDCNADNSKTGASKGGILSKACDYIRELRQTNQRMQETFKEAERLQMDNELLRQQIEELKNENALLRAQLQQHNLEMVGEGTRQ

SEQ ID NO: 907703 - protein, 199 aa, Homo sapiens
MTPQDVLQTGTQRTIAPRTHPYSPKIDGTRTPRDERRRAQHNEVERRRRDKINNWIVQLSKIIPDCNADNSKTGAVSTPDPQCLRWSRPPTLACRKSNSHGARESSLGWRPVGGACPKAPGPLSPPESKGGILSKACDYIRELRQTNQRMQETFKEAERLQMDNELLRQQIEELKNENALLRAQLQQHNLEMVGEGTRQ

SEQ ID NO: 907704 - protein, 225 aa, Homo sapiens; identical to SEQ ID NO: 907698

SEQ ID NO: 907705 - protein, 103 aa, Homo sapiens
MRGRDGGTEKAKGSLCPPTPQAVIQNPFSNGGSPAAEAVSGEARFAYFPASSVGDTTAVSVQTTDQSLQAGGAVLRHDDAPGCASDRNTEDDRPPDTPLLSKN

SEQ ID NO: 907706 - protein, 195 aa, Homo sapiens; identical to SEQ ID NO: 907691

SEQ ID NO: 907707 - protein, 195 aa, Homo sapiens; identical to SEQ ID NO: 907691

SEQ ID NO: 907708 - protein, 195 aa, Homo sapiens; identical to SEQ ID NO: 907691

SEQ ID NO: 907709 - protein, 195 aa, Homo sapiens; identical to SEQ ID NO: 907691

SEQ ID NO: 907710 - protein, 147 aa, Homo sapiens; identical to SEQ ID NO: 907695

SEQ ID NO: 907711 - protein, 195 aa, Homo sapiens; identical to SEQ ID NO: 907691

SEQ ID NO: 907712 - protein, 150 aa, Homo sapiens
SNLILSRCLGKQLCDNTCPLFFSSSCRKIDGTRTPRDERRRAQHNEVERRRRDKINNWIVQLSKIIPDCNADNSKTGASKGGILSKACDYIRELRQTNQRMQETFKEAERLQMDNELLRQQIEELKNENALLRAQLQQHNLEMVGEGTRQ

SEQ ID NO: 907713 - protein, 200 aa, Homo sapiens
MVAVRRPRLSAGRHDLPISQRPVWEILRLCPYRPQTRACRLEAQFYVMMTPQDVLQTGTQRTIAPRTHPYSPKIDGTRTPRDERRRAQHNEVERRRRDKINNWIVQLSKIIPDCNADNSKTGASKGGILSKACDYIRELRQTNQRMQETFKEAERLQMDNELLRQQVGAGPGAGQGPGAPDARRWPSAPLTSVVSARSRS

SEQ ID NO: 907714 - protein, 225 aa, Homo sapiens; identical to SEQ ID NO: 907698

SEQ ID NO: 907715 - protein, 235 aa, Homo sapiens
MPVLKACVALEGPRFFVPLEKLGWGPAGLRVRPLTSQGCGLGGACTVPGCPRAEPLPCEDGRSGMSRQRTRGCDSVFLQLERRRRDKINNWIVQLSKIIPDCNADNSKTGAVSTPDPQCLRWSRPPTLACRKSNSHGARESSLGWRPVGGACPKAPGPLSPPESKGGILSKACDYIRELRQTNQRMQETFKEAERLQMDNELLRQQIEELKNENALLRAQLQQHNLEMVGEGTRQ

SEQ ID NO: 907716 - protein, 179 aa, Homo sapiens
MDMLDPGLDPAASATAAAAASHDKGPEAEEGVELQEGGDGPGAEEQTAVAITSVQQAAFGDHNIQYQFRTETNGGQVTYRVVQVTDGQLDGQGDTAGAVSVVSTAAFAGGQQAVTQVGVDGAAQRPGPAAASVPPGPAAPFPLAGLCCPLPQPLAQRGTHAPPPAAFFYSRFLTKNGEK

SEQ ID NO: 907717 - protein, 688 aa, Homo sapiens
MADLEAVLADVSYLMAMEKSKATPAARASKRIVLPEPSIRSVMQKYLAERNEITFDKIFNQKIGFLLFKDFCLNEINEAVPQVKFYEEIKEYEKLDNEEDRLCRSRQIYDAYIMKELLSCSHPFSKQAVEHVQSHLSKKQVTSTLFQPYIEEICESLRGDIFQKFMESDKFTRFCQWKNVELNIHLTMNEFSVHRIIGRGGFGEVYGCRKADTGKMYAMKCLDKKRIKMKQGETLALNERIMLSLVSTGDCPFIVCMTYAFHTPDKLCFILDLMNGGDLHYHLSQHGVFSEKEMRFYATEIILGLEHMHNRFVVYRDLKPANILLDEHGHARISDLGLACDFSKKKPHASVGTHGYMAPEVLQKGTAYDSSADWFSLGCMLFKLLRGHSPFRQHKTKDKHEIDRMTLTVNVELPDTFSPELKSLLEGLLQRDVSKRLGCHGGGSQEVKEHSFFKGVDWQHVYLQKYPPPLIPPRGEVNAADAFDIGSFDEEDTKGIKLLDCDQELYKNFPLVISERWQQEVTETVYEAVNADTDKIEARKRAKNKQLGHEEDYALGKDCIMHGYMLKLGNPFLTQWQRRYFYLFPNRLEWRGEGESRQNLLTMEQILSVEETQIKDKKCILFRIKGGKQFVLQCESDPEFVQWKKELNETFKEAQRLLRRAPKFLNKPRSGTVELPKPSLCHRNSNGL

SEQ ID NO: 907718 - protein, 688 aa, Homo sapiens; identical to SEQ ID NO: 907717

SEQ ID NO: 907719 - protein, 688 aa, Homo sapiens
MELWGYVAASIRSVMQKYLAERNEITFDKIFNQKIGFLLFKDFCLNEINEAVPQVKFYEEIKEYEKLDNEEDRLCRSRQIYDAYIMKELLSCSHPFSKQAVEHERSSFMMYGIIKELLSCSHPFSKQAVEHVQSHLSKKQVTSTLFQPYIEEICESLRGDIFQKFMESDKFTRFCQWKNVELNIHLTMNEFSVHRIIGRGGFGEVYGCRKADTGKMYAMKCLDKKRIKMKQGETLALNERIMLSLVSTGDCPFIVCMTYAFHTPDKLCFILDLMNGGDLHYHLSQHGVFSEKEMRFYATEIILGLEHMHNRFVVYRDLKPANILLDEHGHARISDLGLACDFSKKKPHASVGTHGYMAPEVLQKGTAYDSSADWFSLGCMLFKLLRGHSPFRQHKTKDKHEIDRMTLTVNVELPDTFSPELKSLLEGLLQRDVSKRLGCHGGGSQEVKEHSFFKGVDWQHVYLQKYPPPLIPPRGEVNAADAFDIGSFDEEDTKGIKLLDCDQELYKNFPLVISERWQQEVTETVYEAVNADTDKIEARKRAKNKQLGHEEDYALGKDCIMHGYMLKLGNPFLTQWQRRYFYLFPNRLEWRGEGESRQNLLTMEQILSVEETQIKDKKCILFRIKGGKQFVLQCESDPEFVQWKKELNETFKEAQRLLRRAPKFLNKPRSGTVELPKPSLCHRNSNGL

SEQ ID NO: 907720 - protein, 688 aa, Homo sapiens; identical to SEQ ID NO: 907719

SEQ ID NO: 907721 - protein, 575 aa, Homo sapiens
MKELLSCSHPFSKQAVEHVQSHLSKKQVTSTLFQPYIEEICESLRGDIFQKFMESDKFTRFCQWKNVELNIHLTMNEFSVHRIIGRGGFGEVYGCRKADTGKMYAMKCLDKKRIKMKQGETLALNERIMLSLVSTGDCPFIVCMTYAFHTPDKLCFILDLMNGGDLHYHLSQHGVFSEKEMRFYATEIILGLEHMHNRFVVYRDLKPANILLDEHGHARISDLGLACDFSKKKPHASVGTHGYMAPEVLQKGTAYDSSADWFSLGCMLFKLLRGHSPFRQHKTKDKHEIDRMTLTVNVELPDTFSPELKSLLEGLLQRDVSKRLGCHGGGSQEVKEHSFFKGVDWQHVYLQKYPPPLIPPRGEVNAADAFDIGSFDEEDTKGIKLLDCDQELYKNFPLVISERWQQEVTETVYEAVNADTDKIEARKRAKNKQLGHEEDYALGKDCIMHGYMLKLGNPFLTQWQRRYFYLFPNRLEWRGEGESRQNLLTMEQILSVEETQIKDKKCILFRIKGGKQFVLQCESDPEFVQWKKELNETFKEAQRLLRRAPKFLNKPRSGTVELPKPSLCHRNSNGL

SEQ ID NO: 907722 - protein, 432 aa, Homo sapiens [sequence omitted]

SEQ ID NO: 907723 - protein, 688 aa, Homo sapiens; identical to SEQ ID NO: 907717

SEQ ID NO: 907724 - protein, 131 aa, Homo sapiens
MTMYPASTPMATRRRCHLCGCGVACGLATSTLATVGCSTCWRRETTRTAATLGPVTLRDMDEAGNHHSQQTNTEAENQTPHVLTHKWELNSENTWTQGGEHHTPRPVREWGTRGRESIGTNTKCMHGLKPR

SEQ ID NO: 907725 - protein, 131 aa, Homo sapiens; identical to SEQ ID NO: 907724

SEQ ID NO: 907726 - protein, 106 aa, Homo sapiens
MTMYPASTPMATRRRCHLCGCGVACGLATSTLATVGCSTCWRRETTRTAATLGPVTLRYSPCAASTTCRGTNVVPSTPPTSAHPTMPPSQDPGLLPRNPPDLPESE

SEQ ID NO: 907727 - protein, 688 aa, Homo sapiens; identical to SEQ ID NO: 907717

SEQ ID NO: 907728 - protein, 688 aa, Homo sapiens; identical to SEQ ID NO: 907717

SEQ ID NO: 907729 - protein, 688 aa, Homo sapiens; identical to SEQ ID NO: 907719

SEQ ID NO: 907730 - protein, 688 aa, Homo sapiens; identical to SEQ ID NO: 907717

SEQ ID NO: 907731 - protein, 338 aa, Homo sapiens
VCVCVCVCVCVCVGFLCCFVLFFETQSHSVAQSWSALGQSRRTRTHMCTSKVCVCVCVCVCVCVCTFSPELKSLLEGLLQRDVSKRLGCHGGGSQEVKEHSFFKGVDWQHVYLQKYPPPLIPPRGEVNAADAFDIGSFDEEDTKGIKLLDCDQELYKNFPLVISERWQQEVTETVYEAVNADTDKIEARKRAKNKQLGHEEDYALGKDCIMHGYMLKLGNPFLTQWQRRYFYLFPNRLEWRGEGESRQNLLTMEQILSVEETQIKDKKCILFRIKGGKQFVLQCESDPEFVQWKKELNETFKEAQRLLRRAPKFLNKPRSGTVELPKPSLCHRNSNGL

SEQ ID NO: 907732 - protein, 131 aa, Homo sapiens; identical to SEQ ID NO: 907724

SEQ ID NO: 907733 - protein, 106 aa, Homo sapiens; identical to SEQ ID NO: 907726

SEQ ID NO: 907734 - protein, 385 aa, Homo sapiens
FFFSSAQKSRSGSLRARSRNQAPGAGAGAAGRRRLRSLRRARPGRPSLLGLGEQRRRRHPGRGNTEHCAACRGLLAALIRNSVWPRSEYWRRDHEIDEFALGVGKKVKPGANMGQKVTGGIKTVDMRDPTYRPLKQELQGLDYCKPTRLDLLLDMPPVSYDVQLLHSWNNNDRSLNVFVKEDDKLIFHRHPVAQSTDAIRGKVGYTRGLHVWQITWAMRQRGTHAVVGVATADAPLHSVGYTTLVGNNHESWGWDLGRNRLYHDGKNQPSKTYPAFLEPDETFIVPDSFLVALDMDDGTLSFIVDGQYMGVAFRGLKGKKLYPVVSAVWGHCEIRMRYLNGLDPEPLPLMDLCRRSVRLALGRERLGEIHTLPLPASLKAYLLYQ

SEQ ID NO: 907735 - protein, 161 aa, Homo sapiens
FFFSSAQKSRSGSLRARSRNQAPGAGAGAAGRRRLRSLRRARPGRPSLLGLGEQRRRRHPGRGNTEHCAACRGLLAALIRNSVWPRSEYWRRDHEIDEFALGVGKKVKPGANMGQKVPGLPSSSVAASMGQGPIPTQAPLSPFPTSAEGSIPACRPYTTPL

SEQ ID NO: 907736 - protein, 385 aa, Homo sapiens; identical to SEQ ID NO: 907734

SEQ ID NO: 907737 - protein, 385 aa, Homo sapiens; identical to SEQ ID NO: 907734

SEQ ID NO: 907738 - protein, 385 aa, Homo sapiens; identical to SEQ ID NO: 907734

SEQ ID NO: 907739 - protein, 332 aa, Homo sapiens
FFFSSAQKSRSGSLRARSRNQAPGAGAGAAGRRRLRSLRRARPGRPSLLGLGEQRRRRHPGRGNTEHCAACRGLLAALIRNSVWPRSEYWRRDHEIDEFALGVGKKVKPGANMGQKVTGGIKTVDMRDPTYRPLKQELQGLDYCKPTRLDLLLDMPPVSYDVQLLHSWNNNDRSLNVFVKEDDKLIFHRHPVAQSTDAIRGKVGYTRGLHVWQITWAMRQRGTHAVVGVATADAPLHSVGYTTLVGNNHESWGWDLGRNRLYHDGKNQPSKTYPAFLEPDETFIVPDSFLVALDMDDGTLSFIVDETVHGSGFSGTQGQKTVSCSECRLGPL

SEQ ID NO: 907740 - protein, 385 aa, Homo sapiens; identical to SEQ ID NO: 907734

SEQ ID NO: 907741 - protein, 385 aa, Homo sapiens; identical to SEQ ID NO: 907734

SEQ ID NO: 907742 - protein, 116 aa, Homo sapiens
SPSRKKGAETKNCLQANKHPAPILAAGAPYPVFILLTITKAIYLFHLERKPCFSPLSLAVLLLSFHLCPPWDMYASPALPGHMCTRAQAQVCLWVPCPAVSRGLCSKFPSGPLREK

SEQ ID NO: 907743 - protein, 385 aa, Homo sapiens; identical to SEQ ID NO: 907734

SEQ ID NO: 907744 - protein, 385 aa, Homo sapiens; identical to SEQ ID NO: 907734

SEQ ID NO: 907745 - protein, 1396 aa, Homo sapiens
RPKGAFASRGAAGAVCYARPPPGEGTARPGTVAEMDRGPAAVACTLLLALVACLAPASGQECDSAHFRCGSGHCIPADWRCDGTKDCSDDADEIGCAVVTCQQGYFKCQSEGQCIPSSWVCDQDQDCDDGSDERQDCSQSTCSSHQITCSNGQCIPSEYRCDHVRDCPDGADENDCQYPTCEQLTCDNGACYNTSQKCDWKVDCRDSSDEINCTEICLHNEFSCGNGECIPRAYVCDHDNDCQDGSDEHACNYPTCGGYQFTCPSGRCIYQNWVCDGEDDCKDNGDEDGCESGPHDVHKCSPREWSCPESGRCISIYKVCDGILDCPGREDENNTSTGKYCSMTLCSALNCQYQCHETPYGGACFCPPGYIINHNDSRTCVEFDDCQIWGICDQKCESRPGRHLCHCEEGYILERGQYCKANDSFGEASIIFSNGRDLLIGDIHGRSFRILVESQNRGVAVGVAFHYHLQRVFWTDTVQNKVFSVDINGLNIQEVLNVSVETPENLAVDWVNNKIYLVETKVNRIDMVNLDGSYRVTLITENLGHPRGIAVDPTVGYLFFSDWESLSGEPKLERAFMDGSNRKDLVKTKLGWPAGVTLDMISKRVYWVDSRFDYIETVTYDGIQRKTVVHGGSLIPHPFGVSLFEGQVFFTDWTKMAVLKANKFTETNPQVYYQASLRPYGVTVYHSLRQPYATNPCKDNNGGCEQVCVLSHRTDNDGLGFRCKCTFGFQLDTDERHCIAVQNFLIFSSQVAIRGIPFTLSTQEDVMVPVSGNPSFFVGIDFDAQDSTIFFSDMSKHMIFKQKIDGTGREILAANRVENVESLAFDWISKNLYWTDSHYKSISVMRLADKTRRTVVQYLNNPRSVVVHPFAGYLFFTDWFRPAKIMRAWSDGSHLLPVINTTLGWPNGLAIDWAASRLYWVDAYFDKIEHSTFDGLDRRRLGHIEQMTHPFGLAIFGEHLFFTDWRLGAIIRVRKADGGEMTVIRSGIAYILHLKSYDVNIQTGSNACNQPTHPNGDCSHFCFPVPNFQRVCGCPYGMRLASNHLTCEGDPTNEPPTEQCGLFSFPCKNGRCVPNYYLCDGVDDCHDNSDEQLCGTLNNTCSSSAFTCGHGECIPAHWRCDKRNDCVDGSDEHNCPTHAPASCLDTQYTCDNHQCISKNWVCDTDNDCGDGSDEKNCNSTETCQPSQFNCPNHRCIDLSFVCDGDKDCVDGSDEVGCVLNCTASQFKCASGDKCIGVTNRCDGVFDCSDNSDEAGCPTRPPGMCHSDEFQCQEDGICIPNFWECDGHPDCLYGSDEHNACVPKTCPSSYFHCDNGNCIHRAWLCDRDNDCGDMSDEKDCPTQPFRCPSWQWQCLGHNICVNLSVVCDGIFDCPNGTDESPLCSKFPDHSLLAINSF

SEQ ID NO: 907746 - protein, 4365 aa, Homo sapiens
MDRGPAAVACTLLLALVACLAPASGQECDSAHFRCGSGHCIPADWRCDGTKDCSDDADEIGCAVVTCQQGYFKCQSEGQCIPSSWVCDQDQDCDDGSDERQDCSQSTCSSHQITCSNGQCIPSEYRCDHVRDCPDGADENDCQYPTCEQLTCDNGACYNTSQKCDWKVDCRDSSDEINCTEICLHNEFSCGNGECIPRAYVCDHDNDCQDGSDEHACNYPTCGGYQFTCPSGRCIYQNWVCDGEDDCKDNGDEDGCESGPHDVHKCSPREWSCPESGRCISIYKVCDGILDCPGREDENNTSTGKYCSMTLCSALNCQYQCHETPYGGACFCPPGYIINHNDSRTCVEFDDCQIWGICDQKCESRPGRHLCHCEEGYILERGQYCKANDSFGEASIIFSNGRDLLIGDIHGRSFRILVESQNRGVAVGVAFHYHLQRVFWTDTVQNKVFSVDINGLNIQEVLNVSVETPENLAVDWVNNKIYLVETKVNRIDMVNLDGSYRVTLITENLGHPRGIAVDPTVGYLFFSDWESLSGEPKLERAFMDGSNRKDLVKTKLGWPAGVTLDMISKRVYWVDSRFDYIETVTYDGIQRKTVVHGGSLIPHPFGVSLFEGQVFFTDWTKMAVLKANKFTETNPQVYYQASLRPYGVTVYHSLRQPYATNPCKDNNGGCEQVCVLSHRTDNDGLGFRCKCTFGFQLDTDERHCIAVQNFLIFSSQVAIRGIPFTLSTQEDVMVPVSGNPSFFVGIDFDAQDSTIFFSDMSKHMIFKQKIDGTGREILAANRVENVESLAFDWISKNLYWTDSHYKSISVMRLADKTRRTVVQYLNNPRSVVVHPFAGYLFFTDWFRPAKIMRAWSDGSHLLPVINTTLGWPNGLAIDWAASRLYWVDAYFDKIEHSTFDGLDRRRLGHIEQMTHPFGLAIFGEHLFFTDWRLGAIIRVRKADGGEMTVIRSGIAYILHLKSYDVNIQTGSNACNQPTHPNGDCSHFCFPVPNFQRVCGCPYGMRLASNHLTCEGDPTNEPPTEQCGLFSFPCKNGRCVPNYYLCDGVDDCHDNSDEQLCGTLNNTCSSSAFTCGHGECIPAHWRCDKRNDCVDGSDEHNCPTHAPASCLDTQYTCDNHQCISKNWVCDTDNDCGDGSDEKNCNSTETCQPSQFNCPNHRCIDLSFVCDGDKDCVDGSDEVGCVLNCTASQFKCASGDKCIGVTNRCDGVFDCSDNSDEAGCPTRPPGMCHSDEFQCQEDGICIPNFWECDGHPDCLYGSDEHNACVPKTCPSSYFHCDNGNCIHRAWLCDRDNDCGDMSDEKDCPTQPFRCPSWQWQCLGHNICVNLSVVCDGIFDCPNGTDESPLCNGNSCSDFNGGCTHECVQEPFGAKCLCPLGFLLANDSKTCEDIDECDILGSCSQHCYNMRGSFRCSCDTGYMLESDGRTCKVTASESLLLLVASQNKIIADSVTSQVHNIYSLVENGSYIVAVDFDSISGRIFWSDATQGKTWSAFQNGTDRRVVFDSSIILTETIAIDWVGRNLYWTDYALETIEVSKIDGSHRTVLISKNLTNPRGLALDPRMNEHLLFWSDWGHHPRIERASMDGSMRTVIVQDKIFWPCGLTIDYPNRLLYFMDSYLDYMDFCDYNGHHRRQVIASDLIIRHPYALTLFEDSVYWTDRATRRVMRANKWHGGNQSVVMYNIQWPLGIVAVHPSKQPNSVNPCAFSRCSHLCLLSSQGPHFYSCVCPSGWSLSPDLLNCLRDDQPFLITVRQHIIFGISLNPEVKSNDAMVPIAGIQNGLDVEFDDAEQYIYWVENPGEIHRVKTDGTNRTVFASISMVGPSMNLALDWISRNLYSTNPRTQSIEVLTLHGDIRYRKTLIANDGTALGVGFPIGITVDPARGKLYWSDQGTDSGVPAKIASANMDGTSVKTLFTGNLEHLECVTLDIEEQKLYWAVTGRGVIERGNVDGTDRMILVHQLSHPWGIAVHDSFLYYTDEQYEVIERVDKATGANKIVLRDNVPNLRGLQVYHRRNAAESSNGCSNNMNACQQICLPVPGGLFSCACATGFKLNPDNRSCSPYNSFIVVSMLSAIRGFSLELSDHSETMVPVAGQGRNALHVDVDVSSGFIYWCDFSSSVASDNAIRRIKPDGSSLMNIVTHGIGENGVRGIAVDWVAGNLYFTNAFVSETLIEVLRINTTYRRVLLKVTVDMPRHIVVDPKNRYLFWADYGQRPKIERSFLDCTNRTVLVSEGIVTPRGLAVDRSDGYVYWVDDSLDIIARIRINGENSEVIRYGSRYPTPYGITVFENSIIWVDRNLKKIFQASKEPENTEPPTVIRDNINWLRDVTIFDKQVQPRSPAEVNNNPCLENNGGCSHLCFALPGLHTPKCDCAFGTLQSDGKNCAISTENFLIFALSNSLRSLHLDPENHSPPFQTINVERTVMSLDYDSVSDRIYFTQNLASGVGQISYATLSSGIHTPTVIASGIGTADGIAFDWITRRIYYSDYLNQMINSMAEDGSNRTVIARVPKPRAIVLDPCQGYLYWADWDTHAKIERATLGGNFRVPIVNSSLVMPSGLTLDYEEDLLYWVDASLQRIERSTLTGVDREVIVNAAVHAFGLTLYGQYIYWTDLYTQRIYRANKYDGSGQIAMTTNLLSQPRGINTVVKNQKQQCNNPCEQFNGGCSHICAPGPNGAECQCPHEGNWYLANNRKHCIVDNGERCGASSFTCSNGRCISEEWKCDNDNDCGDGSDEMESVCALHTCSPTAFTCANGRCVQYSYRCDYYNDCGDGSDEAGCLFRDCNATTEFMCNNRRCIPREFICNGVDNCHDNNTSDEKNCPDRTCQSGYTKCHNSNICIPRVYLCDGDNDCGDNSDENPTYCTTHTCSSSEFQCASGRCIPQHWYCDQETDCFDASDEPASCGHSERTCLADEFKCDGGRCIPSEWICDGDNDCGDMSDEDKRHQCQNQNCSDSEFLCVNDRPPDRRCIPQSWVCDGDVDCTDGYDENQNCTRRTCSENEFTCGYGLCIPKIFRCDRHNDCGDYSDERGCLYQTCQQNQFTCQNGRCISKTFVCDEDNDCGDGSDELMHLCHTPEPTCPPHEFKCDNGRCIEMMKLCNHLDDCLDNSDEKGCGINECHDPSISGCDHNCTDTLTSFYCSCRPGYKLMSDKRTCVDIDECTEMPFVCSQKCENVIGSYICKCAPGYLREPDGKTCRQNSNIEPYLIFSNRYYLRNLTIDGYFYSLILEGLDNVVALDFDRVEKRLYWIDTQRQVIERMFLNKTNKETIINHRLPAAESLAVDWVSRKLYWLDARLDGLFVSDLNGGHRRMLAQHCVDANNTFCFDNPRGLALHPQYGYLYWADWGHRAYIGRVGMDGTNKSVIISTKLEWPNGITIDYTNDLLYWADAHLGYIEYSDLEGHHRHTVYDGALPHPFAITIFEDTIYWTDWNTRTVEKGNKYDGSNRQTLVNTTHRPFDIHVYHPYRQPIVSNPCGTNNGGCSHLCLIKPGGKGFTCECPDDFRTLQLSGSTYCMPMCSSTQFLCANNEKCIPIWWKCDGQKDCSDGSDELALCPQRFCRLGQFQCSDGNCTSPQTLCNAHQNCPDGSDEDRLLCENHHCDSNEWQCANKRCIPESWQCDTFNDCEDNSDEDSSHCASRTCRPGQFRCANGRCIPQAWKCDVDNDCGDHSDEPIEECMSSAHLCDNFTEFSCKTNYRCIPKWAVCNGVDDCRDNSDEQGCEERTCHPVGDFRCKNHHCIPLRWQCDGQNDCGDNSDEENCAPRECTESEFRCVNQQCIPSRWICDHYNDCGDNSDERDCEMRTCHPEYFQCTSGHCVHSELKCDGSADCLDASDEADCPTRFPDGAYCQATMFECKNHVCIPPYWKCDGDDDCGDGSDEELHLCLDVPCNSPNRFRCDNNRCIYSHEVCNGVDDCGDGTDETEEHCRKPTPKPCTEYEYKCGNGHCIPHDNVCDDADDCGDWSDELGCNKGKERTCAENICEQNCTQLNEGGFICSCTAGFETNVFDRTSCLDINECEQFGTCPQHCRNTKGSYECVCADGFTSMSDRPGKRCAAEGSSPLLLLPDNVRIRKYNLSSERFSEYLQDEEYIQAVDYDWDPKDIGLSVVYYTVRGEGSRFGAIKRAYIPNFESGRNNLVQEVDLKLKYVMQPDGIAVDWVGRHIYWSDVKNKRIEVAKLDGRYRKWLISTDLDQPAAIAVNPKLGLMFWTDWGKEPKIESAWMNGEDRNILVFEDLGWPTGLSIDYLNNDRIYWSDFKEDVIETIKYDGTDRRVIAKEAMNPYSLDIFEDQLYWISKEKGEVWKQNKFGQGKKEKTLVVNPWLTQVRIFHQLRYNKSVPNLCKQICSHLCLLRPGGYSCACPQGSSFIEEEHH

SEQ ID NO: 907747 - protein, 1785 aa, Homo sapiens
RPKGAFASRGAAGAVCYARPPPGEGTARPGTVAEMDRGPAAVACTLLLALVACLAPASGQECDSAHFRCGSGHCIPADWRCDGTKDCSDDADEIGCAVVTCQQGYFKCQSEGQCIPSSWVCDQDQDCDDGSDERQDCSQSTCSSHQITCSNGQCIPSEYRCDHVRDCPDGADENDCQYPTCEQLTCDNGACYNTSQKCDWKVDCRDSSDEINCTEICLHNEFSCGNGECIPRAYVCDHDNDCQDGSDEHACNYPTCGGYQFTCPSGRCIYQNWVCDGEDDCKDNGDEDGCESGPHDVHKCSPREWSCPESGRCISIYKVCDGILDCPGREDENNTSTGKYCSMTLCSALNCQYQCHETPYGGACFCPPGYIINHNDSRTCVEFDDCQIWGICDQKCESRPGRHLCHCEEGYILERGQYCKANDSFGEASIIFSNGRDLLIGDIHGRSFRILVESQNRGVAVGVAFHYHLQRVFWTDTVQNKVFSVDINGLNIQEVLNVSVETPENLAVDWVNNKIYLVETKVNRIDMVNLDGSYRVTLITENLGHPRGIAVDPTVGYLFFSDWESLSGEPKLERAFMDGSNRKDLVKTKLGWPAGVTLDMISKRVYWVDSRFDYIETVTYDGIQRKTVVHGGSLIPHPFGVSLFEGQVFFTDWTKMAVLKANKFTETNPQVYYQASLRPYGVTVYHSLRQPYATNPCKDNNGGCEQVCVLSHRTDNDGLGFRCKCTFGFQLDTDERHCIAVQNFLIFSSQVAIRGIPFTLSTQEDVMVPVSGNPSFFVGIDFDAQDSTIFFSDMSKHMIFKQKIDGTGREILAANRVENVESLAFDWISKNLYWTDSHYKSISVMRLADKTRRTVVQYLNNPRSVVVHPFAGYLFFTDWFRPAKIMRAWSDGSHLLPVINTTLGWPNGLAIDWAASRLYWVDAYFDKIEHSTFDGLDRRRLGHIEQMTHPFGLAIFGEHLFFTDWRLGAIIRVRKADGGEMTVIRSGIAYILHLKSYDVNIQTGSNACNQPTHPNGDCSHFCFPVPNFQRVCGCPYGMRLASNHLTCEGDPTNEPPTEQCGLFSFPCKNGRCVPNYYLCDGVDDCHDNSDEQLCGTLNNTCSSSAFTCGHGECIPAHWRCDKRNDCVDGSDEHNCPTHAPASCLDTQYTCDNHQCISKNWVCDTDNDCGDGSDEKNCNSTETCQPSQFNCPNHRCIDLSFVCDGDKDCVDGSDEVGCVLNCTASQFKCASGDKCIGVTNRCDGVFDCSDNSDEAGCPTRPPGMCHSDEFQCQEDGICIPNFWECDGHPDCLYGSDEHNACVPKTCPSSYFHCDNGNCIHRAWLCDRDNDCGDMSDEKDCPTQPFRCPSWQWQCLGHNICVNLSVVCDGIFDCPNGTDESPLCNGNSCSDFNGGCTHECVQEPFGAKCLCPLGFLLANDSKTCEDIDECDILGSCSQHCYNMRGSFRCSCDTGYMLESDGRTCKVTASESLLLLVASQNKIIADSVTSQVHNIYSLVENGSYIVAVDFDSISGRIFWSDATQGKTWSAFQNGTDRRVVFDSSIILTETIAIDWVGRNLYWTDYALETIEVSKIDGSHRTVLISKNLTNPRGLALDPRMNEHLLFWSDWGHHPRIERASMDGSMRTVIVQDKIFWPCGLTIDYPNRLLYFMDSYLDYMDFCDYNGHHRRQVIASDLIIRHPYALTLFEDSVYWTDRATRRVMRANKWHGGNQSVVMYNIQWPLGIVAVHPSKQPNSVNPCAFSRCSHLCLLSSQGPHFYSCVCPSGWSLSPDLLNCLRGIVCSLCEL

SEQ ID NO: 907748 - protein, 444 aa, Homo sapiens
MEVTADQPRWVSHHHPAVLNGQHPDTHHPGLSHSYMDAAQYPLPEEVDVLFNIDGQGNHVPPYYGNSVRATVQRYPPTHHGSQVCRPPLLHGSLPWLDGGKALGSHHTASPWNLSPFSKTSIHHGSPGPLSVYPPASSSSLSGGHASPHLFTFPPTPPKDVSPDPSLSTPGSAGSARQDEKECLKYQVPLPDSMKLESSHSRGSMTALGGASSSTHHPITTYPPYVPEYSSGLFPPSSLLGGSPTGFGCKSRPKARSSTEGRECVNCGATSTPLWRRDGTGHYLCNACGLYHKMNGQNRPLIKPKRRLSAARRAGTSCANCQTTTTTLWRRNANGDPVCNACGLYYKLHNINRPLTMKKEGIQTRNRKMSSKSKKCKKVHDSLEDFPKNSSFNPAALSRHMSSLSHISPFSHSSHMLTTPTPMHPPSSLSFGPHHPSSMVTAMG

SEQ ID NO: 907749 - protein, 444 aa, Homo sapiens; identical to SEQ ID NO: 907748

SEQ ID NO: 907750 - protein, 444 aa, Homo sapiens; identical to SEQ ID NO: 907748

SEQ ID NO: 907751 - protein, 195 aa, Homo sapiens
MENHKSNNKENITIVDISRKINQLPEAERNLLENGSVYVGLNAALCGLIANSLFRRILNVTKARIAAGLPMAGIPFLTTDLTYRCFVSFPLNTGDLDCETCTITRSGLTGLVIGGLYPVFLAIPVNGGLAARYQSALLPHKGNILSYWIRTSKPVFRKMLFPILLQTMFSAYLGSEQYKLLIKALQLSEPGKEIH

SEQ ID NO: 907752 - protein, 104 aa, Homo sapiens
MFCDLDCETCTITRSGLTGLVIGGLYPVFLAIPVNGGLAARYQSALLPHKGNILSYWIRTSKPVFRKMLFPILLQTMFSAYLGSEQYKLLIKALQLSEPGKEIH

SEQ ID NO: 907753 - protein, 195 aa, Homo sapiens; identical to SEQ ID NO: 907751

SEQ ID NO: 907754 - protein, 198 aa, Homo sapiens
MLKMENHKSNNKENITIVDISRKINQLPEAERNLLENGSVYVGLNAALCGLIANSLFRRILNVTKARIAAGLPMAGIPFLTTDLTYRCFVSFPLNTGDLDCETCTITRSGLTGLVIGGLYPVFLAIPVNGGLAARYQSALLPHKGNILSYWIRTSKPVFRKMLFPILLQTMFSAYLGSEQYKLLIKALQLSEPGKEIH

SEQ ID NO: 907755 - protein, 125 aa, Homo sapiens
MAGIPFLTTDLTYRCFVSFPLNTGDLDCETCTITRSGLTGLVIGGLYPVFLAIPVNGGLAARYQSALLPHKGNILSYWIRTSKPVFRKMLFPILLQTMFSAYLGSEQYKLLIKALQLSEPGKEIH

SEQ ID NO: 907756 - protein, 104 aa, Homo sapiens; identical to SEQ ID NO: 907752

SEQ ID NO: 907757 - protein, 125 aa, Homo sapiens; identical to SEQ ID NO: 907755

SEQ ID NO: 907758 - protein, 195 aa, Homo sapiens; identical to SEQ ID NO: 907751

SEQ ID NO: 907759 - protein, 195 aa, Homo sapiens; identical to SEQ ID NO: 907751

SEQ ID NO: 907760 - protein, 257 aa, Homo sapiens
LNHKKPPDSPEITYKSCYQDSHEDPTKMKRFLFLLLTISLLVYGTDTNWTLRTNWEESIRLKMENHKSNNKENITIVDISRKINQLPEAERNLLENGSVYVGLNAALCGLIANSLFRRILNVTKARIAAGLPMAGIPFLTTDLTYRCFVSFPLNTGDLDCETCTITRSGLTGLVIGGLYPVFLAIPVNGGLAARYQSALLPHKGNILSYWIRTSKPVFRKMLFPILLQTMFSAYLGSEQYKLLIKALQLSEPGKEIH

SEQ ID NO: 907761 - protein, 69 aa, Homo sapiens
QSLGIRSLGVAPRPDFHFWPALSPPGRGSGCQSLNNLSMGPTKMFPDPWNAKFKFSYVSRRGRWKKQRE

SEQ ID NO: 907762 - protein, 248 aa, Homo sapiens
MGSVQENRMPEPRSRQPSSCLASRCLPGEQILAWAPGVRKGLEPELSGTLICTNFRVTFQPCGWQWNQDTPLNSEYDFALVNIGRLEAVSGLSRVQLLRPGSLHKFIPEEILIHGRDFRLLRVGFEAGGLEPQAFQVTMAIVQARAQSNQAQQYSGITLSKAGQGSGSRKPPIPLMETAEDWETERKKQAARGWRVSTVNERFDVATSLPRYFWVPNRILDSEVRRAFGHFHQGRGPVSVMVRVMAVD

SEQ ID NO: 907763 - protein, 368 aa, Homo sapiens
KFPRRLLRLGWTHLSKGLEPELSGTLICTNFRVTFQPCGWQWNQDTPLNSEYDFALVNIGRLEAVSGLSRVQLLRPGSLHKFIPEEILIHGRDFRLLRVGFEAGGLEPQAFQVTMAIVQARAQSNQAQQYSGITLSKAGQGSGSRKPPIPLMETAEDWETERKKQAARGWRVSTVNERFDVATSLPRYFWVPNRILDSEVRRAFGHFHQGRGPRLSWHHPGGSDLLRCGGFYTASDPNKEDIRAVELMLQAGHSDVVLVDTMDELPSLADVQLAHLRLRALCLPDSSVAEDKWLSALEGTRWLDYVRACLRKASDISVLVTSRVRSVILQAAFSPRSPNTVWLPITSTARVGGSWTSLPDSAWGNWGQ

SEQ ID NO: 907764 - protein, 224 aa, Homo sapiens
KFPRRLLRLGWTHLSKGLEPELSGTLICTNFRVTFQPCGWQWNQDTPLNSEYDFALVNIGRLEAVSGLSRVQLLRPGSLHKFIPEEILIHGRDFRLLRVGFEAGGLEPQAFQVTMAIVQARAQSNQAQQYSGITLSKAGQGSGSRKPPIPLMETAEDWETERKKQAARGWRVSTVNERFDVATSLPRYFWVPNRILDSEVRRAFGHFHQGRGPVSVMVRVMAVD

SEQ ID NO: 907765 - protein, 637 aa, Homo sapiens
MPPRVTFQPCGWQWNQDTPLNSEYDFALVNIGRLEAVSGLSRVQLLRPGSLHKFIPEEILIHGRDFRLLRVGFEAGGLEPQAFQVTMAIVQARAQSNQAQQYSGITLSKAGQGSGSRKPPIPLMETAEDWETERKKQAARGWRVSTVNERFDVATSLPRYFWVPNRILDSEVRRAFGHFHQGRGPRLSWHHPGGSDLLRCGGFYTASDPNKEDIRAVELMLQAGHSDVVLVDTMDELPSLADVQLAHLRLRALCLPDSSVAEDKWLSALEGTRWLDYVRACLRKASDISVLVTSRVRSVILQERGDRDLNGLLSSLVQLLSAPEARTLFGFQSLVQREWVAAGHPFLTRLGGTGASEEAPVFLLFLDCVWQLLQQFPADFEFSEFFLLALHDSVRVPDTLTFLRNTPWERGKQSGQLNSYTQVYTPGYSQPPAGNSFNLQLSVWDWDLRYSNAQILQFQNPGYDPEHCPDSWLPRPQPSFMVPGPPSSVWLFSRGALTPLNQLCPWRDSPSLLAVSSRWLPRPAISSESLADQEWGLPSHWGACPLPPGLLLPGYLGPQIRLWRRCYLRGRPEVQMGLSSPTISGLQDELSHLQELLRKWTPRISPEDHSKKRDPHTILNPTEIAGILKGRAEGDLG

SEQ ID NO: 907766 - protein, 118 aa, Homo sapiens [sequence omitted]

SEQ ID NO: 907767 - protein, 340 aa, Homo sapiens
MPPRVTFQPCGWQWNQDTPLNSEYDFALVNIGRLEAVSGLSRVQLLRPGSLHKFIPEEILIHGRDFRLLRVGFEAGGLEPQAFQVTMAIVQARAQSNQAQQYSGITLSKAGQGSGSRKPPIPLMETAEDWETERKKQAARGWRVSTVNERFDVATSLPRYFWVPNRILDSEVRRAFGHFHQGRGPRLSWHHPGGSDLLRCGGFYTASDPNKEDIRAVELMLQAGHSDVVLVDTMDELPSLADVQLAHLRLRALCLPDSSVAEDKWLSALEGTRWLDYVRACLRKASDISVLVTSRVRSVILQAAFSPRSPNTVWLPITSTARVGGSWTSLPDSAWGNWGQ

SEQ ID NO: 907768 - protein, 252 aa, Homo sapiens
MGSVQENRMPEPRSRQPSSCLASRCLPGEQILAWAPGVRKGLEPELSGTLICTNFRVTFQPCGWQWNQDTPLNSEYDFALVNIGRLEAVSGLSRVQLLRPGSLHKFIPEEILIHGRDFRLLRVGFEAGGLEPQAFQVTMAIVQARAQSNQAQQYSGITLSKAGQGSGSRKPPIPLMETAEDWETERKKQAARGWRVSTVNERFDVATRLRCFSSSLIVSGSSSSSFQLILNSLSFSFLLFMTVSGFLTPLPS

SEQ ID NO: 907769 - protein, 340 aa, Homo sapiens; identical to SEQ ID NO: 907767

SEQ ID NO: 907770 - protein, 254 aa, Homo sapiens
MAIVQARAQSNQAQQYSGITLSKAGQGSGSRKPPIPLMETAEDWETERKKQAARGWRVSTVNERFDVATSLPRYFWVPNRILDSEVRRAFGHFHQGRGPRLSWHHPGGSDLLRCGGFYTASDPNKEDIRAVELMLQAGHSDVVLVDTMDELPSLADVQLAHLRLRALCLPDSSVAEDKWLSALEGTRWLDYVRACLRKASDISVLVTSRVRSVILQAAFSPRSPNTVWLPITSTARVGGSWTSLPDSAWGNWGQ

SEQ ID NO: 907771 - protein, 334 aa, Homo sapiens
FYVLSQSSYPKPFPSVPLTSPCRISLLILFCPSFLDPSSLSLLPLYHPERGDRDLNGLLSSLVQLLSAPEARTLFGFQSLVQREWVAAGHPFLTRLGGTGASEEAPVFLLFLDCVWQLLQQFPADFEFSEFFLLALHDSVRVPDTLTFLRNTPWERGKQSGQLNSYTQVYTPGYSQPPAGNSFNLQLSVWDWDLRYSNAQILQFQNPGYDPEHCPDSWLPRPQPSFMVPGPPSSVWLFSRGALTPLNQLCPWRDSPSLLAVSSRWLPRPAISSESLADQEWGLPSHWGACPLPPGLLLPGYLGPQIRLWRRCYLRGRPEVQVRRENRLGVGQGT

SEQ ID NO: 907772 - protein, 108 aa, Homo sapiens [sequence omitted]

SEQ ID NO: 907773 - protein, 340 aa, Homo sapiens; identical to SEQ ID NO: 907767

SEQ ID NO: 907774 - protein, 183 aa, Homo sapiens
MTKSNGEEPKMGGRMERFQQGVRKRTLLAKKKVQNITKEDVKSYLFRNAFVLLTVTAVIVGTILGFTLRPYRMSYREVKYFSFPGELLMRMLQMLVLPLIISSLVTGMAALDSKASGKMGMRAVVYYMTTTIIAVVIGIIIVIIIHPGKGTKENMHREGKIVRVTAADAFLDLIRNMFPSKIW

SEQ ID NO: 907775 - protein, 153 aa, Homo sapiens
ALQDRILCSMTMRKPFIPAWEKVKESFVYVIGEQMERFQQGVRKRTLLAKKKVQNITKEDVKSYLFRNAFVLLTVTAVIVGTILGFTLRPYRMSYREVKYFSFPGELLMRMLQMLVLPLIISSLVTGTISSCWFVWFFLSVFIAKDCLEKPVL

SEQ ID NO: 907776 - protein, 524 aa, Homo sapiens
MTKSNGEEPKMGGRMERFQQGVRKRTLLAKKKVQNITKEDVKSTILGFTLRPYRMSYREVKYFSFPGELLMRMLQMLVLPLIISSLVTGMAALDSKASGKMGMRAVVYYMTTTIIAVVIGIIIVIIIHPGKGTKENMHREGKIVRVTAADAFLDLIRNMFPPNLVEACFKQFKTNYEKRSFKVPIQANETLVGAVINNVSEAMETLTRITEELVPVPGSVNGVNALGLVVFSMCFGFVIGNMKEQGQALREFFDSLNEAIMRLVAVIMWYAPVGILFLIAGKIVEMEDMGVIGGQLAMYTVTVIVGLLIHAVIVLPLLYFLVTRKNPWVFIGGLLQALITALGTSSSSATLPITFKCLEENNGVDKRVTRFVLPVGATINMDGTALYEALAAIFIAQVNNFELNFGQIITISITATAASIGAAGIPQAGLVTMVIVLTSVGLPTDDITLIIAVDWFLDRLRTTTNVLGDSLGAGIVEHLSRHELKNRDVEMGNSVIEENEMKKPYQLIAQDNETEKPIDSETKM

SEQ ID NO: 907777 - protein, 145 aa, Homo sapiens
MTKSNGEEPKMGGRMERFQQGVRKRTLLAKKKVQNITKEDVKSTILGFTLRPYRMSYREVKYFSFPGELLMRMLQMLVLPLIISSLVTGMAALDSKASGKMGMRAVVYYMTTTIIAVVIGIIIVIIIHPGKGTKENMHREGKIVR

SEQ ID NO: 907778 - protein, 542 aa, Homo sapiens
MTKSNGEEPKMGGRMERFQQGVRKRTLLAKKKVQNITKEDVKSYLFRNAFVLLTVTAVIVGTILGFTLRPYRMSYREVKYFSFPGELLMRMLQMLVLPLIISSLVTGMAALDSKASGKMGMRAVVYYMTTTIIAVVIGIIIVIIIHPGKGTKENMHREGKIVRVTAADAFLDLIRNMFPPNLVEACFKQFKTNYEKRSFKVPIQANETLVGAVINNVSEAMETLTRITEELVPVPGSVNGVNALGLVVFSMCFGFVIGNMKEQGQALREFFDSLNEAIMRLVAVIMWYAPVGILFLIAGKIVEMEDMGVIGGQLAMYTVTVIVGLLIHAVIVLPLLYFLVTRKNPWVFIGGLLQALITALGTSSSSATLPITFKCLEENNGVDKRVTRFVLPVGATINMDGTALYEALAAIFIAQVNNFELNFGQIITISITATAASIGAAGIPQAGLVTMVIVLTSVGLPTDDITLIIAVDWFLDRLRTTTNVLGDSLGAGIVEHLSRHELKNRDVEMGNSVIEENEMKKPYQLIAQDNETEKPIDSETKM

SEQ ID NO: 907779 - protein, 173 aa, Homo sapiens
MTKSNGEEPKMGGRMERFQQGVRKRTLLAKKKVQNITKEDVKSYLFRNAFVLLTVTAVIVGTILGFTLRPYRMSYREVKYFSFPGELLMRMLQMLVLPLIISSLVTGMAALDSKASGKMGMRAVVYYMTTTIIAVVIGIIIVIIIHPGKGTMAGCLFLVVPGSCEQVPVFQLS

SEQ ID NO: 907780 - protein, 542 aa, Homo sapiens; identical to SEQ ID NO: 907778

SEQ ID NO: 907781 - protein, 129 aa, Homo sapiens
MTKSNGEEPKMGGRMERFQQGVRKRTLLAKKKVQNITKEDVKSYLFRNAFVLLTVTAVIVGTILGFTLRPYRMSYREVKYFSFPGELLMRMLQMLVLPLIISSLVTDNIWLDSLLAIDARMLVLRTTRT

SEQ ID NO: 907782 - protein, 559 aa, Homo sapiens
SGSRRVSRARRWRGRLGRSCPRSAPAAPLAATATWARSLHDLARRLWAGAPPDRSSEIQVFKMKFLLTTAFLILISLWVEEAYSKEKSSKKGKGKKKQYLCPSQQSAEDLARVPANSTSNILNRLLVSYDPRIRPNFKGIPVDVVVNIFINSFGSIQETTMDYRVNIFLRQKWNDPRLKLPSDFRGSDALTVDPTMYKCLWKPDLFFANEKSANFHDVTQENILLFIFRDGDVLVSMRLSITLSCPLDLTLFPMDTQRCKMQLESFGYTTDDLRFIWQSGDPVQLEKIALPQFDIKKEDIEYGNCTKYYKGTGYYTCVEVIFTLRRQVGFYMMGVYAPTLLIVVLSWLSFWINPDASAARVPLGIFSVLSLASECTTLAAELPKVSYVKALDVWLIACLLFGFASLVEYAVVQVMLNNPKRVEAEKARIAKAEQADGKGGNVAKKNTVNGTGTPVHISTLQVGETRCKKVCTSKSDLRSNDFSIVGSLPRDFELSNYDCYGKPIEVNNGLGKSQAKNNKKPPPAKPVIPTAAKRIDLYARALFPFCFLFFNVIYWSIYL

SEQ ID NO: 907783 - protein, 559 aa, Homo sapiens; identical to SEQ ID NO: 907782

SEQ ID NO: 907784 - protein, 365 aa, Homo sapiens
SGSRRVSRARRWRGRLGRSCPRSAPAAPLAATATWARSLHDLARRLWAGAPPDRSSEIQVFKMKFLLTTAFLILISLWVEEAYSKEKSSKKGKGKKKQYLCPSQQSAEDLARVPANSTSNILNRLLVSYDPRIRPNFKGIPVDVVVNIFINSFGSIQETTMDYRVNIFLRQKWNDPRLKLPSDFRGSDALTVDPTMYKCLWKPDLFFANEKSANFHDVTQENILLFIFRDGDVLVSMRLSITLSCPLDLTLFPMDTQRCKMQLESFGYTTDDLRFIWQSGDPVQLEKIALPQFDIKKEDIEYGNCTKYYKGTGYYTCVEVIFTLRRQVGFYMMGVYAPTLLIVVLSWLSFWINPDASAARVPLGW

SEQ ID NO: 907785 - protein, 118 aa, Homo sapiens
SGSRRVSRARRWRGRLGRSCPRSAPAAPLAATATWARSLHDLARRLWAGAPPDRSSEIQVFKMKFLLTTAFLILISLWVEEAYSKEKSSKKGKGKKKQYLCPSLVRPDAKKFVLLSLI

SEQ ID NO: 907786 - protein, 552 aa, Homo sapiens
ALRRAREDARCPARERGAGRLAAAAGSPLRWRPRRRSGWRDAEGRDRSSEIQVFKMKFLLTTAFLILISLWVEEAYSKEKSSKKGKGKKKQYLCPSQQSAEDLARVPANSTSNILNRLLVSYDPRIRPNFKGIPVDVVVNIFINSFGSIQETTMDYRVNIFLRQKWNDPRLKLPSDFRGSDALTVDPTMYKCLWKPDLFFANEKSANFHDVTQENILLFIFRDGDVLVSMRLSITLSCPLDLTLFPMDTQRCKMQLESFGYTTDDLRFIWQSGDPVQLEKIALPQFDIKKEDIEYGNCTKYYKGTGYYTCVEVIFTLRRQVGFYMMGVYAPTLLIVVLSWLSFWINPDASAARVPLGIFSVLSLASECTTLAAELPKVSYVKALDVWLIACLLFGFASLVEYAVVQVMLNNPKRVEAEKARIAKAEQADGKGGNVAKKNTVNGTGTPVHISTLQVGETRCKKVCTSKSDLRSNDFSIVGSLPRDFELSNYDCYGKPIEVNNGLGKSQAKNNKKPPPAKPVIPTAAKRIDLYARALFPFCFLFFNVIYWSIYL

SEQ ID NO: 907787 - protein, 432 aa, Homo sapiens
FVPLIIVTLFVLGPNKFLKIAINIHMCTHVLFLQDYRVNIFLRQKWNDPRLKLPSDFRGSDALTVDPTMYKCLWKPDLFFANEKSANFHDVTQENILLFIFRDGDVLVSMRLSITLSCPLDLTLFPMDTQRCKMQLESFGYTTDDLRFIWQSGDPVQLEKIALPQFDIKKEDIEYGNCTKYYKGTGYYTCVEVIFTLRRQVGFYMMGVYAPTLLIVVLSWLSFWINPDASAARVPLGIFSVLSLASECTTLAAELPKVSYVKALDVWLIACLLFGFASLVEYAVVQVMLNNPKRVEAEKARIAKAEQADGKGGNVAKKNTVNGTGTPVHISTLQVGETRCKKVCTSKSDLRSNDFSIVGSLPRDFELSNYDCYGKPIEVNNGLGKSQAKNNKKPPPAKPVIPTAAKRIDLYARALFPFCFLFFNVIYWSIYL

SEQ ID NO: 907788 - protein, 382 aa, Homo sapiens
MGAFLDKPKMEKHNAQGQGNGLRYGLSSMQGWRVEMEDAHTAVIGLPSGLESWSFFAVYDGHAGSQVAKYCCEHLLDHITNNQDFKGSAGAPSVENVKNGIRTGFLEIDEHMRVMSEKKHGADRSGSTAVGVLISPQHTYFINCGDSRGLLCRNRKVHFFTQDHKPSNPLEKERIQNAGGSVMIQRVNGSLAVSRALGDFDYKCVHGKGPTEQLVSPEPEVHDIERSEEDDQFIILACDGIWDVMGNEELCDFVRSRLEVTDDLEKVCNEVVDTCLYKGSRDNMSVILICFPNAPKVSPEAVKKEAELDKYLECRVEEIIKKQGEGVPDLVHVMRTLASENIPSLPPGGELASKRNVIEAVYNRLNPYKNDDTDSTSTDDMW

SEQ ID NO: 907789 - protein, 324 aa, Homo sapiens
MGAFLDKPKMEKHNAQGQGNGLRYGLSSMQGWRVEMEDAHTAVIGLPSGLESWSFFAVYDGHAGSQVAKYCCEHLLDHITNNQDFKGSAGAPSVENVKNGIRTGFLEIDEHMRVMSEKKHGADRSGSTAVGVLISPQHTYFINCGDSRGLLCRNRKVHFFTQDHKPSNPLEKERIQNAGGSVMIQRVNGSLAVSRALGDFDYKCVHGKGPTEQLVSPEPEVHDIERSEEDDQFIILACDGIWDVMGNEELCDFVRSRLEVTDDLEKVCNEVVDTCLYKGSRDNMSVILICFPNAPKVSPEAVKKEAELDKYLECRVEGGSFNKK

SEQ ID NO: 907790 - protein, 382 aa, Homo sapiens; identical to SEQ ID NO: 907788

SEQ ID NO: 907791 - protein, 382 aa, Homo sapiens; identical to SEQ ID NO: 907788

SEQ ID NO: 907792 - protein, 354 aa, Homo sapiens
MGAFLDKPKMEKHNAQGQGNGLRYGLSSMQGWRVEMEDAHTAVIGLPSGLESWSFFAVYDGHAGSQVAKYCCEHLLDHITNNQDFKGSAGAPSVENVKNGIRTGFLEIDEHMRVMSEKKHGADRSGSTAVGVLISPQHTYFINCGDSRGLLCRNRKVHFFTQDHKPSNPLEKERIQNAGGSVMIQRVNGSLAVSRALGDFDYKCVHGKGPTEQLVSPEPEVHDIERSEEDDQFIILACDGIWDVMGNEELCDFVRSRLEVTDDLEKVCNEVVDTCLYKGSRDNMSVILICFPNAPKVSPEAVKKEAELDKYLECRVEEIIKKQGEGVPDLVHVMRTLASENIPSLPPGGELASK

SEQ ID NO: 907793 - protein, 455 aa, Homo sapiens
MFCSGRKWVAEATICTKLMKREKRRMGKRRAKKAKREEKKKGGERRRNEKRGNQMKRMCERKKYETDLEDQDIMGAFLDKPKMEKHNAQGQGNGLRYGLSSMQGWRVEMEDAHTAVIGLPSGLESWSFFAVYDGHAGSQVAKYCCEHLLDHITNNQDFKGSAGAPSVENVKNGIRTGFLEIDEHMRVMSEKKHGADRSGSTAVGVLISPQHTYFINCGDSRGLLCRNRKVHFFTQDHKPSNPLEKERIQNAGGSVMIQRVNGSLAVSRALGDFDYKCVHGKGPTEQLVSPEPEVHDIERSEEDDQFIILACDGIWDVMGNEELCDFVRSRLEVTDDLEKVCNEVVDTCLYKGSRDNMSVILICFPNAPKVSPEAVKKEAELDKYLECRVEEIIKKQGEGVPDLVHVMRTLASENIPSLPPGGELASKRNVIEAVYNRLNPYKNDDTDSTSTDDMW

SEQ ID NO: 907794 - protein, 382 aa, Homo sapiens; identical to SEQ ID NO: 907788

SEQ ID NO: 907795 - protein, 382 aa, Homo sapiens; identical to SEQ ID NO: 907788

SEQ ID NO: 907796 - protein, 159 aa, Homo sapiens
MALETICRPSGRKSSKMQAFRIWDVNQKTFYLRNNQLVAGYLQGPNVNLEEKIDVVPIEPHALFLGIHGGKMCLSCVKSGDETRLQLEAVNITDLSENRKQDKRFAFIRSDSGPTTSFESAACPGWFLCTAMEADQPVSLTNMPDEGVMVTKFYFQEDE

SEQ ID NO: 907797 - protein, 159 aa, Homo sapiens; identical to SEQ ID NO: 907796

SEQ ID NO: 907798 - protein, 180 aa, Homo sapiens
MALADLYEEGGGGGGEGEDNADSKETICRPSGRKSSKMQAFRIWDVNQKTFYLRNNQLVAGYLQGPNVNLEEKIDVVPIEPHALFLGIHGGKMCLSCVKSGDETRLQLEAVNITDLSENRKQDKRFAFIRSDSGPTTSFESAACPGWFLCTAMEADQPVSLTNMPDEGVMVTKFYFQEDE

SEQ ID NO: 907799 - protein, 143 aa, Homo sapiens
MQAFRIWDVNQKTFYLRNNQLVAGYLQGPNVNLEEKIDVVPIEPHALFLGIHGGKMCLSCVKSGDETRLQLEAVNITDLSENRKQDKRFAFIRSDSGPTTSFESAACPGWFLCTAMEADQPVSLTNMPDEGVMVTKFYFQEDE

SEQ ID NO: 907800 - protein, 94 aa, Homo sapiens
YGHATARREEAGRAVGERPDPAEAVNITDLSENRKQDKRFAFIRSDSGPTTSFESAACPGWFLCTAMEADQPVSLTNMPDEGVMVTKFYFQEDE

SEQ ID NO: 907801 - protein, 159 aa, Homo sapiens; identical to SEQ ID NO: 907796

SEQ ID NO: 907802 - protein, 177 aa, Homo sapiens
MEICRGLRSHLITLLLFLFHSETICRPSGRKSSKMQAFRIWDVNQKTFYLRNNQLVAGYLQGPNVNLEEKIDVVPIEPHALFLGIHGGKMCLSCVKSGDETRLQLEAVNITDLSENRKQDKRFAFIRSDSGPTTSFESAACPGWFLCTAMEADQPVSLTNMPDEGVMVTKFYFQEDE

SEQ ID NO: 907803 - protein, 143 aa, Homo sapiens; identical to SEQ ID NO: 907799

SEQ ID NO: 907804 - protein, 143 aa, Homo sapiens; identical to SEQ ID NO: 907799

SEQ ID NO: 907805 - protein, 119 aa, Homo sapiens
FLYKPQLWARNGSPLPCCSHRMEICRGLRSHLITLLLFLFHSETICRPSGRKSSKMQAFRIWDVNQKTFYLRNNQLVAGYLQGPNVNLEGEWLPGKPMYVGITSLCPSVCSSMACLHKP

SEQ ID NO: 907806 - protein, 159 aa, Homo sapiens; identical to SEQ ID NO: 907796

SEQ ID NO: 907807 - protein, 930 aa, Homo sapiens
MPRAPHFMPLLLLLLLLSLPHTQAAFPQDPLPLLISDLQGTSPLSWFRGLEDDAVAAELGLDFQRFLTLNRTLLVAARDHVFSFDLQAEEEGEGLVPNKYLTWRSQDVENCAVRGKLTDECYNYIRVLVPWDSQTLLACGTNSFSPVCRSYGITSLQQEGEELSGQARCPFDATQSNVAIFAEGSLYSATAADFQASDAVVYRSLGPQPPLRSAKYDSKWLREPHFVQALEHGDHVYFFFREVSVEDARLGRVQFSRVARVCKRDMGGSPRALDRHWTSFLKLRLNCSVPGDSTFYFDVLQALTGPVNLHGRSALFGVFTTQTNSIPGSAVCAFYLDEIERGFEGKFKEQRSLDGAWTPVSEDRVPSPRPGSCAGVGGAALFSSSRDLPDDVLTFIKAHPLLDPAVPPVTHQPLLTLTSRALLTQVAVDGMAGPHSNITVMFLGSNDGTVLKVLTPGGRSGGPEPILLEEIDAYSPARCSGKRTAQTARRIIGLELDTEGHRLFVAFSGCIVYLPLSRCARHGACQRSCLASQDPYCGWHSSRGCVDIRGSGGTDVDQAGNQESMEHGDCQDGATGSQSGPGDSAYGVRRDLPPASASRSVPIPLLLASVAAAFALGASVSGLLVSCACRRAHRRRGKDIETPGLPRPLSLRSLARLHGGGPEPPPPSKDGDAVQTPQLYTTFLPPPEGVPPPELACLPTPESTPELPVKHLRAAGDPWEWNQNRNNAKEGPGRSRGGHAAGGPAPRVLVRPPPPGCPGQAVEVTTLEELLRYLHGPQPPRKGAEPPAPLTSRALPPEPAPALLGGPSPRPHECASPLRLDVPPEGRCASAPARPALSAPAPRLGVGGGRRLPFSGHRAPPALLTRVPSGGPSRYSGGPGKHLLYLGRPEGYRGRALKRVDVEKPQLSLKPPLVGPSSRQAVPNGGRFNF

SEQ ID NO: 907808 - protein, 879 aa, Homo sapiens
MPRAPHFMPLLLLLLLLSLPHTQAAFPQDPLPLLISDLQGTSPLSWFRGLEDDAVAAELGLDFQRFLTLNRTLLVAARDHVFSFDLQAEEEGEGLVPNKYLTWRSQDVENCAVRGKLTDECYNYIRVLVPWDSQTLLACGTNSFSPVCRSYGITSLQQEGEELSGQARCPFDATQSNVAIFAEGSLYSATAADFQASDAVVYRSLGPQPPLRSAKYDSKWLREPHFVQALEHGDHVYFFFREVSVEDARLGRVQFSRVARVCKRDMGGSPRALDRHWTSFLKLRLNCSVPGDSTFYFDVLQALTGPVNLHGRSALFGVFTTQTNSIPGSAVCAFYLDEIERGFEGKFKEQRSLDGAWTPVSEDRVPSPRPGSCAGVGGAALFSSSRDLPDDVLTFIKAHPLLDPAVPPVTHQPLLTLTSRALLTQVAVDGMAGPHSNITVMFLGSNDGTVLKVLTPGGRSGGPEPILLEEIDAYSPARCSGKRTAQTARRIIGLELDTEGHRLFVAFSGCIVYLPLSRCARHGACQRSCLASQDPYCGWHSSRGCVDIRGSGGTDVDQAGNQESMEHGDCQDGATGSQSGPGDSAYGVRRDLPPASASRSVPIPLLLASVAAAFALGASVSGLLVSCACRRAHRRRGKDIETPGLPRPLSLRSLARLHGGGPEPPPPSKDGDAVQTPQLYTTFLPPPEGVPPPELACLPTPESTPELPVKHLRAAGDPWEWNQNRNNAKEGPGRSRGGHAAGGPAPRVLVRPPPPGCPGQAVEVTTLEELLRYLHGPQPPRKGAEPPAPLTSRALPPEPAPALLGGPSPRPHECASPLRLDVPPEGRERSTASSVGSARVLSATSWTLFRTFHRPLAPHLQPSRLAESPEAPFRLGFIY

SEQ ID NO: 907809 - protein, 615 aa, Homo sapiens
MPRAPHFMPLLLLLLLLSLPHTQAAFPQDPLPLLISDLQGTSPLSWFRGLEDDAVAAELGLDFQRFLTLNRTLLVAARDHVFSFDLQAEEEGEGLVPNKYLTWRSQDVENCAVRGKLTDECYNYIRVLVPWDSQTLLACGTNSFSPVCRSYGITSLQQEGEELSGQARCPFDATQSNVAIFAEGSLYSATAADFQASDAVVYRSLGPQPPLRSAKYDSKWLREPHFVQALEHGDHVYFFFREVSVEDARLGRVQFSRVARVCKRDMGGSPRALDRHWTSFLKLRLNCSVPGDSTFYFDVLQALTGPVNLHGRSALFGVFTTQTNSIPGSAVCAFYLDEIERGFEGKFKEQRSLDGAWTPVSEDRVPSPRPGSCAGVGGAALFSSSRDLPDDVLTFIKAHPLLDPAVPPVTHQPLLTLTSRALLTQVAVDGMAGPHSNITVMFLGSNDGTVLKVLTPGGRSGGPEPILLEEIDAYSPARCSGKRTAQTARRIIGLELDTEGHRLFVAFSGCIVYLPLSRCARHGACQRSCLASQDPYCGWHSSRGCVDIRGSGGTDVDQAGNQESMEHGDCQDGATGSQSGPGDSAYGESSCPNLTFPCSAHIPECVSCSSSRAAF

SEQ ID NO: 907810 - protein, 930 aa, Homo sapiens; identical to SEQ ID NO: 907807

SEQ ID NO: 907811 - protein, 611 aa, Homo sapiens
MPRAPHFMPLLLLLLLLSLPHTQAAFPQDPLPLLISDLQGTSPLSWFRGLEDDAVAAELGLDFQRFLTLNRTLLVAARDHVFSFDLQAEEEGEGLVPNKYLTWRSQDVENCAVRGKLTDECYNYIRVLVPWDSQTLLACGTNSFSPVCRSYGITSLQQEGEELSGQARCPFDATQSNVAIFAEGSLYSATAADFQASDAVVYRSLGPQPPLRSAKYDSKWLREPHFVQALEHGDHVYFFFREVSVEDARLGRVQFSRVARVCKRDMGGSPRALDRHWTSFLKLRLNCSVPGDSTFYFDVLQALTGPVNLHGRSALFGVFTTQTNSIPGSAVCAFYLDEIERGFEGKFKEQRSLDGAWTPVSEDRVPSPRPGSCAGVGGAALFSSSRDLPDDVLTFIKAHPLLDPAVPPVTHQPLLTLTSRALLTQVAVDGMAGPHSNITVMFLGSNDGTVLKVLTPGGRSGGPEPILLEEIDAYSPARCSGKRTAQTARRIIGLELDTEGHRLFVAFSGCIVYLPLSRCARHGACQRSCLASQDPYCGWHSSRGCVDIRGSGGTDVDQAGNQESMEHGDCQDGATGSQSGPGDSAYGVRRDLPPASASRSGPAGGQSGKVS

SEQ ID NO: 907812 - protein, 614 aa, Homo sapiens
MPRAPHFMPLLLLLLLLSLPHTQAAFPQDPLPLLISDLQGTSPLSWFRGLEDDAVAAELGLDFQRFLTLNRTLLVAARDHVFSFDLQAEEEGEGLVPNKYLTWRSQDVENCAVRGKLTDECYNYIRVLVPWDSQTLLACGTNSFSPVCRSYGITSLQQEGEELSGQARCPFDATQSNVAIFAEGSLYSATAADFQASDAVVYRSLGPQPPLRSAKYDSKWLREPHFVQALEHGDHVYFFFREVSVEDARLGRVQFSRVARVCKRDMGGSPRALDRHWTSFLKLRLNCSVPGDSTFYFDVLQALTGPVNLHGRSALFGVFTTQTNSIPGSAVCAFYLDEIERGFEGKFKEQRSLDGAWTPVSEDRVPSPRPGSCAGVGGAALFSSSRDLPDDVLTFIKAHPLLDPAVPPVTHQPLLTLTSRALLTQVAVDGMAGPHSNITVMFLGSNDGTVLKVLTPGGRSGGPEPILLEEIDAYSPARCSGKRTAQTARRIIGLELDTEGHRLFVAFSGCIVYLPLSRCARHGACQRSCLASQDPYCGWHSSRGCVDIRGSGGTDVDQAGNQESMEHGDCQGKQKRQLLLQPKLHMAMMATDTIPGLAFCPSLLLWHSHPISSS

SEQ ID NO: 907813 - protein, 399 aa, Homo sapiens
MARRFQEELAAFLFEYDTPRMVLVRNKKVGVIFRLIQLVVLVYVIGWVFLYEKGYQTSSGLISSVSVKLKGLAVTQLPGLGPQVWDVADYVFPAQGDNSFVVMTNFIVTPKQTQGYCAEHPEGGICKEDSGCTPGKAKRKAQGIRTGKCVAFNDTVKTCEIFGWCPVEVDDDIPRPALLREAENFTLFIKNSISFPRFKVNRRNLVEEVNAAHMKTCLFHKTLHPLCPVFQLGYVVQESGQNFSTLAEKGGVVGITIDWHCDLDWHVRHCRPIYEFHGLYEEKNLSPGFNFRFARHFVENGTNYRHLFKVFGIRFDILVDGKAGKFDIIPTMTTIGSGIGIFGVATVLCDLLLLHILPKRHYYKQKKFKYAEDMGPGAAERDLAATSSTLGLQENMRTS

SEQ ID NO: 907814 - protein, 399 aa, Homo sapiens; identical to SEQ ID NO: 907813

SEQ ID NO: 907815 - protein, 175 aa, Homo sapiens
MARRFQEELAAFLFEYDTPRMVLVRNKKVGVIFRLIQLVVLVYVIGWVFLYEKGYQTSSGLISSVSVKLKGLAVTQLPGLGPQVWDVADYVFPAQGDNSFVVMTNFIVTPKQTQGYCAEHPEGGICKEDSGCTPGKAKRKAQGIRTGKCVAFNDTVKTCEIFGWCPVEVDDDIPR

SEQ ID NO: 907816 - protein, 160 aa, Homo sapiens
RRGLSQSMFAVEPQPLATPKMPIPEPMVVIVGMMSNFPAWGRTELGWNHLGPLRVLQGLIHPPGNWPPVRSDPARASPPGTEVGCGGLRTHPRIPTLSPCPSLTQATVLCDLLLLHILPKRHYYKQKKFKYAEDMGPGAAERDLAATSSTLGLQENMRTS

SEQ ID NO: 907817 - protein, 145 aa, Homo sapiens
MATWALLLLAAMLLGNPGLVFSRLSPEYYDLARAHLRDEEKSCPCLAQEGPQGDLLTKTQELGRDYRTCLTIVQKLKKMVDKPTQRSVSNAATRVCRTGRSRWRDVCRNFMRRYQSRVTQGLVAGETAQQICEDLRLCIPSTGPL

SEQ ID NO: 907818 - protein, 130 aa, Homo sapiens
MEGLVFSRLSPEYYDLARAHLRDEEKSCPCLAQEGPQGDLLTKTQELGRDYRTCLTIVQKLKKMVDKPTQRSVSNAATRVCRTGRSRWRDVCRNFMRRYQSRVTQGLVAGETAQQICEDLRLCIPSTGPL

SEQ ID NO: 907819 - protein, 130 aa, Homo sapiens; identical to SEQ ID NO: 907818

SEQ ID NO: 907820 - protein, 116 aa, Homo sapiens
MEGLVFSRLSPEYYDLARAHLRDEEKSCPCLAQEGPQGDLLTKTQELGRDYRTCLTIVQKLKKMVDKPTQDLTLRPRLECTGVILAHCNLSSLAQAILLSKPPEYLGLQVCATMPS

SEQ ID NO: 907821 - protein, 116 aa, Homo sapiens; identical to SEQ ID NO: 907820

SEQ ID NO: 907822 - protein, 162 aa, Homo sapiens
MATWALLLLAAMLLGNPGLVFSRLSPEYYDLARAHLRDEEKSCPCLAQEGPQGDLLTKTQELGRDYRTCLTIVQKLKKMVDKPTQRSVSNAATRVCRTGRSRWRDVCRNFMRRYQSRVTQGLVAGETAQQICEDLRLCIPSTGPNNLLRLPTGFQDVPLGPL

SEQ ID NO: 907823 - protein, 104 aa, Homo sapiens
MATWALLLLAAMLLGNPGLVFSRLSPEYYDLARAHLRDEEKSCPCLAQEGPQGDLLTKTQELGRDYRTCLTIVQKLKKMVDKPTQVRPRGYRASCLLLNGGASL

SEQ ID NO: 907824 - protein, 131 aa, Homo sapiens
MWTGLVFSRLSPEYYDLARAHLRDEEKSCPCLAQEGPQGDLLTKTQELGRDYRTCLTIVQKLKKMVDKPTQRSVSNAATRVCRTGRSRWRDVCRNFMRRYQSRVTQGLVAGETAQQICEDLRLCIPSTGPL

SEQ ID NO: 907825 - protein, 130 aa, Homo sapiens
MGTRCQLLAPSTPIARAAGTCRVAELGRTHPITMSTVVLLLQRSVSNAATRVCRTGRSRWRDVCRNFMRRYQSRVTQGLVAGETAQQICEDLRLCIPSTGPTTCSGCRLASRMCLWVCSVGSGGSGTLSK

SEQ ID NO: 907826 - protein, 102 aa, Homo sapiens
MGTRCQLLAPSTPIARAAGTCRVAELGRTHPITMSTVVLLLQRSVSNAATRVCRTGRSRWRDVCRNFMRRYQSRVTQGLVAGETAQQICEDLRLCIPSTGPL

SEQ ID NO: 907827 - protein, 111 aa, Homo sapiens [sequence omitted]

SEQ ID NO: 907828 - protein, 183 aa, Homo sapiens [sequence omitted]

SEQ ID NO: 907829 - protein, 308 aa, Homo sapiens
MATFISFSRRGIGAKTKGGSDIHCLVQVVLQGSRASVRQQHDNSLKFLGYCPQENSLWPKLTMKEHLELYAAVKGLGKEDAALSISRLVEALKLQEQLKAPVKTLSEGIKRKLCFVLSILGNPSVVLLDEPFTGMDPEGQQQMWQILQATVKNKERGTLLTTHYMSEAEAVCDRMAMMVSGTLRCIGSIQHLKNKFGRDYLLEIKMKEPTQVEALHTEILKLFPQAAWQERYSSLMAYKLPVEDVHPLSRAFFKLEAMKQTFNLEEYSLSQATLEQVFLELCKEQELGNVDDKIDTTVEWKLLPQEDP

SEQ ID NO: 907830 - protein, 308 aa, Homo sapiens; identical to SEQ ID NO: 907829

SEQ ID NO: 907831 - protein, 215 aa, Homo sapiens
RGFPVHPWLGADGLFLALQLCFVLSILGNPSVVLLDEPFTGMDPEGQQQMWQILQATVKNKERGTLLTTHYMSEAEAVCDRMAMMVSGTLRCIGSIQHLKNKFGRDYLLEIKMKEPTQVEALHTEILKLFPQAAWQERYSSLMAYKLPVEDVHPLSRAFFKLEAMKQTFNLEEYSLSQATLEQVFLELCKEQELGNVDDKIDTTVEWKLLPQEDP

SEQ ID NO: 907832 - protein, 108 aa, Homo sapiens
ISPRSRETHPNPEEPEEEDEDVQAERVQAANALTAPNLEEEPVITASCLHKEYYETKKSCFSTRKKKIAIRNVSFCVKKGLNNCSFYYYYNVPYSLDLRLQRGQIFIH

SEQ ID NO: 907833 - protein, 276 aa, Homo sapiens
MATFISFSRRGIGAKTKGGSDIHCLVQVVLQGSRASVRQQHDNSLKFLGYCPQENSLWPKLTMKEHLELYAAVKGLGKEDAALSISRLVEALKLQEQLKAPVKTLSEGIKRKLCFVLSILGNPSVVLLDEPFTGMDPEGQQQMWQILQATVKNKERGTLLTTHYMSEAEAVCDRMAMMVSGTLRCIGSIQHLKNKFGRDYLLEIKMKEPTQVEALHTEILKLFPQAAWQERYSSLMAYKLPVEDVHPLSRAFFKLEAMKQTFNLEEYSLSQATLEQ

SEQ ID NO: 907834 - protein, 102 aa, Homo sapiens
FLPPFSSPDPPLRRPVSSGSRAPEPYSSLMAYKLPVEDVHPLSRAFFKLEAMKQTFNLEEYSLSQATLEQVFLELCKEQELGNVDDKIDTTVEWKLLPQEDP

SEQ ID NO: 907835 - protein, 391 aa, Homo sapiens
ISPRSRETHPNPEEPEEEDEDVQAERVQAANALTAPNLEEEPVITASCLHKEYYETKKSCFSTRKKKIAIRNVSFCVKKGEVLGLLGHNGAGKSTSIKMITGCTKPTAGVVVLQGSRASVRQQHDNSLKFLGYCPQENSLWPKLTMKEHLELYAAVKGLGKEDAALSISRLVEALKLQEQLKAPVKTLSEGIKRKLCFVLSILGNPSVVLLDEPFTGMDPEGQQQMWQILQATVKNKERGTLLTTHYMSEAEAVCDRMAMMVSGTLRCIGSIQHLKNKFGRDYLLEIKMKEPTQVEALHTEILKLFPQAAWQERYSSLMAYKLPVEDVHPLSRAFFKLEAMKQTFNLEEYSLSQATLEQVFLELCKEQELGNVDDKIDTTVEWKLLPQEDP

SEQ ID NO: 907836 - protein, 183 aa, Homo sapiens [sequence omitted]

SEQ ID NO: 907837 - protein, 306 aa, Homo sapiens
MATFISFSRRGIGAKTKGGSDIHCLVQVVLQGSRASVRQQHDNSLKFLGYCPQENSLWPKLTMKEHLELYAAVKGLGKEDAALSISRLVEALKLQEQLKAPVKTLSEGIKRKLCFVLSILGNPSVVLLDEPFTGMDPEGQQQMWQILQATVKNKERGTLLTTHYMSEAEAVCDRMAMMVSGTLRCIGSIQHLKNKFGRDYLLEIKMKEPTQVEALHTEILKLFPQAAWQERYSSLMAYKLPVEDVHPLSRAFFKLEAMKQTFNLEEYSLSQATLEQKQCEASLDADIGTTLLVQPVVSESQLKKSA

SEQ ID NO: 907838 - protein, 398 aa, Homo sapiens
RTSARAHCSPADSWARVRACASLGSWRGPRGEGWKMSMDVTFLGTGAAYPSPTRGASAVVLRCEGECWLFDCGEGTQTQLMKSQLKAGRITKIFITHLHGDHFFGLPGLLCTISLQSGSMVSKQPIEIYGPVGLRDFIWRTMELSHTELVFHYVVHELVPTADQCPAEELKEFAHVNRADSPPKEEQGRTILLDSEENSYLLFDDEQFVVKAFRLFHRIPSFGFSVVEKKRPGKLNAQKLKDLGVPPGPAYGKLKNGISVVLENGVTISPQDVLKKPIVGRKICILGDCSGVVGDGGVKLCFEADLLIHEATLDDAQMDKAKEHGHSTPQMAATFAKLCRAKRLVLTHFSQRYKPVALAREGETDGIAELKKQAESVLDLQEVTLAEDFMVISIPIKK

SEQ ID NO: 907839 - protein, 380 aa, Homo sapiens
RTSARAHCSPADSWARVRACASLGSWRGPRGEGWKMSMDVTFLGTGAAYPSPTRGASAVVLRCEGECWLFDCGEGTQTQLHGDHFFGLPGLLCTISLQSGSMVSKQPIEIYGPVGLRDFIWRTMELSHTELVFHYVVHELVPTADQCPAEELKEFAHVNRADSPPKEEQGRTILLDSEENSYLLFDDEQFVVKAFRLFHRIPSFGFSVVEKKRPGKLNAQKLKDLGVPPGPAYGKLKNGISVVLENGVTISPQDVLKKPIVGRKICILGDCSGVVGDGGVKLCFEADLLIHEATLDDAQMDKAKEHGHSTPQMAATFAKLCRAKRLVLTHFSQRYKPVALAREGETDGIAELKKQAESVLDLQEVTLAEDFMVISIPIKK

SEQ ID NO: 907840 - protein, 398 aa, Homo sapiens; identical to SEQ ID NO: 907838

SEQ ID NO: 907841 - protein, 123 aa, Homo sapiens
RTSARAHCSPADSWARVRACASLGSWRGPRGEGWKMSMDVTFLGTGAAYPSPTRGASAVVLRCEGECWLFDCGEGTQTQLMKSQLKAEFPHLGFQSWKRNAQVNSMHRNLKTLVFHQVLPMGS

SEQ ID NO: 907842 - protein, 165 aa, Homo sapiens
DNFQQEEVERIKWILHHGNLTAPHVTVAGLLLVFFLFGAPLDSLPSMKALSPVRGCYEAVCCLSERSLAIARGRGKGPAAEEPLSLLDDMNHCYSRLRELVPGVPRGTQLSQVEILQRVIDYILDLQVVLAEPAPGPPDGPHLPIQTAELAPELVISNDKRSFCH

SEQ ID NO: 907843 - protein, 67 aa, Homo sapiens
LSAFMLGSEIQRCPKEKENQKKSRYSDLQVVLAEPAPGPPDGPHLPIQTAELAPELVISNDKRSFCH

SEQ ID NO: 907844 - protein, 119 aa, Homo sapiens
MKALSPVRGCYEAVCCLSERSLAIARGRGKGPAAEEPLSLLDDMNHCYSRLRELVPGVPRGTQLSQVEILQRVIDYILDLQVVLAEPAPGPPDGPHLPIQTAELAPELVISNDKRSFCH

SEQ ID NO: 907845 - protein, 165 aa, Homo sapiens; identical to SEQ ID NO: 907842

SEQ ID NO: 907846 - protein, 160 aa, Homo sapiens
MKALSPVRGCYEAVCCLSERSLAIARGRGKGPAAEEPLSLLDDMNHCYSRLRELVPGVPRGTQLSQVEILQRVIDYILDLQVVLAEPAPGPPDGPHLPIQVSLEVGTGLNTQARMLRDPRSSRLPRVTLPSFPLIRQPSSLRNLSSPTTKGAFATDSAVS

SEQ ID NO: 907847 - protein, 160 aa, Homo sapiens; identical to SEQ ID NO: 907846

SEQ ID NO: 907848 - protein, 160 aa, Homo sapiens; identical to SEQ ID NO: 907846

SEQ ID NO: 907849 - protein, 119 aa, Homo sapiens; identical to SEQ ID NO: 907844

SEQ ID NO: 907850 - protein, 119 aa, Homo sapiens; identical to SEQ ID NO: 907844

SEQ ID NO: 907851 - protein, 119 aa, Homo sapiens; identical to SEQ ID NO: 907844

SEQ ID NO: 907852 - protein, 119 aa, Homo sapiens; identical to SEQ ID NO: 907844

SEQ ID NO: 907853 - protein, 174 aa, Homo sapiens
MKALSPVRGCYEAVCCLSERSLAIARGRGKGPAAEEPLSLLDDMNHCYSRLRELSCRKPDGRDGPQLRPAHLTSPNPFLETKPGAQERRTVNLWPERARASSGHQLGDVTLLPPHPQVLRSFQSVEVWKEWLLSKLCQGGGRAGLLVSLEKGSVALIYELYNRVYRFCTFFTGR

SEQ ID NO: 907854 - protein, 125 aa, Homo sapiens
MGFPCYVRPMRQAARGRTWKRKRWSGGVLSSPGRKSQTLPMEASSEPPLDAKSDVTNQLVDFQWKLGMAVSSDTCRSLKYPYVAVMLKVADHSGQVKTKCFEMTIPQFQNFYRQFKEIAAVIETV

SEQ ID NO: 907855 - protein, 125 aa, Homo sapiens; identical to SEQ ID NO: 907854

SEQ ID NO: 907856 - protein, 125 aa, Homo sapiens; identical to SEQ ID NO: 907854

SEQ ID NO: 907857 - protein, 125 aa, Homo sapiens; identical to SEQ ID NO: 907854

SEQ ID NO: 907858 - protein, 138 aa, Homo sapiens
MGFPCYVRPMRQAARGRTWKRKRWSGGVLSSPGRKSQTLPMEASSEPPLDAKSDVTNQLVDFQWKLGMAVSSDTCRSLKYPYVAVMLKVADHSGQVKTKCFEMTIPQFQPQLLATSSLLSASNFYRQFKEIAAVIETV

SEQ ID NO: 907859 - protein, 138 aa, Homo sapiens; identical to SEQ ID NO: 907858

SEQ ID NO: 907860 - protein, 125 aa, Homo sapiens; identical to SEQ ID NO: 907854

SEQ ID NO: 907861 - protein, 125 aa, Homo sapiens; identical to SEQ ID NO: 907854

SEQ ID NO: 907862 - protein, 135 aa, Homo sapiens
NHYHHTYLSIILHYQLIFLSLSHLLILILFNITTPPTPLSSPGRKSQTLPMEASSEPPLDAKSDVTNQLVDFQWKLGMAVSSDTCRSLKYPYVAVMLKVADHSGQVKTKCFEMTIPQFQNFYRQFKEIAAVIETV

SEQ ID NO: 907863 - protein, 125 aa, Homo sapiens; identical to SEQ ID NO: 907854

SEQ ID NO: 907864 - protein, 96 aa, Homo sapiens
RRAAESYSETDARWLPIARQQGRRTPCSTLVDFQWKLGMAVSSDTCRSLKYPYVAVMLKVADHSGQVKTKCFEMTIPQFQNFYRQFKEIAAVIETV

SEQ ID NO: 907865 - protein, 128 aa, Homo sapiens
MSASAQQLAEELQIFGLDCEEALIEKLVELCVQYGQNEEGMVGELIAFCTSTHKVGLTSEILNSFEHEFLSKRLSKARHSTCKDSGHAGARDIVSIQELIEVEEEEEILLNSYTTPSKLFFCFRVHHK

SEQ ID NO: 907866 - protein, 520 aa, Homo sapiens
MSASAQQLAEELQIFGLDCEEALIEKLVELCVQYGQNEEGMVGELIAFCTSTHKVGLTSEILNSFEHEFLSKRLSKARHSTCKDSGHAGARDIVSIQELIEVEEEEEILLNSYTTPSKGSQKRAISTPETPLTKRSVSTRSPHQLLSPSSFSPSATPSQKYNSRSNRGEVVTSFGLAQGVSWSGRGGAGNISLKVLGCPEALTGSYKSMFQKLPDIREVLTCKIEELGSELKEHYKIEAFTPLLAPAQEPVTLLGQIGCDSNGKLNNKSVILEGDREHSSGAQIPVDLSELKEYSLFPGQVVIMEGINTTGRKLVATKLYEGVPLPFYQPTEEDADFEQSMVLVACGPYTTSDSITYDPLLDLIAVINHDRPDVCILFGPFLDAKHEQVENCLLTSPFEDIFKQCLRTIIEGTRSSGSHLVFVPSLRDVHHEPVYPQPPFSYSDLSREDKKQVQFVSEPCSLSINGVIFGLTSTDLLFHLGAEEISSSSGTSDRFSRILKHILTQRSCLSPQMSSSSRQS

SEQ ID NO: 907867 - protein, 598 aa, Homo sapiens
MSASAQQLAEELQIFGLDCEEALIEKLVELCVQYGQNEEGMVGELIAFCTSTHKVGLTSEILNSFEHEFLSKRLSKARHSTCKDSGHAGARDIVSIQELIEVEEEEEILLNSYTTPSKGSQKRAISTPETPLTKRSVSTRSPHQLLSPSSFSPSATPSQKYNSRSNRGEVVTSFGLAQGVSWSGRGGAGNISLKVLGCPEALTGSYKSMFQKLPDIREVLTCKIEELGSELKEHYKIEAFTPLLAPAQEPVTLLGQIGCDSNGKLNNKSVILEGDREHSSGAQIPVDLSELKEYSLFPGQVVIMEGINTTGRKLVATKLYEGVPLPFYQPTEEDADFEQSMVLVACGPYTTSDSITYDPLLDLIAVINHDRPDVCILFGPFLDAKHEQVENCLLTSPFEDIFKQCLRTIIEGTRSSGSHLVFVPSLRDVHHEPVYPQPPFSYSDLSREDKKQVQFVSEPCSLSINGVIFGLTSTDLLFHLGAEEISSSSGTSDRFSRILKHILTQRSYYPLYPPQEDMAIDYESFYVYAQLPVTPDVLIIPSELRYFVKDVLGCVCVNPGRLTKGQVGGTFARLYLRRPAADGAERQSPCIAVQVVRI

SEQ ID NO: 907868 - protein, 139 aa, Homo sapiens
VRKELCAEQLLATAAEDHRCNDGPQLNSSSGTSDRFSRILKHILTQRSYYPLYPPQEDMAIDYESFYVYAQLPVTPDVLIIPSELRYFVKDVLGCVCVNPGRLTKGQVGGTFARLYLRRPAADGAERQSPCIAVQVVRI

SEQ ID NO: 907869 - protein, 598 aa, Homo sapiens; identical to SEQ ID NO: 907867

SEQ ID NO: 907870 - protein, 390 aa, Homo sapiens [sequence omitted]

SEQ ID NO: 907871 - protein, 569 aa, Homo sapiens
MSASAQQLAEELQIFGLDCEEALIEKLVELCVQYGQNEEGMVGELIAFCTSTHKVGLTSEILNSFEHEFLSKRLSKARHSTCKDSGHAGARDIVSIQELIEVEEEEEILLNSYTTPSKGSQKRAISTPETPLTKRSVSTRSPHQLLSPSSFSPSATPSQKYNSRSNRGEVVTSFGLAQGVSWSGRGGAGNISLKVLGCPEALTGSYKSMFQKLPDIREVLTCKIEELGSELKEHYKIEAFTPLLAPAQEPVTLLGQIGCDSNGKLNNKSVILEGDREHSSGAQIPVDLSELKEYSLFPGQVVIMEGINTTGRKLVATKLYEGVPLPFYQPTEEDADFEQSMVLVACGPYTTSDSITYDPLLDLIAVINHDRPDVCILFGPFLDAKHEQVENCLLTSPFEDIFKQCLRTIIEGTRSSGSHLVFVPSLRDVHHEPVYPQPPFSYSDLSREDKKQVQFVSEPCSLSINGVIFGLTSTDLLFHLGAEEISSSSGTSDRFSRILKHILTQRSYYPLYPPQEDMAIDYESFYVYAQLPVTPDVLIIPSELRYFVKVGLNSAFSQKHQNPVFDFPF

SEQ ID NO: 907872 - protein, 394 aa, Homo sapiens
MSASAQQLAEELQIFGLDCEEALIEKLVELCVQYGQNEEGMVGELIAFCTSTHKVGLTSEILNSFEHEFLSKRLSKARHSTCKDSGHAGARDIVSIQELIEVEEEEEILLNSYTTPSKGSQKRAISTPETPLTKRSVSTRSPHQLLSPSSFSPSATPSQKYNSRSNRGEVVTSFGLAQGVSWSGRGGAGNISLKVLGCPEALTGSYKSMFQKLPDIREVLTCKIEELGSELKEHYKIEAFTPLLAPAQEPVTLLGQIGCDSNGKLNNKSVILEGDREHSSGAQIPVDLSELKEYSLFPGQVVIMEGINTTGRKLVATKLYEGVPLPFYQPTEEDADFEQSMVLVACGPYTTSDSITYDPLLDLIAVINHDRPDVCILLGLSWMLRHEPGGAIVY

SEQ ID NO: 907873 - protein, 1500 aa, Homo sapiens
VAPVKLLGVGGEGMGSGGLRCLEMAAPSPASSPGGSGCRVASMALQGPYLGLEVGVHGQQAHEGQGIEPHTEADVQVREAPSQHLQPLASAPSSSGLQLALRDVDQLLGAAAHAPDLQRAPEAVLLSPGLSQQCSPCVSLAQVPLPKRLLLLIPLKLCHVLRRLLAWCSSEARGSFGGRLASGPSAGTCGVVFVGDFIISGFPGSRVEFRLSSSRAPIASSGAAATFCTSLRAADPAAGKSRMMLLGEKWALRKLRVASTSHTGTSRRSLWQAEQSSRGGHCTLGNWGSSLGAPARRALTLLWLDQSQRTAALGLPTRCMEAAAICSKWLAQSRQPEEVAHVASDGWEDLLGLGCFLCVVYILPSCLHSQEVEEDPQGAGKAPEMRLTPLAANPVHLLGKNGTLFPVVQGSFKETVGNFISLLPLEPFIHGVQEVLDYGPAREILGQHCHKLFQGHQALPFQDREPAHFYPQDVVQCRFQVSHVDLGAICQFPNSGSYLVSSGWCNCGLGSLPGEPRESLQVSGIEGPGFHEHGDSGDRAIPEQQVARGEVGDTKLSHHIGLCVQHPAHRHAFVLGQVQSHLSTQVGASLFKDQTASLDVYAKYVLRSICQQEWVGERCLKSLCEDSNDLQDPVLSSAQAQRLMQLICYPHRLLDNEDGENPQRQRIKRILQNLDQWTMRQSSLELQLMIKQTPNNEMNSLLENIAKATIEVFQQSAETGSSSGSTASNMPSSSKTKPVLSSLERSGVWLVAPLIAKLPTSVQGHVLKAAGEELEKGQHLGSSSRKERDRQKQKSMSLLSQQPFLSLVLTCLKGQDEQREGLLTSLYSQVHQIVNNWRDDQYLDDCKPKQLMHEALKLRLNLVGGMFDTVQRSTQQTTEWAMLLLEIIISGTVDMQSNNELFTTVLDMLSVLINGTLAADMSSISQGSMEENKRAYMNLAKKLQKELGERQSDSLEKVRQLLPLPKQTRDVITCEPQGSLIDTKGNKIAGFDSIFKKEGLQVSTKQKISPWDLFEGLKPSAPLSWGWFGTVRVDRRVARGEEQQRLLLYHTHLRPRPRAYYLEPLPLPPEDEEPPAPTLLEPEKKAPEPPKTDKPGAAPPSTEERKKKSTKGKKRSQPATKTEDYGMGPGRSGPYGVTVPPDLLHHPNPGSITHLNYRQGSIGLYTQNQPLPAGGPRVDPYRPVRLPMQKLPTRPTYPGVLPTTMTGVMGLEPSSYKTSVYRQQQPAVPQGQRLRQQLQQSQGMLGQSSVHQMTPSSSYGLQTSQGYTPYVSHVGLQQHTGPAGTMVPPSYSSQPYQSTHPSTNPTLVDPTRHLQQRPSGYVHQQAPTYGHGLTSTQRFSHQTLQQTPMISTMTPMSAQGVQAGVRSTAILPEQQQQQQQQQQQQQQQQQQQQQQQQQQYHIRQQQQQQILRQQQQQQQQQQQQQQQQQQQQQQQQQQHQQQQQQQAAPPQPQPQSQPQFQRQGLQQTQQQQQTAALVRQLQQQLSNTQPQPSTNIFGRY

SEQ ID NO: 907874 - protein, 2210 aa, Homo sapiens
MKQSMPSLHTKKILFCYFHLTNSWCLRRYGLGKMAAFGILSYEHRPLKRPRLGPPDVYPQDPKQKEDELTALNVKQGFNNQPAVSGDEHGSAKNVSFNPAKISSNFSSIIAEKLRCNTLPDTGRRKPQVNQKDNFWLVTARSQSAINTWFTDLAGTKPLTQLAKKVPIFSKKEEVFGYLAKYTVPVMRAAWLIKMTCAYYAAISETKVKKRHVDPFMEWTQIITKYLWEQLQKMAEYYRPGPAGSGGCGSTIGPLPHDVEVAIRQWDYTEKLAMFMFQDGMLDRHEFLTWVLECFEKIRPGEDELLKLLLPLLLRYSGEFVQSAYLSRRLAYFCTRRLALQLDGVSSHSSHVISAQSTSTLPTTPAPQPPTSSTPSTPFSDLLMCPQHRPLVFGLSCILQTILLCCPSALVWHYSLTDSRIKTGSPLDHLPIAPSNLPMPEGNSAFTQQVRAKLREIEQQIKERGQAVEVRWSFDKCQEATAGFTIGRVLHTLEVLDSHSFERSDFSNSLDSLCNRIFGLGPSKDGHEISSDDDAVVSLLCEWAVSCKRSGRHRAMVVAKLLEKRQAEIEAERCGESEAADEKGSIASGSLSAPSAPIFQDVLLQFLDTQAPMLTDPRSESERVEFFNLVLLFCELIRHDVFSHNMYTCTLISRGDLAFGAPGPRPPSPFDDPADDPEHKEAEGSSSSKLEDPGLSESMDIDPSSSVLFEDMEKPDFSLFSPTMPCEGKGSPSPEKPDVEKEVKPPPKEKIEGTLGVLYDQPRHVQYATHFPIPQEESCSHECNQRLVVLFGVGKQRDDARHAIKKITKDILKVLNRKGTAETDQLAPIVPLNPGDLTFLGGEDGQKRRRNRPEAFPTAEDIFAKFQHLSHYDQHQVTAQVSRNVLEQITSFALGMSYHLPLVQHVQFIFDLMEYSLSISGLIDFAIQLLNELSVVEAELLLKSSDLVGSYTTSLCLCIVAVLRHYHACLILNQDQMAQVFEGLCGVVKHGMNRSDGSSAERCILAYLYDLYTSCSHLKNKFGELFSDFCSKVKNTIYCNVEPSESNMRWAPEFMIDTLENPAAHTFTYTGLGKSLSENPANRYSFVCNALMHVCVGHHDPDRVNDIAILCAELTGYCKSLSAEWLGVLKALCCSSNNGTCGFNDLLCNVDVSDLSFHDSLATFVAILIARQCLLLEDLIRCAAIPSLLNAACSEQDSEPGARLTCRILLHLFKTPQLNPCQSDGNKPTVGIRSSCDRHLLAASQNRIVDGAVFAVLKAVFVLGDAELKGSGFTVTGGTEELPEEEGGGGSGGRRQGGRNISVETASLDVYAKYVLRSICQQEWVGERCLKSLCEDSNDLQDPVLSSAQAQRLMQLICYPHRLLDNEDGENPQRQRIKRILQNLDQWTMRQSSLELQLMIKQTPNNEMNSLLENIAKATIEVFQQSAETGSSSGSTASNMPSSSKTKPVLSSLERSGVWLVAPLIAKLPTSVQGHVLKAAGEELEKGQHLGSSSRKERDRQKQKSMSLLSQQPFLSLVLTCLKGQDEQREGLLTSLYSQVHQIVNNWRDDQYLDDCKPKQLMHEALKLRLNLVGGMFDTVQRSTQQTTEWAMLLLEIIISGTVDMQSNNELFTTVLDMLSVLINGTLAADMSSISQGSMEENKRAYMNLAKKLQKELGERQSDSLEKVRQLLPLPKQTRDVITCEPQGSLIDTKGNKIAGFDSIFKKEGLQVSTKQKISPWDLFEGLKPSAPLSWGWFGTVRVDRRVARGEEQQRLLLYHTHLRPRPRAYYLEPLPLPPEDEEPPAPTLLEPEKKAPEPPKTDKPGAAPPSTEERKKKSTKGKKRSQPATKTEDYGMGPGRSGPYGVTVPPDLLHHPNPGSITHLNYRQGSIGLYTQNQPLPAGGPRVDPYRPVRLPMQKLPTRPTYPGVLPTTMTGVMGLEPSSYKTSVYRQQQPAVPQGQRLRQQLQQSQGMLGQSSVHQMTPSSSYGLQTSQGYTPYVSHVGLQQHTGPAGTMVPPSYSSQPYQSTHPSTNPTLVDPTRHLQQRPSGYVHQQAPTYGHGLTSTQRFSHQTLQQTPMISTMTPMSAQGVQAGVRSTAILPEQQQQQQQQQQQQQQQQQQQQQQQQQQYHIRQQQQQQILRQQQQQQQQQQQQQQQQQQQQQQQQQQHQQQQQQQAAPPQPQPQSQPQFQRQGLQQTQQQQQTAALVRQLQQQLSNTQPQPSTNIFGRY

SEQ ID NO: 907875 - protein, 2155 aa, Homo sapiens
KKQLNAAFLPQDELTALNVKQGFNNQPAVSGDEHGSAKNVSFNPAKISSNFSSIIAEKLRCNTLPDTGRRKPQVNQKDNFWLVTARSQSAINTWFTDLAGTKPLTQLAKKVPIFSKKEEVFGYLAKYTVPVMRAAWLIKMTCAYYAAISETKVKKRHVDPFMEWTQIITKYLWEQLQKMAEYYRPGPAGSGGCGSTIGPLPHDVEVAIRQWDYTEKLAMFMFQDGMLDRHEFLTWVLECFEKIRPGEDELLKLLLPLLLRYSGEFVQSAYLSRRLAYFCTRRLALQLDGVSSHSSHVISAQSTSTLPTTPAPQPPTSSTPSTPFSDLLMCPQHRPLVFGLSCILQTILLCCPSALVWHYSLTDSRIKTGSPLDHLPIAPSNLPMPEGNSAFTQQVRAKLREIEQQIKERGQAVEVRWSFDKCQEATAGFTIGRVLHTLEVLDSHSFERSDFSNSLDSLCNRIFGLGPSKDGHEISSDDDAVVSLLCEWAVSCKRSGRHRAMVVAKLLEKRQAEIEAERCGESEAADEKGSIASGSLSAPSAPIFQDVLLQFLDTQAPMLTDPRSESERVEFFNLVLLFCELIRHDVFSHNMYTCTLISRGDLAFGAPGPRPPSPFDDPADDPEHKEAEGSSSSKLEDPGLSESMDIDPSSSVLFEDMEKPDFSLFSPTMPCEGKGSPSPEKPDVEKEVKPPPKEKIEGTLGVLYDQPRHVQYATHFPIPQEESCSHECNQRLVVLFGVGKQRDDARHAIKKITKDILKVLNRKGTAETDQLAPIVPLNPGDLTFLGGEDGQKRRRNRPEAFPTAEDIFAKFQHLSHYDQHQVTAQVSRNVLEQITSFALGMSYHLPLVQHVQFIFDLMEYSLSISGLIDFAIQLLNELSVVEAELLLKSSDLVGSYTTSLCLCIVAVLRHYHACLILNQDQMAQVFEGLCGVVKHGMNRSDGSSAERCILAYLYDLYTSCSHLKNKFGELFSDFCSKVKNTIYCNVEPSESNMRWAPEFMIDTLENPAAHTFTYTGLGKSLSENPANRYSFVCNALMHVCVGHHDPDRVNDIAILCAELTGYCKSLSAEWLGVLKALCCSSNNGTCGFNDLLCNVDVSDLSFHDSLATFVAILIARQCLLLEDLIRCAAIPSLLNAACSEQDSEPGARLTCRILLHLFKTPQLNPCQSDGNKPTVGIRSSCDRHLLAASQNRIVDGAVFAVLKAVFVLGDAELKGSGFTVTGGTEELPEEEGGGGSGGRRQGGRNISVETASLDVYAKYVLRSICQQEWVGERCLKSLCEDSNDLQDPVLSSAQAQRLMQLICYPHRLLDNEDGENPQRQRIKRILQNLDQWTMRQSSLELQLMIKQTPNNEMNSLLENIAKATIEVFQQSAETGSSSGSTASNMPSSSKTKPVLSSLERSGVWLVAPLIAKLPTSVQGHVLKAAGEELEKGQHLGSSSRKERDRQKQKSMSLLSQQPFLSLVLTCLKGQDEQREGLLTSLYSQVHQIVNNWRDDQYLDDCKPKQLMHEALKLRLNLVGGMFDTVQRSTQQTTEWAMLLLEIIISGTVDMQSNNELFTTVLDMLSVLINGTLAADMSSISQGSMEENKRAYMNLAKKLQKELGERQSDSLEKVRQLLPLPKQTRDVITCEPQGSLIDTKGNKIAGFDSIFKKEGLQVSTKQKISPWDLFEGLKPSAPLSWGWFGTVRVDRRVARGEEQQRLLLYHTHLRPRPRAYYLEPLPLPPEDEEPPAPTLLEPEKKAPEPPKTDKPGAAPPSTEERKKKSTKGKKRSQPATKTEDYGMGPGRSGPYGVTVPPDLLHHPNPGSITHLNYRQGSIGLYTQNQPLPAGGPRVDPYRPVRLPMQKLPTRPTYPGVLPTTMTGVMGLEPSSYKTSVYRQQQPAVPQGQRLRQQLQQSQGMLGQSSVHQMTPSSSYGLQTSQGYTPYVSHVGLQQHTGPAGTMVPPSYSSQPYQSTHPSTNPTLVDPTRHLQQRPSGYVHQQAPTYGHGLTSTQRFSHQTLQQTPMISTMTPMSAQGVQAGVRSTAILPEQQQQQQQQQQQQQQQQQQQQQQQQQQYHIRQQQQQQILRQQQQQQQQQQQQQQQQQQQQQQQQQQHQQQQQQQAAPPQPQPQSQPQFQRQGLQQTQQQQQTAALVRQLQQQLSNTQPQPSTNIFGRY

SEQ ID NO: 907876 - protein, 2352 aa, Homo sapiens
MKQSMPSLHTKKILFCYFHLTNSWCLRRYGLGKMAAFGILSYEHRPLKRPRLGPPDVYPQDPKQKEDELTALNVKQGFNNQPAVSGDEHGSAKNVSFNPAKISSNFSSIIAEKLRCNTLPDTGRRKPQVNQKDNFWLVTARSQSAINTWFTDLAGTKPLTQLAKKVPIFSKKEEVFGYLAKYTVPVMRAAWLIKMTCAYYAAISETKVKKRHVDPFMEWTQIITKYLWEQLQKMAEYYRPGPAGSGGCGSTIGPLPHDVEVAIRQWDYTEKLAMFMFQDGMLDRHEFLTWVLECFEKIRPGEDELLKLLLPLLLRYSGEFVQSAYLSRRLAYFCTRRLALQLDGVSSHSSHVISAQSTSTLPTTPAPQPPTSSTPSTPFSDLLMCPQHRPLVFGLSCILQTILLCCPSALVWHYSLTDSRIKTGSPLDHLPIAPSNLPMPEGNSAFTQQVRAKLREIEQQIKERGQAVEVRWSFDKCQEATAGFTIGRVLHTLEVLDSHSFERSDFSNSLDSLCNRIFGLGPSKDGHEISSDDDAVVSLLCEWAVSCKRSGRHRAMVVAKLLEKRQAEIEAERCGESEAADEKGSIASGSLSAPSAPIFQDVLLQFLDTQAPMLTDPRSESERVEFFNLVLLFCELIRHDVFSHNMYTCTLISRGDLAFGAPGPRPPSPFDDPADDPEHKEAEGSSSSKLEDPGLSESMDIDPSSSVLFEDMEKPDFSLFSPTMPCEGKGSPSPEKPDVEKEVKPPPKEKIEGTLGVLYDQPRHVQYATHFPIPQEESCSHECNQRLVVLFGVGKQRDDARHAIKKITKDILKVLNRKGTAETDQLAPIVPLNPGDLTFLGGEDGQKRRRNRPEAFPTAEDIFAKFQHLSHYDQHQVTAQVSRNVLEQITSFALGMSYHLPLVQHVQFIFDLMEYSLSISGLIDFAIQLLNELSVVEAELLLKSSDLVGSYTTSLCLCIVAVLRHYHACLILNQDQMAQVFEGLCGVVKHGMNRSDGSSAERCILAYLYDLYTSCSHLKNKFGELFREERWKVRGSEWDLLPSSHDHPTQEERMARDPAACLGSFVDCVLHILLCYQEWALFLSRLAPRLYLWGPPSSPFSSLPSEAPVPYSHVVPFLPSLFCPISLFLSQDPSSLTFSFFSFLPFPDHPSTSAGLLQHYYLLSSIPGSDFCSKVKNTIYCNVEPSESNMRWAPEFMIDTLENPAAHTFTYTGLGKSLSENPANRYSFVCNALMHVCVGHHDPDRVNDIAILCAELTGYCKSLSAEWLGVLKALCCSSNNGTCGFNDLLCNVDVSDLSFHDSLATFVAILIARQCLLLEDLIRCAAIPSLLNAACSEQDSEPGARLTCRILLHLFKTPQLNPCQSDGNKPTVGIRSSCDRHLLAASQNRIVDGAVFAVLKAVFVLGDAELKGSGFTVTGGTEELPEEEGGGGSGGRRQGGRNISVETASLDVYAKYVLRSICQQEWVGERCLKSLCEDSNDLQDPVLSSAQAQRLMQLICYPHRLLDNEDGENPQRQRIKRILQNLDQWTMRQSSLELQLMIKQTPNNEMNSLLENIAKATIEVFQQSAETGSSSGSTASNMPSSSKTKPVLSSLERSGVWLVAPLIAKLPTSVQGHVLKAAGEELEKGQHLGSSSRKERDRQKQKSMSLLSQQPFLSLVLTCLKGQDEQREGLLTSLYSQVHQIVNNWRDDQYLDDCKPKQLMHEALKLRLNLVGGMFDTVQRSTQQTTEWAMLLLEIIISGTVDMQSNNELFTTVLDMLSVLINGTLAADMSSISQGSMEENKRAYMNLAKKLQKELGERQSDSLEKVRQLLPLPKQTRDVITCEPQGSLIDTKGNKIAGFDSIFKKEGLQVSTKQKISPWDLFEGLKPSAPLSWGWFGTVRVDRRVARGEEQQRLLLYHTHLRPRPRAYYLEPLPLPPEDEEPPAPTLLEPEKKAPEPPKTDKPGAAPPSTEERKKKSTKGKKRSQPATKTEDYGMGPGRSGPYGVTVPPDLLHHPNPGSITHLNYRQGSIGLYTQNQPLPAGGPRVDPYRPVRLPMQKLPTRPTYPGVLPTTMTGVMGLEPSSYKTSVYRQQQPAVPQGQRLRQQLQQSQGMLGQSSVHQMTPSSSYGLQTSQGYTPYVSHVGLQQHTGPAGTMVPPSYSSQPYQSTHPSTNPTLVDPTRHLQQRPSGYVHQQAPTYGHGLTSTQRFSHQTLQQTPMISTMTPMSAQGVQAGVRSTAILPEQQQQQQQQQQQQQQQQQQQQQQQQQQYHIRQQQQQQILRQQQQQQQQQQQQQQQQQQQQQQQQQQHQQQQQQQAAPPQPQPQSQPQFQRQGLQQTQQQQQTAALVRQLQQQLSNTQPQPSTNIFGRY

SEQ ID NO: 907877 - protein, 2327 aa, Homo sapiens
MKQSMPSLHTKKILFCYFHLTNSWCLRRYGLGKMAAFGILSYEHRPLKRPRLGPPDVYPQDPKQKEDELTALNVKQGFNNQPAVSGDEHGSAKNVSFNPAKISSNFSSIIAEKLRCNTLPDTGRRKPQVNQKDNFWLVTARSQSAINTWFTDLAGTKPLTQLAKKVPIFSKKEEVFGYLAKYTVPVMRAAWLIKMTCAYYAAISETKVKKRHVDPFMEWTQIITKYLWEQLQKMAEYYRPGPAGSGGCGSTIGPLPHDVEVAIRQWDYTEKLAMFMFQDGMLDRHEFLTWVLECFEKIRPGEDELLKLLLPLLLRYSGEFVQSAYLSRRLAYFCTRRLALQLDGVSSHSSHVISAQSTSTLPTTPAPQPPTSSTPSTPFSDLLMCPQHRPLVFGLSCILQTILLCCPSALVWHYSLTDSRIKTGSPLDHLPIAPSNLPMPEGNSAFTQQVRAKLREIEQQIKERGQAVEVRWSFDKCQEATAGFTIGRVLHTLEVLDSHSFERSDFSNSLDSLCNRIFGLGPSKDGHEISSDDDAVVSLLCEWAVSCKRSGRHRAMVVAKLLEKRQAEIEAERCGESEAADEKGSIASGSLSAPSAPIFQDVLLQFLDTQAPMLTDPRSESERVEFFNLVLLFCELIRHDVFSHNMYTCTLISRGDLAFGAPGPRPPSPFDDPADDPEHKEAEGSSSSKLEDPGLSESMDIDPSSSVLFEDMEKPDFSLFSPTMPCEGKGSPSPEKPDVEKEVKPPPKEKIEGTLGVLYDQPRHVQYATHFPIPQEESCSHECNQRLVVLFGVGKQRDDARHAIKKITKDILKVLNRKGTAETDQLAPIVPLNPGDLTFLGGEDGQKRRRNRPEAFPTAEDIFAKFQHLSHYDQHQVTAQVSRNVLEQITSFALGMSYHLPLVQHVQFIFDLMEYSLSISGLIDFAIQLLNELSVVEAELLLKSSDLVGSYTTSLCLCIVAVLRHYHACLILNQDQMAQVFEGLCGVVKHGMNRSDGSSAERCILAYLYDLYTSCSHLKNKFGELFREERWKVRGSEWDLLPSSHDHPTQEERMARDPAACLGSFVDCVLHILLCYQEWALFLSRLAPRLYLWGPPSSPFSSLPSEAPVPYSHVVPFLPSLFCPISLFLSQDPSSLTFSFFSFLPFPDHPSTSAGLLQHYYLLSSIPGSDFCSKVKNTIYCNVEPSESNMRWAPEFMIDTLENPAAHTFTYTGLGKSLSENPANRYSFVCNALMHVCVGHHDPDRVNDIAILCAELTGYCKSLSAEWLGVLKALCCSSNNGTCGFNDLLCNVDVSDLSFHDSLATFVAILIARQCLLLEDLIRCAAIPSLLNAACSEQDSEPGARLTCRILLHLFKTPQLNPCQSDGNKPTVGIRSSCDRHLLAASQNRIVDGAVFAVLKAVFVLGDAELKGSGFTVTGGTEELPEEEGGGGSGGRRQGGRNISVETASLDVYAKYVLRSICQQEWVGERCLKSLCEDSNDLQDPVLSSAQAQRLMQLICYPHRLLDNEDGENPQRQRIKRILQNLDQWTMRQSSLELQLMIKQTPNNEMNSLLENIAKATIEVFQQSAETGSSSGSTASNMPSSSKTKPVLSSLERSGVWLVAPLIAKLPTSVQGHVLKAAGEELEKGQHLGSSSRKERDRQKQKSMSLLSQQPFLSLVLTCLKGQDEQREGLLTSLYSQVHQIVNNWRDDQYLDDCKPKQLMHEALKLRLNLVGGMFDTVQRSTQQTTEWAMLLLEIIISGTVDMQSNNELFTTVLDMLSVLINGTLAADMSSISQGSMEENKRAYMNLAKKLQKELGERQSDSLEKVRQLLPLPKQTRDVITCEPQGSLIDTKGNKIAGFDSIFKKEGLQVSTKQKISPWDLFEGLKPSAPLSWGWFGTVRVDRRVARGEEQQRLLLYHTHLRPRPRAYYLEPLPLPPEDEEPPAPTLLEPEKKAPEPPKTDKPGAAPPSTEERKKKSTKGKKRSQPATKTEDYGMGPGRSGPYGVTVPPDLLHHPNPGSITHLNYRQGSIGLYTQNQPLPAGGPRVDPYRPVRLPMQKLPTRPTYPGVLPTTMTGVMGLEPSSYKTSVYRQQQPAVPQGQRLRQQLQQSQGMLGQSSVHQMTPSSSYGLQTSQGYTPYVSHVGLQQHTGPADPTRHLQQRPSGYVHQQAPTYGHGLTSTQRFSHQTLQQTPMISTMTPMSAQGVQAGVRSTAILPEQQQQQQQQQQQQQQQQQQQQQQQQQQYHIRQQQQQQILRQQQQQQQQQQQQQQQQQQQQQQQQQQHQQQQQQQAAPPQPQPQSQPQFQRQGLQQTQQQQQTAALVRQLQQQLSNTQPQPSTNIFGRY

SEQ ID NO: 907878 - protein, 1992 aa, Homo sapiens
MKQSMPSLHTKKILFCYFHLTNSWCLRRYGLGKMAAFGILSYEHRPLKRPRLGPPDVYPQDPKQKEDELTALNVKQGFNNQPAVSGDEHGSAKNVSFNPAKISSNFSSIIAEKLRCNTLPDTGRRKPQVNQKDNFWLVTARSQSAINTWFTDLAGTKPLTQLAKKVPIFSKKEEVFGYLAKYTVPVMRAAWLIKMTCAYYAAISETKVKKRHVDPFMEWTQIITKYLWEQLQKMAEYYRPGPAGSGGCGSTIGPLPHDVEVAIRQWDYTEKLAMFMFQDGMLDRHEFLTWVLECFEKIRPGEDELLKLLLPLLLRYSGEFVQSAYLSRRLAYFCTRRLALQLDGVSSHSSHVISAQSTSTLPTTPAPQPPTSSTPSTPFSDLLMCPQHRPLVFGLSCILQTILLCCPSALVWHYSLTDSRIKTGSPLDHLPIAPSNLPMPEGNSAFTQQVRAKLREIEQQIKERGQAVEVRWSFDKCQEATAGFTIGRVLHTLEVLDSHSFERSDFSNSLDSLCNRIFGLGPSKDGHEISSDDDAVVSLLCEWAVSCKRSGRHRAMVVAKLLEKRQAEIEAERCGESEAADEKGSIASGSLSAPSAPIFQDVLLQFLDTQAPMLTDPRSESERVEFFNLVLLFCELIRHDVFSHNMYTCTLISRGDLAFGAPGPRPPSPFDDPADDPEHKEAEGSSSSKLEDPGLSESMDIDPSSSVLFEDMEKPDFSLFSPTMPCEGKGSPSPEKPDVEKEVKPPPKEKIEGTLGVLYDQPRHVQYATHFPIPQEESCSHECNQRLVVLFGVGKQRDDARHAIKKITKDILKVLNRKGTAETDQLAPIVPLNPGDLTFLGGEDGQKRRRNRPEAFPTAEDIFAKFQHLSHYDQHQVTAQVSRNVLEQITSFALGMSYHLPLVQHVQFIFDLMEYSLSISGLIDFAIQLLNELSVVEAELLLKSSDLVGSYTTSLCLCIVAVLRHYHACLILNQDQMAQVFEGLCGVVKHGMNRSDGSSAERCILAYLYDLYTSCSHLKNKFGELFREERWKVRGSEWDLLPSSHDHPTQEERMARDPAACLGSFVDCVLHILLCYQEWALFLSRLAPRLYLWGPPSSPFSSLPSEAPVPYSHVVPFLPSLFCPISLFLSQDPSSLTFSFFSFLPFPDHPSTSAGLLQHYYLLSSIPGSDFCSKVKNTIYCNVEPSESNMRWAPEFMIDTLENPAAHTFTYTGLGKSLSENPANRYSFVCNALMHVCVGHHDPDRVNDIAILCAELTGYCKSLSAEWLGVLKALCCSSNNGTCGFNDLLCNVDVSDLSFHDSLATFVAILIARQCLLLEDLIRCAAIPSLLNAACSEQDSEPGARLTCRILLHLFKTPQLNPCQSDGNKPTVGIRSSCDRHLLAASQNRIVDGAVFAVLKAVFVLGDAELKGSGFTVTGGTEELPEEEGGGGSGGRRQGGRNISVETASLDVYAKYVLRSICQQEWVGERCLKSLCEDSNDLQDPVLSSAQAQRLMQLICYPHRLLDNEDGENPQRQRIKRILQNLDQWTMRQSSLELQLMIKQTPNNEMNSLLENIAKATIEVFQQSAETGSSSGSTASNMPSSSKTKPVLSSLERSGVWLVAPLIAKLPTSVQGHVLKAAGEELEKGQHLGSSSRKERDRQKQKSMSLLSQQPFLSLVLTCLKGQDEQREGLLTSLYSQVHQIVNNWRDDQYLDDCKPKQLMHEALKLRLNLVGGMFDTVQRSTQQTTEWAMLLLEIIISGTVDMQSNNELFTTVLDMLSVLINGTLAADMSSISQGSMEENKRAYMNLAKKLQKELGERQSDSLEKVRQLLPLPKQTRDVITCEPQGSLIDTKGNKIAGFDSIFKKEGLQVSTKQKISPWDLFEGLKPSAPLSWGWFGTVRVDRRVARGEEQQRLLLYHTHLRPRPRASSARGFSRPSSSNRQQLWSGNFNNSSLIPSHSPVPTYLDATEPPGGTACALDVAPPFPLNSQSHSWASTSSGWGPPLRLHF

SEQ ID NO: 907879 - protein, 533 aa, Homo sapiens
EGGSTGFHQTEDGIDTKGNKIAGFDSIFKKEGLQVSTKQKISPWDLFEGLKPSAPLSWGWFGTVRVDRRVARGEEQQRLLLYHTHLRPRPRAYYLEPLPLPPEDEEPPAPTLLEPEKKAPEPPKTDKPGAAPPSTEERKKKSTKGKKRSQPATKTEDYGMGPGRSGPYGVTVPPDLLHHPNPGSITHLNYRQGSIGLYTQNQPLPAGGPRVDPYRPVRLPMQKLPTRPTYPGVLPTTMTGVMGLEPSSYKTSVYRQQQPAVPQGQRLRQQLQQSQGMLGQSSVHQMTPSSSYGLQTSQGYTPYVSHVGLQQHTGPAGTMVPPSYSSQPYQSTHPSTNPTLVDPTRHLQQRPSGYVHQQAPTYGHGLTSTQRFSHQTLQQTPMISTMTPMSAQGVQAGVRSTAILPEQQQQQQQQQQQQQQQQQQQQQQQQQQYHIRQQQQQQILRQQQQQQQQQQQQQQQQQQQQQQQQQQHQQQQQQQAAPPQPQPQSQPQFQRQGLQQTQQQQQTAALVRQLQQQLSNTQPQPSTNIFGRY

SEQ ID NO: 907880 - protein, 1686 aa, Homo sapiens
MKQSMPSLHTKKILFCYFHLTNSWCLRRYGLGKMAAFGILSYEHRPLKRPRLGPPDVYPQDPKQKEDELTALNVKQGFNNQPAVSGDEHGSAKNVSFNPAKISSNFSSIIAEKLRCNTLPDTGRRKPQVNQKDNFWLVTARSQSAINTWFTDLAGTKPLTQLAKKVPIFSKKEEVFGYLAKYTVPVMRAAWLIKMTCAYYAAISETKVKKRHVDPFMEWTQIITKYLWEQLQKMAEYYRPGPAGSGGCGSTIGPLPHDVEVAIRQWDYTEKLAMFMFQDGMLDRHEFLTWVLECFEKIRPGEDELLKLLLPLLLRYSGEFVQSAYLSRRLAYFCTRRLALQLDGVSSHSSHVISAQSTSTLPTTPAPQPPTSSTPSTPFSDLLMCPQHRPLVFGLSCILQTILLCCPSALVWHYSLTDSRIKTGSPLDHLPIAPSNLPMPEGNSAFTQQVRAKLREIEQQIKERGQAVEVRWSFDKCQEATAGFTIGRVLHTLEVLDSHSFERSDFSNSLDSLCNRIFGLGPSKDGHEISSDDDAVVSLLCEWAVSCKRSGRHRAMVVAKLLEKRQAEIEAERCGESEAADEKGSIASGSLSAPSAPIFQDVLLQFLDTQAPMLTDPRSESERVEFFNLVLLFCELIRHDVFSHNMYTCTLISRGDLAFGAPGPRPPSPFDDPADDPEHKEAEGSSSSKLEDPGLSESMDIDPSSSVLFEDMEKPDFSLFSPTMPCEGKGSPSPEKPDVEKEVKPPPKEKIEGTLGVLYDQPRHVQYATHFPIPQEESCSHECNQRLVVLFGVGKQRDDARHAIKKITKDILKVLNRKGTAETDQLAPIVPLNPGDLTFLGGEDGQKRRRNRPEAFPTAEDIFAKFQHLSHYDQHQVTAQVSRNVLEQITSFALGMSYHLPLVQHVQFIFDLMEYSLSISGLIDFAIQLLNELSVVEAELLLKSSDLVGSYTTSLCLCIVAVLRHYHACLILNQDQMAQVFEGLCGVVKHGMNRSDGSSAERCILAYLYDLYTSCSHLKNKFGELFREERWKVRGSEWDLLPSSHDHPTQEERMARDPAACLGSFVDCVLHILLCYQEWALFLSRLAPRLYLWGPPSSPFSSLPSEAPVPYSHVVPFLPSLFCPISLFLSQDPSSLTFSFFSFLPFPDHPSTSAGLLQHYYLLSSIPGSDFCSKVKNTIYCNVEPSESNMRWAPEFMIDTLENPAAHTFTYTGLGKSLSENPANRYSFVCNALMHVCVGHHDPDRVNDIAILCAELTGYCKSLSAEWLGVLKALCCSSNNGTCGFNDLLCNVDVSDLSFHDSLATFVAILIARQCLLLEDLIRCAAIPSLLNAACSEQDSEPGARLTCRILLHLFKTPQLNPCQSDGNKPTVGIRSSCDRHLLAASQNRIVDGAVFAVLKAVFVLGDAELKGSGFTVTGGTEELPEEEGGGGSGGRRQGGRNISVETASLDVYAKYVLRSICQQEWVGERCLKSLCEDSNDLQDPVLSSAQAQRLMQLICYPHRLLDNEDGENPQRQRIKRILQNLDQWTMRQSSLELQLMIKQTPNNEMNSLLENIAKATIEVFQQSAETGSSSGSTASNMPSSSKTKPVLSSLERSGVWLVAPLIAKLPTSVQGHVLKAAGEELEKGQHLGSSSRKERDRQKQKSMSLLSQQPFLSLVLTCLKGQDEQREGLLTSLYSQVHQIG

SEQ ID NO: 907881 - protein, 1341 aa, Homo sapiens
MKQSMPSLHTKKILFCYFHLTNSWCLRRYGLGKMAAFGILSYEHRPLKRPRLGPPDVYPQDPKQKEDELTALNVKQGFNNQPAVSGDEHGSAKNVSFNPAKISSNFSSIIAEKLRCNTLPDTGRRKPQVNQKDNFWLVTARSQSAINTWFTDLAGTKPLTQLAKKVPIFSKKEEVFGYLAKYTVPVMRAAWLIKMTCAYYAAISETKVKKRHVDPFMEWTQIITKYLWEQLQKMAEYYRPGPAGSGGCGSTIGPLPHDVEVAIRQWDYTEKLAMFMFQDGMLDRHEFLTWVLECFEKIRPGEDELLKLLLPLLLRYSGEFVQSAYLSRRLAYFCTRRLALQLDGVSSHSSHVISAQSTSTLPTTPAPQPPTSSTPSTPFSDLLMCPQHRPLVFGLSCILQTILLCCPSALVWHYSLTDSRIKTGSPLDHLPIAPSNLPMPEGNSAFTQQVRAKLREIEQQIKERGQAVEVRWSFDKCQEATAGFTIGRVLHTLEVLDSHSFERSDFSNSLDSLCNRIFGLGPSKDGHEISSDDDAVVSLLCEWAVSCKRSGRHRAMVVAKLLEKRQAEIEAERCGESEAADEKGSIASGSLSAPSAPIFQDVLLQFLDTQAPMLTDPRSESERVEFFNLVLLFCELIRHDVFSHNMYTCTLISRGDLAFGAPGPRPPSPFDDPADDPEHKEAEGSSSSKLEDPGLSESMDIDPSSSVLFEDMEKPDFSLFSPTMPCEGKGSPSPEKPDVEKEVKPPPKEKIEGTLGVLYDQPRHVQYATHFPIPQEESCSHECNQRLVVLFGVGKQRDDARHAIKKITKDILKVLNRKGTAETDQLAPIVPLNPGDLTFLGGEDGQKRRRNRPEAFPTAEDIFAKFQHLSHYDQHQVTAQVSRNVLEQITSFALGMSYHLPLVQHVQFIFDLMEYSLSISGLIDFAIQLLNELSVVEAELLLKSSDLVGSYTTSLCLCIVAVLRHYHACLILNQDQMAQVFEGLCGVVKHGMNRSDGSSAERCILAYLYDLYTSCSHLKNKFGELFREERWKVRGSEWDLLPSSHDHPTQEERMARDPAACLGSFVDCVLHILLCYQEWALFLSRLAPRLYLWGPPSSPFSSLPSEAPVPYSHVVPFLPSLFCPISLFLSQDPSSLTFSFFSFLPFPDHPSTSAGLLQHYYLLSSIPGSDFCSKVKNTIYCNVEPSESNMRWAPEFMIDTLENPAAHTFTYTGLGKSLSENPANRYSFVCNALMHVCVGHHDPDRVNDIAILCAELTGYCKSLSAEWLGVLKALCCSSNNGTCGFNDLLCNVDVSDLSFHDSLATFVAILIARQCLLLEDLIRCAAIPSLLNAGELPICNP

SEQ ID NO: 907882 - protein, 106 aa, Homo sapiens
VRAWDCETRGMRQAALHTLGPDSLSPSSLQGYTPYVSHVGLQQHTGPAGTMVPPSYSSQPYQSTHPSTNPTLVDPTRHLQQRPSGYVHQQAPTYGHGLTSTQRYPK

SEQ ID NO: 907883 - protein, 123 aa, Homo sapiens
LGQRTVKQTPNKEMNSLLENIAKATIEVFQQSAETGSSSGSTASNMPSIFCIFARDGVSPCCQAGLELLTSSDPPTLASQSAGITGVSHRTQPQFFFKPINTSVCVYKRRVILPPGGHCSVWG

SEQ ID NO: 907884 - protein, 2327 aa, Homo sapiens
MQILLKTFLGQNRARLWEPKSSQNSAPQRPPSSLVCIPSSFCASGTFHRFLLSEIDLLPPPPKNSRGTELRPHRARPHLLCSRYCPMVPGVPRLPSVVSGNGREFLTCPLVVSRPPSSQPPPPFSAPSPPSRSPSQPGPGWCLRRYGLGKMAAFGILSYEHRPLKRPRLGPPDVYPQDPKQKEDELTALNVKQGFNNQPAVSGDEHGSAKNVSFNPAKISSNFSSIIAEKLRCNTLPDTGRRKPQVNQKDNFWLVTARSQSAINTWFTDLAGTKPLTQLAKKVPIFSKKEEVFGYLAKYTVPVMRAAWLIKMTCAYYAAISETKVKKRHVDPFMEWTQIITKYLWEQLQKMAEYYRPGPAGSGGCGSTIGPLPHDVEVAIRQWDYTEKLAMFMFQDGMLDRHEFLTWVLECFEKIRPGEDELLKLLLPLLLRYSGEFVQSAYLSRRLAYFCTRRLALQLDGVSSHSSHVISAQSTSTLPTTPAPQPPTSSTPSTPFSDLLMCPQHRPLVFGLSCILQTILLCCPSALVWHYSLTDSRIKTGSPLDHLPIAPSNLPMPEGNSAFTQQVRAKLREIEQQIKERGQAVEVRWSFDKCQEATAGFTIGRVLHTLEVLDSHSFERSDFSNSLDSLCNRIFGLGPSKDGHEISSDDDAVVSLLCEWAVSCKRSGRHRAMVVAKLLEKRQAEIEAERCGESEAADEKGSIASGSLSAPSAPIFQDVLLQFLDTQAPMLTDPRSESERVEFFNLVLLFCELIRHDVFSHNMYTCTLISRGDLAFGAPGPRPPSPFDDPADDPEHKEAEGSSSSKLEDPGLSESMDIDPSSSVLFEDMEKPDFSLFSPTMPCEGKGSPSPEKPDVEKEVKPPPKEKIEGTLGVLYDQPRHVQYATHFPIPQEESCSHECNQRLVVLFGVGKQRDDARHAIKKITKDILKVLNRKGTAETDQLAPIVPLNPGDLTFLGGEDGQKRRRNRPEAFPTAEDIFAKFQHLSHYDQHQVTAQVSRNVLEQITSFALGMSYHLPLVQHVQFIFDLMEYSLSISGLIDFAIQLLNELSVVEAELLLKSSDLVGSYTTSLCLCIVAVLRHYHACLILNQDQMAQVFEGLCGVVKHGMNRSDGSSAERCILAYLYDLYTSCSHLKNKFGELFSDFCSKVKNTIYCNVEPSESNMRWAPEFMIDTLENPAAHTFTYTGLGKSLSENPANRYSFVCNALMHVCVGHHDPDRVNDIAILCAELTGYCKSLSAEWLGVLKALCCSSNNGTCGFNDLLCNVDVSDLSFHDSLATFVAILIARQCLLLEDLIRCAAIPSLLNAACSEQDSEPGARLTCRILLHLFKTPQLNPCQSDGNKPTVGIRSSCDRHLLAASQNRIVDGAVFAVLKAVFVLGDAELKGSGFTVTGGTEELPEEEGGGGSGGRRQGGRNISVETASLDVYAKYVLRSICQQEWVGERCLKSLCEDSNDLQDPVLSSAQAQRLMQLICYPHRLLDNEDGENPQRQRIKRILQNLDQWTMRQSSLELQLMIKQTPNNEMNSLLENIAKATIEVFQQSAETGSSSGSTASNMPSSSKTKPVLSSLERSGVWLVAPLIAKLPTSVQGHVLKAAGEELEKGQHLGSSSRKERDRQKQKSMSLLSQQPFLSLVLTCLKGQDEQREGLLTSLYSQVHQIVNNWRDDQYLDDCKPKQLMHEALKLRLNLVGGMFDTVQRSTQQTTEWAMLLLEIIISGTVDMQSNNELFTTVLDMLSVLINGTLAADMSSISQGSMEENKRAYMNLAKKLQKELGERQSDSLEKVRQLLPLPKQTRDVITCEPQGSLIDTKGNKIAGFDSIFKKEGLQVSTKQKISPWDLFEGLKPSAPLSWGWFGTVRVDRRVARGEEQQRLLLYHTHLRPRPRAYYLEPLPLPPEDEEPPAPTLLEPEKKAPEPPKTDKPGAAPPSTEERKKKSTKGKKRSQPATKTEDYGMGPGRSGPYGVTVPPDLLHHPNPGSITHLNYRQGSIGLYTQNQPLPAGGPRVDPYRPVRLPMQKLPTRPTYPGVLPTTMTGVMGLEPSSYKTSVYRQQQPAVPQGQRLRQQLQQSQGMLGQSSVHQMTPSSSYGLQTSQGYTPYVSHVGLQQHTGPAGTMVPPSYSSQPYQSTHPSTNPTLVDPTRHLQQRPSGYVHQQAPTYGHGLTSTQRFSHQTLQQTPMISTMTPMSAQGVQAGVRSTAILPEQQQQQQQQQQQQQQQQQQQQQQQQQQYHIRQQQQQQILRQQQQQQQQQQQQQQQQQQQQQQQQQQHQQQQQQQAAPPQPQPQSQPQFQRQGLQQTQQQQQTAALVRQLQQQLSNTQPQPSTNIFGRY

SEQ ID NO: 907885 - protein, 2303 aa, Homo sapiens
MKQSMPSLHTKKILFCYFHLTNSWCLRRYGLGKMAAFGILSYEHRPLKRPRLGPPDVYPQDPKQKEDELTALNVKQGFNNQPAVSGDEHGSAKNVSFNPAKISSNFSSIIAEKLRCNTLPDTGRRKPQVNQKDNFWLVTARSQSAINTWFTDLAGTKPLTQLAKKVPIFSKKEEVFGYLAKYTVPVMRAAWLIKMTCAYYAAISETKVKKRHVDPFMEWTQIITKYLWEQLQKMAEYYRPGPAGSGGCGSTIGPLPHDVEVAIRQWDYTEKLAMFMFQDGMLDRHEFLTWVLECFEKIRPGEDELLKLLLPLLLRYSGEFVQSAYLSRRLAYFCTRRLALQLDGVSSHSSHVISAQSTSTLPTTPAPQPPTSSTPSTPFSDLLMCPQHRPLVFGLSCILQTILLCCPSALVWHYSLTDSRIKTGSPLDHLPIAPSNLPMPEGNSAFTQQVRAKLREIEQQIKERGQAVEVRWSFDKCQEATAGFTIGRVLHTLEVLDSHSFERSDFSNSLDSLCNRIFGLGPSKDGHEISSDDDAVVSLLCEWAVSCKRSGRHRAMVVAKLLEKRQAEIEAERCGESEAADEKGSIASGSLSAPSAPIFQDVLLQFLDTQAPMLTDPRSESERVEFFNLVLLFCELIRHDVFSHNMYTCTLISRGDLAFGAPGPRPPSPFDDPADDPEHKEAEGSSSSKLEDPGLSESMDIDPSSSVLFEDMEKPDFSLFSPTMPCEGKGSPSPEKPDVEKEVKPPPKEKIEGTLGVLYDQPRHVQYATHFPIPQEESCSHECNQRLVVLFGVGKQRDDARHAIKKITKDILKVLNRKGTAETDQLAPIVPLNPGDLTFLGGEDGQKRRRNRPEAFPTAEDIFAKFQHLSHYDQHQVTAQVSRNVLEQITSFALGMSYHLPLVQHVQFIFDLMEYSLSISGLIDFAIQLLNELSVVEAELLLKSSDLVGSYTTSLCLCIVAVLRHYHACLILNQDQMAQVFEGLCGVVKHGMNRSDGSSAERCILAYLYDLYTSCSHLKNKFGELFREERWKVRGSEWDLLPSSHDHPLPPFPHCLQRPQFLIPMWFLSCPVCFVPSPFSCLKILHPSLSPFFLFSPFLTIPRPQQAFFNTTISFPPSLRDFCSKVKNTIYCNVEPSESNMRWAPEFMIDTLENPAAHTFTYTGLGKSLSENPANRYSFVCNALMHVCVGHHDPDRVNDIAILCAELTGYCKSLSAEWLGVLKALCCSSNNGTCGFNDLLCNVDVSDLSFHDSLATFVAILIARQCLLLEDLIRCAAIPSLLNAACSEQDSEPGARLTCRILLHLFKTPQLNPCQSDGNKPTVGIRSSCDRHLLAASQNRIVDGAVFAVLKAVFVLGDAELKGSGFTVTGGTEELPEEEGGGGSGGRRQGGRNISVETASLDVYAKYVLRSICQQEWVGERCLKSLCEDSNDLQDPVLSSAQAQRLMQLICYPHRLLDNEDGENPQRQRIKRILQNLDQWTMRQSSLELQLMIKQTPNNEMNSLLENIAKATIEVFQQSAETGSSSGSTASNMPSSSKTKPVLSSLERSGVWLVAPLIAKLPTSVQGHVLKAAGEELEKGQHLGSSSRKERDRQKQKSMSLLSQQPFLSLVLTCLKGQDEQREGLLTSLYSQVHQIVNNWRDDQYLDDCKPKQLMHEALKLRLNLVGGMFDTVQRSTQQTTEWAMLLLEIIISGTVDMQSNNELFTTVLDMLSVLINGTLAADMSSISQGSMEENKRAYMNLAKKLQKELGERQSDSLEKVRQLLPLPKQTRDVITCEPQGSLIDTKGNKIAGFDSIFKKEGLQVSTKQKISPWDLFEGLKPSAPLSWGWFGTVRVDRRVARGEEQQRLLLYHTHLRPRPRAYYLEPLPLPPEDEEPPAPTLLEPEKKAPEPPKTDKPGAAPPSTEERKKKSTKGKKRSQPATKTEDYGMGPGRSGPYGVTVPPDLLHHPNPGSITHLNYRQGSIGLYTQNQPLPAGGPRVDPYRPVRLPMQKLPTRPTYPGVLPTTMTGVMGLEPSSYKTSVYRQQQPAVPQGQRLRQQLQQSQGMLGQSSVHQMTPSSSYGLQTSQGYTPYVSHVGLQQHTGPAGTMVPPSYSSQPYQSTHPSTNPTLVDPTRHLQQRPSGYVHQQAPTYGHGLTSTQRFSHQTLQQTPMISTMTPMSAQGVQAGVRSTAILPEQQQQQQQQQQQQQQQQQQQQQQQQQQYHIRQQQQQQILRQQQQQQQQQQQQQQQQQQQQQQQQQQHQQQQQQQAAPPQPQPQSQPQFQRQGLQQTQQQQQTAALVRQLQQQLSNTQPQPSTNIFGRY

SEQ ID NO: 907886 - protein, 2193 aa, Homo sapiens
MKQSMPSLHTKKILFCYFHLTNSWCLRRYGLGKMAAFGILSYEHRPLKRPRLGPPDVYPQDPKQKEDELTALNVKQGFNNQPAVSGDEHGSAKNVSFNPAKISSNFSSIIAEKLRCNTLPDTGRRKPQVNQKDNFWLVTARSQSAINTWFTDLAGTKPLTQLAKKVPIFSKKEEVFGYLAKYTVPVMRAAWLIKMTCAYYAAISETKVKKRHVDPFMEWTQIITKYLWEQLQKMAEYYRPGPAGSGGCGSTIGPLPHDVEVAIRQWDYTEKLAMFMFQDGMLDRHEFLTWVLECFEKIRPGEDELLKLLLPLLLRYSGEFVQSAYLSRRLAYFCTRRLALQLDGVSSHSSHVISAQSTSTLPTTPAPQPPTSSTPSTPFSDLLMCPQHRPLVFGLSCILQTILLCCPSALVWHYSLTDSRIKTGSPLDHLPIAPSNLPMPEGNSAFTQQVRAKLREIEQQIKERGQAVEVRWSFDKCQEATAGFTIGRVLHTLEVLDSHSFERSDFSNSLDSLCNRIFGLGPSKDGHEISSDDDAVVSLLCEWAVSCKRSGRHRAMVVAKLLEKRQAEIEAERCGESEAADEKGSIASGSLSAPSAPIFQDVLLQFLDTQAPMLTDPRSESERVEFFNLVLLFCELIRHDVFSHNMYTCTLISRGDLAFGAPGPRPPSPFDDPADDPEHKEAEGSSSSKLEDPGLSESMDIDPSSSVLFEDMEKPDFSLFSPTMPCEGKGSPSPEKPDVEKEVKPPPKEKIEGTLGVLYDQPRHVQYATHFPIPQEESCSHECNQRLVVLFGVGKQRDDARHAIKKITKDILKVLNRKGTAETDQLAPIVPLNPGDLTFLGGEDGQKRRRNRPEAFPTAEDIFAKFQHLSHYDQHQVTAQVSRNVLEQITSFALGMSYHLPLVQHVQFIFDLMEYSLSISGLIDFAIQLLNELSVVEAELLLKSSDLVGSYTTSLCLCIVAVLRHYHACLILNQDQMAQVFEGLCGVVKHGMNRSDGSSAERCILAYLYDLYTSCSHLKNKFGELFREERWKVRGSEWDLLPSSHDHPTQEERMARDPAACLGSFVDCVLHILLCYQEWALFLSRLAPRLYLWGPPSSPFSSLPSEAPVPYSHVVPFLPSLFCPISLFLSQDPSSLTFSFFSFLPFPDHPSTSAGLLQHYYLLSSIPGSDFCSKVKNTIYCNVEPSESNMRWAPEFMIDTLENPAAHTFTYTGLGKSLSENPANRYSFVCNALMHVCVGHHDPDRVNDIAILCAELTGYCKSLSAEWLGVLKALCCSSNNGTCGFNDLLCNVDVSDLSFHDSLATFVAILIARQCLLLEDLIRCAAIPSLLNAACSEQDSEPGARLTCRILLHLFKTPQLNPCQSDGNKPTVGIRSSCDRHLLAASQNRIVDGAVFAVLKAVFVLGDAELKGSGFTVTGGTEELPEEEGGGGSGGRRQGGRNISVETASLDVYAKYVLRSICQQEWVGERCLKSLCEDSNDLQDPVLSSAQAQRLMQLICYPHRLLDNEDGENPQRQRIKRILQNLDQWTMRQSSLELQLMIKQTPNNEMNSLLENIAKATIEVFQQSAETGSSSGSTASNMPSSSKTKPVLSSLERSGVWLVAPLIAKLPTSVQGHVLKAAGEELEKGQHLGSSSRKERDRQKQKSMSLLSQQPFLSLVLTCLKGQDEQREGLLTSLYSQVHQIVNNWRDDQYLDDCKPKQLMHEALKLRLNLVGGMFDTVQRSTQQTTEWAMLLLEIIISGTVDMQSNNELFTTVLDMLSVLINGTLAADMSSISQGSMEENKRAYMNLAKKLQKELGERQSDSLEKVRQLLPLPKQTRDVITCEPQGSLIDTKGNKIAGFDSIFKKEGLQVSTKQKISPWDLFEGLKPSAPLSWGWFGTVRVDRRVARGEEQQRLLLYHTHLRPRPRAYYLEPLPLPPEDEEPPAPTLLEPEKKAPEPPKTDKPGAAPPSTEERKKKSTKGKKRSQPATKTEDYGMGPGRSGPYGVTVPPDLLHHPNPGSITHLNYRQGSIGLYTQNQPLPAGGPRVDPYRPVRLPMQKLPTRPTYPGVLPTTMTGVMGLEPSSYKTSVYRQQQPAVPQGQRLRQQLQQSQGMLGQSSVHQMTPSSSYGLQTSQGYTPYVSHVGLQQHTGPAGTMVPPSYSSQPYQSTHPSTNPTLVDPTRHLQQRPSGYVHQQAPTYGHGLTSTQRYPK

SEQ ID NO: 907887 - protein, 797 aa, Homo sapiens
KGIRAGARAFVLVLETGSSSGSTASNMPSSSKTKPVLSSLERSGVWLVAPLIAKLPTSVQGHVLKAAGEELEKGQHLGSSSRKERDRQKQKSMSLLSQQPFLSLVLTCLKGQDEQREGLLTSLYSQVHQIVNNWRDDQYLDDCKPKQLMHEALKLRLNLVGGMFDTVQRSTQQTTEWAMLLLEIIISGTVDMQSNNELFTTVLDMLSVLINGTLAADMSSISQGSMEENKRAYMNLAKKLQKELGERQSDSLEKVRQLLPLPKQTRDVITCEPQGSLIDTKGNKIAGFDSIFKKEGLQVSTKQKISPWDLFEGLKPSAPLSWGWFGTVRVDRRVARGEEQQRLLLYHTHLRPRPRAYYLEPLPLPPEDEEPPAPTLLEPEKKAPEPPKTDKPGAAPPSTEERKKKSTKGKKRSQPATKTEDYGMGPGRSGPYGVTVPPDLLHHPNPGSITHLNYRQGSIGLYTQNQPLPAGGPRVDPYRPVRLPMQKLPTRPTYPGVLPTTMTGVMGLEPSSYKTSVYRQQQPAVPQGQRLRQQLQQSQGMLGQSSVHQMTPSSSYGLQTSQGYTPYVSHVGLQQHTGPAGTMVPPSYSSQPYQSTHPSTNPTLVDPTRHLQQRPSGYVHQQAPTYGHGLTSTQRFSHQTLQQTPMISTMTPMSAQGVQAGVRSTAILPEQQQQQQQQQQQQQQQQQQQQQQQQQQYHIRQQQQQQILRQQQQQQQQQQQQQQQQQQQQQQQQQQHQQQQQQQAAPPQPQPQSQPQFQRQGLQQTQQQQQTAALVRQLQQQLSNTQPQPSTNIFGRY

SEQ ID NO: 907888 - protein, 404 aa, Homo sapiens
RGRASRPGGRATAAAGAADAAAGTRTEDYGMGPGRSGPYGVTVPPDLLHHPNPGSITHLNYRQGSIGLYTQNQPLPAGGPRVDPYRPVRLPMQKLPTRPTYPGVLPTTMTGVMGLEPSSYKTSVYRQQQPAVPQGQRLRQQLQQSQGMLGQSSVHQMTPSSSYGLQTSQGYTPYVSHVGLQQHTGPAGTMVPPSYSSQPYQSTHPSTNPTLVDPTRHLQQRPSGYVHQQAPTYGHGLTSTQRFSHQTLQQTPMISTMTPMSAQGVQAGVRSTAILPEQQQQQQQQQQQQQQQQQQQQQQQQQQYHIRQQQQQQILRQQQQQQQQQQQQQQQQQQQQQQQQQQHQQQQQQQAAPPQPQPQSQPQFQRQGLQQTQQQQQTAALVRQLQQQLSNTQPQPSTNIFGRY

SEQ ID NO: 907889 - protein, 98 aa, Homo sapiens
NACFCATPPEPQSHIVPSSARGFSRPSSSNRQQLWSGNFNNSSLIPSHSPVPTYLDATEPPGGTACALDVAPPFPLNSQSHSWASTSSGWGPPLRLHF

SEQ ID NO: 907890 - protein, 476 aa, Homo sapiens
MMHLAFLVLLCLPVCSAYPLSGAAKEEDSNKDLAQQYLEKYYNLEKDVKQFRRKDSNLIVKKIQGMQKFLGLEVTGKLDTDTLEVMRKPRCGVPDVGHFSSFPGMPKWRKTHLTYRIVNYTPDLPRDAVDSAIEKALKVWEEVTPLTFSRLYEGEADIMISFAVKEHGDFYSFDGPGHSLAHAYPPGPGLYGDIHFDDDEKWTEDASGTNLFLVAAHELGHSLGLFHSANTEALMYPLYNSFTELAQFRLSQDDVNGIQSLYGPPPASTEEPLVPTKSVPSGSEMPAKCDPALSFDAISTLRGEYLFFKDRYFWRRSHWNPEPEFHLISAFWPSLPSYLDAAYEVNSRDTVFIFKGNEFWAIRGNEVQAGYPRGIHTLGFPPTIRKIDAAVSDKEKKKTYFFAADKYWRFDENSQSMEQGFPRLIADDFPGVEPKVDAVLQAFGFFYFFSGSSQFEFDPNARMVTHILKSNSWLHC

SEQ ID NO: 907891 - protein, 192 aa, Homo sapiens [sequence omitted]

SEQ ID NO: 907892 - protein, 425 aa, Homo sapiens
MASSSPDSPCSCDCFVSVPPASAIPAVIFAKNSDRPRDEVQEVVFVPAGTHTPGSRLQCTYIEVEQVSKTHAVILSRPSWLWGAEMGANEHGVCIGNEAVWTKEPVGEGEALLGMDLLRLALERSSSAQEALHVITGLLEHYGQGGNCLEDAAPFSYHSTFLLADRTEAWVLETAGRLWAAQRIQEGARNISNQLSIGTDISAQHPELRTHAQAKGWWDGQGAFDFAQIFSLTQQPVRMEAAKARFQAGRELLRQRQGGITAEVMMGILRDKESGICMDSGGFRTTASMVSVLPQDPTQPCVHFLTATPDPSRSVFKPFIFGVGVAQAPQVLSPTFGAQDPVRTLPRFQTQVDRRHTLYRGHQAALGLMERDQDRGQQLQQKQQDLEQEGLEATQGLLAGEWAPPLWELGSLFQAFVKRESQAYA

SEQ ID NO: 907893 - protein, 378 aa, Homo sapiens [sequence omitted]

SEQ ID NO: 907894 - protein, 307 aa, Homo sapiens
MLALERSSSAQEALHVITGLLEHYGQGGNCLEDAAPFSYHSTFLLADRTEAWVLETAGRLWAAQRIQEGARNISNQLSIGTDISAQHPELRTHAQAKGWWDGQGAFDFAQIFSLTQQPVRMEAAKARFQAGRELLRQRQGGITAEVMMGILRDKESGICMDSGGFRTTASMVSVLPQDPTQPCVHFLTATPDPSRSVFKPFIFGVGVAQAPQVLSPTFGAQDPVRTLPRFQTQVDRRHTLYRGHQAALGLMERDQDRGQQLQQKQQDLEQEGLEATQGLLAGEWAPPLWELGSLFQAFVKRESQAYA

SEQ ID NO: 907895 - protein, 307 aa, Homo sapiens; identical to SEQ ID NO: 907894

SEQ ID NO: 907896 - protein, 187 aa, Homo sapiens [sequence omitted]

SEQ ID NO: 907897 - protein, 297 aa, Homo sapiens
VWEEERMASSSPDSPCSCNCLEDAAPFSYHSTFLLADRTEAWVLETAGRLWAAQRIQEGARNISNQLSIGTDISAQHPELRTHAQAKGWWDGQGAFDFAQIFSLTQQPVRMEAAKARFQAGRELLRQRQGGITAEVMMGILRDKESGICMDSGGFRTTASMVSVLPQDPTQPCVHFLTATPDPSRSVFKPFIFGVGVAQAPQVLSPTFGAQDPVRTLPRFQTQVDRRHTLYRGHQAALGLMERDQDRGQQLQQKQQDLEQEGLEATQGLLAGEWAPPLWELGSLFQAFVKRESQAYA

SEQ ID NO: 907898 - protein, 68 aa, Homo sapiens
ISNQLSIGTDISAQHPELRTHAQAKGWWDGQGAFDFAQIFSLTQQPVRMEAAKARFQAGRELLRQRQG

SEQ ID NO: 907899 - protein, 378 aa, Homo sapiens [sequence omitted]

SEQ ID NO: 907900 - protein, 433 aa, Homo sapiens [sequence omitted]

SEQ ID NO: 907901 - protein, 187 aa, Homo sapiens [sequence omitted]

SEQ ID NO: 907902 - protein, 307 aa, Homo sapiens; identical to SEQ ID NO: 907894

SEQ ID NO: 907903 - protein, 257 aa, Homo sapiens
MHYGQGGNCLEDAAPFSYHSTFLLADRTEAWVLETAGRLWAAQRIQEGARNISNQLSIGTDISAQHPELRTHAQAKGWWDGQGAFDFAQIFSLTQQPVRMEAAKARFQAGRELLRQRQGGITAEVMMGILRDKESGICMDSGGFRTTASMVSVLPQDPTQPCVHFLTATPDPSRSVFKPFIFGVGVAQAPQVLSPTFGAQDPVRTLPRFQTQVEIGGSSSSRNSRIWSRKASRPHRGCWPASGPHPSGSWAASSRPS

SEQ ID NO: 907904 - protein, 216 aa, Homo sapiens
MSKYKLIMLRHGEGAWNKENRFCSWVDQKLNSEGMEEARNCGKQLKALNFEFDLVFTSVLNRSIHTAWLILEELGQEWVPVESSWRLNERHYGALIGLNREQMALNHGEEQVRLWRRSYNVTPPPIEESHPYYQEIYNDRRYKVCDVPLDQLPRSESLKDVLERLLPYWNERIAPEVLRGKTILISAHGNSSRALLKHLEGTSFIYHLLEVAKCDI

SEQ ID NO: 907905 - protein, 259 aa, Homo sapiens
MSKYKLIMLRHGEGAWNKENRFCSWVDQKLNSEGMEEARNCGKQLKALNFEFDLVFTSVLNRSIHTAWLILEELGQEWVPVESSWRLNERHYGALIGLNREQMALNHGEEQVRLWRRSYNVTPPPIEESHPYYQEIYNDRRYKVCDVPLDQLPRSESLKDVLERLLPYWNERIAPEVLRGKTILISAHGNSSRALLKHLEGISDEDIINITLPTGVPILLELDENLRAVGPHQFLGDQEAIQAAIKKVEDQGKVKQAKK

SEQ ID NO: 907906 - protein, 259 aa, Homo sapiens; identical to SEQ ID NO: 907905

SEQ ID NO: 907907 - protein, 259 aa, Homo sapiens; identical to SEQ ID NO: 907905

SEQ ID NO: 907908 - protein, 79 aa, Homo sapiens
TTQHPHPVFTPPRPPSPVYIGISDEDIINITLPTGVPILLELDENLRAVGPHQFLGDQEAIQAAIKKVEDQGKVKQAKK

SEQ ID NO: 907909 - protein, 152 aa, Homo sapiens
MSKYKLIMLRHGEGAWNKENRFCSWVDQKLNSEGMEEARNCGKQLKALNFEFDLVFTSVLNRSIHTAWLILEELGQEWVPVESSWRLNERHYGALIGLNREQMALNHGEEQVRLWRRSYNVTPPPIEESHPYYQEIIIESPLTGTILISSSL

SEQ ID NO: 907910 - protein, 259 aa, Homo sapiens; identical to SEQ ID NO: 907905

SEQ ID NO: 907911 - protein, 259 aa, Homo sapiens; identical to SEQ ID NO: 907905

SEQ ID NO: 907912 - protein, 259 aa, Homo sapiens; identical to SEQ ID NO: 907905

SEQ ID NO: 907913 - protein, 259 aa, Homo sapiens; identical to SEQ ID NO: 907905

SEQ ID NO: 907914 - protein, 81 aa, Homo sapiens
ELKKHIKYANNTPRFGVSVEIYRISDEDIINITLPTGVPILLELDENLRAVGPHQFLGDQEAIQAAIKKVEDQGKVKQAKK

SEQ ID NO: 907915 - protein, 318 aa, Homo sapiens
GPAPVGGARQRRREATRKTKPGRRCLRRLQPPRSDQGRWDALMAGPAALSAAAAAALAAALLLLRREDPGPGAGPSMAETEALSKLREDFRMQNKSVFILGASGETGRVLLKEILEQGLFSKVTLIGRRKLTFDEEAYKNVNQEVVDFEKLDDYASAFQGHDVGFCCLGTTRGKAGAEGFVRVDRDYVLKSAELAKAGGCKHFNLLSSKGADKSSNFLYLQVKGEVEAKVEELKFDRYSVFRPGVLLCDRQESRPGEWLVRKFFGSLPDSWASGHSVPVVTVVRAMLNNVVRPRDKQMELLENKAIHDLGKAHGSLKP

SEQ ID NO: 907916 - protein, 242 aa, Homo sapiens
MAETEALSKLREDFRMQNKSVFILGASGETGRVLLKEILEQGLFSKVTLIGRRKLTFDEEAYKNVNQEVVDFEKLDDYASAFQGHDVGFCCLGTTRGKAGAEGFVRVDRDYVLKSAELAKAGGCKHFNLLSSKGADKSSNFLYLQVKGEVEAKVEELKFDRYSVFRPGVLLCDRQESRPGEWLVRKFFGSLPDSWASGHSVPVVTVVRAMLNNVVRPRDKQMELLENKAIHDLGKAHGSLKP

SEQ ID NO: 907917 - protein, 280 aa, Homo sapiens
GPAPVGGARQRRREATRKTKPGRRCLRRLQPPRSDQGSMAETEALSKLREDFRMQNKSVFILGASGETGRVLLKEILEQGLFSKVTLIGRRKLTFDEEAYKNVNQEVVDFEKLDDYASAFQGHDVGFCCLGTTRGKAGAEGFVRVDRDYVLKSAELAKAGGCKHFNLLSSKGADKSSNFLYLQVKGEVEAKVEELKFDRYSVFRPGVLLCDRQESRPGEWLVRKFFGSLPDSWASGHSVPVVTVVRAMLNNVVRPRDKQMELLENKAIHDLGKAHGSLKP

SEQ ID NO: 907918 - protein, 253 aa, Homo sapiens
MRCCVLVRLFLFVEELVDGVGQWRKTVVQDSDAINPLLGHENEVLLKEILEQGLFSKVTLIGRRKLTFDEEAYKNVNQEVVDFEKLDDYASAFQGHDVGFCCLGTTRGKAGAEGFVRVDRDYVLKSAELAKAGGCKHFNLLSSKGADKSSNFLYLQVKGEVEAKVEELKFDRYSVFRPGVLLCDRQESRPGEWLVRKFFGSLPDSWASGHSVPVVTVVRAMLNNVVRPRDKQMELLENKAIHDLGKAHGSLKP

SEQ ID NO: 907919 - protein, 242 aa, Homo sapiens; identical to SEQ ID NO: 907916

SEQ ID NO: 907920 - protein, 242 aa, Homo sapiens; identical to SEQ ID NO: 907916

SEQ ID NO: 907921 - protein, 242 aa, Homo sapiens; identical to SEQ ID NO: 907916

SEQ ID NO: 907922 - protein, 242 aa, Homo sapiens; identical to SEQ ID NO: 907916

SEQ ID NO: 907923 - protein, 242 aa, Homo sapiens; identical to SEQ ID NO: 907916

SEQ ID NO: 907924 - protein, 242 aa, Homo sapiens; identical to SEQ ID NO: 907916

SEQ ID NO: 907925 - protein, 242 aa, Homo sapiens; identical to SEQ ID NO: 907916

SEQ ID NO: 907926 - protein, 242 aa, Homo sapiens; identical to SEQ ID NO: 907916

SEQ ID NO: 907927 - protein, 242 aa, Homo sapiens; identical to SEQ ID NO: 907916

SEQ ID NO: 907928 - protein, 242 aa, Homo sapiens; identical to SEQ ID NO: 907916

SEQ ID NO: 907929 - protein, 196 aa, Homo sapiens
MAETEALSKLREDFRMQNKSVFILGASGETGRVLLKEILEQGLFSKVTLIGRRKLTFDEEAYKNVNQEVVDFEKLDDYASAFQGHDVGFCCLGTTRGKAGAGEVEAKVEELKFDRYSVFRPGVLLCDRQESRPGEWLVRKFFGSLPDSWASGHSVPVVTVVRAMLNNVVRPRDKQMELLENKAIHDLGKAHGSLKP

SEQ ID NO: 907930 - protein, 318 aa, Homo sapiens; identical to SEQ ID NO: 907915

SEQ ID NO: 907931 - protein, 129 aa, Homo sapiens
MAETEALSKLREDFRMQNKSVFILGASGETGRVLLKEILEQGLFSKVTLIGRRKLTFDEEAYKNVNQEVVDFEKLDDYASAFQGHDVGFCCLGTTRGKAGAEGFVRVDRDYVLKSAELAKAGGCKHFNF

SEQ ID NO: 907932 - protein, 85 aa, Homo sapiens
GPPRAEGSIAYPVVCDGEKSRPGEWLVRKFFGSLPDSWASGHSVPVVTVVRAMLNNVVRPRDKQMELLENKAIHDLGKAHGSLKP

SEQ ID NO: 907933 - protein, 178 aa, Homo sapiens
GPAPVGGARQRRREATRKTKPGRRCLRRLQPPRSDQGRWDALMAGPAALSAAAAAALAAALLLLRREDPGPGAGPSMAETEALSKLREDFRMQNKSVFILGASGETGRVLLKEILEQGLFSKVTLIGRRKLTFDEEAYKNVNQEVVDFEKLDDYASAFQGHDVGFCCLGTTRGKAGAR

SEQ ID NO: 907934 - protein, 102 aa, Homo sapiens
MAETEALSKLREDFRMQNKSVFILGASGETGRVLLKEILEQGLFSKVTLIGRRKLTFDEEAYKNVNQEVVDFEKLDDYASAFQGHDVGFCCLGTTRGKAGAR

SEQ ID NO: 907935 - protein, 102 aa, Homo sapiens; identical to SEQ ID NO: 907934

SEQ ID NO: 907936 - protein, 242 aa, Homo sapiens; identical to SEQ ID NO: 907916

SEQ ID NO: 907937 - protein, 73 aa, Homo sapiens
CYIIFYLCVRGGGFICNDSLNYHRYRIKKWWTLKSWMTTPLPFKVMMLDSVAWVPPEGKLGRRDLFVLTEIMC

SEQ ID NO: 907938 - protein, 202 aa, Homo sapiens
MLFIGAKYRGRGKLSARLSYPPPLHNQEVVDFEKLDDYASAFQGHDVGFCCLGTTRGKAGAEGFVRVDRDYVLKSAELAKAGGCKHFNLLSSKGADKSSNFLYLQVKGEVEAKVEELKFDRYSVFRPGVLLCDRQESRPGEWLVRKFFGSLPDSWASGHSVPVVTVVRAMLNNVVRPRDKQMELLENKAIHDLGKAHGSLKP

SEQ ID NO: 907939 - protein, 242 aa, Homo sapiens; identical to SEQ ID NO: 907916

SEQ ID NO: 907940 - protein, 242 aa, Homo sapiens; identical to SEQ ID NO: 907916

SEQ ID NO: 907941 - protein, 242 aa, Homo sapiens; identical to SEQ ID NO: 907916

SEQ ID NO: 907942 - protein, 242 aa, Homo sapiens; identical to SEQ ID NO: 907916

SEQ ID NO: 907943 - protein, 242 aa, Homo sapiens; identical to SEQ ID NO: 907916

SEQ ID NO: 907944 - protein, 242 aa, Homo sapiens; identical to SEQ ID NO: 907916

SEQ ID NO: 907945 - protein, 242 aa, Homo sapiens; identical to SEQ ID NO: 907916

SEQ ID NO: 907946 - protein, 272 aa, Homo sapiens
GPAPVGGARQRRREATRKTKPGRRCLRRLQPPRSDQGRWDALMAGPAALSAAAAAALAAALLLLRREDPGPGAGPSMAETEALSKLREDFRMQNKSVFILGASGETGRVLLKEILEQGLFSKVTLIGRRKLTFDEEAYKNVNQEVVDFEKLDDYASAFQGHDVGFCCLGTTRGKAGAGEVEAKVEELKFDRYSVFRPGVLLCDRQESRPGEWLVRKFFGSLPDSWASGHSVPVVTVVRAMLNNVVRPRDKQMELLENKAIHDLGKAHGSLKP

SEQ ID NO: 907947 - protein, 237 aa, Homo sapiens
GPAPVGGARQRRREATRKTKPGRRCLRRLQPPRSDQGRWDALMAGPAALSAAAAAALAAALLLLRREDPGPGAGPSMAETEALSKLREDFRMQNKSVFILGASGETGRVLLKEILEQGLFSKVTLIGRRKLTFDEEAYKNVNQEVVDFEKLDDYASAFQGHDVGFCCLGTTRGKAGAEGFVRVDRDYVLKSAELAKAGGCKHFNLLSSKGADKSSNFLYLQVKGEVEAKVEELKFDR

SEQ ID NO: 907948 - protein, 178 aa, Homo sapiens; identical to SEQ ID NO: 907933

SEQ ID NO: 907949 - protein, 94 aa, Homo sapiens
ARYRQTLNYVEKKELTLLVGMEIRVVIVENSMEISQKTKKRTIISNSSYYYLPKDKKSVYQRDNLHSHLPCLLQHNSQEQRYGMHLSVHQWMSG

SEQ ID NO: 907950 - protein, 119 aa, Homo sapiens
MTTPLPFKVMMLDSVAWVPPEGKLGRGKEGICSFPFLLASNIKDSFLAHSFSLCLLQCLNVNKPLLFKILYAALTFGILLIVLISSSFKVILEFRPQCWRRRKYLHDFAYCDYRYHYIP

SEQ ID NO: 907951 - protein, 1101 aa, Homo sapiens
MDRAPTEQNVKLSAEVEPFIPQKKSPDTFMIPMALPNDNGSVSGVEPTPIPSYLITCYPFVQENQSNRQFPLYNNDIRWQQPNPNPTGPYFAYPIISAQPPVSTEYTYYQLMPAPCAQVMGFYHPFPTPYSNTFQAANTVNAITTECTERPSQLGQVFPLSSHRSRNSNRGSVVPKQQLLQQHIKSKRPLVKNVATQKETNAAGPDSRSKIVLLVDASQQTDFPSDIANKSLSETTATMLWKSKGRRRRASHPTAESSSEQGASEADIDSDSGYCSPKHSNNQPAAGALRNPDSGTMNHVESSMCAGGVNWSNVTCQATQKKPWMEKNQTFSRGGRQTEQRNNSQVGFRCRGHSTSSERRQNLQKRPDNKHLSSSQSHRSDPNSESLYFEDEDGFQELNENGNAKDENIQQKLSSKVLDDLPENSPINIVQTPIPITTSVPKRAKSQKKKALAAALATAQEYSEISMEQKKLQEALSKAAGKKNKTPVQLDLGDMLAALEKQQQAMKARQITNTRPLSYTVVTAASFHTKDSTNRKPLTKSQPCLTSFNSVDIASSKAKKGKEKEIAKLKRPTALKKVILKEREEKKGRLTVDHNLLGSEEPTEMHLDFIDDLPQEIVSQEDTGLSMPSDTSLSPASQNSPYCMTPVSQGSPASSGIGSPMASSTITKIHSKRFREYCNQVLCKEIDECVTLLLQELVSFQERIYQKDPVRAKARRRLVMGLREVTKHMKLNKIKCVIISPNCEKIQSKGGLDEALYNVIAMAREQEIPFVFALGRKALGRCVNKLVPVSVVGIFNYFGAESLFNKLVELTEEARKAYKDMVAAMEQEQAEEALKNVKKVPHHMGHSRNPSAASAISFCSVISEPISEVNEKEYETNWRNMVETSDGLEASENEKEVSCKHSTSEKPSKLPFDTPPIGKQPSLVATGSTTSATSAGKSTASDKEEVKPDDLEWASQQSTETGSLDGSCRDLLNSSITSTTSTLVPGMLEEEEDEDEEEEEDYTHEPISVEVQLNSRIESWVSETQRTMETLQLGKTLNGSEEDNVEQSGEEEAEAPEVLEPGMDSEAWTADQQASPGQQKSSNCSSLNKEHSDSNYTTQTT

SEQ ID NO: 907952 - protein, 145 aa, Homo sapiens
MDRAPTEQNVKLSAEVEPFIPQKKSPDTFMIPMALPNDNGSVSGVEPTPIPSYLITCYPFVQENQSNRQFPLYNNDILTDTLITGIQRRGSNDSFAGKGHTNQVIQMTVYESGQLISCSMDDTVWYTTSCCGTTADKECETDVSK

SEQ ID NO: 907953 - protein, 1101 aa, Homo sapiens; identical to SEQ ID NO: 907951

SEQ ID NO: 907954 - protein, 1101 aa, Homo sapiens; identical to SEQ ID NO: 907951

SEQ ID NO: 907955 - protein, 1056 aa, Homo sapiens
MDRAPTEQNVKLSAEVEPFIPQKKSPDTFMIPMALPNDNGSVSGVEPTPIPSYLITCYPFVQENQSNRQFPLYNNDIRWQQPNPNPTGPYFAYPIISAQPPVSTEYTYYQLMPAPCAQVMGFYHPFPTPYSNTFQAANTVNAITTECTERPSQLGQVFPLSSHRSRNSNRGSVVPKQQLLQQHIKSKRPLVKNVATQKETNAAGPDSRSKIVLLVDASQQTDFPSDIANKSLSETTATMLWKSKGRRRRASHPTAESSSEQGASEADIDSDSGYCSPKHSNNQPAAGALRNPDSGTMNHVESSMCAGGVNWSNVTCQATQKKPWMEKNQTFSRGGRQTEQRNNSQDEDGFQELNENGNAKDENIQQKLSSKVLDDLPENSPINIVQTPIPITTSVPKRAKSQKKKALAAALATAQEYSEISMEQKKLQEALSKAAGKKNKTPVQLDLGDMLAALEKQQQAMKARQITNTRPLSYTVVTAASFHTKDSTNRKPLTKSQPCLTSFNSVDIASSKAKKGKEKEIAKLKRPTALKKVILKEREEKKGRLTVDHNLLGSEEPTEMHLDFIDDLPQEIVSQEDTGLSMPSDTSLSPASQNSPYCMTPVSQGSPASSGIGSPMASSTITKIHSKRFREYCNQVLCKEIDECVTLLLQELVSFQERIYQKDPVRAKARRRLVMGLREVTKHMKLNKIKCVIISPNCEKIQSKGGLDEALYNVIAMAREQEIPFVFALGRKALGRCVNKLVPVSVVGIFNYFGAESLFNKLVELTEEARKAYKDMVAAMEQEQAEEALKNVKKVPHHMGHSRNPSAASAISFCSVISEPISEVNEKEYETNWRNMVETSDGLEASENEKEVSCKHSTSEKPSKLPFDTPPIGKQPSLVATGSTTSATSAGKSTASDKEEVKPDDLEWASQQSTETGSLDGSCRDLLNSSITSTTSTLVPGMLEEEEDEDEEEEEDYTHEPISVEVQLNSRIESWVSETQRTMETLQLGKTLNGSEEDNVEQSGEEEAEAPEVLEPGMDSEAWTADQQASPGQQKSSNCSSLNKEHSDSNYTTQTT

SEQ ID NO: 907956 - protein, 635 aa, Homo sapiens
MEQKKLQEALSKAAGKKNKTPVQLDLGDMLAALEKQQQAMKARQITNTRPLSYTVVTAASFHTKDSTNRKPLTKSQPCLTSFNSVDIASSKAKKGKEKEIAKLKRPTALKKVILKEREEKKGRLTVDHNLLGSEEPTEMHLDFIDDLPQEIVSQEDTGLSMPSDTSLSPASQNSPYCMTPVSQGSPASSGIGSPMASSTITKIHSKRFREYCNQVLCKEIDECVTLLLQELVSFQERIYQKDPVRAKARRRLVMGLREVTKHMKLNKIKCVIISPNCEKIQSKGGLDEALYNVIAMAREQEIPFVFALGRKALGRCVNKLVPVSVVGIFNYFGAESLFNKLVELTEEARKAYKDMVAAMEQEQAEEALKNVKKVPHHMGHSRNPSAASAISFCSVISEPISEVNEKEYETNWRNMVETSDGLEASENEKEVSCKHSTSEKPSKLPFDTPPIGKQPSLVATGSTTSATSAGKSTASDKEEVKPDDLEWASQQSTETGSLDGSCRDLLNSSITSTTSTLVPGMLEEEEDEDEEEEEDYTHEPISVEVQLNSRIESWVSETQRTMETLQLGKTLNGSEEDNVEQSGEEEAEAPEVLEPGMDSEAWTADQQASPGQQKSSNCSSLNKEHSDSNYTTQTT

SEQ ID NO: 907957 - protein, 497 aa, Homo sapiens [sequence omitted]

SEQ ID NO: 907958 - protein, 638 aa, Homo sapiens
MDRAPTEQNVKLSAEVEPFIPQKKSPDTFMIPMALPNDNGSVSGVEPTPIPSYLITCYPFVQENQSNRQFPLYNNDIRWQQPNPNPTGPYFAYPIISAQPPVSTEYTYYQLMPAPCAQVMGFYHPFPTPYSNTFQAANTVNAITTECTERPSQLGQVFPLSSHRSRNSNRGSVVPKQQLLQQHIKSKRPLVKNVATQKETNAAGPDSRSKIVLLVDASQQTDFPSDIANKSLSETTATMLWKSKGRRRRASHPTAESSSEQGASEADIDSDSGYCSPKHSNNQPAAGALRNPDSGTMNHVESSMCAGGVNWSNVTCQATQKKPWMEKNQTFSRGGRQTEQRNNSQVGFRCRGHSTSSERRQNLQKRPDNKHLSSSQSHRSDPNSESLYFEDEDGFQELNENGNAKDENIQQKLSSKVLDDLPENSPINIVQTPIPITTSVPKRAKSQKKKALAAALATAQEYSEISMEQKKLQEALSKAAGKKNKTPVQLDLGDMLAALEKQQQAMKARQITNTRPLSYTVVTAASFHTKDSTNRKPLTKSQPCLTSFNSVDIASSKAKKGKEKEIAKLKRPTALKKVILKEREEKKGRLTVDHNLLGSEEPTEMHLDFIDDLPQEIVSQEGKELPLSPLLMEWSEIF

SEQ ID NO: 907959 - protein, 401 aa, Homo sapiens [sequence omitted]

SEQ ID NO: 907960 - protein, 1101 aa, Homo sapiens; identical to SEQ ID NO: 907951

SEQ ID NO: 907961 - protein, 1101 aa, Homo sapiens; identical to SEQ ID NO: 907951

SEQ ID NO: 907962 - protein, 982 aa, Homo sapiens [sequence omitted]

SEQ ID NO: 907963 - protein, 635 aa, Homo sapiens; identical to SEQ ID NO: 907956

SEQ ID NO: 907964 - protein, 497 aa, Homo sapiens [sequence omitted]

SEQ ID NO: 907965 - protein, 537 aa, Homo sapiens
MDRAPTEQNVKLSAEVEPFIPQKKSPDTFMIPMALPNDNGSVSGVEPTPIPSYLITCYPFVQENQSNRQFPLYNNDIRWQQPNPNPTGPYFAYPIISAQPPVSTEYTYYQLMPAPCAQVMGFYHPFPTPYSNTFQAANTVNAITTECTERPSQLGQVFPLSSHRSRNSNRGSVVPKQQLLQQHIKSKRPLVKNVATQKETNAAGPDSRSKIVLLVDASQQTDFPSDIANKSLSETTATMLWKSKGRRRRASHPTAESSSEQGASEADIDSDSGYCSPKHSNNQPAAGALRNPDSGTMNHVESSMCAGGVNWSNVTCQATQKKPWMEKNQTFSRGGRQTEQRNNSQVGFRCRGHSTSSERRQNLQKRPDNKHLSSSQSHRSDPNSESLYFEDEDGFQELNENGNAKDENIQQKLSSKVLDDLPENSPINIVQTPIPITTSVPKRAKSQKKKALAAALATAQEYSEISMEQKKLQEALSKAAGKKNKTPVQLDLGDMLAALEKQQQAMKARQITNTRPLSYTGDIISLSNLLFVSANIC

SEQ ID NO: 907966 - protein, 676 aa, Homo sapiens
PRPWKAGDCELGWRSRGAEATESKLSGGFRWTQKTSPTQGDSAITHSLYRMIFLTALPLFWIMISASRGGHWGAWMPSSISAFEGTCVSIPCRFDFPDELRPAVVHGVWYFNSPYPKNYPPVVFKSRTQVVHESFQGRSRLLGDLGLRNCTLLLSNVSPELGGKYYFRGDLGGYNQYTFSEHSVLDIVNTPNIVVPPEVVAGTEVEVSCMVPDNCPELRPELSWLGHEGLGEPAVLGRLREDEGTWVQVSLLHFVPTREANGHRLGCQASFPNTTLQFEGYASMDVKYPPVIVEMNSSVEAIEGSHVSLLCGADSNPPPLLTWMRDGTVLREAVAESLLLELEEVTPAEDGVYACLAENAYGQDNRTVGLSVMYAPWKPTVNGTMVAVEGETVSILCSTQSNPDPILTIFKEKQILSTVIYESELQLELPAVSPEDDGEYWCVAENQYGQRATAFNLSVEFAPVLLLESHCAAARDTVQCLCVVKSNPEPSVAFELPSRNVTVNESEREFVYSERSGLVLTSILTLRGQAQAPPRVICTARNLYGAKSLELPFQGAHRLMWAKIGPVGAVVAFAILIAIVCYITQTRRKKNVTESPSFSAGDNPPVLFSSDFRISGAPEKYESERRLGSERRLLGLRGEPPELDLSYSHSDLGKRPTKDSYTLTEELAEYAEIRVK

SEQ ID NO: 907967 - protein, 337 aa, Homo sapiens
PRPWKAGDCELGWRSRGAEATESKLSGGFRWTQKTSPTQGDSAITHSLYRMIFLTALPLFWIMISASRGGHWGAWMPSSISAFEGTCVSIPCRFDFPDELRPAVVHGVWYFNSPYPKNYPPVVFKSRTQVVHESFQGRSRLLGDLGLRNCTLLLSNVSPELGGKYYFRGDLGGYNQYTFSEHSVLDIVNTPNIVVPPEVVAGTEVEVSCMVPDNCPELRPELSWLGHEGLGEPAVLGRLREDEGTWVQVSLLHFVPTREANGHRLGCQASFPNTTLQFEGYASMDVKYPPGIVQMKPRGSHTRVPSEAVLGGEKTPRFNGSGGKPPKEAKGLESEVN

SEQ ID NO: 907968 - protein, 691 aa, Homo sapiens
PRPWKAGDCELGWRSRGAEATESKLSGGFRWTQKTSPTQGDSAITHSLYRMIFLTALPLFWIMISASRGGHWGAWMPSSISAFEGTCVSIPCRFDFPDELRPAVVHGVWYFNSPYPKNYPPVVFKSRTQVVHESFQGRSRLLGDLGLRNCTLLLSNVSPELGGKYYFRGDLGGYNQYTFSEHSVLDIVNTPNIVVPPEVVAGTEVEVSCMVPDNCPELRPELSWLGHEGLGEPAVLGRLREDEGTWVQVSLLHFVPTREANGHRLGCQASFPNTTLQFEGYASMDVKYPPVIVEMNSSVEAIEGSHVSLLCGADSNPPPLLTWMRDGTVLREAVAESLLLELEEVTPAEDGVYACLAENAYGQDNRTVGLSVMYAPWKPTVNGTMVAVEGETVSILCSTQSNPDPILTIFKEKQILSTVIYESELQLELPAVSPEDDGEYWCVAENQYGQRATAFNLSVEFAPVLLLESHCAAARDTVQCLCVVKSNPEPSVAFELPSRNVTVNESEREFVYSERSGLVLTSILTLRGQAQAPPRVICTARNLYGAKSLELPFQGAHRLMWAKIGPVGAVVAFAILIAIVCYITQTRRKKNVTESPSFSAGDNPPVLFSSDFRISGAPEKYESKEVSTLESHWVPQESERRLGSERRLLGLRGEPPELDLSYSHSDLGKRPTKDSYTLTEELAEYAEIRVK

SEQ ID NO: 907969 - protein, 165 aa, Homo sapiens
MSCGPLWCMVSGTSIAPTPRTTPRVICTARNLYGAKSLELPFQGAHRLMWAKIGPVGAVVAFAILIAIVCYITQTRRKKNVTESPSFSAGDNPPVLFSSDFRISGAPEKYESERRLGSERRLLGLRGEPPELDLSYSHSDLGKRPTKDSYTLTEELAEYAEIRVK

SEQ ID NO: 907970 - protein, 189 aa, Homo sapiens
PRPWKAGDCELGWRSRGAEATESKLSGGFRWTQKTSPTQGDSAITHSLYRMIFLTALPLFWIMISASRGGHWGAWMPSSISAFEGTCVSIPCRFDFPDELRPAVVHGVWYFNSPYPKNYPPVVFKSRTQVVHESFQGRSRLLGDLGLRNCTLLLSNVSPEQRQRNTNNQKNQKQTTTKNTLLKSTRFRG

SEQ ID NO: 907971 - protein, 686 aa, Homo sapiens
PRPWKAGDCELGWRSRGAEATESKLSGGFRWTQKTSPTQGDSAITHSLYRMIFLTALPLFWIMISASRGGHWGAWMPSSISAFEGTCVSIPCRFDFPDELRPAVVHGVWYFNSPYPKNYPPVVFKSRTQVVHESFQGRSRLLGDLGLRNCTLLLSNVSPELGGKYYFRGDLGGYNQYTFSEHSVLDIVNTPNIVVPPEVVAGTEVEVSCMVPDNCPELRPELSWLGHEGLGEPAVLGRLREDEGTWVQVSLLHFVPTREANGHRLGCQASFPNTTLQFEGYASMDVKYPPVIVEMNSSVEAIEGSHVSLLCGADSNPPPLLTWMRDGTVLREAVAESLLLELEEVTPAEDGVYACLAENAYGQDNRTVGLSVMYAPWKPTVNGTMVAVEGETVSILCSTQSNPDPILTIFKEKQILSTVIYESELQLELPAVSPEDDGEYWCVAENQYGQRATAFNLSVEFAPVLLLESHCAAARDTVQCLCVVKSNPEPSVAFELPSRNVTVNESEREFVYSERSGLVLTSILTLRGQAQAPPRVICTARNLYGAKSLELPFQGAHRLMWAKIGPVGAVVAFAILIAIVCYITQTRRKKNVTESPSFSAGDNPPVLFSSDFRISGAPEKYESERRLGSERRLLGLRGEPPELDLSYSHSDLGKRPTKDSYTQDYICTRDALRVHHHRLPGDVGPC

SEQ ID NO: 907972 - protein, 162 aa, Homo sapiens
MRAPIPEPKPGDLIEIFRPFYRHWAIYVGDGYVVHLAPPSEVAGAGAASVMSALTDKAIVKKELLYDVAGSDKYQVNNKHDDKYSPLPCSKIIQRAEELVGQEVLYKLTSENCEHFVNELRYGVARSDQVRDVIIAASVAGMGLAAMSLIGVMFSRNKRQKQ

SEQ ID NO: 907973 - protein, 162 aa, Homo sapiens; identical to SEQ ID NO: 907972

SEQ ID NO: 907974 - protein, 167 aa, Homo sapiens
IYRSLFAAAFPEPKPGDLIEIFRPFYRHWAIYVGDGYVVHLAPPSEVAGAGAASVMSALTDKAIVKKELLYDVAGSDKYQVNNKHDDKYSPLPCSKIIQRAEELVGQEVLYKLTSENCEHFVNELRYGVARSDQVRDVIIAASVAGMGLAAMSLIGVMFSRNKRQKQ

SEQ ID NO: 907975 - protein, 112 aa, Homo sapiens
MSALTDKAIVKKELLYDVAGSDKYQVNNKHDDKYSPLPCSKIIQRAEELVGQEVLYKLTSENCEHFVNELRYGVARSDQVRDVIIAASVAGMGLAAMSLIGVMFSRNKRQKQ

SEQ ID NO: 907976 - protein, 112 aa, Homo sapiens; identical to SEQ ID NO: 907975

SEQ ID NO: 907977 - protein, 106 aa, Homo sapiens
MSALTDKAIVKKELLYDVAGSDKYQVNNKHDDKYSPLPCSKIIQRAEVLYKLTSENCEHFVNELRYGVARSDQVRDVIIAASVAGMGLAAMSLIGVMFSRNKRQKQ

SEQ ID NO: 907978 - protein, 162 aa, Homo sapiens; identical to SEQ ID NO: 907972

SEQ ID NO: 907979 - protein, 162 aa, Homo sapiens; identical to SEQ ID NO: 907972

SEQ ID NO: 907980 - protein, 177 aa, Homo sapiens
MKTQRSSWCQLLLHRIGQRIPEPKPGDLIEIFRPFYRHWAIYVGDGYVVHLAPPSEVAGAGAASVMSALTDKAIVKKELLYDVAGSDKYQVNNKHDDKYSPLPCSKIIQRAEELVGQEVLYKLTSENCEHFVNELRYGVARSDQVRDVIIAASVAGMGLAAMSLIGVMFSRNKRQKQ

SEQ ID NO: 907981 - protein, 221 aa, Homo sapiens
MLLPFREEEIKLLKGARWLFLGSEARLSRPAQQKPQSRGVWRRSFLLMTINPCSPCLRHLRSEIEPGLEGPHREGRCVRPLHWAIYVGDGYVVHLAPPSEVAGAGAASVMSALTDKAIVKKELLYDVAGSDKYQVNNKHDDKYSPLPCSKIIQRAEELVGQEVLYKLTSENCEHFVNELRYGVARSDQVRDVIIAASVAGMGLAAMSLIGVMFSRNKRQKQ

SEQ ID NO: 907982 - protein, 156 aa, Homo sapiens
MRAPIPEPKPGDLIEIFRPFYRHWAIYVGDGYVVHLAPPSEVAGAGAASVMSALTDKAIVKKELLYDVAGSDKYQVNNKHDDKYSPLPCSKIIQRAEVLYKLTSENCEHFVNELRYGVARSDQVRDVIIAASVAGMGLAAMSLIGVMFSRNKRQKQ

SEQ ID NO: 907983 - protein, 104 aa, Homo sapiens
MRAPIPEPKPGDLIEIFRPFYRHWAIYVGDGYVVHLAPPSQRCHHRCKRCRNGLGSHEPYWSHVLKKQATKAITEKDCPVSDDFIHQGGLVLLESLGFGLWISL

SEQ ID NO: 907984 - protein, 1264 aa, Homo sapiens
MSTLYVSPHPDAFPSLRALIAARYGEAGEGPGWGGAQPRICLQPPPTSRTPFPPPRLPALEQGPGGLWVWGATAVAQLLWPAGLGGPGGSRAAVLVQQWVSYADTELIPAACGATLPALGLRSSAQDPQAVLGALGRALSPLEEWLRLHTYLAGEAPTLADLAAVTALLLPFRYVLDPPARRIWNNVTRWFVTCVRQPEFRAVLGEVVLYSGARPLSHQPGPEAPALPKTAAQLKKEAKKREKLEKFQQKQKIQQQQPPPGEKKPKPEKREKRDPGVITYDLPTPPGEKKDVSGPMPDSYSPRYVEAAWYPWWEQQGFFKPEYGRPNVSAANPRGVFMMCIPPPNVTGSLHLGHALTNAIQDSLTRWHRMRGETTLWNPGCDHAGIATQVVVEKKLWREQGLSRHQLGREAFLQEVWKWKEEKGDRIYHQLKKLGSSLDWDRACFTMDPKLSAAVTEAFVRLHEEGIIYRSTRLVNWSCTLNSAISDIEVDKKELTGRTLLSVPGYKEKVEFGVLVSFAYKVQGSDSDEEVVVATTRIETMLGDVAVAVHPKDTRYQHLKGKNVIHPFLSRSLPIVFDEFVDMDFGTGAVKITPAHDQNDYEVGQRHGLEAISIMDSRGALINVPPPFLGLPRFEARKAVLVALKERGLFRGIEDNPMVVPLCNRSKDVVEPLLRPQWYVRCGEMAQAASAAVTRGDLRILPEAHQRTWHAWMDNIREWCISRQLWWGHRIPAYFVTVSDPAVPPGEDPDGRYWVSGRNEAEAREKAAKEFGVSPDKISLQQDEDVLDTWFSSGLFPLSILGWPNQSEDLSVFYPGTLLETGHDILFFWVARMVMLGLKLTGRLPFREVYLHAIVRDAHGRKMSKSLGNVIDPLDVIYGISLQGLHNQLLNSNLDPSEVEKAKEGQKADFPAGIPECGTDALRFGLCAYMSQGRDINLDVNRILGYRHFCNKLWNATKFALRGLGKGFVPSPTSQPGGHESLVDRWIRSRLTEAVRLSNQGFQAYDFPAVTTAQYSFWLYELCDVYLECLKPVLNGVDQVAAECARQTLYTCLDVGLRLLSPFMPFVTEELFQRLPRRMPQAPPSLCVTPYPEPSECSWKDPEAEAALELALSITRAVRSLRADYNLTRIRPDCFLEVADEATGALASAVSGYVQALASAGVVAVLALGAPAPQGCAVALASDRCSIHLQLQGLVDPARELGKLQAKRVEAQRQAQRLRERRAASGYPVKVPLEVQEADEAKLQQTEAELRKVDEAIALFQKML

SEQ ID NO: 907985 - protein, 1264 aa, Homo sapiens; identical to SEQ ID NO: 907984

SEQ ID NO: 907986 - protein, 969 aa, Homo sapiens [sequence omitted]

SEQ ID NO: 907987 - protein, 1102 aa, Homo sapiens
MALMASGLGELAEGTKPFPRPRRANSVAIPELVAELAVTQYPVHIQDYVPTCPRSDINLDVNLDTGLPPAQLKKEAKKREKLEKFQQKQKIQQQQPPPGEKKPKPEKREKRDPGVITYDLPTPPGEKKDVSGPMPDSYSPRYVEAAWYPWWEQQGFFKPEYGRPNVSAANPRGVFMMCIPPPNVTGSLHLGHALTNAIQDSLTRWHRMRGETTLWNPGCDHAGIATQVVVEKKLWREQGLSRHQLGREAFLQEVWKWKEEKGDRIYHQLKKLGSSLDWDRACFTMDPKLSAAVTEAFVRLHEEGIIYRSTRLVNWSCTLNSAISDIEVDKKELTGRTLLSVPGYKEKVEFGVLVSFAYKVQGSDSDEEVVVATTRIETMLGDVAVAVHPKDTRYQHLKGKNVIHPFLSRSLPIVFDEFVDMDFGTGAVKITPAHDQNDYEVGQRHGLEAISIMDSRGALINVPPPFLGLPRFEARKAVLVALKERGLFRGIEDNPMVVPLCNRSKDVVEPLLRPQWYVRCGEMAQAASAAVTRGDLRILPEAHQRTWHAWMDNIREWCISRQLWWGHRIPAYFVTVSDPAVPPGEDPDGRYWVSGRNEAEAREKAAKEFGVSPDKISLQQDEDVLDTWFSSGLFPLSILGWPNQSEDLSVFYPGTLLETGHDILFFWVARMVMLGLKLTGRLPFREVYLHAIVRDAHGRKMSKSLGNVIDPLDVIYGISLQGLHNQLLNSNLDPSEVEKAKEGQKADFPAGIPECGTDALRFGLCAYMSQGRDINLDVNRILGYRHFCNKLWNATKFALRGLGKGFVPSPTSQPGGHESLVDRWIRSRLTEAVRLSNQGFQAYDFPAVTTAQYSFWLYELCDVYLECLKPVLNGVDQVAAECARQTLYTCLDVGLRLLSPFMPFVTEELFQRLPRRMPQAPPSLCVTPYPEPSECSWKDPEAEAALELALSITRAVRSLRADYNLTRIRPDCFLEVADEATGALASAVSGYVQALASAGVVAVLALGAPAPQGCAVALASDRCSIHLQLQGLVDPARELGKLQAKRVEAQRQAQRLRERRAASGYPVKVPLEVQEADEAKLQQTEAELRKVDEAIALFQKML

SEQ ID NO: 907988 - protein, 1315 aa, Homo sapiens
MSTLYVSPHPDAFPSLRALIAARYGEAGEGPGWGGAQPRICLQPPPTSRTPFPPPRLPALEQGPGGLWVWGATAVAQLLWPAGLGGPGGSRAAVLVQQWVSYADTELIPAACGATLPALGLRSSAQDPQAVLGALGRALSPLEEWLRLHTYLAGEAPTLADLAAVTALLLPFRYVLDPPARRIWNNVTRWFVTCVRQPEFRAVLGEVVLYSGARPLSHQPGPEAPALPKTAAQLKKEAKKREKLEKFQQKQKIQQQQPPPGEKKPKPEKREKRDPGVITYDLPTPPGEKKDVSGPMPDSYSPRYVEAAWYPWWEQQGFFKPEYGRPNVSAANPRGVFMMCIPPPNVTGSLHLGHALTNAIQDSLTRWHRMRGETTLWNPGCDHAGIATQVVVEKKLWREQGLSRHQLGREAFLQEVWKWKEEKGDRIYHQLKKLGSSLDWDRACFTMDPKLSAAVTEAFVRLHEEGIIYRSTRLVNWSCTLNSAISDIEVDKKELTGRTLLSVPGYKEKVEFGVLVSFAYKVQGSDSDEEVVVATTRIETMLGDVAVAVHPKDTRYQHLKGKNVIHPFLSRSLPIVFDEFVDMDFGTGAVKITPAHDQNDYEVGQRHGLEAISIMDSRGALINVPPPFLGLPRFEARKAVLVALKERGLFRGIEDNPMVVPLCNRSKDVVEPLLRPQWYVRCGEMAQAASAAVTRGDLRILPEAHQRTWHAWMDNIRCVGSSVWEGLAEELSRAHSGQAPSGPPWFLLPDICREWCISRQLWWGHRIPAYFVTVSDPAVPPGEVSRGPELLLGHPAGVDPDGRYWVSGRNEAEAREKAAKEFGVSPDKISLQQDEDVLDTWFSSGLFPLSILGWPNQSEDLSVFYPGTLLETGHDILFFWVARMVMLGLKLTGRLPFREVYLHAIVRDAHGRKMSKSLGNVIDPLDVIYGISLQGLHNQLLNSNLDPSEVEKAKEGQKADFPAGIPECGTDALRFGLCAYMSQGRDINLDVNRILGYRHFCNKLWNATKFALRGLGKGFVPSPTSQPGGHESLVDRWIRSRLTEAVRLSNQGFQAYDFPAVTTAQYSFWLYELCDVYLECLKPVLNGVDQVAAECARQTLYTCLDVGLRLLSPFMPFVTEELFQRLPRRMPQAPPSLCVTPYPEPSECSWKDPEAEAALELALSITRAVRSLRADYNLTRIRPDCFLEVADEATGALASAVSGYVQALASAGVVAVLALGAPAPQGCAVALASDRCSIHLQLQGLVDPARELGKLQAKRVEAQRQAQRLRERRAASGYPVKVPLEVQEADEAKLQQTEAELRKVDEAIALFQKML

SEQ ID NO: 907989 - protein, 1225 aa, Homo sapiens
MSTLYVSPHPDAFPSLRALIAARYGEAGEGPGWGGAQPRICLQPPPTSRTPFPPPRLPALEQGPGGLWVWGATAVAQLLWPAGLGGPGGSRAAVLVQQWVSYADTELIPAACGATLPALGLRSSAQDPQAVLGALGRALSPLEEWLRLHTYLAGEAPTLADLAAVTALLLPFRYVLDPPARRIWNNVTRWFVTCVRQPEFRAVLGEVVLYSGARPLSHQPGPEAPALPKTAAQLKKEAKKREKLEKFQQKQKIQQQQPPPGEKKPKPEKREKRDPGVITYDLPTPPGEKKDVSGPMPDSYSPRYVEAAWYPWWEQQGFFKPEYGRPNVSAANPRGVFMMCIPPPNVTGSLHLGHALTNAIQDSLTRWHRMRGETTLWNPGCDHAGIATQVVVEKKLWREQGLSRHQLGREAFLQEVWKWKEEKGDRIYHQLKKLGSSLDWDRACFTMDPKLSAAVTEAFVRLHEEGIIYRSTRLVNWSCTLNSAISDIEVDKKELTGRTLLSVPGYKEKVEFGVLVSFAYKVQGSDSDEEVVVATTRIETMLGDVAVAVHPKDTRYQHLKGKNVIHPFLSRSLPIVFDEFVDMDFGTGAVKITPAHDQNDYEVGQRHGLEAISIMDSRGALINVPPPFLGLPRFEARKAVLVALKERGLFRGIEDNPMVVPLCNRSKDVVEPLLRPQWEWCISRQLWWGHRIPAYFVTVSDPAVPPGEDPDGRYWVSGRNEAEAREKAAKEFGVSPDKISLQQDEDVLDTWFSSGLFPLSILGWPNQSEDLSVFYPGTLLETGHDILFFWVARMVMLGLKLTGRLPFREVYLHAIVRDAHGRKMSKSLGNVIDPLDVIYGISLQGLHNQLLNSNLDPSEVEKAKEGQKADFPAGIPECGTDALRFGLCAYMSQGRDINLDVNRILGYRHFCNKLWNATKFALRGLGKGFVPSPTSQPGGHESLVDRWIRSRLTEAVRLSNQGFQAYDFPAVTTAQYSFWLYELCDVYLECLKPVLNGVDQVAAECARQTLYTCLDVGLRLLSPFMPFVTEELFQRLPRRMPQAPPSLCVTPYPEPSECSWKDPEAEAALELALSITRAVRSLRADYNLTRIRPDCFLEVADEATGALASAVSGYVQALASAGVVAVLALGAPAPQGCAVALASDRCSIHLQLQGLVDPARELGKLQAKRVEAQRQAQRLRERRAASGYPVKVPLEVQEADEAKLQQTEAELRKVDEAIALFQKML

SEQ ID NO: 907990 - protein, 1293 aa, Homo sapiens
MSTLYVSPHPDAFPSLRALIAARYGEAGEGPGWGGAQPRICLQPPPTSRTPFPPPRLPALEQGPGGLWVWGATAVAQLLWPAGLGGPGGSRAAVLVQQWVSYADTELIPAACGATLPALGLRSSAQDPQAVLGALGRALSPLEEWLRLHTYLAGEAPTLADLAAVTALLLPFRYVLDPPARRIWNNVTRWFVTCVRQPEFRAVLGEVVLYSGARPLSHQPGPEAPALPKTAAQLKKEAKKREKLEKFQQKQKIQQQQPPPGEKKPKPEKREKRDPGVITYDLPTPPGEKKDVSGPMPDSYSPRYVEAAWYPWWEQQGFFKPEYGRPNVSAANPRGVFMMCIPPPNVTGSLHLGHALTNAIQDSLTRWHRMRGETTLWNPGCDHAGIATQVVVEKKLWREQGLSRHQLGREAFLQEVWKWKEEKGDRIYHQLKKLGSSLDWDRACFTMDPKLSAAVTEAFVRLHEEGIIYRSTRLVNWSCTLNSAISDIEVDKKELTGRTLLSVPGYKEKVEFGVLVSFAYKVQGSDSDEEVVVATTRIETMLGDVAVAVHPKDTRYQHLKGKNVIHPFLSRSLPIVFDEFVDMDFGTGAVKITPAHDQNDYEVGQRHGLEAISIMDSRGALINVPPPFLGLPRFEARKAVLVALKERGLFRGIEDNPMVVPLCKLRVGAWDGRKMEGSSGFYRLAFSPTCTPSRSKDVVEPLLRPQWYVRCGEMAQAASAAVTRGDLRILPEAHQRTWHAWMDNIREWCISRQLWWGHRIPAYFVTVSDPAVPPGEDPDGRYWVSGRNEAEAREKAAKEFGVSPDKISLQQDEDVLDTWFSSGLFPLSILGWPNQSEDLSVFYPGTLLETGHDILFFWVARMVMLGLKLTGRLPFREVYLHAIVRDAHGRKMSKSLGNVIDPLDVIYGISLQGLHNQLLNSNLDPSEVEKAKEGQKADFPAGIPECGTDALRFGLCAYMSQGRDINLDVNRILGYRHFCNKLWNATKFALRGLGKGFVPSPTSQPGGHESLVDRWIRSRLTEAVRLSNQGFQAYDFPAVTTAQYSFWLYELCDVYLECLKPVLNGVDQVAAECARQTLYTCLDVGLRLLSPFMPFVTEELFQRLPRRMPQAPPSLCVTPYPEPSECSWKDPEAEAALELALSITRAVRSLRADYNLTRIRPDCFLEVADEATGALASAVSGYVQALASAGVVAVLALGAPAPQGCAVALASDRCSIHLQLQGLVDPARELGKLQAKRVEAQRQAQRLRERRAASGYPVKVPLEVQEADEAKLQQTEAELRKVDEAIALFQKML

SEQ ID NO: 907991 - protein, 682 aa, Homo sapiens
MDFGTGAVKITPAHDQNDYEVGQRHGLEAISIMDSRGALINVPPPFLGLPRFEARKAVLVALKERGLFRGIEDNPMVVPLCNRSKDVVEPLLRPQWYVRCGEMAQAASAAVTRGDLRILPEAHQRTWHAWMDNIREWCISRQLWWGHRIPAYFVTVSDPAVPPGEDPDGRYWVSGRNEAEAREKAAKEFGVSPDKISLQQDEDVLDTWFSSGLFPLSILGWPNQSEDLSVFYPGTLLETGHDILFFWVARMVMLGLKLTGRLPFREVYLHAIVRDAHGRKMSKSLGNVIDPLDVIYGISLQGLHNQLLNSNLDPSEVEKAKEGQKADFPAGIPECGTDALRFGLCAYMSQGRDINLDVNRILGYRHFCNKLWNATKFALRGLGKGFVPSPTSQPGGHESLVDRWIRSRLTEAVRLSNQGFQAYDFPAVTTAQYSFWLYELCDVYLECLKPVLNGVDQVAAECARQTLYTCLDVGLRLLSPFMPFVTEELFQRLPRRMPQAPPSLCVTPYPEPSECSWKDPEAEAALELALSITRAVRSLRADYNLTRIRPDCFLEVADEATGALASAVSGYVQALASAGVVAVLALGAPAPQGCAVALASDRCSIHLQLQGLVDPARELGKLQAKRVEAQRQAQRLRERRAASGYPVKVPLEVQEADEAKLQQTEAELRKVDEAIALFQKML

SEQ ID NO: 907992 - protein, 811 aa, Homo sapiens
TPPPPNPNKARYEAGVNRPRLVNWSCTLNSAISDIEVDKKELTGRTLLSVPGYKEKVEFGVLVSFAYKVQGSDSDEEVVVATTRIETMLGDVAVAVHPKDTRYQHLKGKNVIHPFLSRSLPIVFDEFVDMDFGTGAVKITPAHDQNDYEVGQRHGLEAISIMDSRGALINVPPPFLGLPRFEARKAVLVALKERGLFRGIEDNPMVVPLCNRSKDVVEPLLRPQWYVRCGEMAQAASAAVTRGDLRILPEAHQRTWHAWMDNIREWCISRQLWWGHRIPAYFVTVSDPAVPPGEDPDGRYWVSGRNEAEAREKAAKEFGVSPDKISLQQDEDVLDTWFSSGLFPLSILGWPNQSEDLSVFYPGTLLETGHDILFFWVARMVMLGLKLTGRLPFREVYLHAIVRDAHGRKMSKSLGNVIDPLDVIYGISLQGLHNQLLNSNLDPSEVEKAKEGQKADFPAGIPECGTDALRFGLCAYMSQGRDINLDVNRILGYRHFCNKLWNATKFALRGLGKGFVPSPTSQPGGHESLVDRWIRSRLTEAVRLSNQGFQAYDFPAVTTAQYSFWLYELCDVYLECLKPVLNGVDQVAAECARQTLYTCLDVGLRLLSPFMPFVTEELFQRLPRRMPQAPPSLCVTPYPEPSECSWKDPEAEAALELALSITRAVRSLRADYNLTRIRPDCFLEVADEATGALASAVSGYVQALASAGVVAVLALGAPAPQGCAVALASDRCSIHLQLQGLVDPARELGKLQAKRVEAQRQAQRLRERRAASGYPVKVPLEVQEADEAKLQQTEAELRKVDEAIALFQKML

SEQ ID NO: 907993 - protein, 1083 aa, Homo sapiens
MSTLYVSPHPDAFPSLRALIAARYGEAGEGPGWGGAQPRICLQPPPTSRTPFPPPRLPALEQGPGGLWVWGATAVAQLLWPAGLGGPGGSRAAVLVQQWVSYADTELIPAACGATLPALGLRSSAQDPQAVLGALGRALSPLEEWLRLHTYLAGEAPTLADLAAVTALLLPFRYVLDPPARRIWNNVTRWFVTCVRQPEFRAVLGEVVLYSGARPLSHQPGPEAPALPKTAAQLKKEAKKREKLEKFQQKQKIQQQQPPPGEKKPKPEKREKRDPGVITYDLPTPPGEKKDVSGPMPDSYSPRYVEAAWYPWWEQQGFFKPEYGRPNVSAANPRGVFMMCIPPPNVTGSLHLGHALTNAIQDSLTRWHRMRGETTLWNPGCDHAGIATQVVVEKKLWREQGLSRHQLGREAFLQEVWKWKEEKGDRIYHQLKKLGSSLDWDRACFTMDPKLSAAVTEAFVRLHEEGIIYRSTRLVNWSCTLNSAISDIEVDKKELTGRTLLSVPGYKEKVEFGVLVSFAYKVQGSDSDEEVVVATTRIETMLGDVAVAVHPKDTRYQHLKGKNVIHPFLSRSLPIVFDEFVDMDFGTGAVKITPAHDQNDYEVGQRHGLEAISIMDSRGALINVPPPFLGLPRFEARKAVLVALKERGLFRGIEDNPMVVPLCNRSKDVVEPLLRPQWYVRCGEMAQAASAAVTRGDLRILPEAHQRTWHAWMDNIREWCISRQLWWGHRIPAYFVTVSDPAVPPGEDPDGRYWVSGRNEAEAREKAAKEFGVSPDKISLQQDEDVLDTWFSSGLFPLSILGWPNQSEDLSVFYPGTLLETGHDILFFWVARMVMLGLKLTGRLPFREVYLHAIVRDAHGRKMSKSLGNVIDPLDVIYGISLQGLHNQLLNSNLDPSEVEKAKEGQKADFPAGIPECGTDALRFGLCAYMSQGRDINLDVNRILGYRHFCNKLWNATKFALRGLGKGFVPSPTSQPGGHESLVDRWIRSRLTEAVRLSNQGFQAYDFPAVTTAQYSFWLYELCDVYLGVLNLCCGGGPRLGLVVPPQPVPCRGWRGGGPLCPGGGVPRARGGPPCFPPGPVCG

SEQ ID NO: 907994 - protein, 704 aa, Homo sapiens
RLGTRLGVLSRSLPIVFDEFVDMDFGTGAVKITPAHDQNDYEVGQRHGLEAISIMDSRGALINVPPPFLGLPRFEARKAVLVALKERGLFRGIEDNPMVVPLCNRSKDVVEPLLRPQWYVRCGEMAQAASAAVTRGDLRILPEAHQRTWHAWMDNIREWCISRQLWWGHRIPAYFVTVSDPAVPPGEDPDGRYWVSGRNEAEAREKAAKEFGVSPDKISLQQDEDVLDTWFSSGLFPLSILGWPNQSEDLSVFYPGTLLETGHDILFFWVARMVMLGLKLTGRLPFREVYLHAIVRDAHGRKMSKSLGNVIDPLDVIYGISLQGLHNQLLNSNLDPSEVEKAKEGQKADFPAGIPECGTDALRFGLCAYMSQGRDINLDVNRILGYRHFCNKLWNATKFALRGLGKGFVPSPTSQPGGHESLVDRWIRSRLTEAVRLSNQGFQAYDFPAVTTAQYSFWLYELCDVYLECLKPVLNGVDQVAAECARQTLYTCLDVGLRLLSPFMPFVTEELFQRLPRRMPQAPPSLCVTPYPEPSECSWKDPEAEAALELALSITRAVRSLRADYNLTRIRPDCFLEVADEATGALASAVSGYVQALASAGVVAVLALGAPAPQGCAVALASDRCSIHLQLQGLVDPARELGKLQAKRVEAQRQAQRLRERRAASGYPVKVPLEVQEADEAKLQQTEAELRKVDEAIALFQKML

SEQ ID NO: 907995 - protein, 755 aa, Homo sapiens
MSTLYVSPHPDAFPSLRALIAARYGEAGEGPGWGGAQPRICLQPPPTSRTPFPPPRLPALEQGPGGLWVWGATAVAQLLWPAGLGGPGGSRAAVLVQQWVSYADTELIPAACGATLPALGLRSSAQDPQAVLGALGRALSPLEEWLRLHTYLAGEAPTLADLAAVTALLLPFRYVLDPPARRIWNNVTRWFVTCVRQPEFRAVLGEVVLYSGARPLSHQPGPEAPALPKTAAQLKKEAKKREKLEKFQQKQKIQQQQPPPGEKKPKPEKREKRDPGVITYDLPTPPGEKKDVSGPMPDSYSPRYVEAAWYPWWEQQGFFKPEYGRPNVSAANPRGVFMMCIPPPNVTGSLHLGHALTNAIQDSLTRWHRMRGETTLWNPGCDHAGIATQVVVEKKLWREQGLSRHQLGREAFLQEVWKWKEEKGDRIYHQLKKLGSSLDWDRACFTMDPKLSAAVTEAFVRLHEEGIIYRSTRLVNWSCTLNSAISDIEVDKKELTGRTLLSVPGYKEKVEFGVLVSFAYKVQGSDSDEEVVVATTRIETMLGDVAVAVHPKDTRYQHLKGKNVIHPFLSRSLPIVFDEFVDMDFGTGAVKITPAHDQNDYEVGQRHGLEAISIMDSRGALINVPPPFLGLPRFEARKAVLVALKERGLFRGIEDNPMVVPLCNRSKDVVEPLLRPQWYVRCGEMAQAASAAVTRGDLRILPEAHQRTWHAWMDNIREWCISRQLWWGHRIPAYFVTVSDPVPGGPWVGFCWGGR

SEQ ID NO: 907996 - protein, 753 aa, Homo sapiens
SRRLALLHAFLVSFRPQHLKGKNVIHPFLSRSLPIVFDEFVDMDFGTGAVKITPAHDQNDYEVGQRHGLEAISIMDSRGALINVPPPFLVRLPEARVPGQGDGGMAGHRHDEASFLTQGLPRFEARKAVLVALKERGLFRGIEDNPMVVPLCNRSKDVVEPLLRPQWYVRCGEMAQAASAAVTRGDLRILPEAHQRTWHAWMDNIREWCISRQLWWGHRIPAYFVTVSDPAVPPGEDPDGRYWVSGRNEAEAREKAAKEFGVSPDKISLQQDEDVLDTWFSSGLFPLSILGWPNQSEDLSVFYPGTLLETGHDILFFWVARMVMLGLKLTGRLPFREVYLHAIVRDAHGRKMSKSLGNVIDPLDVIYGISLQGLHNQLLNSNLDPSEVEKAKEGQKADFPAGIPECGTDALRFGLCAYMSQGRDINLDVNRILGYRHFCNKLWNATKFALRGLGKGFVPSPTSQPGGHESLVDRWIRSRLTEAVRLSNQGFQAYDFPAVTTAQYSFWLYELCDVYLECLKPVLNGVDQVAAECARQTLYTCLDVGLRLLSPFMPFVTEELFQRLPRRMPQAPPSLCVTPYPEPSECSWKDPEAEAALELALSITRAVRSLRADYNLTRIRPDCFLEVADEATGALASAVSGYVQALASAGVVAVLALGAPAPQGCAVALASDRCSIHLQLQGLVDPARELGKLQAKRVEAQRQAQRLRERRAASGYPVKVPLEVQEADEAKLQQTEAELRKVDEAIALFQKML

SEQ ID NO: 907997 - protein, 456 aa, Homo sapiens
LVLAGFLWIMLETGHDILFFWVARMVMLGLKLTGRLPFREVYLHAIVRDAHGRKMSKSLGNVIDPLDVIYGISLQGLHNQLLNSNLDPSEVEKAKEGQKADFPAGIPECGTDALRFGLCAYMSQGRDINLDVNRILGYRHFCNKLWNATKFALRGLGKGFVPSPTSQPGGHESLVDRWIRSRLTEAVRLSNQGFQAYDFPAVTTAQYSFWLYELCDVYLECLKPVLNGVDQVAAECARQTLYTCLDVGLRLLSPFMPFVTEELFQRLPRRMPQAPPSLCVTPYPEPSECSWKDPEAEAALELALSITRAVRSLRADYNLTRIRPDCFLEVADEATGALASAVSGYVQALASAGVVAVLALGAPAPQGCAVALASDRCSIHLQLQGLVDPARELGKLQAKRVEAQRQAQRLRERRAASGYPVKVPLEVQEADEAKLQQTEAELRKVDEAIALFQKML

SEQ ID NO: 907998 - protein, 1264 aa, Homo sapiens; identical to SEQ ID NO: 907984

SEQ ID NO: 907999 - protein, 969 aa, Homo sapiens [sequence omitted]

SEQ ID NO: 908000 - protein, 1300 aa, Homo sapiens
MSTLYVSPHPDAFPSLRALIAARYGEAGEGPGWGGAQPRICLQPPPTSRTPFPPPRLPALEQGPGGLWVWGATAVAQLLWPAGLGGPGGSRAAVLVQQWVSYADTELIPAACGATLPALGLRSSAQDPQAVLGALGRALSPLEEWLRLHTYLAGEAPTLADLAAVTALLLPFRYVLDPPARRIWNNVTRWFVTCVRQPEFRAVLGEVVLYSGARPLSHQPGPEAPALPKTAAQLKKEAKKREKLEKFQQKQKIQQQQPPPGEKKPKPEKREKRDPGVITYDLPTPPGEKKDVSGPMPDSYSPRYVEAAWYPWWEQQGFFKPEYGRPNVSAANPRGVFMMCIPPPNVTGSLHLGHALTNAIQDSLTRWHRMRGETTLWNPGCDHAGIATQVVVEKKLWREQGLSRHQLGREAFLQEVWKWKEEKGDRIYHQLKKLGSSLDWDRACFTMDPKLSAAVTEAFVRLHEEGIIYRSTRLVNWSCTLNSAISDIEVDKKELTGRTLLSVPGYKEKVEFGVLVSFAYKVQGSDSDEEVVVATTRIETMLGDVAVAVHPKDTRYQHLKGKNVIHPFLSRSLPIVFDEFVDMDFGTGAVKITPAHDQNDYEVGQRHGLEAISIMDSRGALINVPPPFLGLPRFEARKAVLVALKERGLFRGIEDNPMVVPLCNRSKDVVEPLLRPQWYVRCGEMAQAASAAVTRGDLRILPEAHQRTWHAWMDNIRCVGSSVWEGLAEELSRAHSGQAPSGPPWFLLPDICREWCISRQLWWGHRIPAYFVTVSDPAVPPGEDPDGRYWVSGRNEAEAREKAAKEFGVSPDKISLQQDEDVLDTWFSSGLFPLSILGWPNQSEDLSVFYPGTLLETGHDILFFWVARMVMLGLKLTGRLPFREVYLHAIVRDAHGRKMSKSLGNVIDPLDVIYGISLQGLHNQLLNSNLDPSEVEKAKEGQKADFPAGIPECGTDALRFGLCAYMSQGRDINLDVNRILGYRHFCNKLWNATKFALRGLGKGFVPSPTSQPGGHESLVDRWIRSRLTEAVRLSNQGFQAYDFPAVTTAQYSFWLYELCDVYLECLKPVLNGVDQVAAECARQTLYTCLDVGLRLLSPFMPFVTEELFQRLPRRMPQAPPSLCVTPYPEPSECSWKDPEAEAALELALSITRAVRSLRADYNLTRIRPDCFLEVADEATGALASAVSGYVQALASAGVVAVLALGAPAPQGCAVALASDRCSIHLQLQGLVDPARELGKLQAKRVEAQRQAQRLRERRAASGYPVKVPLEVQEADEAKLQQTEAELRKVDEAIALFQKML

SEQ ID NO: 908001 - protein, 965 aa, Homo sapiens
MGRSPAPHLSPATPDQQGFFKPEYGRPNVSAANPRGVFMMCIPPPNVTGSLHLGHALTNAIQDSLTRWHRMRGETTLWNPGCDHAGIATQVVVEKKLWREQGLSRHQLGREAFLQEVWKWKEEKGDRIYHQLKKLGSSLDWDRACFTMDPKLSAAVTEAFVRLHEEGIIYRSTRLVNWSCTLNSAISDIEVDKKELTGRTLLSVPGYKEKVEFGVLVSFAYKVQGSDSDEEVVVATTRIETMLGDVAVAVHPKDTRYQHLKGKNVIHPFLSRSLPIVFDEFVDMDFGTGAVKITPAHDQNDYEVGQRHGLEAISIMDSRGALINVPPPFLGLPRFEARKAVLVALKERGLFRGIEDNPMVVPLCNRSKDVVEPLLRPQWYVRCGEMAQAASAAVTRGDLRILPEAHQRTWHAWMDNIREWCISRQLWWGHRIPAYFVTVSDPAVPPGEDPDGRYWVSGRNEAEAREKAAKEFGVSPDKISLQQDEDVLDTWFSSGLFPLSILGWPNQSEDLSVFYPGTLLETGHDILFFWVARMVMLGLKLTGRLPFREVYLHAIVRDAHGRKMSKSLGNVIDPLDVIYGISLQGLHNQLLNSNLDPSEVEKAKEGQKADFPAGIPECGTDALRFGLCAYMSQGRDINLDVNRILGYRHFCNKLWNATKFALRGLGKGFVPSPTSQPGGHESLVDRWIRSRLTEAVRLSNQGFQAYDFPAVTTAQYSFWLYELCDVYLECLKPVLNGVDQVAAECARQTLYTCLDVGLRLLSPFMPFVTEELFQRLPRRMPQAPPSLCVTPYPEPSECSWKDPEAEAALELALSITRAVRSLRADYNLTRIRPDCFLEVADEATGALASAVSGYVQALASAGVVAVLALGAPAPQGCAVALASDRCSIHLQLQGLVDPARELGKLQAKRVEAQRQAQRLRERRAASGYPVKVPLEVQEADEAKLQQTEAELRKVDEAIALFQKML

SEQ ID NO: 908002 - protein, 1264 aa, Homo sapiens; identical to SEQ ID NO: 907984

SEQ ID NO: 908003 - protein, 1240 aa, Homo sapiens
MSTLYVSPHPDAFPSLRALIAARYGEAGEGPGWGGAQPRICLQPPPTSRTPFPPPRLPALEQGPGGLWVWGATAVAQLLWPAGLGGPGGSRAAVLVQQWVSYADTELIPAACGATLPALGLRSSAQDPQAVLGALGRALSPLEEWLRLHTYLAGEAPTLADLAAVTALLLPFRYVLDPPARRIWNNVTRWFVTCVRQPEFRAVLGEVVLYSGARPLSHQPGPEAPALPKTAAQLKKEAKKREKLEKFQQKQKIQQQQPPPGEKKPKPEKREKRDPGVITYDLPTPPGEKKDVSGPMPDSYSPRYVEAAWYPWWEQQGFFKPEYGRPNVSAANPRGVFMMCIPPPNVTGSLHLGHALTNAIQDSLTRWHRMRGETTLWNPGCDHAGIATQVVVEKKLWREQGLSRHQLGREAFLQEVWKWKEEKGDRIYHQLKKLGSSLDWDRACFTMDPKLSAAVTEAFVRLHEEGIIYRSTRLVNWSCTLNSAISDIEVDKKELTGRTLLSVPGYKEKVEFGVLVSFAYKVQGSDSDEEVVVATTRIETMLGDVAVAVHPKDTRYQHLKGKNVIHPFLSRSLPIVFDEFVDMDFGTGAVKITPAHDQNDYEVGQRHGLEAISIMDSRGALINVPPPFLGLPRFEARKAVLVALKERGLFRGIEDNPMVVPLCNRSKDVVEPLLRPQWYVRCGEMAQAASAAVTRGDLRILPEAHQRTWHAWMDNIREWCISRQLWWGHRIPAYFVTVSDPAVPPGEDPDGRYWVSGRNEAEAREKAAKEFGVSPDKISLQQDEDVLDTWFSSGLFPLSILGWPNQSEDLSVFYPGTLLETGHDILFFWVARMVMLGLKLTGRLPFREVYLHAIVRDAHGRKMSKSLGNVIDPLDVIYGISLQGLHNQLLNSNLDPSEVEKAKEGQKADFPAGIPECGTDALRFGLCAYMSQGRDINLDVNRILGYRHFCNKLWNATKFALRGLGKGFVPSPTSQPGGHESLVDRWIRSRLTEAVRLSNQGFQAYDFPAVTTAQYSFWLYELCDVYLECLKPVLNGVDQVAAECARQTLYTCLDVGLRLLSPFMPFVTEELFQRLPRRMPQAPPSLCVTPYPEPSECSWKDPEAEAALELALSITRAVRSLRADYNLTRIRPDCFLEVADEATGALASAVSGYVQALASAGVVAVLALGAPAPQGCLGKLQAKRVEAQRQAQRLRERRAASGYPVKVPLEVQEADEAKLQQTEAELRKVDEAIALFQKML

SEQ ID NO: 908004 - protein, 1322 aa, Homo sapiens
MSTLYVSPHPDAFPSLRALIAARYGEAGEGPGWGGAQPRICLQPPPTSRTPFPPPRLPALEQGPGGLWVWGATAVAQLLWPAGLGGPGGSRAAVLVQQWVSYADTELIPAACGATLPALGLRSSAQDPQAVLGALGRALSPLEEWLRLHTYLAGEAPTLADLAAVTALLLPFRYVLDPPARRIWNNVTRWFVTCVRQPEFRAVLGEVVLYSGARPLSHQPGPEAPALPKTAAQLKKEAKKREKLEKFQQKQKIQQQQPPPGEKKPKPEKREKRDPGVITYDLPTPPGEKKDVSGPMPDSYSPRYVEAAWYPWWEQQGFFKPEYGRPNVSAANPRGVFMMCIPPPNVTGSLHLGHALTNAIQDSLTRWHRMRGETTLWNPGCDHAGIATQVVVEKKLWREQGLSRHQLGREAFLQEVWKWKEEKGDRIYHQLKKLGSSLDWDRACFTMDPKLSAAVTEAFVRLHEEGIIYRSTRLVNWSCTLNSAISDIEVDKKELTGRTLLSVPGYKEKVEFGVLVSFAYKVQGSDSDEEVVVATTRIETMLGDVAVAVHPKDTRYQHLKGKNVIHPFLSRSLPIVFDEFVDMDFGTGAVKITPAHDQNDYEVGQRHGLEAISIMDSRGALINVPPPFLVRLPEARVPGQGDGGMAGHRHDEASFLTQGLPRFEARKAVLVALKERGLFRGIEDNPMVVPLCKLRVGAWDGRKMEGSSGFYRLAFSPTCTPSRSKDVVEPLLRPQWYVRCGEMAQAASAAVTRGDLRILPEAHQRTWHAWMDNIREWCISRQLWWGHRIPAYFVTVSDPAVPPGEDPDGRYWVSGRNEAEAREKAAKEFGVSPDKISLQQDEDVLDTWFSSGLFPLSILGWPNQSEDLSVFYPGTLLETGHDILFFWVARMVMLGLKLTGRLPFREVYLHAIVRDAHGRKMSKSLGNVIDPLDVIYGISLQGLHNQLLNSNLDPSEVEKAKEGQKADFPAGIPECGTDALRFGLCAYMSQGRDINLDVNRILGYRHFCNKLWNATKFALRGLGKGFVPSPTSQPGGHESLVDRWIRSRLTEAVRLSNQGFQAYDFPAVTTAQYSFWLYELCDVYLECLKPVLNGVDQVAAECARQTLYTCLDVGLRLLSPFMPFVTEELFQRLPRRMPQAPPSLCVTPYPEPSECSWKDPEAEAALELALSITRAVRSLRADYNLTRIRPDCFLEVADEATGALASAVSGYVQALASAGVVAVLALGAPAPQGCAVALASDRCSIHLQLQGLVDPARELGKLQAKRVEAQRQAQRLRERRAASGYPVKVPLEVQEADEAKLQQTEAELRKVDEAIALFQKML

SEQ ID NO: 908005 - protein, 978 aa, Homo sapiens
MSTLYVSPHPDAFPSLRALIAARYGEAGEGPGWGGAQPRICLQPPPTSRTPFPPPRLPALEQGPGGLWVWGATAVAQLLWPAGLGGPGGSRAAVLVQQWVSYADTELIPAACGATLPALGLRSSAQDPQAVLGALGRALSPLEEWLRLHTYLAGEAPTLADLAAVTALLLPFRYVLDPPARRIWNNVTRWFVTCVRQPEFRAVLGEVVLYSGARPLSHQPGPEAPALPKTAAQLKKEAKKREKLEKFQQKQKIQQQQPPPGEKKPKPEKREKRDPGVITYDLPTPPGEKKDVSGPMPDSYSPRYVEAAWYPWWEQQGFFKPEYGRPNVSAANPRGVFMMCIPPPNVTGSLHLGHALTNAIQDSLTRWHRMRGETTLWNPGCDHAGIATQVVVEKKLWREQGLSRHQLGREAFLQEVWKWKEEKGDRIYHQLKKLGSSLDWDRACFTMDPKLSAAVTEAFVRLHEEGIIYRSTRLVNWSCTLNSAISDIEVDKKELTGRTLLSVPGYKEKVEFGVLVSFAYKVQGSDSDEEVVVATTRIETMLGDVAVAVHPKDTRYQHLKGKNVIHPFLSRSLPIVFDEFVDMDFGTGAVKITPAHDQNDYEVGQRHGLEAISIMDSRGALINVPPPFLGLPRFEARKAVLVALKERGLFRGIEDNPMVVPLCNRSKDVVEPLLRPQWYVRCGEMAQAASAAVTRGDLRILPEAHQRTWHAWMDNIREWCISRQLWWGHRIPAYFVTVSDPAVPPGEDPDGRYWVSGRNEAEAREKAAKEFGVSPDKISLQQDEDVLDTWFSSGLFPLSILGWPNQSEDLSVFYPGTLLETGHDILFFWVARMVMLGLKLTGRLPFREVYLHAIVRDAHGRKMSKSLGNVIDPLDVIYGISLQGLHNQLLNSNLDPSEVEKAKEGQKADFPAGIPECGTDALRFGLCAYMSQGRDINLDVNRILGYRHFCNKLWNATKFALRGLGKGFVPSPTSQPEA

SEQ ID NO: 908006 - protein, 847 aa, Homo sapiens
TPPPPNPNKARYEAGVNRPRLVNWSCTLNSAISDIEVDKKELTGRTLLSVPGYKEKVEFGVLVSFAYKVQGSDSDEEVVVATTRIETMLGDVAVAVHPKDTRYQHLKGKNVIHPFLSRSLPIVFDEFVDMDFGTGAVKITPAHDQNDYEVGQRHGLEAISIMDSRGALINVPPPFLGLPRFEARKAVLVALKERGLFRGIEDNPMVVPLCNRSKDVVEPLLRPQWYVRCGEMAQAASAAVTRGDLRILPEAHQRTWHAWMDNIRCVGSSVWEGLAEELSRAHSGQAPSGPPWFLLPDICREWCISRQLWWGHRIPAYFVTVSDPAVPPGEDPDGRYWVSGRNEAEAREKAAKEFGVSPDKISLQQDEDVLDTWFSSGLFPLSILGWPNQSEDLSVFYPGTLLETGHDILFFWVARMVMLGLKLTGRLPFREVYLHAIVRDAHGRKMSKSLGNVIDPLDVIYGISLQGLHNQLLNSNLDPSEVEKAKEGQKADFPAGIPECGTDALRFGLCAYMSQGRDINLDVNRILGYRHFCNKLWNATKFALRGLGKGFVPSPTSQPGGHESLVDRWIRSRLTEAVRLSNQGFQAYDFPAVTTAQYSFWLYELCDVYLECLKPVLNGVDQVAAECARQTLYTCLDVGLRLLSPFMPFVTEELFQRLPRRMPQAPPSLCVTPYPEPSECSWKDPEAEAALELALSITRAVRSLRADYNLTRIRPDCFLEVADEATGALASAVSGYVQALASAGVVAVLALGAPAPQGCAVALASDRCSIHLQLQGLVDPARELGKLQAKRVEAQRQAQRLRERRAASGYPVKVPLEVQEADEAKLQQTEAELRKVDEAIALFQKML

SEQ ID NO: 908007 - protein, 876 aa, Homo sapiens
MDPKLSAAVTEAFVRLHEEGIIYRSTRLVNWSCTLNSAISDIEVDKKELTGRTLLSVPGYKEKVEFGVLVSFAYKVQGSDSDEEVVVATTRIETMLGDVAVAVHPKDTRYQHLKGKNVIHPFLSRSLPIVFDEFVDMDFGTGAVKITPAHDQNDYEVGQRHGLEAISIMDSRGALINVPPPFLVRLPEARVPGQGDGGMAGHRHDEASFLTQGLPRFEARKAVLVALKERGLFRGIEDNPMVVPLCKLRVGAWDGRKMEGSSGFYRLAFSPTCTPSRSKDVVEPLLRPQWYVRCGEMAQAASAAVTRGDLRILPEAHQRTWHAWMDNIREWCISRQLWWGHRIPAYFVTVSDPAVPPGEDPDGRYWVSGRNEAEAREKAAKEFGVSPDKISLQQDEDVLDTWFSSGLFPLSILGWPNQSEDLSVFYPGTLLETGHDILFFWVARMVMLGLKLTGRLPFREVYLHAIVRDAHGRKMSKSLGNVIDPLDVIYGISLQGLHNQLLNSNLDPSEVEKAKEGQKADFPAGIPECGTDALRFGLCAYMSQGRDINLDVNRILGYRHFCNKLWNATKFALRGLGKGFVPSPTSQPGGHESLVDRWIRSRLTEAVRLSNQGFQAYDFPAVTTAQYSFWLYELCDVYLECLKPVLNGVDQVAAECARQTLYTCLDVGLRLLSPFMPFVTEELFQRLPRRMPQAPPSLCVTPYPEPSECSWKDPEAEAALELALSITRAVRSLRADYNLTRIRPDCFLEVADEATGALASAVSGYVQALASAGVVAVLALGAPAPQGCAVALASDRCSIHLQLQGLVDPARELGKLQAKRVEAQRQAQRLRERRAASGYPVKVPLEVQEADEAKLQQTEAELRKVDEAIALFQKML

SEQ ID NO: 908008 - protein, 552 aa, Homo sapiens
LVWAMWIPHYFVTGNVTSGAPWVRSLDWGGYLGYADAMRADVPREKQPKYVPEVSLVTRIQFSQAKTEGCTWEYTGFSSGPLFPVIPFWACPNQSEDLSVFYPGTLLETGHDILFFWVARMVMLGLKLTGRLPFREVYLHAIVRDAHGRKMSKSLGNVIDPLDVIYGISLQGLHNQLLNSNLDPSEVEKAKEGQKADFPAGIPECGTDALRFGLCAYMSQGRDINLDVNRILGYRHFCNKLWNATKFALRGLGKGFVPSPTSQPGGHESLVDRWIRSRLTEAVRLSNQGFQAYDFPAVTTAQYSFWLYELCDVYLECLKPVLNGVDQVAAECARQTLYTCLDVGLRLLSPFMPFVTEELFQRLPRRMPQAPPSLCVTPYPEPSECSWKDPEAEAALELALSITRAVRSLRADYNLTRIRPDCFLEVADEATGALASAVSGYVQALASAGVVAVLALGAPAPQGCAVALASDRCSIHLQLQGLVDPARELGKLQAKRVEAQRQAQRLRERRAASGYPVKVPLEVQEADEAKLQQTEAELRKVDEAIALFQKML

SEQ ID NO: 908009 - protein, 265 aa, Homo sapiens
MSTLYVSPHPDAFPSLRALIAARYGEAGEGPGWGWRKEPQTHDIVISTPKHPDISRELRINHNNIKNKTSDPVKQRPTQEDEHLEDDRRGHKDIERAQPASKPSKDKTTRPHESTDKLNGKATQCNQNTNADKQYKPGNTRENKTNKHGNSEDKQKQRTETPTIERAPNHTIGGRPKNTNQGHRYTGRAAPSGGQRSHPGSTQPMQTAKRTPKTLNTTPEQGEHPRNGTTTQKWPSNTTTSMTHNNPVRKSEHTPHQTHGQPTHD

SEQ ID NO: 908010 - protein, 301 aa, Homo sapiens
MAAFSEMGVMPEIAQAVEEMDWLLPTDIQAESIPLILGGGDVLMAAETGSGKTGAFSIPVIQIVYETLKDQQEGKKGKTTIKTGASVLNKWQMNPYDRGSAFAIGSDGLCCQSREVKEWHGCRATKGLMKGKHYYEVSCHDQGLCRVGWSTMQASLDLGTDKFGFGFGGTGKKSHNKQFDNYGEEFTMHDTIGCYLDIDKGHVKFSKNGKDLGLAFEIPPHMKNQALFPACVLKNAELKFNFGEEEFKFPPKDGFVALSKAPDGYIVKSQHSGMPGDQQSSPMLESSHVTSGVSDNLILTR

SEQ ID NO: 908011 - protein, 700 aa, Homo sapiens
MAAFSEMGVMPEIAQAVEEMDWLLPTDIQAESIPLILGGGDVLMAAETGSGKTGAFSIPVIQIVYETLKDQQEGKKGKTTIKTGASVLNKWQMNPYDRGSAFAIGSDGLCCQSREVKEWHGCRATKGLMKGKHYYEVSCHDQGLCRVGWSTMQASLDLGTDKFGFGFGGTGKKSHNKQFDNYGEEFTMHDTIGCYLDIDKGHVKFSKNGKDLGLAFEIPPHMKNQALFPACVLKNAELKFNFGEEEFKFPPKDGFVALSKAPDGYIVKSQHSGNAQVTQTKFLPNAPKALIVEPSRELAEQTLNNIKQFKKYIDNPKLRELLIIGGVAARDQLSVLENGVDIVVGTPGRLDDLVSTGKLNLSQVRFLVLDEADGLLSQGYSDFINRMHNQIPQVTSDGKRLQVIVCSATLHSFDVKKLSEKIMHFPTWVDLKGEDSVPDTVHHVVVPVNPKTDRLWERLGKSHIRTDDVHAKDNTRPGANSPEMWSEAIKILKGEYAVRAIKEHKMDQAIIFCRTKIDCDNLEQYFIQQGGGPDKKGHQFSCVCLHGDRKPHERKQNLERFKKGDVRFLICTDVAARGIDIHGVPYVINVTLPDEKQNYVHRIGRVGRAERMGLAISLVATEKEKVWYHVCSSRGKGCYNTRLKEDGGCTIWYNEMQLLSEIEEHLNCTISQVEPDIKVPVDEFDGKVTYGTYCSRVGCP

SEQ ID NO: 908012 - protein, 675 aa, Homo sapiens
MAAFSEMGVMPEIAQAVEEMDWLLPTDIQAESIPLILGGGDVLMAAETGSGKTGAFSIPVIQIVYETLKDQQEGKKGKTTIKTGASVLNKWQMNPYDRGSAFAIGSDGLCCQSREVKEWHGCRATKGLMKGKHYYEVSCHDQGLCRVGWSTMQASLDLGTDKFGFGFGGTGKKSHNKQFDNYGEEFTMHDTIGCYLDIDKGHVKFSKNGKDLGLAFEIPPHMKNQALFPACVLKNAELKFNFGEEEFKFPPKDGFVALSKAPDGYIVKSQHSGNAQVTQTKFLPNAPKALIVEPSRELAEQTLNNIKQFKKYIDNPKLRELLIIGGVAARDQLSVLENGVDIVVGTPGRLDDLVSTGKLNLSQVRFLVLDEADGLLSQGYSDFINRMHNQIPQVTSDGKRLQVIVCSATLHSFDVKKLSEKIMHFPTWVDLKGEDSVPDTVHHVVVPVNPKTDRLWERLGKSHIRTDDVHAKDNTRPGANSPEMWSEAIKILKGEYAVRAIKEHKMDQAIIFCRTKIDCDNLEQYFIQQGGGPDKKGHQFSCVCLHGDRKPHERKQNLERFKKGDVRFLICTDVAARGIDIHGVPYVINVTLPDEKQNYVHRIGRVGRAERMGLAISLVATEKEKVWYHVCSSRGKGCYNTRLKEDGGCTIWYNEMQLLSEIEVHRTSYGYELGC

SEQ ID NO: 908013 - protein, 629 aa, Homo sapiens
MAAFSEMGVMPEIAQAVEEMDWLLPTDIQAESIPLILGGGDVLMAAETGSGKTGAFSIPVIQIVYETLKDQQEGKKGKTTIKTGASVLNKWQMNPYDRGSAFAIGSDGLCCQSREVKEWHGCRATKGLMKGKHYYEVSCHDQGLCRVGWSTMQASLDLGTDKFGFGFGGTGKKSHNKQFDNYGEEFTMHDTIGCYLDIDKGHVKFSKNGKDLGLAFEIPPHMKNQALFPACVLKNAELKFNFGEEEFKFPPKDGFVALSKAPDGYIVKSQHSGNAQVTQTKFLPNAPKALIVEPSRELAEQTLNNIKQFKKYIDNPKLRELLIIGGVAARDQLSVLENGVDIVVGTPGRLDDLVSTGKLNLSQVRFLVLDEADGLLSQGYSDFINRMHNQIPQVTSDGKRLQVIVCSATLHSFDVKKLSEKIMHFPTWVDLKGEDSVPDTVHHVVVPVNPKTDRLWERLGKSHIRTDDVHAKDNTRPGANSPEMWSEAIKILKGEYAVRAIKEHKMDQAIIFCRTKIDCDNLEQYFIQQGGGPDKKGHQFSCVCLHGDRKPHERKQNLERFKKGDVRFLICTDVAARGIDIHGVPYVINVTLPDEKQNYVHRIGRVGRAERMVWHFLVHRTESCHVCST

SEQ ID NO: 908014 - protein, 589 aa, Homo sapiens
MAAFSEMGVMPEIAQAVEEMDWLLPTDIQAESIPLILGGGDVLMAAETGSGKTGAFSIPVIQIVYETLKDQQEGKKGKTTIKTGASVLNKWQMNPYDRGSAFAIGSDGLCCQSREVKEWHGCRATKGLMKGKHYYEVSCHDQGLCRVGWSTMQASLDLGTDKFGFGFGGTGKKSHNKQFDNYGEEFTMHDTIGCYLDIDKGHVKFSKNGKDLGLAFEIPPHMKNQALFPACVLKNAELKFNFGEEEFKFPPKDGFVALSKAPDGYIVKSQHSGNAQVTQTKFLPNAPKALIVEPSRELAEQTLNNIKQFKKYIDNPKLRELLIIGGVAARDQLSVLENGVDIVVGTPGRLDDLVSTGKLNLSQVRFLVLDEADGLLSQGYSDFINRMHNQIPQVTSDGKRLQVIVCSATLHSFDVKKLSEKIMHFPTWVDLKGEDSVPDTVHHVVVPVNPKTDRLWERLGKSHIRTDDVHAKDNTRPGANSPEMWSEAIKILKGEYAVRAIKEHKMDQAIIFCRTKIDCDNLEQYFIQQGGGPDKKGHQFSCVCLHGDRKPHERKHRPQKSKDPKRAKTPKEQRPQKSRDHIRAKTPEG

SEQ ID NO: 908015 - protein, 851 aa, Homo sapiens
MAAFSEMGVMPEIAQAVEEMDWLLPTDIQAESIPLILGGGDVLMAAETGSGKTGAFSIPVIQIVYETLKDQQEGKKGKTTIKTGASVLNKWQMNPYDRGSAFAIGSDGLCCQSREVKEWHGCRATKGLMKGKHYYEVSCHDQGLCRVGWSTMQASLDLGTDKFGFGFGGTGKKSHNKQFDNYGEEFTMHDTIGCYLDIDKGHVKFSKNGKDLGLAFEIPPHMKNQALFPACVLKNAELKFNFGEEEFKFPPKDGFVALSKAPDGYIVKSQHSGNAQVTQTKFLPNAPKALIVEPSRELAEQTLNNIKQFKKYIDNPKLRELLIIGGVAARDQLSVLENGVDIVVGTPGRLDDLVSTGKLNLSQVRFLVLDEADGLLSQGYSDFINRMHNQIPQVTSDGKRLQVIVCSATLHSFDVKKLSEKIMHFPTWVDLKGEDSVPDTVHHVVVPVNPKTDRLWERLGKSHIRTDDVHAKDNTRPGANSPEMWSEAIKILKGEYAVRAIKEHKMDQAIIFCRTKIDCDNWGDFHRGGRYRPVSGLPWQARKNALHEYILEMEIPSSIGTTCLRVASLCRVGLSVTSPTTTPYNKTTTYTKHDKPPRQNTRRTQHTKQQHSSKNRKRPQRNGQRREREGRQSRTDNKRGEQRTENDEKKTDHEGTGEKSVRKTIGKKNTNRTKTTQANARRQTAQTQRNQNKRRDDGREGKGEEKRRRRDQKDTSREADEVRGDREQPDRRDRQREQQKATKEDSTEQREDSANKKTGTRERRKRSGQERQKEKAENKRREGRDDNNKNRQEEGTHGAKAREGANERTRRQEHRRSRHGERAKNENEEQEEERKARDKGRTKKRPPTPHA

SEQ ID NO: 908016 - protein, 406 aa, Homo sapiens
MAAFSEMGVMPEIAQAVEEMDWLLPTDIQAESIPLILGGGDVLMAAETGSGKTGAFSIPVIQIVYETLKDQQEGKKGKTTIKTGASVLNKWQMNPYDRGSAFAIGSDGLCCQSREVKEWHGCRATKGLMKGKHYYEVSCHDQGLCRVGWSTMQASLDLGTDKFGFGFGGTGKKSHNKQFDNYGEEFTMHDTIGCYLDIDKGHVKFSKNGKDLGLAFEIPPHMKNQALFPACVLKNAELKFNFGEEEFKFPPKDGFVALSKAPDGYIVKSQHSGNAQVTQTKFLPNAPKALIVEPSRELAEQTLNNIKQFKKYIDNPKLRELLIIGGVAARDQLSVLENGVDIVVGTPGRLDDLVSTGKLNLSQVRFLVLDEADGLLSQGYSDFINRMHNQIPQVTSDGKRLQVTAV

SEQ ID NO: 908017 - protein, 129 aa, Homo sapiens
MGLAISLVATEKEKVWYHVCSSRGKGCYNTRLKEDGGCTIWYNEMQLLSEIEEHLNCTISQVEPDIKVPVDEFDGKVTYGQKRAAGGGSYKGHVDILAPTVQELAALEKEAQTSFLHLGYLPNQLFRTF

SEQ ID NO: 908018 - protein, 740 aa, Homo sapiens
MAAFSEMGVMPEIAQAVEEMDWLLPTDIQAESIPLILGGGDVLMAAETGSGKTGAFSIPVIQIVYETLKDQQEGKKGKTTIKTGASVLNKWQMNPYDRGSAFAIGSDGLCCQSREVKEWHGCRATKGLMKGKHYYEVSCHDQGLCRVGWSTMQASLDLGTDKFGFGFGGTGKKSHNKQFDNYGEEFTMHDTIGCYLDIDKGHVKFSKNGKDLGLAFEIPPHMKNQALFPACVLKNAELKFNFGEEEFKFPPKDGFVALSKAPDGYIVKSQHSGNAQVTQTKFLPNAPKALIVEPSRELAEQTLNNIKQFKKYIDNPKLRELLIIGGVAARDQLSVLENGVDIVVGTPGRLDDLVSTGKLNLSQVRFLVLDEADGLLSQGYSDFINRMHNQIPQVTSDGKRLQVIVCSATLHSFDVKKLSEKIMHFPTWVDLKGEDSVPDTVHHVVVPVNPKTDRLWERLGKSHIRTDDVHAKDNTRPGANSPEMWSEAIKILKGEYAVRAIKEHKMDQAIIFCRTKIDCDNLEQYFIQQGGGPDKKGHQFSCVCLHGDRKPHERKQNLERFKKGDVRFLICTDVAARGIDIHGVPYVINVTLPDEKQNYVHRIGRVGRAERMGLAISLVATEKEKVWYHVCSSRGKGCYNTRLKEDGGCTIWYNEMQLLSEIEEHLNCTISQVEPDIKVPVDEFDGKVTYGQKRAAGGGSYKGHVDILAPTVQELAALEKEAQTSFLHLGYLPNQLFRTF

SEQ ID NO: 908019 - protein, 677 aa, Homo sapiens
MAAFSEMGVMPEIAQAVEEMDWLLPTDIQAESIPLILGGGDVLMAAETGSGKTGAFSIPVIQIVYETLKDQQEGKKGKTTIKTGASVLNKWQMNPYDRGSAFAIGSDGLCCQSREVKEWHGCRATKGLMKGKHYYEVSCHDQGLCRVGWSTMQASLDLGTDKFGFGFGGTGKKSHNKQFDNYGEEFTMHDTIGCYLDIDKGHVKFSKNGKDLGLAFEIPPHMKNQALFPACVLKNAELKFNFGEEEFKFPPKDGFVALSKAPDGYIVKSQHSGNAQVTQTKFLPNAPKALIVEPSRELAEQTLNNIKQFKKYIDNPKLRELLIIGGVAARDQLSVLENGVDIVVGTPGRLDDLVSTGKLNLSQVRFLVLDEADGLLSQGYSDFINRMHNQIPQVTSDGKRLQVIVCSATLHSFDVKKLSEKIMHFPTWVDLKGEDSVPDTVHHVVVPVNPKTDRLWERLGKSHIRTDDVHAKDNTRPGANSPEMWSEAIKILKGEYAVRAIKEHKMDQAIIFCRTKIDCDNLEQYFIQQGGGPDKKGHQFSCVCLHGDRKPHERKQNLERFKVWYHVCSSRGKGCYNTRLKEDGGCTIWYNEMQLLSEIEEHLNCTISQVEPDIKVPVDEFDGKVTYGQKRAAGGGSYKGHVDILAPTVQELAALEKEAQTSFLHLGYLPNQLFRTF

SEQ ID NO: 908020 - protein, 660 aa, Homo sapiens
MAAFSEMGVMPEIAQAVEEMDWLLPTDIQAESIPLILGGGDVLMAAETGSGKTGAFSIPVIQIVYETLKDQQEGKKGKTTIKTGASVLNKWQMNPYDRGSAFAIGSDGLCCQSREVKEWHGCRATKGLMKGKHYYEVSCHDQGLCRVGWSTMQASLDLGTDKFGFGFGGTGKKSHNKQFDNYGEEFTMHDTIGCYLDIDKGHVKFSKNGKDLGLAFEIPPHMKNQALFPACVLKNAELKFNFGEEEFKFPPKDGFVALSKAPDGYIVKSQHSGNAQVTQTKFLPNAPKALIVEPSRELAEQTLNNIKQFKKYIDNPKLRELLIIGGVAARDQLSVLENGVDIVVGTPGRLDDLVSTGKLNLSQVRFLVLDEADGLLSQGYSDFINRMHNQIPQVTSDGKRLQVIVCSATLHSFDVKKLSEKIMHFPTWVDLKGEDSVPDTVHHVVVPVNPKTDRLWERLGKSHIRTDDVHAKDNTRPGANSPEMWSEAIKILKGEYAVRAIKEHKMDQAIIFCRTKIDCDNLEQYFIQQGGGPDKKGHQFSCVCLHGDRKPHERKQNLERFKKGDVRFLICTDVAARGIDIHGVPYVINVTLPDEKQNYVHRIGRVGRAERMGLAISLVATEKEKVWYHVCSSRGKGCYNTRLKEDGGCTIWYNEMQLLS

SEQ ID NO: 908021 - protein, 610 aa, Homo sapiens
MAAFSEMGVMPEIAQAVEEMDWLLPTDIQAESIPLILGGGDVLMAAETGSGKTGAFSIPVIQIVYETLKDQQEGKKGKTTIKTGASVLNKWQMNPYDRGSAFAIGSDGLCCQSREVKEWHGCRATKGLMKGKHYYEVSCHDQGLCRVGWSTMQASLDLGTDKFGFGFGGTGKKSHNKQFDNYGEEFTMHDTIGCYLDIDKGHVKFSKNGKDLGLAFEIPPHMKNQALFPACVLKNAELKFNFGEEEFKFPPKDGFVALSKAPDGYIVKSQHSGNAQVTQTKFLPNAPKALIVEPSRELAEQTLNNIKQFKKYIDNPKLRELLIIGGVAARDQLSVLENGVDIVVGTPGRLDDLVSTGKLNLSQVRFLVLDEADGLLSQGYSDFINRMHNQIPQVTSDGKRLQVIVCSATLHSFDVKKLSEKIMHFPTWVDLKGEDSVPDTVHHVVVPVNPKTDRLWERLGKSHIRTDDVHAKDNTRPGANSPEMWSEAIKILKGEYAVRAIKEHKMDQAIIFCRTKIDCDNLEQYFIQQGGGPDKKGHQFSCVCLHGDRKPHERKQNLERFKKGDVRFLICTDVAARGIDKARSLPYVINVTLDVMKMQYYQLELLEDYA

SEQ ID NO: 908022 - protein, 214 aa, Homo sapiens [sequence omitted]

SEQ ID NO: 908023 - protein, 342 aa, Homo sapiens
MAAFSEMGVMPEIAQAVEEMDWLLPTDIQAESIPLILGGGDVLMAAETGSGKTGAFSIPVIQIVYETLKDQQEGKKGKTTIKTGASVLNKWQMNPYDRGSAFAIGSDGLCCQSREVKEWHGCRATKGLMKGKHYYEVSCHDQGLCRVGWSTMQASLDLGTDKFGFGFGGTGKKSHNKQFDNYGEEFTMHDTIGCYLDIDKGHVKFSKNGKDLGLAFEIPPHMKNQALFPACVLKNAELKFNFGEEEFKFPPKDGFVALSKAPDGYIVKSQHSGNAQVTQTKFLPNAPKALIVEPSRELAEQTLNNIKQFKKYIDNPKLRELLIIGGVAARDQLSVLENGKLT

SEQ ID NO: 908024 - protein, 521 aa, Homo sapiens
MFTSEKGVVEEWLSEFKTLPETSLPNYATNLKDKSSLVSSLYKVIQEPQSELLEPVCHQLFEFYRSGEEQLLQFTLQFLPELIWCYLAVSASRNVHSSGCIEALLLGVYNLEIVDKQGHTKVLSFTIPSLSKPSVYHEPSSIGSMALTESALSQHGLSKAVYSGPHPQREMLTAQNRFEVLTFLLLCYNAALTCMPSVSLQSLCQICSRICVCGYPRQHVRKYKGISSRIPVSSGFMVQMLTGIYFAFYNGEWDLAQKALDDIIYRAQLELYPEPLLVANAIKASLPHGPMKSNKEGTRCIQVEITPTSSRISRNAVTSMSIRGHRWKRHGNTELTGQEELMEISEVDEGFYSRAASSTSQSGLSNSSHNCSNKPSIGKNHRRSGGSKTGGKEKETTGESCKDHFARKQTQRAQSENLELLSLKRLTLTTSQSLPKPSSHGLAKTAATVFSKSFEQVSGVTVPHNPSSAVGCGAGTDANRFSACSLQEEKLIYVSERTELPMKHQSGQQRPPSISITLSTD

SEQ ID NO: 908025 - protein, 362 aa, Homo sapiens
GDSRGPHTEPVRIISRALLVANAIKASLPHGPMKSNKEGTRCIQVEITPTSSRISRNAVTSMSIRGHRWKRHEQPDNNNDATELGILVIPEISVTNVAGERTGNGEKGRTLGEIDAQHIQGVQETATDPRTESKGLPEIRRQKSVRKMMEDGINSPGRVQFYAEHFITALQGNTELTGQEELMEISEVDEGFYSRAASSTSQSGLSNSSHNCSNKPSIGKNHRRSGGSKTGGKEKETTGESCKDHFARKQTQRAQSENLELLSLKRLTLTTSQSLPKPSSHGLAKTAATVFSKSFEQVSGVTVPHNPSSAVGCGAGTDANRFSACSLQEEKLIYVSERTELPMKHQSGQQRPPSISITLSTD

SEQ ID NO: 908026 - protein, 406 aa, Homo sapiens
MFTSEKGVVEEWLSEFKTLPETSLPNYATNLKDKSSLVSSLYKVIQEPQSELLEPVCHQLFEFYRSGEEQLLQFTLQFLPELIWCYLAVSASRNVHSSGCIEALLLGVYNLEIVDKQGHTKVLSFTIPSLSKPSVYHEPSSIGSMALTESALSQHGLSKAVYSGPHPQREMLTAQNRFEVLTFLLLCYNAALTCMPSVSLQSLCQICSRICVCGYPRQHVRKYKGISSRIPVSSGFMVQMLTGIYFAFYNGEWDLAQKALDDIIYRAQLELYPEPLLVANAIKASLPHGPMKSNKEGTRCIQVEITPTSSRISRNAVTSMSIRGHRWKRHEQPDNNNDATELGILVIPEISVTNVAGERTGNGEKGRTLGEIDAQHIQGVQETATDPRTESKGLPEIRRQKSEIQN

SEQ ID NO: 908027 - protein, 419 aa, Homo sapiens
MFTSEKGVVEEWLSEFKTLPETSLPNYATNLKDKSSLVSSLYKVIQEPQSELLEPVCHQLFEFYRSGEEQLLQFTLQFLPELIWCYLAVSASRNVHSSGCIEALLLGVYNLEIVDKQGHTKVLSFTIPSLSKPSVYHEPSSIGSMALTESALSQHGLSKAVYSGPHPQREMLTAQNRFEVLTFLLLCYNAALTCMPSVSLQSLCQICSRICVCGYPRQHVRKYKGISSRIPVSSGFMVQMLTGIYFAFYNGEWDLAQKALDDIIYRAQLELYPEPLLVANAIKASLPHGPMKSNKEGTRCIQVEITPTSSRISRNAVTSMSIRGHRWKRHEQPDNNNDATELGILVIPEISVTNVAGERTGNGEKGRTLGEIDAQHIQGVQETATDPRTESKGLPEIRRQKSVRKMMEDGINSPGRVQF

SEQ ID NO: 908028 - protein, 212 aa, Homo sapiens
SAPGRTAGRLLNVEFPATKLRGNTELTGQEELMEISEVDEGFYSRAASSTSQSGLSNSSHNCSNKPSIGKNHRRSGGSKTGGKEKETTGESCKDHFARKQTQRAQSENLELLSLKRLTLTTSQSLPKPSSHGLAKTAATVFSKSFEQVSGVTVPHNPSSAVGCGAGTDANRFSACSLQEEKLIYVSERTELPMKHQSGQQRPPSISITLSTD

SEQ ID NO: 908029 - protein, 229 aa, Homo sapiens
PGCACAELVAAPAPAGGSLLGRAAAMGEAEVGGGGAAGDKGPGEAATSPAEETVVWSPEVEVCLFHAMLGHKPVGVNRHFHMICIRDKFSQNIGRQVPSKVIWDHLSTMYDMQALHESEILPFPNPERNFVLPEEIIQEVREGKVMIEEEMKEEMKEDVDPHNGADDVFSSSGSLGKASEKSSKDKEKNSSDLGCKEGADKRKRSRVTDKVLTANSNPSSPSAAKRRRT

SEQ ID NO: 908030 - protein, 236 aa, Homo sapiens
PGCACAELVAAPAPAGGSLLGRAAAMGEAEVGGGGAAGDKGPGEAATSPAEETVVWSPEVEVCLFHAMLGHKPVGVNRHFHMICIRDKFSQNIGRQVPSKVIWDHLSTMYDMQALHESEILPFPNPERNFVLPEEIIQEVREGEARERLGLGFRKGQTLAKGREVRVRTPGLQGGVRVQRRPRPTCAWVVLEPPGLERTLFESSGWTEAEACVGSKRRSSPWPDHPPASATTVGFR

SEQ ID NO: 908031 - protein, 205 aa, Homo sapiens
PGCACAELVAAPAPAGGSLLGRAAAMGEAEVGGGGAAGDKGPGEAATSPAEETVVWSPEVEVCLFHAMLGHKPVGVNRHFHMICIRDKFSQNIGRQVPSKVIWDHLSTMYDMQALHESEILPFPNPERNFVLPEEIIQEVREVAGRKLRPVWAASVGAVPGLTIPQRRPPPWVFGERQLSPPQKSDDRRGDERGDEGRRGPPQWG

SEQ ID NO: 908032 - protein, 229 aa, Homo sapiens; identical to SEQ ID NO: 908029

SEQ ID NO: 908033 - protein, 229 aa, Homo sapiens; identical to SEQ ID NO: 908029

SEQ ID NO: 908034 - protein, 216 aa, Homo sapiens
PRVRLRGARGRACSRRGLLARPGRGHGRGRGGRRGRRRRQGPGGGGHQPGGGDSGVEPRGGGVNRHFHMICIRDKFSQNIGRQVPSKVIWDHLSTMYDMQALHESEILPFPNPERNFVLPEEIIQEVREGKVMIEEEMKEEMKEDVDPHNGADDVFSSSGSLGKASEKSSKDKEKNSSDLGCKEGADKRKRSRVTDKVLTANSNPSSPSAAKRRRT

SEQ ID NO: 908035 - protein, 136 aa, Homo sapiens
PECACAELVAAPAPAGGSLLGRAAAMGEAEVGGGGAAGDKGPGEAATSPAEETVVWSPEVEVCLFHAMLGHKPVGVNRHFHMICIRDKFSQNIGRQVPSKVIWDHLSTMYDMQALRGTSSFQKRSFRRSEKWLDGS

SEQ ID NO: 908036 - protein, 229 aa, Homo sapiens; identical to SEQ ID NO: 908029

SEQ ID NO: 908037 - protein, 338 aa, Homo sapiens
GRCLLLAPAPAAPVPPRRGSSAWLLEELLRPDCPEPAGLDATREGPDRNFRLSEHRQALAAAKHRGPAATPGSPDPGPGPWGEEHLAERGPRGWERGGDRCDAPGGDAARRPDPEAEAPPAGSIEAAPSSAAEPVIVSRSDPRDEKLALYLAEVEKQDKYLRQRNKYRFHIIPDGNCLYRAVSKTVYGDQSLHRELREQTVHYIADHFNHFSPLIEGDVGEFIIAAAQDGAWAGYPELLAMGQMLNVNIHLTTGGRLESPTVSTMIHYLGPEDSLRPSIWLSWLSNGHYDAVFDHSYPNPEYDNWCKQTQVQRKRDEELAKSMAISLSKMYIEQNACS

SEQ ID NO: 908038 - protein, 338 aa, Homo sapiens; identical to SEQ ID NO: 908037

SEQ ID NO: 908039 - protein, 589 aa, Homo sapiens
MSRRLLPRAEKRRRRLEQRQQPDEQRRRSGAMVKMAAAGGGGGGGRYYGGGSEGGRAPKRLKTDNAGDQHGGGGGGGGGAGAAGGGGGGENYDDPHKTPASPVVHIRGLIDGVVEADLVEALQEFGPISYVVVMPKKRQALVEFEDVLGACNAVNYAADNQIYIAGHPAFVNYSTSQKISRPGDSDDSRSVNSVLLFTILNPIYSITTDVLYTICNPCGPVQRIVIFRKNGVQAMVEFDSVQSAQRAKASLNGADIYSGCCTLKIEYAKPTRLNVFKNDQDTWDYTNPNLSGQGDPGSNPNKRQRQPPLLGDHPAEYGGPHGGYHSHYHDEGYGPPPPHYEGRRMGPPVGGHRRGPSRYGPQYGHPPPPPPPPEYGPHADSPVLMVYGLDQSKMNCDRVFNVFCLYGNVEKVKFMKSKPGAAMVEMADGYAVDRAITHLNNNFMFGQKLNVCVSKQPAIMPGQSYGLEDGSCSYKDFSESRNNRFSTPEQAAKNRIQHPSNVLHFFNAPLEVTEENFFEICDELGVKRPSSVKVFSGKSERSSSGLLEWESKSDALETLGFLNHYQMKNPNGPYPYTLKLCFSTAQHAS

SEQ ID NO: 908040 - protein, 187 aa, Homo sapiens
CRSTLEAPRYYDVLYTICNPCGPVQRIVIFRKNGVQAMVEFDSVQSAQRAKASLNGADIYSGCCTLKIEYAKPTRLNVFKNDQDTWDYTNPNLSGQGDPGSNPNKRQRQPPLLGDHPAEYGGPHGGYHSHYHDEGYGPPPPHYEGRRMGPPVGGHRRGPSRYGPQYGHPPPPPLPPPAESQRSHRGK

SEQ ID NO: 908041 - protein, 311 aa, Homo sapiens
MSRRLLPRAEKRRRRLEQRQQPDEQRRRSGAMVKMAAAGGGGGGGRYYGGGSEGGRAPKRLKTDNAGDQHGGGGGGGGGAGAAGGGGGGENYDDPHKTPASPVVHIRGLIDGVVEADLVEALQEFGPISYVVVMPKKRQALVEFEDVLGACNAVNYAADNQIYIAGHPAFVNYSTSQKISRPGDSDDSRSVNSVLLFTILNPIYSITTDVLYTICNPCGPVQRIVIFRKNGVQAMVEFDSVQSAQRAKASLNGADIYSGCCTLKIEYAKPTRLNVFKNDQDTWDYTNPNLSGQGNLDDHFVLNIPALLSLD

SEQ ID NO: 908042 - protein, 311 aa, Homo sapiens; identical to SEQ ID NO: 908041

SEQ ID NO: 908043 - protein, 311 aa, Homo sapiens; identical to SEQ ID NO: 908041

SEQ ID NO: 908044 - protein, 216 aa, Homo sapiens
MSRRLLPRAEKRRRRLEQRQQPDEQRRRSGAMVKMAAAGGGGGGGRYYGGGSEGGRAPKRLKTDNAGDQHGGGGGGGGGAGAAGGGGGGENYDDPHKTPASPVVHIRGLIDGVVEADLVEALQEFGPISYVVVMPKKRQALVEFEDVLGACNAVNYAADNQIYIAGHPAFVNYSTSQKISRPGDSDDSRSVNSVLLFTILNPIYSITTVRASRHFL

SEQ ID NO: 908045 - protein, 299 aa, Homo sapiens
MVESDPGSNPNKRQRQPPLLGDHPAEYGGPHGGYHSHYHDEGYGPPPPHYEGRRMGPPVGGHRRGPSRYGPQYGHPPPPPPPPEYGPHADSPVLMVYGLDQSKMNCDRVFNVFCLYGNVEKVKFMKSKPGAAMVEMADGYAVDRAITHLNNNFMFGQKLNVCVSKQPAIMPGQSYGLEDGSCSYKDFSESRNNRFSTPEQAAKNRIQHPSNVLHFFNAPLEVTEENFFEICDELGVKRPSSVKVFSGKSERSSSGLLEWESKSDALETLGFLNHYQMKNPNGPYPYTLKLCFSTAQHAS

SEQ ID NO: 908046 - protein, 245 aa, Homo sapiens
MGPPVGGHRRGPSRYGPQYGHPPPPPPPPEYGPHADSPVLMVYGLDQSKMNCDRVFNVFCLYGNVEKVKFMKSKPGAAMVEMADGYAVDRAITHLNNNFMFGQKLNVCVSKQPAIMPGQSYGLEDGSCSYKDFSESRNNRFSTPEQAAKNRIQHPSNVLHFFNAPLEVTEENFFEICDELGVKRPSSVKVFSGKSERSSSGLLEWESKSDALETLGFLNHYQMKNPNGPYPYTLKLCFSTAQHAS

SEQ ID NO: 908047 - protein, 311 aa, Homo sapiens; identical to SEQ ID NO: 908041

SEQ ID NO: 908048 - protein, 584 aa, Homo sapiens
MVKMAAAGGGGGGGRYYGGGSEGGRAPKRLKTDNAGDQHGGGGGGGGGAGAAGGGGGGENYDDPHKTPASPVVHIRGLIDGVVEADLVEALQEFGPISYVVVMPKKRQALVEFEDVLGACNAVNYAADNQIYIAGHPAFVNYSTSQKISRPGDSDDSRSVNSVLLFTILNPIYSITTDVLYTICNPCGPVQRIVIFRKNGVQAMVEFDSVQSAQRAKASLNGADIYSGCCTLKIEYAKPTRLNVFKNDQDTWDYTNPNLSGQGSQCMFDGTPSFRTVLTHCVKRPMVESDPGSNPNKRQRQPPLLGDHPAEYGGPHGGYHSHYHDEGYGPPPPHYEGRRMGPPVGGHRRGPSRYGPQYGHPPPPPPPPEYGPHADSPVLMVYGLDQSKMNCDRVFNVFCLYGNVEKVKFMKSKPGAAMVEMADGYAVDRAITHLNNNFMFGQKLNVCVSKQPAIMPGQSYGLEDGSCSYKDFSESRNNRFSTPEQAAKNRIQHPSNVLHFFNAPLEVTEENFFEICDELGVKRPSSVKVFSGKSERSSSGLLEWESKSDALETLGFLNHYQMKNPNGPYPYTLKLCFSTAQHAS

SEQ ID NO: 908049 - protein, 311 aa, Homo sapiens; identical to SEQ ID NO: 908041

SEQ ID NO: 908050 - protein, 311 aa, Homo sapiens; identical to SEQ ID NO: 908041

SEQ ID NO: 908051 - protein, 392 aa, Homo sapiens
LAGPPLVEATTDVLYTICNPCGPVQRIVIFRKNGVQAMVEFDSVQSAQRAKASLNGADIYSGCCTLKIEYAKPTRLNVFKNDQDTWDYTNPNLSGQGDPGSNPNKRQRQPPLLGDHPAEYGGPHGGYHSHYHDEGYGPPPPHYEGRRMGPPVGGHRRGPSRYGPQYGHPPPPPPPPEYGPHADSPVLMVYGLDQSKMNCDRVFNVFCLYGNVEKVKFMKSKPGAAMVEMADGYAVDRAITHLNNNFMFGQKLNVCVSKQPAIMPGQSYGLEDGSCSYKDFSESRNNRFSTPEQAAKNRIQHPSNVLHFFNAPLEVTEENFFEICDELGVKRPSSVKVFSGKSERSSSGLLEWESKSDALETLGFLNHYQMKNPNGPYPYTLKLCFSTAQHAS

SEQ ID NO: 908052 - protein, 245 aa, Homo sapiens; identical to SEQ ID NO: 908046

SEQ ID NO: 908053 - protein, 311 aa, Homo sapiens
FITNNAFLETFVRVDSDPGSNPNKRQRQPPLLGDHPAEYGGPHGGYHSHYHDEGYGPPPPHYEGRRMGPPVGGHRRGPSRYGPQYGHPPPPPPPPEYGPHADSPVLMVYGLDQSKMNCDRVFNVFCLYGNVEKVKFMKSKPGAAMVEMADGYAVDRAITHLNNNFMFGQKLNVCVSKQPAIMPGQSYGLEDGSCSYKDFSESRNNRFSTPEQAAKNRIQHPSNVLHFFNAPLEVTEENFFEICDELGVKRPSSVKVFSGKSERSSSGLLEWESKSDALETLGFLNHYQMKNPNGPYPYTLKLCFSTAQHAS

SEQ ID NO: 908054 - protein, 188 aa, Homo sapiens
EVLTAATLPKVKFMKSKPGAAMVEMADGYAVDRAITHLNNNFMFGQKLNVCVSKQPAIMPGQSYGLEDGSCSYKDFSESRNNRFSTPEQAAKNRIQHPSNVLHFFNAPLEVTEENFFEICDELGVKRPSSVKVFSGKSERSSSGLLEWESKSDALETLGFLNHYQMKNPNGPYPYTLKLCFSTAQHAS

SEQ ID NO: 908055 - protein, 312 aa, Homo sapiens
MSRRLLPRAEKRRRRLEQRQQPDEQRRRSGAMVKMAAAGGGGGGGRYYGGGSEGGRAPKRLKTDNAGDQHGGGGGGGGGAGAAGGGGGGENYDDPHKTPASPVVHIRGLIDGVVEADLVEALQEFGPISYVVVMPKKRQALVEFEDVLGACNAVNYAADNQIYIAGHPAFVNYSTSQKISRPGDSDDSRSVNSVLLFTILNPIYSITTDVLYTICNPCGPVQRIVIFRKNGVQAMVEFDSVQSAQRAKASLNGADIYSGCCTLKIEYAKPTRLNVFKNDQDTWDYTNPNLSGQGDPGSNPNKRQRGTVISQD

SEQ ID NO: 908056 - protein, 347 aa, Homo sapiens
MSRRLLPRAEKRRRRLEQRQQPDEQRRRSGAMVKMAAAGGGGGGGRYYGGGSEGGRAPKRLKTDNAGDQHGGGGGGGGGAGAAGGGGGGENYDDPHKTPASPVVHIRGLIDGVVEADLVEALQEFGPISYVVVMPKKRQALVEFEDVLGACNAVNYAADNQIYIAGHPAFVNYSTSQKISRPGDSDDSRSVNSVLLFTILNPIYSITTDVLYTICNPCGPVQRIVIFRKNGVQAMVEFDSVQSAQRAKASLNGADIYSGCCTLKIEYAKPTRLNVFKNDQDTWDYTNPNLSGQGDPGSNPNKRQRQPPLLGDHPAEYGEGRGFPSVDSRGSCAPARRPPCKFSPVLP

SEQ ID NO: 908057 - protein, 248 aa, Homo sapiens
MSRRLLPRAEKRRRRLEQRQQPDEQRRRSGAMVKMAAAGGGGGGGRYYGGGSEGGRAPKRLKTDNAGDQHGGGGGGGGGAGAAGGGGGGENYDDPHKTPASPVVHIRGLIDGVVEADLVEALQEFGPISYVVVMPKKRQALVEFEDVLGACNAVNYAADNQIYIAGHPAFVNYSTSQKISRPGDSDDSRSVNSVLLFTILNPIYSITTDVLYTICNPCGPVQRIVIFRKNGVQAMVEYPLLENRCSLG

SEQ ID NO: 908058 - protein, 156 aa, Homo sapiens
MSRRLLPRAEKRRRRLEQRQQPDEQRRRSGAMVKMAAAGGGGGGGRYYGGGSEGGRAPKRLKTDNAGDQHGGGGGGGGGAGAAGGGGGGENYDDPHKTPASPVVHIRGLIDGVVEADLVEALQEFGPIRYWAQRPGVGLPKLTPGCPCVSTISGWK

SEQ ID NO: 908059 - protein, 311 aa, Homo sapiens; identical to SEQ ID NO: 908041

SEQ ID NO: 908060 - protein, 240 aa, Homo sapiens
PVSALFDPGRPVRLAAELENYDDPHKTPASPVVHIRGLIDGVVEADLVEALQEFGPISYVVVMPKKRQALVEFEDVLGACNAVNYAADNQIYIAGHPAFVNYSTSQKISRPGDSDDSRSVNSVLLFTILNPIYSITTDVLYTICNPCGPVQRIVIFRKNGVQAMVEFDSVQSAQRAKASLNGADIYSGCCTLKIEYAKPTRLNVFKNDQDTWDYTNPNLSGQGNLDDHFVLNIPALLSLD

SEQ ID NO: 908061 - protein, 311 aa, Homo sapiens; identical to SEQ ID NO: 908041

SEQ ID NO: 908062 - protein, 245 aa, Homo sapiens; identical to SEQ ID NO: 908046

SEQ ID NO: 908063 - protein, 299 aa, Homo sapiens; identical to SEQ ID NO: 908045

SEQ ID NO: 908064 - protein, 245 aa, Homo sapiens; identical to SEQ ID NO: 908046

SEQ ID NO: 908065 - protein, 518 aa, Homo sapiens
PVSALFDPGRPVRLAAELENYDDPHKTPASPVVHIRGLIDGVVEADLVEALQEFGPISYVVVMPKKRQALVEFEDVLGACNAVNYAADNQIYIAGHPAFVNYSTSQKISRPGDSDDSRSVNSVLLFTILNPIYSITTDVLYTICNPCGPVQRIVIFRKNGVQAMVEFDSVQSAQRAKASLNGADIYSGCCTLKIEYAKPTRLNVFKNDQDTWDYTNPNLSGQGDPGSNPNKRQRQPPLLGDHPAEYGGPHGGYHSHYHDEGYGPPPPHYEGRRMGPPVGGHRRGPSRYGPQYGHPPPPPPPPEYGPHADSPVLMVYGLDQSKMNCDRVFNVFCLYGNVEKVKFMKSKPGAAMVEMADGYAVDRAITHLNNNFMFGQKLNVCVSKQPAIMPGQSYGLEDGSCSYKDFSESRNNRFSTPEQAAKNRIQHPSNVLHFFNAPLEVTEENFFEICDELGVKRPSSVKVFSGKSERSSSGLLEWESKSDALETLGFLNHYQMKNPNGPYPYTLKLCFSTAQHAS

SEQ ID NO: 908066 - protein, 311 aa, Homo sapiens; identical to SEQ ID NO: 908041

SEQ ID NO: 908067 - protein, 511 aa, Homo sapiens
AVLSWGGVGRRENYDDPHKTPASPVVHIRGLIDGVVEADLVEALQEFGPISYVVVMPKKRQALVEFEDVLGACNAVNYAADNQIYIAGHPAFVNYSTSQKISRPGDSDDSRSVNSVLLFTILNPIYSITTDVLYTICNPCGPVQRIVIFRKNGVQAMVEFDSVQSAQRAKASLNGADIYSGCCTLKIEYAKPTRLNVFKNDQDTWDYTNPNLSGQGDPGSNPNKRQRQPPLLGDHPAEYGGPHGGYHSHYHDEGYGPPPPHYEGRRMGPPVGGHRRGPSRYGPQYGHPPPPPPPPEYGPHADSPVLMVYGLDQSKMNCDRVFNVFCLYGNVEKVKFMKSKPGAAMVEMADGYAVDRAITHLNNNFMFGQKLNVCVSKQPAIMPGQSYGLEDGSCSYKDFSESRNNRFSTPEQAAKNRIQHPSNVLHFFNAPLEVTEENFFEICDELGVKRPSSVKVFSGKSERSSSGLLEWESKSDALETLGFLNHYQMKNPNGPYPYTLKLCFSTAQHAS

SEQ ID NO: 908068 - protein, 245 aa, Homo sapiens; identical to SEQ ID NO: 908046

SEQ ID NO: 908069 - protein, 205 aa, Homo sapiens
MVYGLDQSKMNCDRVFNVFCLYGNVEKVKFMKSKPGAAMVEMADGYAVDRAITHLNNNFMFGQKLNVCVSKQPAIMPGQSYGLEDGSCSYKDFSESRNNRFSTPEQAAKNRIQHPSNVLHFFNAPLEVTEENFFEICDELGVKRPSSVKVFSGKSERSSSGLLEWESKSDALETLGFLNHYQMKNPNGPYPYTLKLCFSTAQHAS

SEQ ID NO: 908070 - protein, 130 aa, Homo sapiens
MPGQSYGLEDGSCSYKDFSESRNNRFSTPEQAAKNRIQHPSNVLHFFNAPLEVTEENFFEICDELGVKRPSSVKVFSGKSERSSSGLLEWESKSDALETLGFLNHYQMKNPNGPYPYTLKLCFSTAQHAS

SEQ ID NO: 908071 - protein, 104 aa, Homo sapiens
MPVLAGARMAYQHPSNVLHFFNAPLEVTEENFFEICDELGVKRPSSVKVFSGKSERSSSGLLEWESKSDALETLGFLNHYQMKNPNGPYPYTLKLCFSTAQHAS

SEQ ID NO: 908072 - protein, 216 aa, Homo sapiens; identical to SEQ ID NO: 908044

SEQ ID NO: 908073 - protein, 139 aa, Homo sapiens
HPSNVLHFFNAPLEVTEENFFEVCAVELRRQSGPCHGRLSRPFISVFSANSCGTPVLPGPGLSARDTAEARTDRNLCSQTGQGENGTKFLATPFAAFLPFTFLASRATARLLGKLLHRPSDEGPISQEPHWRRLRVPSP

SEQ ID NO: 908074 - protein, 587 aa, Homo sapiens
MTRFSYAEYFSLFHSCSAPSRSTAPPESSPARAPMGLFQGVMQKYSSSLFKTSQLAPADPLIKAIKDGDEEALKTMIKEGKNLAEPNKEGWLPLHEAAYYGQVGCLKVLQRAYPGTIDQRTLQEETAVYLATCRGHLDCLLSLLQAGAEPDISNKSRETPLYKACERKNAEAVKILVQHNADTNHRCNRGWTALHESVSRNDLEVMQILVSGGAKVESKNAYGITPLFVAAQSGQLEALRFLAKYGADINTQASDNASALYEACKNEHEEVVEFLLSQGADANKTNKDGLLPLHIASKKGNYRIVQMLLPVTSRTRIRRSGVSPLHLAAERNHDEVLEALLSARFDVNTPLAPERARLYEDRRSSALYFAVVNNNVYATELLLQHGADPNRDVISPLLVAIRHGCLRTMQLLLDHGANIDAYIATHPTAFPATIMFAMKCLSLLKFLMDLGCDGEPCFSCLYGNGPHPPAPQPSSRFNDAPAADKEPSVVQFCEFVSAPEVSRWAGPIIDVLLDYVGNVQLCSRLKEHIDSFEDWAVIKEKAEPPRPLAHLCRLRVRKAIGKYRIKLLDTLPLPGRLIRYLKYENTQ

SEQ ID NO: 908075 - protein, 156 aa, Homo sapiens
MTRFSYAEYFSLFHSCSAPSRSTAPPESSPARAPMGLFQGVMQKYSSTTRISLGLRAQSFGQSREQNVSRRRIICLQTDEQIPDLLYLQEWQKPLFLGPGQSLRCSGEGGAQSLPCAPPLVLENSPLDFRAFSPKTKMKTWPKVGGRGSLGLGGLC

SEQ ID NO: 908076 - protein, 533 aa, Homo sapiens
MRPADPLIKAIKDGDEEALKTMIKEGKNLAEPNKEGWLPLHEAAYYGQVGCLKVLQRAYPGTIDQRTLQEETAVYLATCRGHLDCLLSLLQAGAEPDISNKSRETPLYKACERKNAEAVKILVQHNADTNHRCNRGWTALHESVSRNDLEVMQILVSGGAKVESKNAYGITPLFVAAQSGQLEALRFLAKYGADINTQASDNASALYEACKNEHEEVVEFLLSQGADANKTNKDGLLPLHIASKKGNYRIVQMLLPVTSRTRIRRSGVSPLHLAAERNHDEVLEALLSARFDVNTPLAPERARLYEDRRSSALYFAVVNNNVYATELLLQHGADPNRDVISPLLVAIRHGCLRTMQLLLDHGANIDAYIATHPTAFPATIMFAMKCLSLLKFLMDLGCDGEPCFSCLYGNGPHPPAPQPSSRFNDAPAADKEPSVVQFCEFVSAPEVSRWAGPIIDVLLDYVGNVQLCSRLKEHIDSFEDWAVIKEKAEPPRPLAHLCRLRVRKAIGKYRIKLLDTLPLPGRLIRYLKYENTQ

SEQ ID NO: 908077 - protein, 581 aa, Homo sapiens
MTRFSYAEYFSLFHSCSAPSRSTAPPESSPARAPMGLFQGVMQKYSSSLFKTSQLAPADPLIKAIKDGDEEALKTMIKEGKNLAEPNKEGWLPLHEAAYYGQVGCLKVLQRAYPGTIDQRTLQEETAVYLATCRGHLDCLLSLLQAGAEPDISNKSRETPLYKACERKNAEAVKILVQHNADTNHRCNRGWTALHESVSRNDLEVMQILVSGGAKVESKNAYGITPLFVAAQSGQLEALRFLAKYGADINTQASDNASALYEACKNEHEEVVEFLLSQGADANKTNKDGLLPLHIASKKGNYRIVQMLLPVTSRTRIRRSGVSPLHLAAERNHDEVLEALLSARFDVNTPLAPERARLYEDRRSSALYFAVVNNNVYATELLLQHGADPNRDVISPLLVAIRHGCLRTMQLLLDHGANIDAYIATHPTAFPATIMFAMKCLSLLKFLMDLGCDGEPCFSCLYGNGPHPPAPQPSSRFNDAPAADKEPSVVQFCEFVSAPEVSRWAGPIIDVLLDYVGNVQLCSRLKEHIDSFEDWAVIKEKAAPLVLENSPLDFRAFSPKTKMKTWPKVGGRGSLGLGGLC

SEQ ID NO: 908078 - protein, 204 aa, Homo sapiens
AEPGARALLLAGPALPVHTPTLPSPAPAPRPGRIVQMLLPVTSRTRIRRSGVSPLHLAAERNHDEVLEALLSARFDVNTPLAPERARLYEDRRSSALYFAVVNNNVYATELLLQHGADPNRDVISPLLVAIRHGCLRTMQLLLDHGANIDAYIATHPTAFPATIMFAMKCLSLLKFLMDLGCDGEPCFSCLYGNGPHPPAPQPS

SEQ ID NO: 908079 - protein, 489 aa, Homo sapiens
MRPADPLIKAIKDGDEEALKTMIKEGKNLAEPNKEGWLPLHEAAYYGQVGCLKVLQRAYPGTIDQRTLQEETAVYLATCRGHLDCLLSLLQAGAEPDISNKSRETPLYKACERKNAEAVKILVQHNADTNHRCNRGWTALHESVSRNDLEVMQILVSGGAKVESKNAYGITPLFVAAQSGQLEALRFLAKYGADINTQASDNASALYEACKNEHEEVVEFLLSQGADANKTNKDGLLPLHIASKKGNYRIVQMLLPVTSRTRIRRSGVSPLHLAAERNHDEVLEALLSARFDVNTPLAPERARLYEDRRSSALYFAVVNNNVYATELLLQHGADPNRDVISPLLVAIRHGCLRTMQLLLDHGANIDAYIATHPTAFPATIMFAMKCLSLLKFLMDLGCDGEPCFSCLYGNGPHPPAPQPSSRFNDAPAADKEPSVVQFCEFVSAPEVSRWAGPIIDVLLDYVGNVQLCSRLKEHIDSFEDWVLEGFVKY

SEQ ID NO: 908080 - protein, 590 aa, Homo sapiens
MTRFSYAEYFSLFHSCSAPSRSTAPPESSPARAPMGLFQGVMQKYSSSLFKTSQLAPADPLIKAIKDGDEEALKTMIKEGKNLAEPNKEGWLPLHEAAYYGQVGCLKVLQRAYPGTIDQRTLQEETAVYLATCRGHLDCLLSLLQAGAEPDISNKSRETPLYKACERKNAEAVKILVQHNADTNHRCNRGWTALHESVSRNDLEVMQILVSGGAKVESKNAYGITPLFVAAQSGQLEALRFLAKYGADINTQASDNASALYEACKNEHEEVVEFLLSQGADANKTNKDGLLPLHIASKKGNYRIVQMLLPVTSRTRIRRSGVSPLHLAAERNHDEVLEALLSARFDVNTPLAPERARLYEDRRSSALYFAVVNNNVYATELLLQHGADPNRDVISPLLVAIRHGCLRTMQLLLDHGANIDAYIATHPTAFPATIMFAMKCLSLLKFLMDLGCDGEPCFSCLYGNGPHPPAPQPSSRFNDAPAADKEPSVVQFCEFVSAPEVSRWAGPIIDVLLDYVGNVQLCSRLKEHIDSFEDWAVIKEKAEPPRPLAHLCRLRVRKAIGKYRIKLLDTLPLPGRLIRYLKYENTQGRG

SEQ ID NO: 908081 - protein, 269 aa, Homo sapiens
MTRFSYAEYFSLFHSCSAPSRSTAPPESSPARAPMGLFQGVMQKYSSSLFKTSQLAPADPLIKAIKDGDEEALKTMIKEGKNLAEPNKEGWLPLHEAAYYGQVGCLKVLQRAYPGTIDQRTLQEETAVYLATCRGHLDCLLSLLQAGAEPDISNKSRETPLYKACERKNAEAVKILVQHNADTNHRCNRGWTALHESVSRNDLEVMQILVSGGAKVESKNAYGITPLFVAAQSGQLEALRFLAKYGEWLRVPRSWSPQRAHGKDVRGQL

SEQ ID NO: 908082 - protein, 3705 aa, Homo sapiens
MQRALGMDMTTAPRSKSQQQLHSPALSPAHSPAKQPLGKPDQERSRGPGGPQPGSRQAETARATSVPGPAQAAAPPEVGRVSPQPPQPTKPSTAEPRPPAGEAPAKSATAVPAGLGATEQTQEGLTGKLFGLGASLLTQASTLMSVQPEADTQGQPAPSKGTPKIVFNDASKEAGPKPLGSGPGPGPAPGAKTEPGARMGPGSGPGALPKTGGTTSPKHGRAEHQAASKAAAKPKTMPKERAICPLCQAELNVGSKSPANYNTCTTCRLQVCNLCGFNPTPHLVEKTEWLCLNCQTKRLLEGSLGEPTPLPPPTSQQPPVGAPHRASGTSPLKQKGPQGLGQPSGPLPAKASPLSTKASPLPSKASPQAKPLRASEPSKTPSSVQEKKTRVPTKAEPMPKPPPETTPTPATPKVKSGVRRAEPATPVVKAVPEAPKGGEAEDLVGKPYSQDASRSPQSLSDTGYSSDGISSSQSEITGVVQQEVEQLDSAGVTGPHPPSPSEIHKVGSSMRPLLQAQGLAPSERSKPLSSGTGEEQKQRPHSLSITPEAFDSDEELEDILEEDEDSAEWRRRREQQDTAESSDDFGSQLRHDYVEDSSEGGLSPLPPQPPARAAELTDEDFMRRQILEMSAEEDNLEEDDTATSGRGLAKHGTQKGGPRPRPEPSQEPAALPKRRLPHNATTGYEELLPEGGSAEATDGSGTLQGGLRRFKTIELNSTGSYGHELDLGQGPDPSLDREPELEMESLTGSPEDRSRGEHSSTLPASTPSYTSGTSPTSLSSLEEDSDSSPSRRQRLEEAKQQRKARHRSHGPLLPTIEDSSEEEELREEEELLREQEKMREVEQQRIRSTARKTRRDKEELRAQRRRERSKTPPSNLSPIEDASPTEELRQAAEMEELHRSSCSEYSPSPSLDSEAEALDGGPSRLYKSGSEYNLPTFMSLYSPTETPSGSSTTPSSGRPLKSAEEAYEEMMRKAELLQRQQGQAAGARGPHGGPSQPTGPRGLGSFEYQDTTDREYGQAAQPAAEGTPASLGAAVYEEILQTSQSIVRMRQASSRDLAFAEDKKKEKQFLNAESAYMDPMKQNGGPLTPGTSPTQLAAPVSFSTPTSSDSSGGRVIPDVRVTQHFAKETQDPLKLHSSPASPSSASKEIGMPFSQGPGTPATTAVAPCPAGLPRGYMTPASPAGSERSPSPSSTAHSYGHSPTTANYGSQTEDLPQAPSGLAAAGRAAREKPLSASDGEGGTPQPSRAYSYFASSSPPLSPSSPSESPTFSPGKMGPRATAEFSTQTPSPAPASDMPRSPGAPTPSPMVAQGTQTPHRPSTPRLVWQESSQEAPFMVITLASDASSQTRMVHASASTSPLCSPTETQPTTHGYSQTTPPSVSQLPPEPPGPPGFPRVPSAGADGPLALYGWGALPAENISLCRISSVPGTSRVEPGPRTPGTAVVDLRTAVKPTPIILTDQGMDLTSLAVEARKYGLALDPIPGRQSTAVQPLVINLNAQEHTFLATATTVSITMASSVFMAQQKQPVVYGDPYQSRLDFGQGGGSPVCLAQVKQVEQAVQTAPYRSGPRGRPREAKFARYNLPNQVAPLARRDVLITQMGTAQSIGLKPGPVPEPGAEPHRATPAELRSHALPGARKPHTVVVQMGEGTAGTVTTLLPEEPAGALDLTGMRPESQLACCDMVYKLPFGSSCTGTFHPAPSVPEKSMADAAPPGQSSSPFYGPRDPEPPEPPTYRAQGVVGPGPHEEQRPYPQGLPGRLYSSMSDTNLAEAGLNYHAQRIGQLFQGPGRDSAMDLSSLKHSYSLGFADGRYLGQGLQYGSVTDLRHPTDLLAHPLPMRRYSSVSNIYSDHRYGPRGDAVGFQEASLAQYSATTAREISRMCAALNSMDQYGGRHGSGGGGPDLVQYQPQHGPGLSAPQSLVPLRPGLLGNPTFPEGHPSPGNLAQYGPAAGQGTAVRQLLPSTATVRAADGMIYSTINTPIAATLPITTQPASVLRPMVRGGMYRPYASGGITAVPLTSLTRVPMIAPRVPLGPTGLYRYPAPSRFPIASSVPPAEGPVYLGKPAAAKAPGAGGPSRPEMPVGAAREEPLPTTTPAAIKEAAGAPAPAPLAGQKPPADAAPGGGSGALSRPGFEKEEASQEERQRKQQEQLLQLERERVELEKLRQLRLQEELERERVELQRHREEEQLLVQRELQELQTIKHHVLQQQQEERQAQFALQREQLAQQRLQLEQIQQLQQQLQQQLEEQKQRQKAPFPAACEAPGRGPPLAAAELAQNGQYWPPLTHAAFIAMAGPEGLGQPREPVLHRGLPSSASDMSLQTEEQWEASRSGIKKRHSMPRLRDACELESGTEPCVVRRIADSSVQTDDEDGESRYLLSRRRRARRSADCSVQTDDEDSAEWEQPVRRRRSRLPRHSDSGSDSKHDATASSSSAAATVRAMSSVGIQTISDCSVQTEPDQLPRVSPAIHITAATDPKVEIVRYISAPEKTGRGESLACQTEPDGQAQGVAGPQLVGPTAISPYLPGIQIVTPGPLGRFEKKKPDPLEIGYQAHLPPESLSQLVSRQPPKSPQVLYSPVSPLSPHRLLDTSFASSERLNKAHVSPQKHFTADSALRQQTLPRPMKTLQRSLSDPKPLSPTAEESAKERFSLYQHQGGLGSQVSALPPNSLVRKVKRTLPSPPPEEAHLPLAGQASPQLYAASLLQRGLTGPTTVPATKASLLRELDRDLRLVEHESTKLRKKQAELDEEEKEIDAKLKYLELGITQRKESLAKDRGGRDYPPLRGLGEHRDYLSDSELNQLRLQGCTTPAGQFVDFPATAAAPATPSGPTAFQQPRFQPPAPQYSAGSGGPTQNGFPAHQAPTYPGPSTYPAPAFPPGASYPAEPGLPNQQAFRPTGHYAGQTPMPTTQSTLFPVPADSRAPLQKPRQTSLADLEQKVPTNYEVIASPVVPMSSAPSETSYSGPAVSSGYEQGKVPEVPRAGDRGSVSQSPAPTYPSDSHYTSLEQNVPRNYVMIDDISELTKDSTSTAPDSQRLEPLGPGSSGRPGKEPGEPGVLDGPTLPCCYARGEEESEEDSYDPRGKGGHLRSMESNGRPASTHYYGDSDYRHGARVEKYGPGPMGPKHPSKSLAPAAISSKRSKHRKQGMEQKISKFSPIEEAKDVESDLASYPPPAVSSSLVSRGRKFQDEITYGLKKNVYEQQKYYGMSSRDAVEDDRIYGGSSRSRAPSAYSGEKLSSHDFSGWGKGYEREREAVERLQKAGPKPSSLSMAHSRVRPPMRSQASEEESPVSPLGRPRPAGGPLPPGGDTCPQFCSSHSMPDVQEHVKDGPRAHAYKREEGYILDDSHCVVSDSEAYHLGQEETDWFDKPRDARSDRFRHHGGHAVSSSSQKRGPARHSYHDYDEPPEEGLWPHDEGGPGRHASAKEHRHGDHGRHSGRHTGEEPGRRAAKPHARDLGRHEARPHSQPSSAPAMPKKGQPGYPSSAEYSQPSRASSAYHHASDSKKGSRQAHSGPAALQSKAEPQAQPQLQGRQAAPGPQQSQSPSSRQIPSGAASRQPQTQQQQQGLGLQPPQQALTQARLQQQSQPTTRGSAPAASQPAGKPQPGPSTATGPQPAGPPRAEQTNGSKGTAKAPQQGRAPQAQPTPGPGPAGVKAGARPGGTPGAPAGQPGADGESVFSKILPGGAAEQAGKLTEAVSAFGKKFSSFW

SEQ ID NO: 908083 - protein, 3705 aa, Homo sapiens; identical to SEQ ID NO: 908082

SEQ ID NO: 908084 - protein, 3810 aa, Homo sapiens
MQRALGMDMTTAPRSKSQQQLHSPALSPAHSPAKQPLGKPDQERSRGPGGPQPGSRQAETARATSVPGPAQAAAPPEVGRVSPQPPQPTKPSTAEPRPPAGEAPAKSATAVPAGLGATEQTQEGLTGKLFGLGASLLTQASTLMSVQPEADTQGQPAPSKGTPKIVFNDASKEAGPKPLGSGPGPGPAPGAKTEPGARMGPGSGPGALPKTGGTTSPKHGRAEHQAASKAAAKPKTMPKERAICPLCQAELNVGSKSPANYNTCTTCRLQVCNLCGFNPTPHLVEKTEWLCLNCQTKRLLEGSLGEPTPLPPPTSQQPPVGAPHRASGTSPLKQKGPQGLGQPSGPLPAKASPLSTKASPLPSKASPQAKPLRASEPSKTPSSVQEKKTRVPTKAEPMPKPPPETTPTPATPKVKSGVRRAEPATPVVKAVPEAPKGGEAEDLVGKPYSQDASRSPQSLSDTGYSSDGISSSQSEITGVVQQEVEQLDSAGVTGPHPPSPSEIHKVGSSMRPLLQAQGLAPSERSKPLSSGTGEEQKQRPHSLSITPEAFDSDEELEDILEEDEDSAEWRRRREQQDTAESSDDFGSQLRHDYVEDSSEGGLSPLPPQPPARAAELTDEDFMRRQILEMSAEEDNLEEDDTATSGRGLAKHGTQKGGPRPRPEPSQEPAALPKRRLPHNATTGYEELLPEGGSAEATDGSGTLQGGLRRFKTIELNSTGSYGHELDLGQGPDPSLDREPELEMESLTGSPEDRSRGEHSSTLPASTPSYTSGTSPTSLSSLEEDSDSSPSRRQRLEEAKQQRKARHRSHGPLLPTIEDSSEEEELREEEELLREQEKMREVEQQRIRSTARKTRRDKEELRAQRRRERSKTPPSNLSPIEDASPTEELRQAAEMEELHRSSCSEYSPSPSLDSEAEALDGGPSRLYKSGSEYNLPTFMSLYSPTETPSGSSTTPSSGRPLKSAEEAYEEMMRKAELLQRQQGQAAGARGPHGGPSQPTGPRGLGSFEYQDTTDREYGQAAQPAAEGTPASLGAAVYEEILQTSQSIVRMRQASSRDLAFAEDKKKEKQFLNAESAYMDPMKQNGGPLTPGTSPTQLAAPVSFSTPTSSDSSGGRVIPDVRVTQHFAKETQDPLKLHSSPASPSSASKEIGMPFSQGPGTPATTAVAPCPAGLPRGYMTPASPAGSERSPSPSSTAHSYGHSPTTANYGSQTEDLPQAPSGLAAAGRAAREKPLSASDGEGGTPQPSRAYSYFASSSPPLSPSSPSESPTFSPGKMGPRATAEFSTQTPSPAPASDMPRSPGAPTPSPMVAQGTQTPHRPSTPRLVWQESSQEAPFMVITLASDASSQTRMVHASASTSPLCSPTETQPTTHGYSQTTPPSVSQLPPEPPGPPGFPRVPSAGADGPLALYGWGALPAENISLCRISSVPGTSRVEPGPRTPGTAVVDLRTAVKPTPIILTDQGMDLTSLAVEARKYGLALDPIPGRQSTAVQPLVINLNAQEHTFLATATTVSITMASSVFMAQQKQPVVYGDPYQSRLDFGQGGGSPVCLAQVKQVEQAVQTAPYRSGPRGRPREAKFARYNLPNQVAPLARRDVLITQMGTAQSIGLKPGPVPEPGAEPHRATPAELRSHALPGARKPHTVVVQMGEGTAGTVTTLLPEEPAGALDLTGMRPESQLACCDMVYKLPFGSSCTGTFHPAPSVPEKSMADAAPPGQSSSPFYGPRDPEPPEPPTYRAQGVVGPGPHEEQRPYPQGLPGRLYSSMSDTNLAEAGLNYHAQRIGQLFQGPGRDSAMDLSSLKHSYSLGFADGRYLGQGLQYGSVTDLRHPTDLLAHPLPMRRYSSVSNIYSDHRYGPRGDAVGFQEASLAQYSATTAREISRMCAALNSMDQYGGRHGSGGGGPDLVQYQPQHGPGLSAPQSLVPLRPGLLGNPTFPEGHPSPGNLAQYGPAAGQGTAVRQLLPSTATVRAADGMIYSTINTPIAATLPITTQPASVLRPMVRGGMYRPYASGGITAVPLTSLTRVPMIAPRVPLGPTGLYRYPAPSRFPIASSVPPAEGPVYLGKPAAAKAPGAGGPSRPEMPVGAAREEPLPTTTPAAIKEAAGAPAPAPLAGQKPPADAAPGGGSGALSRPGFEKEEASQEERQRKQQEQLLQLERERVELEKLRQLRLQEELERERVELQRHREEEQLLVQRELQELQTIKHHVLQQQQEERQAQFALQREQLAQQRLQLEQIQQLQQQLQQQLEEQKQRQKAPFPAACEAPGRGPPLAAAELAQNGQYWPPLTHAAFIAMAGPEGLGQPREPVLHRGLPSSASDMSLQTEEQWEASRSGIKKRHSMPRLRDACELESGTEPCVVRRIADSSVQTDDEDGESRYLLSRRRRARRSADCSVQTDDEDSAEWEQPVRRRRSRLPRHSDSGSDSKHDATASSSSAAATVRAMSSVGIQTISDCSVQTEPDQLPRVSPAIHITAATDPKVEIVRYISAPEKTGRGESLACQTEPDGQAQGVAGPQLVGPTAISPYLPGIQIVTPGPLGRFEKKKPDPLEIGYQAHLPPESLSQLVSRQPPKSPQVLYSPVSPLSPHRLLDTSFASSERLNKAHVSPQKHFTADSALRQQTLPRPMKTLQRSLSDPKPLSPTAEESAKERFSLYQHQGGLGSQVSALPPNSLVRKVKRTLPSPPPEEAHLPLAGQASPQLYAASLLQRGLTGPTTVPATKASLLRELDRDLRLVEHESTKLRKKQAELDEEEKEIDAKLKYLELGITQRKESLAKDRGGRDYPPLRGLGEHRDYLSDSELNQLRLQGCTTPAGQFVDFPATAAAPATPSGPTAFQQPRFQPPAPQYSAGSGGPTQNGFPAHQAPTYPGPSTYPAPAFPPGASYPAEPGLPNQQAFRPTGHYAGQTPMPTTQSTLFPVPADSRAPLQKPRQTSLADLEQKVPTNYEVIASPVVPMSSAPSETSYSGPAVSSGYEQGKVPEVPRAGDRGSVSQSPAPTYPSDSHYTSLEQNVPRNYVMIDDISELTKDSTSTAPDSQRLEPLGPGSSGRPGKEPGEPGVLDGPTLPCCYARGEEESEEDSYDPRGKGGHLRSMESNGRPASTHYYGDSDYRHGARVEKYGPGPMGPKHPSKSLAPAAISSKRSKHRKQGMEQKISKFSPIEEAKDVESDLASYPPPAVSSSLVSRGRKFQDEITYGLKKNVYEQQKYYGMSSRDAVEDDRIYGGSSRSRAPSAYSGEKLSSHDFSGWGKGYEREREAVERLQKAGPKPSSLSMAHSRVRPPMRSQASEEESPVSPLGRPRPAGGPLPPGGDTCPQFCSSHSMPDVQEHVKDGPRAHAYKREEGYILDDSHCVVSDSEGNGSQEVISADTQQLGGLPTCGALGPKMSQQGLVWRLIWWALLQAELPLPAPSVPWSVVAGGWAGGLLICLWLWHPLSWFLCMASARPPPAASPGVDGILFLVSEAYHLGQEETDWFDKPRDARSDRFRHHGGHAVSSSSQKRGPARHSYHDYDEPPEEGLWPHDEGGPGRHASAKEHRHGDHGRHSGRHTGEEPGRRAAKPHARDLGRHEARPHSQPSSAPAMPKKGQPGYPSSAEYSQPSRASSAYHHASDSKKGSRQAHSGPAALQSKAEPQAQPQLQGRQAAPGPQQSQSPSSRQIPSGAASRQPQTQQQQQGLGLQPPQQALTQARLQQQSQPTTRGSAPAASQPAGKPQPGPSTATGPQPAGPPRAEQTNGSKGTAKAPQQGRAPQAQPTPGPGPAGVKAGARPGGTPGAPAGQPGADGESVFSKILPGGAAEQAGKLTEAVSAFGKKFSSFW

SEQ ID NO: 908085 - protein, 107 aa, Homo sapiens
ILFEDFSVFLIFINPLSHFLAENRVALSELPNQAATGGQPRRADPPAAAHLTAAPCRGPSPCIWNIPSEAERATGAGPAFRPPACQGQPSIHQGQPSAQQGQPPGQA

SEQ ID NO: 908086 - protein, 3926 aa, Homo sapiens
MGNEVSLEGGAGDGPLPPGGAGPGPGPGPGPGAGKPPSAPAGGGQLPAAGAARSTAVPPVPGPGPGPGPGPGPGSTSRRLDPKEPLGNQRAASPTPKQASATTPGHESPRETRAQGPAGQEADGPRRTLQVDSRTQRSGRSPSVSPDRGSTPTSPYSVPQIAPLPSSTLCPICKTSDLTSTPSQPNFNTCTQCHNKVCNQCGFNPNPHLTQVKEWLCLNCQMQRALGMDMTTAPRSKSQQQLHSPALSPAHSPAKQPLGKPDQERSRGPGGPQPGSRQAETARATSVPGPAQAAAPPEVGRVSPQPPQPTKPSTAEPRPPAGEAPAKSATAVPAGLGATEQTQEGLTGKLFGLGASLLTQASTLMSVQPEADTQGQPAPSKGTPKIVFNDASKEAGPKPLGSGPGPGPAPGAKTEPGARMGPGSGPGALPKTGGTTSPKHGRAEHQAASKAAAKPKTMPKERAICPLCQAELNVGSKSPANYNTCTTCRLQVCNLCGFNPTPHLVEKTEWLCLNCQTKRLLEGSLGEPTPLPPPTSQQPPVGAPHRASGTSPLKQKGPQGLGQPSGPLPAKASPLSTKASPLPSKASPQAKPLRASEPSKTPSSVQEKKTRVPTKAEPMPKPPPETTPTPATPKVKSGVRRAEPATPVVKAVPEAPKGGEAEDLVGKPYSQDASRSPQSLSDTGYSSDGISSSQSEITGVVQQEVEQLDSAGVTGPHPPSPSEIHKVGSSMRPLLQAQGLAPSERSKPLSSGTGEEQKQRPHSLSITPEAFDSDEELEDILEEDEDSAEWRRRREQQDTAESSDDFGSQLRHDYVEDSSEGGLSPLPPQPPARAAELTDEDFMRRQILEMSAEEDNLEEDDTATSGRGLAKHGTQKGGPRPRPEPSQEPAALPKRRLPHNATTGYEELLPEGGSAEATDGSGTLQGGLRRFKTIELNSTGSYGHELDLGQGPDPSLDREPELEMESLTGSPEDRSRGEHSSTLPASTPSYTSGTSPTSLSSLEEDSDSSPSRRQRLEEAKQQRKARHRSHGPLLPTIEDSSEEEELREEEELLREQEKMREVEQQRIRSTARKTRRDKEELRAQRRRERSKTPPSNLSPIEDASPTEELRQAAEMEELHRSSCSEYSPSPSLDSEAEALDGGPSRLYKSGSEYNLPTFMSLYSPTETPSGSSTTPSSGRPLKSAEEAYEEMMRKAELLQRQQGQAAGARGPHGGPSQPTGPRGLGSFEYQDTTDREYGQAAQPAAEGTPASLGAAVYEEILQTSQSIVRMRQASSRDLAFAEDKKKEKQFLNAESAYMDPMKQNGGPLTPGTSPTQLAAPVSFSTPTSSDSSGGRVIPDVRVTQHFAKETQDPLKLHSSPASPSSASKEIGMPFSQGPGTPATTAVAPCPAGLPRGYMTPASPAGSERSPSPSSTAHSYGHSPTTANYGSQTEDLPQAPSGLAAAGRAAREKPLSASDGEGGTPQPSRAYSYFASSSPPLSPSSPSESPTFSPGKMGPRATAEFSTQTPSPAPASDMPRSPGAPTPSPMVAQGTQTPHRPSTPRLVWQESSQEAPFMVITLASDASSQTRMVHASASTSPLCSPTETQPTTHGYSQTTPPSVSQLPPEPPGPPGFPRVPSAGADGPLALYGWGALPAENISLCRISSVPGTSRVEPGPRTPGTAVVDLRTAVKPTPIILTDQGMDLTSLAVEARKYGLALDPIPGRQSTAVQPLVINLNAQEHTFLATATTVSITMASSVFMAQQKQPVVYGDPYQSRLDFGQGGGSPVCLAQVKQVEQAVQTAPYRSGPRGRPREAKFARYNLPNQVAPLARRDVLITQMGTAQSIGLKPGPVPEPGAEPHRATPAELRSHALPGARKPHTVVVQMGEGTAGTVTTLLPEEPAGALDLTGMRPESQLACCDMVYKLPFGSSCTGTFHPAPSVPEKSMADAAPPGQSSSPFYGPRDPEPPEPPTYRAQGVVGPGPHEEQRPYPQGLPGRLYSSMSDTNLAEAGLNYHAQRIGQLFQGPGRDSAMDLSSLKHSYSLGFADGRYLGQGLQYGSVTDLRHPTDLLAHPLPMRRYSSVSNIYSDHRYGPRGDAVGFQEASLAQYSATTAREISRMCAALNSMDQYGGRHGSGGGGPDLVQYQPQHGPGLSAPQSLVPLRPGLLGNPTFPEGHPSPGNLAQYGPAAGQGTAVRQLLPSTATVRAADGMIYSTINTPIAATLPITTQPASVLRPMVRGGMYRPYASGGITAVPLTSLTRVPMIAPRVPLGPTGLYRYPAPSRFPIASSVPPAEGPVYLGKPAAAKAPGAGGPSRPEMPVGAAREEPLPTTTPAAIKEAAGAPAPAPLAGQKPPADAAPGGGSGALSRPGFEKEEASQEERQRKQQEQLLQLERERVELEKLRQLRLQEELERERVELQRHREEEQLLVQRELQELQTIKHHVLQQQQEERQAQFALQREQLAQQRLQLEQIQQLQQQLQQQLEEQKQRQKAPFPAACEAPGRGPPLAAAELAQNGQYWPPLTHAAFIAMAGPEGLGQPREPVLHRGLPSSASDMSLQTEEQWEASRSGIKKRHSMPRLRDACELESGTEPCVVRRIADSSVQTDDEDGESRYLLSRRRRARRSADCSVQTDDEDSAEWEQPVRRRRSRLPRHSDSGSDSKHDATASSSSAAATVRAMSSVGIQTISDCSVQTEPDQLPRVSPAIHITAATDPKVEIVRYISAPEKTGRGESLACQTEPDGQAQGVAGPQLVGPTAISPYLPGIQIVTPGPLGRFEKKKPDPLEIGYQAHLPPESLSQLVSRQPPKSPQVLYSPVSPLSPHRLLDTSFASSERLNKAHVSPQKHFTADSALRQQTLPRPMKTLQRSLSDPKPLSPTAEESAKERFSLYQHQGGLGSQVSALPPNSLVRKVKRTLPSPPPEEAHLPLAGQASPQLYAASLLQRGLTGPTTVPATKASLLRELDRDLRLVEHESTKLRKKQAELDEEEKEIDAKLKYLELGITQRKESLAKDRGGRDYPPLRGLGEHRDYLSDSELNQLRLQGCTTPAGQFVDFPATAAAPATPSGPTAFQQPRFQPPAPQYSAGSGGPTQNGFPAHQAPTYPGPSTYPAPAFPPGASYPAEPGLPNQQAFRPTGHYAGQTPMPTTQSTLFPVPADSRAPLQKPRQTSLADLEQKVPTNYEVIASPVVPMSSAPSETSYSGPAVSSGYEQGKVPEVPRAGDRGSVSQSPAPTYPSDSHYTSLEQNVPRNYVMIDDISELTKDSTSTAPDSQRLEPLGPGSSGRPGKEPGEPGVLDGPTLPCCYARGEEESEEDSYDPRGKGGHLRSMESNGRPASTHYYGDSDYRHGARVEKYGPGPMGPKHPSKSLAPAAISSKRSKHRKQGMEQKISKFSPIEEAKDVESDLASYPPPAVSSSLVSRGRKFQDEITYGLKKNVYEQQKYYGMSSRDAVEDDRIYGGSSRSRAPSAYSGEKLSSHDFSGWGKGYEREREAVERLQKAGPKPSSLSMAHSRVRPPMRSQASEEESPVSPLGRPRPAGGPLPPGGDTCPQFCSSHSMPDVQEHVKDGPRAHAYKREEGYILDDSHCVVSDSEAYHLGQEETDWFDKPRDARSDRFRHHGGHAVSSSSQKRGPARHSYHDYDEPPEEGLWPHDEGGPGRHASAKEHRHGDHGRHSGRHTGEEPGRRAAKPHARDLGRHEARPHSQPSSAPAMPKKGQPGYPSSAEYSQPSRASSAYHHASDSKKGSRQAHSGPAALQSKAEPQAQPQLQGRQAAPGPQQSQSPSSRQIPSGAASRQPQTQQQQQGLGLQPPQQALTQARLQQQSQPTTRGSAPAASQPAGKPQPGPSTATGPQPAGPPRAEQTNGSKGTAKAPQQGRAPQAQPTPGPGPAGVKAGARPGGTPGAPAGQPGADGESVFSKILPGGAAEQAGKLTEAVSAFGKKFSSFW

SEQ ID NO: 908087 - protein, 3705 aa, Homo sapiens; identical to SEQ ID NO: 908082

SEQ ID NO: 908088 - protein, 2542 aa, Homo sapiens
MQRALGMDMTTAPRSKSQQQLHSPALSPAHSPAKQPLGKPDQERSRGPGGPQPGSRQAETARATSVPGPAQAAAPPEVGRVSPQPPQPTKPSTAEPRPPAGEAPAKSATAVPAGLGATEQTQEGLTGKLFGLGASLLTQASTLMSVQPEADTQGQPAPSKGTPKIVFNDASKEAGPKPLGSGPGPGPAPGAKTEPGARMGPGSGPGALPKTGGTTSPKHGRAEHQAASKAAAKPKTMPKERAICPLCQAELNVGSKSPANYNTCTTCRLQVCNLCGFNPTPHLVEKTEWLCLNCQTKRLLEGSLGEPTPLPPPTSQQPPVGAPHRASGTSPLKQKGPQGLGQPSGPLPAKASPLSTKASPLPSKASPQAKPLRASEPSKTPSSVQEKKTRVPTKAEPMPKPPPETTPTPATPKVKSGVRRAEPATPVVKAVPEAPKGGEAEDLVGKPYSQDASRSPQSLSDTGYSSDGISSSQSEITGVVQQEVEQLDSAGVTGPHPPSPSEIHKVGSSMRPLLQAQGLAPSERSKPLSSGTGEEQKQRPHSLSITPEAFDSDEELEDILEEDEDSAEWRRRREQQDTAESSDDFGSQLRHDYVEDSSEGGLSPLPPQPPARAAELTDEDFMRRQILEMSAEEDNLEEDDTATSGRGLAKHGTQKGGPRPRPEPSQEPAALPKRRLPHNATTGYEELLPEGGSAEATDGSGTLQGGLRRFKTIELNSTGSYGHELDLGQGPDPSLDREPELEMESLTGSPEDRSRGEHSSTLPASTPSYTSGTSPTSLSSLEEDSDSSPSRRQRLEEAKQQRKARHRSHGPLLPTIEDSSEEEELREEEELLREQEKMREVEQQRIRSTARKTRRDKEELRAQRRRERSKTPPSNLSPIEDASPTEELRQAAEMEELHRSSCSEYSPSPSLDSEAEALDGGPSRLYKSGSEYNLPTFMSLYSPTETPSGSSTTPSSGRPLKSAEEAYEEMMRKAELLQRQQGQAAGARGPHGGPSQPTGPRGLGSFEYQDTTDREYGQAAQPAAEGTPASLGAAVYEEILQTSQSIVRMRQASSRDLAFAEDKKKEKQFLNAESAYMDPMKQNGGPLTPGTSPTQLAAPVSFSTPTSSDSSGGRVIPDVRVTQHFAKETQDPLKLHSSPASPSSASKEIGMPFSQGPGTPATTAVAPCPAGLPRGYMTPASPAGSERSPSPSSTAHSYGHSPTTANYGSQTEDLPQAPSGLAAAGRAAREKPLSASDGEGGTPQPSRAYSYFASSSPPLSPSSPSESPTFSPGKMGPRATAEFSTQTPSPAPASDMPRSPGAPTPSPMVAQGTQTPHRPSTPRLVWQESSQEAPFMVITLASDASSQTRMVHASASTSPLCSPTETQPTTHGYSQTTPPSVSQLPPEPPGPPGFPRVPSAGADGPLALYGWGALPAENISLCRISSVPGTSRVEPGPRTPGTAVVDLRTAVKPTPIILTDQGMDLTSLAVEARKYGLALDPIPGRQSTAVQPLVINLNAQEHTFLATATTVSITMASSVFMAQQKQPVVYGDPYQSRLDFGQGGGSPVCLAQVKQVEQAVQTAPYRSGPRGRPREAKFARYNLPNQVAPLARRDVLITQMGTAQSIGLKPGPVPEPGAEPHRATPAELRSHALPGARKPHTVVVQMGEGTAGTVTTLLPEEPAGALDLTGMRPESQLACCDMVYKLPFGSSCTGTFHPAPSVPEKSMADAAPPGQSSSPFYGPRDPEPPEPPTYRAQGVVGPGPHEEQRPYPQGLPGRLYSSMSDTNLAEAGLNYHAQRIGQLFQGPGRDSAMDLSSLKHSYSLGFADGRYLGQGLQYGSVTDLRHPTDLLAHPLPMRRYSSVSNIYSDHRYGPRGDAVGFQEASLAQYSATTAREISRMCAALNSMDQYGGRHGSGGGGPDLVQYQPQHGPGLSAPQSLVPLRPGLLGNPTFPEGHPSPGNLAQYGPAAGQGTAVRQLLPSTATVRAADGMIYSTINTPIAATLPITTQPASVLRPMVRGGMYRPYASGGITAVPLTSLTRVPMIAPRVPLGPTGLYRYPAPSRFPIASSVPPAEGPVYLGKPAAAKAPGAGGPSRPEMPVGAAREEPLPTTTPAAIKEAAGAPAPAPLAGQKPPADAAPGGGSGALSRPGFEKEEASQEERQRKQQEQLLQLERERVELEKLRQLRLQEELERERVELQRHREEEQLLVQRELQELQTIKHHVLQQQQEERQAQFALQREQLAQQRLQLEQIQQLQQQLQQQLEEQKQRQKAPFPAACEAPGRGPPLAAAELAQNGQYWPPLTHAAFIAMAGPEGLGQPREPVLHRGLPSSASDMSLQTEEQWEASRSGIKKRHSMPRLRDACELESGTEPCVVRRIADSSVQTDDEDGESRYLLSRRRRARRSADCSVQTDDEDSAEWEQPVRRRRSRLPRHSDSGSDSKHDATASSSSAAATVRAMSSVGIQTISDCSVQTEPDQLPRVSPAIHITAATDPKVEIVRYISAPEKTGRGESLACQTEPDGQAQGVAGPQLVGPTAISPYLPGIQIVTPGPLGRLPVPLK

SEQ ID NO: 908089 - protein, 125 aa, Homo sapiens
MGSQCLLFTLLQDLVGKPYSQDASRSPQSLSDTGYSSDGISSSQSEITGVVQQEVEQLDSAGVTGPHPPSPSEIHKVGSSMRPLLQAQGLAPSERSKPLSSGTGEEQKQRPHSLSITPEAFDSDE

SEQ ID NO: 908090 - protein, 328 aa, Homo sapiens
INDLQKDIEGSRKRESELLLFTERLTSKNAQLQSESNSLQSQFDKVSCSESQLQSQCEQMKQTNINLESRLLKEEELRKEEVQTLQAELACRQTEVKALSTQVEELKDELVTQRRKHASSIKDLTKQLQQARRKLDQVESGSYDKEVSSMGSRSSSSGSLNARSSAEDRSPENTGSSVAVDNFPQVDKAMLIERIVRLQKAHARKNEKIEFMEDHIKQLVEEIRKKTKIIQSYILREESGTLSSEASDFNKVHLSRRGGIMASLYTSHPADNGLTLELSLEINRKLQAVLEDTLLKNITLKENLQTLGTEIERLIKHQHELEQRTKKT

SEQ ID NO: 908091 - protein, 137 aa, Homo sapiens
INDLQKDIEGSRKRESELLLFTERLTSKNAQLQSESNSLQSQFDKVSCSESQLQSQCEQMKQTNINLESRLLKEEELRKEEVQTLQAELACRQTEVKALSTQVEELKDELVTQRRKHASSIKDLTKQLQQGIKFFHT

SEQ ID NO: 908092 - protein, 144 aa, Homo sapiens
INDLQKDIEGSRKRESELLLFTERLTSKNAQLQSESNSLQSQFDKVSCSESQLQSQCEQMKQTNINLESRLLKEEELRKEEVQTLQAELACRQTEVKALSTQVEELKDELVTQRRKHASSIKDLTKQLQQGYRHLGCRYPRCVL

SEQ ID NO: 908093 - protein, 260 aa, Homo sapiens
MGKEKTHINIVVIGHVDSGKSTTTGHLIYKCGGIDKRTIEKFEKEAAEMGKGSFKYAWVLDKLKAPASPGCLQNWWYWYCSCWPSGDWCSQTRYGGHLCSSQRYNADMLTHNKHRPLVKMHHEALSEALSLGGNPQTILGFWGGGGPPFFFSPHNTNKTFFVGGAPISFPARQNTKHTTVRAVRPNTTPHPQPPRLSCCWWGRGHHIIIGGGPAPRLLLLPPPAPLTSLLAGGGHHILRLSPPPLSRTNPCTHDTRVSLM

SEQ ID NO: 908094 - protein, 373 aa, Homo sapiens
MGKEKTHINIVVIGHVDSGKSTTTGHLIYKCGGIDKRTIEKFEKEAAEMGKGSFKYAWVLDKLKAERERGITIDISLWKFETSKYYVTIIDAPGHRDFIKNMITGTSQADCAVLIVAAGVGEFEAGISKNGQTREHALLAYTLGVKQLIVGVNKMDSTEPPYSQKRYEEIVKEVSTYIKKIGYNPDTVAFVPISGWNGDNMLEPSANMPWFKGWKVTRKDGNASGTTLLEALDCILPPTRPTDKPLRLPLQDVYKIGGIGTVPVGRVETGVLKPGMVVTFAPVNVTTEVKSVEMHHEALSEALPGDNVGFNVKNVSVKDVRRGNVAGDSKNDPPMEAAGFTAQVIILNHPGQISAGYAPVLGLPHGSHCMQVC

SEQ ID NO: 908095 - protein, 370 aa, Homo sapiens
CRCDCERIPSKTQAYLKEPFPGHLIYKCGGIDKRTIEKFEKEAAEMGKGSFKYAWVLDKLKAERERGITIDISLWKFETSKYYVTIIDAPGHRDFIKNMITGTSQADCAVLIVAAGVGEFEAGISKNGQTREHALLAYTLGVKQLIVGVNKMDSTEPPYSQKRYEEIVKEVSTYIKKIGYNPDTVAFVPISGWNGDNMLEPSANMPWFKGWKVTRKDGNASGTTLLEALDCILPPTRPTDKPLRLPLQDVYKIGGIGTVPVGRVETGVLKPGMVVTFAPVNVTTEVKSVEMHHEALSEALPGDNVGFNVKNVSVKDVRRGNVAGDSKNDPPMEAAGFTAQVIILNHPGQISAGYAPVLGLPHGSHCMQVC

SEQ ID NO: 908096 - protein, 373 aa, Homo sapiens; identical to SEQ ID NO: 908094

SEQ ID NO: 908097 - protein, 373 aa, Homo sapiens; identical to SEQ ID NO: 908094

SEQ ID NO: 908098 - protein, 373 aa, Homo sapiens; identical to SEQ ID NO: 908094

SEQ ID NO: 908099 - protein, 355 aa, Homo sapiens
MGKEKTHINIVVIGHVDSGKSTTTGHLIYKCGGIDKRTIEKFEKEAAEMGKGSFKYAWVLDKLKAERERGITIDISLWKFETSKYYVTIIDAPGHRDFIKNMITGTSQADCAVLIVAAGVGEFEAGISKNGQTREHALLAYTLGVKQLIVGVNKMDSTEPPYSQKRYEEIVKEVSTYIKGDNMLEPSANMPWFKGWKVTRKDGNASGTTLLEALDCILPPTRPTDKPLRLPLQDVYKIGGIGTVPVGRVETGVLKPGMVVTFAPVNVTTEVKSVEMHHEALSEALPGDNVGFNVKNVSVKDVRRGNVAGDSKNDPPMEAAGFTAQVIILNHPGQISAGYAPVLGLPHGSHCMQVC

SEQ ID NO: 908100 - protein, 315 aa, Homo sapiens
MGKEKTHINIVVIGHVDSGKSTTTGHLIYKCGGIDKRTIEKFEKEAAEMGKGSFKYAWVLDKLKAERERGITIDISLWKFETSKYYVTIIDAPGHRDFIKNMITGTSQADCAVLIVAAGVGEFEAGISKNGQTREHALLAYTLGVKQLIVGVNKMDSTEPPYSQKRYEEIVKEVSTYIKKIGYNPDTVAFVPISGWNGDNMLEPSANMPWFKGWKVTRKDGNASGTTLLEALDCILPPTRPTDKPLRLPLQDVYKIGGIGTVPVGRVETGVLKPGMVVTFAPVNVTTEVKSVEMHHEALSEALPGDNVGFNVKNV

SEQ ID NO: 908101 - protein, 362 aa, Homo sapiens
MGKEKTHINIVVIGHVDSGKSTTTGHLIYKCGGIDKRTIEKFEKEAAEMGKGSFKYAWVLDKLKAERERGITIDISLWKFETSKYYVTIIDAPGHRDFIKNMITGTSQADCAVLIVAAGVGEFEAGISKNGQTREHALLAYTLGVKQLIVGVNKMDSTEPPYSQKRYEEIVKEVSTYIKKIGYNPDTVAFVPISGWNGDNMLEPSANMPWFKGWKVTRKDGNASGTTLLEALDCILPPTRPTDKPLGIGTVPVGRVETGVLKPGMVVTFAPVNVTTEVKSVEMHHEALSEALPGDNVGFNVKNVSVKDVRRGNVAGDSKNDPPMEAAGFTAQVIILNHPGQISAGYAPVLGLPHGSHCMQVC

SEQ ID NO: 908102 - protein, 367 aa, Homo sapiens
MGKEKTHINIVVIGHVDSGKSTTTGHLIYKCGGIDKRTIEKFEKEAAEMGKGSFKYAWVLDKLKAERERGITIDISLWKFETSKYYVTIIDAPGHRDFIKNMITGTSQADCAVLIVAAGVGEFEAGISKNGQTREHALLAYTLGVKQLIVGVNKMDSTEPPYSQKRYEEIVKEVSTYIKKIGYNPDTVAFVPISGWNGDNMLEPSANMPWFKGWKVTRKDGNASGTTLLEALDCILPPTRPTDKPLRLPLQDVYKIGGIGTVPVGRVETGVLKPGMVVTFAPVNVTTEVKSVEMHHEALSEALPGDNVGFNVKNVSVKDVRRGNVAGDSKNDPPMEAAGFTAQVIILNHPGQISAGYAPVLGARVNA

SEQ ID NO: 908103 - protein, 161 aa, Homo sapiens
AFSQRVCRQNTGVVKTTPKSQNGKGKDSYQHCRHWTRRFGQVHHYGIGTVPVGRVETGVLKPGMVVTFAPVNVTTEVKSVEMHHEALSEALPGDNVGFNVKNVSVKDVRRGNVAGDSKNDPPMEAAGFTAQVIILNHPGQISAGYAPVLGLPHGSHCMQVC

SEQ ID NO: 908104 - protein, 290 aa, Homo sapiens
MGKEKTHINIVVIGHVDSGKSTTTGHLIYKCGGIDKRTIEKFEKEAAEMGKGSFKYAWVLDKLKAERERGITIDISLWKFETSKYYVTIIDAPGHRDFIKNMITGTSQADCAVLIVAAGVGEFEAGISKNGQTREHALLAYTLGVKQLIVGVNKMDSTEPPYSQKRYEEIVKEVSTYIKKIGYNPDTVAFVPISGWNGDNMLEPSANMPWFKGWKVTRKDGNASGTTLLEALDCILPPTRPTDKPLRLPLQDVYKIGLHPTTNSSNSNKRRLCPCIGIATRLTLHASLLS

SEQ ID NO: 908105 - protein, 368 aa, Homo sapiens
MGKEKTHINIVVIGHVDSGKSTTTGHLIYKCGGIDKRTIEKFEKEAAEMGKGSFKYAWVLDKLKAERERGITIDISLWKFETSKYYVTIIDAPGHRDFIKNMITGTSQADCAVLIVAAGVGEFEAGISKNGQTREHALLAYTLGVKQLIVGVNKMDSTEPPYSQKRYEEIVKEVSTYIKKIGYNPDTVAFVPISGWNGDNMLEPSANMPWFKGWKVTRKDGNASGTTLLEALDCILPPTRPTDKPLRLPLQDVYKIGGIGTVPVGRVETGVLKPGMVVTFAPVNVTTEVKSVEMHHEALSEALPGDNVGFNVKNVSVKDVRRGNVAGDSKNDPPMEAAGFTAQVIILNHPGRCWSWQGHQVCPESSEG

SEQ ID NO: 908106 - protein, 155 aa, Homo sapiens
MGKEKTHINIVVIGHVDSGKSTTTGHLIYKCGGIDKRTIEKFEKEAAEMGKGSFKYAWVLDKLKAERERGITIDISLWKFETSKYYVTIIDAPGHRDFIKNMITGTSQADCAVLIVAAGVGEFEAGISKNGQTREHALQCQECVCQGCSSWQRCW

SEQ ID NO: 908107 - protein, 154 aa, Homo sapiens
MGKEKTHINIVVIGHVDSGKSTTTGHLIYKCGGIDKRTIEKFEKEAAEMGKGSFKYAWVLDKLKAERERGITIDISLWKFETSKYYVTIIDAPGHRDFIKNMITGTSQADCAVLIVAAGVGEFEAGISKNGQTREHALLAVGWLSGIHLCDTDH

SEQ ID NO: 908108 - protein, 325 aa, Homo sapiens
MGKGSFKYAWVLDKLKAERERGITIDISLWKFETSKYYVTIIDAPGHRDFIKNMITGTSQADCAVLIVAAGVGEFEAGISKNGQTREHALLAYTLGVKQLIVGVNKMDSTEPPYSQKRYEEIVKEVSTYIKKIGYNPDTVAFVPISGWNGDNMLEPSANMPWFKGWKVTRKDGNASGTTLLEALDCILPPTRPTDKPLRLPLQDVYKIGGIGTVPVGRVETGVLKPGMVVTFAPVNVTTEVKSVEMHHEALSEALPGDNVGFNVKNVSVKDVRRGNVAGDSKNDPPMEAAGFTAQVIILNHPGQISAGYAPVLGLPHGSHCMQVC

SEQ ID NO: 908109 - protein, 373 aa, Homo sapiens; identical to SEQ ID NO: 908094

SEQ ID NO: 908110 - protein, 373 aa, Homo sapiens; identical to SEQ ID NO: 908094

SEQ ID NO: 908111 - protein, 373 aa, Homo sapiens; identical to SEQ ID NO: 908094

SEQ ID NO: 908112 - protein, 376 aa, Homo sapiens
MGKEKTHINIVVIGHVDSGKSTTTGHLIYKCGGIDKRTIEKFEKEAAEMGKGSFKYAWVLDKLKAERERGITIDISLWKFETSKYYVTIIDAPGHRDFIKNMITGTSQADCAVLIVAAGVGEFEAGISKNGQTREHALLAYTLGVKQLIVGVNKMDSTEPPYSQKRYEEIVKEVSTYIKKIGYNPDTVAFVPISGWNGDNMLEPSANMPWFKGWKVTRKDGNASGTTLLEALDCILPPTRPTDKPLRLPLQDVYKIGGIGTVPVGRVETGVLKPGMVVTFAPVNVTTEVKSVEMHHEALSEALPGDNVGFNVKNVSVKDVRRGNVAGDSKNDPPMEAAGFTAQVIILNHPGQISAGYAPVLGLPHGSHCMQVLAGA

SEQ ID NO: 908113 - protein, 364 aa, Homo sapiens
MGKEKTHINIVVIGHVDSGKSTTTGHLIYKCGGIDKRTIEKFEKEAAEMGKGSFKYAWVLDKLKAERERGITIDISLWKFETSKYYVTIIDAPGHRDFIKNMITGTSQADCAVLIVAAGVGEFEAGISKNGQTREHALLAYTLGVKQLIVGVNKMDSTEPPYSQKRYEEIVKEVSTYIKKIGYNPDTVAFVPISGWNGDNMLEPSANMPWFKGWKVTRKDGNASGTTLLEALDCILPPTRPTDKPLRLPLQDVYKIGGIGTVPVGRVETGVLKPGMVVTFAPVNVTTEVKSVEMHHEALSEALPGDNVGFNVKNVSVKDVRRGNVAGDSKNDPPMEAAGFTAQVIILNHPGLATRLTLHASLLS

SEQ ID NO: 908114 - protein, 354 aa, Homo sapiens
MGKEKTHINIVVIGHVDSGKSTTTGHLIYKCGGIDKRTIEKFEKEAAEMGKGSFKYAWVLDKLKAERERGITIDISLWKFETSKYYVTIIDAPGHRDFIKNMITGTSQADCAVLIVAAGVGEFEAGISKNGQTREHALLAYTLGVKQLIVGVNKMDSTEPPYSQKRYEEIVKEVSTYIKKIGYNPDTVAFVPISGWNGDNMLEPSANMPWFKGWKVTRKDGNASGTTLLEALDCILPPTRPTDKPLRLPLQDVYKIGVVTFAPVNVTTEVKSVEMHHEALSEALPGDNVGFNVKNVSVKDVRRGNVAGDSKNDPPMEAAGFTAQVIILNHPGQISAGYAPVLGLPHGSHCMQVC

SEQ ID NO: 908115 - protein, 243 aa, Homo sapiens
MGKEKTHINIVVIGHVDSGKSTTTGHLIYKCGGIDKRTIEKFEKEAAEMGKGSFKYAWVLDKLKAERERGITIDISLWKFETSKYYVTIIDAPGHRDFIKNMITGTSQADCAVLIVAAGVGEFEAGISKNGQTREHALLAYTLGVKQLIVGVNKMDSTEPPYSQKRYEEIVKEVSTYIKKIGYNPDTVAFVPISGWNGDNMLEPSANMPWFKGWKVTRKDGNASGHLCSSQRYNGSKICRNAP

SEQ ID NO: 908116 - protein, 155 aa, Homo sapiens; identical to SEQ ID NO: 908106

SEQ ID NO: 908117 - protein, 369 aa, Homo sapiens
MGKEKTHINIVVIGHVDSGKSTTTGHLIYKCGGIDKRTIEKFEKEAAEMGKGSFKYAWVLDKLKAERERGITIDISLWKFETSKYYVTIIDAPGHRDFIKNMITGTSQADCAVLIVAAGVGEFEAGISKNGQTREHALLAYTLGVKQLIVGVNKMDSTEPPYSQKRYEEIVKEVSTYIKKIGYNPDTVAFVPISGWNGDNMLEPSANMPWFKGWKVTRKDGNASGTTLLEALDCILPPTRPTDKPLRLPLQDVYKIGGIGTVPVGRVETGVLKPGMVVTFAPVNVTTCSRLHTSATLPELVPLLGGVRAFLRVLYFQGTWWGCVSQRQKLFPSHTLGLTVLHLTHSVDCSLLRPSKRPWVFLFNDCIAS

SEQ ID NO: 908118 - protein, 1430 aa, Homo sapiens
MTVFRQENVDDYYDTGEELGSGQFAVVKKCREKSTGLQYAAKFIKKRRTKSSRRGVSREDIEREVSILKEIQHPNVITLHEVYENKTDVILILELVAGGELFDFLAEKESLTEEEATEFLKQILNGVYYLHSLQIAHFDLKPENIMLLDRNVPKPRIKIIDFGLAHKIDFGNEFKNIFGTPEFVAPEIVNYEPLGLEADMWSIGVITYILLSGASPFLGDTKQETLANVSAVNYEFEDEYFSNTSALAKDFIRRLLVKDPKKRMTIQDSLQHPWIKPKDTQQALSRKASAVNMEKFKKFAARKKWKQSVRLISLCQRLSRSFLSRSNMSVARSDDTLDEEDSFVMKAIIHAINDDNVPGLQHLLGSLSNYDVNQPNKHGTPPLLIAAGCGNIQILQLLIKRGSRIDVQDKGGSNAVYWAARHGHVDTLKFLSENKCPLDVKDKSGEMALHVAARYGHADVAQLLCSFGSNPNIQDKEEETPLHCAAWHGYYSVAKALCEAGCNVNIKNREGETPLLTASARGYHDIVECLAEHGADLNACDKDGHIALHLAVRRCQMEVIKTLLSQGCFVDYQDRHGNTPLHVACKDGNMPIVVALCEANCNLDISNKYGRTPLHLAANNGILDVVRYLCLMGASVEALTTDGKTAEDLARSEQHEHVAGLLARLRKDTHRGLFIQQLRPTQNLQPRIKLKLFGHSGSGKTTLVESLKCGLLRSFFRRRRPRLSSTNSSRFPPSPLASKPTVSVSINNLYPGCENVSVRSRSMMFEPGLTKGMLEVFVAPTHHPHCSADDQSTKAIDIQNAYLNGVGDFSVWEFSGNPVYFCCYDYFAANDPTSIHVVVFSLEEPYEIQLNQVIFWLSFLKSLVPVEEPIAFGGKLKNPLQVVLVATHADIMNVPRPAGGEFGYDKDTSLLKEIRNRFGNDLHISNKLFVLDAGASGSKDMKVLRNHLQEIRSQIVSVCPPMTHLCEKIISTLPSWRKLNGPNQLMSLQQFVYDVQDQLNPLASEEDLRRIAQQLHSTGEINIMQSETVQDVLLLDPRWLCTNVLGKLLSVETPRALHHYRGRYTVEDIQRLVPDSDVEELLQILDAMDICARDLSSGTMVDVPALIKTDNLHRSWADEEDEVMVYGGVRIVPVEHLTPFPCGIFHKVQVNLCRWIHQQSTEGDADIRLWVNGCKLANRGAELLVLLVNHGQGIEVQVRGLETEKIKCCLLLDSVCSTIENVMATTLPGLLTVKHYLSPQQLREHHEPVMIYQPRDFFRAQTLKETSLTNTMGGYKESFSSIMCFGCHDVYSQASLGMDIHASDLNLLTRRKLSRLLDPPDPLGKDWCLLAMNLGLPDLVAKYNTSNGAPKDFLPSPLHALLREWTTYPESTVGTLMSKLRELGRRDAADFLLKASSVFKINLDGNGQEAYASSCNSGTSYNSISSVVSR

SEQ ID NO: 908119 - protein, 108 aa, Homo sapiens
MALHVAARYGHADVAQLLCSFGSNPNIQDKEEETPLHCAAWHGYYSVAKALCEAGCNVNIKNREGETPLLTASARGYHDIVECLAEHGADLNACDKVPYGGRLICTGK

SEQ ID NO: 908120 - protein, 539 aa, Homo sapiens
MNVPRPAGGEFGYDKDTSLLKEIRNRFGNDLHISNKLFVLDAGASGSKDMKVLRNHLQEIRSQIVSVCPPMTHLCEKIISTLPSWRKLNGPNQLMSLQQFVYDVQDQLNPLASEEDLRRIAQQLHSTGEINIMQSETVQDVLLLDPRWLCTNVLGKLLSVETPRALHHYRGRYTVEDIQRLVPDSDVEELLQILDAMDICARDLSSGTMVDVPALIKTDNLHRSWADEEDEVMVYGGVRIVPVEHLTPFPCGIFHKVQVNLCRWIHQQSTEGDADIRLWVNGCKLANRGAELLVLLVNHGQGIEVQVRGLETEKIKCCLLLDSVCSTIENVMATTLPGLLTVKHYLSPQQLREHHEPVMIYQPRDFFRAQTLKETSLTNTMGGYKESFSSIMCFGCHDVYSQASLGMDIHASDLNLLTRRKLSRLLDPPDPLGKDWCLLAMNLGLPDLVAKYNTSNGAPKDFLPSPLHALLREWTTYPESTVGTLMSKLRELGRRDAADFLLKASSVFKINLDGNGQEAYASSCNSGTSYNSISSVVSR

SEQ ID NO: 908121 - protein, 1430 aa, Homo sapiens; identical to SEQ ID NO: 908118

SEQ ID NO: 908122 - protein, 554 aa, Homo sapiens
MTVFRQENVDDYYDTGEELGSGQFAVVKKCREKSTGLQYAAKFIKKRRTKSSRRGVSREDIEREVSILKEIQHPNVITLHEVYENKTDVILILELVAGGELFDFLAEKESLTEEEATEFLKQILNGVYYLHSLQIAHFDLKPENIMLLDRNVPKPRIKIIDFGLAHKIDFGNEFKNIFGTPEFVAPEIVNYEPLGLEADMWSIGVITYILLSGASPFLGDTKQETLANVSAVNYEFEDEYFSNTSALAKDFIRRLLVKDPKKRMTIQDSLQHPWIKPKDTQQALSRKASAVNMEKFKKFAARKKWKQSVRLISLCQRLSRSFLSRSNMSVARSDDTLDEEDSFVMKAIIHAINDDNVPGLQHLLGSLSNYDVNQPNKHGTPPLLIAAGCGNIQILQLLIKRGSRIDVQDKGGSNAVYWAARHGHVDTLKFLSENKCPLDVKDKSGEMALHVAARYGHADVAQLLCSFGSNPNIQDKEEETPLHCAAWHGYYSVAKALCEAGCNVNIKNREGETPLLTASARGYHDIVECLAEHGADLNACDKVPYGGRLICTGK

SEQ ID NO: 908123 - protein, 429 aa, Homo sapiens
MTVFRQENVDDYYDTGEELGSGQFAVVKKCREKSTGLQYAAKFIKKRRTKSSRRGVSREDIEREVSILKEIQHPNVITLHEVYENKTDVILILELVAGGELFDFLAEKESLTEEEATEFLKQILNGVYYLHSLQIAHFDLKPENIMLLDRNVPKPRIKIIDFGLAHKIDFGNEFKNIFGTPEFVAPEIVNYEPLGLEADMWSIGVITYILLSGASPFLGDTKQETLANVSAVNYEFEDEYFSNTSALAKDFIRRLLVKDPKKRMTIQDSLQHPWIKPKDTQQALSRKASAVNMEKFKKFAARKKWKQSVRLISLCQRLSRSFLSRSNMSVARSDDTLDEEDSFVMKAIIHAINDDNVPGLQHLLGSLSNYDVNQPNKVWFCSAAYWRGGSQRPCPSISKERPHLLLHSPFQLEAPYCGENHFCLESDLS

SEQ ID NO: 908124 - protein, 367 aa, Homo sapiens [sequence omitted]

SEQ ID NO: 908125 - protein, 668 aa, Homo sapiens [sequence omitted]

SEQ ID NO: 908126 - protein, 1430 aa, Homo sapiens; identical to SEQ ID NO: 908118

SEQ ID NO: 908127 - protein, 641 aa, Homo sapiens
MTVFRQENVDDYYDTGEELGSGQFAVVKKCREKSTGLQYAAKFIKKRRTKSSRRGVSREDIEREVSILKEIQHPNVITLHEVYENKTDVILILELVAGGELFDFLAEKESLTEEEATEFLKQILNGVYYLHSLQIAHFDLKPENIMLLDRNVPKPRIKIIDFGLAHKIDFGNEFKNIFGTPEFVAPEIVNYEPLGLEADMWSIGVITYILLSGASPFLGDTKQETLANVSAVNYEFEDEYFSNTSALAKDFIRRLLVKDPKKRMTIQDSLQHPWIKPKDTQQALSRKASAVNMEKFKKFAARKKWKQSVRLISLCQRLSRSFLSRSNMSVARSDDTLDEEDSFVMKAIIHAINDDNVPGLQHLLGSLSNYDVNQPNKHGTPPLLIAAGCGNIQILQLLIKRGSRIDVQDKGGSNAVYWAARHGHVDTLKFLSENKCPLDVKDKSGEMALHVAARYGHADVAQLLCSFGSNPNIQDKEEETPLHCAAWHGYYSVAKALCEAGCNVNIKNREGETPLLTASARGYHDIVECLAEHGADLNACDKDGHIALHLAVRRCQMEVIKTLLSQGCFVDYQDRHGNTPLHVACKDGNMPIVVALCEANCNLDISNKYGRTPLHLAANNGILDVVRYLCLMGASVEALTT

SEQ ID NO: 908128 - protein, 495 aa, Homo sapiens
PSWDIGAARGWEAITYLALRKKTKASMHSFPPLLLLLFWGVVSHSFPATLETQEQDVDLVQKYLEKYYNLKNDGRQVEKRRNSGPVVEKLKQMQEFFGLKVTGKPDAETLKVMKQPRCGVPDVAQFVLTEGNPRWEQTHLTYRIENYTPDLPRADVDHAIEKAFQLWSNVTPLTFTKVSEGQADIMISFVRGDHRDNSPFDGPGGNLAHAFQPGPGIGGDAHFDEDERWTNNFREYNLHRVAAHELGHSLGLSHSTDIGALMYPSYTFSGDVQLAQDDIDGIQAIYGRSQNPVQPIGPQTPKACDSKLTFDAITTIRGEVMFFKDRFYMRTNPFYPEVELNFISVFWPQLPNGLEAAYEFADRDEVRFFKGNKYWAVQGQNVLHGYPKDIYSSFGFPRTVKHIDAALSEENTGKTYFFVANKYWRYDEYKRSMDPGYPKMIAHDFPGIGHKVDAVFMKDGFFYFFHGTRQYKFDPKTKRILTLQKANSWFNCRKN

SEQ ID NO: 908129 - protein, 784 aa, Homo sapiens
MSGGWPGGQACQPAVEMALEDVNSRRDILPDYELKLIHHDSKCDPGQATKYLYELLYNDPIKIILMPGCSSVSTLVAEAARMWNLIVLSYGSSSPALSNRQRFPTFFRTHPSATLHNPTRVKLFEKWGWKKIATIQQTTEVFTSTLDDLEERVKEAGIEITFRQSFFSDPAVPVKNLKRQDARIIVGLFYETEARKVFCEVYKERLFGKKYVWFLIGWYADNWFKIYDPSINCTVDEMTEAVEGHITTEIVMLNPANTRSISNMTSQEFVEKLTKRLKRHPEETGGFQEAPLAYDAIWALALALNKTSGGGGRSGVRLEDFNYNNQTITDQIYRAMNSSSFEGVSGHVVFDASGSRMAWTLIEQLQGGSYKKIGYYDSTKDDLSWSKTDKWIGGSPPADQTLVIKTFRFLSQKLFISVSVLSSLGIVLAVVCLSFNIYNSHVRYIQNSQPNLNNLTAVGCSLALAAVFPLGLDGYHIGRNQFPFVCQARLWLLGLGFSLGYGSMFTKIWWVHTVFTKKEEKKEWRKTLEPWKLYATVGLLVGMDVLTLAIWQIVDPLHRTIETFAKEEPKEDIDVSILPQLEHCSSRKMNTWLGIFYGYKGLLLLLGIFLAYETKSVSTEKINDHRAVGMAIYNVAVLCLITAPVTMILSSQQDAAFAFASLAIVFSSYITLVVLFVPKMRRLITRGEWQSEAQDTMKTGSSTNNNEEEKSRLLEKENRELEKIIAEKEERVSELRHQLQSRQQLRSRRHPPTPPEPSGGLPRGPPEPPDRLSCDGSRVHLLYK

SEQ ID NO: 908130 - protein, 835 aa, Homo sapiens
MRLSMCAGGSARWWGPRSASAWPTAPGQIWTHPAAVPHSERRAVYIGALFPMSGGWPGGQACQPAVEMALEDVNSRRDILPDYELKLIHHDSKCDPGQATKYLYELLYNDPIKIILMPGCSSVSTLVAEAARMWNLIVLSYGSSSPALSNRQRFPTFFRTHPSATLHNPTRVKLFEKWGWKKIATIQQTTEVFTSTLDDLEERVKEAGIEITFRQSFFSDPAVPVKNLKRQDARIIVGLFYETEARKVFCEVYKERLFGKKYVWFLIGWYADNWFKIYDPSINCTVDEMTEAVEGHITTEIVMLNPANTRSISNMTSQEFVEKLTKRLKRHPEETGGFQEAPLAYDAIWALALALNKTSGGGGRSGVRLEDFNYNNQTITDQIYRAMNSSSFEGVSGHVVFDASGSRMAWTLIEQLQGGSYKKIGYYDSTKDDLSWSKTDKWIGGSPPADQTLVIKTFRFLSQKLFISVSVLSSLGIVLAVVCLSFNIYNSHVRYIQNSQPNLNNLTAVGCSLALAAVFPLGLDGYHIGRNQFPFVCQARLWLLGLGFSLGYGSMFTKIWWVHTVFTKKEEKKEWRKTLEPWKLYATVGLLVGMDVLTLAIWQIVDPLHRTIETFAKEEPKEDIDVSILPQLEHCSSRKMNTWLGIFYGYKGLLLLLGIFLAYETKSVSTEKINDHRAVGMAIYNVAVLCLITAPVTMILSSQQDAAFAFASLAIVFSSYITLVVLFVPKMRRLITRGEWQSEAQDTMKTGSSTNNNEEEKSRLLEKENRELEKIIAEKEERVSELRHQLQSRQQLRSRRHPPTPPEPSGGLPRGPPEPPDRLSCDGSRVHLLYK

SEQ ID NO: 908131 - protein, 167 aa, Homo sapiens
MLLLLLLAPLFLRPPGAGGAQTPNATSEGCQIIHPPWEGGIRYRGLTRDQVKAINFLPVDYEIEYVCRGEREVVGPKVRKCLANGSWTDMDTPSRCVRICSKSYLTLENGKVFLTGGDLPALDGARVDFRCDPDFHLVGSSRSICSQGQWSTPKPHCQVNRTLPACS

SEQ ID NO: 908132 - protein, 961 aa, Homo sapiens
MLLLLLLAPLFLRPPGAGGAQTPNATSEGCQIIHPPWEGGIRYRGLTRDQVKAINFLPVDYEIEYVCRGEREVVGPKVRKCLANGSWTDMDTPSRCVRICSKSYLTLENGKVFLTGGDLPALDGARVDFRCDPDFHLVGSSRSICSQGQWSTPKPHCQVNRTPHSERRAVYIGALFPMSGGWPGGQACQPAVEMALEDVNSRRDILPDYELKLIHHDSKCDPGQATKYLYELLYNDPIKIILMPGCSSVSTLVAEAARMWNLIVLSYGSSSPALSNRQRFPTFFRTHPSATLHNPTRVKLFEKWGWKKIATIQQTTEVFTSTLDDLEERVKEAGIEITFRQSFFSDPAVPVKNLKRQDARIIVGLFYETEARKVFCEVYKERLFGKKYVWFLIGWYADNWFKIYDPSINCTVDEMTEAVEGHITTEIVMLNPANTRSISNMTSQEFVEKLTKRLKRHPEETGGFQEAPLAYDAIWALALALNKTSGGGGRSGVRLEDFNYNNQTITDQIYRAMNSSSFEGVSGHVVFDASGSRMAWTLIEQLQGGSYKKIGYYDSTKDDLSWSKTDKWIGGSPPADQTLVIKTFRFLSQKLFISVSVLSSLGIVLAVVCLSFNIYNSHVRYIQNSQPNLNNLTAVGCSLALAAVFPLGLDGYHIGRNQFPFVCQARLWLLGLGFSLGYGSMFTKIWWVHTVFTKKEEKKEWRKTLEPWKLYATVGLLVGMDVLTLAIWQIVDPLHRTIETFAKEEPKEDIDVSILPQLEHCSSRKMNTWLGIFYGYKGLLLLLGIFLAYETKSVSTEKINDHRAVGMAIYNVAVLCLITAPVTMILSSQQDAAFAFASLAIVFSSYITLVVLFVPKMRRLITRGEWQSEAQDTMKTGSSTNNNEEEKSRLLEKENRELEKIIAEKEERVSELRHQLQSRQQLRSRRHPPTPPEPSGGLPRGPPEPPDRLSCDGSRVHLLYK

SEQ ID NO: 908133 - protein, 578 aa, Homo sapiens
MLLLLLLAPLFLRPPGAGGAQTPNATSEGCQIIHPPWEGGIRYRGLTRDQVKAINFLPVDYEIEYVCRGEREVVGPKVRKCLANGSWTDMDTPSRCVRICSKSYLTLENGKVFLTGGDLPALDGARVDFRCDPDFHLVGSSRSICSQGQWSTPKPHCQVNRTPHSERRAVYIGALFPMSGGWPGGQACQPAVEMALEDVNSRRDILPDYELKLIHHDSKCDPGQATKYLYELLYNDPIKIILMPGCSSVSTLVAEAARMWNLIVLSYGSSSPALSNRQRFPTFFRTHPSATLHNPTRVKLFEKWGWKKIATIQQTTEVFTSTLDDLEERVKEAGIEITFRQSFFSDPAVPVKNLKRQDARIIVGLFYETEARKVFCEVYKERLFGKKYVWFLIGWYADNWFKIYDPSINCTVDEMTEAVEGHITTEIVMLNPANTRSISNMTSQEFVEKLTKRLKRHPEETGGFQEAPLAYDAIWALALALNKTSGGGGRSGVRLEDFNYNNQTITDQIYRAMNSSSFEGVSGHVVFDASGSRMAWTLIEQLQGGSYKKIGYYDSTKDDLSWSKTDKWIVISRTHSPT

SEQ ID NO: 908134 - protein, 200 aa, Homo sapiens
AQVLSPAILGIFYGYKGLLLLLGIFLAYETKSVSTEKINDHRAVGMAIYNVAVLCLITAPVTMILSSQQDAAFAFASLAIVFSSYITLVVLFVPKMRRLITRGEWQSEAQDTMKTGSSTNNNEEEKSRLLEKENRELEKIIAEKEERVSELRHQLQSRQQLRSRRHPPTPPEPSGGLPRGPPEPPDRLSCDGSRVHLLYK

SEQ ID NO: 908135 - protein, 138 aa, Homo sapiens [sequence omitted]

SEQ ID NO: 908136 - protein, 578 aa, Homo sapiens; identical to SEQ ID NO: 908133

SEQ ID NO: 908137 - protein, 578 aa, Homo sapiens; identical to SEQ ID NO: 908133

SEQ ID NO: 908138 - protein, 117 aa, Homo sapiens
HRPRPTLPFLPLGSLPFPLSHHSSLYASPTHPLGCQIIHPPWEGGIRYRGLTRDQVKAINFLPVDYEIEYVCRGEREVVGPKVRKCLANGSWTDMDTPSRCGVASEAPPLFKTIPFP

SEQ ID NO: 908139 - protein, 145 aa, Homo sapiens
SCSVLISPFNLFCPLTLRPPPTFFCALPLFPCALPLFPSSPLLHHLLFSYYPNCASSSRKRSVSLNCAINSSLGSSSAPGATHRHPQNPLGACPGDPLSPPTGLAVMGVECICFISEGRVREDRPVGGGKGRGEGQGTQEAGGPH

SEQ ID NO: 908140 - protein, 961 aa, Homo sapiens; identical to SEQ ID NO: 908132

SEQ ID NO: 908141 - protein, 578 aa, Homo sapiens; identical to SEQ ID NO: 908133

SEQ ID NO: 908142 - protein, 961 aa, Homo sapiens; identical to SEQ ID NO: 908132

SEQ ID NO: 908143 - protein, 961 aa, Homo sapiens; identical to SEQ ID NO: 908132

SEQ ID NO: 908144 - protein, 196 aa, Homo sapiens
MNTWLGIFYGYKGLLLLLGIFLAYETKSVSTEKINDHRAVGMAIYNVAVLCLITAPVTMILSSQQDAAFAFASLAIVFSSYITLVVLFVPKMRRLITRGEWQSEAQDTMKTGSSTNNNEEEKSRLLEKENRELEKIIAEKEERVSELRHQLQSRQQLRSRRHPPTPPEPSGGLPRGPPEPPDRLSCDGSRVHLLYK

SEQ ID NO: 908145 - protein, 961 aa, Homo sapiens; identical to SEQ ID NO: 908132

SEQ ID NO: 908146 - protein, 578 aa, Homo sapiens; identical to SEQ ID NO: 908133

SEQ ID NO: 908147 - protein, 138 aa, Homo sapiens
MLLLLLLAPLFLRPPGAGGAQTPNATSEGCQIIHPPWEGGIRYRGLTRDQVKAINFLPVDYEIEYVCRGEREVVGPKVRKCLANGSWTDMDTPSRCGVASEAPPLFKTIPFPAANLALLLASQHFKSSIPKFTNTFIE

SEQ ID NO: 908148 - protein, 134 aa, Homo sapiens
MLLVLLSVVLLALSSAQSTDNDVNYEDFTFTIPDVEDSSQRPDQGPQRPPPEGLLPRPPGDSGNQDDGPQQRPPKPGGHHRHPPPPPFQNQQRPPQRGHRQLSLPRFPSVSLQEASSFFRRDRPARHPQEQPLW

SEQ ID NO: 908149 - protein, 191 aa, Homo sapiens
EVFEAGWCVGYPNLCGWAAGSPQGPGAVPRVYAWGLCAGGGSPGSVGERRSGGSGEQREGSSCCRRIFCLLEPAVSTQEWKFSQKMQHTVKISGDASTKAHRGVKSVITFFLLYAIFSLSFFISVWTSERLEENLIILSQVMGMAYPSCHSCVLILGNKKLRQASLSVLLWLRYMFKDGEPSGHKEFRESS

SEQ ID NO: 908150 - protein, 158 aa, Homo sapiens
MVLLWVLLLVLLGEFVVLLGEFVVMLLVLLSVVLLALSSAQSTDNDVNYEDFTFTIPDVEDSSQRPDQGPQRPPPEGLLPRPPGDSGNQDDGPQQRPPKPGGHHRHPPPPPFQNQQRPPQRGHRQLSLPRFPSVSLQEASSFFRRDRPARHPQEQPLW

SEQ ID NO: 908151 - protein, 166 aa, Homo sapiens
MLLILLSVALLAFSSAQDLNEDVSQEDVPLVISDGGDSEQFIDEERQGPPLGGQQSQPSAGDGNQNDGPQQGPPQQGGQQQQGPPPPQGKPQGPPQQGGHPPPPQGRPQGPPQQGGHPRPPRGRPQGPPQQGGHQQGPPPPPPGKPQGPPPQGGRPQGPPQGQSPQ

SEQ ID NO: 908152 - protein, 185 aa, Homo sapiens
MLLILLSVALLAFSSAQDLNEDVSQEDVPLVISDGGDSEQFIDEERQGPPLGGQQSQPSAGDGNQNDGPQQGPPQQGGQQQQGPPPPQGKPQGPPQQGGHPPPPQGRPQGPPQQGGHPRPPRGRPQGPPQQGGHQQGPPPHQQRPPQRGHRQLSLPRFPSVSLQEASSFFRRDRPARHPQEQPLW

SEQ ID NO: 908153 - protein, 147 aa, Homo sapiens [sequence omitted]

SEQ ID NO: 908154 - protein, 108 aa, Homo sapiens
LSINYSHNVEDSSQRPDQGPQRPPPEGLLPRPPGDSGNQDDGPQQRPPKPGGHHRHPPPPPFQNQQRPPQRGHRQLSLPRFPSVSLQEASSFFRRDRPARHPQEQPLW

SEQ ID NO: 908155 - protein, 125 aa, Homo sapiens
MVLLWVLLLVLLGEFVVLLGEFVVMLLVLLSVVLLALSSAQSTDNDVNYEDFTFTIPDVEDSSQRPDQGPQRPPPEGLLPRPPGDSGNQDDGPQQRPPKPGGHHRHPPPPPFQTASSQPPVLQRP

SEQ ID NO: 908156 - protein, 182 aa, Homo sapiens
REIGRGVDEYGRVRCSDRVGSSNLNPLLVMGTRMMALSRDHPNKEASSNKVHHLLRESHKDHPNKEASSNKVHHLLRESHKDHPNREAIPLLLKEGHKDHPNREAIPVLLEEGHKDHPNREAISKVLPHISNDHPNEDTVNSLYPDFLLSACRKHHHSSGGTDQQDIPRSNHSGNLEFSGRK

SEQ ID NO: 908157 - protein, 184 aa, Homo sapiens
REIGRGVDEYGRVRCSDRVGSSNLNPLLVMGTRMMALSRDHPNKEASSNKVHHLLRESHKDHPNKEASSNKVHHLLRESHKDHPNREAIPLLLKEGHKDHPNREAIPVLLEEGHKDHPNREAISKVLPHLLLESPRDHLPKGAAHKDLHRGSLLSNLGFNDRYDSSLLSIKGSNCYSSPTSLCQ

SEQ ID NO: 908158 - protein, 317 aa, Homo sapiens
MGGVIKSIFTFVLIVEFIIGNLGNSFIALVNCIDWVKGRKISSVDRILTALAISRISLVWLIFGSWCVSVFFPALFATEKMFRMLTNIWTVINHFSVWLATGLGTFYFLKIANFSNSIFLYLKWRVKKVVLVLLLVTSVFLFLNIALINIHINASINGYRRNKTCSSDSSNFTRFSSLIVLTSTVFIFIPFTLSLAMFLLLIFSMWKHRKKMQHTVKISGDASTKAHRGVKSVITFFLLYAIFSLSFFISVWTSERLEENLIILSQVMGMAYPSCHSCVLILGNKKLRQASLSVLLWLRYMFKDGEPSGHKEFRESS

SEQ ID NO: 908159 - protein, 141 aa, Homo sapiens
GAVNTGWMLLVLLSVVLLALSSAQSTDNDVNYEDFTFTIPDVEDSSQRPDQGPQRPPPEGLLPRPPGDSGNQDDGPQQRPPKPGGHHRHPPPPPFQNQQRPPQRGHRQLSLPRFPSVSLQEASSFFRRDRPARHPQEQPLW

SEQ ID NO: 908160 - protein, 166 aa, Homo sapiens; identical to SEQ ID NO: 908151

SEQ ID NO: 908161 - protein, 166 aa, Homo sapiens; identical to SEQ ID NO: 908151

SEQ ID NO: 908162 - protein, 121 aa, Homo sapiens
APWYRWSLLRTIILVPLSPYHVEDSSQRPDQGPQRPPPEGLLPRPPGDSGNQDDGPQQRPPKPGGHHRHPPPPPFQNQQRPPQRGHRQLSLPRFPSVSLQEASSFFRRDRPARHPQEQPLW

SEQ ID NO: 908163 - protein, 132 aa, Homo sapiens
MGTRMMALSRDHPNKEASSNKVHHLLRESHKDHPNREAIPLLLKEGHKDHPNREAIPVLLEEGHKDHPNREAISKVLPHISNDHPNEDTVNSLYPDFLLSACRKHHHSSGGTDQQDIPRSNHSGNLEFSGRK

SEQ ID NO: 908164 - protein, 132 aa, Homo sapiens
MRSVRDHLWEDSNLNPLLVMGTRMMALSRDHPNKEASSNKVHHLLRESHKDHPNREAIPLLLKEGHKDHPNREAIPVLLEEGHKDHPNREAISKVLPHLLLESPRDHLPKGAAHKDLHRGSLLSNLGFNDRK

SEQ ID NO: 908165 - protein, 274 aa, Homo sapiens
ACAGRAGARALPPRPHPDPEGATMAAPPQPVTHLIFDMDGLLLGYTGSIVAAASGESSRGLQSRWTDTERLYSVVFQEICNRYDKKYSWDVKSLVMGKKALEAAQIIIDVLQLPMSKEELVEESQTKLKEVFPTAALMPGAEKLIIHLRKHGIPFALATSSGSASFDMKTSRHKEFFSLFSHIVLGDDPEVQHGKPDPDIFLACAKRFSPPPAMEKCLVFEDAPNGVEAALAAGMQVVMVPDGNLSRDLTTKATLVLNSLQDFQPELFGLPSYE

SEQ ID NO: 908166 - protein, 251 aa, Homo sapiens
ACAGRAGARALPPRPHPDPEGATMAAPPQPVTHLIFDMDGLLLDTERLYSVVFQEICNRYDKKYSWDVKSLVMGKKALEAAQIIIDVLQLPMSKEELVEESQTKLKEVFPTAALMPGAEKLIIHLRKHGIPFALATSSGSASFDMKTSRHKEFFSLFSHIVLGDDPEVQHGKPDPDIFLACAKRFSPPPAMEKCLVFEDAPNGVEAALAAGMQVVMVPDGNLSRDLTTKATLVLNSLQDFQPELFGLPSYE

SEQ ID NO: 908167 - protein, 131 aa, Homo sapiens
ACAGRAGARALPPRPHPDPEGATMAAPPQPVTHLIFDMDGLLLDTERLYSVVFQEICNRYDKKYSWDVKSLVMGKKALEAAQIIIDVLQLPMSKEELVEESQTKLKEVFPTAALMPGHQLFTQQQLPACGP

SEQ ID NO: 908168 - protein, 418 aa, Homo sapiens
MEVNPPKQEHLLALKVMRLTKPTLFTNIPVTCEEKDLPGDLFNQLMRDDPSTVNGAEVLMLGEMLTLPQNFGNIFLGETFSSYISVHNDSNQVVKDILVKADLQTSSQRLNLSASNAAVAELKPDCCIDDVIHHEVKEIGTHILVCAVSYTTQAGEKMYFRKFFKFQVLKPLDVKTKFYNAESDLSSVTDEVFLEAQIQNMTTSPMFMEKVSLEPSIMYNVTELNSVSQAGECVSTFGSRAYLQPMDTRQYLYCLKPKNEFAEKAGIIKGVTVIGKLDIVWKTNLGERGRLQTSQLQRMAPGYGDVRLSLEAIPDTVNLEEPFHITCKITNCSSERTMDLVLEMCNTNSIHWCGISGRQLGKLHPSSSLCLALTLLSSVQGLQSISGLRLTDTFLKRTYEYDDIAQVCVVSSAIKVES

SEQ ID NO: 908169 - protein, 418 aa, Homo sapiens; identical to SEQ ID NO: 908168

SEQ ID NO: 908170 - protein, 168 aa, Homo sapiens
MEVNPPKQEHLLALKVMRLTKPTLFTNIPVTCEEKDLPGDLFNQLMRDDPSTVNGAEVLMLGEMLTLPQNFGNIFLGETFSSYISVHNDSNQVVKDILVKADLQTSSQRLNLSASNAAVAELKPDCCIDDVIHHEVKEIGTHILVCAVSYTTQAGEKMYFRKFFKFQD

SEQ ID NO: 908171 - protein, 218 aa, Homo sapiens
MTTSPMFMEKVSLEPSIMYNVTELNSVSQAGECVSTFGSRAYLQPMDTRQYLYCLKPKNEFAEKAGIIKGVTVIGKLDIVWKTNLGERGRLQTSQLQRMAPGYGDVRLSLEAIPDTVNLEEPFHITCKITNCSSERTMDLVLEMCNTNSIHWCGISGRQLGKLHPSSSLCLALTLLSSVQGLQSISGLRLTDTFLKRTYEYDDIAQVCVVSSAIKVES

SEQ ID NO: 908172 - protein, 261 aa, Homo sapiens [sequence omitted]

SEQ ID NO: 908173 - protein, 418 aa, Homo sapiens; identical to SEQ ID NO: 908168

SEQ ID NO: 908174 - protein, 250 aa, Homo sapiens
MTTEVILHYRPCESDPTQLPKIAEKAIQDFPTRPLSRFIPWFPYDGSKLPLRPKRSPPVISEEAAEDVKQYLTISEHDAKSHSYDCTVDLLEFQPSLKKQHLTWSHTLKEQTNSGNLGKQSEKGKQHKRRSWSISLPSNNCTKNVSPLSKKLQDSLKALNLHSLYRARWTIEHTICNSQTLEDIWTKLNQIIRHNELPSCNATIQRHLGQIWVFCDIMYCEYVGSLLKGRLALTGKINLFVHKYGVIFSM

SEQ ID NO: 908175 - protein, 399 aa, Homo sapiens
MEVNPPKQEHLLALKVMRLTKPTLFTNIPVTCEEKDLPGDLFNQLMRDDPSTVNGAEVLMLGEMLTLPQNFGNIFLGETFSSYISVHNDSNQVVKDILVKADLQTSSQRLNLSASNAAVAELKPDCCIDDVIHHEVKEIGTHILVCAVSYTTQAGEKMYFRKFFKFQVLKPLDVKTKFYNAESDLSSVTDEVFLEAQIQNMTTSPMFMEKVSLEPSIMYNVTELNSVSQAGECVSTFGSRAYLQPMDTRQYLYCLKPKNEFAEKAGIIKGVTVIGKLDIVWKTNLGERGRLQTSQLQRMAPGYGDVRLSLEAIPDTVNLEEPFHITYTNSIHWCGISGRQLGKLHPSSSLCLALTLLSSVQGLQSISGLRLTDTFLKRTYEYDDIAQVCVVSSAIKVES

SEQ ID NO: 908176 - protein, 427 aa, Homo sapiens
MEVNPPKQEHLLALKVMRLTKPTLFTNIPVTCEEKDLPGDLFNQLMRDDPSTVNGAEVLMLGEMLTLPQNFGNIFLGETFSSYISVHNDSNQVVKDILVKADLQTSSQRLNLSASNAAVAELKPDCCIDDVIHHEVKEIGTHILVCAVSYTTQAGEKMYFTHHTNFFPFFSKKISGSQTIGMGKPNFTMQRVTSVLWTDEVFLEAQIQNMTTSPMFMEKVSLEPSIMYNVTELNSVSQAGECVSTFGSRAYLQPMDTRQYLYCLKPKNEFAEKAGIIKGVTVIGKLDIVWKTNLGERGRLQTSQLQRMAPGYGDVRLSLEAIPDTVNLEEPFHITCKITNCSSERTMDLVLEMCNTNSIHWCGISGRQLGKLHPSSSLCLALTLLSSVQGLQSISGLRLTDTFLKRTYEYDDIAQVCVVSSAIKVES

SEQ ID NO: 908177 - protein, 418 aa, Homo sapiens; identical to SEQ ID NO: 908168

SEQ ID NO: 908178 - protein, 233 aa, Homo sapiens
MEVNPPKQEHLLALKVMRLTKPTLFTNIPVTCEEKDLPGDLFNQLMRDDPSTVNGAEVLMLGEMLTLPQNFGNIFLGETFSSYISVHNDSNQVVKDILVKADLQTSSQRLNLSASNAAVAELKPDCCIDDVIHHEVKEIGTHILVCAVSYTTQAGEKMYFRKFFKFQVLKPLDVKTKFYNAESDLSSVTDEVFLEAQIQNMTTSPMFMEKVSLEPSIMYNVTELNSVSQAGEW

SEQ ID NO: 908179 - protein, 215 aa, Homo sapiens
VAGKRRPRRLLRDAEGPEETVRLWPAARAAMDAAEVEFLAEKELVTIIPNFSLDKIYLIGGDLGPFNPGLPVEVPLWLAINLKQRQKCRLLPPEWMDVEKLEKMRDHERKEETFTPMPSPYYMELTKLLLNHASDNIPKADEIRTLVKDMWDTRIAKLRVSADSFVRQQEAHAKLDNLTLMEINTSGTFLTQALNHMYKLRTNLQPLESTQSQDF

SEQ ID NO: 908180 - protein, 166 aa, Homo sapiens
VAGKRRPRRLLRDAEGPEETVRLWPAARAAMDAAEVEFLAEKELVTIIPNFSLDKIYLIGGDLGPFNPGLPVEVPLWLAINLKQRQKCRLLPPEWMDVEKLEKMRDHERKEETFTPMPSPYYMELTKLLLNHASDNIPKADEIRTLVKDMWDTRIAKLRVSADSFC

SEQ ID NO: 908181 - protein, 185 aa, Homo sapiens
MDAAEVEFLAEKELVTIIPNFSLDKIYLIGGDLGPFNPGLPVEVPLWLAINLKQRQKCRLLPPEWMDVEKLEKMRDHERKEETFTPMPSPYYMELTKLLLNHASDNIPKADEIRTLVKDMWDTRIAKLRVSADSFVRQQEAHAKLDNLTLMEINTSGTFLTQALNHMYKLRTNLQPLESTQSQDF

SEQ ID NO: 908182 - protein, 215 aa, Homo sapiens; identical to SEQ ID NO: 908179

SEQ ID NO: 908183 - protein, 140 aa, Homo sapiens
YKKQLYRPESPDMSLLSPEWMDVEKLEKMRDHERKEETFTPMPSPYYMELTKLLLNHASDNIPKADEIRTLVKDMWDTRIAKLRVSADSFVRQQEAHAKLDNLTLMEINTSGTFLTQALNHMYKLRTNLQPLESTQSQDF

SEQ ID NO: 908184 - protein, 215 aa, Homo sapiens; identical to SEQ ID NO: 908179

SEQ ID NO: 908185 - protein, 215 aa, Homo sapiens; identical to SEQ ID NO: 908179

SEQ ID NO: 908186 - protein, 215 aa, Homo sapiens; identical to SEQ ID NO: 908179

SEQ ID NO: 908187 - protein, 1063 aa, Homo sapiens
MGSPLEVVTVLYTPHDASHVAGVECPEAALLILGPPRMEPLRHSPGPGGQRLLLPSMLLALLLLLAPSPGHATRVVYKVPEEQPPNTLIGSLAADYGFPDVGHLYKLEVGAPYLRVDGKTGDIFTTETSIDREGLRECQNQLPGDPCILEFEVSITDLVQNGSPRLLEGQIEVQDINDNTPNFASPVITLAIPENTNIGSLFPIPLASDRDAGPNGVASYELQVAEDQEEKQPQLIVMGNLDRERWDSYDLTIKVQDGGSPPRASSALLRVTVLDTNDNAPKFERPSYEAELSENSPIGHSVIQVKANDSDQGANAEIEYTFHQAPEVVRRLLRLDRNTGLITVQGPVDREDLSTLRFSVLAKDRGTNPKSARAQVVVTVKDMNDNAPTIEIRGIGLVTHQDGMANISEDVAEETAVALVQVSDRDEGENAAVTCVVAGDVPFQLRQASETGSDSKKKYFLQTTTPLDYEKVKDYTIEIVAVDSGNPPLSSTNSLKVQVVDVNDNAPVFTQSVTEVAFPENNKPGEVIAEITASDADSGSNAELVYSLEPEPAAKGLFTISPETGEIQVKTSLDREQRESYELKVVAADRGSPSLQGTATVLVNVLDCNDNDPKFMLSGYNFSVMENMPALSPVGMVTVIDGDKGENAQVQLSVEQDNGDFVIQNGTGTILSSLSFDREQQSTYTFQLKAVDGGVPPRSAYVGVTINVLDENDNAPYITAPSNTSHKLLTPQTRLGETVSQVAAEDFDSGVNAELIYSIAGGNPYGLFQIGSHSGAITLEKEIERRHHGLHRLVVKVSDRGKPPRYGTALVHLYVNETLANRTLLETLLGHSLDTPLDIDIAGDPEYERSKQRGNILFGVVAGVVAVALLIALAVLVRYCRQREAKSGYQAGKKETKDLYAPKPSGKASKGNKSKGKKSKSPKPVKPVEDEDEAGLQKSLKFNLMSDAPGDSPRIHLPLNYPPGSPDLGRHYRSNSPLPSIQLQPQSPSASKKHQVVQDLPPANTFVGTGDTTSTGSEQYSDYSYRTNPPKYPSKQVGQPFQLSTPQPLPHPYHGAIWTEVWE

SEQ ID NO: 908188 - protein, 1086 aa, Homo sapiens
AGAGARTAAPAPAVRSRSPGRGRRRLMDSGAGGRRCPEAALLILGPPRMEPLRHSPGPGGQRLLLPSMLLALLLLLAPSPGHATRVVYKVPEEQPPNTLIGSLAADYGFPDVGHLYKLEVGAPYLRVDGKTGDIFTTETSIDREGLRECQNQLPGDPCILEFEVSITDLVQNGSPRLLEGQIEVQDINDNTPNFASPVITLAIPENTNIGSLFPIPLASDRDAGPNGVASYELQAGPEAQELFGLQVAEDQEEKQPQLIVMGNLDRERWDSYDLTIKVQDGGSPPRASSALLRVTVLDTNDNAPKFERPSYEAELSENSPIGHSVIQVKANDSDQGANAEIEYTFHQAPEVVRRLLRLDRNTGLITVQGPVDREDLSTLRFSVLAKDRGTNPKSARAQVVVTVKDMNDNAPTIEIRGIGLVTHQDGMANISEDVAEETAVALVQVSDRDEGENAAVTCVVAGDVPFQLRQASETGSDSKKKYFLQTTTPLDYEKVKDYTIEIVAVDSGNPPLSSTNSLKVQVVDVNDNAPVFTQSVTEVAFPENNKPGEVIAEITASDADSGSNAELVYSLEPEPAAKGLFTISPETGEIQVKTSLDREQRESYELKVVAADRGSPSLQGTATVLVNVLDCNDNDPKFMLSGYNFSVMENMPALSPVGMVTVIDGDKGENAQVQLSVEQDNGDFVIQNGTGTILSSLSFDREQQSTYTFQLKAVDGGVPPRSAYVGVTINVLDENDNAPYITAPSNTSHKLLTPQTRLGETVSQVAAEDFDSGVNAELIYSIAGGNPYGLFQIGSHSGAITLEKEIERRHHGLHRLVVKVSDRGKPPRYGTALVHLYVNETLANRTLLETLLGHSLDTPLDIDIAGDPEYERSKQRGNILFGVVAGVVAVALLIALAVLVRYCRQREAKSGYQAGKKETKDLYAPKPSGKASKGNKSKGKKSKSPKPVKPVEDEDEAGLQKSLKFNLMSDAPGDSPRIHLPLNYPPGSPDLGRHYRSNSPLPSIQLQPQSPSASKKHQVVQDLPPANTFVGTGDTTSTGSEQYSDYSYRTNPPKYPSKQVGQPFQLSTPQPLPHPYHGAIWTEVWE

SEQ ID NO: 908189 - protein, 1135 aa, Homo sapiens
AGAGARTAAPAPAVRSRSPGRGRRRLMDSGAGGRRCPEAALLILGPPRMEPLRHSPGPGGQRLLLPSMLLALLLLLAPSPGHATRVVYKVPEEQPPNTLIGSLAADYGFPDVGHLYKLEVGAPYLRVDGKTGDIFTTETSIDREGLRECQNQLPGDPCILEFEVSITDLVQNGSPRLLEGQIEVQDINDNTPNFASPVITLAIPENTNIGSLFPIPLASDRDAGPNGVASYELQAGPEAQELFGLQVAEDQEEKQPQLIVMGNLDRERWDSYDLTIKVQDGGSPPRASSALLRVTVLDTNDNAPKFERPSYEAELSENSPIGHSVIQSLVDWDLEKRLRKKRETDSREIANNNSLGARHRSKHMMCIISFNPYQYKVKANDSDQGANAEIEYTFHQAPEVVRRLLRLDRNTGLITVQGPVDREDLSTLRFSVLAKDRGTNPKSARAQVVVTVKDMNDNAPTIEIRGIGLVTHQDGMANISEDVAEETAVALVQVSDRDEGENAAVTCVVAGDVPFQLRQASETGSDSKKKYFLQTTTPLDYEKVKDYTIEIVAVDSGNPPLSSTNSLKVQVVDVNDNAPVFTQSVTEVAFPENNKPGEVIAEITASDADSGSNAELVYSLEPEPAAKGLFTISPETGEIQVKTSLDREQRESYELKVVAADRGSPSLQGTATVLVNVLDCNDNDPKFMLSGYNFSVMENMPALSPVGMVTVIDGDKGENAQVQLSVEQDNGDFVIQNGTGTILSSLSFDREQQSTYTFQLKAVDGGVPPRSAYVGVTINVLDENDNAPYITAPSNTSHKLLTPQTRLGETVSQVAAEDFDSGVNAELIYSIAGGNPYGLFQIGSHSGAITLEKEIERRHHGLHRLVVKVSDRGKPPRYGTALVHLYVNETLANRTLLETLLGHSLDTPLDIDIAGDPEYERSKQRGNILFGVVAGVVAVALLIALAVLVRYCRQREAKSGYQAGKKETKDLYAPKPSGKASKGNKSKGKKSKSPKPVKPVEDEDEAGLQKSLKFNLMSDAPGDSPRIHLPLNYPPGSPDLGRHYRSNSPLPSIQLQPQSPSASKKHQVVQDLPPANTFVGTGDTTSTGSEQYSDYSYRTNPPKYPSKQVGQPFQLSTPQPLPHPYHGAIWTEVWE

SEQ ID NO: 908190 - protein, 1263 aa, Homo sapiens
AGAGARTAAPAPAVRSRSPGRGRRRLMDSGAGGRRCPEAALLILGPPRMEPLRHSPGPGGQRLLLPSMLLALLLLLAPSPGHATRVVYKVPEEQPPNTLIGSLAADYGFPDVGHLYKLEVGAPYLRVDGKTGDIFTTETSIDREGLRECQNQLPGDPCILEFEVSITDLVQNGSPRLLEGQIEVQDINDNTPNFASPVITLAIPENTNIGSLFPIPLASDRDAGPNGVASYELQAGPEAQELFGLQVAEDQEEKQPQLIVMGNLDRERWDSYDLTIKVQDGGSPPRASSALLRVTVLDTNDNAPKFERPSYEAELSENSPIGHSVIQVKANDSDQGANAEIEYTFHQAPEVVRRLLRLDRNTGLITVQGPVDREDLSTLRFSVLAKDRGTNPKSARAQVVVTVKDMNDNAPTIEIRGIGLVTHQDGMANISEDVAEETAVALVQVSDRDEGENAAVTCVVAGDVPFQLRQASETGSDSKKKYFLQTTTPLDYEKVKDYTIEIVAVDSGNPPLSSTNSLKVQVVDVNDNAPVFTQSVTEVAFPENNKPGEVIAEITASDADSGSNAELVYSLEPEPAAKGLFTISPETGEIQVKTSLDREQRESYELKVVAADRGSPSLQGTATVLVNVLDCNDNDPKFMLSGYNFSVMENMPALSPVGMVTVIDGDKGENAQVQLSVEQDNGDFVIQNGTGTILSSLSFDREQQSTYTFQLKAVDGGVPPRSAYVGVTINVLDENDNAPYITAPSNTSHKLLTPQTRLGETVSQVAAEDFDSGVNAELIYSIAGGNPYGLFQIGSHSGAITLEKEIERRHHGLHRLVVKVSDRGKPPRYGTALVHLYVNETLANRTLLETLLGHSLDTPLDIDIAGDPEYERSKQRGNILFGVVAGVVAVALLIALAVLVRYCRQREAKSGYQAGKKETKDLYAPKPSGKASKGNKSKGKKSKSPKPVKPVEDEDEAGLQKSLKFNLMSDAPGDSPRIHLPLNYPPGSPDLGRHYRSNSPLPSIQLQPQSPSASKKHQVVQDLPPANTFVGTGDTTSTGSEQYSDYSYRTNPPKYPSKQLPHRRVTFSATSQAQELQDPSQHSYYDSGLEESETPSSKSSSGPRLGPLALPEDHYERTTPDGSIGEMEHPENDLRPLPDVAMTGTCTRECSEFGHSDTCWMPGQSSPSRRTKSSALKLSTFVPYQDRGGQEPAGAGSPSPPEDRNTKTAPVRLLPSYSAFSHSSHDSCKDSATLEEIPLTQTSDFPPAATPASAQTAKREIYL

SEQ ID NO: 908191 - protein, 699 aa, Homo sapiens
AGAGARTAAPAPAVRSRSPGRGRRRLMDSGAGGRRCPEAALLILGPPRMEPLRHSPGPGGQRLLLPSMLLALLLLLAPSPGHATRVVYKVPEEQPPNTLIGSLAADYGFPDVGHLYKLEVGAPYLRVDGKTGDIFTTETSIDREGLRECQNQLPGDPCILEFEVSITDLVQNGSPRLLEGQIEVQDINDNTPNFASPVITLAIPENTNIGSLFPIPLASDRDAGPNGVASYELQAGPEAQELFGLQVAEDQEEKQPQLIVMGNLDRERWDSYDLTIKVQDGGSPPRASSALLRVTVLDTNDNAPKFERPSYEAELSENSPIGHSVIQVKANDSDQGANAEIEYTFHQAPEVVRRLLRLDRNTGLITVQGPVDREDLSTLRFSVLAKDRGTNPKSARAQVVVTVKDMNDNAPTIEIRGIGLVTHQDGMANISEDVAEETAVALVQVSDRDEGENAAVTCVVAGDVPFQLRQASETGSDSKKKYFLQTTTPLDYEKVKDYTIEIVAVDSGNPPLSSTNSLKVQVVDVNDNAPVFTQSVTEVAFPENNKPGEVIAEITASDADSGSNAELVYSLEPEPAAKGLFTISPETGEIQVKTSLDREQRESYELKVVAADRGSPSLQGTATVLVNVLDCNDNDPKFMLSGYNFSVMENMPALSPVGMVTRTAPVRLPPPSTHSSPAVPDPEMSYTWISPVSGESLST

SEQ ID NO: 908192 - protein, 1240 aa, Homo sapiens
MGSPLEVVTVLYTPHDASHVAGVECPEAALLILGPPRMEPLRHSPGPGGQRLLLPSMLLALLLLLAPSPGHATRVVYKVPEEQPPNTLIGSLAADYGFPDVGHLYKLEVGAPYLRVDGKTGDIFTTETSIDREGLRECQNQLPGDPCILEFEVSITDLVQNGSPRLLEGQIEVQDINDNTPNFASPVITLAIPENTNIGSLFPIPLASDRDAGPNGVASYELQVAEDQEEKQPQLIVMGNLDRERWDSYDLTIKVQDGGSPPRASSALLRVTVLDTNDNAPKFERPSYEAELSENSPIGHSVIQVKANDSDQGANAEIEYTFHQAPEVVRRLLRLDRNTGLITVQGPVDREDLSTLRFSVLAKDRGTNPKSARAQVVVTVKDMNDNAPTIEIRGIGLVTHQDGMANISEDVAEETAVALVQVSDRDEGENAAVTCVVAGDVPFQLRQASETGSDSKKKYFLQTTTPLDYEKVKDYTIEIVAVDSGNPPLSSTNSLKVQVVDVNDNAPVFTQSVTEVAFPENNKPGEVIAEITASDADSGSNAELVYSLEPEPAAKGLFTISPETGEIQVKTSLDREQRESYELKVVAADRGSPSLQGTATVLVNVLDCNDNDPKFMLSGYNFSVMENMPALSPVGMVTVIDGDKGENAQVQLSVEQDNGDFVIQNGTGTILSSLSFDREQQSTYTFQLKAVDGGVPPRSAYVGVTINVLDENDNAPYITAPSNTSHKLLTPQTRLGETVSQVAAEDFDSGVNAELIYSIAGGNPYGLFQIGSHSGAITLEKEIERRHHGLHRLVVKVSDRGKPPRYGTALVHLYVNETLANRTLLETLLGHSLDTPLDIDIAGDPEYERSKQRGNILFGVVAGVVAVALLIALAVLVRYCRQREAKSGYQAGKKETKDLYAPKPSGKASKGNKSKGKKSKSPKPVKPVEDEDEAGLQKSLKFNLMSDAPGDSPRIHLPLNYPPGSPDLGRHYRSNSPLPSIQLQPQSPSASKKHQVVQDLPPANTFVGTGDTTSTGSEQYSDYSYRTNPPKYPSKQLPHRRVTFSATSQAQELQDPSQHSYYDSGLEESETPSSKSSSGPRLGPLALPEDHYERTTPDGSIGEMEHPENDLRPLPDVAMTGTCTRECSEFGHSDTCWMPGQSSPSRRTKSSALKLSTFVPYQDRGGQEPAGAGSPSPPEDRNTKTAPVRLLPSYSAFSHSSHDSCKDSATLEEIPLTQTSDFPPAATPASAQTAKREIYL

SEQ ID NO: 908193 - protein, 1086 aa, Homo sapiens; identical to SEQ ID NO: 908188

SEQ ID NO: 908194 - protein, 165 aa, Homo sapiens
MGTPRWSVGSQALLISLGPLLSCCRCRGETPRPVGSFRCLSLQYSPSPTPPKPPGHPCSYCSQIPGSPDLGRHYRSNSPLPSIQLQPQSPSASKKHQVVQDLPPANTFVGTGDTTSTGSEQYSDYSYRTNPPKYPSKQVGQPFQLSTPQPLPHPYHGAIWTEVWE

SEQ ID NO: 908195 - protein, 161 aa, Homo sapiens
MPDTFNSWFLITLLHVWMCLVRMKQEGRSGKYMCRIIVHFMWEDVQQRGRVMGVNPYILKKNMILMTNHFYAAILGYDEGILSDDHGLAAALWRTFFNRKCEDPRHLELLVEYVRKQIQYLDSMNGEDLLLTGEVSWRPLVEKNPQSILKPHSPTYNDEGL

SEQ ID NO: 908196 - protein, 332 aa, Homo sapiens
GRACPGTTAWCTAEKTTARARSDLFAPAPPLPVFRRQKEDVEKGTPETHSSPRKWLLRNMALLVRVLRNQTSISQWVPVCSRLIPVSPTQGQGDRALSRTSQWPQMSQSQACGGSEQIPGIDIQLNRKYHTTRKLSTTKDSPQPVEEKVGAFTKIIEAMGFTGPLKYSKWKIKIAALRMYTSCVEKTDFEEFFLRCQMPDTFNSWFLITLLHVWMCLVRMKQEGRSGKYMCRIIVHFMWEDVQQRGRVMGGILSDDHGLAAALWRTFFNRKCEDPRHLELLVEYVRKQIQYLDSMNGEDLLLTGEVSWRPLVEKNPQSILKPHSPTYNDEGL

SEQ ID NO: 908197 - protein, 118 aa, Homo sapiens
MVRSPPHAPSPSFLSSGRLVPDAGSSPLPCLCRFLLPPPLVADTVPGLHERGGSASDRGGELAPSSGEESSEHPEAPFSDLQRRGTLMGWALRTARQLASRNLQERSACWSRTLQKVA

SEQ ID NO: 908198 - protein, 358 aa, Homo sapiens
GRACPGTTAWCTAEKTTARARSDLFAPAPPLPVFRRQKEDVEKGTPETHSSPRKWLLRNMALLVRVLRNQTSISQWVPVCSRLIPVSPTQGQGDRALSRTSQWPQMSQSQACGGSEQIPGIDIQLNRKYHTTRKLSTTKDSPQPVEEKVGAFTKIIEAMGFTGPLKYSKWKIKIAALRMYTSCVEKTDFEEFFLRCQMPDTFNSWFLITLLHVWMCLVRMKQEGRSGKYMCRIIVHFMWEDVQQRGRVMGVNPYILKKNMILMTNHFYAAILGYDEGILSDDHGLAAALWRTFFNRKCEDPRHLELLVEYVRKQIQYLDSMNGEDLLLTGEVSWRPLVEKNPQSILKPHSPTYNDEGL

SEQ ID NO: 908199 - protein, 324 aa, Homo sapiens
FLYFTDKKTEPQRGIPGQVPWLTPVIPAHWEAERNQTSISQWVPVCSRLIPVSPTQGQGDRALSRTSQWPQMSQSQACGGSEQIPGIDIQLNRKYHTTRKLSTTKDSPQPVEEKVGAFTKIIEAMGFTGPLKYSKWKIKIAALRMYTSCVEKTDFEEFFLRCQMPDTFNSWFLITLLHVWMCLVRMKQEGRSGKYMCRIIVHFMWEDVQQRGRVMGVNPYILKKNMILMTNHFYAAILGYDEGILSDDHGLAAALWRTFFNRKCEDPRHLELLVEYVRKQIQYLDSMNGEDLLLTGEVSWRPLVEKNPQSILKPHSPTYNDEGL

SEQ ID NO: 908200 - protein, 372 aa, Homo sapiens
GRACPGTTAWCTAEKTTARARSDLFAPAPPLPVFRRQKEDVEKGTPETHSSPRKWLLRNMALLVRVLRNQTSISQWVPVCSRLIPVSPTQGQGDRALSRTSQVPWLETSASEWHPQWPQMSQSQACGGSEQIPGIDIQLNRKYHTTRKLSTTKDSPQPVEEKVGAFTKIIEAMGFTGPLKYSKWKIKIAALRMYTSCVEKTDFEEFFLRCQMPDTFNSWFLITLLHVWMCLVRMKQEGRSGKYMCRIIVHFMWEDVQQRGRVMGVNPYILKKNMILMTNHFYAAILGYDEGILSDDHGLAAALWRTFFNRKCEDPRHLELLVEYVRKQIQYLDSMNGEDLLLTGEVSWRPLVEKNPQSILKPHSPTYNDEGL

SEQ ID NO: 908201 - protein, 326 aa, Homo sapiens
GRACPGTTAWCTAEKTTARARSDLFAPAPPLPVFRRQKEDVEKGTPETHSSPRKWLLRNMALLVRVLRNQTSISQWVPVCSRLIPVSPTQGQGDRALSRTSQLSTTKDSPQPVEEKVGAFTKIIEAMGFTGPLKYSKWKIKIAALRMYTSCVEKTDFEEFFLRCQMPDTFNSWFLITLLHVWMCLVRMKQEGRSGKYMCRIIVHFMWEDVQQRGRVMGVNPYILKKNMILMTNHFYAAILGYDEGILSDDHGLAAALWRTFFNRKCEDPRHLELLVEYVRKQIQYLDSMNGEDLLLTGEVSWRPLVEKNPQSILKPHSPTYNDEGL

SEQ ID NO: 908202 - protein, 340 aa, Homo sapiens
GRACPGTTAWCTAEKTTARARSDLFAPAPPLPVFRRQKEDVEKGTPETHSSPRKWLLRNMALLVRVLRNQTSISQWVPVCSRLIPVSPTQGQGDRALSRTSQWPQMSQSQACGGSEQIPGIDIQLNRKYHTTRKLSTTKDSPQPVEEKVGAFTKIIEAMGFTGPLKYSKWKIKIAALRMYTSCVESWFLITLLHVWMCLVRMKQEGRSGKYMCRIIVHFMWEDVQQRGRVMGVNPYILKKNMILMTNHFYAAILGYDEGILSDDHGLAAALWRTFFNRKCEDPRHLELLVEYVRKQIQYLDSMNGEDLLLTGEVSWRPLVEKNPQSILKPHSPTYNDEGL

SEQ ID NO: 908203 - protein, 358 aa, Homo sapiens; identical to SEQ ID NO: 908198

SEQ ID NO: 908204 - protein, 338 aa, Homo sapiens
GRACPGTTAWCTAEKTTARARSDLFAPAPPLPVFRRQKEDVEKGTPETHSSPRKWLLRNMALLVRVLRNQTSISQWVPVCSRLIPVSPTQGQGDRALSRTSQWPQMSQSQACGGSEQIPGIDIQLNRKYHTTRKLSTTKDSPQPVEEKVGAFTKIIEAMGFTGPLKYSKWKIKIAALRMYTSCVEKTDFEEFFLRCQMPDTFNSWFLITLLHVWMCLVRMKQEGRSGKYMCRIIVHFMWEDVQQRGRVMGVNPYILKKNMILMTNHFYAAILGYDEGILSDDHGLAAALWRTFFNRKCEDPRHLELLVEYVRKQVSDPFPPLPSPGNSGSSSWAFRGS

SEQ ID NO: 908205 - protein, 221 aa, Homo sapiens
HGLLVRVLRNQTSISQWVPVCSRLIPVSPTQGQGDRALSRTSQWPQMSQSQACGGSEQIPGIDIQLNRKYHTTRKLSTTKDSPQPVEEKVGAFTKIIEAMGFTGPLKYSKWKIKIAALRMYTSCVEKTDFEEFFLRCQMPDTFNSWFLITLLHVWMCLVRMKQEGRSGKYMCRIIVHFMWEDVQQRGRVMGVSECCQMLVLDNSREGFEFGVLSVVKWPCF

SEQ ID NO: 908206 - protein, 387 aa, Homo sapiens
LVQNMASLVSHLLYETPRLDMPSEGDSDLCSRLIPVSPTQGQGDRALSRTSQWPQMSQSQACGGSEQIPGIDIQLNRKYHTTRKLSTTKDSPQPVEEKVGAFTKIIEAMGFTGPLKYSKWKIKIAALRMYTSCVEKTDFEEFFLRCQMPDTFNSWFLITLLHVWMCLVRMKQEGRSGKYMCRIIVHFMWEDVQQRGRVMGWVRGLADFKNEAADLHSKCYQLLKVVRTQRVSSSKIYGEDRKNKASTVWKGDLSGLPLLARVASFYSLICPCPCLLIGPFYRVLIGAFLQSADWCIYNPVARHRALIGAFLQNADWCIYNPLARHRALIGASIHPTQKPSWLHLPLVSSFVYVVYFVYLDHVLVACSSLLLGSISLPPSLGASKVEP

SEQ ID NO: 908207 - protein, 358 aa, Homo sapiens; identical to SEQ ID NO: 908198

SEQ ID NO: 908208 - protein, 187 aa, Homo sapiens
MQPIDTCVSYPRTGGQGSVSHFPGCQMPDTFNSWFLITLLHVWMCLVRMKQEGRSGKYMCRIIVHFMWEDVQQRGRVMGVNPYILKKNMILMTNHFYAAILGYDEGILSDDHGLAAALWRTFFNRKCEDPRHLELLVEYVRKQIQYLDSMNGEDLLLTGEVSWRPLVEKNPQSILKPHSPTYNDEGL

SEQ ID NO: 908209 - protein, 144 aa, Homo sapiens
LGTLPVRPNSWFLITLLHVWMCLVRMKQEGRSGKYMCRIIVHFMWEDVQQRGRVMGVNPYILKKNMILMTNHFYAAILGYDEGILSDDHGLAAALWRTFFNRKCEDPRHLELLVEYVRKQVSDPFPPLPSPGNSGSSSWAFRGS

SEQ ID NO: 908210 - protein, 299 aa, Homo sapiens
HGLLVRVLRNQTSISQWVPVCSRLIPVSPTQGQGDRALSRTSQWPQMSQSQACGGSEQIPGIDIQLNRKYHTTRKLSTTKDSPQPVEEKVGAFTKIIEAMGFTGPLKYSKWKIKIAALRMYTSCVEKTDFEEFFLRCQMPDTFNSWFLITLLHVWMCLVRMKQEGRSGKYMCRIIVHFMWEDVQQRGRVMGVNPYILKKNMILMTNHFYAAILGYDEGILSDDHGLAAALWRTFFNRKCEDPRHLELLVEYVRKQIQYLDSMNGEDLLLTGEVSWRPLVEKNPQSILKPHSPTYNDEGL

SEQ ID NO: 908211 - protein, 253 aa, Homo sapiens
MSQSQACGGSEQIPGIDIQLNRKYHTTRKLSTTKDSPQPVEEKVGAFTKIIEAMGFTGPLKYSKWKIKIAALRMYTSCVEKTDFEEFFLRCQMPDTFNSWFLITLLHVWMCLVRMKQEGRSGKYMCRIIVHFMWEDVQQRGRVMGVNPYILKKNMILMTNHFYAAILGYDEGILSDDHGLAAALWRTFFNRKCEDPRHLELLVEYVRKQIQYLDSMNGEDLLLTGEVSWRPLVEKNPQSILKPHSPTYNDEGL

SEQ ID NO: 908212 - protein, 161 aa, Homo sapiens; identical to SEQ ID NO: 908195

SEQ ID NO: 908213 - protein, 105 aa, Homo sapiens
MCLCSGQDTASQACRLGPRRPLMTKGFHILSHLEGGLENKVTFVTPSELNEEHAVSCLGLPFHEILGRREHSSWLSCSRPRPVPSFGPPSQLLKHVLQSHLGLST

SEQ ID NO: 908214 - protein, 221 aa, Homo sapiens; identical to SEQ ID NO: 908205

SEQ ID NO: 908215 - protein, 229 aa, Homo sapiens
HGLLVRVLRNQTSISQWVPVCSRLIPVSPTQGQGDRALSRTSQWPQMSQSQACGGSEQIPGIDIQLNRKYHTTRKLSTTKDSPQPVEEKVGAFTKIIEAMGFTGPLKYSKWKIKIAALRMYTSCVEKTDFEEFFLRCQMPDTFNSWFLITLLHVWMCLVRMKQEGRSGKYMCRIIVHFMWEDVQQRGRVMGELKLKLLDHWQPRRVCGFVVSLTSRMKPQTFTASVTSS

SEQ ID NO: 908216 - protein, 222 aa, Homo sapiens
MLSRAVCGTSRQLAPVLGYLGSRQKHSLPDLPYDYGALEPHINAQIMQLHHSKHHAAYVNNLNVTEEKYQEALAKGDVTAQIALQPALKFNGGGHINHSIFWTNLSPNGGGEPKGELLEAIKRDFGSFDKFKEKLTAASVGVQGSGWGWLGFNKERGHLQIAACPNQDPLQGTTGLIPLLGIDVWEHAYYLQYKNVRPDYLKAIWNVINWENVTERYMACKK

SEQ ID NO: 908217 - protein, 222 aa, Homo sapiens; identical to SEQ ID NO: 908216

SEQ ID NO: 908218 - protein, 141 aa, Homo sapiens
MLSRAVCGTSRQLAPVLGYLGSRQKHSLPDLPYDYGALEPHINAQIMQLHHSKHHAAYVNNLNVTEEKYQEALAKGRFQAERREAVPGRGDPREPGPIRTGLSVEENSLRICTGSEFSRRCYSPDSSSACTEVQWWWSYQS

SEQ ID NO: 908219 - protein, 222 aa, Homo sapiens; identical to SEQ ID NO: 908216

SEQ ID NO: 908220 - protein, 222 aa, Homo sapiens; identical to SEQ ID NO: 908216

SEQ ID NO: 908221 - protein, 222 aa, Homo sapiens; identical to SEQ ID NO: 908216

SEQ ID NO: 908222 - protein, 222 aa, Homo sapiens; identical to SEQ ID NO: 908216

SEQ ID NO: 908223 - protein, 222 aa, Homo sapiens; identical to SEQ ID NO: 908216

SEQ ID NO: 908224 - protein, 222 aa, Homo sapiens; identical to SEQ ID NO: 908216

SEQ ID NO: 908225 - protein, 222 aa, Homo sapiens; identical to SEQ ID NO: 908216

SEQ ID NO: 908226 - protein, 222 aa, Homo sapiens; identical to SEQ ID NO: 908216

SEQ ID NO: 908227 - protein, 222 aa, Homo sapiens; identical to SEQ ID NO: 908216

SEQ ID NO: 908228 - protein, 222 aa, Homo sapiens; identical to SEQ ID NO: 908216

SEQ ID NO: 908229 - protein, 222 aa, Homo sapiens; identical to SEQ ID NO: 908216

SEQ ID NO: 908230 - protein, 140 aa, Homo sapiens
MLSRAVCGTSRQLAPVLGYLGSRQKHSLPDLPYDYGALEPHINAQIMQLHHSKHHAAYVNNLNVTEEKYQEALAKGRFQAERREAVPGRGDPREPGPIRTGLSVEENSLRICTGSEFSRHDSLSFKHMVYLIVEGVPRWV

SEQ ID NO: 908231 - protein, 183 aa, Homo sapiens
MLSRAVCGTSRQLAPVLGYLGSRQKHSLPDLPYDYGALEPHINAQIMQLHHSKHHAAYVNNLNVTEEKYQEALAKGELLEAIKRDFGSFDKFKEKLTAASVGVQGSGWGWLGFNKERGHLQIAACPNQDPLQGTTGLIPLLGIDVWEHAYYLQYKNVRPDYLKAIWNVINWENVTERYMACKK

SEQ ID NO: 908232 - protein, 137 aa, Homo sapiens
MLSRAVCGTSRQLAPVLGYLGSRQKHSLPDLPYDYGALEPHINAQIMQLHHSKHHAAYVNNLNVTEEKYQEALAKGDVTAQIALQPALKFNGGGHINHSIFWTNLSPNGGGEPKGELLEAIKRDFGSLAFLAYLPAG

SEQ ID NO: 908233 - protein, 38 aa, Homo sapiens
MDAHPHKYLPPGNKTYNSTTMVKPRYYRTKVGQKHGKL

SEQ ID NO: 908234 - protein, 222 aa, Homo sapiens; identical to SEQ ID NO: 908216

SEQ ID NO: 908235 - protein, 183 aa, Homo sapiens; identical to SEQ ID NO: 908231

SEQ ID NO: 908236 - protein, 222 aa, Homo sapiens; identical to SEQ ID NO: 908216

SEQ ID NO: 908237 - protein, 222 aa, Homo sapiens; identical to SEQ ID NO: 908216

SEQ ID NO: 908238 - protein, 222 aa, Homo sapiens; identical to SEQ ID NO: 908216

SEQ ID NO: 908239 - protein, 222 aa, Homo sapiens; identical to SEQ ID NO: 908216

SEQ ID NO: 908240 - protein, 222 aa, Homo sapiens; identical to SEQ ID NO: 908216

SEQ ID NO: 908241 - protein, 222 aa, Homo sapiens; identical to SEQ ID NO: 908216

SEQ ID NO: 908242 - protein, 222 aa, Homo sapiens; identical to SEQ ID NO: 908216

SEQ ID NO: 908243 - protein, 177 aa, Homo sapiens
MLSRAVCGTSRQLAPVLGYLGSRQKHSLPDLPYDYGALEPHINAQIMQLHHSKHHAAYVNNLNVTEEKYQEALAKGDVTAQIALQPALKFNGGGHINHSIFWTNLSPNGGGEPKGELLEAIKRDFGSFDKFKEKLTAASVGVQGSGWGWLGFNKERGHLQIAACPNQDPLQGTTVIP

SEQ ID NO: 908244 - protein, 192 aa, Homo sapiens
MLSRAVCGTSRQLAPVLGYLGSRQKHSLPDLPYDYGALEPHINAQIMQLHHSKHHAAYVNNLNVTEEKYQEALAKGDVTAQIALQPALKFNGGGHINHSIFWTNLSPNGGGEPKGELLEAIKRDFGSFDKFKEKLTAASVGVQGSGWGWLIELDKGQSQTAHQDLSHPSNFAIYQHLAKPISHLFHHEFTLS

SEQ ID NO: 908245 - protein, 63 aa, Homo sapiens
MRTRHVMLPKDIAKLVPKTHLMSESEWRNLGVQQSQGWVHYMIHEPEPHILLFRRPLPKKPKK

SEQ ID NO: 908246 - protein, 109 aa, Homo sapiens
ESPVRKDIKAYVCSRDINIQEAFRIKVKSYMSHKQIYYSDKYDDEEFEYRHVMLPKDIAKLVPKTHLMSESEWRNLGVQQSQGWVHYMIHEPEPHILLFRRPLPKKPKK

SEQ ID NO: 908247 - protein, 75 aa, Homo sapiens
YGSRSGQGATRQFEYRHVMLPKDIAKLVPKTHLMSESEWRNLGVQQSQGWVHYMIHEPEPHILLFRRPLPKKPKK

SEQ ID NO: 908248 - protein, 257 aa, Homo sapiens
PFLPRPPQPLLYQRGPSPPPPPPPPLPPSPPPPLPPWGPPPSPPPSPPLHVLGLLSWRRSYSRSPLWARGAAMADGGGGGGTGAVGGGGTSQASAGAATGATGASGGGGPINPASLPPGDPQLIALIVEQLKSRGLFDSFRRDCLADVDTKPAYQNLRQKVDNFVSTHLDKQEWNPTMNKNQLRNGLRQSVVQSGMLEAGVDRIISQVVDPKLNHIFRPQIERAIHEFLAAQKKAAVPAPPPEPEGQDPPAPSQDTS

SEQ ID NO: 908249 - protein, 201 aa, Homo sapiens
PFLPRPPQPLLYQRGPSPPPPPPPPLPPSPPPPLPPWGPPPSPPPSPPLHVLGLLSWRRSYSRSPLWARGAAMADGGGGGGTGAVGGGGTSQASAGAATGATGASGGGGPINPASLPPGDPQLIALIVEQLKSRGLFDSFRRDCLADVDTKPAYQNLRQKVDNFVSTHLDKQEWNPTMNKNQLRNGLRQSVVQIRQTPFES

SEQ ID NO: 908250 - protein, 257 aa, Homo sapiens; identical to SEQ ID NO: 908248

SEQ ID NO: 908251 - protein, 198 aa, Homo sapiens
PFLPRPPQPLLYQRGPSPPPPPPPPLPPSPPPPLPPWGPPPSPPPSPPLHVLGLLSWRRSYSRSPLWARGAAMADGGGGGGTGAVGGGGTSQASAGAATGATGASGGGGPINPASLPPGDPQLIALIVEQLKSRGLFDSFRRDCLADVDTKPAYQNLRQKVDNFVSTHLDKQEWNPTMNKNQLRNGLRQSVVQLGDCG

SEQ ID NO: 908252 - protein, 257 aa, Homo sapiens; identical to SEQ ID NO: 908248

SEQ ID NO: 908253 - protein, 201 aa, Homo sapiens; identical to SEQ ID NO: 908249

SEQ ID NO: 908254 - protein, 803 aa, Homo sapiens
MKVISLFILVGFIGEFQSFSSASSPVNCQWDFYAPWSECNGCTKTQTRRRSVAVYGQYGGQPCVGNAFETQSCEPTRGCPTEEGCGERFRCFSGQCISKSLVCNGDSDCDEDSADEDRCEDSERRPSCDIDKPPPNIELTGNGYNELTGQFRNRVINTKSFGGQCRKVFSGDGKDFYRLSGNVLSYTFQVKINNDFNYEFYNSTWSYVKHTSTEHTSSSRKRSFFRSSSSSSRSYTSHTNEIHKGKSYQLLVVENTVEVAQFINNNPEFLQLAEPFWKELSHLPSLYDYSAYRRLIDQYGTHYLQSGSLGGEYRVLFYVDSEKLKQNDFNSVEEKKCKSSGWHFVVKFSSHGCKELENALKAASGTQNNVLRGEPFIRGGGAGFISGLSYLELDNPAGNKRRYSAWAESVTNLPQVIKQKLTPLYELVKEVPCASVKKLYLKWALEEYLDEFDPCHCRPCQNGGLATVEGTHCLCHCKPYTFGAACEQGVLVGIKQEGLMEVGVAGPLGAPVSKGRKQEAVNAITHLPVGVGDPALEKRQKAHDEGTMFPVGKNVVYTCNEGYSLIGNPVARCGEDLRWLVGEMHCQKIACVLPVLMDGIQSHPQKPFYTVGEKVTVSCSGGMSLEGPSAFLCGSSLKWSPEMKNARCVQKENPLTQAVPKCQRWEKLQNSRCVCKMPYECGPSLDVCAQDERSKRILPLTVCKMHVLHCQGRNYTLTGRDSCTLPASAEKACGACPLWGKCDAESSKCVCREASECEEEGFSICVEVNGKEQTMSECEAGALRCRGQSISVTSIRPCAAETQ

SEQ ID NO: 908255 - protein, 271 aa, Homo sapiens
RADSCKDGFVQDEGTMFPVGKNVVYTCNEGYSLIGNPVARCGEDLRWLVGEMHCQKIACVLPVLMDGIQSHPQKPFYTVGEKVTVSCSGGMSLEGPSAFLCGSSLKWSPEMKNARCVQKENPLTQAVPKCQRWEKLQNSRCVCKMPYECGPSLDVCAQDERSKRILPLTVCKMHVLHCQGRNYTLTGRDSCTLPASAEKACGACPLWGKCDAESSKCVCREASECEEEGFSICVEVNGKEQTMSECEAGALRCRGQSISVTSIRPCAAETQ

SEQ ID NO: 908256 - protein, 100 aa, Homo sapiens
PPCRPREFDSALPLTGRDSCTLPASAEKACGACPLWGKCDAESSKCVCREASECEEEGFSICVEVNGKEQTMSECEAGALRCRGQSISVTSIRPCAAETQ

SEQ ID NO: 908257 - protein, 69 aa, Homo sapiens
LPTKWGKCDAESSKCVCREASECEEEGFSICVEVNGKEQTMSECEAGALRCRGQSISVTSIRPCAAETQ

SEQ ID NO: 908258 - protein, 843 aa, Homo sapiens
MKVISLFILVGFIGEFQSFSSASSPVNCQWDFYAPWSECNGCTKTQTRRRSVAVYGQYGGQPCVGNAFETQSCEPTRGCPTEEGCGERFRCFSGQCISKSLVCNGDSDCDEDSADEDRCEDSERRPSCDIDKPPPNIELTGNGYNELTGQFRNRVINTKSFGGQCRKVFSGDGKDFYRLSGNVLSYTFQVKINNDFNYEFYNSTWSYVKHTSTEHTSSSRKRSFFRSSSSSSRSYTSHTNEIHKGKSYQLLVVENTVEVAQFINNNPEFLQLAEPFWKELSHLPSLYDYSAYRRLIDQYGTHYLQSGSLGGEYRVLFYVDSEKLKQNDFNSVEEKKCKSSGWHFVVKFSSHGCKELENALKAASGTQNNVLRGEPFIRGGGAGFISGLSYLELDNPAGNKRRYSAWAESVTNLPQVIKQKLTPLYELVKEVPCASVKKLYLKWALEEYLDEFDPCHCRPCQNGGLATVEGTHCLCHCKPYTFGAACEQGVLVGNQAGGVDGGWSCWSSWSPCVQGKKTRSRECNNPPPSGGGRSCVGETTESTQCEDEELEHLRLLEPHCFPLSLVPTEFCPSPPALKDGFVQDEGTMFPVGKNVVYTCNEGYSLIGNPVARCGEDLRWLVGEMHCQKIACVLPVLMDGIQSHPQKPFYTVGEKVTVSCSGGMSLEGPSAFLCGSSLKWSPEMKNARCVQKENPLTQAVPKCQRWEKLQNSRCVCKMPYECGPSLDVCAQDERSKRILPLTVCKMHVLHCQGRNYTLTGRDSCTLPASAEKACGACPLWGKCDAESSKCVCREASECEEEGFSICVEVNGKEQTMSECEAGALRCRGQSISVTSIRPCAAETQ

SEQ ID NO: 908259 - protein, 726 aa, Homo sapiens
MKVISLFILVGFIGEFQSFSSASSPVNCQWDFYAPWSECNGCTKTQTRRRSVAVYGQYGGQPCVGNAFETQSCEPTRGCPTEEGCGERFRCFSGQCISKSLVCNGDSDCDEDSADEDRCEDSERRPSCDIDKPPPNIELTGNGYNELTGQFRNRVINTKSFGGQCRKVFSGDGKDFYRLSGNVLSYTFQVKINNDFNYEFYNSTWSYVKHTSTEHTSSSRKRSFFRSSSSSSRSYTSHTNEIHKGKSYQLLVVENTVEVAQFINNNPEFLQLAEPFWKELSHLPSLYDYSAYRRLIDQYGTHYLQSGSLGGEYRVLFYVDSEKLKQNDFNSVEEKKCKSSGWHFVVKFSSHGCKELENALKAASGTQNNVLRGEPFIRGGGAGFISGLSYLELDNPAGNKRRYSAWAESVTNLPQVIKQKLTPLYELVKEVPCASVKKLYLKWALEEYLDEFDPCHCRPCQNGGLATVEGTHCLCHCKPYTFGAACEQGVLVGNQAGGVDGGWSCWSSWSPCVQGKKTRSRECNNPPPSGGGRSCVGETTESTQCEDEELEHLRLLEPHCFPLSLVPTEFCPSPPALKDGFVQDEGTMFPVGKNVVYTCNEGYSLIGNPVARCGEDLRWLVGEMHCQKIACVLPVLMDGIQSHPQKPFYTVGEKVTVSCSGGMSLEGPSAFLCGSSLKWSPEMKNARCVQKENPLTQAVPKFRARPGSELRPGSGDDGERLLGLGV

SEQ ID NO: 908260 - protein, 253 aa, Homo sapiens
MKVISLFILVGFIGEFQSFSSASSPVNCQWDFYAPWSECNGCTKTQTRRRSVAVYGQYGGQPCVGNAFETQSCEPTRGCPTEEGCGERFRCFSGQCISKSLVCNGDSDCDEDSADEDRCEDSERRPSCDIDKPPPNIELTGNGYNELTGQFRNRVINTKSFGGQCRKVFSGDGKDFYRLSGNVLSYTFQVKINNDFNYEFYNSTWSYVKHTSTEHTSSSRKRSFFRSSSSSSRSYTSHTNEIHKGKVSIKCQL

SEQ ID NO: 908261 - protein, 843 aa, Homo sapiens; identical to SEQ ID NO: 908258

SEQ ID NO: 908262 - protein, 373 aa, Homo sapiens
RLLLCCKDDRRFGAACEQGVLVGNQAGGVDGGWSCWSSWSPCVQGKKTRSRECNNPPPSGGGRSCVGETTESTQCEDEELEHLRLLEPHCFPLSLVPTEFCPSPPALKDGFVQDEGTMFPVGKNVVYTCNEGYSLIGNPVARCGEDLRWLVGEMHCQKIACVLPVLMDGIQSHPQKPFYTVGEKVTVSCSGGMSLEGPSAFLCGSSLKWSPEMKNARCVQKENPLTQAVPKCQRWEKLQNSRCVCKMPYECGPSLDVCAQDERSKRILPLTVCKMHVLHCQGRNYTLTGRDSCTLPASAEKACGACPLWGKCDAESSKCVCREASECEEEGFSICVEVNGKEQTMSECEAGALRCRGQSISVTSIRPCAAETQ

SEQ ID NO: 908263 - protein, 843 aa, Homo sapiens; identical to SEQ ID NO: 908258

SEQ ID NO: 908264 - protein, 843 aa, Homo sapiens; identical to SEQ ID NO: 908258

SEQ ID NO: 908265 - protein, 784 aa, Homo sapiens
MKVISLFILVGFIGEFQSFSSASSPVNCQWDFYAPWSECNGCTKTQTRRRSVAVYGQYGGQPCVGNAFETQSCEPTRGCPTEEGCGERFRCFSGQCISKSLVCNGDSDCDEDSADEDRCEDSERRPSCDIDKPPPNIELTGNGYNELTGQFRNRVINTKSFGGQCRKVFSGDGKDFYRLSGNVLSYTFQVKINNDFNYEFYNSTWSYVKHTSTEHTSSSRKRSFFRSSSSSSRSYTSHTNEIHKGKSYQLLVVENTVEVAQFINNNPEFLQLAEPFWKELSHLPSLYDYSAYRRLIDQYGTHYLQSGSLGGEYRVLFYVDSEKLKQNDFNSVEEKKCKSSGWHFVVKFSSHGCKELENALKAASGTQNNVLRGEPFIRGGGAGFISGLSYLELDNPAGNKRRYSAWAESVTNLPQVIKQKLTPLYELVKEVPCASVKKLYLKWALEEYLDEFDPCHCRPCQNGGLATVEGTHCLCHCKPYTFGAACEQGVLVGNQAGGVDGGWSCWSSWSPCVQGKKTRSRECNNPPPSGGGRSCVGETTESTQCEDEELEHLRLLEPHCFPLSLVPTEFCPSPPALKDGFVQDEGTMFPVGKNVVYTCNEGYSLIGNPVARCGEDLRWLVGEMHCQKIACVLPVLMDGIQSHPQKPFYTVGEKVTVSCSGGMSLEGPSAFLCGSSLKWSPEMKNARCVQKENPLTQAVPKCQRWEKLQNSRCVCKMPYECGPSLDVCAQDERSKRILPLTVCKMHVLHCQGRNYTLTGRDSCTLPASAEKACGACPLWGKCDV

SEQ ID NO: 908266 - protein, 164 aa, Homo sapiens
MKVISLFILVGFIGEFQSFSSASSPVNCQWDFYAPWSECNGCTKTQTRRRSVAVYGQYGGQPCVGNAFETQSCEPTRGCPTEEGCGERFRCFSGQCISKSLVCNGDSDCDEDSADEDRCEDSERRPSCDIDKPPPNIELTGNGFNSKPAVAIDTKEPCVSQICS

SEQ ID NO: 908267 - protein, 1082 aa, Homo sapiens
CSARCSASYLGFQFDKKRLPVEESEGKEEELAHSCLGGCGRRKMARALCPLQALWLLEWVLLLLGPCAAPPAWALNLDPVQLTFYAGPNGSQFGFSLDFHKDSHGRVAIVVGAPRTLGPSQEETGGVFLCPWRAEGGQCPSLLFDLRDETRNVGSQTLQTFKARQGLGASVVSWSDVIVACAPWQHWNVLEKTEEAEKTPVGSCFLAQPESGRRAEYSPCRGNTLSRIYVENDFSWDKRYCEAGFSSVVTQAGELVLGAPGGYYFLGLLAQAPVADIFSSYRPGILLWHVSSQSLSFDSSNPEYFDGYWGYSVAVGEFDGDLNTTEYVVGAPTWSWTLGAVEILDSYYQRLHRLRAEQMASYFGHSVAVTDVNGDGRHDLLVGAPLYMESRADRKLAEVGRVYLFLQPRGPHALGAPSLLLTGTQLYGRFGSAIAPLGDLDRDGYNDIAVAAPYGGPSGRGQVLVFLGQSEGLRSRPSQVLDSPFPTGSAFGFSLRGAVDIDDNGYPDLIVGAYGANQVAVYRAQPVVKASVQLLVQDSLNPAVKSCVLPQTKTPVSCFNIQMCVGATGHNIPQKLSLNAELQLDRQKPRQGRRVLLLGSQQAGTTLNLDLGGKHSPICHTTMAFLRDEADFRDKLSPIVLSLNVSLPPTEAGMAPAVVLHGDTHVQEQTRIVLDCGEDDVCVPQLQLTASVTGSPLLVGADNVLELQMDAANEGEGAYEAELAVHLPQGAHYMRALSNVEGFERLICNQKKENETRVVLCELGNPMKKNAQIGIAMLVSVGNLEEAGESVSFQLQIRSKNSQNPNSKIVLLDVPVRAEAQVELRGNSFPASLVVAAEEGEREQNSLDSWGPKVEHTYELHNNGPGTVNGLHLSIHLPGQSQPSDLLYILDIQPQGGLQCFPQPPVNPLKVDWGLPIPSPSPIHPAHHKRDRRQIFLPEPEQPSRLQDPVLVSCDSAPCTVVQCDLQEMARGQRAMVTVLAFLWLPSLYQRPLDQFVLQSHAWFNVSSLPYAVPPLSLPRGEAQVWTQLLRALEERAIPIWWVLVGVLGGLLLLTILVLAMWKVGFFKRNRPPLEEDDEEGE

SEQ ID NO: 908268 - protein, 227 aa, Homo sapiens
KILKGAWARWLTPVIPALWEPKVGRSLEVRSSRSAWPNSFPASLVVAAEEGEREQNSLDSWGPKVEHTYELHNNGPGTVNGLHLSIHLPGQSQPSDLLYILDIQPQGGLQCFPQPPVNPLKVDWGLPIPSPSPIHPAHHKRDRRQIFLPEPEQPSRLQDPVLVSCDSAPCTVVQCDLQEMARGQRAMVTVLAFLWLPSLYQRPLDQFVLQSHAWFNVSFEEEAKCSS

SEQ ID NO: 908269 - protein, 1136 aa, Homo sapiens
CSARCSASYLGFQFDKKRLPVEESEGKEEELAHSCLGGCGRRKMARALCPLQALWLLEWVLLLLGPCAAPPAWALNLDPVQLTFYAGPNGSQFGFSLDFHKDSHGRVAIVVGAPRTLGPSQEETGGVFLCPWRAEGGQCPSLLFDLRESQARRAGWGQRDVDCRASAPHPFLCLPGDETRNVGSQTLQTFKARQGLGASVVSWSDVIVVGPAVQGTGNNRGQGHLGPGGAQVSRPSPPPVAFLQACAPWQHWNVLEKTEEAEKTPVGSCFLAQPESGRRAEYSPCRGNTLSRIYVENDFSWDKRYCEAGFSSVVTQAVGSKSAVGAAPKQGPLSPSGLPFQAGELVLGAPGGYYFLGLLAQAPVADIFSSYRPGILLWHVSSQSLSFDSSNPEYFDGYWGYSVAVGEFDGDLNTTEYVVGAPTWSWTLERRHDLLVGAPLYMESRADRKLAEVGRVYLFLQPRGPHALGAPSLLLTGTQLYGRFGSAIAPLGDLDRDGYNDIAVAAPYGGPSGRGQVLVFLGQSEGLRSRPSQVLDSPFPTGSAFGFSLRGAVDIDDNGYPDLIVGAYGANQVAVYRAQPVVKASVQLLVQDSLNPAVKSCVLPQTKTPVSCFNIQMCVGATGHNIPQKLSLNAELQLDRQKPRQGRRVLLLGSQQAGTTLNLDLGGKHSPICHTTMAFLRDEADFRDKLSPIVLSLNVSLPPTEAGMAPAVVLHGDTHVQEQTRIVLDCGEDDVCVPQLQLTASVTGSPLLVGADNVLELQMDAANEGEGAYEAELAVHLPQGAHYMRALSNVEGFERLICNQKKENETRVVLCELGNPMKKNAQIGIAMLVSVGNLEEAGESVSFQLQIRSKNSQNPNSKIVLLDVPVRAEAQVELRGNSFPASLVVAAEEGEREQNSLDSWGPKVEHTYELHNNGPGTVNGLHLSIHLPGQSQPSDLLYILDIQPQGGLQCFPQPPVNPLKVDWGLPIPSPSPIHPAHHKRDRRQIFLPEPEQPSRLQDPVLVSCDSAPCTVVQCDLQEMARGQRAMVTVLAFLWLPSLYQRPLDQFVLQSHAWFNVSSLPYAVPPLSLPRGEAQVWTQLLRALEERAIPIWWVLVGVLGGLLLLTILVLAMWKVGFFKRNRPPLEEDDEEGE

SEQ ID NO: 908270 - protein, 1108 aa, Homo sapiens
CSARCSASYLGFQFDKKRLPVEESEGKEEELAHSCLGGCGRRKMARALCPLQALWLLEWVLLLLGPCAAPPAWALNLDPVQLTFYAGPNGSQFGFSLDFHKDSHGRVAIVVGAPRTLGPSQEETGGVFLCPWRAEGGQCPSLLFDLRESQARRAGWGQRDVDCRASAPHPFLCLPGDETRNVGSQTLQTFKARQGLGASVVSWSDVIVVGPAVQGTGNNRGQGHLGPGGAQVSRPSPPPVAFLQACAPWQHWNVLEKTEEAEKTPVGSCFLAQPESGRRAEYSPCRGNTLSRIYVENDFSWDKRYCEAGFSSVVTQAGELVLGAPGGYYFLGLLAQAPVADIFSSYRPGILLWHVSSQSLSFDSSNPEYFDGYWGYSVAVGEFDGDLNTTEYVVGAPTWSWTLGAVEILDSYYQRLHRLRAEQMASYFGHSVAVTDVNGDGRHDLLVGAPLYMESRADRKLAEVGRVYLFLQPRGPHALGAPSLLLTGTQLYGRFGSAIAPLGDLDRDGYNDIAVAAPYGGPSGRGQVLVFLGQSEGLRSRPSQVLDSPFPTGSAFGFSLRGAVDIDDNGYPDLIVGAYGANQVAVYRAQPVVKASVQLLVQDSLNPAVKSCVLPQTKTPVSCFNIQMCVGATGHNIPQKLSLNAELQLDRQKPRQGRRVLLLGSQQAGTTLNLDLGGKHSPICHTTMAFLRDEADFRDKLSPIVLSLNVSLPPTEAGMAPAVVLHGDTHVQEQTRIVLDCGEDDVCVPQLQLTASVTGSPLLVGADNVLELQMDAANEGEGAYEAELAVHLPQGAHYMRALSNVEGFERLICNQKKENETRVVLCELGNPMKKNAQIGIAMLVSVGNLEEAGESVSFQLQIRSKNSQNPNSKIVLLDVPVRAEAQVELRGNSFPASLVVAAEEGEREQNSLDSWGPKVEHTYELHNNGPGTVNGLHLSIHLPGQSQPSDLLYILDIQPQGGLQCFPQPPVNPLKVDWGLPIPSPSPIHPAHHKRDRRQIFLPEPEQPSRLQDPVLVSCDSAPCTVVQCDLQEMARGQRAMVTVLAFLWLPSLYQRPLDQFVLQSHAWFNVSSLPYAVPPLSLPRGEAQVGFFKRNRPPLEEDDEEGE

SEQ ID NO: 908271 - protein, 1147 aa, Homo sapiens
CSARCSASYLGFQFDKKRLPVEESEGKEEELAHSCLGGCGRRKMARALCPLQALWLLEWVLLLLGPCAAPPAWALNLDPVQLTFYAGPNGSQFGFSLDFHKDSHGRVAIVVGAPRTLGPSQEETGGVFLCPWRAEGGQCPSLLFDLRESQARRAGWGQRDVDCRASAPHPFLCLPGDETRNVGSQTLQTFKARQGLGASVVSWSDVIVVGPAVQGTGNNRGQGHLGPGGAQVSRPSPPPVAFLQACAPWQHWNVLEKTEEAEKTPVGSCFLAQPESGRRAEYSPCRGNTLSRIYVENDFSWDKRYCEAGFSSVVTQAGELVLGAPGGYYFLGLLAQAPVADIFSSYRPGILLWHVSSQSLSFDSSNPEYFDGYWGYSVAVGEFDGDLNTTEYVVGAPTWSWTLGAVEILDSYYQRLHRLRAEQMASYFGHSVAVTDVNGDGRHDLLVGAPLYMESRADRKLAEVGRVYLFLQPRGPHALGAPSLLLTGTQLYGRFGSAIAPLGDLDRDGYNDIAVAAPYGGPSGRGQVLVFLGQSEGLRSRPSQVLDSPFPTGSAFGFSLRGAVDIDDNGYPDLIVGAYGANQVAVYRAQPVVKASVQLLVQDSLNPAVKSCVLPQTKTPVSCFNIQMCVGATGHNIPQKLSLNAELQLDRQKPRQGRRVLLLGSQQAGTTLNLDLGGKHSPICHTTMAFLRDEADFRDKLSPIVLSLNVSLPPTEAGMAPAVVLHGDTHVQEQTRIVLDCGEDDVCVPQLQLTASVTGSPLLVGADNVLELQMDAANEGEGAYEAELAVHLPQGAHYMRALSNVEGFERLICNQKKENETRVVLCELGNPMKKNAQIGIAMLVSVGNLEEAGESVSFQLQIRSKNSQNPNSKIVLLDVPVRAEAQVELRGNSFPASLVVAAEEGEREQNSLDSWGPKVEHTYELHNNGPGTVNGLHLSIHLPGQSQPSDLLYILDIQPQGGLQCFPQPPVNPLKVDWGLPIPSPSPIHPAHHKRDRRQIFLPEPEQPSRLQDPVLVSCDSAPCTVVQCDLQEMARGQRAMVTVLAFLWLPSLYQRPLDQFVLQSHAWFNVSSLPYAVPPLSLPRGEAQVWTQLLRALEERAIPIWWVLVGVLGGLLLLTILVLAMWKVGFFKRNRPPLEEDDEEGE

SEQ ID NO: 908272 - protein, 1061 aa, Homo sapiens
CSARCSASYLGFQFDKKRLPVEESEGKEEELAHSCLGGCGRRKMARALCPLQALWLLEWVLLLLGPCAAPPAWALNLDPVQLTFYAGPNGSQFGFSLDFHKDSHGRVAIVVGAPRTLGPSQEETGGVFLCPWRAEGGQCPSLLFDLRESQARRAGWGQRDVDCRASAPHPFLCLPGDETRNVGSQTLQTFKARQGLGASVVSWSDVIVVGPAVQGTGNNRGQGHLGPGGAQVSRPSPPPVAFLQACAPWQHWNVLEKTEEAEKTPVGSCFLAQPESGRRAEYSPCRGNTLSRIYVENDFSWDKRYCEAGFSSVVTQAGELVLGAPGGYYFLGLLAQAPVADIFSSYRPGILLWHVSSQSLSFDSSNPEYFDGYWGYSVAVGEFDGDLNTTEYVVGAPTWSWTLGAVEILDSYYQRLHRLRAEQMASYFGHSVAVTDVNGDGRHDLLVGAPLYMESRADRKLAEVGRVYLFLQPRGPHALGAPSLLLTGTQLYGRFGSAIAPLGDLDRDGYNDIAVAAPYGGPSGRGQVLVFLGQSEGLRSRPSQVLDSPFPTGSAFGFSLRGAVDIDDNGYPDLIVGAYGANQVAVYRAQPVVKASVQLLVQDSLNPAVKSCVLPQTKTPVSCFNIQMCVGATGHNIPQKLSLNAELQLDRQKPRQGRRVLLLGSQQAGTTLNLDLGGKHSPICHTTMAFLRDEADFRDKLSPIVLSLNVSLPPTEAGMAPAVVLHGDTHVQEQTRIVLDCGEDDVCVPQLQLTASVTGSPLLVGADNVLELQMDAANEGEGAYEAELAVHLPQGAHYMRALSNVEGFERLICNQKKENETRVVLCELGNPMKKNAQIGIAMLVSVGNLEEAGESVSFQLQIRSKNSQNPNSKIVLLDVPVRAEAQVELRGNSFPASLVVAAEEGEREQNSLDSWGPKVEHTYELHNNGPGTVNGLHLSIHLPGQSQPSDLLYILDIQPQGGLQCFPQPPVNPLKVDWGLPIPSPSPIHPAHHKRDRRQIFLPEPEQPSRLQDPVLVVSRLSGLWPGLPGTHGAEGMGGGRGVRVCCGPLWATLGPWEHFK

SEQ ID NO: 908273 - protein, 164 aa, Homo sapiens
GYAGICAALTQLSYAEWPSWWAPRGPWAPARRRRAACSCAPGGPRAASAPRCSLTSVSPRQGEQGWGQRDVDCRASAPHPFLCLPGDETRNVGSQTLQTFKARQGLGASVVSWSDVIVVGPAVQGTGNNRGQGHLGPGGAQVSRPSPLLWPFSRPAPPGSTGTS

SEQ ID NO: 908274 - protein, 369 aa, Homo sapiens [sequence omitted]

SEQ ID NO: 908275 - protein, 410 aa, Homo sapiens
MWSGRKLGSSGGWFLRVLGPGGCNTKAARPLISSAVYVKNQLSGTLQIKPGVFNEYRTIWFKSYRTIFSCLNRIKSFRWSFTSVAQAGVQWCDLGSLQPPPPGFKRFSCLSLLSHWDYRYPWARLYSTSQTTVDSGEVKTFLALAHKWWDEQGVYAPLHSMNDLRVPFIRDNLLKTIPNHQPGKPLLGMKILDVGCGGGLLTEPLGRLGASVIGIDPVDENIKTAQCHKSFDPVLDKRIEYRVCSLEEIVEETAETFDAVVASEVVEHVIDLETFLQCCCQVLKPGGSLFITTINKTQLSYALGIVFSEQIAGIVPKGTHTWEKFVSPETLESILESNGLSVQTVVGMLYNPFSGYWHWSENTSLNYAAHAVKSRVQEHPASAEFVLKGETEELQANACTNPAVHEKLKK

SEQ ID NO: 908276 - protein, 149 aa, Homo sapiens
FYGGISFWPVFPDTPPHIKITHFPGGSLFITTINKTQLSYALGIVFSEQIAGIVPKGTHTWEKFVSPETLESILESNGLSVQTVVGMLYNPFSGYWHWSENTSLNYAAHAVKSRVQEHPASAEFVLKGETEELQANACTNPAVHEKLKK

SEQ ID NO: 908277 - protein, 369 aa, Homo sapiens [sequence omitted]

SEQ ID NO: 908278 - protein, 250 aa, Homo sapiens
MNDLRVPFIRDNLLKTIPNHQPGKPLLGMKILDVGCGGGLLTEPLGRLGASVIGIDPVDENIKTAQCHKSFDPVLDKRIEYRVCSLEEIVEETAETFDAVVASEVVEHVIDLETFLQCCCQVLKPGGSLFITTINKTQLSYALGIVFSEQIAGIVPKGTHTWEKFVSPETLESILESNGLSVQTVVGMLYNPFSGYWHWSENTSLNYAAHAVKSRVQEHPASAEFVLKGETEELQANACTNPAVHEKLKK

SEQ ID NO: 908279 - protein, 289 aa, Homo sapiens
MVGVKPVGSDPDFQPELSGAGSRLAVVKFTMRGCGPCLRIAPAFSSMSNKYPQAVFLEVDVHQCQGTAATNNISATPTFLFFRNKVRIDQYQGADAVGLEEKIKQHLENDPGSNEDTDIPKGYMDLMPFINKAGCECLNESDEHGFDNCLRKDTTFLESDCDEQLLITVAFNQPVKLYSMKFQGPDNGQGPKYVKIFINLPRSMDFEEAERSEPTQALELTEDDIKEDGIVPLRYVKFQNVNSVTIFVQSNQGEEETTRISYFTFIGTPVQATNMNDFKRVVGKKGESH

SEQ ID NO: 908280 - protein, 166 aa, Homo sapiens
MVGVKPVGSDPDFQPELSGAGSRLAVVKFTMRGCGPCLRIAPAFSSMSNKYPQAVFLEVDVHQCQGTAATNNISATPTFLFFRNKVRIDQYQGADAVGLEEKIKQHLENDPGSNEDTDIPKGYMDLMPFINKAGCECLNESDEHGFDNCLRCLLLWHSINLLSFIP

SEQ ID NO: 908281 - protein, 289 aa, Homo sapiens; identical to SEQ ID NO: 908279

SEQ ID NO: 908282 - protein, 289 aa, Homo sapiens; identical to SEQ ID NO: 908279

SEQ ID NO: 908283 - protein, 289 aa, Homo sapiens; identical to SEQ ID NO: 908279

SEQ ID NO: 908284 - protein, 322 aa, Homo sapiens
MVGVKPVGSDPDFQPELSGAGSRLAVVKFTMRGCGPCLRIAPAFSSMSNKYPQAVFLEVDVHQCQGTAATNNISATPTFLFFRNKVRIDQYQGADAVGLEEKIKQHLENDPGSNEDTDIPKGYMDLMPFINKAGCECLNESDEHGFDNCLRKDTTFLESDCDEQLLITVAFNQPVKLYSMKFQGPDNGQGPKYVKIFINLPRSMDFEEAERSEPTQALELTEDDIKEDGIVPLRYVKFQNVNSVTIFVQSNQGEEETTRISYFTFIGTPVQATNMNDFKRHLSALTLPMFSPLLVQDFYSFYHLDQPCYLGFLNHLFLQISS

SEQ ID NO: 908285 - protein, 293 aa, Homo sapiens
MVGVKPVGSDPDFQPELSGAGSRLAVVKFTMRGCGPCLRIAPAFSSMSNKYPQAVFLEVDVHQCQGTAATNNISATPTFLFFRNKVRIDQYQGADAVGLEEKIKQHLENDPGSNEDTDIPKGYMDLMPFINKAGCECLNESDEHGFDNCLRKDTTFLESDCDEQLLITVAFNQPVKLYSMKFQGPDNGQGPKYVKIFINLPRSMDFEEAERSEPTQALELTEDDIKEDGIVPLRYVKFQNVNSVTIFVQSNQGEEETTRISYFTQQSLYWVYIINHSTIKTHAHIYSLQHGLS

SEQ ID NO: 908286 - protein, 244 aa, Homo sapiens
LYSFLGHHRLFLGVDVHQCQGTAATNNISATPTFLFFRNKVRIDQYQGADAVGLEEKIKQHLENDPGSNEDTDIPKGYMDLMPFINKAGCECLNESDEHGFDNCLRKDTTFLESDCDEQLLITVAFNQPVKLYSMKFQGPDNGQGPKYVKIFINLPRSMDFEEAERSEPTQALELTEDDIKEDGIVPLRYVKFQNVNSVTIFVQSNQGEEETTRISYFTFIGTPVQATNMNDFKRVVGKKGESH

SEQ ID NO: 908287 - protein, 269 aa, Homo sapiens
MVGVKPVGSDPDFQPELSGAGSRLAVVKFTMRGCGPCLRIAPAFSSMSNKYPQAVFLEVDVHQCQGTAATNNISATPTFLFFRNKVRIDQYQGADAVGLEEKIKQHLENDPGSNEDTDIPKGYMDLMPFINKAGCECLNESDEHGFDNCLRKDTTFLESDCDEQLLITVAFNQPVKLYSMKFQGPDNEAERSEPTQALELTEDDIKEDGIVPLRYVKFQNVNSVTIFVQSNQGEEETTRISYFTFIGTPVQATNMNDFKRVVGKKGESH

SEQ ID NO: 908288 - protein, 175 aa, Homo sapiens
MVGVKPVGSDPDFQPELSGAGSRLAVVKFTMRGCGPCLRIAPAFSSMSNKYPQAVFLEVDVHQCQGTAATNNISATPTFLFFRNKVRIDQYQGADAVGLEEKIKQHLENDPGSNEDTDIPKGYMDLMPFINKAGCECLNESDEHGFDNCLRKDTTFLESDCDEQTCYYYYIQSNL

SEQ ID NO: 908289 - protein, 289 aa, Homo sapiens; identical to SEQ ID NO: 908279

SEQ ID NO: 908290 - protein, 289 aa, Homo sapiens; identical to SEQ ID NO: 908279

SEQ ID NO: 908291 - protein, 325 aa, Homo sapiens
MVGVKPVGSDPDFQPELSGAGSRLAVVKFTMRGCGPCLRIAPAFSSMSNKYPQAVFLEVDVHQCQGTAATNNISATPTFLFFRNKVRIDQYQGADAVGLEEKIKQHLENDPGSNEDTDIPKGYMDLMPFINKAGCECLNESDEHGFDNCLRKDTTFLESDCDEQLLITVAFNQPVKLYSMKFQGPDNGQGPKYVKIFINLPRSMDFEEAERSEPTQALELTEDDIKEDGIVPLRYVKFQNVNSVTIFVQSNQGEEETTRISYFTFIGTPVQATNMNDFKRHLSALTLPMFSPLLVQDFYSFYHLDQPCYLENTHWQVESYQPVKQ

SEQ ID NO: 908292 - protein, 130 aa, Homo sapiens
AAGCRTPSHPPPLPSPIPPRPLGRSAPWRDSALRVPGEDSAVATSSVQASAFLSISPSSPRSSSPSVSKPVASRPPCRALCEDGGGEARRERPGFPARAERRGLQTRRGQVHHERVWAMFEDCPSIQFYE

SEQ ID NO: 908293 - protein, 166 aa, Homo sapiens; identical to SEQ ID NO: 908280

SEQ ID NO: 908294 - protein, 134 aa, Homo sapiens
NETLIFTAALLITVAFNQPVKLYSMKFQGPDNGQGPKYVKIFINLPRSMDFEEAERSEPTQALELTEDDIKEDGIVPLRYVKFQNVNSVTIFVQSNQGEEETTRISYFTFIGTPVQATNMNDFKRVVGKKGESH

SEQ ID NO: 908295 - protein, 96 aa, Homo sapiens
LVLEVSIAEVQVDRGQEHDHVLDHILQEDTIIIGGVDLEHTARDQEAGPAVTVKALEDIIIMVLLTFKAKHTRDDLKRLWLCNSSKAQFPLTQPLR

SEQ ID NO: 908296 - protein, 215 aa, Homo sapiens
MTSRSTARPNGQPQASKICQFKLVLLGESAVGKSSLVLRFVKGQFHEYQESTIGAAFLTQSVCLDDTTVKFEIWDTAGQERYHSLAPMYYRGAQAAIVVYDITNQETFARAKTWVKELQRQASPSIVIALAGNKADLANKRMVEYEEAQAYADDNSLLFMETSAKTAMNVNDLFLAIAKKLPKSEPQNLGGAAGRSRGVDLHEQSQQNKSQCCSN

SEQ ID NO: 908297 - protein, 279 aa, Homo sapiens
RARRRRRGRRVWLSCSCLSVRHRLGADGGDGAPGVLKPGNPLPFPLPPLQYPPPSTLSHSDNLAMTSRSTARPNGQPQASKICQFKLVLLGESAVGKSSLVLRFVKGQFHEYQESTIGAAFLTQSVCLDDTTVKFEIWDTAGQERYHSLAPMYYRGAQAAIVVYDITNQETFARAKTWVKELQRQASPSIVIALAGNKADLANKRMVEYEEAQAYADDNSLLFMETSAKTAMNVNDLFLAIAKKLPKSEPQNLGGAAGRSRGVDLHEQSQQNKSQCCSN

SEQ ID NO: 908298 - protein, 101 aa, Homo sapiens
PPPKSHPSPSPRWKKATVRGWDMNWQREWGGKISGTRQEVPCKLTGRRWRCSVNCGSVTLQRPSFPSRSLLGSVSPNRGGWTPESSKEFSLVACIFGSAVI

SEQ ID NO: 908299 - protein, 279 aa, Homo sapiens; identical to SEQ ID NO: 908297

SEQ ID NO: 908300 - protein, 242 aa, Homo sapiens
RARRRRRGRRVWLSCSCLSVRHRLGADGGDGAPGVLKPGNPLPFPLPPLQYPPPSTLSHSDNLAMTSRSTARPNGQPQASKICQFKLVLLGESAVGKSSLVLRFVKGQFHEYQESTIGAAFLTQSVCLDDTTVKFEIWDTAGQERYHSLAPMYYRGAQAAIVVYDITNQETFARAKTWVKELQRQASPSIVIALAGNKADLANKRMVEYEVRWPVEFLSNTSSVPGTSFFPNQPGPAPSPAR

SEQ ID NO: 908301 - protein, 279 aa, Homo sapiens; identical to SEQ ID NO: 908297

SEQ ID NO: 908302 - protein, 275 aa, Homo sapiens
RARRRRRGRRVWLSCSCLSVRHRLGADGGDGAPGVLKPGNPLPFPLPPLQYPPPSTLSHSDNLAMTSRSTARPNGQPQASKICQFKLVLLGESAVGKSSLVLRFVKGQFHEYQESTIGAAFLTQSVCLDDTTVKFEIWDTAGQERYHSLAPMYYRGAQAAIVVYDITNQETFARAKTWVKELQRQASPSIVIALAGNKADLANKRMVEYEEAQAYADDNSLLFMETSAKTAMNVNDLFLAIAKKLPKSEPQNLGGAAGRSRGVDLHEQSQQNKNG

SEQ ID NO: 908303 - protein, 279 aa, Homo sapiens; identical to SEQ ID NO: 908297

SEQ ID NO: 908304 - protein, 279 aa, Homo sapiens; identical to SEQ ID NO: 908297

SEQ ID NO: 908305 - protein, 191 aa, Homo sapiens
GEEEKEGQEGWLSCSCLSVRHRLGADGGDGAPGVLKPGNPLPFPLPPLQYPPPSTLSHSDNLAMTSRSTARPNGQPQASKICQFKLVLLGESAVGKSSLVLRFVKGQFHEYQESTIGAAFLTQSVCLDDTTVKFEIWDTAGQERYHSLAHNDNYMGLHHKHFPITTFCNPTHCARPDKTGSNEHQRHTCRY

SEQ ID NO: 908306 - protein, 316 aa, Homo sapiens
MLSKLGHSPLGGLRARLTFPVCLLYHRLWASPAAPGKKKEMGNSMKSTPAPAERPLPNPEGLDSDFLAVLSDYPSPDISPPIFRRGEKLRVISDEGGWWKAISLSTGRESYIPGICVARVYHGWLFEGLGRDKAEELLQLPDTKVGSFMIRESETKKGFYSLSVRHRQVKHYRIFRLPNNWYYISPRLTFQCLEDLVNHYSEVADGLCCVLTTPCLTQSTAAPAVRASSSPVTLRQKTVDWRRVSRLQEDPEGTENPLGVDESLFSYGLRESIASYLSLTSEDNTSFDRKKKSISLMYGGSKRKSSFFSSPPYFED

SEQ ID NO: 908307 - protein, 77 aa, Homo sapiens
AAWFLTQTLLWLLTILSKGAEEWKLLPPTAFASNFPLCGFSVIPLIKELELRKSNQSSPISSSHINSRLSRSKLPEK

SEQ ID NO: 908308 - protein, 272 aa, Homo sapiens [sequence omitted]

SEQ ID NO: 908309 - protein, 272 aa, Homo sapiens [sequence omitted]

SEQ ID NO: 908310 - protein, 272 aa, Homo sapiens [sequence omitted]

SEQ ID NO: 908311 - protein, 272 aa, Homo sapiens [sequence omitted]

SEQ ID NO: 908312 - protein, 426 aa, Homo sapiens
MSGGVYGGDEVGALVFDIGSFSVRAGYAGEDCPKADFPTTVGLLAAEEGGGLELEGDKEKKGKIFHIDTNALHVPRDGAEVMSPLKNGMIEDWECFRAILDHTYSKHVKSEPNLHPVLMSEAPWNTRAKREKLTELMFEQYNIPAFFLCKTAVLTAFANGRSTGLVLDSGATHTTAIPVHDGYVLQQGIVKSPLAGDFISMQCRELFQEMAIDIIPPYMIAAKEPVREGAPPNWKKKEKLPQVSKSWHNYMCNEVIQDFQASVLQVSDSPYDEQVAAQMPTVHYEMPNGYNTDYGAERLRIPEGLFDPSNVKGLSGNTMLGVGHVVTTSIGMCDIDIRPGLYGSVIVTGGNTLLQGFTDRLNRELSQKTPPSMRLKLIASNSTMERKFSPWIGGSILASLGTFQQMWISKQEYEEGGKQCVERKCP

SEQ ID NO: 908313 - protein, 290 aa, Homo sapiens
MFEQYNIPAFFLCKTAVLTAFANGRSTGLVLDSGATHTTAIPVHDGYVLQQGIVKSPLAGDFISMQCRELFQEMAIDIIPPYMIAAKEPVREGAPPNWKKKEKLPQVSKSWHNYMCNEVIQDFQASVLQVSDSPYDEQVAAQMPTVHYEMPNGYNTDYGAERLRIPEGLFDPSNVKGLSGNTMLGVGHVVTTSIGMCDIDIRPGLYGSVIVTGGNTLLQGFTDRLNRELSQKTPPSMRLKLIASNSTMERKFSPWIGGSILASLGTFQQMWISKQEYEEGGKQCVERKCP

SEQ ID NO: 908314 - protein, 277 aa, Homo sapiens
TYPSDASFANGRSTGLVLDSGATHTTAIPVHDGYVLQQGIVKSPLAGDFISMQCRELFQEMAIDIIPPYMIAAKEPVREGAPPNWKKKEKLPQVSKSWHNYMCNEVIQDFQASVLQVSDSPYDEQVAAQMPTVHYEMPNGYNTDYGAERLRIPEGLFDPSNVKGLSGNTMLGVGHVVTTSIGMCDIDIRPGLYGSVIVTGGNTLLQGFTDRLNRELSQKTPPSMRLKLIASNSTMERKFSPWIGGSILASLGTFQQMWISKQEYEEGGKQCVERKCP

SEQ ID NO: 908315 - protein, 160 aa, Homo sapiens
MSGGVYGGDEVGALVFDIGSFSVRAGYAGEDCPKADFPTTVGLLAAEEGGGLELEGDKEKKGKIFHIDTNALHVPRDGAEVMSPLKNGMIEDWECFRAILDHTYSKHVKSEPNLHPVLMSEAPWNTRAKREKLTELMFEQYNIPAFFLCKTAVLTAYPLD

SEQ ID NO: 908316 - protein, 233 aa, Homo sapiens
MSGGVYGGDEVGALVFDIGSFSVRAGYAGEDCPKADFPTTVGLLAAEEGGGLELEGDKEKKGKIFHIDTNALHVPRDGAEVMSPLKNGMIEDWECFRAILDHTYSKHVKSEPNLHPVLMSEAPWNTRAKREKLTELMFEQYNIPAFFLCKTAVLTAFANGRSTGLVLDSGATHTTAIPVHDGYVLQQGIVKSPLAGDFISMQCRELFQEMAIDIIPPYMIAAKVGPLGTWSCH

SEQ ID NO: 908317 - protein, 254 aa, Homo sapiens
PLAGSTAEPAAPGSCRAGNSARKVGVGVRWARKGCSYTVPPQEPVREGAPPNWKKKEKLPQVSKSWHNYMCNEVIQDFQASVLQVSDSPYDEQQSPAPFWVGVAAQMPTVHYEMPNGYNTDYGAERLRIPEGLFDPSNVKGLSGNTMLGVGHVVTTSIGMCDIDIRPGLYGSVIVTGGNTLLQGFTDRLNRELSQKTPPSMRLKLIASNSTMERKFSPWIGGSILASLGTFQQMWISKQEYEEGGKQCVERKCP

SEQ ID NO: 908318 - protein, 252 aa, Homo sapiens
PPPAASTLAARAAAGWTLLARGAMSRSLDSARSFLERLEARGGREGAVLAGEFSVSGTRGPRAARPGPGPAYACPPRTAGSAFLSRCPRCLPASGGLSVFLSPALLCRSCCLRLHSLPPGPGARRPRPGRDGPCTPSFPVSSSRSRNNLAAGGTGGAGAAGEGGRPAALDSPGPAASGDLTVPCDHRKEGAAAGRRGTRRLWRGEGVNAGLESASGPESASRPESASRPSACGPGGLPGPSDLGFSLGEMGT

SEQ ID NO: 908319 - protein, 316 aa, Homo sapiens
RLPRRPHSPRARRPGWTLLARGAMSRSLDSARSFLERLEARGGREGAVLAGEFSDIQACSAAWKADGVCSTVAGSRPENVRKNRYKDVLPYDQTRVILSLLQEEGHSDYINGNFIRGVDGSLAYIATQGPLPHTLLDFWRLVWEFGVKVSTWGCGTMVGSTSKYPLGSFPGPLTQITFLSPDPPCLVILMACREIENGRKRCERYWAQEQEPLQTGLFCITLIKEKWLNEDIMLRTLKVTFQKESRSVYQLQYMSWPDRGVPSSPDHMLAMVEEARRLQGSGPEPLCVHCRFWKWASGGSGEAEGTEHGGEYRAWG

SEQ ID NO: 908320 - protein, 316 aa, Homo sapiens; identical to SEQ ID NO: 908319

SEQ ID NO: 908321 - protein, 483 aa, Homo sapiens
RLPRRPHSPRARRPGWTLLARGAMSRSLDSARSFLERLEARGGREGAVLAGEFSDIQACSAAWKADGVCSTVAGSRPENVRKNRYKDVLPYDQTRVILSLLQEEGHSDYINGNFIRGVDGSLAYIATQGPLPHTLLDFWRLVWEFGVKVILMACREIENGRKRCERYWAQEQEPLQTGLFCITLIKEKWLNEDIMLRTLKVTFQKESRSVYQLQYMSWPDRGVPSSPDHMLAMVEEARRLQGSGPEPLCVHCSAGCGRTGVLCTVDYVRQLLLTQMIPPDFSLFDVVLKMRKQRPAAVQTEEQYRFLYHTVAQMFCSTLQNASPHYQNIKENCAPLYDDALFLRTPQALLAIPRPPGGVLRSISVPGSPGHAMADTYAVVQKRGAPAGAGSGTQTGTGTGTGARSAEEAPLYSKVTPRAQRPGAHAEDARGTLPGRVPADQSPAGSGAYEDVAGGAQTGGLGFNLRIGRPKGPRDPPAEWTRV

SEQ ID NO: 908322 - protein, 316 aa, Homo sapiens; identical to SEQ ID NO: 908319

SEQ ID NO: 908323 - protein, 316 aa, Homo sapiens; identical to SEQ ID NO: 908319

SEQ ID NO: 908324 - protein, 316 aa, Homo sapiens; identical to SEQ ID NO: 908319

SEQ ID NO: 908325 - protein, 316 aa, Homo sapiens; identical to SEQ ID NO: 908319

SEQ ID NO: 908326 - protein, 316 aa, Homo sapiens; identical to SEQ ID NO: 908319

SEQ ID NO: 908327 - protein, 316 aa, Homo sapiens; identical to SEQ ID NO: 908319

SEQ ID NO: 908328 - protein, 316 aa, Homo sapiens; identical to SEQ ID NO: 908319

SEQ ID NO: 908329 - protein, 151 aa, Homo sapiens
APSPYPTQTPRFSPYLLTDDQTRVILSLLQEEGHSDYINGNFIRGVDGSLAYIATQGPLPHTLLDFWRLVWEFGVKVSTWGCGTMVGSTSKYPLGSFPGPLTQITFLSPDPPCLGDPDGLSRDREWAGRCPLPPGFMSLWEEGGGILLAPP

SEQ ID NO: 908330 - protein, 86 aa, Homo sapiens
VRVGVTEGGGLGVARGGPQNLSREFGLHQGVDGSLAYIATQGPLPHTLLDFWRLVWEFGVKVSTWGCGTMVGSTSKYPLGSFPGPL

SEQ ID NO: 908331 - protein, 483 aa, Homo sapiens; identical to SEQ ID NO: 908321

SEQ ID NO: 908332 - protein, 316 aa, Homo sapiens; identical to SEQ ID NO: 908319

SEQ ID NO: 908333 - protein, 376 aa, Homo sapiens
RLPRRPHSPRARRPGWTLLARGAMSRSLDSARSFLERLEARGGREGAVLAGEFSKRCERYWAQEQEPLQTGLFCITLIKEKWLNEDIMLRTLKVTFQKESRSVYQLQYMSWPDRGVPSSPDHMLAMVEEARRLQGSGPEPLCVHCSAGCGRTGVLCTVDYVRQLLLTQMIPPDFSLFDVVLKMRKQRPAAVQTEEQYRFLYHTVAQMFCSTLQNASPHYQNIKENCAPLYDDALFLRTPQALLAIPRPPGGVLRSISVPGSPGHAMADTYAVVQKRGAPAGAGSGTQTGTGTGTGARSAEEAPLYSKVTPRAQRPGAHAEDARGTLPGRVPADQSPAGSGAYEDVAGGAQTGGLGFNLRIGRPKGPRDPPAEWTRV

SEQ ID NO: 908334 - protein, 566 aa, Homo sapiens
RLPRRPHSPRARRPGWTLLARGAMSRSLDSARSFLERLEARGGREGAVLAGEFSDIQACSAAWKADGVCSTVAGSRPENVRKNRYKDVLPYDQTRVILSLLQEEGHSDYINGNFIRGVDGSLAYIATQGPLPHTLLDFWRLVWEFGVKVILMACREIENGRKRCERYWAQEQEPLQTGLFCITLIKEKWLNEDIMLRTLKVTFQKESRSVYQLQYMSWPDRGVPSSPDHMLAMVEEARRLQGSGPEPLCVHCSAGCGRTGVLCTVDYVRQLLLTQVRYRHPVCAVCCPGPRVLLKCLVCLPQMIPPDFSLFDVVLKMRKQRPAAVQTEEQYRFLYHTVAQMFCSTLQNASPHYQNIKENCAPLYDDALFLRTPQALLAIPRPPGGVLRALGTQKRGLQPKEPSLPSSAPPRREGSPWFARWAASPLPPCPAPPFHFLPALPACRSISVPGSPGHAMADTYAVVQKRGAPAGAGSGTQTGTGTGTGARSAEEAPLYSKVTPRAQRPGAHAEDARGTLPGRVPADQSPAGSGAYEDVAGGAQTGGLGFNLRIGRPKGPRDPPAEWTRV

SEQ ID NO: 908335 - protein, 316 aa, Homo sapiens; identical to SEQ ID NO: 908319

SEQ ID NO: 908336 - protein, 316 aa, Homo sapiens; identical to SEQ ID NO: 908319

SEQ ID NO: 908337 - protein, 316 aa, Homo sapiens; identical to SEQ ID NO: 908319

SEQ ID NO: 908338 - protein, 316 aa, Homo sapiens; identical to SEQ ID NO: 908319

SEQ ID NO: 908339 - protein, 316 aa, Homo sapiens; identical to SEQ ID NO: 908319

SEQ ID NO: 908340 - protein, 181 aa, Homo sapiens
RLPRRPHSPRARRPGWTLLARGAMSRSLDSARSFLERLEARGGREGAVLAGEFSDIQACSAAWKADGVCSTVAGSRPENVRKNRYKDVLPYDQTRVILSLLQEEGHSDYINGNFIRGVDGSLAYIATQGPLPHTLLDFWRLVWEFGVKVILMACREIENGRVGALCPQVSCPCGRREEGSC

SEQ ID NO: 908341 - protein, 151 aa, Homo sapiens; identical to SEQ ID NO: 908329

SEQ ID NO: 908342 - protein, 165 aa, Homo sapiens; identical to SEQ ID NO: 879533

SEQ ID NO: 908343 - protein, 165 aa, Homo sapiens; identical to SEQ ID NO: 879533

SEQ ID NO: 908344 - protein, 165 aa, Homo sapiens; identical to SEQ ID NO: 879533

SEQ ID NO: 908345 - protein, 165 aa, Homo sapiens; identical to SEQ ID NO: 879533

SEQ ID NO: 908346 - protein, 165 aa, Homo sapiens; identical to SEQ ID NO: 879533

SEQ ID NO: 908347 - protein, 147 aa, Homo sapiens
MVNPTVFFDIAVDGEPLGRVSFELFADKVPKTAGFHRIIPGFMCQGGDFTRHNGTGGKSIYGEKFEDENFILKHTGPGILSMANAGPNTNGSQFFICTAKTEWLDGKHVVFGKVKEGMNIVEAMERFGSRNGKTSKKITIADCGQLE

SEQ ID NO: 908348 - protein, 189 aa, Homo sapiens
MGGNKENMEPKGNCSESTKILGYCEQMGWRGALLSYRRNDLVVKIKHKSNLFELSTVSNGDLLAGLAIPGPKALHGFHRIIPGFMCQGGDFTRHNGTGGKSIYGEKFEDENFILKHTGPGILSMANAGPNTNGSQFFICTAKTEWLDGKHVVFGKVKEGMNIVEAMERFGSRNGKTSKKITIADCGQLE

SEQ ID NO: 908349 - protein, 165 aa, Homo sapiens; identical to SEQ ID NO: 879533

SEQ ID NO: 908350 - protein, 165 aa, Homo sapiens; identical to SEQ ID NO: 879533

SEQ ID NO: 908351 - protein, 165 aa, Homo sapiens; identical to SEQ ID NO: 879533

SEQ ID NO: 908352 - protein, 165 aa, Homo sapiens; identical to SEQ ID NO: 879533

SEQ ID NO: 908353 - protein, 160 aa, Homo sapiens
MVNPTVFFDIAVDGEPLGRVSFELFADKVPKTAENFRALSTGEKGFGYKGSCFHRIIPGFMCQGGDFTRHNGTGGKSIYGEKFEDENFILKHTGPGILSMANAGPNTNGSQFFICTAKTEWLDGKHVVFGKVKEGMNIVEAMERFGSHATWPPCTKGQEK

SEQ ID NO: 908354 - protein, 106 aa, Homo sapiens
MVNPTVFFDIAVDGEPLGRVSFELFADKVPKTAENFRALSTGEKGFGYKGSCFHRIIPGFMCQGGDFTRHNGTGGKSIYGEKFEYCGGHGALWVQEWQDQQEDHHC

SEQ ID NO: 908355 - protein, 353 aa, Homo sapiens
MAMTLLEDWCRGMDVNSQRALLVWGIPVNCDEAEIEETLQAAMPQVSYRMLGRMFWREENAKAALLELTGAVDYAAIPREMPGKGGVWKVLFKPPTSDAEFLERLHLFLAREGWTVQDVARVLGFQNPTPTPGPEMPAEMLNYILDNVIQPLVESIWYKRLTLFSGRDIPGPGEETFDPWLEHTNEVLEEWQVSDVEKRRRLMESLRGPAADVIRILKSNNPAITTAECLKALEQVFGSVESSRDAQIKFLNTYQNPGEKLSAYVIRLEPLLQKVVEKGAIDKDNVNQARLEQVIAGANHSGAIRRQLWLTGAGEGPAPNLFQLLVQIREEEAKEEEEEAEATLLQLGLEGHF

SEQ ID NO: 908356 - protein, 201 aa, Homo sapiens
GKFDPRQTAVKRGQPVGLSCPEDSHPAWEMQLSLGFSLSVVLASSLAVGGALYAYSPAADVIRILKSNNPAITTAECLKALEQVFGSVESSRDAQIKFLNTYQNPGEKLSAYVIRLEPLLQKVVEKGAIDKDNVNQARLEQVIAGANHSGAIRRQLWLTGAGEGPAPNLFQLLVQIREEEAKEEEEEAEATLLQLGLEGHF

SEQ ID NO: 908357 - protein, 353 aa, Homo sapiens; identical to SEQ ID NO: 908355

SEQ ID NO: 908358 - protein, 353 aa, Homo sapiens; identical to SEQ ID NO: 908355

SEQ ID NO: 908359 - protein, 353 aa, Homo sapiens; identical to SEQ ID NO: 908355

SEQ ID NO: 908360 - protein, 1488 aa, Homo sapiens
MEQLPGVPPGPPHPVRPPPPPPPPMPLQLEAHLRSHGLEPAAPSPRLRPEESLDPPGAMQELLGALEPLPPAPGDTGVGPPNSEGKDPAGAYRSPSPQGTKAPRFVPLTSICFPDSLLQDEERSFFPTMEEMFGGGAADDYGKAGPPEDEGDPKAGAGPPPGPPAYDPYGPYCPGRASGAGPETPGLGLDPNKPPELPSTVNAEPLGLIQSGPHQAAPPPPPPPPPPPAPASEPKGGLTSPIFCSTKPKKLLKTSSFHLLRRRDPPFQTPKKLYAQEYEFEADEDKADVPADIRLNPRRLPDLVSSCRSRPALSPLGDIDFCPPNPGPDGPRRRGRKPTKAKRDGPPRPRGRPRIRPLEVPTTAGPASASTPTDGAKKPRGRGRGRGRKAEEAGGTRLEPLKPLKIKLSVPKAGEGLGTSSGDAISGTDHNSLDSSLTREKIEAKIKEVEEKQPEMKSGFMASFLDFLKSGKRHPPLYQAGLTPPLSPPKSVPPSVPARGLQPQPPATPAVPHPPPSGAFGLGGALEAAESEGLGLGCPSPCKRLDEELKRNLETLPSFSSDEEDSVAKNRDLQESISSAISALDDPPLAGPKDTSTPDGPPLAPAAAVPGPPPLPGLPSANSNGTPEPPLLEEKPPPTPPPAPTPQPQPPPPPPPPQPALPSPPPLVAPTPSSPPPPPLPPPPPPAMPSPPPPPPPAAAPLAAPPEEPAAPSPEDPELPDTRPLHLAKKQETAAVCGETDEEAGESGGEGIFRERDEFVIRAEDIPSLKLALQTGREPPPIWRVQKALLQKFTPEIKDGQRQFCATSNYLGYFGDAKNRYQRLYVKFLENVNKKDYVRVCARKPWHRPPVPVRRSGQAKNPVSAGGSSAPPPKAPAPPPKPETPEKTTSEKPPEQTPETAMPEPPAPEKPSLLRPVEKEKEKEKVTRGERPLRGERATSGRQTRPERSLATGQPATSRLPKARPTKVKAEPPPKKRKKWLKEAGGNATAGGGPPGSSSDSESSPGAPSEDERAVPGRLLKTRAMREMYRSYVEMLVSTALDPDMIQALEDTHDELYLPPMRKIDGLLNEHKKKVLKRLSLSPALQDALHTFPQLQVEQSGEGSPEEGAVRLRPAGEPYNRKTLSKLKRSVVRAQEFKVELEKSGYYTLYHSLHHYKYHTFLRCRDQTLAIEGGAEDLGQEEVVQQCMRNQPWLEQLFDSFSDLLAQAQAHSRCGDPAPACEGGASSMNRELGQNRVLKELTPGLHRRGKGVMGQGVSVLPPPGQEFKVRLPAPAKKPLSAGPQPPRLRHSFSLWLVSQTVSLSPCPDPPSTATAPAPSTLYIMYEEKSMYGWGGWGGFRELGDPFPPSPPCRPRSLLKAIPSAGHLASGGRGKRILLIIFNLIYCTYLGQGLGEVEGGEGSPLSAPPTPFLRRFVCVWPPPTAHPPLLSGCGSIFYRSPFPSSPFSPPPHPLLPLPFVSCSFLGFCTTQLVYTVYTQPAKRKPNGKH

SEQ ID NO: 908361 - protein, 353 aa, Homo sapiens; identical to SEQ ID NO: 908355

SEQ ID NO: 908362 - protein, 353 aa, Homo sapiens; identical to SEQ ID NO: 908355

SEQ ID NO: 908363 - protein, 178 aa, Homo sapiens
ISGHQLMSLSTADAKKDPSCKTCNISGALYAYSPAADVIRILKSNNPAITTAECLKALEQVFGSVESSRDAQIKFLNTYQNPGEKLSAYVIRLEPLLQKVVEKGAIDKDNVNQARLEQVIAGANHSGAIRRQLWLTGAGEGPAPNLFQLLVQIREEEAKEEEEEAEATLLQLGLEGHF

SEQ ID NO: 908364 - protein, 848 aa, Homo sapiens
PGGAVSPRVSRSFLHCLCLYNRGRRWTELIRTMESRVLLRTFCLIFGLGAVWGLGVDPSLQIDVLTELELGESTTGVRQVPGLHNGTKAFLFQDTPRSIKASTATAEQFFQKLRNKHEFTILVTLKQTHLNSGVILSIHHLDHRYLELESSGHRNEVRLHYRSGSHRPHTEVFPYILADDKWHKLSLAISASHLILHIDCNKIYERVVEKPSTDLPLGTTFWLGQRNNAHGYFKGIMQDVQLLVMPQGFIAQCPDLNRTCPTCNDFHGLVQKIMELQDILAKTSAKLSRAEQRMNRLDQCYCERTCTMKGTTYREFESWIDGCKNCTCLNGTIQCETLICPNPDCPLKSALAYVDGKCCKECKSICQFQGRTYFEGERNTVYSSSGVCVLYECKDQTMKLVESSGCPALDCPESHQITLSHSCCKVCKGYDFCSERHNCMENSICRNLNDRAVCSCRDGFRALREDNAYCEDIDECAEGRHYCRENTMCVNTPGSFMCICKTGYIRIDDYSCTEHDECITNQHNCDENALCFNTVGGHNCVCKPGYTGNGTTCKAFCKDGCRNGGACIAANVCACPQGFTGPSCETDIDECSDGFVQCDSRANCINLPGWYHCECRDGYHDNGMFSPSGESCEDIDECGTGRHSCANDTICFNLDGGYDCRCPHGKNCTGDCIHDGKVKHNGQIWVLENDRCSVCSCQNGFVMCRRMVCDCENPTVDLFCCPECDPRLSSQCLHQNGETLYNSGDTWVQNCQQCRCLQGEVDCWPLPCPDVECEFSILPENECCPRCVTDPCQADTIRNDITKTCLDEMNVVRFTGSSWIKHGTECTLCQCKNGHICCSVDPQCLQEL

SEQ ID NO: 908365 - protein, 815 aa, Homo sapiens
METGLGAPLFKAWLLISVWGLGVDPSLQIDVLTELELGESTTGVRQVPGLHNGTKAFLFQDTPRSIKASTATAEQFFQKLRNKHEFTILVTLKQTHLNSGVILSIHHLDHRYLELESSGHRNEVRLHYRSGSHRPHTEVFPYILADDKWHKLSLAISASHLILHIDCNKIYERVVEKPSTDLPLGTTFWLGQRNNAHGYFKGIMQDVQLLVMPQGFIAQCPDLNRTCPTCNDFHGLVQKIMELQDILAKTSAKLSRAEQRMNRLDQCYCERTCTMKGTTYREFESWIDGCKNCTCLNGTIQCETLICPNPDCPLKSALAYVDGKCCKECKSICQFQGRTYFEGERNTVYSSSGVCVLYECKDQTMKLVESSGCPALDCPESHQITLSHSCCKVCKGYDFCSERHNCMENSICRNLNDRAVCSCRDGFRALREDNAYCEDIDECAEGRHYCRENTMCVNTPGSFMCICKTGYIRIDDYSCTEHDECITNQHNCDENALCFNTVGGHNCVCKPGYTGNGTTCKAFCKDGCRNGGACIAANVCACPQGFTGPSCETDIDECSDGFVQCDSRANCINLPGWYHCECRDGYHDNGMFSPSGESCEDIDECGTGRHSCANDTICFNLDGGYDCRCPHGKNCTGDCIHDGKVKHNGQIWVLENDRCSVCSCQNGFVMCRRMVCDCENPTVDLFCCPECDPRLSSQCLHQNGETLYNSGDTWVQNCQQCRCLQGEVDCWPLPCPDVECEFSILPENECCPRCVTDPCQADTIRNDITKTCLDEMNVVRFTGSSWIKHGTECTLCQCKNGHICCSVDPQCLQEL

SEQ ID NO: 908366 - protein, 761 aa, Homo sapiens
LTLEDPDTPRSIKASTATAEQFFQKLRNKHEFTILVTLKQTHLNSGVILSIHHLDHRYLELESSGHRNEVRLHYRSGSHRPHTEVFPYILADDKWHKLSLAISASHLILHIDCNKIYERVVEKPSTDLPLGTTFWLGQRNNAHGYFKGIMQDVQLLVMPQGFIAQCPDLNRTCPTCNDFHGLVQKIMELQDILAKTSAKLSRAEQRMNRLDQCYCERTCTMKGTTYREFESWIDGCKNCTCLNGTIQCETLICPNPDCPLKSALAYVDGKCCKECKSICQFQGRTYFEGERNTVYSSSGVCVLYECKDQTMKLVESSGCPALDCPESHQITLSHSCCKVCKGYDFCSERHNCMENSICRNLNDRAVCSCRDGFRALREDNAYCEDIDECAEGRHYCRENTMCVNTPGSFMCICKTGYIRIDDYSCTEHDECITNQHNCDENALCFNTVGGHNCVCKPGYTGNGTTCKAFCKDGCRNGGACIAANVCACPQGFTGPSCETDIDECSDGFVQCDSRANCINLPGWYHCECRDGYHDNGMFSPSGESCEDIDECGTGRHSCANDTICFNLDGGYDCRCPHGKNCTGDCIHDGKVKHNGQIWVLENDRCSVCSCQNGFVMCRRMVCDCENPTVDLFCCPECDPRLSSQCLHQNGETLYNSGDTWVQNCQQCRCLQGEVDCWPLPCPDVECEFSILPENECCPRCVTDPCQADTIRNDITKTCLDEMNVVRFTGSSWIKHGTECTLCQCKNGHICCSVDPQCLQEL

SEQ ID NO: 908367 - protein, 222 aa, Homo sapiens
CCFFLSIDIDECGTGRHSCANDTICFNLDGGYDCRCPHGKNCTGDCIHDGKVKHNGQIWVLENDRCSVCSCQNGFVMCRRMVCDCENPTVDLFCCPECDPRLSSQCLHQNGETLYNSGDTWVQNCQQCRCLQGEVDCWPLPCPDVECEFSILPENECCPRCVTDPCQADTIRNDITKTCLDEMNVVRFTGSSWIKHGTECTLCQCKNGHICCSVDPQCLQEL

SEQ ID NO: 908368 - protein, 673 aa, Homo sapiens
MESRVLLRTFCLIFGLGAVWGLGVDPSLQIDVLTELELGESTTGVRQVPGLHNGTKAFLFQDTPRSIKASTATAEQFFQKLRNKHEFTILVTLKQTHLNSGVILSIHHLDHRYLELESSGHRNEVRLHYRSGSHRPHTEVFPYILADDKWHKLSLAISASHLILHIDCNKIYERVVEKPSTDLPLGTTFWLGQRNNAHGYFKGIMQDVQLLVMPQGFIAQCPDLNRTCPTCNDFHGLVQKIMELQDILAKTSAKLSRAEQRMNRLDQCYCERTCTMKGTTYREFESWIDGCKNCTCLNGTIQCETLICPNPDCPLKSALAYVDGKCCKECKSICQFQGRTYFEGERNTVYSSSGVCVLYECKDQTMKLVESSGCPALDCPESHQITLSHSCCKVCKGYDFCSERHNCMENSICRNLNDRAVCSCRDGFRALREDNAYCEDIDECAEGRHYCRENTMCVNTPGSFMCICKTGYIRIDDYSCTEHDECITNQHNCDENALCFNTVGGHNCVCKPGYTGNGTTCKAFCKDGCRNGGACIAANVCACPQGFTGPSCETDIDECSDGFVQCDSRANCINLPGWYHCECRDGYHDNGMFSPSGESCEDIDECGTGRHSCANDTICFNLDGGYDCRCPHGKNCTGDCIHDGKVKHNGQIWVLENDRCSVCSCQVGINEKL

SEQ ID NO: 908369 - protein, 367 aa, Homo sapiens
MESRVLLRTFCLIFGLGAVWGLGVDPSLQIDVLTELELGESTTGVRQVPGLHNGTKAFLFQDTPRSIKASTATAEQFFQKLRNKHEFTILVTLKQTHLNSGVILSIHHLDHRYLELESSGHRNEVRLHYRSGSHRPHTEVFPYILADDKWHKLSLAISASHLILHIDCNKIYERVVEKPSTDLPLGTTFWLGQRNNAHGYFKGIMQDVQLLVMPQGFIAQCPDLNRTCPTCNDFHGLVQKIMELQDILAKTSAKLSRAEQRMNRLDQCYCERTCTMKGTTYREFESWIDGCKNCTCLNGTIQCETLICPNPDCPLKSALAYVDGKCCKECKCEHNFYDEYFLWKNKARCGRNKQHNHKSIHRLICQP

SEQ ID NO: 908370 - protein, 176 aa, Homo sapiens
MESRVLLRTFCLIFGLGAVWGLGVDPSLQIDVLTELELGESTTGVRQVPGLHNGTKAFLFQDTPRSIKASTATAEQFFQKLRNKHEFTILVTLKQTHLNSGVILSIHHLDHRYLELESSGHRNEVRLHYRSGSHRPHTEVFPYILADDKWHKLSLAISASHLILHIDCNNVSSRVG

SEQ ID NO: 908371 - protein, 193 aa, Homo sapiens
MTNRVSDSDPPIQNFKLQELFFIYPPVQGIMQDVQLLVMPQGFIAQCPDLNRTCPTCNDFHGLVQKIMELQDILAKTSAKLSRAEQRMNRLDQCYCERTCTMKGTTYREFESWIDGCKNCTCLNGTIQCETLICPNPDCPLKSALAYVDGKCCKECKCEHNFYDEYFLWKNKARCGRNKQHNHKSIHRLICQP

SEQ ID NO: 908372 - protein, 816 aa, Homo sapiens
MESRVLLRTFCLIFGLGAVWGLGVDPSLQIDVLTELELGESTTGVRQVPGLHNGTKAFLFQDTPRSIKASTATAEQFFQKLRNKHEFTILVTLKQTHLNSGVILSIHHLDHRYLELESSGHRNEVRLHYRSGSHRPHTEVFPYILADDKWHKLSLAISASHLILHIDCNKIYERVVEKPSTDLPLGTTFWLGQRNNAHGYFKGIMQDVQLLVMPQGFIAQCPDLNRTCPTCNDFHGLVQKIMELQDILAKTSAKLSRAEQRMNRLDQCYCERTCTMKGTTYREFESWIDGCKNCTCLNGTIQCETLICPNPDCPLKSALAYVDGKCCKECKSICQFQGRTYFEGERNTVYSSSGVCVLYECKDQTMKLVESSGCPALDCPESHQITLSHSCCKVCKGYDFCSERHNCMENSICRNLNDRAVCSCRDGFRALREDNAYCEDIDECAEGRHYCRENTMCVNTPGSFMCICKTGYIRIDDYSCTEHDECITNQHNCDENALCFNTVGGHNCVCKPGYTGNGTTCKAFCKDGCRNGGACIAANVCACPQGFTGPSCETDIDECSDGFVQCDSRANCINLPGWYHCECRDGYHDNGMFSPSGESCEDIDECGTGRHSCANDTICFNLDGGYDCRCPHGKNCTGDCIHDGKVKHNGQIWVLENDRCSVCSCQNGFVMCRRMVCDCENPTVDLFCCPECDPRLSSQCLHQNGETLYNSGDTWVQNCQQCRCLQGEVDCWPLPCPDVECEFSILPENECCPRCVTDPCQADTIRNDITKTCLDEMNVVRFTGSSWIKHGTECTLCQCKNGHICCSVDPQCLQEL

SEQ ID NO: 908373 - protein, 285 aa, Homo sapiens
DIAVLEDPSRPCPQGFTGPSCETDIDECSDGFVQCDSRANCINLPGWYHCECRDGYHDNGMFSPSGESCEDIDECGTGRHSCANDTICFNLDGGYDCRCPHGKNCTGDCIHDGKVKHNGQIWVLENDRCSVCSCQNGFVMCRRMVCDCENPTVDLFCCPECDPRLSSQCLHQNGETLYNSGDTWVQNCQQCRCLQGEVDCWPLPCPDVECEFSILPENECCPRCVTDPCQADTIRNDITKTCLDEMNVVRFTGSSWIKHGTECTLCQCKNGHICCSVDPQCLQEL

SEQ ID NO: 908374 - protein, 349 aa, Homo sapiens
MESRVLLRTFCLIFGLGAVWGLGVDPSLQIDVLTELELGESTTGVRQVPGLHNGTKAFLFQDTPRSIKASTATAEQFFQKLRNKHEFTILVTLKQTHLNSGVILSIHHLDHRYLELESSGHRNEVRLHYRSGSHRPHTEVFPYILADDKWHKLSLAISASHLILHIDCNKIYERVVEKPSTDLPLGTTFWLGQRNNAHGYFKGIMQDVQLLVMPQGFIAQCPDLNRTCPTCNDFHGLVQKIMELQDILAKTSAKLSRAEQRMNRLDQCYCERTCTMKGTTYREFESWIDGCKNCTCLNGTIQCETLICPNPDCPLKSALAYVDGKCCKECKCEHNFYDEYFLWKNKALY

SEQ ID NO: 908375 - protein, 230 aa, Homo sapiens
MESRVLLRTFCLIFGLGAVWGLGVDPSLQIDVLTELELGESTTGVRQVPGLHNGTKAFLFQDTPRSIKASTATAEQFFQKLRNKHEFTILVTLKQTHLNSGVILSIHHLDHRYLELESSGHRNEVRLHYRSGSHRPHTEVFPYILADDKWHKLSLAISASHLILHIDCNKIYERVVEKPSTDLPLGTTFWLGQRNNAHGYFKGIMQDVQLLVMPQGFIAQCPDLNRTSSN

SEQ ID NO: 908376 - protein, 151 aa, Homo sapiens
PGGAVSPRVSRSFLHCLCLYNRFGRRGRRGGAGPPQPGLSWGRPPSTGCASLWLLLFGSGANSPTEPRRGESDPSLRAPSGPRCRLGPACGNDVRIGGSKFFTRLGRPPFSFLGNQSVLILLISKSEAAAGETNVIFPLDSKNLFDFYFYF

SEQ ID NO: 908377 - protein, 122 aa, Homo sapiens
GGGTEKLKRKWRTACAGGVMERQQQQQQQLRNLRDFLLVYNRMTELCFQRCVPSLHHRALDAEEEACLHSCAGKLIHSNHRLMAAYVQLMPALVQRRIADYEAASAVPGVAAEQPGVSPSGS

SEQ ID NO: 908378 - protein, 90 aa, Homo sapiens
GGGTEKLKRKWRTACAGGVMERQQQQQQQLRNEACLHSCAGKLIHSNHRLMAAYVQLMPALVQRRIADYEAASAVPGVAAEQPGVSPSGS

SEQ ID NO: 908379 - protein, 122 aa, Homo sapiens; identical to SEQ ID NO: 908377

SEQ ID NO: 908380 - protein, 122 aa, Homo sapiens; identical to SEQ ID NO: 908377

SEQ ID NO: 908381 - protein, 99 aa, Homo sapiens
QQQQQQLRNLRDFLLVYNRMTELCFQRCVPSLHHRALDAEEEACLHSCAGKLIHSNHRLMAAYVQLMPALVQRRIADYEAASAVPGVAAEQPGVSPSGS

SEQ ID NO: 908382 - protein, 122 aa, Homo sapiens; identical to SEQ ID NO: 908377

SEQ ID NO: 908383 - protein, 122 aa, Homo sapiens; identical to SEQ ID NO: 908377

SEQ ID NO: 908384 - protein, 337 aa, Homo sapiens [sequence omitted]

SEQ ID NO: 908385 - protein, 337 aa, Homo sapiens [sequence omitted]

SEQ ID NO: 908386 - protein, 200 aa, Homo sapiens
MRSKSRSDWPKKTAILGSNSIVTQLKLASPPCLPFHASVLTQTWGRLPHCGLVLGPALLSFLKHAQLPFRQFLSWAYVKMAASVLNTVLRRLPMLSLFRGSHRVQVPLQTLCTKAPSEEDSLSSVPISPYKDEPWKYLESEEYQERYGSRPVWADYRRNHKGGVPPQRTRKTCIRRNKVVGNPCPICRDHKLHVDFRESV

SEQ ID NO: 908387 - protein, 148 aa, Homo sapiens
FLDHLSVIWVEYPIIVLAFDLVRGLKYSSYQSHHRCESQVLQAIQKAWDHGLLIYHIPQVEPRDLDFSTSHGAVSATPPAPTLVSGDPWYPWYNWKQPPERELSRLRRLYQGHLQEESGPPPESMPKMPPRTPAEASSTGQTGPQSAL

SEQ ID NO: 908388 - protein, 134 aa, Homo sapiens
DRAAVTPLGSGLNLLGFTRALIASARALMAWIVCIFFRPFLLCFLAKRMFLRNLGSTPLRDSYSLSSVPISPYKDEPWKYLESEEYQERYGSRPVWADYRRNHKGGVPPQRTRKTCIEAEVAVSCSHTPALQPG

SEQ ID NO: 908389 - protein, 211 aa, Homo sapiens
MRSKSRSDWPKKTAILGSNSIVTQLKLASPPCLPFHASVLTQTWGRLPHCGLVLGPALLSFLKHAQLPFRQFLSWAYVKMAASVLNTVLRRLPMLSLFRGSHRVQVPLQTLCTKAPSEEDSLSSVPISPYKDEPWKYLESEEYQERYGSRPVWADYRRNHKGGVPPQRTRKTCIRRNKVVGNPCPICRRLGRELEGLGDNVYVGLCDGISP

SEQ ID NO: 908390 - protein, 154 aa, Homo sapiens
MRSKSRSDWPKKTAILGSNSIVTQLKLASPPCLPFHASVLTQTWGRLPHCGLVLGPALLSFLKHAQLPFRQFLSWAYVKMAASVLNTVLRRLPMLSLFRGSHRVQVPLQTLCTKAPSEEDSLSSVPISPYKDEPWKYLESEGTSKGGKGGSDRI

SEQ ID NO: 908391 - protein, 125 aa, Homo sapiens
QDIFLPTGVCVKQHKRLTQAIQKARDHGLLIYHIPQVEPRDLDFSTSHGAVSATPPAPTLVSGDPWYPWYNWKQPPERELSRLRRLYQGHLQEESGPPPESMPKMPPRTPAEASSTGQTGPQSAL

SEQ ID NO: 908392 - protein, 191 aa, Homo sapiens
MRSKSRSDWPKKTAILGSNSIVTQLKLASPPCLPFHASVLTQTWGRLPHCGLVLGPALLSFLKHAQLPFRQFLSWAYVKMAASVLNTVLRRLPMLSLFRGSHRVQVPLQTLCTKAPSEEDSLSSVPISPYKDEPWKYLESEEYQERYGSRPVWADYRRNHKGGVPPQRTRKTCIEAEVAVSCSHTPALQPG

SEQ ID NO: 908393 - protein, 439 aa, Homo sapiens
SYERGACAEDPHQGAGCSCGSRAMAEEQGRERDSVPKPSVLFLHPDLGVGGAERLVLDAALALQARGCSVKIWTAHYDPGHCFAESRELPVRCAGDWLPRGLGWGGRGAAVCAYVRMVFLALYVLFLADEEFDVVVCDQVSACIPVFRLARRRKKILFYCHFPDLLLTKRDSFLKRLYRAPIDWIEEYTTGMADCILVNSQFTAAVFKETFKSLSHIDPDVLYPSLNVTSFDSVVPEKLDDLVPKGKKFLLLSINRYERKKNLTLALEALVQLRGRLTSQDWERVHLIVAGGYDERVLENVEHYQELKKMVQQSDLGQYVTFLRSFSDKQKISLLHSCTCVLYTPSNEHFGIVPLEAMYMQCPVIAVNSGGPLESIDHSVTGFLCEPDPVHFSEAIEKFIREPSLKATMGLAGRARVKEKFSPEAFTEQLYRYVTKLLV

SEQ ID NO: 908394 - protein, 439 aa, Homo sapiens; identical to SEQ ID NO: 908393

SEQ ID NO: 908395 - protein, 492 aa, Homo sapiens
SYERGACAEDPHQGAGCSCGSRAMAEEQGRERDSVPKPSVLFLHPDLGVGGAERLVLDAALALQARGCSVKIWTAHYDPGHCFAESRELPVRCAGDWLPRGLGWGGRGAAVCAYVRMVFLALYVLFLADEEFDVVVCDQAICIPLSLCSEPGHTVLSSVMCEKRQAEYIMPLLKLVHGSPLVFGEKFKLFTLVSACIPVFRLARRRKKILFYCHFPDLLLTKRDSFLKRLYRAPIDWIEEYTTGMADCILVNSQFTAAVFKETFKSLSHIDPDVLYPSLNVTSFDSVVPEKLDDLVPKGKKFLLLSINRYERKKNLTLALEALVQLRGRLTSQDWERVHLIVAGGYDERVLENVEHYQELKKMVQQSDLGQYVTFLRSFSDKQKISLLHSCTCVLYTPSNEHFGIVPLEAMYMQCPVIAVNSGGPLESIDHSVTGFLCEPDPVHFSEAIEKFIREPSLKATMGLAGRARVKEKFSPEAFTEQLYRYVTKLLV

SEQ ID NO: 908396 - protein, 480 aa, Homo sapiens
SYERGACAEDPHQGAGCSCGSRAMAEEQGRERDSVPKPSVLFLHPDLGVGGAERLVLDAALALQARGCSVKIWTAHYDPGHCFAESRELPVRCAGDWLPRGLGWGGRGAAVCAYVRMVFLALYVLFLADEEFDVVVCDQATPSSAVSCVKNAKLNISCPYYKLVHGSPLVFGEKFKLFTLVSACIPVFRLARRRKKILFYCHFPDLLLTKRDSFLKRLYRAPIDWIEEYTTGMADCILVNSQFTAAVFKETFKSLSHIDPDVLYPSLNVTSFDSVVPEKLDDLVPKGKKFLLLSINRYERKKNLTLALEALVQLRGRLTSQDWERVHLIVAGGYDERVLENVEHYQELKKMVQQSDLGQYVTFLRSFSDKQKISLLHSCTCVLYTPSNEHFGIVPLEAMYMQCPVIAVNSGGPLESIDHSVTGFLCEPDPVHFSEAIEKFIREPSLKATMGLAGRARVKEKFSPEAFTEQLYRYVTKLLV

SEQ ID NO: 908397 - protein, 439 aa, Homo sapiens; identical to SEQ ID NO: 908393

SEQ ID NO: 908398 - protein, 323 aa, Homo sapiens
MPLLKLVHGSPLVFGEKFKLFTLVSACIPVFRLARRRKKILFYCHFPDLLLTKRDSFLKRLYRAPIDWIEEYTTGMADCILVNSQFTAAVFKETFKSLSHIDPDVLYPSLNVTSFDSVVPEKLDDLVPKGKKFLLLSINRYERKKNLTLALEALVQLRGRLTSQDWERVHLIVAGGYDERVLENVEHYQELKKMVQQSDLGQYVTFLRSFSDKQKISLLHSCTCVLYTPSNEHFGIVPLEAMYMQCPVIAVNSGGPLESIDHSVTGFLCEPDPVHFSEAIEKFIREPSLKATMGLAGRARVKEKFSPEAFTEQLYRYVTKLLV

SEQ ID NO: 908399 - protein, 323 aa, Homo sapiens; identical to SEQ ID NO: 908398

SEQ ID NO: 908400 - protein, 761 aa, Homo sapiens
MDSGGGSLGLHTPDSRMAHTMIMQDFVAGMAGTAHIDGDHIVVSVPEAVLVSDVVTDDGITLDHGLAAEVVHGPDIITETDVVTEGVIVPEAVLEADVAIEEDLEEDDGDHILTSELITETVRVPEQVFVADLVTGPNGHLEHVVQDCVSGVDSPTMVSEEVLVTNSDTETVIQAAGGVPGSTVTIKTEDDDDDDVKSTSEDYLMISLDDVGEKLEHMGNTPLKIGSDGSQEDAKEDGFGSEVIKVYIFKAEAEDDVEIGGTEIVTESEYTSGHSVAGVLDQSRMQREKMVYMAVKDSSQEEDDIRDERRVSRRYEDCQASGNTLDSALESRSSTAAQYLQICDGINTNKVLKQKAKKRRRGETRQWQTAVIIGPDGQPLTVYPCHICTKKFKSRGFLKRHMKNHPDHLMRKKYQCTDCDFTTNKKVSFHNHLESHKLINKVDKTHEFTEYTRRYREASPLSSNKLILRDKEPKMHKCKYCDYETAEQGLLNRHLLAVHSKNFPHVCVECGKGFRHPSELKKHMRTHTGEKPYQCQYCIFRCADQSNLKTHIKSKHGNNLPYKCEHCPQAFGDERELQRHLDLFQGHKTHQCPHCDHKSTNSSDLKRHIISVHTKDFPHKCEVCDKGFHRPSELKKHSDIHKGRKIHQCRHCDFKTSDPFILSGHILSVHTKDQPLKCKRCKRGFRQQNELKKHMKTHTGRKIYQCEYCEYSTTDASGFKRHVISIHTKDYPHRCEFCKKGFRRPSEKNQHIMRHHKEALM

SEQ ID NO: 908401 - protein, 807 aa, Homo sapiens
MDSGGGSLGLHTPDSRMAHTMIMQDFVAGMAGTAHIDGDHIVVSVPEAVLVSDVVTDDGITLDHGLAAEVVHGPDIITETDVVTEGVIVPEAVLEADVAIEEDLEEDDGDHILTSELITETVRVPEQVFVADLVTGPNGHLEHVVQDCVSGVDSPTMVSEEVLVTNSDTETVIQAAGGVPGSTVTIKTEDDDDDDVKSTSEDYLMISLDDVGEKLEHMGNTPLKIGSDGSQEDAKEDGFGSEVIKVYIFKAEAEDDVEIGGTEIVTESEYTSGHSVAGVLDQSRMQREKMVYMAVKDSSQEEDDISCAEIADEVYMEVIVGEEEGTSLPEIQLEDSDVNKTVVPVVWAAAYGDERRVSRRYEDCQASGNTLDSALESRSSTAAQYLQICDGINTNKVLKQKAKKRRRGETRQWQTAVIIGPDGQPLTVYPCHICTKKFKSRGFLKRHMKNHPDHLMRKKYQCTDCDFTTNKKVSFHNHLESHKLINKVDKTHEFTEYTRRYREASPLSSNKLILRDKEPKMHKCKYCDYETAEQGLLNRHLLAVHSKNFPHVCVECGKGFRHPSELKKHMRTHTGEKPYQCQYCIFRCADQSNLKTHIKSKHGNNLPYKCEHCPQAFGDERELQRHLDLFQGHKTHQCPHCDHKSTNSSDLKRHIISVHTKDFPHKCEVCDKGFHRPSELKKHSDIHKGRKIHQCRHCDFKTSDPFILSGHILSVHTKDQPLKCKRCKRGFRQQNELKKHMKTHTGRKIYQCEYCEYSTTDASGFKRHVISIHTKDYPHRCEFCKKGFRRPSEKNQHIMRHHKEALM

SEQ ID NO: 908402 - protein, 761 aa, Homo sapiens; identical to SEQ ID NO: 908400

SEQ ID NO: 908403 - protein, 791 aa, Homo sapiens
MDSGGGSLGLHTPDSRMAHTMIMQDFVAGMAGTAHIDGDHIVVSVPEAVLVSDVVTDDGITLDHGLAAEVVHGPDIITETDVVTEGVIVPEAVLEADVAIEEDLEEDDGDHILTSELITETVRVPEQVFVADLVTGPNGHLEHVVQDCVSGVDSPTMVSEEVLVTNSDTETVIQAAGGVPGSTVTIKTEDDDDDDVKSTSEDYLMISLDDVGEKLEHMGNTPLKIGSDGSQEDAKEDGFGSEVIKVYIFKAEAEDDVEIGGTEIVTESEYTSGHSVAGVLDQSRMQREKMVYMAVKDSSQEEDDISCAEIADEVYMEVIVGEEEGTSLPEIQLEDSDVNKTVVPVVWAAAYGNTLDSALESRSSTAAQYLQICDGINTNKVLKQKAKKRRRGETRQWQTAVIIGPDGQPLTVYPCHICTKKFKSRGFLKRHMKNHPDHLMRKKYQCTDCDFTTNKKVSFHNHLESHKLINKVDKTHEFTEYTRRYREASPLSSNKLILRDKEPKMHKCKYCDYETAEQGLLNRHLLAVHSKNFPHVCVECGKGFRHPSELKKHMRTHTGEKPYQCQYCIFRCADQSNLKTHIKSKHGNNLPYKCEHCPQAFGDERELQRHLDLFQGHKTHQCPHCDHKSTNSSDLKRHIISVHTKDFPHKCEVCDKGFHRPSELKKHSDIHKGRKIHQCRHCDFKTSDPFILSGHILSVHTKDQPLKCKRCKRGFRQQNELKKHMKTHTGRKIYQCEYCEYSTTDASGFKRHVISIHTKDYPHRCEFCKKGFRRPSEKNQHIMRHHKEALM

SEQ ID NO: 908404 - protein, 140 aa, Homo sapiens
CVCQLRFRLRLSTAVKKLPCQITSYLVAHTLGRRMLYPGSVYLLQKALMPVLLQGQARLVEECNGRRAKLLACDGNEIDTMFVDRRGTAEPQGQKLVRGSREPRGGVSVRKAVEVWGPQCYSTSLKEPLLGIISCPSSTL

SEQ ID NO: 908405 - protein, 739 aa, Homo sapiens
MSQLARRRSRYGLTSRAHNTSEAGRAGPAGGPAAGRAAARAGAMAKLLSCVLGPRLYKIYRERDSERAPASVPETPTAVTAPHSSSWDTYYQPRALEKHADSILALASVFWSISYYSSPFAFFYLYRKGYLSLSKVVPFSHYAGTLLLLLAGVACLRGIGRWTNPQYRQFITILEATHRNQSSENKRQLANYNFDFRSWPVDFHWEEPSSRKESRGGPSRRGVALLRPEPLHRGTADTLLNRVKKLPCQITSYLVAHTLGRRMLYPGSVYLLQKALMPVLLQGQARLVEECNGRRAKLLACDGNEIDTMFVDRRGTAEPQGQKLVICCEGNAGFYEVGCVSTPLEGRTVTQPPYLRPLKGNVPASHTDLTSPGLCFLWVRFLSLSALGKSPLAICFDNLTSLPWPVSLAIMLFILFHSPTTHPTQITCCSLCCLRTSGVISYFWEGLELFASKLGGTSALPSPRDGERAVGHKVSVLPPPVLQLDIQSWAGIIQALLEARGCHSRRMRLMPWMWWSSLPSTALGFQPQDIIIYAWSIGGFTATWAAMSYPDVSAMILDASFDDLVPLALKVMPDSWRGLVTRTVRQHLNLNNAEQLCRYQGPVLLIRRTKDEIITTTVPEDIMSNRGNDLLLKLLQHRYPRVMAEEGLRVVRQWLEASSQLEEASIYSRWEVEEDWCLSVLRSYQAEHGPDFPWSVGEDMSADGRRQLALFLARKHLHNFEATHCTPLPAQNFQMPWHL

SEQ ID NO: 908406 - protein, 414 aa, Homo sapiens
MSQLARRRSRYGLTSRAHNTSEAGRAGPAGGPAAGRAAARAGAMAKLLSCVLGPRLYKIYRERDSERAPASVPETPTAVTAPHSSSWDTYYQPRALEKHADSILALASVFWSISYYSSPFAFFYLYRKGYLSLSKVVPFSHYAGTLLLLLAGVACLRGIGRWTNPQYRQFITILEATHRNQSSENKRQLANYNFDFRSWPVDFHWEEPSSRKESRGGPSRRGVALLRPEPLHRGTADTLLNRVKKLPCQITSYLVAHTLGRRMLYPGSVYLLQKALMPVLLQGQARLVEECNGRRAKLLACDGNEIDTMFVDRRGTAEPQGQKLVICCEGNAGFYEVGCVSTPLEAGYSVLGWNHPGFAGSTGVPFPQNEANAMDVVVQFAIHRPGLPAPGHHHLRLVHRRLHCHVGSHVLPRC

SEQ ID NO: 908407 - protein, 414 aa, Homo sapiens; identical to SEQ ID NO: 908406

SEQ ID NO: 908408 - protein, 414 aa, Homo sapiens; identical to SEQ ID NO: 908406

SEQ ID NO: 908409 - protein, 267 aa, Homo sapiens
MRWAASPRPWKLDIQSWAGIIQALLEARGCHSRRMRLMPWMWWSSLPSTALGFQPQDIIIYAWSIGGFTATWAAMSYPDVSAMILDASFDDLVPLALKVMPDSWRGLVTRTVRQHLNLNNAEQLCRYQGPVLLIRRTKDEIITTTVPEDIMSNRGNDLLLKLLQHRYPRVMAEEGLRVVRQWLEASSQLEEASIYSRWEVEEDWCLSVLRSYQAEHGPDFPWSVGEDMSADGRRQLALFLARKHLHNFEATHCTPLPAQNFQMPWHL

SEQ ID NO: 908410 - protein, 267 aa, Homo sapiens; identical to SEQ ID NO: 908409

SEQ ID NO: 908411 - protein, 414 aa, Homo sapiens; identical to SEQ ID NO: 908406

SEQ ID NO: 908412 - protein, 193 aa, Homo sapiens [sequence omitted]

SEQ ID NO: 908413 - protein, 414 aa, Homo sapiens; identical to SEQ ID NO: 908406

SEQ ID NO: 908414 - protein, 143 aa, Homo sapiens
PGDGRGYRCCRSFSRRSLPRLDMMSSGTVVVMISSLVLLQHRYPRVMAEEGLRVVRQWLEASSQLEEASIYSRWEVEEDWCLSVLRSYQAEHGPDFPWSVGEDMSADGRRQLALFLARKHLHNFEATHCTPLPAQNFQMPWHL

SEQ ID NO: 908415 - protein, 414 aa, Homo sapiens; identical to SEQ ID NO: 908406

SEQ ID NO: 908416 - protein, 413 aa, Homo sapiens
MSQLARRRSRYGLTSRAHNTSEAGRAGPAGGPAAGRAAARAGAMAKLLSCVLGPRLYKIYRERDSERAPASVPETPTAVTAPHSSSWDTYYQPRALEKHADSILALASVFWSISYYSSPFAFFYLYRKGYLSLSKVVPFSHYAGTLLLLLAGVACLRGIGRWTNPQYRQFITILEATHRNQSSENKRQLANYNFDFRSWPVDFHWEEPSSRKESRGGPSRRGVALLRPEPLHRGTADTLLNRVKKLPCQITSYLVAHTLGRRMLYPGSVYLLQKALMPVLLQGQARLVEECNGRRAKLLACDGNEIDTMFVDRRGTAEPQGQKLVICCEGNAGFYEVGCVSTPLEAGYSVLGWNHPGFAGSTGVPFPQNEANAMDVVVQFAIHRPGLPAPGHHHLRLVHRRLHWYQPPSHPPL

SEQ ID NO: 908417 - protein, 414 aa, Homo sapiens; identical to SEQ ID NO: 908406

SEQ ID NO: 908418 - protein, 414 aa, Homo sapiens; identical to SEQ ID NO: 908406

SEQ ID NO: 908419 - protein, 267 aa, Homo sapiens; identical to SEQ ID NO: 908409

SEQ ID NO: 908420 - protein, 414 aa, Homo sapiens; identical to SEQ ID NO: 908406

SEQ ID NO: 908421 - protein, 414 aa, Homo sapiens; identical to SEQ ID NO: 908406

SEQ ID NO: 908422 - protein, 141 aa, Homo sapiens
MSQLARRRSRYGLTSRAHNTSEAGRAGPAGGPAAGRAAARAGAMAKLLSCVLGPRLYKIYRERDSERAPASVPETPTAVTAPHSSSWDTYYQPRALEKHADSILALVCLPWHLGLCISRDQLGLIMEEWGERRHEERPSYL

SEQ ID NO: 908423 - protein, 238 aa, Homo sapiens
MSEDLAKQLASYKAQLQQVEAALSGNGENEDLLKLKKDLQEVIELTKDLLSTQPSETLASSDSFASTQPTHSWKVGDKCMAVWSEDGQCYEAEIEEIDEENGTAAITFAGYGNAEVTPLLNLKPVEEGRKAKEDSGNKPMSKKEMIAQQREYKKKKALKKAQRIKELEQEREDQKVKWQQFNNRAYSKNKKGQVKRSIFASPESVTGKVGVGTCGIADKPMTQYQDTSKYNVRHLMPQ

SEQ ID NO: 908424 - protein, 238 aa, Homo sapiens; identical to SEQ ID NO: 908423

SEQ ID NO: 908425 - protein, 238 aa, Homo sapiens; identical to SEQ ID NO: 908423

SEQ ID NO: 908426 - protein, 308 aa, Homo sapiens
MSEDLAKQLASYKAQLQQVEAALSGNGENEDLLKLKKDLQWLSASPKRLPSVSRVLECTPFDLLICRSQHLMLPGIADYCNCCPSVDEGAVSELRLEGGKVINVFVFLFYEVIELTKDLLSTQPSETLASSDSFASTQPTHSWKVGDKCMAVWSEDGQCYEAEIEEIDEENGTAAITFAGYGNAEVTPLLNLKPVEEGRKAKEDSGNKPMSKKEMIAQQREYKKKKALKKAQRIKELEQEREDQKVKWQQFNNRAYSKNKKGQVKRSIFASPESVTGKVGVGTCGIADKPMTQYQDTSKYNVRHLMPQ

SEQ ID NO: 908427 - protein, 238 aa, Homo sapiens; identical to SEQ ID NO: 908423

SEQ ID NO: 908428 - protein, 238 aa, Homo sapiens; identical to SEQ ID NO: 908423

SEQ ID NO: 908429 - protein, 238 aa, Homo sapiens; identical to SEQ ID NO: 908423

SEQ ID NO: 908430 - protein, 238 aa, Homo sapiens; identical to SEQ ID NO: 908423

SEQ ID NO: 908431 - protein, 96 aa, Homo sapiens
SWYFSRDFTVSVFSSFQCPAFLPSPSPPTEFFLFRPGRLAVVAVIFLLLLLLLLPPPLPLGSFAPTPSRRPAPSPTQDVRGFSKAAGKLQSSAPAS

SEQ ID NO: 908432 - protein, 403 aa, Homo sapiens
CLGGAWEPQEMPKARQSPGARGRQAGVALPWAGLHPHTQVSGLLTPQLQEPDVWSPSRGQPVSLHLPGKGAPEVKEMAWWKSWIEQEGVTVKSSSHFNPDPDAETLYKAMKGIGTNEQAIIDVLTKRSNTQRQQIAKSFKAQFGKDLTETLKSELSGKFERLIVALMYPPYRYEAKELHDAMKGLGTKEGVIIEILASRTKNQLREIMKAYEEDYGSSLEEDIQADTSGYLERILVCLLQGSRDDVSSFVDPGLALQDAQDLYAAGEKIRGTDEMKFITILCTRSATHLLRVFEEYEKIANKSIEDSIKSETHGSLEEAMLTVVKCTQNLHSYFAERLYYAMKGAGTRDGTLIRNIVSRSEIDLNLIKCHFKKMYGKTLSSMIMEDTSGDYKNALLSLVGSDP

SEQ ID NO: 908433 - protein, 86 aa, Homo sapiens
CLGGAWEPQEMPKARQSPGARGRQAGVALPWAGLHPHTQVSGLLTPQLQEPDVWSPSRGQPVSLHLPGKGAPEVKEMAWWKSWENE

SEQ ID NO: 908434 - protein, 294 aa, Homo sapiens [sequence omitted]

SEQ ID NO: 908435 - protein, 337 aa, Homo sapiens
MQLQEAFASVFFPLLTWIEQEGVTVKSSSHFNPDPDAETLYKAMKGIGTNEQAIIDVLTKRSNTQRQQIAKSFKAQFGKDLTETLKSELSGKFERLIVALMYPPYRYEAKELHDAMKGLGTKEGVIIEILASRTKNQLREIMKAYEEDYGSSLEEDIQADTSGYLERILVCLLQGSRDDVSSFVDPGLALQDAQDLYAAGEKIRGTDEMKFITILCTRSATHLLRVFEEYEKIANKSIEDSIKSETHGSLEEAMLTVVKCTQNLHSYFAERLYYAMKGAGTRDGTLIRNIVSRSEIDLNLIKCHFKKMYGKTLSSMIMEDTSGDYKNALLSLVGSDP

SEQ ID NO: 908436 - protein, 424 aa, Homo sapiens
CLGGAWEPQEMPKARQSPGARGRQAGVALPWAGLHPHTQVSGLLTPQLQEPDVWSPSRGQPVSLHLPGKGAPEVKEMAWWKSWIEQEGVTVKSSSHFNPDPDAETLYKAMKGIGTNEQAIIDVLTKRSNTQRQQIAKSFKAQFGKDLTETLKSELSGKFERLIVALMYPPYRYEAKELHDAMKGLGTKEGVIIEILASRTKNQLREIMKAYEEDYGSSLEEDIQADTSGYLERILVCLLQGSRDDVSSFVDPGLALQDAQDLYAAGEKIRGTDEMKFITILCTRSATHLLRVFEEYEKIANKSIEDSIKSETHGSLEEAMLTVVKCTQNLHSYFAERLYYAMKEQGRVTGTWITTHRLPGPEDDLSLQHMVTSQHDVRTDPQQHEHATNNRGAYRTPARPGGPDPDGRQKADTQPRRRAPDPPA

SEQ ID NO: 908437 - protein, 133 aa, Homo sapiens
ARAQDGDEFHLISPTNLLLLRVFEEYEKIANKSIEDSIKSETHGSLEEAMLTVVKCTQNLHSYFAERLYYAMKGAGTRDGTLIRNIVSRSEIDLNLIKCHFKKMYGKTLSSMIMEDTSGDYKNALLSLVGSDP

SEQ ID NO: 908438 - protein, 313 aa, Homo sapiens
MAWWKSWIEQEGVTVKSSSHFNPDPDAETLYKAMKGIGTNEQAIIDVLTKRSNTQRQQIAKSFKAQFGKDLTETLKSELSGKFERLIVALMYPPYRYEAKELHDAMKGLGTKEGVIIEILASRTKNQLREIMKAYEEDYGSSLEEDIQADTSGYLERILVCLLQGSRDDVSSFVDPGLALQDAQDLYAAGEKIRGTDEMKFITILCTRSATHLLRVFEEYEKIANKSIEDSIKSETHGSLEEAMLTVAGVNDQTPGIGEGTLSRKGGPLPVEMSGGGILVYKLDPRSGRVNPWSPENAPPRGAARGPARLRTS

SEQ ID NO: 908439 - protein, 354 aa, Homo sapiens
CLGGAWEPQEMPKARQSPGARGRQAGVALPWAGLHPHTQVSGLLTPQLQEPDVWSPSRGQPVSLHLPGKGAPEVKEMAWWKSWIEQEGVTVKSSSHFNPDPDAETLYKAMKGIGTNEQAIIDVLTKRSNTQRQQIAKSFKAQFGKDLTETLKSELSGKFERLIVALMYPPYRYEAKELHDAMKGLGTKEGVIIEILASRTKNQLREIMKAYEEDYGSSLEEDIQADTSGYLERILVCLLQGSRDDVSSFVDPGLALQDAQDLYAAGEKIRGTDEMKFITILCTRSATHLLRVFEEYEKIANKSIEDSIKSETHGSLEEAMLTVAPSAKPRSSKPPRSSTRGSYLTQTCRGSERF

SEQ ID NO: 908440 - protein, 144 aa, Homo sapiens
NRLGTGLGCESADDEMKFITILCTRSATHLLRVFEEYEKIANKSIEDSIKSETHGSLEEAMLTVVKCTQNLHSYFAERLYYAMKGAGTRDGTLIRNIVSRSEIDLNLIKCHFKKMYGKTLSSMIMEDTSGDYKNALLSLVGSDP

SEQ ID NO: 908441 - protein, 389 aa, Homo sapiens
CLGGAWEPQEMPKARQSPGARGRQAGVALPWAGLHPHTQVSGLLTPQLQEPDVWSPSRGQPVSLHLPGKGAPEVKEMAWWKSWIEQEGVTVKSSSHFNPDPDAETLYKAMKGIGTNEQAIIDVLTKRSNTQRQQIAKSFKAQFGKDLTETLKSELSGKFERLIVALMYPPYRYEAKELHDAMKGLGTKEGVIIEILASRTKNQLREIMKAYEEDYGSSLEEDIQADTSGYLERILVCLLQGSRDDVSSFVDPGLALQDAQDLYAAGEKIRGTDEMKFITILCTRSATHLLRVFEEYEKIANKSIEDSIKSETHGSLEEAMLTVAGVNDQTPGIGEGTLSRKGGPLPVEMSGGGILVYKLDPRSGRVNPWSPENAPPRGAARGPARLRTS

SEQ ID NO: 908442 - protein, 111 aa, Homo sapiens
MTSHHCVGPGNHISWSGHEKEHRLDYCPEVTFPLTKGFPLGYTLLFNFASYPFLLPSACLLLIRRCNIEYSSTGLNFLNTFTVSLIVTVIPLLQNVPVPLGNNVGKMQVYE

SEQ ID NO: 908443 - protein, 128 aa, Homo sapiens
MTSHHCVGPGNHISWSGHEKEHRLDYCPEVTFPLTKGFPLGYTLLFNFASYPFLLPSKIKTLLRNKDSFLNILCPACLLLIRRCNIEYSSTGLNFLNTFTVSLIVTVIPLLQNVPVPLGNNVGGFFIF

SEQ ID NO: 908444 - protein, 129 aa, Homo sapiens
MTSHHCVGPGNHISWSGHEKEHRLDYCPEVTFPLTKGFPLGYTLLFNFASYPFLLPSKIKTLLRNKDSFLNILCPACLLLIRRCNIEYSSTGLNFLNTFTVSLIVTVIPLLQNVPVPLGNNVGKMQVYE

SEQ ID NO: 908445 - protein, 278 aa, Homo sapiens
SADCHKMASVAAARAVPVGSGLRGLQRTLPLVVILGATGTGKSTLALQLGQRLGGEIVSADSMQVYEGLDIITNKVSAQEQRICRHHMISFVDPLVTNYTVVDFRNRATALIEDIFARDKIPIVVGGTNYYIESLLWKVLVNTKPQEMGTEKVIDRKVELEKEDGLVLHKRLSQVDPEMAAKLHPHDKRKVARSLQVFEETGISHSEFLHRQHTEEGGGPLGGPLKFSNPCILWLHADQAVLDERLDKRVDDMLAAGLLEELRDFHRRYNQKNVSENR

SEQ ID NO: 908446 - protein, 473 aa, Homo sapiens
SADCHKMASVAAARAVPVGSGLRGLQRTLPLVVILGATGTGKSTLALQLGQRLGGEIVSADSMQVYEGLDIITNKVSAQEQRICRHHMISFVDPLVTNYTVVDFRNRATALIEDIFARDKIPIVVGGTNYYIESLLWKVLVNTKPQEMGTEKVIDRKVELEKEDGLVLHKRLSQVDPEMAAKLHPHDKRKVARSLQVFEETGISHSEFLHRQHTEEGGGPLGGPLKFSNPCILWLHADQAVLDERLDKRVDDMLAAGLLEELRDFHRRYNQKNVSENSQDYQHGIFQSIGFKEFHEYLITEGKCTLETSNQLLKKGIEALKQVTKRYARKQNRWVKNRFLSRPGPIVPPVYGLEVSDVSKWEESVLEPALEIVQSFIQGHKPTATPIKMPYNEAENKRSYHLCDLCDRIIIGDREWAAHIKSKSHLNQLKKRRRLDSDAVNTIESQSVSPDHNKEPKEKGSPGQNDQELKCSV

SEQ ID NO: 908447 - protein, 149 aa, Homo sapiens
SADCHKMASVAAARAVPVGSGLRGLQRTLPLVVILGATGTGKSTLALQLGQRLGGEIVSADSMQVYEGLDIITNKVSAQEQRICRHHMISFVDPLVTNYTVVDFRNRATALIEDIFARDKIPIVVGGTNYYIESLLWKVLVNTKELASF

SEQ ID NO: 908448 - protein, 436 aa, Homo sapiens
MASVAAARAVPVGSGLRGLQRTLPLVVILGATGTGKSTLALQLGQRLGGEIVSADSMQVYEGLDIITNKVSAQEQRICRHHMISFVDPLVTNYTVVDFRNRATALIEDIFARDKIPIVVGGTNYYIESLLWKVLVNTKPQEMGTEKVIDRKVELEKEDGLVLHKRLSQVDPEMAAKLHPHDKRKVARSLQVFEETGISHSEFLHRQHTEEGGGPLGGPLKFSNPCILWLHADQAVLDERLDKRVDDMLAAGLLEELRDFHRRYNQKNVSENSQDYQHGIFQSIGFKEFHEYLITEGKCTLETSNQLLKKGIEALKQVTKRYARKQNRWVKNRFLSRPGPIVPPVYGLEVSDVSKWEESVLEPALEIVQSFIQGHKPTATPIKMPYNEAENKRSYHLCDLCDRIIIGDREWAAHIKSKSHLNQLKKRRRLDSDAIFF

SEQ ID NO: 908449 - protein, 75 aa, Homo sapiens
SADCHKMASVAAARAVPVGSGLRGLQRTLPLVVILGATGTGKSTLALQLGQRLGGEIVSADSMQDLVPLSPLSMA

SEQ ID NO: 908450 - protein, 278 aa, Homo sapiens; identical to SEQ ID NO: 908445

SEQ ID NO: 908451 - protein, 123 aa, Homo sapiens
SADCHKMASVAAARAVPVGSGLRGLQRTLPLVVILGATGTGKSTLALQLGQRLGGEIVSADSMQVYEGLDIITNKVSAQEQRICRHHMISFVDPLVTNYTVVDFRNRATALISLGKAAAGFGG

SEQ ID NO: 908452 - protein, 71 aa, Homo sapiens
SGLRGLQRTLPLVVILGATGTGKSTLALQLGQRLGGEIVSADSMQVWQCGWPGRLGTPEAAWTPCGKGLKG

SEQ ID NO: 908453 - protein, 393 aa, Homo sapiens
SADCHKMASVAAARAVPVGSGLRGLQRTLPLVVILGATGTGKSTLALQLGQRLGGEIVSADSMQPQEMGTEKVIDRKVELEKEDGLVLHKRLSQVDPEMAAKLHPHDKRKVARSLQVFEETGISHSEFLHRQHTEEGGGPLGGPLKFSNPCILWLHADQAVLDERLDKRVDDMLAAGLLEELRDFHRRYNQKNVSENSQDYQHGIFQSIGFKEFHEYLITEGKCTLETSNQLLKKGIEALKQVTKRYARKQNRWVKNRFLSRPGPIVPPVYGLEVSDVSKWEESVLEPALEIVQSFIQGHKPTATPIKMPYNEAENKRSYHLCDLCDRIIIGDREWAAHIKSKSHLNQLKKRRRLDSDAVNTIESQSVSPDHNKEPKEKGSPGQNDQELKCSV

SEQ ID NO: 908454 - protein, 447 aa, Homo sapiens
SADCHKMASVAAARAVPVGSGLRGLQRTLPLVVILGATGTGKSTLALQLGQRLGGEIVSADSMQVYEGLDIITNKVSAQEQRICRHHMISFVDPLVTNYTVVDFRNRATALIEDIFARDKIPIVVGGTNYYIESLLWKVLVNTKPQEMGTEKVIDRKVELEKEDGLVLHKRLSQVDPEMAAKLHPHDKRKVARSLQVFEETGISHSEFLHRQHTEEGGGPLGGPLKFSNPCILWLHADQAVLDERLDKRVDDMLAAGLLEELRDFHRRYNQKNVSENSQDYQHGIFQSIGFKEFHEYLITEGKCTLETSNQLLKKGPGPIVPPVYGLEVSDVSKWEESVLEPALEIVQSFIQGHKPTATPIKMPYNEAENKRSYHLCDLCDRIIIGDREWAAHIKSKSHLNQLKKRRRLDSDAVNTIESQSVSPDHNKEPKEKGSPGQNDQELKCSV

SEQ ID NO: 908455 - protein, 221 aa, Homo sapiens
MLAAGLLEELRDFHRRYNQKNVSENSQDYQHGIFQSIGFKEFHEYLITEGKCTLETSNQLLKKGIEALKQVTKRYARKQNRWVKNRFLSRPGPIVPPVYGLEVSDVSKWEESVLEPALEIVQSFIQGHKPTATPIKMPYNEAENKRSYHLCDLCDRIIIGDREWAAHIKSKSHLNQLKKRRRLDSDAVNTIESQSVSPDHNKEPKEKGSPGQNDQELKCSV

SEQ ID NO: 908456 - protein, 281 aa, Homo sapiens
SADCHKMASVAAARAVPVGSGLRGLQRTLPLVVILGATGTGKSTLALQLGQRLGGEIVSADSMQVYEGLDIITNKVSAQEQRICRHHMISFVDPLVTNYTVVDFRNRATALIEDIFARDKIPIVVGGTNYYIESLLWKVLVNTKPQEMGTEKVIDRKVELEKEDGLVLHKRLSQVDPEMAAKLHPHDKRKVARSLQVFEETGISHSEFLHRQHTEEGGGPLGGPLKFSNPCILWLHADQAVLDERLDKRVDDMLAAGLLEELRDFHRRYNQKNVSENREMM

SEQ ID NO: 908457 - protein, 193 aa, Homo sapiens
SADCHKMASVAAARAVPVGSGLRGLQRTLPLVVILGATGTGKSTLALQLGQRLGGEIVSADSMQVYEGLDIITNKVSAQEQRICRHHMISFVDPLVTNYTVVDFRNRATALIEDIFARDKIPIVVGGTNYYIESLLWKVLVNTKPQEMGTEKVIDRKVELEKEDGLVLHKRLSQVDPEMAAKLHPHDKRKVAR

SEQ ID NO: 908458 - protein, 298 aa, Homo sapiens
MSTNGDDHQVKDSLEQLRCHFTWELSIDDDEMPDLENRVLDQIEFLDTKYSVGIHNLLAYVKHLKGQNEGKRLKEALHKKGYQKHSNWPRTRNPMTKTKPKLVDTDDPGSGTLGEPTHSMHLATLSSETPTLETHATLATAKYPKQTSPSANQSVRDREKHYSHTSEQAVEARHFPPFPRLIPTMQDDRSPQPTPRPMGETRPAASRSPHGMTNARANREHQQFSPNQSATHGHHDARDQRAEKTADPHRGPMRTHQAHHRTRQNDLRPPPQTRNRGPNNPKHPQKNQPSAPQSSLRH

SEQ ID NO: 908459 - protein, 447 aa, Homo sapiens
MPDLENRVLDQIEFLDTKYSVGIHNLLAYVKHLKGQNEEALKSLKEAENLMQEEHDNQANVRSLVTWGNFAWMYYHMGRLAEAQTYLDKVENICKKLSNPFRYRMECPEIDCEEGWALLKCGGKNYERAKACFEKVLEVDPENPESSAGYAISAYRLDGFKLATKNHKPFSLLPLRQAVRLNPDNGYIKVLLALKLQDEGQEAEGEKYIEEALANMSSQTYVFRYAAKFYRRKGSVDKALELLKKALQETPTSVLLHHQIGLCYKAQMIQIKEATKGQPRGQNREKLDKMIRSAIFHFESAVEKKPTFEVAHLDLARMYIEAGNHRKAEENFQKLLCMKPVVEETMQDIHFHYGRFQEFQKKSDVNAIIHYLKAIKIEQASLTRDKSINSLKKLVLRKLRRKALDLESLSLLGFVYKLEGNMNEALEYYERALRLAADFENSVRQGP

SEQ ID NO: 908460 - protein, 112 aa, Homo sapiens
GDSEDSGSSQMQDIHFHYGRFQEFQKKSDVNAIIHYLKAIKIEQASLTRDKSINSLKKLVLRKLRRKALDLESLSLLGFVYKLEGNMNEALEYYERALRLAADFENSVRQGP

SEQ ID NO: 908461 - protein, 478 aa, Homo sapiens
MSTNGDDHQVKDSLEQLRCHFTWELSIDDDEMPDLENRVLDQIEFLDTKYSVGIHNLLAYVKHLKGQNEEALKSLKEAENLMQEEHDNQANVRSLVTWGNFAWMYYHMGRLAEAQTYLDKVENICKKLSNPFRYRMECPEIDCEEGWALLKCGGKNYERAKACFEKVLEVDPENPESSAGYAISAYRLDGFKLATKNHKPFSLLPLRQAVRLNPDNGYIKVLLALKLQDEGQEAEGEKYIEEALANMSSQTYVFRYAAKFYRRKGSVDKALELLKKALQETPTSVLLHHQIGLCYKAQMIQIKEATKGQPRGQNREKLDKMIRSAIFHFESAVEKKPTFEVAHLDLARMYIEAGNHRKAEENFQKLLCMKPVVEETMQDIHFHYGRFQEFQKKSDVNAIIHYLKAIKIEQASLTRDKSINSLKKLVLRKLRRKALDLESLSLLGFVYKLEGNMNEALEYYERALRLAADFENSVRQGP

SEQ ID NO: 908462 - protein, 478 aa, Homo sapiens; identical to SEQ ID NO: 908461

SEQ ID NO: 908463 - protein, 478 aa, Homo sapiens; identical to SEQ ID NO: 908461

SEQ ID NO: 908464 - protein, 742 aa, Homo sapiens
MFEREYTGLPGVCWEGSIISARVRQVRSTQMETSVSVSLWMPPSQRVFTFCVCHHVFVLLGASVFVSGRVSVLDRGDFVPDGFCVRARASVHVGELGGCVSVSMAVVRYKSEHVCQGVFVPVCACLGGHSRFLPNVGQCRCAALCLETSSRAGAQGRQVAATEEPKAPGLAGKDTTSSFSPLGPARVAGKQWWPALQGAVGPRPGQPQEKEGEGRGGKGEECLAPSRLPACHWPKVPVRHGEGSSPKVLCTYRAERTAKRLLQSTGWNWQAPRAPSTRQAECAGRVPTTPTPQPLNEASRRPLAARRAPPWVRLLRRPQPVRLPARLRAMGQPGNGSAFLLAPNGSHAPDHDVTQQRDEVWVVGMGIVMSLIVLAIVFGNVLVITAIAKFERLQTVTNYFITSLACADLVMGLAVVPFGAAHILMKMWTFGNFWCEFWTSIDVLCVTASIETLCVIAVDRYFAITSPFKYQSLLTKNKARVIILMVWIVSGLTSFLPIQMHWYRATHQEAINCYANETCCDFFTNQAYAIASSIVSFYVPLVIMVFVYSRVFQEAKRQLQKIDKSEGRFHVQNLSQVEQDGRTGHGLRRSSKFCLKEHKALKTLGIIMGTFTLCWLPFFIVNIVHVIQDNLIRKEVYILLNWIGYVNSGFNPLIYCRSPDFRIAFQELLCLRRSSLKAYGNGYSSNGNTGEQSGYHVEQEKENKLLCEDLPGTEDFVGHQGTVPSDNIDSQGRNCSTNDSLL

SEQ ID NO: 908465 - protein, 259 aa, Homo sapiens
MLPSTSVNSLVQGNGVLNSRDAARHTAGAKRYKYLRRLFRFRQMDFEFAAWQMLYLFTSPQRVYRNFHYRKQTKDQWARDDPAFLVLLSIWLCVSTIGFGFVLDMGFFETIKLLLWVVLIDCVGVGLLIATLMWFISNKYLVKRQSRDYDVEWGYAFDVHLNAFYPLLVILHFIQLFFINHVILTDTFIGYLVGNTLWLVAVGYYIYVTFLGYSALPFLKNTVILLYPFAPLILLYGLSLALGWNFTHTLCSFYKYRVK

SEQ ID NO: 908466 - protein, 259 aa, Homo sapiens; identical to SEQ ID NO: 908465

SEQ ID NO: 908467 - protein, 259 aa, Homo sapiens; identical to SEQ ID NO: 908465

SEQ ID NO: 908468 - protein, 140 aa, Homo sapiens
ASLVSGVCSQIRHQGGSVKAFKSNTFLRTPQWLLTSPGIKAKDCQPCFFSGFISCSFSFRHWSFHHSSGLPGTITILGSLPCYFMTLICTIASQVCILHISLLLSLFPLPSDIGVSLSAFLPRWKAGIFVCFVYWYISRI

SEQ ID NO: 908469 - protein, 261 aa, Homo sapiens
MLPSTSVNSLVQGNGVLNSRDAARHTAGAKRYKYLRRLFRFRQMDFEFAAWQMLYLFTSPQRVYRNFHYRKQTKDQWARDDPAFLVLLSIWLCVSTIGFGFVLDMGFFETIKLLLWVVLIDCVGVGLLIATLMWFISNKYLVKRQSRDYDVEWGYAFDVHLNAFYPLLVILHFIQLFFINHVILTDTFIGYLVGNTLWLVAVGYYIYVTFLGYSVWIPFFSSIAIFEKYSNSSVSICTSDSALRAFPGTGMELHPYSLFFL

SEQ ID NO: 908470 - protein, 216 aa, Homo sapiens
MLPSTSVNSLVQGNGVLNSRDAARHTAGAKRYKYLRRLFRFRQMDFEFAAWQMLYLFTSPQRVYRNFHYRKQTKDQWARDDPAFLVLLSIWLCVSTIGFGFVLDMGFFETIKLLLWVVLIDCVGVGLLIATLMWFISNKYLVKRQSRDYDVEWGYAFDVHLNAFYPLLVILHFIQLFFINHVILTDTFIGYLVGNTLWLVAVGYYIYVTFLGYSGK

SEQ ID NO: 908471 - protein, 173 aa, Homo sapiens
MLPSTSVNSLVQGNGVLNSRDAARHTAGAKRYKYLRRLFRFRQMDFEFAAWQMLYLFTSPQRVYRNFHYRKQTKDQWARDDPAFLVLLSIWLCVSTIGFGFVLDMGFFETIKLLLWVVLIDCVGVGLLIATLMCIAIFEKYSNSSVSICTSDSALRAFPGTGMELHPYSLFFL

SEQ ID NO: 908472 - protein, 133 aa, Homo sapiens
MLPSTSVNSLVQGNGVLNSRDAARHTAGAKRYKYLRRLFRFRQMDFEFAAWQMLYLFTSPQRVYRNFHYRKQTKDQWARDDPAFLVLLSIWLCVSTIGFGFVLDMGFFETIKLLLWVVLIDCVGVGLLIATLM

SEQ ID NO: 908473 - protein, 259 aa, Homo sapiens; identical to SEQ ID NO: 908465

SEQ ID NO: 908474 - protein, 236 aa, Homo sapiens
MLPSTSVNSLVQGNGVLNSRDAARHTAGAKRYKYLRRLFRFRQMDFEFAAWQMLYLFTSPQRVYRNFHYRMSTIGFGFVLDMGFFETIKLLLWVVLIDCVGVGLLIATLMWFISNKYLVKRQSRDYDVEWGYAFDVHLNAFYPLLVILHFIQLFFINHVILTDTFIGYLVGNTLWLVAVGYYIYVTFLGYSALPFLKNTVILLYPFAPLILLYGLSLALGWNFTHTLCSFYKYRVK

SEQ ID NO: 908475 - protein, 140 aa, Homo sapiens; identical to SEQ ID NO: 908468

SEQ ID NO: 908476 - protein, 182 aa, Homo sapiens [sequence omitted]

SEQ ID NO: 908477 - protein, 73 aa, Homo sapiens
GAKRYKYLRRLFRFRQMDFEFAAWQMLYLFTSPQRVYRNFHYRKQTKDQWARDDPAFLVLLSIWLCGKCVYLR

SEQ ID NO: 908478 - protein, 400 aa, Homo sapiens [sequence omitted]

SEQ ID NO: 908479 - protein, 400 aa, Homo sapiens [sequence omitted]

SEQ ID NO: 908480 - protein, 400 aa, Homo sapiens [sequence omitted]

SEQ ID NO: 908481 - protein, 335 aa, Homo sapiens
MLARRKPVLPALTINPTIAEGPSPTSEGASEANLVDLQKKLEELELDEQQKKRLEAFLTQKAKVGELKDDDFERISELGAGNGGVVTKVQHRPSGLIMARKLIHLEIKPAIRNQIIRELQVLHECNSPYIVGFYGAFYSDGEISICMEHMDGGSLDQVLKEAKRIPEEILGKVSIAVLRGLAYLREKHQIMHRDVKPSNILVNSRGEIKLCDFGVSGQLIDSMANSFVGTRSYMAPERLQGTHYSVQSDIWSMGLSLVELAVGRYPIPPPDAKELEAIFGRPVVDGEEGEPHSMAGVPLGTGDAAVCGLRGSASLGYKTKQGEKKQKPKKKRKKK

SEQ ID NO: 908482 - protein, 529 aa, Homo sapiens
MLARRKPVLPALTINPTIAEGPSPTSEGASEANLVDLQKKLEELELDEQQKKRLEAFLTQKAKVGELKDDDFERISELGAGNGGVVTKVQHRPSGLIMARKLIHLEIKPAIRNQIIRELQVLHECNSPYIVGFYGAFYSDGEISICMEHMDGGSLDQVLKEAKRIPEEILGKVSIAVLRGLAYLREKHQIMHRDVKPSNILVNSRGEIKLCDFGVSGQLIDSMANSFVGTRSYMAPERLQGTHYSVQSDIWSMGLSLVELAVGRYPIPPPDAKELEAIFGRPVVDGEEGEPHSMLAPPPTLLPHPCGEHRGGATAHAGTGVSSPARPGRGASGDGRRCCVWSQRLCFLRLQNKTGREKAKAKKKKKKKIIINNKNKNTITKNKQHICCARARPVGPPRKRLSFNTPPLWVWGGARARAPMVCYVTHRVAHHVFPLERDTPRGSYTTTKSGVGEFFATIYKKKSAGGGENKTREIVVSRQTSLQEGRRRFAEENKYRGWCLSTKEESITTTERASVFISDILSDAGVGGG

SEQ ID NO: 908483 - protein, 420 aa, Homo sapiens
YREKPVRDLVAAPPLPLPLGLGLRRQPSSGLGSGSGSLASGPSPTSEGASEANLVDLQKKLEELELDEQQKKRLEAFLTQKAKVGELKDDDFERISELGAGNGGVVTKVQHRPSGLIMARKLIHLEIKPAIRNQIIRELQVLHECNSPYIVGFYGAFYSDGEISICMEHMDGGSLDQVLKEAKRIPEEILGKVSIAVLRGLAYLREKHQIMHRDVKPSNILVNSRGEIKLCDFGVSGQLIDSMANSFVGTRSYMAPERLQGTHYSVQSDIWSMGLSLVELAVGRYPIPPPDAKELEAIFGRPVVDGEEGEPHSISPRPRPPGRPVSGHGMDSRPAMAIFELLDYIVNEPPPKLPNGVFTPDFQEFVNKCLIKNPAERADLKMLTNHTFIKRSEVEEVDFAGWLCKTLRLNQPGTPTRTAV

SEQ ID NO: 908484 - protein, 210 aa, Homo sapiens
MHRDVKPSNILVNSRGEIKLCDFGVSGQLIDSMANSFVGTRSYMAPERLQGTHYSVQSDIWSMGLSLVELAVGRYPIPPPDAKELEAIFGRPVVDGEEGEPHSISPRPRPPGRPVSGHGMDSRPAMAIFELLDYIVNEPPPKLPNGVFTPDFQEFVNKCLIKNPAERADLKMLTNHTFIKRSEVEEVDFAGWLCKTLRLNQPGTPTRTAV

SEQ ID NO: 908485 - protein, 270 aa, Homo sapiens
MLAVEEEAPASWGPSSIPKSAEHCRLFKSCGQHQLQASGWKPLQQVPQGGPGWVSREVELRNSSLSIAAVISHGEGDGGCERGKPPGFQLPSSPLWALSSLALLQPERLQGTHYSVQSDIWSMGLSLVELAVGRYPIPPPDAKELEAIFGRPVVDGEEGEPHSISPRPRPPGRPVSGHGMDSRPAMAIFELLDYIVNEPPPKLPNGVFTPDFQEFVNKCLIKNPAERADLKMLTNHTFIKRSEVEEVDFAGWLCKTLRLNQPGTPTRTAV

SEQ ID NO: 908486 - protein, 153 aa, Homo sapiens
SPRKTGTPQDASSSLSKFTVAAPDAKELEAIFGRPVVDGEEGEPHSISPRPRPPGRPVSGHGMDSRPAMAIFELLDYIVNEPPPKLPNGVFTPDFQEFVNKCLIKNPAERADLKMLTNHTFIKRSEVEEVDFAGWLCKTLRLNQPGTPTRTAV

SEQ ID NO: 908487 - protein, 210 aa, Homo sapiens; identical to SEQ ID NO: 908484

SEQ ID NO: 908488 - protein, 64 aa, Homo sapiens
EEILGKVSIAVSPPQTHIAPPPHSARTSSTRPGFREPLTVWWGLGWPLQKESGQGCAHLLWSLN

SEQ ID NO: 908489 - protein, 400 aa, Homo sapiens [sequence omitted]

SEQ ID NO: 908490 - protein, 425 aa, Homo sapiens
MLARRKPVLPALTINPTIAEGPSPTSEGASEANLVDLQKKLEELELDEQQKKRLEAFLTQKAKVGELKDDDFERISELGAGNGGVVTKVQHRPSGLIMARKLIHLEIKPAIRNQIIRELQVLHECNSPYIVGFYGAFYSDGEISICMEHMDGGSLDQVLKEAKRIPEEILGKVSIAVLRGLAYLREKHQIMHRDVKPSNILVNSRGEIKLCDFGVSGQLIDSMANSFVGTRSYMAPERLQGTHYSVQSDIWSMGLSLVELAVGRYPIPPPDAKELEAIFGRPVVDGEEGEPHSISPRPRPPGRPVSGHGMDSRPAMAIFELLDYIVNEPTPKLPTACTPPDFQEYWPKCLIQNPGKEADPEEGSSNHTLIQAGPEGKKEIKPAETVDKHRERTTQEHKHPRETVPGNKGPKEKETDRVIHALTRK

SEQ ID NO: 908491 - protein, 254 aa, Homo sapiens
MLARRKPVLPALTINPTIAEGPSPTSEGASEANLVDLQKKLEELELDEQQKKRLEAFLTQKAKVGELKDDDFERISELGAGNGGVVTKVQHRPSGLIMARKLIHLEIKPAIRNQIIRELQVLHECNSPYIVGFYGAFYSDGEISICMEHMDGGSLDQVLKEAKRIPEEILGKVSIAVLRGLAYLREKHQIMHRDVKPSNILVNSRGEIKLCDFGVSGQLIDSMANSFVGTRSYMAVTGWIAGLPWPSLNSWTIL

SEQ ID NO: 908492 - protein, 340 aa, Homo sapiens
MLARRKPVLPALTINPTIAEGPSPTSEGASEANLVDLQKKLEELELDEQQKKRLEAFLTQKAKVGELKDDDFERISELGAGNGGVVTKVQHRPSGLIMARKLIHLEIKPAIRNQIIRELQVLHECNSPYIVGFYGAFYSDGEISICMEHMDGGSLDQVLKEAKRIPEEILGKVSIAVLRGLAYLREKHQIMHRDVKPSNILVNSRGEIKLCDFGVSGQLIDSMANSFVGTRSYMAPERLQGTHYSVQSDIWSMGLSLVELAVGRYPIPRPKAQLCFGLLSAESALGYGGRTGWGSGSRPSHSACQTYPPCASVHPVHTQGLQEHPESVGCLPAVPKQGDP

SEQ ID NO: 908493 - protein, 210 aa, Homo sapiens; identical to SEQ ID NO: 908484

SEQ ID NO: 908494 - protein, 217 aa, Homo sapiens
MLARRKPVLPALTINPTIAEGPSPTSEGASEANLVDLQKKLEELELDEQQKKRLEAFLTQKAKVGELKDDDFERISELGAGNGGVVTKVQHRPSGLIMARKLIHLEIKPAIRNQIIRELQVLHECNSPYIVGFYGAFYSDGEISICMEHMVSASGAGAGAGPPRNRACWGEGRPPHGPFPQRQQCAGFQGILLKAVDAIQVCICRCLWFCFVFFLFF

SEQ ID NO: 908495 - protein, 297 aa, Homo sapiens
MLARRKPVLPALTINPTIAEGPSPTSEGASEANLVDLQKKLEELELDEQQKKRLEAFLTQKAKVGELKDDDFERISELGAGNGGVVTKVQHRPSGGRGASGDGRRCCVWSQRLCFLRLQNKTGREKAKAKKKKKKKIIINNKNKNTITKNKQHICCARARPVGPPRKRLSFNTPPCGCGGARALRAPMVCYVTHRVAHHVFPLERDTPRGSYTTTKSGVGEFFATIYKKKSAGGGENKTREIVVSRQTSLQEGRRRFAEENKYRGWCLSTKEESITTTERASVFISDILSDAGVGGG

SEQ ID NO: 908496 - protein, 514 aa, Homo sapiens
GGPGGKSRQGGAVSGNQVATRVGFIFLWNFCFTDRTMAARVLIIGSGGREHTLAWKLAQSHHVKQVLVAPGNAGTACSEKISNTAISISDHTALAQFCKEKKIEFVVVGPEAPLAAGIVGNLRSAGVQCFGPTAEAAQLESSKRFAKEFMDRHGIPTAQWKAFTKPEEACSFILSADFPALVVKASGLAAGKGVIVAKSKEEACKAVQEIMQEKAFGAAGETIVIEELLDGEEVSCLCFTDGKTVAPMPPAQDHKRLLEGDGGPNTGGMGAYCPAPQVSNDLLLKIKDTVLQRTVDGMQQEGTPYTGILYAGIMLTKNGPKVLEFNCRFGDPECQVILPLLKSDLYEVIQSTLDGLLCTSLPVWLENHTALTVVMASKGYPGDYTKGVEITGFPEAQALGLEVFHAGTALKNGKVVTHGGRVLAVTAIRENLISALEEAKKGLAAIKFEGAIYRKDIGFRAIAFLQQPRSLTYKESGVDIAAGNMLVKKIQPLAKATSRSGCKVDLGGLLVFLI

SEQ ID NO: 908497 - protein, 478 aa, Homo sapiens
MAARVLIIGSGGREHTLAWKLAQSHHVKQVLVAPGNAGTACSEKISNTAISISDHTALAQFCKEKKIEFVVVGPEAPLAAGIVGNLRSAGVQCFGPTAEAAQLESSKRFAKEFMDRHGIPTAQWKAFTKPEEACSFILSADFPALVVKASGLAAGKGVIVAKSKEEACKAVQEIMQEKAFGAAGETIVIEELLDGEEVSCLCFTDGKTVAPMPPAQDHKRLLEGDGGPNTGGMGAYCPAPQVSNDLLLKIKDTVLQRTVDGMQQEGTPYTGILYAGIMLTKNGPKVLEFNCRFGDPECQVILPLLKSDLYEVIQSTLDGLLCTSLPVWLENHTALTVVMASKGYPGDYTKGVEITGFPEAQALGLEVFHAGTALKNGKVVTHGGRVLAVTAIRENLISALEEAKKGLAAIKFEGAIYRKDIGFRAIAFLQQPRSLTYKESGVDIAAGNMLVKKIQPLAKATSRSGCKVDLGGLLVFLI

SEQ ID NO: 908498 - protein, 478 aa, Homo sapiens; identical to SEQ ID NO: 908497

SEQ ID NO: 908499 - protein, 478 aa, Homo sapiens; identical to SEQ ID NO: 908497

SEQ ID NO: 908500 - protein, 478 aa, Homo sapiens; identical to SEQ ID NO: 908497

SEQ ID NO: 908501 - protein, 288 aa, Homo sapiens
MAARVLIIGSGGREHTLAWKLAQSHHVKQVLVAPGNAGTACSEKISNTAISISDHTALAQFCKEKKIEFVVVGPEAPLAAGIVGNLRSAGVQCFGPTAEAAQLESSKRFAKEFMDRHGIPTAQWKAFTKPEEACSFILSADFPALVVKASGLAAGKGVIVAKSKEEACKAVQEIMQEKAFGAAGETIVIEELLDGEEVSCLCFTDGKTVAPMPPAQDHKRLLEGDGGPNTGGMGAYCPAPQVSNDLLLKIKDTVLQRTVDGMQQEGTPYTGRPTHITMEATYRVTFYF

SEQ ID NO: 908502 - protein, 478 aa, Homo sapiens; identical to SEQ ID NO: 908497

SEQ ID NO: 908503 - protein, 478 aa, Homo sapiens; identical to SEQ ID NO: 908497

SEQ ID NO: 908504 - protein, 306 aa, Homo sapiens
RVCVRLLSGLMSRNRLYTNVGVHSVSHDQQRRVKALLLDTVGNKDQSGLDPAKGDKIKWAGVVARAEGSPRVKVKNLIESMQINGSVLKNGSLTNHFSFEKKKARVAVLISGTGSNLQALIDSTREPNSSAQIDIVISNKAAVAGLDKAERAGIPTRVINHKLYKNRVEFDSAIDLVLEEFSIDIVCLAGFMRILSGPFVQKWNGKMLNIHPSLLPSFKGSNAHEQALETGVTVTGCTVHFVAEDVDAGQIILQEAVPVKRGDTVATLSERVKLAEHKIFPAALQLVASGTVQLGENGKICWVKEE

SEQ ID NO: 908505 - protein, 94 aa, Homo sapiens
EILLLFEIICQICSLLGFPEAQALGLEVFHAGTALKNGKVVTHGGRVLAVTAIRENLISALEEAKKGLAAIKFEGAIYRKDIGFRAIAFLQQPR

SEQ ID NO: 908506 - protein, 181 aa, Homo sapiens [sequence omitted]

SEQ ID NO: 908507 - protein, 433 aa, Homo sapiens [sequence omitted]

SEQ ID NO: 908508 - protein, 478 aa, Homo sapiens; identical to SEQ ID NO: 908497

SEQ ID NO: 908509 - protein, 478 aa, Homo sapiens; identical to SEQ ID NO: 908497

SEQ ID NO: 908510 - protein, 478 aa, Homo sapiens; identical to SEQ ID NO: 908497

SEQ ID NO: 908511 - protein, 492 aa, Homo sapiens
MCVNDILAQGAEPLFFLDYFSCGKLDLSVTEAVVAGIAKACGKAGCALLGGETAEMPDMYPPGEYDLAGFAVGAMERDQKLPHLERITEGDVVVGIASSGLHSNGFSLVRKIVAKSSLQYSSPAPDGCGDQTLGDLLLTPTRIYSHSLLPVLRSGHVKAFAHITGGGLLENIPRVLPEKLGVDLDAQTWRIPRVFSWLQQEGHLSEEEMARTFNCGVGAVLVVSKEQTEQILRDIQQHKEEAWVIGSVVARAEGSPRVKVKNLIESMQINGSVLKNGSLTNHFSFEKKKARVAVLISGTGSNLQALIDSTREPNSSAQIDIVISNKAAVAGLDKAERAGIPTRVINHKLYKNRVEFDSAIDLVLEEFSIDIVCLAGFMRILSGPFVQKWNGKMLNIHPSLLPSFKGSNAHEQALETGVTVTGCTVHFVAEDVDAGQIILQEAVPVKRGDTVATLSERVKLAEHKIFPAALQLVASGTVQLGENGKICWVKEE

SEQ ID NO: 908512 - protein, 349 aa, Homo sapiens
RTRGSTHASRSGHVKAFAHITGGGLLENIPRVLPEKLGVDLDAQTWRIPRVFSWLQQEGHLSEEEMARTFNCGVGAVLVVSKEQTEQILRDIQQHKEEAWVIGSVVARAEGSPRVKVKNLIESMQINGSVLKNGSLTNHFSFEKKKARVAVLISGTGSNLQALIDSTREPNSSAQIDIVISNKAAVAGLDKAERAGIPTRVINHKLYKNRVEFDSAIDLVLEEFSIDIVCLAGFMRILSGPFVQKWNGKMLNIHPSLLPSFKGSNAHEQALETGVTVTGCTVHFVAEDVDAGQIILQEAVPVKRGDTVATLSERVKLAEHKIFPAALQLVASGTVQLGENGKICWVKEE

SEQ ID NO: 908513 - protein, 315 aa, Homo sapiens
MAARVLIIGSGGREHTLAWKLAQSHHVKQVLVAPGNAGTACSEKISNTAISISDHTALAQFCKEKKIEFVVVGPEAPLAAGIVGNLRSAGVQCFGPTAEAAQLESSKRFAKEFMDRHGIPTAQWKAFTKPEEACSFILSADFPALVVKASGLAAGKGVIVAKSKEEACKAVQEIMQEKAFGAAGETIVIEELLDGEEVSCLCFTDGKTVAPMPPAQDHKRLLEGDGGPNTGGMGAYCPAPQVSNDLLLKIKDTVLQRTVDGMQQEGTPYTGILYAGIMLTKNGPKVLEFNCRFGDPECQVGKNIKVLLGRRYVVF

SEQ ID NO: 908514 - protein, 251 aa, Homo sapiens [sequence omitted]

SEQ ID NO: 908515 - protein, 73 aa, Homo sapiens
ILIRITVTKEKRRANCDDSLNLHRYTLECSGMISAHCNLRLPGSSDSPASASQIAVITGHSVHVTNSWLRGYG

SEQ ID NO: 908516 - protein, 78 aa, Homo sapiens
HWYLLPFRGGYESGTGGQIQSPKGEMENLWVFLQPQPHWYLLPFRGGYESGTGGQIQSPEGEMEKPGLLRKATGVGVN

SEQ ID NO: 908517 - protein, 1894 aa, Homo sapiens
IRGRVDRRRQKGGCRRRGAGDPNMANLEESFPRGGTRKIHKPEKAFQQSVEQDNLFDISTEEGSTKRKKSQKGPAKTKKLKIEKRESSKSAREKFEILSVESLCEGMRILGCVKEVNELELVISLPNGLQGFVQVTEICDAYTKKLNEQVTQEQPLKDLLHLPELFSPGMLVRCVVSSLGITDRGKKSVKLSLNPKNVNRVLSAEALKPGMLLTGTVSSLEDHGYLVDIGVDGTRAFLPLLKAQEYIRQKNKGAKLKVGQYLNCIVEKVKGNGGVVSLSVGHSEVSTAIATEQQSWNLNNLLPGLVVKAQVQKVTPFGLTLNFLTFFTGVVDFMHLDPKKAGTYFSNQAVRACILCVHPRTRVVHLSLRPIFLQPGRPLTRLSCQNLGAVLDDVPVQGFFKKAGATFRLKDGVLAYARLSHLSDSKNVFNPEAFKPGNTHKCRIIDYSQMDELALLSLRTSIIEAQYLRYHDIEPGAVVKGTVLTIKSYGMLVKVGEQMRGLVPPMHLADILMKNPEKKYHIGDEVKCRVLLCDPEAKKLMMTLKKTLIESKLPVITCYADAKPGLQTHGFIIRVKDYGCIVKFYNNVQGLVPKHELSTEYIPDPERVFYTGQVVKVVVLNCEPSKERMLLSFKLSSDPEPKKEPAGHSQKKGKAINIGQLVDVKVLEKTKDGLEVAVLPHNIRAFLPTSHLSDHVANGPLLHHWLQAGDILHRVLCLSQSEGRVLLCRKPALVSTVEGGQDPKNFSEIHPGMLLIGFVKSIKDYGVFIQFPSGLSGLAPKAIMSDKFVTSTSDHFVEGQTVAAKVTNVDEEKQRMLLSLRLSDCGLGDLAITSLLLLNQCLEELQGVRSLMSNRDSVLIQTLAEMTPGMFLDLVVQEVLEDGSVVFSGGPVPDLVLKASRYHRAGQEVESGQKKKVVILNVDLLKLEVHVSLHQDLVNRKARKLRKGSEHQAIVQHLEKSFAIASLVETGHLAAFSLTSHLNDTFRFDSEKLQVGQGVSLTLKTTEPGVTGLLLAVEGPAAKRTMRPTQKDSETVDEDEEVDPALTVGTIKKHTLSIGDMVTGTVKSIKPTHVVVTLEDGIIGCIHASHILDDVPEGTSPTTKLKVGKTVTARVIGGRDMKTFKYLPISHPRFVRTIPELSVRPSELEDGHTALNTHSVSPMEKIKQYQAGQTVTCFLKKYNVVKKWLEVEIAPDIRGRIPLLLTSLSFKVLKHPDKKFRVGQALRATVVGPDSSKTFLCLSLTGPHKLEEGEVAMGRVVKVTPNEGLTVSFPFGKIGTVSIFHMSDSYSETPLEDFVPQKVVRCYILSTADNVLTLSLRSSRTNPETKSKVEDPEINSIQDIKEGQLLRGYVGSIQPHGVFFRLGPSVVGLARYSHVSQHSPSKKALYNKHLPEGKLLTARVLRLNHQKNLVELSFLPGDTGKPDVLSASLEGQLTKQEERKTEAEERDQKGEKKNQKRNEKKNQKGQEEVEMPSKEKQQPQKPQAQKRGGRECRESGSEQERVSKKPKKAGLSEEDDSLVDVYYREGKEEAEETNVLPKEKQTKPAEAPRLQLSSGFAWNVGLDSLTPALPPLAESSDSEEDEKPHQATIKKSKKERELEKQKAEKELSRIEEALMDPGRQPESADDFDRLVLSSPNSSILWLQYMAFHLQATEIEKARAVAERALKTISFREEQEKLNVWVALLNLENMYGSQESLTKVFERAVQYNEPLKVFLHLADIYAKSEKFQEAGELYNRMLKRFRQEKAVWIKYGAFLLRRSQAAASHRVLQRALECLPSKEHVDVIAKFAQLEFQLGDAERAKAIFENTLSTYPKRTDVWSVYIDMTIKHGSQKDVRDIFERVIHLSLAPKRMKFFFKRYLDYEKQHGTEKDVQAVKAKALEYVEAKSSVLEA

SEQ ID NO: 908518 - protein, 1288 aa, Homo sapiens
SSSPILPVVKVVVLNCEPSKERMLLSFKLSSDPEPKKEPAGHSQKKGKAINIGQLVDVKVLEKTKDGLEVAVLPHNIRAFLPTSHLSDHVANGPLLHHWLQAGDILHRVLCLSQSEGRVLLCRKPALVSTVEGGQDPKNFSEIHPGMLLIGFVKSIKDYGVFIQFPSGLSGLAPKAIMSDKFVTSTSDHFVEGQTVAAKVTNVDEEKQRMLLSLRLSDCGLGDLAITSLLLLNQCLEELQGVRSLMSNRDSVLIQTLAEMTPGMFLDLVVQEVLEDGSVVFSGGPVPDLVLKASRYHRAGQEVESGQKKKVVILNVDLLKLEVHVSLHQDLVNRKARKLRKGSEHQAIVQHLEKSFAIASLVETGHLAAFSLTSHLNDTFRFDSEKLQVGQGVSLTLKTTEPGVTGLLLAVEGPAAKRTMRPTQKDSETVDEDEEVDPALTVGTIKKHTLSIGDMVTGTVKSIKPTHVVVTLEDGIIGCIHASHILDDVPEGTSPTTKLKVGKTVTARVIGGRDMKTFKYLPISHPRFVRTIPELSVRPSELEDGHTALNTHSVSPMEKIKQYQAGQTVTCFLKKYNVVKKWLEVEIAPDIRGRIPLLLTSLSFKVLKHPDKKFRVGQALRATVVGPDSSKTLLCLSLTGPHKLEEGEVAMGRVVKVTPNEGLTVSFPFGKIGTVSIFHMSDSYSETPLEDFVPQKVVRCYILSTADNVLTLSLRSSRTNPETKSKVEDPEINSIQDIKEGQLLRGYVGSIQPHGVFFRLGPSVVGLARYSHVSQHSPSKKALYNKHLPEGKLLTARVLRLNHQKNLVELSFLPGDTGKPDVLSASLEGQLTKQEERKTEAEERDQKGEKKNQKRNEKKNQKGQEEVEMPSKEKQQPQKPQAQKRGGRECRESGSEQERVSKKPKKAGLSEEDDSLVDVYYREGKEEAEETNVLPKEKQTKPAEAPRLQLSSGFAWNVGLDSLTPALPPLAESSDSEEDEKPHQATIKKSKKERELEKQKAEKELSRIEEALMDPGRQPESADDFDRLVLSSPNSSILWLQYMAFHLQATEIEKARAVAERALKTISFREEQEKLNVWVALLNLENMYGSQESLTKVFERAVQYNEPLKVFLHLADIYAKSEKFQEAGELYNRMLKRFRQEKAVWIKYGAFLLRRSQAAASHRVLQRALECLPSKEHVDVIAKFAQLEFQLGDAERAKAIFENTLSTYPKRTDVWSVYIDMTIKHGSQKDVRDIFERVIHLSLAPKRMKFFFKRYLDYEKQHGTEKDVQAVKAKALEYVEAKSSVLEA

SEQ ID NO: 908519 - protein, 1051 aa, Homo sapiens
MVLIRVSFGSLADSVLIQTLAEMTPGMFLDLVVQEVLEDGSVVFSGGPVPDLVLKASRYHRAGQEVESGQKKKVVILNVDLLKLEVHVSLHQDLVNRKARKLRKGSEHQAIVQHLEKSFAIASLVETGHLAAFSLTSHLNDTFRFDSEKLQVGQGVSLTLKTTEPGVTGLLLAVEGPAAKRTMRPTQKDSETVDEDEEVDPALTVGTIKKHTLSIGDMVTGTVKSIKPTHVVVTLEDGIIGCIHASHILDDVPEGTSPTTKLKVGKTVTARVIGGRDMKTFKYLPISHPRFVRTIPELSVRPSELEDGHTALNTHSVSPMEKIKQYQAGQTVTCFLKKYNVVKKWLEVEIAPDIRGRIPLLLTSLSFKVLKHPDKKFRVGQALRATVVGPDSSKTFLCLSLTGPHKLEEGEVAMGRVVKVTPNEGLTVSFPFGKIGTVSIFHMSDSYSETPLEDFVPQKVVRCYILSTADNVLTLSLRSSRTNPETKSKVEDPEINSIQDIKEGQLLRGYVGSIQPHGVFFRLGPSVVGLARYSHVSQHSPSKKALYNKHLPEGKLLTARVLRLNHQKNLVELSFLPGDTGKPDVLSASLEGQLTKQEERKTEAEERDQKGEKKNQKRNEKKNQKGQEEVEMPSKEKQQPQKPQAQKRGGRECRESGSEQERVSKKPKKAGLSEEDDSLVDVYYREGKEEAEETNVLPKEKQTKPAEAPRLQLSSGFAWNVGLDSLTPALPPLAESSDSEEDEKPHQATIKKSKKERELEKQKAEKELSRIEEALMDPGRQPESADDFDRLVLSSPNSSILWLQYMAFHLQATEIEKARAVAERALKTISFREEQEKLNVWVALLNLENMYGSQESLTKVFERAVQYNEPLKVFLHLADIYAKSEKFQEAGELYNRMLKRFRQEKAVWIKYGAFLLRRSQAAASHRVLQRALECLPSKEHVDVIAKFAQLEFQLGDAERAKAIFENTLSTYPKRTDVWSVYIDMTIKHGSQKDVRDIFERVIHLSLAPKRMKFFFKRYLDYEKQHGTEKDVQAVKAKALEYVEAKSSVLEA

SEQ ID NO: 908520 - protein, 496 aa, Homo sapiens
ALWSPRGGISSYPRASSLSFLPGDTGKPDVLSASLEGQLTKQEERKTEAEERDQKGEKKNQKRNEKKNQKGQEEVEMPSKEKQQPQKPQAQKRGGRECRESGSEQERVSKKPKKAGLSEEDDSLVDVYYREGKEEAEETNVLPKEKQTKPAEAPRLQLSSGFAWNVGLDSLTPALPPLAESSDSEEDEKPHQATIKKSKKERELEKQKAEKELSRIEEALMDPGRQPESADDFDRLVLSSPNSSILWLQYMAFHLQATEIEKARAVAERALKTISFREEQEKLNVWVALLNLENMYGSQESLTKVFERAVQYNEPLKVFLHLADIYAKSEKFQEAGELYNRMLKRFRQEKAVWIKYGAFLLRRSQAAASHRVLQRALECLPSKEHVDVIAKFAQLEFQLGDAERAKAIFENTLSTYPKRTDVWSVYIDMTIKHGSQKDVRDIFERVIHLSLAPKRMKFFFKRYLDYEKQHGTEKDVQAVKAKALEYVEAKSSVLEA

SEQ ID NO: 908521 - protein, 1535 aa, Homo sapiens
RIALDCGYPGLRVCEYRGARLVVAGCRRRGAGDPNMANLEESFPRGGTRKIHKPEKAFQQSVEQDNLFDISTEEGSTKRKKSQKGPAKTKKLKIEKRESSKSAREKFEILSVESLCEGMRILGCVKEVNELELVISLPNGLQGFVQVTEICDAYTKKLNEQVTQEQPLKDLLHLPELFSPGMLVRCVVSSLGITDRGKKSVKLSLNPKNVNRVLSAEALKPGMLLTGTVSSLEDHGYLVDIGVDGTRAFLPLLKAQEYIRQKNKGAKLKVGQYLNCIVEKVKGNGGVVSLSVGHSEVSTAIATEQQSWNLNNLLPGLVVKAQVQKVTPFGLTLNFLTFFTGVVDFMHLDPKKAGTYFSNQAVRACILCVHPRTRVVHLSLRPIFLQPGRPLTRLSCQNLGAVLDDVPVQGFFKKAGATFRLKDGVLAYARLSHLSDSKNVFNPEAFKPGNTHKCRIIDYSQMDELALLSLRTSIIEAQYLRYHDIEPGAVVKGTVLTIKSYGMLVKVGEQMRGLVPPMHLADILMKNPEKKYHIGDEVKCRVLLCDPEAKKLMMTLKKTLIESKLPVITCYADAKPGLQTHGFIIRVKDYGCIVKFYNNVQGLVPKHELSTEYIPDPERVFYTGQVVKVVVLNCEPSKERMLLSFKLSSDPEPKKEPAGHSQKKGKAINIGQLVDVKVLEKTKDGLEVAVLPHNIRAFLPTSHLSDHVANGPLLHHWLQAGDILHRVLCLSQSEGRVLLCRKPALVSTVEGGQDPKNFSEIHPGMLLIGFVKSIKDYGVFIQFPSGLSGLAPKAIMSDKFVTSTSDHFVEGQTVAAKVTNVDEEKQRMLLSLRLSDCGLGDLAITSLLLLNQCLEELQGVRSLMSNRDSVLIQTLAEMTPGMFLDLVVQEVLEDGSVVFSGGPVPDLVLKASRYHRAGQEVESGQKKKVVILNVDLLKLEVHVSLHQDLVNRKARKLRKGSEHQAIVQHLEKSFAIASLVETGHLAAFSLTSHLNDTFRFDSEKLQVGQGVSLTLKTTEPGVTGLLLAVEGPAAKRTMRPTQKDSETVDEDEEVDPALTVGTIKKHTLSIGDMVTGTVKSIKPTHVVVTLEDGIIGCIHASHILDDVPEGTSPTTKLKVGKTVTARVIGGRDMKTFKYLPISHPRFVRTIPELSVRPSELEDGHTALNTHSVSPMEKIKQYQAGQTVTCFLKKYNVVKKWLEVEIAPDIRGRIPLLLTSLSFKVLKHPDKKFRVGQALRATVVGPDSSKTFLCLSLTGPHKLEEGEVAMGRVVKVTPNEGLTVSFPFGKIGTVSIFHMSDSYSETPLEDFVPQKVVRCYILSTADNVLTLSLRSSRTNPETKSKVEDPEINSIQDIKEGQLLRGYVGSIQPHGVFFRLGPSVVGLARYSHVSQHSPSKKALYNKHLPEGKLLTARVLRLNHQKNLVELSFLPGDTGKPDVLSASLEGQLTKQEERKTEAEERDQKGEKKNQKRNEKKNQKGQEEVEMPSKEKQQPQKPQAQKRGGRECRESGSEQERVSKKPKKAGAVSPAGGGQ

SEQ ID NO: 908522 - protein, 1337 aa, Homo sapiens
RIALDCGYPGLRVCEYRGARLVVAGCRRRGAGDPNMANLEESFPRGGTRKIHKPEKAFQQSVEQDNLFDISTEEGSTKRKKSQKGPAKTKKLKIEKRESSKSAREKFEILSVESLCEGMRILGCVKEVNELELVISLPNGLQGFVQVTEICDAYTKKLNEQVTQEQPLKDLLHLPELFSPGMLVRCVVSSLGITDRGKKSVKLSLNPKNVNRVLSAEALKPGMLLTGTVSSLEDHGYLVDIGVDGTRAFLPLLKAQEYIRQKNKGAKLKVGQYLNCIVEKVKGNGGVVSLSVGHSEVSTAIATEQQSWNLNNLLPGLVVKAQVQKVTPFGLTLNFLTFFTGVVDFMHLDPKKAGTYFSNQAVRACILCVHPRTRVVHLSLRPIFLQPGRPLTRLSCQNLGAVLDDVPVQGFFKKAGATFRLKDGVLAYARLSHLSDSKNVFNPEAFKPGNTHKCRIIDYSQMDELALLSLRTSIIEAQYLRYHDIEPGAVVKGTVLTIKSYGMLVKVGEQMRGLVPPMHLADILMKNPEKKYHIGDEVKCRVLLCDPEAKKLMMTLKKTLIESKLPVITCYADAKPGLQTHGFIIRVKDYGCIVKFYNNVQGLVPKHELSTEYIPDPERVFYTGQVVKVVVLNCEPSKERMLLSFKLSSDPEPKKEPAGHSQKKGKAINIGQLVDVKVLEKTKDGLEVAVLPHNIRAFLPTSHLSDHVANGPLLHHWLQAGDILHRVLCLSQSEGRVLLCRKPALVSTVEGGQDPKNFSEIHPGMLLIGFVKSIKDYGVFIQFPSGLSGLAPKAIMSDKFVTSTSDHFVEGQTVAAKVTNVDEEKQRMLLSLRLSDCGLGDLAITSLLLLNQCLEELQGVRSLMSNRDSVLIQTLAEMTPGMFLDLVVQEVLEDGSVVFSGGPVPDLVLKASRYHRAGQEVESGQKKKVVILNVDLLKLEVHVSLHQDLVNRKARKLRKGSEHQAIVQHLEKSFAIASLVETGHLAAFSLTSHLNDTFRFDSEKLQVGQGVSLTLKTTEPGVTGLLLAVEGPAAKRTMRPTQKDSETVDEDEEVDPALTVGTIKKHTLSIGDMVTGTVKSIKPTHVVVTLEDGIIGCIHASHILDDVPEGTSPTTKLKVGKTVTARVIGGRDMKTFKYLPISHPRFVRTIPELSVRPSELEDGHTALNTHSVSPMEKIKQYQAGQTVTCFLKKYNVVKKWLEVEIAPDIRGRIPLLLTSLSFKVLKHPDKKFRVGQALRATVVGPDSSKTFLCLSLTGPHKLEEGEVAMGRVVKVTPNEGLTVSFPFGKIGTVSIFHMSDSYSETPLEDFVPQKVVRCYILSTADNVLTLSLRSSSC

SEQ ID NO: 908523 - protein, 1217 aa, Homo sapiens
RIALDCGYPGLRVCEYRGARLVVAGCRRRGAGDPNMANLEESFPRGGTRKIHKPEKAFQQSVEQDNLFDISTEEGSTKRKKSQKGPAKTKKLKIEKRESSKSAREKFEILSVESLCEGMRILGCVKEVNELELVISLPNGLQGFVQVTEICDAYTKKLNEQVTQEQPLKDLLHLPELFSPGMLVRCVVSSLGITDRGKKSVKLSLNPKNVNRVLSAEALKPGMLLTGTVSSLEDHGYLVDIGVDGTRAFLPLLKAQEYIRQKNKGAKLKVGQYLNCIVEKVKGNGGVVSLSVGHSEVSTAIATEQQSWNLNNLLPGLVVKAQVQKVTPFGLTLNFLTFFTGVVDFMHLDPKKAGTYFSNQAVRACILCVHPRTRVVHLSLRPIFLQPGRPLTRLSCQNLGAVLDDVPVQGFFKKAGATFRLKDGVLAYARLSHLSDSKNVFNPEAFKPGNTHKCRIIDYSQMDELALLSLRTSIIEAQYLRYHDIEPGAVVKGTVLTIKSYGMLVKVGEQMRGLVPPMHLADILMKNPEKKYHIGDEVKCRVLLCDPEAKKLMMTLKKTLIESKLPVITCYADAKPGLQTHGFIIRVKDYGCIVKFYNNVQGLVPKHELSTEYIPDPERVFYTGQVVKVVVLNCEPSKERMLLSFKLSSDPEPKKEPAGHSQKKGKAINIGQLVDVKVLEKTKDGLEVAVLPHNIRAFLPTSHLSDHVANGPLLHHWLQAGDILHRVLCLSQSEGRVLLCRKPALVSTVEGGQDPKNFSEIHPGMLLIGFVKSIKDYGVFIQFPSGLSGLAPKAIMSDKFVTSTSDHFVEGQTVAAKVTNVDEEKQRMLLSLRLSDCGLGDLAITSLLLLNQCLEELQGVRSLMSNRDSVLIQTLAEMTPGMFLDLVVQEVLEDGSVVFSGGPVPDLVLKASRYHRAGQEVESGQKKKVVILNVDLLKLEVHVSLHQDLVNRKARKLRKGSEHQAIVQHLEKSFAIASLVETGHLAAFSLTSHLNDTFRFDSEKLQVGQGVSLTLKTTEPGVTGLLLAVEGPAAKRTMRPTQKDSETVDEDEEVDPALTVGTIKKHTLSIGDMVTGTVKSIKPTHVVVTLEDGIIGCIHASHILDDVPEGTSPTTKLKVGKTVTARVIGGRDMKTFKYLPISHPRFVRTIPELSVRPSELEDGHTALNTHSVSPMEKIKQYQAGQTVTCFLKKYNVVKKWLEVEIAPDIRGRIDTSH

SEQ ID NO: 908524 - protein, 226 aa, Homo sapiens
RIALDCGYPGLRVCEYRGARLVVAGCRRRGAGDPNMANLEESFPRGGTRKIHKPEKAFQQSVEQDNLFDISTEEGSTKRKKSQKGPAKTKKLKIEKRESSKSAREKFEILSVESLCEGMRILGCVKEVNELELVISLPNGLQGFVQVTEICDAYTKKLNEQVTQEQPLKDLLHLPELFSPGMLVRCVVSSLGITDRGKKSVKLSLNPKNVNRVLSAEALKPGMVGV

SEQ ID NO: 908525 - protein, 73 aa, Homo sapiens
ADAKPGLQTHGFIIRVKDYGCIVKFYNNVQGLVPKHELSTEYIPDPERVFYTGQVTLPLDRSPLPLVTPQTQI

SEQ ID NO: 908526 - protein, 1906 aa, Homo sapiens
RIALDCGYPGLRVCEYRGARLVVAGCRRRGAGDPNMANLEESFPRGGTRKIHKPEKAFQQSVEQDNLFDISTEEGSTKRKKSQKGPAKTKKLKIEKRESSKSAREKFEILSVESLCEGMRILGCVKEVNELELVISLPNGLQGFVQVTEICDAYTKKLNEQVTQEQPLKDLLHLPELFSPGMLVRCVVSSLGITDRGKKSVKLSLNPKNVNRVLSAEALKPGMLLTGTVSSLEDHGYLVDIGVDGTRAFLPLLKAQEYIRQKNKGAKLKVGQYLNCIVEKVKGNGGVVSLSVGHSEVSTAIATEQQSWNLNNLLPGLVVKAQVQKVTPFGLTLNFLTFFTGVVDFMHLDPKKAGTYFSNQAVRACILCVHPRTRVVHLSLRPIFLQPGRPLTRLSCQNLGAVLDDVPVQGFFKKAGATFRLKDGVLAYARLSHLSDSKNVFNPEAFKPGNTHKCRIIDYSQMDELALLSLRTSIIEAQYLRYHDIEPGAVVKGTVLTIKSYGMLVKVGEQMRGLVPPMHLADILMKNPEKKYHIGDEVKCRVLLCDPEAKKLMMTLKKTLIESKLPVITCYADAKPGLQTHGFIIRVKDYGCIVKFYNNVQGLVPKHELSTEYIPDPERVFYTGQVVKVVVLNCEPSKERMLLSFKLSSDPEPKKEPAGHSQKKGKAINIGQLVDVKVLEKTKDGLEVAVLPHNIRAFLPTSHLSDHVANGPLLHHWLQAGDILHRVLCLSQSEGRVLLCRKPALVSTVEGGQDPKNFSEIHPGMLLIGFVKSIKDYGVFIQFPSGLSGLAPKAIMSDKFVTSTSDHFVEGQTVAAKVTNVDEEKQRMLLSLRLSDCGLGDLAITSLLLLNQCLEELQGVRSLMSNRDSVLIQTLAEMTPGMFLDLVVQEVLEDGSVVFSGGPVPDLVLKASRYHRAGQEVESGQKKKVVILNVDLLKLEVHVSLHQDLVNRKARKLRKGSEHQAIVQHLEKSFAIASLVETGHLAAFSLTSHLNDTFRFDSEKLQVGQGVSLTLKTTEPGVTGLLLAVEGPAAKRTMRPTQKDSETVDEDEEVDPALTVGTIKKHTLSIGDMVTGTVKSIKPTHVVVTLEDGIIGCIHASHILDDVPEGTSPTTKLKVGKTVTARVIGGRDMKTFKYLPISHPRFVRTIPELSVRPSELEDGHTALNTHSVSPMEKIKQYQAGQTVTCFLKKYNVVKKWLEVEIAPDIRGRIPLLLTSLSFKVLKHPDKKFRVGQALRATVVGPDSSKTFLCLSLTGPHKLEEGEVAMGRVVKVTPNEGLTVSFPFGKIGTVSIFHMSDSYSETPLEDFVPQKVVRCYILSTADNVLTLSLRSSRTNPETKSKVEDPEINSIQDIKEGQLLRGYVGSIQPHGVFFRLGPSVVGLARYSHVSQHSPSKKALYNKHLPEGKLLTARVLRLNHQKNLVELSFLPGDTGKPDVLSASLEGQLTKQEERKTEAEERDQKGEKKNQKRNEKKNQKGQEEVEMPSKEKQQPQKPQAQKRGGRECRESGSEQERVSKKPKKAGLSEEDDSLVDVYYREGKEEAEETNVLPKEKQTKPAEAPRLQLSSGFAWNVGLDSLTPALPPLAESSDSEEDEKPHQATIKKSKKERELEKQKAEKELSRIEEALMDPGRQPESADDFDRLVLSSPNSSILWLQYMAFHLQATEIEKARAVAERALKTISFREEQEKLNVWVALLNLENMYGSQESLTKVFERAVQYNEPLKVFLHLADIYAKSEKFQEAGELYNRMLKRFRQEKAVWIKYGAFLLRRSQAAASHRVLQRALECLPSKEHVDVIAKFAQLEFQLGDAERAKAIFENTLSTYPKRTDVWSVYIDMTIKHGSQKDVRDIFERVIHLSLAPKRMKFFFKRYLDYEKQHGTEKDVQAVKAKALEYVEAKSSVLEA

SEQ ID NO: 908527 - protein, 1865 aa, Homo sapiens
RIALDCGYPGLRVCEYRGARLVVAGCRRRGAGDPNMANLEESFPRGGTRKIHKPEKAFQQSVEQDNLFDISTEEGSTKRKKSQKGPAKTKKLKIEKRESSKSAREKFEILSVESLCEGMRILGCVKEVNELELVISLPNGLQGFVQVTEICDAYTKKLNEQVTQEQPLKDLLHLPELFSPGMLVRCVVSSLGITDRGKKSVKLSLNPKNVNRVLSAEALKPGMLLTGTVSSLEDHGYLVDIGVDGTRAFLPLLKAQEYIRQKNKGAKLKVGQYLNCIVEKVKGNGGVVSLSVGHSEVSTAIATEQQSWNLNNLLPGLVVKAQVQKVTPFGLTLNFLTFFTGVVDFMHLDPKKAGTYFSNQAVRACILCVHPRTRVVHLSLRPIFLQPGRPLTRLSCQNLGAVLDDVPVQGFFKKAGATFRLKDGVLAYARLSHLSDSKNVFNPEAFKPGNTHKCRIIDYSQMDELALLSLRTSIIEAQYLRYHDIEPGAVVKGTVLTIKSYGMLVKVGEQMRGLVPPMHLADILMKNPEKKYHIGDEVKCRVLLCDPEAKKLMMTLKKTLIESKLPVITCYADAKPGLQTHGFIIRVKDYGCIVKFYNNVQGLVPKHELSTEYIPDPERVFYTGQVVKVVVLNCEPSKERMLLSFKLSSDPEPKKEPAGHSQKKGKAINIGQLVDVKVLEKTKDGLEVAVLPHNIRAFLPTSHLSDHVANGPLLHHWLQAGDILHRVLCLSQSEGRVLLCRKPALVSTVEGGQDPKNFSEIHPGMLLIGFVKSIKDYGVFIQFPSGLSGLAPKAIMSDKFVTSTSDHFVEGQTVAAKVTNVDEEKQRMLLSLRLSDCGLGDLAITSLLLLNQCLEELQGVRSLMSNRDSVLIQTLAEMTPGMFLDLVVQEVLEDGSVVFSGGPVPDLVLKASRYHRAGQEVESGQKKKVVILNVDLLKLEVHVSLHQDLVNRKARKLRKGSEHQAIVQHLEKSFAIASLVETGHLAAFSLTSHLNDTFRFDSEKLQVGQGVSLTLKTTEPGVTGLLLAVEGPAAKRTMRPTQKDSETVDEDEEVDPALTVGTIKKHTLSIGDMVTGTVKSIKPTHVVVTLEDGIIGCIHASHILDDVPEGTSPTTKLKVGKTVTARVIGGRDMKTFKYLPISHPRFVRTIPELSVRPSELEDGHTALNTHSVSPMEKIKQYQAGQTVTCFLKKYNVVKKWLEVEIAPDIRGRIPLLLTSLSFKVLKHPDKKFRVGQALRATVVGPDSSKTFLCLSLTGPHKLEEGEVAMGRVVKVTPNEGLTVSFPFGKIGTVSIFHMSDSYSETPLEDFVPQKVVRCYILSTADNVLTLSLRSSRTNPETKSKVEDPEINSIQDIKEGQLLRGYVGSIQPHGVFFRLNHQKNLVELSFLPGDTGKPDVLSASLEGQLTKQEERKTEAEERDQKGEKKNQKRNEKKNQKGQEEVEMPSKEKQQPQKPQAQKRGGRECRESGSEQERVSKKPKKAGLSEEDDSLVDVYYREGKEEAEETNVLPKEKQTKPAEAPRLQLSSGFAWNVGLDSLTPALPPLAESSDSEEDEKPHQATIKKSKKERELEKQKAEKELSRIEEALMDPGRQPESADDFDRLVLSSPNSSILWLQYMAFHLQATEIEKARAVAERALKTISFREEQEKLNVWVALLNLENMYGSQESLTKVFERAVQYNEPLKVFLHLADIYAKSEKFQEAGELYNRMLKRFRQEKAVWIKYGAFLLRRSQAAASHRVLQRALECLPSKEHVDVIAKFAQLEFQLGDAERAKAIFENTLSTYPKRTDVWSVYIDMTIKHGSQKDVRDIFERVIHLSLAPKRMKFFFKRYLDYEKQHGTEKDVQAVKAKALEYVEAKSSVLEA

SEQ ID NO: 908528 - protein, 1846 aa, Homo sapiens
RIALDCGYPGLRVCEYRGARLVVAGCRRRGAGDPNMANLEESFPRGGTRKIHKPEKAFQQSVEQDNLFDISTEEGSTKRKKSQKGPAKTKKLKIEKRESSKSAREKFEILSVESLCEGMRILGCVKEVNELELVISLPNGLQGFVQVTEICDAYTKKLNEQVTQEQPLKDLLHLPELFSPGMLVRCVVSSLGITDRGKKSVKLSLNPKNVNRVLSAEALKPGMLLTGTVSSLEDHGYLVDIGVDGTRAFLPLLKAQEYIRQKNKGAKLKVGQYLNCIVEKVKGNGGVVSLSVGHSEVSTAIATEQQSWNLNNLLPGLVVKAQVQKVTPFGLTLNFLTFFTGVVDFMHLDPKKAGTYFSNQAVRACILCVHPRTRVVHLSLRPIFLQPGRPLTRLSCQNLGAVLDDVPVQGFFKKAGATFRLKDGVLAYARLSHLSDSKNVFNPEAFKPGNTHKCRIIDYSQMDELALLSLRTSIIEAQYLRYHDIEPGAVVKGTVLTIKSYGMLVKVGEQMRGLVPPMHLADILMKNPEKKYHIGDEVKCRVLLCDPEAKKLMMTLKKTLIESKLPVITCYADAKPGLQTHGFIIRVKDYGCIVKFYNNVQGLVPKHELSTEYIPDPERVFYTGQVVKVVVLNCEPSKERMLLSFKLSSDPEPKKEPAGHSQKKGKAINIGQLVDVKVLEKTKDGLEVAVLPHNIRAFLPTSHLSDHVANGPLLHHWLQAGDILHRVLCLSQSEGRVLLCRKPALVSTVEGGQDPKNFSEIHPGMLLIGFVKSIKDYGVFIQFPSGLSGLAPKAIMSDKFVTSTSDHFVEGQTVAAKVTNVDEEKQRMLLSLRLSDCGLGDLAITSLLLLNQCLEELQGVRSLMSNRDSVLIQTLAEMTPGMFLDLVVQEVLEDGSVVFSGGPVPDLVLKASRYHRAGQEVESGQKKKVVILNVDLLKLEVHVSLHQDLVNRKARKLRKGSEHQAIVQHLEKSFAIASLVETGHLAAFSLTSHLNDTFRFDSEKLQVGQGVSLTLKTTEPGVTGLLLAVEGPAAKRTMRPTQKDSETVDEDEEVDPALTVGTIKKHTLSIGDMVTGTVKSIKPTHVVVTLEDGIIGCIHASHILDDVPEGTSPTTKLKVGKTVTARVIGGRDMKTFKYLPISHPRFVRTIPELSVRPSELEDGHTALNTHSVSPMEKIKQYQAGQTVTCFLKKYNVVKKWLEVEIAPDIRGRIPLLLTSLSFKVLKHPDKKFRVGQALRATVVGPDSSKTFLCLSLTGPHKLEEGEVAMGRVVKVTPNEGLTVSFPFGKIGTVSIFHMSDSYSETPLEDFVPQKVVSLGPSVVGLARYSHVSQHSPSKKALYNKHLPEGKLLTARVLRLNHQKNLVELSFLPGDTGKPDVLSASLEGQLTKQEERKTEAEERDQKGEKKNQKRNEKKNQKGQEEVEMPSKEKQQPQKPQAQKRGGRECRESGSEQERVSKKPKKAGLSEEDDSLVDVYYREGKEEAEETNVLPKEKQTKPAEAPRLQLSSGFAWNVGLDSLTPALPPLAESSDSEEDEKPHQATIKKSKKERELEKQKAEKELSRIEEALMDPGRQPESADDFDRLVLSSPNSSILWLQYMAFHLQATEIEKARAVAERALKTISFREEQEKLNVWVALLNLENMYGSQESLTKVFERAVQYNEPLKVFLHLADIYAKSEKFQEAGELYNRMLKRFRQEKAVWIKYGAFLLRRSQAAASHRVLQRALECLPSKEHVDVIAKFAQLEFQLGDAERAKAIFENTLSTYPKRTDVWSVYIDMTIKHGSQKDVRDIFERVIHLSLAPKRMKFFFKRYLDYEKQHGTEKDVQAVKAKALEYVEAKSSVLEA

SEQ ID NO: 908529 - protein, 1443 aa, Homo sapiens
RIALDCGYPGLRVCEYRGARLVVAGCRRRGAGDPNMANLEESFPRGGTRKIHKPEKAFQQSVEQDNLFDISTEEGSTKRKKSQKGPAKTKKLKIEKRESSKSAREKFEILSVESLCEGMRILGCVKEVNELELVISLPNGLQGFVQVTEICDAYTKKLNEQVTQEQPLKDLLHLPELFSPGMLVRCVVSSLGITDRGKKSVKLSLNPKNVNRVLSAEALKPGMLLTGTVSSLEDHGYLVDIGVDGTRAFLPLLKAQEYIRQKNKGAKLKVGQYLNCIVEKVKGNGGVVSLSVGHSEVSTAIATEQQSWNLNNLLPGLVVKAQVQKVTPFGLTLNFLTFFTGVVDFMHLDPKKAGTYFSNQAVRACILCVHPRTRVVHLSLRPIFLQPGRPLTRLSCQNLGAVLDDVPVQGFFKKAGATFRLKDGVLAYARLSHLSDSKNVFNPEAFKPGNTHKCRIIDYSQMDELALLSLRTSIIEAQYLRYHDIEPGAVVKGTVLTIKSYGMLVKVGEQMRGLVPPMHLADILMKNPEKKYHIGDEVKCRVLLCDPEAKKLMMTLKKTLIESKLPVITCYADAKPGLQTHGFIIRVKDYGCIVKFYNNVQGLVPKHELSTEYIPDPERVFYTGQVVKVVVLNCEPSKERMLLSFKLSSDPEPKKEPAGHSQKKGKAINIGQLVDVKVLEKTKDGLEVAVLPHNIRAFLPTSHLSDHVANGPLLHHWLQAGDILHRVLCLSQSEGRVLLCRKPALVSTVEGGQDPKNFSEIHPGMLLIGFVKSIKDYGVFIQFPSGLSGLAPKAIMSDKFVTSTSDHFVEGQTVAAKVTNVDEEKQRMLLSLRLSDCGLGDLAITSLLLLNQCLEELQGVRSLMSNRDSVLIQTLAEMTPGMFLDLVVQEVLEDGSVVFSGGPVPDLVLKASRYHRAGQEVESGQKKKVVILNVDLLKLEVHVSLHQDLVNRKARKLRKGSEHQAIVQHLEKSFAIASLVETGHLAAFSLTSHLNDTFRFDSEKLQVGQGVSLTLKTTEPGVTGLLLAVEGPAAKRTMRPTQKDSETVDEDEEVDPALTVGTIKKHTLSIGDMVTGTVKSIKPTHVVVTLEDGIIGCIHASHILDDVPEGTSPTTKLKVGKTVTARVIGGRDMKTFKYLPISHPRFVRTIPELSVRPSELEDGHTALNTHSVSPMEKIKQYQAGQTVTCFLKKYNVVKKWLEVEIAPDIRGRIPLLLTSLSFKVLKHPDKKFRVGQALRATVVGPDSSKTFLCLSLTGPHKLEEGEVAMGRVVKVTPNEGLTVSFPFGKIGTVSIFHMSDSYSETPLEDFVPQKVVRCYILSTADNVLTLSLRSSRTNPETKSKVEDPEINSIQDIKEGQLLRGYVGSIQPHGVFFRLGPSVVGLARYSHVSQHSPSKKALYNKHLPEGKLLTGTFCPLGEAMSLGQEDKFRAQRGKWRNLGC

SEQ ID NO: 908530 - protein, 1377 aa, Homo sapiens
RIALDCGYPGLRVCEYRGARLVVAGCRRRGAGDPNMANLEESFPRGGTRKIHKPEKAFQQSVEQDNLFDISTEEGSTKRKKSQKGPAKTKKLKIEKRESSKSAREKFEILSVESLCEGMRILGCVKEVNELELVISLPNGLQGFVQVTEICDAYTKKLNEQVTQEQPLKDLLHLPELFSPGMLVRCVVSSLGITDRGKKSVKLSLNPKNVNRVLSAEALKPGMLLTGTVSSLEDHGYLVDIGVDGTRAFLPLLKAQEYIRQKNKGAKLKVGQYLNCIVEKVKGNGGVVSLSVGHSEVSTAIATEQQSWNLNNLLPGLVVKAQVQKVTPFGLTLNFLTFFTGVVDFMHLDPKKAGTYFSNQAVRACILCVHPRTRVVHLSLRPIFLQPGRPLTRLSCQNLGAVLDDVPVQGFFKKAGATFRLKDGVLAYARLSHLSDSKNVFNPEAFKPGNTHKCRIIDYSQMDELALLSLRTSIIEAQYLRYHDIEPGAVVKGTVLTIKSYGMLVKVGEQMRGLVPPMHLADILMKNPEKKYHIGDEVKCRVLLCDPEAKKLMMTLKKTLIESKLPVITCYADAKPGLQTHGFIIRVKDYGCIVKFYNNVQGLVPKHELSTEYIPDPERVFYTGQVVKVVVLNCEPSKERMLLSFKLSSDPEPKKEPAGHSQKKGKAINIGQLVDVKVLEKTKDGLEVAVLPHNIRAFLPTSHLSDHVANGPLLHHWLQAGDILHRVLCLSQSEGRVLLCRKPALVSTVEGGQDPKNFSEIHPGMLLIGFVKSIKDYGVFIQFPSGLSGLAPKAIMSDKFVTSTSDHFVEGQTVAAKVTNVDEEKQRMLLSLRLSDCGLGDLAITSLLLLNQCLEELQGVRSLMSNRDSVLIQTLAEMTPGMFLDLVVQEVLEDGSVVFSGGPVPDLVLKASRYHRAGQEVESGQKKKVVILNVDLLKLEVHVSLHQDLVNRKARKLRKGSEHQAIVQHLEKSFAIASLVETGHLAAFSLTSHLNDTFRFDSEKLQVGQGVSLTLKTTEPGVTGLLLAVEGPAAKRTMRPTQKDSETVDEDEEVDPALTVGTIKKHTLSIGDMVTGTVKSIKPTHVVVTLEDGIIGCIHASHILDDVPEGTSPTTKLKVGKTVTARVIGGRDMKTFKYLPISHPRFVRTIPELSVRPSELEDGHTALNTHSVSPMEKIKQYQAGQTVTCFLKKYNVVKKWLEVEIAPDIRGRIPLLLTSLSFKVLKHPDKKFRVGQALRATVVGPDSSKTFLCLSLTGVGMKQCLVGEGERQEGVGWVFSYCLSWRTPSVLESSESLVWDLLGTVFLLGFALAQLLHCSLSYLYLYRLPLPTQVFFSSPWERVVHHLALRSLATWQGDLSLDGSGSLSPDTPSLGSL

SEQ ID NO: 908531 - protein, 1023 aa, Homo sapiens
RIALDCGYPGLRVCEYRGARLVVAGCRRRGAGDPNMANLEESFPRGGTRKIHKPEKAFQQSVEQDNLFDISTEEGSTKRKKSQKGPAKTKKLKIEKRESSKSAREKFEILSVESLCEGMRILGCVKEVNELELVISLPNGLQGFVQVTEICDAYTKKLNEQVTQEQPLKDLLHLPELFSPGMLVRCVVSSLGITDRGKKSVKLSLNPKNVNRVLSAEALKPGMLLTGTVSSLEDHGYLVDIGVDGTRAFLPLLKAQEYIRQKNKGAKLKVGQYLNCIVEKVKGNGGVVSLSVGHSEVSTAIATEQQSWNLNNLLPGLVVKAQVQKVTPFGLTLNFLTFFTGVVDFMHLDPKKAGTYFSNQAVRACILCVHPRTRVVHLSLRPIFLQPGRPLTRLSCQNLGAVLDDVPVQGFFKKAGATFRLKDGVLAYARLSHLSDSKNVFNPEAFKPGNTHKCRIIDYSQMDELALLSLRTSIIEAQYLRYHDIEPGAVVKGTVLTIKSYGMLVKVGEQMRGLVPPMHLADILMKNPEKKYHIGDEVKCRVLLCDPEAKKLMMTLKKTLIESKLPVITCYADAKPGLQTHGFIIRVKDYGCIVKFYNNVQGLVPKHELSTEYIPDPERVFYTGQVVKVVVLNCEPSKERMLLSFKLSSDPEPKKEPAGHSQKKGKAINIGQLVDVKVLEKTKDGLEVAVLPHNIRAFLPTSHLSDHVANGPLLHHWLQAGDILHRVLCLSQSEGRVLLCRKPALVSTVEGGQDPKNFSEIHPGMLLIGFVKSIKDYGVFIQFPSGLSGLAPKAIMSDKFVTSTSDHFVEGQTVAAKVTNVDEEKQRMLLSLRLSDCGLGDLAITSLLLLNQCLEELQGVRSLMSNRDSVLIQTLAEMTPGMFLDLVVQEVLEDGSVVFSGGPVPDLVLKASRYHRAGQEVESGQKKKVVILNVDLLKLEVHVSLHQDLVNRKARKLRKGSEHQAIVQHLEKSFAIASLVETGHLAAFSLTSHLNDTFRFDSEKLQVGQGVSLTLKTTDPASC

SEQ ID NO: 908532 - protein, 715 aa, Homo sapiens
PTHPTPAPEHPCWAAWGLAGGAGPGERVGRASGGDEVKVIDAAQPGSGRGRGCVSVALELAEVMSGGDTRAAIARPRMAAAHGPVAPSSPEQNGAVPSEATKRDQNLKRGNWGNQIEFVLTSVGYAVGLGNVWRFPYLCYRNGGGAFMFPYFIMLIFCGIPLFFMELSFGQFASQGCLGVWRISPMFKGVGYGMMVVSTYIGIYYNVVICIAFYYFFSSMTHVLPWAYCNNPWNTHDCAGVLDASNLTNGSRPAALPSNLSHLLNHSLQRTSPSEEYWRLYVLKLSDDIGNFGEVRLPLLGCLGVSWLVVFLCLIRGVKSSGKVVYFTATFPYVVLTILFVRGVTLEGAFDGIMYYLTPQWDKILEAKVWGDAASQIFYSLACAWGGLITMASYNKFHNNCYRDSVIISITNCATSVYAGFVIFSILGFMANHLGVDVSRVADHGPGLAFVAYPEALTLLPISPLWSLLFFFMLILLGLGTQFCLLETLVTAIVDEVGNEWILQKKTYVTLGVAVAGFLLGIPLTSQAGIYWLLLMDNYAASFSLVVISCIMCVAIMYIYGHRNYFQDIQMMLGFPPPLFFQICWRFVSPAIIFFILVFTVIQYQPITYNHYQYPGWAVAIGFLMALSSVLCIPLYAMFRLCRTDGDTLLQRLKNATKPSRDWGPALLEHRTGRYAPTIAPSPEDGFEVQSLHPDKAQIPIVGSNGSSRLQDSRI

SEQ ID NO: 908533 - protein, 252 aa, Homo sapiens
EALVTDALLTEALVTVRNERPSGEGCLGVWRISPMFKGVGYGMMVVSTYIGIYYNVVICIAFYYFFSSMTHVLPWAYCNNPWNTHDCAGVLDASNLTNGSRPAALPSNLSHLLNHSLQRTSPSEEYWRLYVLKLSDDIGNFGEVRLPLLGCLGVSWLVVFLCLIRGVKSSGKVVYFTATFPYVVLTILFVRGVTLEGAFDGIMYYLTPQWDKILEAKVWGDAASQIFYSLACAWGGLITMASYNKFHNNCYR

SEQ ID NO: 908534 - protein, 769 aa, Homo sapiens
PTHPTPAPEHPCWAAWGLAGGAGPGERVGRASGGDEVKVIDAAQPGSGRGRGCVSVALELAEVMSGGDTRAAIARPRMAAAHGPVAPSSPEQVTLLPVQRSFFLPPFSGATPSTSLAESVLKVWHGAYNSGLLPQLMAQHSLAMAQNGAVPSEATKRDQNLKRGNWGNQIEFVLTSVGYAVGLGNVWRFPYLCYRNGGGAFMFPYFIMLIFCGIPLFFMELSFGQFASQGCLGVWRISPMFKGVGYGMMVVSTYIGIYYNVVICIAFYYFFSSMTHVLPWAYCNNPWNTHDCAGVLDASNLTNGSRPAALPSNLSHLLNHSLQRTSPSEEYWRLYVLKLSDDIGNFGEVRLPLLGCLGVSWLVVFLCLIRGVKSSGKVVYFTATFPYVVLTILFVRGVTLEGAFDGIMYYLTPQWDKILEAKVWGDAASQIFYSLACAWGGLITMASYNKFHNNCYRDSVIISITNCATSVYAGFVIFSILGFMANHLGVDVSRVADHGPGLAFVAYPEALTLLPISPLWSLLFFFMLILLGLGTQFCLLETLVTAIVDEVGNEWILQKKTYVTLGVAVAGFLLGIPLTSQAGIYWLLLMDNYAASFSLVVISCIMCVAIMYIYGHRNYFQDIQMMLGFPPPLFFQICWRFVSPAIIFFILVFTVIQYQPITYNHYQYPGWAVAIGFLMALSSVLCIPLYAMFRLCRTDGDTLLQRLKNATKPSRDWGPALLEHRTGRYAPTIAPSPEDGFEVQSLHPDKAQIPIVGSNGSSRLQDSRI

SEQ ID NO: 908535 - protein, 233 aa, Homo sapiens
EALVTDALLTEALVTVRNERPSGEGCLGVWRISPMFKGVGYGMMVVSTYIGIYYNVVICIAFYYFFSSMTHVLPWAYCNNPWNTHDCAGVLDASNLTNGSRPAALPSNLSHLLNHSLQRTSPSEEYWRLYVLKLSDDIGNFGEVRLPLLGCLGVSWLVVFLCLIRGVKSSGKVVYFTATFPYVVLTILFVRGVTLEGAFDGIMYYLTPQWDKILEAKVWGDAASQIFYSLACA

SEQ ID NO: 908536 - protein, 173 aa, Homo sapiens
MARMNRPAPVEVTYKNMRFLITHNPTNATLNKFIEELKKYGVTTIVRVCEATYDTTLVEKEGIHVLDWPFDDGAPPSNQIVDDWLSLVKIKFREEPGCCIAVHCVAGLGRAPVLVALALIEGGMKYEDAVQFIRQKRRGAFNSKQLLYLEKYRPKMRLRFKDSNGHRNNCCIQ

SEQ ID NO: 908537 - protein, 173 aa, Homo sapiens; identical to SEQ ID NO: 908536

SEQ ID NO: 908538 - protein, 173 aa, Homo sapiens; identical to SEQ ID NO: 908536

SEQ ID NO: 908539 - protein, 173 aa, Homo sapiens; identical to SEQ ID NO: 908536

SEQ ID NO: 908540 - protein, 173 aa, Homo sapiens; identical to SEQ ID NO: 908536

SEQ ID NO: 908541 - protein, 173 aa, Homo sapiens; identical to SEQ ID NO: 908536

SEQ ID NO: 908542 - protein, 173 aa, Homo sapiens; identical to SEQ ID NO: 908536

SEQ ID NO: 908543 - protein, 170 aa, Homo sapiens
MNRPAPVEVTYKNMRFLITHNPTNATLNKFIEELKKYGVTTIVRVCEATYDTTLVEKEGIHVLDWPFDDGAPPSNQIVDDWLSLVKIKFREEPGCCIAVHCVAGLGRAPVLVALALIEGGMKYEDAVQFIRQKRRGAFNSKQLLYLEKYRPKMRLRFKDSNGHRNNCCIQ

SEQ ID NO: 908544 - protein, 173 aa, Homo sapiens; identical to SEQ ID NO: 908536

SEQ ID NO: 908545 - protein, 173 aa, Homo sapiens; identical to SEQ ID NO: 908536

SEQ ID NO: 908546 - protein, 187 aa, Homo sapiens
MCALLDRFNYEKRGLQHDSFQSINRNLSRSHPFLTSGFLHPGALPAAPSLPRPGDAPTRRLAIHQPVHTGGGRRGVTSGGGGPPPPPVGSWPAVPGRDWWLEGCTSRRLERGGLVTQGRLGACIGSFGCGPARLRALLRAAHCMVESGAPAAACIAATAAPPRPPPPPALQPPPPPVSPPPRDRLYD

SEQ ID NO: 908547 - protein, 173 aa, Homo sapiens; identical to SEQ ID NO: 908536

SEQ ID NO: 908548 - protein, 173 aa, Homo sapiens; identical to SEQ ID NO: 908536

SEQ ID NO: 908549 - protein, 173 aa, Homo sapiens; identical to SEQ ID NO: 908536

SEQ ID NO: 908550 - protein, 173 aa, Homo sapiens; identical to SEQ ID NO: 908536

SEQ ID NO: 908551 - protein, 173 aa, Homo sapiens; identical to SEQ ID NO: 908536

SEQ ID NO: 908552 - protein, 173 aa, Homo sapiens; identical to SEQ ID NO: 908536

SEQ ID NO: 908553 - protein, 173 aa, Homo sapiens; identical to SEQ ID NO: 908536

SEQ ID NO: 908554 - protein, 173 aa, Homo sapiens; identical to SEQ ID NO: 908536

SEQ ID NO: 908555 - protein, 173 aa, Homo sapiens; identical to SEQ ID NO: 908536

SEQ ID NO: 908556 - protein, 343 aa, Homo sapiens
RAVSCLFRRHASSSSLYSSPLLAPSRALLRRCPAPSRRRACCCPAVSPSPPPPLCRASCACLPCRPPLRLLFLASLASSPSDRSPLSRLRAPRRPGRRPLVALVVSCFVLLFLPVFRSLVSCSLRIFGPPLSALFRVFALCRVVLCRALFPCSVLRLLSSFPVLPLAVVFPSPLLAPRSSPSPSLSLSRVLWCPSSRSRSSSFCAAARPLSLRRVAVVLCSFSLLFCVAAPPQSLLLSSPVRPPPWSLRLSASPALLAVLWLVLSLYPPCVLFCASAPPAGGLRAAPPLPLFFFLLVSFFLSSLSLSLLFFFFFFFFFFFFSLFFFFFFFFFFFFFLFLFLFW

SEQ ID NO: 908557 - protein, 366 aa, Homo sapiens
MAAARHSTLDFMLGAKADGETILKGLQSIFQEQGMAESVHTWQDHGYLATYTNKNGSFANLRIYPHGLVLLDLQSYDGDAQGKEEIDSILNKVEERMKELSQDSTGRVKRLPPIVRGGAIDRYWPTADGRLVEYDIDEVVYDEDSPYQNIKILHSKQFGNILILSGDVNLAESDLAYTRAIMGSGKEDYTGKDVLILGGGDGGILCEIVKLKPKMVTMVEIDQMVIDGCKKYMRKTCGDVLDNLKGDCYQVLIEDCIPVLKRYAKEGREFDYVINDLTAVPISTSPEEDSTWEFLRLILDLSMKVLKQDGKYFTQGNCVNLTEALSLYEEQLGRLYCPVEFSKEIVCVPSYLELWVFYTVWKKAKP

SEQ ID NO: 908558 - protein, 366 aa, Homo sapiens; identical to SEQ ID NO: 908557

SEQ ID NO: 908559 - protein, 332 aa, Homo sapiens
MAESVHTWQDHGYLATYTNKNGSFANLRIYPHGLVLLDLQSYDGDAQGKEEIDSILNKVEERMKELSQDSTGRVKRLPPIVRGGAIDRYWPTADGRLVEYDIDEVVYDEDSPYQNIKILHSKQFGNILILSGDVNLAESDLAYTRAIMGSGKEDYTGKDVLILGGGDGGILCEIVKLKPKMVTMVEIDQMVIDGCKKYMRKTCGDVLDNLKGDCYQVLIEDCIPVLKRYAKEGREFDYVINDLTAVPISTSPEEDSTWEFLRLILDLSMKVLKQDGKYFTQGNCVNLTEALSLYEEQLGRLYCPVEFSKEIVCVPSYLELWVFYTVWKKAKP

SEQ ID NO: 908560 - protein, 270 aa, Homo sapiens
MKELSQDSTGRVKRLPPIVRGGAIDRYWPTADGRLVEYDIDEVVYDEDSPYQNIKILHSKQFGNILILSGDVNLAESDLAYTRAIMGSGKEDYTGKDVLILGGGDGGILCEIVKLKPKMVTMVEIDQMVIDGCKKYMRKTCGDVLDNLKGDCYQVLIEDCIPVLKRYAKEGREFDYVINDLTAVPISTSPEEDSTWEFLRLILDLSMKVLKQDGKYFTQGNCVNLTEALSLYEEQLGRLYCPVEFSKEIVCVPSYLELWVFYTVWKKAKP

SEQ ID NO: 908561 - protein, 366 aa, Homo sapiens; identical to SEQ ID NO: 908557

SEQ ID NO: 908562 - protein, 190 aa, Homo sapiens
MAAARHSTLDFMLGAKADGETILKGLQSIFQEQGMAESVHTWQDHGYLATYTNKNGSFANLRIYPHGLVLLDLQSYDGDAQGKEEIDSILNKVEERMKELSQDSTGRVKRLPPIVRGGAIDRYWPTADGRLVEYDIDEVVYDEDSPYQNIKIWQRVIWHIPGPSWAVAKKITLAKMYSFWEVETEAYCVK

SEQ ID NO: 908563 - protein, 360 aa, Homo sapiens
MAAARHSTLDFMLGAKADGETILKGLQSIFQEQGMAESVHTWQDHGYLATYTNKNGSFANLRIYPHGLVLLDLQSYDGDAQGKEEIDSILNKVEERMKELSQDSTGRVKRLPPIVRGGAIDRYWPTADGRLVEYDIDEVVYDEDSPYQNIKILHSKQFGNILILSGDVNLAESDLAYTRAIMGSGKEDYTGKDVLILGGGDGGILCEIVKLKPKMVTMVEIDQMVIDGCKKYMRKTCGDVLDNLKGDCYQVLIEDCIPVLKRYAKEGREFDYVINDLTAVPISTSPEEDSTWEFLRLILDLSMKVLKQDGKYFTQGNCVNLTEALSLYEEQLGRLYCPVEFRPVPRLCHACQARLVEDRL

SEQ ID NO: 908564 - protein, 177 aa, Homo sapiens
MAAARHSTLDFMLGAKADGETILKGLQSIFQEQGMAESVHTWQDHGYLATYTNKNGRLPPIVRGGAIDRYWPTADGRLVEYDIDEVVYDEDSPYQNIKILHSKQFGNILILSGDVNLAESDLAYTRAIMGSGKEDYTGKDVLILGGGDGGILCEIVKLKPKMVTMVEVGILHCLEES

SEQ ID NO: 908565 - protein, 235 aa, Homo sapiens
MAAARHSTLDFMLGAKADGETILKGLQSIFQEQGMAESVHTWQDHGYLATYTNKNGSFANLRIYPHGLVLLDLQSYDGDAQGKEEIDSILNKVEERMKELSQDSTGRVKRLPPIVRGGAIDRYWPTADGRLVEYDIDEVVYDEDSPYQNIKILHSKQFGNILILSGDVNLAESDLAYTRAIMGSGKEDYTGKDVLILGGGDGGILCEIELYGSVKKISITVPKLSFDNVSSVSLR

SEQ ID NO: 908566 - protein, 286 aa, Homo sapiens
MAAARHSTLDFMLGAKADGETILKGLQSIFQEQGMAESVHTWQDHGYLATYTNKNGSFANLRIYPHGLVLLDLQSYDGDAQGKEEIDSILNKVEERMKELSQDSTGRVKRLPPIVRGGAIDRYWPTADGRLVEYDIDEVVYDEDSPYQNIKILHSKQFGNILILSGDVNLGRRVILALYPGPIIGQGQEDPLGKMSHLAVHGALVNVNYPDALVIARCWVTICNRGFTLDVASPTAPGIVTGPAGSPEDGSSESFSDPTHSHKPPPPHHPPTTPPSTSPQPAKLTD

SEQ ID NO: 908567 - protein, 366 aa, Homo sapiens; identical to SEQ ID NO: 908557

SEQ ID NO: 908568 - protein, 366 aa, Homo sapiens; identical to SEQ ID NO: 908557

SEQ ID NO: 908569 - protein, 454 aa, Homo sapiens
AEAALLLAPRSVPAAARGLQGQSRVPAGRAALPGPGRPPALPRGLAAFALPLGESPGCRARADPPWDEGCRDCGGARRDPRGEPGLGACAERGCPRDLFLFLQAADGETILKGLQSIFQEQGMAESVHTWQDHGYLATYTNKNGSFANLRIYPHGLVLLDLQSYDGDAQGKEEIDSILNKVEERMKELSQDSTGRVKRLPPIVRGGAIDRYWPTADGRLVEYDIDEVVYDEDSPYQNIKILHSKQFGNILILSGDVNLAESDLAYTRAIMGSGKEDYTGKDVLILGGGDGGILCEIVKLKPKMVTMVEIDQMVIDGCKKYMRKTCGDVLDNLKGDCYQVLIEDCIPVLKRYAKEGREFDYVINDLTAVPISTSPEEDSTWEFLRLILDLSMKVLKQDGKYFTQGNCVNLTEALSLYEEQLGRLYCPVEFSKEIVCVPSYLELWVFYTVWKKAKP

SEQ ID NO: 908570 - protein, 366 aa, Homo sapiens; identical to SEQ ID NO: 908557

SEQ ID NO: 908571 - protein, 372 aa, Homo sapiens
MAAARHSTLDFMLGAKADGETILKGLQSIFQEQGMAESVHTWQDHGYLATYTNKNGSFANLRIYPHGLVLLDLQSYDGDAQGKEEIDSILNKVEERMKELSQDSTGRVKRLPPIVRGGAIDRYWPTADGRLVEYDIDEVVYDEDSPYQNIKILHSKQFGNILILSGDVNLAESDLAYTRAIMGSGKEDYTGKDVLILGGGDGGILCEIVKLKPKMVTMVEIDQMVIDGCKKYMRKTCGDVLDNLKGDCYQVLIEDCIPVLKRYAKEGREFDYVINDLTAVPISTSPEEDSTWEFLRLILDLSMKVLKQDGKYFTQGNCVNLTEALSLYEEQLGRLYCPVEFSKEIVCVPSYLEFSLTFWRVSSSNAPVVANK

SEQ ID NO: 908572 - protein, 280 aa, Homo sapiens
MAAARHSTLDFMLGAKADGETILKGLQSIFQEQGMAESVHTWQDHGYLATYTNKNGSFANLRIYPHGLVLLDLQSYDGDAQGKEEIDSILNKVEERMKELSQDSTGRVKRLPPIVRGGAIDRYWPTADGRLVEYDIDEVVYDEDSPYQNIKILHSKQFGNILILSGDVNLAESDLAYTRAIMGSGKEDYTGKDVLILGGGDGGILCEIVKLKPKMVTMVEIDQMVIDGCKKYMRKTCGDVLDNLKGDCYQVLIEDCIPVLKRYAKEGREFDYVINDLTAV

SEQ ID NO: 908573 - protein, 224 aa, Homo sapiens
MAAARHSTLDFMLGAKADGETILKGLQSIFQEQGMAESVHTWQDHGYLATYTNKNGSFANLRIYPHGLVLLDLQSYDGDAQGKEEIDSILNKVEERMKELSQDSTGRVKRLPPIVRGGAIDRYWPTADGRLVEYDIDEVVYDEDSPYQNIKILHSKQFGNILILSGDVNLAESDLAYTRAIMGSGKEDYTGKDVLILGGGDGGILCEIELQFLHKESKRTISFT

SEQ ID NO: 908574 - protein, 196 aa, Homo sapiens
MADGQMPFSCHYPSRLRRDPFRDSPLSSRLLDDGFGMDPFPDDLTASWPDWALPRLSSAWPGTLRSGMVPRGPTATARFGVPAEGRTPPPFPGEPWKVCVNVHSFKPEELMVKTKDGYVEVSGKHEEKQQEGGIVSKNFTKKIQLPAEVDPVTVFASLSPEGLLIIEAPQVPPYSTFGESSFNNELPQDSQEVTCT

SEQ ID NO: 908575 - protein, 149 aa, Homo sapiens
MADGQMPFSCHYPSRLRRDPFRDSPLSSRLLDDGFGMDPFPDDLTASWPDWALPRLSSAWPGTLRSGMVPPGGPPHCPAVFGLCLGTPPPPLGEPLKSCGVEMVPQLSKPSREWVPDGWGGLAQMEEQWVLSQKKKPNIPCRKVGSLCV

SEQ ID NO: 908576 - protein, 214 aa, Homo sapiens
MADGQMPFSCHYPSRLRRDPFRDSPLSSRLLDDGFGMDPFPDDLTASWPDWALPRLSSAWPGTLRSGMVPRGPTATARFGVPAEGRTPPPFPGEPWKVCVNVHSFKPEELMVKTKDGYVEVSGKHEEKQQEGGIVSKNFTKKIQLPAEVDPVTVFASLSPEGLLIIEAPQVPPCFVPNPRASLIPGYITLAELRFSASKMLEGAGVRTDHRFPG

SEQ ID NO: 908577 - protein, 137 aa, Homo sapiens [sequence omitted]

SEQ ID NO: 908578 - protein, 116 aa, Homo sapiens
KGYFSLGTSPITQVPWKVCVNVHSFKPEELMVKTKDGYVEVSGKHEEKQQEGGIVSKNFTKKIQLPAEVDPVTVFASLSPEGLLIIEAPQVPPYSTFGESSFNNELPQDSQEVTCT

SEQ ID NO: 908579 - protein, 105 aa, Homo sapiens
IDLEDSPLEDVHSFKPEELMVKTKDGYVEVSGKHEEKQQEGGIVSKNFTKKIQLPAEVDPVTVFASLSPEGLLIIEAPQVPPYSTFGESSFNNELPQDSQEVTCT

SEQ ID NO: 908580 - protein, 196 aa, Homo sapiens; identical to SEQ ID NO: 908574

SEQ ID NO: 908581 - protein, 102 aa, Homo sapiens
MADGQMPFSCHYPSRLRRDPFRDSPLSSRLLDDGFGMDPFPDDLTASWPDWALPRLSSACRGQDPPTLPWGALESVCECAQLQARGVDGEDQRWIRGGVWQT

SEQ ID NO: 908582 - protein, 85 aa, Homo sapiens
LAALTLLTTANRKHEEKQQEGGIVSKNFTKKIQLPAEVDPVTVFASLSPEGLLIIEAPQVPPYSTFGESSFNNELPQDSQEVTCT

SEQ ID NO: 908583 - protein, 84 aa, Homo sapiens
CRYYYLAGVSGKHEEKQQEGGIVSKNFTKKIQLPAEVDPVTVFASLSPEGLLIIEAPQVPPYSTFGESSFNNELPQDSQEVTCT

SEQ ID NO: 908584 - protein, 243 aa, Homo sapiens
RGRGGAWSAAAAGPGAGAAAAATGGGGGALEAAMAKQYDSVECPFCDEVSKYEKLAKIGQGTFGEVFKARHRKTGQKVALKKVLMENEKEGFPITALREIKILQLLKHENVVNLIEICRTKASPYNRCKGSIYLVFDFCEHDLAGLLSNVLVKFTLSEIKRVMQMLLNGLYYIHRNKILHRDMKAANVLITRDGVLKLADFGLARAFSLAKNSQPNRYTNRVVTLWYRPPELLLGEDSRAGQG

SEQ ID NO: 908585 - protein, 372 aa, Homo sapiens
MAKQYDSVECPFCDEVSKYEKLAKIGQGTFGEVFKARHRKTGQKVALKKVLMENEKEGFPITALREIKILQLLKHENVVNLIEICRTKASPYNRCKGSIYLVFDFCEHDLAGLLSNVLVKFTLSEIKRVMQMLLNGLYYIHRNKILHRDMKAANVLITRDGVLKLADFGLARAFSLAKNSQPNRYTNRVVTLWYRPPELLLGERDYGPPIDLWGAGCIMAEMWTRSPIMQGNTEQHQLALISQLCGSITPEVWPNVDNYELYEKLELVKGQKRKVKDRLKAYVRDPYALDLIDKLLVLDPAQRIDSDDALNHDFFWSDPMPSDLKGMLSTHLTSMFEYLAPPRRKGSQITQQSTNQSRNPATTNQTEFERVF

SEQ ID NO: 908586 - protein, 367 aa, Homo sapiens
MAKQYDSVECPFCDEVSKYEKLAKIGQGTFGEVFKARHRKTGQKVALKKVLMENEKEGFPITALREIKILQLLKHENVVNLIEICRTKASPYNRCKGSIYLVFDFCEHDLAGLLSNVLVKFTLSEIKRVMQMLLNGLYYIHRNKILHRDMKAANVLITRDGVLKLADFGLARAFSLAKNSQPNRYTNRVVTLWYRPPELLLGERDYGPPIDLWGAGCIMAEMWTRSPIMQGNTEQHQLALISQLCGSITPEVWPNVDNYELYEKLELVKGQKRKVKDRLKAYVRDPYALDLIDKLLVLDPAQRIDSDDALNHDFFWSDLKGMLSTHLTSMFEYLAPPRRKGSQITQQSTNQSRNPATTNQTEFERVF

SEQ ID NO: 908587 - protein, 372 aa, Homo sapiens; identical to SEQ ID NO: 908585

SEQ ID NO: 908588 - protein, 347 aa, Homo sapiens
MLALSPNLAVSTDPRAGLCTALTLDHFPLFLTQFPITALREIKILQLLKHENVVNLIEICRTKASPYNRCKGSIYLVFDFCEHDLAGLLSNVLVKFTLSEIKRVMQMLLNGLYYIHRNKILHRDMKAANVLITRDGVLKLADFGLARAFSLAKNSQPNRYTNRVVTLWYRPPELLLGERDYGPPIDLWGAGCIMAEMWTRSPIMQGNTEQHQLALISQLCGSITPEVWPNVDNYELYEKLELVKGQKRKVKDRLKAYVRDPYALDLIDKLLVLDPAQRIDSDDALNHDFFWSDPMPSDLKGMLSTHLTSMFEYLAPPRRKGSQITQQSTNQSRNPATTNQTEFERVF

SEQ ID NO: 908589 - protein, 437 aa, Homo sapiens
RGRGGAWSAAAAGPGAGAAAAATGGGGGALEAAMAKQYDSVECPFCDEVSKYEKLAKIGQGTFGEVFKARHRKTGQKVALKKVLMENEKEGFPITALREIKILQLLKHENVVNLIEICRTKDGDCFFWSSFIVAGASSGPALAQKRHSENILTASPYNRCKGSIYLVFDFCEHDLAGLLSNVLVKFTLSEIKRVMQMLLNGLYYIHRNKILHRDMKAANVLITRDGVLKLADFGLARAFSLAKNSQPNRYTNRVVTLWYRPPELLLGERDYGPPIDLWGAGCIMAEMWTRSPIMQGNTEQHQLALISQLCGSITPEVWPNVDNYELYEKLELVKGQKRKVKDRLKAYVRDPYALDLIDKLLVLDPAQRIDSDDALNHDFFWSDPMPSDLKGMLSTHLTSMFEYLAPPRRKGSQITQQSTNQSRNPATTNQTEFERVF

SEQ ID NO: 908590 - protein, 195 aa, Homo sapiens
RGRGGAWSAAAAGPGAGAAAAATGGGGGALEAAMAKQYDSVECPFCDEVSKYEKLAKIGQGTFGEVFKARHRKTGQKVALKKVLMENEKEGFPITALREIKILQLLKHENVVNLIEICRTKASPYNRCKGSIYLVFDFCEHDLAGLLSNVLVKFTLSEIKRVMQMLLNGLYYIHRNKILHRDMKAANVLITRDGV

SEQ ID NO: 908591 - protein, 238 aa, Homo sapiens
RGRGGAWSAAAAGPGAGAAAAATGGGGGALEAAMAKQYDSVECPFCDEVSKYEKLAKIGQGTFGEVFKARHRKTGQKVALKKVLMENEKEGFPITALREIKILQLLKHENVVNLIEICRTKASPYNRCKGSIYLVFDFCEHDLAGLLSNVLVKFTLSEIKRVMQMLLNGLYYIHRNKHDFFWSDPMPSDLKGMLSTHLTSMFEYLAPPRRKGSQITQQSTNQSRNPATTNQTEFERVF

SEQ ID NO: 908592 - protein, 322 aa, Homo sapiens
MAKQYDSVECPFCDEVSKYEKLAKIGQGTFGEVFKARHRKTGQKVALKKVLMENEKEGFPITALREIKILQLLKHENVVNLIEICRTKASPYNRCKGSIYLVFDFCEHDLAGLLSNVLVKFTLSEIKRVMQMLLNGLYYIHRNKILHRDMKAANVLITRDGVLKLADFGLARAFSLAKNSQPNRYTNRVVTLWYRPPELLLGERDYGPPIDLWGAGCIMAEMWTRSPIMQGNTEQHQLALISQLCGSITPEVWPNVDNYELYEKLELVKGQKRKVKDRLKAYVRDPYALDLIDKLLVLDPAQRIDSDDALNHDFFWSDPMPL

SEQ ID NO: 908593 - protein, 129 aa, Homo sapiens
LSTPPPSQVWPNVDNYELYEKLELVKGQKRKVKDRLKAYVRDPYALDLIDKLLVLDPAQRIDSDDALNHDFFWSDPMPSDLKGMLSTHLTSMFEYLAPPRRKGSQITQQSTNQSRNPATTNQTEFERVF

SEQ ID NO: 908594 - protein, 372 aa, Homo sapiens; identical to SEQ ID NO: 908585

SEQ ID NO: 908595 - protein, 372 aa, Homo sapiens; identical to SEQ ID NO: 908585

SEQ ID NO: 908596 - protein, 372 aa, Homo sapiens; identical to SEQ ID NO: 908585

SEQ ID NO: 908597 - protein, 372 aa, Homo sapiens; identical to SEQ ID NO: 908585

SEQ ID NO: 908598 - protein, 374 aa, Homo sapiens
PIWTSRHRITLGTRCSNFTFRAGNTFVYSSDPSEVFKARHRKTGQKVALKKVLMENEKEGFPITALREIKILQLLKHENVVNLIEICRTKASPYNRCKGSIYLVFDFCEHDLAGLLSNVLVKFTLSEIKRVMQMLLNGLYYIHRNKILHRDMKAANVLITRDGVLKLADFGLARAFSLAKNSQPNRYTNRVVTLWYRPPELLLGERDYGPPIDLWGAGCIMAEMWTRSPIMQGNTEQHQLALISQLCGSITPEVWPNVDNYELYEKLELVKGQKRKVKDRLKAYVRDPYALDLIDKLLVLDPAQRIDSDDALNHDFFWSDPMPSDLKGMLSTHLTSMFEYLAPPRRKGSQITQQSTNQSRNPATTNQTEFERVF

SEQ ID NO: 908599 - protein, 212 aa, Homo sapiens
GQASTWPLPPNCQGFLSCRPWGIEPQEALGLKGPSWCALLPRERDYGPPIDLWGAGCIMAEMWTRSPIMQGNTEQHQLALISQLCGSITPEVWPNVDNYELYEKLELVKGQKRKVKDRLKAYVRDPYALDLIDKLLVLDPAQRIDSDDALNHDFFWSDPMPSDLKGMLSTHLTSMFEYLAPPRRKGSQITQQSTNQSRNPATTNQTEFERVF

SEQ ID NO: 908600 - protein, 372 aa, Homo sapiens; identical to SEQ ID NO: 908585

SEQ ID NO: 908601 - protein, 675 aa, Homo sapiens
MPRAQPSSASYQPVPADPFAIVSRAQQMVEILSDENRNLRQELEGCYEKVARLQKVETEIQRVSEAYENLVKSSSKREALEKAMRNKLEGEIRRMHDFNRDLRERLETANKQLAEKEYEGSEDTRKTISQLFAKNKESQREKEKLEAELATARSTNEDQRRHIEIRDQALSNAQAKVVKLEEELKKKQVYVDKVEKMQQALVQLQAACEKREQLEHRLRTRLERELESLRIQQRQGNCQPTNVSEYNAAALMELLREKEERILALEADMTKWEQKYLEENVMRHFALDAAATVAAQRDTTVISHSPNTSYDTALEARIQKEEEEILMANKRCLDMEGRIKTLHAQIIEKDAMIKVLQQRSRKEPSKTEQLSCMRPAKSLMSISNAGSGLLSHSSTLTGSPIMEEKRDDKSWKGSLGILLGGDYRAEYVPSTPSPVPPSTPLLSAHSKTGSRDCSTQTERGTESNKTAAVAPISVPAPVAAAATAAAITATAATITTTMVAAAPVAVAAAAAPAAAAAPSPATAAATAAAVSPAAAGQIPAAASVASAAAVAPSAAAAAAVQVAPAAPAPVPAPALVPVPAPAAAQASAPAQTQAPTSAPAVAPTPAPTPTPAVAQAEVPASPATGPGPHRLSIPSLTCNPDKTDGPVFHSNTLERKTPIQILGQEPDAEMVEYLI

SEQ ID NO: 908602 - protein, 675 aa, Homo sapiens; identical to SEQ ID NO: 908601

SEQ ID NO: 908603 - protein, 675 aa, Homo sapiens; identical to SEQ ID NO: 908601

SEQ ID NO: 908604 - protein, 675 aa, Homo sapiens; identical to SEQ ID NO: 908601

SEQ ID NO: 908605 - protein, 675 aa, Homo sapiens; identical to SEQ ID NO: 908601

SEQ ID NO: 908606 - protein, 406 aa, Homo sapiens
MQLFLLLCLVLLSPQGASLHRHHPREMKKRVEDLHVGATVAPSSRRDFTFDLYRALASAAPSQNIFFSPVSISMSLAMLSLGAGSSTKMQILEGLGLNLQKSSEKELHRGFQQLLQELNQPRDGFQLSLGNALFTDLVVDLQDTFVSAMKTLYLADTFPTNFRDSAGAMKQINDYVAKQTKGKIVDLLKNLDSNAVVIMVNYIFFKAKWETSFNHKGTQEQDFYVTSETVVRVPMMSREDQYHYLLDRNLSCRVVGVPYQGNATALFILPSEGKMQQVENGLSEKTLRKWLKMFKKRQLELYLPKFSIEGSYQLEKVLPSLGISNVFTSHADLSGISNHSNIQVSEMVHKAVVEVDESGTRAAAATGTIFTFRSARLNSQRLVFNRPFLMFIVDNNILFLGKVNRP

SEQ ID NO: 908607 - protein, 442 aa, Homo sapiens
KCWLQSSQPSALSEPEGLPPPLCAHSATGHKQRTATMQLFLLLCLVLLSPQGASLHRHHPREMKKRVEDLHVGATVAPSSRRDFTFDLYRALASAAPSQNIFFSPVSISMSLAMLSLGAGSSTKMQILEGLGLNLQKSSEKELHRGFQQLLQELNQPRDGFQLSLGNALFTDLVVDLQDTFVSAMKTLYLADTFPTNFRDSAGAMKQINDYVAKQTKGKIVDLLKNLDSNAVVIMVNYIFFKAKWETSFNHKGTQEQDFYVTSETVVRVPMMSREDQYHYLLDRNLSCRVVGVPYQGNATALFILPSEGKMQQVENGLSEKTLRKWLKMFKKRQLELYLPKFSIEGSYQLEKVLPSLGISNVFTSHADLSGISNHSNIQVSEMVHKAVVEVDESGTRAAAATGTIFTFRSARLNSQRLVFNRPFLMFIVDNNILFLGKVNRP

SEQ ID NO: 908608 - protein, 363 aa, Homo sapiens
KCWLQSSQPSALSEPEGLPPPLCAHSATGHKQRTATMQLFLLLCLVLLSPQGASLHRHHPREMKKRVEDLHVGATVAPSSRRDFTFDLYRALASAAPSQNIFFSPVSISMSLAMLSLGAGSSTKMQILEGLGLNLQKSSEKELHRGFQQLLQELNQPRDGFQLSLGNALFTDLVVDLQDTFVSAMKTLYLADTFPTNFRDSAGAMKQINDYVAKQTKGKIVDLLKNLDSNAVVIMVNYIFFKAKWETSFNHKGTQEQDFYVTSETVVRVPMMSREDQYHYLLDRNLSCRVVGVPYQGNATALFILPSEGKMQQVENGLSEKTLRKWLKMFKKRWCTKLWWRWTSREPEQRQPRGQYSLSGRPA

SEQ ID NO: 908609 - protein, 426 aa, Homo sapiens
KCWLQSSQPSALSEPEGLPPPLCAHSATGHKQRTATMQLFLLLCLVLLSPQGASLHRHHPREMKKRVEDLHVGATVAPSSRRDFTFDLYRALASAAPSQNIFFSPVSISMSLAMLSLGAGSSTKMQILEGLGLNLQKSSEKELHRGFQQLLQELNQPRDGFQLSLGNALFTDLVVDLQDTFVSAMKTLYLADTFPTNFRDSAGAMKQINDYVAKQTKGKIVDLLKNLDSNAVVIMVNYIFFKAKWETSFNHKGTQEQDFYVTSETVVRVPMMSREDQYHYLLDRNLSCRVVGVPYQGNATALFILPSEGKMQQVENGLSEKTLRKWLKMFKKRQLELYLPKFSIEGSYQLEKVLPSLGISNVFTSHADLSGISNHSNIQVSEMVHKAVVEVDESGTRAAAATGTIFTFRCLGEMWRTFNLAVTIHQ

SEQ ID NO: 908610 - protein, 406 aa, Homo sapiens; identical to SEQ ID NO: 908606

SEQ ID NO: 908611 - protein, 388 aa, Homo sapiens
MQLFLLLCLVLLSPQGASLHRHHPREMKKRVEDLHVGATVAPSSRRDFTFDLYRALASAAPSQNIFFSPVSISMSLAMLSLGAGSSTKMQILEGLGLNLQKKPRDGFQLSLGNALFTDLVVDLQDTFVSAMKTLYLADTFPTNFRDSAGAMKQINDYVAKQTKGKIVDLLKNLDSNAVVIMVNYIFFKAKWETSFNHKGTQEQDFYVTSETVVRVPMMSREDQYHYLLDRNLSCRVVGVPYQGNATALFILPSEGKMQQVENGLSEKTLRKWLKMFKKRQLELYLPKFSIEGSYQLEKVLPSLGISNVFTSHADLSGISNHSNIQVSEMVHKAVVEVDESGTRAAAATGTIFTFRSARLNSQRLVFNRPFLMFIVDNNILFLGKVNRP

SEQ ID NO: 908612 - protein, 283 aa, Homo sapiens
PTRGNSSNLVPNSARVDLQDTFVSAMKTLYLADTFPTNFRDSAGAMKQINDYVAKQTKGKIVDLLKNLDSNAVVIMVNYIFFKAKWETSFNHKGTQEQDFYVTSETVVRVPMMSREDQYHYLLDRNLSCRVVGVPYQGNATALFILPSEGKMQQVENGLSEKTLRKWLKMFKKRQLELYLPKFSIEGSYQLEKVLPSLGISNVFTSHADLSGISNHSNIQVSEMVHKAVVEVDESGTRAAAATGTIFTFRSARLNSQRLVFNRPFLMFIVDNNILFLGKVNRP

SEQ ID NO: 908613 - protein, 270 aa, Homo sapiens
KCWLQSSQPSALSEPEGLPPPLCAHSATGHRAMKQINDYVAKQTKGKIVDLLKNLDSNAVVIMVNYIFFKAKWETSFNHKGTQEQDFYVTSETVVRVPMMSREDQYHYLLDRNLSCRVVGVPYQGNATALFILPSEGKMQQVENGLSEKTLRKWLKMFKKRQLELYLPKFSIEGSYQLEKVLPSLGISNVFTSHADLSGISNHSNIQVSEMVHKAVVEVDESGTRAAAATGTIFTFRSARLNSQRLVFNRPFLMFIVDNNILFLGKVNRP

SEQ ID NO: 908614 - protein, 406 aa, Homo sapiens; identical to SEQ ID NO: 908606

SEQ ID NO: 908615 - protein, 386 aa, Homo sapiens
KCWLQSSQPSALSEPEGLPPPLCAHSATGHKQRTATMQLFLLLCLVLLSPQGASLHRHHPREMKKRVEDLHVGATVAPSSRRDFTFDLYRALASAAPSQNIFFSPVSISMSLAMLSLGAGSSTKMQILEGLGLNLQKSSEKELHRGFQQLLQELNQPRDGFQLSLGNALFTDLVVDLQDTFVSAMKTLYLADTFPTNFRDSAGAMKQINDYVAKQTKGKIVDLLKNLDSNAVVIMVNYIFFKAKWETSFNHKGTQEQDFYVTSETVVRVPMMSREDQYHYLLDRNLSCRVVGVPYQGNATALFILPSEGKMQQVENGLSEKTLRKWLKMFKKRVLSDYPRASLNPHSPRETHTPYQGHTALVGRTHPAKELPPGPEASCDIQVLGA

SEQ ID NO: 908616 - protein, 406 aa, Homo sapiens; identical to SEQ ID NO: 908606

SEQ ID NO: 908617 - protein, 396 aa, Homo sapiens
KCWLQSSQPSALSEPEGLPPPLCAHSATGHKQRTATMQLFLLLCLVLLSPQGASLHRHHPREMKKRVEDLHVGATVAPSSRRDFTFDLYRALASAAPSQNIFFSPVSISMSLAMLSLGAGSSTKMQILEGLGLNLQKSSEKELHRGFQQLLQELNQPRDGFQLSLGNALFTDLVVDLQDTFVSAMKTLYLADTFPTNFRDSAGAMKQINDYVAKQTKGKIVDLLKNLDSNAVVIMVNYIFFKAKWETSFNHKGTQEQDFYVTSETVVRVPMMSREDQYHYLLDRNLSCRVVGVPYQGNATALFILPSEGKMQQVENGLSEKTLRKWLKMFKKSWRKSSPVWGSVTSSPPMLICPASATTQISRCLRWCTKLWWRWTSREPEQRQPRGQYSLSGRPA

SEQ ID NO: 908618 - protein, 406 aa, Homo sapiens; identical to SEQ ID NO: 908606

SEQ ID NO: 908619 - protein, 351 aa, Homo sapiens
KAMGTKCRLDRRCSNKEQPPCSSSSSCAGSSTKMQILEGLGLNLQKSSEKELHRGFQQLLQELNQPRDGFQLSLGNALFTDLVVDLQDTFVSAMKTLYLADTFPTNFRDSAGAMKQINDYVAKQTKGKIVDLLKNLDSNAVVIMVNYIFFKAKWETSFNHKGTQEQDFYVTSETVVRVPMMSREDQYHYLLDRNLSCRVVGVPYQGNATALFILPSEGKMQQVENGLSEKTLRKWLKMFKKRQLELYLPKFSIEGSYQLEKVLPSLGISNVFTSHADLSGISNHSNIQVSEMVHKAVVEVDESGTRAAAATGTIFTFRSARLNSQRLVFNRPFLMFIVDNNILFLGKVNRP

SEQ ID NO: 908620 - protein, 406 aa, Homo sapiens; identical to SEQ ID NO: 908606

SEQ ID NO: 908621 - protein, 249 aa, Homo sapiens
VIPPRPEDCRAMKQINDYVAKQTKGKIVDLLKNLDSNAVVIMVNYIFFKAKWETSFNHKGTQEQDFYVTSETVVRVPMMSREDQYHYLLDRNLSCRVVGVPYQGNATALFILPSEGKMQQVENGLSEKTLRKWLKMFKKRQLELYLPKFSIEGSYQLEKVLPSLGISNVFTSHADLSGISNHSNIQVSEMVHKAVVEVDESGTRAAAATGTIFTFRSARLNSQRLVFNRPFLMFIVDNNILFLGKVNRP

SEQ ID NO: 908622 - protein, 383 aa, Homo sapiens
KCWLQSSQPSALSEPEGLPPPLCAHSATGHKQRTATMQLFLLLCLVLLSPQGASLHRHHPREMKKRVEDLHVGATVAPSSRRDFTFDLYRALASAAPSQNIFFSPVSISMSLAMLSLGAGSSTKMQILEGLGLNLQKSSEKELHRGFQQLLQELNQPRDGFQLSLGNALFTDLVVDLQDTFVSAMKTLYLADTFPTNFRDSAGAMKQINDYVAKQTKGKIVDLLKNLDSNAVVIMVNYIFFKAKWETSFNHKGTQEQDFYVTSETVVRVPMMSREDQYHYLLDRNLSCRVVGVPYQGNATALFILPSEGKMQQVENGLSEKTLRKWLKMFKKRQLELYLPKFSIEGSYQLEKVLPSLGISNVCNLHPIYPATGSTLYTQVYLD

SEQ ID NO: 908623 - protein, 218 aa, Homo sapiens
MQLFLLLCLVLLSPQGASLHRHHPREMKKRVEDLHVGATVAPSSRRDFTFDLYRALASAAPSQNIFFSPVSISMSLAMLSLGAGSSTKMQILEGLGLNLQKSSEKELHRGFQQLLQELNQPRDGFQLSLGNALFTDLVVDLQDTFVSAMKTLYLADTFPTNFRDSAGAMKQINDYVAKQTKGKIVDLLKNLDSNAVVIMVNYIFFKGKALGPKPAISL

SEQ ID NO: 908624 - protein, 755 aa, Homo sapiens
DHPAPTVNGTRPARKKFQKKGASQSFSKAARLKWQSLERRIIDIVMQRMTIVNLEADMERLIKKREELFLLQEALRRKRERLQAESPEEEKGLQELAEEIEVLAANIDYINDGITDCQATIVQLEETKEELDSTDTSVVISSCSLAEARLLLDNFLKASIDKGLQVAQKEAQIRLLEGRLRQTDMAGSSQNHLLLDALREKAEAHPELQALIYNVQQENGYASTDEEISEFSEGSFSQSFTMKGSTSHDDFKFKSEPKLSAQMKAVSAECLGPPLDISTKNITKSLASLVEIKEDGVGFSVRDPYYRDRVSRTVSLPTRGSTFPRQSRATETSPLTRRKSYDRGQPIRSTDVGFTPPSSPPTRPRNDRNVFSRLTSNQSQGSALDKSDDSDSSLSEVLRGIISPVGGAKGARTAPLQCVSMAEGHTKPILCLDATDELLFTGSKDRSCKMWNLVTGQEIAALKGHPNNVVSIKYCSHSGLVFSVSTSYIKVWDIRDSAKCIRTLTSSGQVISGDACAATSTRAITSAQGEHQINQIALSPSGTMLYAASGNAVRIWELSRFQPVGKLTGHIGPVMCLTVTQTASQHDLVVTGSKDHYVKMFELGECVTGTIGPTHNFEPPHYDGIECLAIQGDILFSGSRDNGIKKWDLDQQELIQQIPNAHKDWVCALAFIPGRPMLLSACRAGVIKVWNVDNFTPIGEIKGHDSPINAICTNAKHIFTASSDCRVKLWNYVPGLTPCLPRRVLAIKGRATTLP

SEQ ID NO: 908625 - protein, 728 aa, Homo sapiens
DHPAPTVNGTRPARKKFQKKGASQSFSKAARLKWQSLERRIIDIVMQRMTIVNLEADMERLIKKREELFLLQEALRRKRERLQAESPEEEKGLQELAEEIEVLAANIDYINDGITDCQATIVQLEETKEELDSTDTSVVISSCSLAEARLLLDNFLKASIDKGLQVAQKEAQIRLLEGRLRQTDMAGSSQNHLLLDALREKAEAHPELQALIYNVQQENGYASTDEEISEFSEGSFSQSFTMKGSTSHDDFKFKSEPKLSAQMKAVSAECLGPPLDISTKNITKSLASLVEIKEDGVGFSVRDPYYRDRVSRTVSLPTRGSTFPRQSRATETSPLTRRKSYDRGQPIRSTDVGFTPPSSPPTRPRNDRNVFSRLTSNQSQGSALDKGIISPVGGAKGARTAPLQCVSMAEGHTKPILCLDATDELLFTGSKDRSCKMWNLVTGQEIAALKGHPNNVVSIKYCSHSGLVFSVSTSYIKVWDIRDSAKCIRTLTSSGQVISGDACAATSTRAITSAQGEHQINQIALSPSGTMLYAASGNAVRIWELSRFQPVGKLTGHIGPVMCLTVTQTASQHDLVVTGSKDHYVKMFELGECVTGTIGPTHNFEPPHYDGIECLAIQGDILFSGSRDNGIKKWDLDQQELIQQIPNAHKDWVCALAFIPGRPMLLSACRAGVIKVWNVDNFTPIGEIKGHDSPINAICTNAKHIFTASSDLTVKFWSVRRLPHSGPP

SEQ ID NO: 908626 - protein, 616 aa, Homo sapiens
IKEHIMQMLQNPDWKYRHAGLMAFIWLDNFLKASIDKGLQVAQKEAQIRLLEGRLRQTDMAGSSQNHLLLDALREKAEAHPELQALIYNVQQENGYASTDEEISEFSEGSFSQSFTMKGSTSHDDFKFKSEPKLSAQMKAVSAECLGPPLDISTKNITKSLASLVEIKEDGVGFSVRDPYYRDRVSRTVSLPTRGSTFPRQSRATETSPLTRRKSYDRGQPIRSTDVGFTPPSSPPTRPRNDRNVFSRLTSNQSQGSALDKSDDSDSSLSEVLRGIISPVGGAKGARTAPLQCVSMAEGHTKPILCLDATDELLFTGSKDRSCKMWNLVTGQEIAALKGHPNNVVSIKYCSHSGLVFSVSTSYIKVWDIRDSAKCIRTLTSSGQVISGDACAATSTRAITSAQGEHQINQIALSPSGTMLYAASGNAVRIWELSRFQPVGKLTGHIGPVMCLTVTQTASQHDLVVTGSKDHYVKMFELGECVTGTIGPTHNFEPPHYDGIECLAIQGDILFSGSRDNGIKKWDLDQQELIQQIPNAHKDWVCALAFIPGRPMLLSACRAGVIKVWNVDNFTPIGEIKGHDSPINAICTNAKHIFTASSDLTVKFWSVRRLPHSGPP

SEQ ID NO: 908627 - protein, 757 aa, Homo sapiens
DHPAPTVNGTRPARKKFQKKGASQSFSKAARLKWQSLERRIIDIVMQRMTIVNLEADMERLIKKREELFLLQEALRRKRERLQAESPEEEKGLQELAEEIEVLAANIDYINDGITDCQATIVQLEETKEELDSTDTSVVISSCSLAEARLLLDNFLKASIDKGLQVAQKEAQIRLLEGRLRQTDMAGSSQNHLLLDALREKAEAHPELQALIYNVQQENGYASTDEEISEFSEGSFSQSFTMKGSTSHDDFKFKSEPKLSAQMKAVSAECLGPPLDISTKNITKSLASLVEIKEDGVGFSVRDPYYRDRVSRTVSLPTRGSTFPRQSRATETSPLTRRKSYDRGQPIRSTDVGFTPPSSPPTRPRNDRNVFSRLTSNQSQGSALDKSDDSDSSLSEVLRGIISPVGGAKGARTAPLQCVSMAEGHTKPILCLDATDELLFTGSKDRSCKMWNLVTGQEIAALKGHPNNVVSIKYCSHSGLVFSVSTSYIKVWDIRDSAKCIRTLTSSGQVISGDACAATSTRAITSAQGEHQINQIALSPSGTMLYAASGNAVRIWELSRFQPVGKLTGHIGPVMCLTVTQTASQHDLVVTGSKDHYVKMFELGECVTGTIGPTHNFEPPHYDGIECLAIQGDILFSGSRDNGIKKWDLDQQELIQQIPNAHKDWVCALAFIPGRPMLLSACRAGVIKVWNVDNFTPIGEIKGHDSPINAICTKFVGRPPKRGQLYIFRNPKGGPPLTVDLTVKFWSVRRLPHSGPP

SEQ ID NO: 908628 - protein, 253 aa, Homo sapiens
MERRPSLAENYQGRGSWQSFSAPGLGTRSSGEIVKSVFWRPLLGELWNYRSGPWGGLSSIPLPRPTPTQSCPPCFSVASLVLCFPLQSGSQEPAPPPFRGRSDFWTFQRWFCVSALGSSPSWAGALGALSMWRPVLGGGRLQWRLSEAWSLPRALLGAATEAKTAVLLVLALLDVVLKSGAADSRKETPLDAGLLGPEQSVSNGWKSFFLWPPRGCRATPLALRCGHKSLPTPPRQPEQKVLTLQPVRKNPSA

SEQ ID NO: 908629 - protein, 741 aa, Homo sapiens
DHPAPTVNGTRPARKKFQKKGASQSFSKAARLKWQSLERRIIDIVMQRMTIVNLEADMERLIKKREELFLLQEALRRKRERLQAESPEEEKGLQELAEEIEVLAANIDYINDGITDCQATIVQLEETKEELDSTDTSVVISSCSLAEARLLLDNFLKASIDKGLQVAQKEAQIRLLEGRLRQTDMAGSSQNHLLLDALREKAEAHPELQALIYNVQQENGYASTDEEISEFSEGSFSQSFTMKGSTSHDDFKFKSEPKLSAQMKAVSAECLGPPLDISTKNITKSLASLVEIKEDGVGFSVRDPYYRDRVSRTVSLPTRGSTFPRQSRATETSPLTRRKSYDRGQPIRSTDVGFTPPSSPPTRPRNDRNVFSRLTSNQSQGSALDKSDDSDSSLSEVLRGIISPVGGAKGARTAPLQCVSMAEGHTKPILCLDATDELLFTGSKDRSCKMWNLVTGQEIAALKGHPNNVVSIKYCSHSGLVFSVSTSYIKVWDIRDSAKCIRTLTSSGQVISGDACAATSTRAITSAQGEHQINQIALSPSGTMLYAASGNAVRIWELSRFQPVGKLTGHIGPVMCLTVTQTASQHDLVVTGSKDHYVKMFELGECVTGTIGPTHNFEPPHYDGIECLAIQGDILFSGSRDNGIKKWDLDQQELIQQIPNAHKDWVCALAFIPGRPMLLSACRAGVIKVWNVDNFTPIGEIKGHDSPINAICTNAKHIFTASSDLTVKFWSVRRLPHSGPP

SEQ ID NO: 908630 - protein, 741 aa, Homo sapiens; identical to SEQ ID NO: 908629

SEQ ID NO: 908631 - protein, 741 aa, Homo sapiens; identical to SEQ ID NO: 908629

SEQ ID NO: 908632 - protein, 755 aa, Homo sapiens; identical to SEQ ID NO: 908624

SEQ ID NO: 908633 - protein, 427 aa, Homo sapiens
PDQPDSGDFPRQSRATETSPLTRRKSYDRGQPIRSTDVGFTPPSSPPTRPRNDRNVFSRLTSNQSQGSALDKSDDSDSSLSEVLRGIISPVGGAKGARTAPLQCVSMAEGHTKPILCLDATDELLFTGSKDRSCKMWNLVTGQEIAALKGHPNNVVSIKYCSHSGLVFSVSTSYIKVWDIRDSAKCIRTLTSSGQVISGDACAATSTRAITSAQGEHQINQIALSPSGTMLYAASGNAVRIWELSRFQPVGKLTGHIGPVMCLTVTQTASQHDLVVTGSKDHYVKMFELGECVTGTIGPTHNFEPPHYDGIECLAIQGDILFSGSRDNGIKKWDLDQQELIQQIPNAHKDWVCALAFIPGRPMLLSACRAGVIKVWNVDNFTPIGEIKGHDSPINAICTNAKHIFTASSDLTVKFWSVRRLPHSGPP

SEQ ID NO: 908634 - protein, 253 aa, Homo sapiens; identical to SEQ ID NO: 908628

SEQ ID NO: 908635 - protein, 99 aa, Homo sapiens
KARASATGDARAHAVRRRGLRPGEVPHSPSAYEGAPTGAAAPGTASSLNLKSFRSPEPNIHETPRVVLHESWILCPLFQGCPRSMLGGRPPAPLTAQAP

SEQ ID NO: 908636 - protein, 781 aa, Homo sapiens
MCEFTQCQTGSGRKHQHLFPPVSSSPELAAVTCLGNNVPDIFCAVVSVPNFCSLIFIRNTYPLNKFKGQVSSLVAAWDLTVELSWVWWQRLRWEDCLSPGVSGCSELGLHHCAPPGDRVRLSRLNNSNNSKLQFAKHCPIVGPFDCLQVCGVDTILHFCPAVTVDISRQTVQSLGLLVMLMDIAKSHGNILEMDGGMVSTVSAVSVFRAGAGRDWVLVTAVLSPVPATFHVCLDVWSRVVSHLLGGFSLGKHAGQLTMEECPILPHTSLGREHVPPSEHVIPLLLGDHEAMRASGPQAERHSSWGCALQSSPLVPKCEMGMRPTYRVARMPQRVNVSLSIMFSMEMINGEELLRNSRHPMTPPPLFPIFPINSKNLLFLNQLSRLKSRRSLNTINKSKYVLNAFIFTSAFEQTADVVSHYREGRGGTERSENRPEVTQQVGQPVLNAALGSRVCKTHSAPHLIDGLCAPTLYPQQVPCHTVPSTSQKEYGVPFQMVNLSLLCAAVIEYPENWVIYNELSVRFGGDKHSNHNKWGVWVVSLGMLELGLRGPCDSDCLGHVVLVELGTNSGVARAIETRPDPLGVAAGPPEWALGIEVGTGLKGKIWFSRYTHGICLLKEGSRGPMTRGTALSAFQEGVCSGSCIRVGCVSQQPLPHLGVPTDLEHLSARGPAPSRGSAGFCVFSWLIGTFLFLLHNLVLAAEPCGRPGANHTPRCSVLGIQCWQAAWRLVMSCTWGSQHLGAVLGVSVFHTLARASAVLAHLSVQFHSPDPFQAAGISPHDI

SEQ ID NO: 908637 - protein, 179 aa, Homo sapiens
MAARTLGRGVGRLLGSLRGLSGQPARPPCGVSAPRRAASGPSGSAPAVAAAAAQPGSYPALSAQAAREPAAFWGPLARDTLVWDTPYHTVWDCDFSTGKIGWFLGGQLNVSVNCLDQHVRKSPESVALIWERDEPGTEVRITYRISECDRKQSAPQCYRCSVPGDSLSAVSGGPIRDSF

SEQ ID NO: 908638 - protein, 397 aa, Homo sapiens
MHAYFLVTWCEHGGVGGQAPDAPFLSLQLVFDHQPGDIFGCVADIGWITGHSYVVYGPLCNGATSVLFESTPVYPNAGRYWETVERLKINQFYGAPTAVRLLLKYGDAWVKKYDRSSLRTLGSVGEPINCEAWEWLHRVVGDSRCTLVDTWWQTETGGICIAPRPSEEGAEILPAMAMRPFFGIVPVLMDEKGSVVEGSNVSGALCISQAWPGMARTIYGDHQRFVDAYFKAYPGYYFTGDGAYRTEGGYYQITGRMDDVINISGHRLGTAEIEDAIADHPAVPESAVIGYPHDIKGEAAFAFIVVKDSAGDSDVVVQELKSMVATKIAKYAVPDEILVVKRLPKTRSGKVMRRLLRKIITSEAQELGDTTTLEDPSIIAEILSVYQKCKDKQAAAK

SEQ ID NO: 908639 - protein, 689 aa, Homo sapiens [sequence omitted]

SEQ ID NO: 908640 - protein, 689 aa, Homo sapiens [sequence omitted]

SEQ ID NO: 908641 - protein, 724 aa, Homo sapiens
MCEFTQCQTGSGRKHQHLFPPVSSSPELAAVTCLGNNVPDIFCAVVSVPNFCSLIFIRNTYPLNKFKGQVSSLVAAWDLTVELSWVWWQRLRWEDCLSPGVSGCSELGLHHCAPPGDRVRLSRLNNSNNSKLQFAKHCPIVGPFDCLQVCGVDTILHFCPAVTVDISRQTVQSLGLLVMLMDIAKSHGNILEMDGGMVSTVSAVSVFRAGAGRDWVLVTAVLSPVPATFHVCLDVWSRVVSHLLGGFSLGKHAGQLTMEECPILPHTSLGREHVPPSEHVIPLLLGDHEAMRASGPQAERHSSWGCALQSSPLVPKCEMGMRPTYRVARMPQRVNVSLSIMFSMEMINGEELLRNSRHPMTPPPLFPIFPINSKNLLFLNQLSRLKSRRSLNTINKSKYVLNAFIFTSAFEQTADVVSHYREGRGGTERSENRPEVTQQVGQPVLNAALGSRVCKTHSAPHLIDGLCAPTLYPQQVPCHTVPSTSQKEYGVPFQMVNLSLLCAAVIEYPETGGFIMNRNLLVHISGGWEVHIKVLASGEGLLAASSHGGRAKRRQERARGGGTHPFIMAPIPLMRVETSWHNHLIKVPPLNTVTMAITFQREIVEGTNIQTIISGEFVVVSLGMLELGLRGPCDSDCLGHVVLVDWEQTAGWPGPRNSPRSSRCCQQGHLSGPWALGGDRAEGQDLVFQIHSWDLSPEGRFTGSNDKGYRPKCISGRGVLWQLH

SEQ ID NO: 908642 - protein, 689 aa, Homo sapiens [sequence omitted]

SEQ ID NO: 908643 - protein, 689 aa, Homo sapiens [sequence omitted]

SEQ ID NO: 908644 - protein, 689 aa, Homo sapiens [sequence omitted]

SEQ ID NO: 908645 - protein, 327 aa, Homo sapiens
MLFLLLPLLAVLPGDGNADGLKEPLSFHVTWIASFYNHSWKQNLVSGWLSDLQTHTWDSNSSTIVFLCPWSRGNFSNEEWKELETLFRIRTIRSFEGIRRYAHELQFEYPFEIQVTGGCELHSGKVSGSFLQLAYQGSDFVSFQNNSWLPYPVAGNMAKHFCKVLNQNQHENDITHNLLSDTCPRFILGLLDAGKAHLQRQVKPEAWLSHGPSPGPGHLQLVCHVSGFYPKPVWVMWMRGEQEQQGTQRGDILPSADGTWYLRATLEVAAGEAADLSCRVKHSSLEGQDIVLYWEHHSSVGFIILAVIVPLLLLIGLALWFRKRCFC

SEQ ID NO: 908646 - protein, 364 aa, Homo sapiens
QDLHCSSEDSGEGLALCSGVILAHFSLNLPSSWDYRCDLLLLAFCHDFEASSAMWNWLKEPLSFHVTWIASFYNHSWKQNLVSGWLSDLQTHTWDSNSSTIVFLCPWSRGNFSNEEWKELETLFRIRTIRSFEGIRRYAHELQFEYPFEIQVTGGCELHSGKVSGSFLQLAYQGSDFVSFQNNSWLPYPVAGNMAKHFCKVLNQNQHENDITHNLLSDTCPRFILGLLDAGKAHLQRQVKPEAWLSHGPSPGPGHLQLVCHVSGFYPKPVWVMWMRGEQEQQGTQRGDILPSADGTWYLRATLEVAAGEAADLSCRVKHSSLEGQDIVLYWEHHSSVGFIILAVIVPLLLLIGLALWFRKRCFC

SEQ ID NO: 908647 - protein, 309 aa, Homo sapiens
MLFLLLPLLAVLPGDGNADGLKEPLSFHVTWIASFYNHSWKHSSTIVFLCPWSRGNFSNEEWKELETLFRIRTIRSFEGIRRYAHELQFEYPFEIQVTGGCELHSGKVSGSFLQLAYQGSDFVSFQNNSWLPYPVAGNMAKHFCKVLNQNQHENDITHNLLSDTCPRFILGLLDAGKAHLQRQVKPEAWLSHGPSPGPGHLQLVCHVSGFYPKPVWVMWMRGEQEQQGTQRGDILPSADGTWYLRATLEVAAGEAADLSCRVKHSSLEGQDIVLYWEHHSSVGFIILAVIVPLLLLIGLALWFRKRCFC

SEQ ID NO: 908648 - protein, 294 aa, Homo sapiens
MLFLLLPLLAVLPGDGNADGLKEPLSFHVTWIASFYNHSWKHSSTIVFLCPWSRGNFSNEEWKELETLFRIRTIRSFEGIRRYAHELQFEYPFEIQVTGGCELHSGKVSGSFLQLAYQGSDFVSFQNNSWLPYPVAGNMAKHFCKVLNQNQHENDITHNLLSDTCPRFILGLLDAGKAHLQRQVKPEAWLSHGPSPGPGHLQLVCHVSGFYPKPVWVMWMRGEQEQQGTQRGDILPSADGTWYLRATLEVAAGEAADLSCRVKHSSLEGQDIVLYWGEKKLRPRLEMPGSGPQA

SEQ ID NO: 908649 - protein, 326 aa, Homo sapiens
LQWGRKNLGAMFAFGGATGLKEPLSFHVTWIASFYNHSWKQNLVSGWLSDLQTHTWDSNSSTIVFLCPWSRGNFSNEEWKELETLFRIRTIRSFEGIRRYAHELQFEYPFEIQVTGGCELHSGKVSGSFLQLAYQGSDFVSFQNNSWLPYPVAGNMAKHFCKVLNQNQHENDITHNLLSDTCPRFILGLLDAGKAHLQRQVKPEAWLSHGPSPGPGHLQLVCHVSGFYPKPVWVMWMRGEQEQQGTQRGDILPSADGTWYLRATLEVAAGEAADLSCRVKHSSLEGQDIVLYWEHHSSVGFIILAVIVPLLLLIGLALWFRKRCFC

SEQ ID NO: 908650 - protein, 326 aa, Homo sapiens; identical to SEQ ID NO: 908649

SEQ ID NO: 908651 - protein, 397 aa, Homo sapiens
LEELLLGRPGDPVGREEGGKMVLESTMVCVDNSEYMRNGDFLPTRLQAQQDAVNIVCHSKTRSNPENNVGLITLANDCEVLTTLTPDTGRILSKLHTVQPKGKITFCTGIRVAHLALKHRQGKNHKMRIIAFVGSPVEDNEKDLVKLAKRLKKEKVNVDIINFGEEEVNTEKLTAFVNTLNGKDGTGSHLVTVPPGPSLADALISSPILAGEGGAMLGLGASDFEFGVDPSADPELALALRVSMEEQRQRQEEEARRAAAASAAEAGIATTGTEDSDDALLKMTISQQEFGRTGLPDLSSMTEEEQIAYAMQMSLQGAEFGQAESADIDASSAMDTSEPAKEEDDYDVMQDPEFLQSVLENLPGVDPNNEAIRNAMGSLASQATKDGKKDKKEEDKK

SEQ ID NO: 908652 - protein, 104 aa, Homo sapiens
MEEQEGGGGGRGSEFWCEAGLLQSGTEDSDDALLKMTISQQEFGRTGLPDLSSMTEEEQIAYAMQMSLQGAEFGQAESADIDASSAMDTSEPAKGETQPCPHQV

SEQ ID NO: 908653 - protein, 424 aa, Homo sapiens
NSQMTFYFIQRYKGNYVQQQSDGQSKLLGGSKFMVNVMMVGREEGGKMVLESTMVCVDNSEYMRNGDFLPTRLQAQQDAVNIVCHSKTRSNPENNVGLITLANDCEVLTTLTPDTGRILSKLHTVQPKGKITFCTGIRVAHLALKHRQGKNHKMRIIAFVGSPVEDNEKDLVKLAKRLKKEKVNVDIINFGEEEVNTEKLTAFVNTLNGKDGTGSHLVTVPPGPSLADALISSPILAGEGGAMLGLGASDFEFGVDPSADPELALALRVSMEEQRQRQEEEARRAAAASAAEAGIATTGTEDSDDALLKMTISQQEFGRTGLPDLSSMTEEEQIAYAMQMSLQGAEFGQAESADIDASSAMDTSEPAKEEDDYDVMQDPEFLQSVLENLPGVDPNNEAIRNAMGSLASQATKDGKKDKKEEDKK

SEQ ID NO: 908654 - protein, 397 aa, Homo sapiens; identical to SEQ ID NO: 908651

SEQ ID NO: 908655 - protein, 351 aa, Homo sapiens
LEELLLGRPGDPVGREEGGKMVLESTMVCVDNSEYMRNGDFLPTRLQAQQDAVNIVCHSKTRSNPENNVGLITLANDCEVLTTLTPDTGRILSKLHTVQPKGKITFCTGIRVAHLALKHRQGKNHKMRIIAFVGSPVEDNEKDLVKLAKRLKKEKVNVDIINFGEEEVNTEKLTAFVNTLNGKDGTGSHLVTVPPGPSLADALISSPILAGEGGAMLGLGASDFEFGVDPSADPELALALRVSMEEQRQRQEEEARRAAAASAAEAGIATTGTEDSDDALLKMTISQQEFGRTGLPDLSSMTEEEQIAYAMQMSLQGAEFGQAESADIDASSAMDTSEPAKGETQPCPHQV

SEQ ID NO: 908656 - protein, 391 aa, Homo sapiens
IGWMHAPGKSGRGQMVLESTMVCVDNSEYMRNGDFLPTRLQAQQDAVNIVCHSKTRSNPENNVGLITLANDCEVLTTLTPDTGRILSKLHTVQPKGKITFCTGIRVAHLALKHRQGKNHKMRIIAFVGSPVEDNEKDLVKLAKRLKKEKVNVDIINFGEEEVNTEKLTAFVNTLNGKDGTGSHLVTVPPGPSLADALISSPILAGEGGAMLGLGASDFEFGVDPSADPELALALRVSMEEQRQRQEEEARRAAAASAAEAGIATTGTEDSDDALLKMTISQQEFGRTGLPDLSSMTEEEQIAYAMQMSLQGAEFGQAESADIDASSAMDTSEPAKEEDDYDVMQDPEFLQSVLENLPGVDPNNEAIRNAMGSLASQATKDGKKDKKEEDKK

SEQ ID NO: 908657 - protein, 462 aa, Homo sapiens
LEELLLGRPGDPVGREEGGKMVLESTMVCVDNSEYMRNGDFLPTRLQAQQDAVNIVCHSKTRSNPENNVGLITLANDCEVLTTLTPDTGRILSKLHTVQPKGKITFCTGIRVAHLALKHRQGKNHKMRIIAFVGSPVEDNEKDLVKLAKRLKKEKVNVDIINFGEEEVNTEKLTAFVNTLNGKDGTGSHLVTVPPGPSLADALISSPILAGEGGAMLGLGASDFEFGVDPSADPELALALRVSMEEQRQRQEEEARRAAAASAAEAGIATTGTEGERGGIRSPGTAGCYTLKAGCRHCRESVEVCQGRNMWEGWARNGLGGWPVWIWHQFYPAPLFLFPDSDDALLKMTISQQEFGRTGLPDLSSMTEEEQIAYAMQMSLQGAEFGQAESADIDASSAMDTSEPAKEEDDYDVMQDPEFLQSVLENLPGVDPNNEAIRNAMGSLASQATKDGKKDKKEEDKK

SEQ ID NO: 908658 - protein, 377 aa, Homo sapiens
NSQMTFYFIQRYKGNYVQQQSDGQSKLLGGSKFMVNVMMVGREEGGKMVLESTMVCDCEVLTTLTPDTGRILSKLHTVQPKGKITFCTGIRVAHLALKHRQGKNHKMRIIAFVGSPVEDNEKDLVKLAKRLKKEKVNVDIINFGEEEVNTEKLTAFVNTLNGKDGTGSHLVTVPPGPSLADALISSPILAGEGGAMLGLGASDFEFGVDPSADPELALALRVSMEEQRQRQEEEARRAAAASAAEAGIATTGTEDSDDALLKMTISQQEFGRTGLPDLSSMTEEEQIAYAMQMSLQGAEFGQAESADIDASSAMDTSEPAKEEDDYDVMQDPEFLQSVLENLPGVDPNNEAIRNAMGSLASQATKDGKKDKKEEDKK

SEQ ID NO: 908659 - protein, 271 aa, Homo sapiens
MRIIAFVGSPVEDNEKDLVKLAKRLKKEKVNVDIINFGEEEVNTEKLTAFVNTLNGKDGTGSHLVTVPPGPSLADALISSPILAGEGGAMLGLGASDFEFGVDPSADPELALALRVSMEEQRQRQEEEARRAAAASAAEAGIATTGTEDSDDALLKMTISQQEFGRTGLPDLSSMTEEEQIAYAMQMSLQGAEFGQAESADIDASSAMDTSEPAKEEDDYDVMQDPEFLQSVLENLPGVDPNNEAIRNAMGSLASQATKDGKKDKKEEDKK

SEQ ID NO: 908660 - protein, 337 aa, Homo sapiens
LEELLLGRPGDPVGREEGGKMVLESTMVCVDNSEYMRNGDFLPTRLQAQQDAVNIVCHSKTRSNPENNVGLITLANDCEVLTTLTPDTGRILSKLHTVQPKGKITFCTGIRVAHLALKHRQGKNHKMRIIAFVGSPVEDNEKDLVKLAKRLKKEKVNVDIINFGEEEVNTEKLTAFVNTLNGKDGTGSHLVTVPPGPSLADALISSPILAGEGGAMLGLGASDFEFGVDPSADPELALALRVSMEEQRQRQEEEARRAAAASAAEAGIATTGTEAHRACLQEEDDYDVMQDPEFLQSVLENLPGVDPNNEAIRNAMGSLASQATKDGKKDKKEEDKK

SEQ ID NO: 908661 - protein, 182 aa, Homo sapiens [sequence omitted]

SEQ ID NO: 908662 - protein, 338 aa, Homo sapiens
LAPMADCEEPYVLLSLVNVLTTLTPDTGRLLITALLSHTHGQIISFLYGLSRVAHLALKHRQGKNHKMRIIAFVGSPVEDNEKDLVKLAKRLKKEKVNVDIINFGEEEVNTEKLTAFVNTLNGKDGTGSHLVTVPPGPSLADALISSPILAGEGGAMLGLGASDFEFGVDPSADPELALALRVSMEEQRQRQEEEARRAAAASAAEAGIATTGTEDSDDALLKMTISQQEFGRTGLPDLSSMTEEEQIAYAMQMSLQGAEFGQAESADIDASSAMDTSEPAKEEDDYDVMQDPEFLQSVLENLPGVDPNNEAIRNAMGSLASQATKDGKKDKKEEDKK

SEQ ID NO: 908663 - protein, 340 aa, Homo sapiens
LEELLLGRPGDPVGREEGGKMVLESTMVCVDNSEYMRNGDFLPTRLQAQQDAVNIVCHSKTRSNPENNVGLITLANDCEVLTTLTPDTGRILSKLHTVQPKGKITFCTGIRVAHLALKHRQGKNHKMRIIAFVGSPVEDNEKDLVKLAKRLKKEKVNVDIINFGEEEVNTEKLTAFVNTLNGKDGTGSHLVTVPPGPSLADALISSPILAGEGGAMLGLGASDFEFGVDPSADPELALALRVSMEEQRQRQEEEARRAAAASAAEAGIATTGTEDSDDALLKLPCKELALGSEPKVIGKNVSRDPPGEWAGKDMASDRPRKIGPLFQPEKISPEERSGVQ

SEQ ID NO: 908664 - protein, 412 aa, Homo sapiens
NSQMTFYFIQRYKGNYVQQQSDGQSKLLGGSKFMVNVMMVGREEGGKMVLESTMVCVDNSEYMRNGDFLPTRLQAQQDAVNIVCHSKTRSNPENNVGLITLANDCEVLTTLTPDTGRILSKLHTVQPKGKITFCTGIRVAHLALKHRQGKNHKMRIIAFVGSPVEDNEKDLVKLAKRLKKEKVNVDIINFGEEEVNTEKLTAFVNTLVPPGPSLADALISSPILAGEGGAMLGLGASDFEFGVDPSADPELALALRVSMEEQRQRQEEEARRAAAASAAEAGIATTGTEDSDDALLKMTISQQEFGRTGLPDLSSMTEEEQIAYAMQMSLQGAEFGQAESADIDASSAMDTSEPAKEEDDYDVMQDPEFLQSVLENLPGVDPNNEAIRNAMGSLASQATKDGKKDKKEEDKK

SEQ ID NO: 908665 - protein, 456 aa, Homo sapiens
IGWMHAPGKSGRGQMVLESTMVCVDNSEYMRNGDFLPTRLQAQQDAVNIVCHSKTRSNPENNVGLITLANDCEVLTTLTPDTGRILSKLHTVQPKGKITFCTGIRVAHLALKHRQGKNHKMRIIAFVGSPVEDNEKDLVKLAKRLKKEKVNVDIINFGEEEVNTEKLTAFVNTLNGKDGTGSHLVTVPPGPSLADALISSPILAGEGGAMLGLGASDFEFGVDPSADPELALALRVSMEEQRQRQEEEARRAAAASAAEAGIATTGTEGERGGIRSPGTAGCYTLKAGCRHCRESVEVSQGRNMWEGWARNGLGGWPVWIWHQFYPAPLFLFPDSDDALLKMTISQQEFGRTGLPDLSSMTEEEQIAYAMQMSLQGAEFGQAESADIDASSAMDTSEPAKEEDDYDVMQDPEFLQSVLENLPGVDPNNEAIRNAMGSLASQATKDGKKDKKEEDKK

SEQ ID NO: 908666 - protein, 239 aa, Homo sapiens
NSQMTFYFIQRYKGNYVQQQSDGQSKLLGGSKFMVNVMMVGREEGGKMVLESTMVCVDNSEYMRNGDFLPTRLQAQQDAVNIVCHSKTRSNPENNVGLITLANDCEVLTTLTPDTGRILSKLHTVQPKGKITFCTGLPDLSSMTEEEQIAYAMQMSLQGAEFGQAESADIDASSAMDTSEPAKEEDDYDVMQDPEFLQSVLENLPGVDPNNEAIRNAMGSLASQATKDGKKDKKEEDKK

SEQ ID NO: 908667 - protein, 284 aa, Homo sapiens
TNTTTPPPHPPTSSSTACLTRERLWEAICVCVDNSEYMRNGDFLPTRLQAQQDAVNIVCHSKTRSNPENNVGLITLANDCEVLTTLTPDTGRILSKLHTVQPKGKITFCTGIRVAHLALKHRQGKNHKMRIIAFVGSPVEDNEKDLVKLAKRLKKEKVNVDIINFGEEEVNTEKLTAFVNTLNGKDGTGSHLVTVPPGPSLADALISSPILAGEGGAMLGLGASDFEFGVDPSADPELALALRVSMEEQRQRQEEEARRAAAASAAEAGIATTGTEDSDDSLLK

SEQ ID NO: 908668 - protein, 397 aa, Homo sapiens; identical to SEQ ID NO: 908651

SEQ ID NO: 908669 - protein, 397 aa, Homo sapiens; identical to SEQ ID NO: 908651

SEQ ID NO: 908670 - protein, 362 aa, Homo sapiens
MRNGDFLPTRLQAQQDAVNIVCHSKTRSNPENNVGLITLANDCEVLTTLTPDTGRILSKLHTVQPKGKITFCTGIRVAHLALKHRQGKNHKMRIIAFVGSPVEDNEKDLVKLAKRLKKEKVNVDIINFGEEEVNTEKLTAFVNTLNGKDGTGSHLVTVPPGPSLADALISSPILAGEGGAMLGLGASDFEFGVDPSADPELALALRVSMEEQRQRQEEEARRAAAASAAEAGIATTGTEDSDDALLKMTISQQEFGRTGLPDLSSMTEEEQIAYAMQMSLQGAEFGQAESADIDASSAMDTSEPAKEEDDYDVMQDPEFLQSVLENLPGVDPNNEAIRNAMGSLASQATKDGKKDKKEEDKK

SEQ ID NO: 908671 - protein, 357 aa, Homo sapiens
LEELLLGRPGDPVGREEGGKMVLESTMVCVDNSEYMRNGDFLPTRLQAQQDAVNIVCHSKTRSNPENNVGLITLANDCEVLTTLTPDTGRILSKLHTVQPKGKITFCTGIRVAHLALKHRQGKNHKMRIIAFVGSPVEDNEKDLVKLAKRLKKEKVNVDIINFGEEEVNTEKLTAFVNTLNGKDGTGSHLVTVPPGPSLADALISSPILAGEGGAMLGLGASDFEFGVDPSADPELALALRVSMEEQRQRQEEEARRAAAASAAEAGIATTGTEDSDDALLKMTITDIDASSAMDTSEPAKEEDDYDVMQDPEFLQSVLENLPGVDPNNEAIRNAMGSLASQATKDGKKDKKEEDKK

SEQ ID NO: 908672 - protein, 346 aa, Homo sapiens
RLGARTGRVNFGEEEITAGLMTGEGDCEVLTTLTPDTGRILSKLHTVQPKGKITFCTGIRVAHLALKHRQGKNHKMRIIAFVGSPVEDNEKDLVKLAKRLKKEKVNVDIINFGEEEVNTEKLTAFVNTLNGKDGTGSHLVTVPPGPSLADALISSPILAGEGGAMLGLGASDFEFGVDPSADPELALALRVSMEEQRQRQEEEARRAAAASAAEAGIATTGTEDSDDALLKMTISQQEFGRTGLPDLSSMTEEEQIAYAMQMSLQGAEFGQAESADIDASSAMDTSEPAKEEDDYDVMQDPEFLQSVLENLPGVDPNNEAIRNAMGSLASQATKDGKKDKKEEDKK

SEQ ID NO: 908673 - protein, 182 aa, Homo sapiens [sequence omitted]

SEQ ID NO: 908674 - protein, 306 aa, Homo sapiens
NRLDACPWKIGTRADGVGKHYGVLALKHRQGKNHKMRIIAFVGSPVEDNEKDLVKLAKRLKKEKVNVDIINFGEEEVNTEKLTAFVNTLNGKDGTGSHLVTVPPGPSLADALISSPILAGEGGAMLGLGASDFEFGVDPSADPELALALRVSMEEQRQRQEEEARRAAAASAAEAGIATTGTEDSDDALLKMTISQQEFGRTGLPDLSSMTEEEQIAYAMQMSLQGAEFGQAESADIDASSAMDTSEPAKEEDDYDVMQDPEFLQSVLENLPGVDPNNEAIRNAMGSLASQATKDGKKDKKEEDKK

SEQ ID NO: 908675 - protein, 305 aa, Homo sapiens
LGQAGVNRTRGQIPSDGHPRGHLALKHRQGKNHKMRIIAFVGSPVEDNEKDLVKLAKRLKKEKVNVDIINFGEEEVNTEKLTAFVNTLNGKDGTGSHLVTVPPGPSLADALISSPILAGEGGAMLGLGASDFEFGVDPSADPELALALRVSMEEQRQRQEEEARRAAAASAAEAGIATTGTEDSDDALLKMTISQQEFGRTGLPDLSSMTEEEQIAYAMQMSLQGAEFGQAESADIDASSAMDTSEPAKEEDDYDVMQDPEFLQSVLENLPGVDPNNEAIRNAMGSLASQATKDGKKDKKEEDKK

SEQ ID NO: 908676 - protein, 182 aa, Homo sapiens [sequence omitted]

SEQ ID NO: 908677 - protein, 257 aa, Homo sapiens
GSHVATSFDVAHDAREPVDIINFGEEEVNTEKLTAFVNTLNGKDGTGSHLVTVPPGPSLADALISSPILAGEGGAMLGLGASDFEFGVDPSADPELALALRVSMEEQRQRQEEEARRAAAASAAEAGIATTGTEDSDDALLKMTISQQEFGRTGLPDLSSMTEEEQIAYAMQMSLQGAEFGQAESADIDASSAMDTSEPAKEEDDYDVMQDPEFLQSVLENLPGVDPNNEAIRNAMGSLASQATKDGKKDKKEEDKK

SEQ ID NO: 908678 - protein, 210 aa, Homo sapiens
LEELLLGRPGDPVGREEGGKMVLESTMVCVDNSEYMRNGDFLPTRLQAQQDAVNIVCHSKTRSNPENNVGLITLANDCEVLTTLTPDTGRILSKLHTVQPKGKITFCTGIRVAHLALKHRQGKNHKMRIIAFVGSPVEDNEKDLVKLAKRLKKEKVNVDIINFGEEEVNTEKLTAFVNTLNGKDGTGSHLVTVPPGPSLADALISSPRGG

SEQ ID NO: 908679 - protein, 195 aa, Homo sapiens
NSQMTFYFIQRYKGNYVQQQSDGQSKLLGGSKFMVNVMMVGREEGGKMVLESTMVCVDNSEYMRNGDFLPTRLQAQQDAVNIVCHSKTRSNPENNVGLITLANDCEVLTTLTPDTGRILSKLHTVQPKGKITFCTGIRVAHLALKHRQGKNHKMRIIAFVGSPVEDNEKDLVKLAKRLKKEGCTGRLVEYRKCLG

SEQ ID NO: 908680 - protein, 137 aa, Homo sapiens
TPAFTMKSSGLFPFLVLLALGTLAPWAVEGSGKSFKAGVCPPKKSAQCLRYKKPECQSDWQCPGKKRCCPDTCGIKCLDPVDTPNPTRRKPGKCPVTYGQCLMLNPPNFCEMDGQCKRDLKCCMGMCGKSCVSPVKA

SEQ ID NO: 908681 - protein, 110 aa, Homo sapiens
GTDDRRPFKAGVCPPKKSAQCLRYKKPECQSDWQCPGKKRCCPDTCGIKCLDPVDTPNPTRRKPGKCPVTYGQCLMLNPPNFCEMDGQCKRDLKCCMGMCGKSCVSPVKA

SEQ ID NO: 908682 - protein, 118 aa, Homo sapiens
MPSSKPLRDCQKCPAFKAGVCPPKKSAQCLRYKKPECQSDWQCPGKKRCCPDTCGIKCLDPVDTPNPTRRKPGKCPVTYGQCLMLNPPNFCEMDGQCKRDLKCCMGMCGKSCVSPVKA

SEQ ID NO: 908683 - protein, 137 aa, Homo sapiens; identical to SEQ ID NO: 908680

SEQ ID NO: 908684 - protein, 132 aa, Homo sapiens
MWRKDLVEGFTDARDPEGSSRLLRKLGLPLERVECIARDADLEIVGGADLKRWVDWIHTQGCVSKAESKSVKKCGGKDRDRRPQQGSGSGQEPSVGGWKGQPPGRKKCFGAGTSGGGQTRDTRNGTLYTGTT

SEQ ID NO: 908685 - protein, 137 aa, Homo sapiens; identical to SEQ ID NO: 908680

SEQ ID NO: 908686 - protein, 205 aa, Homo sapiens
KRELQMRGGRNPGEVILKRWLEFPQEAMEDFTGHWMAPGALIWSWVLEPSQAVGIWHLGCRACPPLIPRLWQPHHRSLQAASVPMQWPHSPGFEDQPCYLPAFKAGVCPPKKSAQCLRYKKPECQSDWQCPGKKRCCPDTCGIKCLDPVDTPNPTRRKPGKCPVTYGQCLMLNPPNFCEMDGQCKRDLKCCMGMCGKSCVSPVKA

SEQ ID NO: 908687 - protein, 167 aa, Homo sapiens
TPAFTMKSSGLFPFLVLLALGTLAPWAVEGSGKSFKAGVCPPKKSAQCLRYKKPECQSDWQCPGKKRCCPDTCGIKCLDPVDTPNPTRRKPGKCPVTYGQCLMLNPPNFCEMDGQCKRDLKCCMGMCGKSCVSPVKGCFSPSISPSHFFTMSSISTFSAVLRTSASS

SEQ ID NO: 908688 - protein, 170 aa, Homo sapiens
TPAFTMKSSGLFPFLVLLALGTLAPWAVEGSGKSFKAGVCPPKKSAQCLRYKKPECQSDWQCPGKKRCCPDTCGIKCLDPVDTPNPTRRKPGKCPVTYGQCLMLNPPNFCEMDGQCKRDLKCCMGMCGKGYRSTGGFAVPKVCTAVCVCVMEAQGEQDQASVCGVWCVCF

SEQ ID NO: 908689 - protein, 1250 aa, Homo sapiens
KSRICESPGGSAAAAVRRPGAEPPVAQPLRARAWAGRERPEQRQEPEAGAEEECDQGSAGAREYARAGMGQQVGRVGEAPGLQQPQPRGIRGSSAARPSGRRRDPAGRTTETGFNIFTQHDHFASCVEDGFEGDKTGGSSPEALHRPYGCDVEPQALNEAIRWSSKENLLGATESDPNLFVALYDFVASGDNTLSITKGEKLRVLGYNQNGEWSEVRSKNGQGWVPSNYITPVNSLEKHSWYHGPVSRSAAEYLLSSLINGSFLVRESESSPGQLSISLRYEGRVYHYRINTTADGKVYVTAESRFSTLAELVHHHSTVADGLVTTLHYPAPKCNKPTVYGVSPIHDKWEMERTDITMKHKLGGGQYGEVYVGVWKKYSLTVAVKTLKEDTMEVEEFLKEAAVMKEIKHPNLVQLLGVCTLEPPFYIVTEYMPYGNLLDYLRECNREEVTAVVLLYMATQISSAMEYLEKKNFIHRDLAARNCLVGENHVVKVADFGLSRLMTGDTYTAHAGAKFPIKWTAPESLAYNTFSIKSDVWAFGVLLWEIATYGMSPYPGIDLSQVYDLLEKGYRMEQPEGCPPKVYELMRACWKWSPADRPSFAETHQAFETMFHDSSISEEVAEELGRAASSSSVVPYLPRLPILPSKTRTLKKQVENKENIEGAQDATENSASSLAPGFIRGAQASSGSPALPRKQRDKSPSSLLEDAKETCFTRDRKGGFFSSFMKKRNAPTPPKRSSSFREMENQPHKKYELTGNFSSVASLQHADGFSFTPAQQEANLVPPKCYGGSFAQRNLCNDDGGGGGGSGTAGGGWSGITGFFTPRLIKKTLGLRAGKPTASDDTSKPFPRSNSTSSMSSGLPEQDRMAMTLPRNCQRSKLQLERTVSTSSQPEENVDRANDMLPKKSEESAAPSRERPKAKLLPRGATALPLRTPSGDLAITEKDPPGVGVAGVAAAPKGKEKNGGARLGMAGVPEDGEQPGWPSPAKAAPVLPTTHNHKVPVLISPTLKHTPADVQLIGTDSQGNKFKLLSEHQVTSSGDKDRPRRVKPKCAPPPPPVMRLLQHPSICSDPTEEPTALTAGQSTSETQEGGKKAALGAVPISGKAGRPVMPPPQVPLPTSSISPAKMANGTAGTKVALRKTKQAAEKISADKISKEALLECADLLSSALTEPVPNSQLVDTGHQLLDYCSGYVDCIPQTRNKFAFREAVSKLELSLQELQVSSAAAGVPGTNPVLNNLLSCVQEISDVVQR

SEQ ID NO: 908690 - protein, 1150 aa, Homo sapiens
LGRGMVLGTVLLPPNSYGRDQDTSLCCLCTEASESALPDLTEALHRPYGCDVEPQALNEAIRWSSKENLLGATESDPNLFVALYDFVASGDNTLSITKGEKLRVLGYNQNGEWSEVRSKNGQGWVPSNYITPVNSLEKHSWYHGPVSRSAAEYLLSSLINGSFLVRESESSPGQLSISLRYEGRVYHYRINTTADGKVYVTAESRFSTLAELVHHHSTVADGLVTTLHYPAPKCNKPTVYGVSPIHDKWEMERTDITMKHKLGGGQYGEVYVGVWKKYSLTVAVKTLKEDTMEVEEFLKEAAVMKEIKHPNLVQLLGVCTLEPPFYIVTEYMPYGNLLDYLRECNREEVTAVVLLYMATQISSAMEYLEKKNFIHRDLAARNCLVGENHVVKVADFGLSRLMTGDTYTAHAGAKFPIKWTAPESLAYNTFSIKSDVWAFGVLLWEIATYGMSPYPGIDLSQVYDLLEKGYRMEQPEGCPPKVYELMRACWKWSPADRPSFAETHQAFETMFHDSSISEEVAEELGRAASSSSVVPYLPRLPILPSKTRTLKKQVENKENIEGAQDATENSASSLAPGFIRGAQASSGSPALPRKQRDKSPSSLLEDAKETCFTRDRKGGFFSSFMKKRNAPTPPKRSSSFREMENQPHKKYELTGNFSSVASLQHADGFSFTPAQQEANLVPPKCYGGSFAQRNLCNDDGGGGGGSGTAGGGWSGITGFFTPRLIKKTLGLRAGKPTASDDTSKPFPRSNSTSSMSSGLPEQDRMAMTLPRNCQRSKLQLERTVSTSSQPEENVDRANDMLPKKSEESAAPSRERPKAKLLPRGATALPLRTPSGDLAITEKDPPGVGVAGVAAAPKGKEKNGGARLGMAGVPEDGEQPGWPSPAKAAPVLPTTHNHKVPVLISPTLKHTPADVQLIGTDSQGNKFKLLSEHQVTSSGDKDRPRRVKPKCAPPPPPVMRLLQHPSICSDPTEEPTALTAGQSTSETQEGGKKAALGAVPISGKAGRPVMPPPQVPLPTSSISPAKMANGTAGTKVALRKTKQAAEKISADKISKEALLECADLLSSALTEPVPNSQLVDTGHQLLDYCSGYVDCIPQTRNKFAFREAVSKLELSLQELQVSSAAAGVPGTNPVLNNLLSCVQEISDVVQR

SEQ ID NO: 908691 - protein, 1006 aa, Homo sapiens
LGRGMVLGTVLLPPNSYGRDQDTSLCCLCTEASESALPDLTDHFASCVEDGFEGDKTGGSSPEALHRPYGCDVEPQALNEAIRWSSKENLLGATESDPNLFVALYDFVASGDNTLSITKGEKLRVLGYNQNGEWSEVRSKNGQGWVPSNYITPVNSLEKHSWYHGPVSRSAAEYLLSSLINGSFLVRESESSPGQLSISLRYEGRVYHYRINTTADGKVYVTAESRFSTLAELVHHHSTVADGLVTTLHYPAPKCNKPTVYGVSPIHDKWEMERTDITMKHKLGGGQYGEVYVGVWKKYSLTVAVKTLKEDTMEVEEFLKEAAVMKEIKHPNLVQLLGVCTLEPPFYIVTEYMPYGNLLDYLRECNREEVTAVVLLYMATQISSAMEYLEKKNFIHSFWGIVWEIATYGMSPYPGIDLSQVYDLLEKGYRMEQPEGCPPKVYELMRACWKWSPADRPSFAETHQAFETMFHDSSISEEVAEELGRAASSSSVVPYLPRLPILPSKTRTLKKQVENKENIEGAQDATENSASSLAPGFIRGAQASSGSPALPRKQRDKSPSSLLEDAKETCFTRDRKGGFFSSFMKKRNAPTPPKRSSSFREMENQPHKKYELTGLPEQDRMAMTLPRNCQRSKLQLERTVSTSSQPEENVDRANDMLPKKSEESAAPSRERPKAKLLPRGATALPLRTPSGDLAITEKDPPGVGVAGVAAAPKGKEKNGGARLGMAGVPEDGEQPGWPSPAKAAPVLPTTHNHKVPVLISPTLKHTPADVQLIGTDSQGNKFKLLSEHQVTSSGDKDRPRRVKPKCAPPPPPVMRLLQHPSICSDPTEEPTALTAGQSTSETQEGGKKAALGAVPISGKAGRPVMPPPQVPLPTSSISPAKMANGTAGTKVALRKTKQAAEKISADKISKEALLECADLLSSALTEPVPNSQLVDTGHQLLDYCSGYVDCIPQTRNKFAFREAVSKLELSLQELQVSSAAAGVPGTNPVLNNLLSCVQEISDVVQR

SEQ ID NO: 908692 - protein, 1109 aa, Homo sapiens
LGRGMVLGTVLLPPNSYGRDQDTSLCCLCTEASESALPDLTDHFASCVEDGFEGDKTGGSSPEALHRPYGCDVEPQALNEAIRWSSKENLLGATESDPNLFVALYDFVASGDNTLSITKGEKLRVLGYNQNGEWSEVRSKNGQGWVPSNYITPVNSLEKHSWYHGPVSRSAAEYLLSSLINGSFLVRESESSPGQLSISLRYEGRVYHYRINTTADGKVYVTAESRFSTLAELVHHHSTVADGLVTTLHYPAPKCNKPTVYGVSPIHDKWEMERTDITMKHKLGGGQYGEVYVGVWKKYSLTVAVKTLKEDTMEVEEFLKEAAVMKEIKHPNLVQLLGVCTLEPPFYIVTEYMPYGNLLDYLRECNREEVTAVVLLYMATQISSAMEYLEKKNFIHSFWGIVWEIATYGMSPYPGIDLSQVYDLLEKGYRMEQPEGCPPKVYELMRACWKWSPADRPSFAETHQAFETMFHDSSISEEVAEELGRAASSSSVVPYLPRLPILPSKTRTLKKQVENKENIEGAQDATENSASSLAPGFIRGAQASSGSPALPRKQRDKSPSSLLEDAKETCFTRDRKGGFFSSFMKKRNAPTPPKRSSSFREMENQPHKKYELTGNFSSVASLQHADGFSFTPAQQEANLVPPKCYGGSFAQRNLCNDDGGGGGGSGTAGGGWSGITGFFTPRLIKKTLGLRAGKPTASDDTSKPFPRSNSTSSMSSGLPEQDRMAMTLPRNCQRSKLQLERTVSTSSQPEENVDRANDMLPKKSEESAAPSRERPKAKLLPRGATALPLRTPSGDLAITEKDPPGVGVAGVAAAPKGKEKNGGARLGMAGVPEDGEQPGWPSPAKAAPVLPTTHNHKVPVLISPTLKHTPADVQLIGTDSQGNKFKLLSEHQVTSSGDKDRPRRVKPKCAPPPPPVMRLLQHPSICSDPTEEPTALTAGQSTSETQEGGKKAALGAVPISGKAGRPVMPPPQVPLPTSSISPAKMANGTAGTKVALRKTKQAAEKISADKISKEALLECADLLSSALTEPVPNSQLVDTGHQLLDYCSGYVDCIPQTRNKFAFREAVSKLELSLQELQVSSAAAGVPGTNPVLNNLLSCVQEISDVVQR

SEQ ID NO: 908693 - protein, 112 aa, Homo sapiens
TKTQASSSFQDSSQPAGKKKGHSRTLTRICTMGRKLDPTKEKRGPGRKARKQKGAETELVRFLPAVSDENSKRLSSRARKRAAKRRLGSVEAPKTNKSPEAKPLPGKLPKGP

SEQ ID NO: 908694 - protein, 812 aa, Homo sapiens
MGRKLDPTKEKRGPGRKARKQKGAETELVRFLPAVSDENSKRLSSRARKRAAKRRLGSVEAPKTNKSPEAKPLPGKLPKGISAGAVQTAGKKGPQSLFNAPRGKKRPAPGSDEEEEEEDSEEDGMVNHGDLWGSEDDADTVDDYGADSNSEDEEEGEALLPIERAARKQKAREAAAGIQWSEEETEDEEEEKEVTPESGPPKVEEADGGLQINVDEEPFVLPPAGEMEQDAQAPDLQRVHKRIQDIVGILRDFGAQREEGRSRSEYLNRLKKDLAIYYSYGDFLLGKLMDLFPLSELVEFLEANEVPRPVTLRTNTLKTRRRDLAQALINRGVNLDPLGKWSKTGLVVYDSSVPIGATPEYLAGHYMLQGASSMLPVMALAPQEHERILDMCCAPGGKTSYMAQLMKNTGVILANDANAERLKSVVGNLHRLGVTNTIISHYDGRQFPKVVGGFDRVLLDAPCSGTGVISKDPAVKTNKDEKDILRCAHLQKELLLSAIDSVNATSKTGGYLVYCTCSITVEENEWVVDYALKKRNVRLVPTGLDFGQEGFTRFRERRFHPSLRSTRRFYPHTHNMDGFFIAKFKKFSNSIPQSQTGNSETATPTNVDLPQVIPKSENSSQPAKKAKGAAKTKQQLQKQQHPKKASFQKLNGISKGADSELSTVPSVTKTQASSSFQDSSQPAGKAEGIREPKVTGKLKQRSPKLQSSKKVAFLRQNAPPKGTDTQTPAVLSPSKTQATLKPKDHHQPLGRAKGVEKQQLPEQPFEKAAFQKQNDTPKGPQPPTVSPIRSSRPPPAKRKKSQSRGNSQLLLS

SEQ ID NO: 908695 - protein, 845 aa, Homo sapiens
MGRKLDPTKEKRGPGRKARKQKGAETELVRFLPAVSDENSKRLSSRARKRAAKRRLGSVEAPKTNKSPEAKPLPGKLPKGISAGAVQTAGKKGPQSLFNAPRGKKRPAPGSDEEEEEEDSEEDGMVNHGDLWGSEDDADTVDDYGADSNSEDEEEGEALLPIERAARKQKAREAAAGIQWSEEETEDEEEEKEVTPESGPPKVEEADGGLQINVDEEPFVLPPAGEMEQDILAGQSEELGGRWLGEGFPGLRTSCHSSLTGPHAQAPDLQRVHKRIQDIVGILRDFGAQREEGRSRSEYLNRLKKDLAIYYSYGDFLLGKLMDLFPLSELVEFLEANEVPRPVTLRTNTLKTRRRDLAQALINRGVNLDPLGKWSKTGLVVYDSSVPIGATPEYLAGHYMLQGASSMLPVMALAPQEHERILDMCCAPGGKTSYMAQLMKNTGVILANDANAERLKSVVGNLHRLGVTNTIISHYDGRQFPKVVGGFDRVLLDAPCSGTGVISKDPAVKTNKDEKDILRCAHLQKELLLSAIDSVNATSKTGGYLVYCTCSITVEENEWVVDYALKKRNVRLVPTGLDFGQEGFTRFRERRFHPSLRSTRRFYPHTHNMDGFFIAKFKKFSNSIPQSQTGNSETATPTNVDLPQVIPKSENSSQPAKKAKGAAKTKQQLQKQQHPKKASFQKLNGISKGADSELSTVPSVTKTQASSSFQDSSQPAGKAEGIREPKVTGKLKQRSPKLQSSKKVAFLRQNAPPKGTDTQTPAVLSPSKTQATLKPKDHHQPLGRAKGVEKQQLPEQPFEKAAFQKQNDTPKGPQPPTVSPIRSSRPPPAKRKKSQSRGNSQLLLS

SEQ ID NO: 908696 - protein, 894 aa, Homo sapiens
MGRKLDPTKEKRGPGRKARKQKGAETELVRFLPAVSDENSKRLSSRARKRAAKRRLGSVEAPKTNKSPEAKPLPGKLPKGISAGAVQTAGKKGPQSLFNAPRGKKRPAPGSDEEEEEEDSEEDGMVNHGDLWGSEDDADTVDDYGADSNSEDEEEGEALLPIERAARKQKAREAAAGIQWSEEETEDEEEEKEVTPESGPPKVEEADGGLQINVDEEPFVLPPAGEMEQDAQAPDLQRVHKRIQDIVGILRDFGAQREEGRSRSEYLNRLKKDLAIYYSYGDFLLGKLMDLFPLSELVEFLEANEVPRPVTLRTNTLKTRRRDLAQALINRGVNLDPLGKWSKTGLVVYDSSVPIGATPEYLAGHYMLQGASSMLPVMALAPQEHERILDMCCAPGGKTSYMAQLMKNTGVILANDANAERLKSVVGNLHRLGVTNTIISHYDGRQFPKVVGGFDRVLLDAPCSGTGVISKDPAVKTNKVRSQVVAPERPWLGLVELETEMGTPSGLPSPPEAALGLFLGQDEKDILRCAHLQKELLLSAIDSVNATSKTGGYLVYCTCSITVRPLPWQSRGGWAGGLFAPESSLQLQLCFFLRSLSSPHIQVEENEWVVDYALKKRNVRLVPTGLDFGQEGFTRFRERRFHPSLRSTRRFYPHTHNMDGFFIAKFKKFSNSIPQSQTGNSETATPTNVDLPQVIPKSENSSQPAKKAKGAAKTKQQLQKQQHPKKASFQKLNGISKGADSELSTVPSVTKTQASSSFQDSSQPAGKAEGIREPKVTGKLKQRSPKLQSSKKVAFLRQNAPPKGTDTQTPAVLSPSKTQATLKPKDHHQPLGRAKGVEKQQLPEQPFEKAAFQKQNDTPKGPQPPTVSPIRSSRPPPAKRKKSQSRGNSQLLLS

SEQ ID NO: 908697 - protein, 237 aa, Homo sapiens [sequence omitted]

SEQ ID NO: 908698 - protein, 83 aa, Homo sapiens
RKRRGREASATRAPAWNDSVASAGRKLGPDCTWRAARRALSDINPHSVPWGASWTLRRRSGGQAERPGSRRVPRQNSSDSCLQ

SEQ ID NO: 908699 - protein, 83 aa, Homo sapiens; identical to SEQ ID NO: 908698

SEQ ID NO: 908700 - protein, 812 aa, Homo sapiens; identical to SEQ ID NO: 908694

SEQ ID NO: 908701 - protein, 812 aa, Homo sapiens; identical to SEQ ID NO: 908694

SEQ ID NO: 908702 - protein, 852 aa, Homo sapiens
MGRKLDPTKEKRGPGRKARKQKGAETELVRFLPAVSDENSKRLSSRARKRAAKRRLGSVEAPKTNKSPEAKPLPGKLPKGISAGAVQTAGKKGPQSLFNAPRGKKRPAPGSDEEEEEEDSEEDGMVNHGDLWGSEDDADTVDDYGADSNSEDEEEGEALLPIERAARKQKAREAAAGIQWSEEETEDEEEEKEVTPESGPPKVEEADGGLQINVDEEPFVLPPAGEMEQDAQAPDLQRVHKRIQDIVGILRDFGAQREEGRSRSEYLNRLKKDLAIYYSYGDFLLGKLMDLFPLSELVEFLEANEVPRPVTLRTNTLKTRRRDLAQALINRGVNLDPLGKWSKTGLVVYDSSVPIGATPEYLAGHYMLQGASSMLPVMALAPQEHERILDMCCAPGGKTSYMAQLMKNTGVILANDANAERLKSVVGNLHRLGVTNTIISHYDGRQFPKVVGGFDRVLLDAPCSGTGVISKDPAVKTNKDEKDILRCAHLQKELLLSAIDSVNATSKTGGYLVYCTCSITVRPLPWQSRGGWAGGLFAPESSLQLQLCFFLRSLSSPHIQVEENEWVVDYALKKRNVRLVPTGLDFGQEGFTRFRERRFHPSLRSTRRFYPHTHNMDGFFIAKFKKFSNSIPQSQTGNSETATPTNVDLPQVIPKSENSSQPAKKAKGAAKTKQQLQKQQHPKKASFQKLNGISKGADSELSTVPSVTKTQASSSFQDSSQPAGKAEGIREPKVTGKLKQRSPKLQSSKKVAFLRQNAPPKGTDTQTPAVLSPSKTQATLKPKDHHQPLGRAKGVEKQQLPEQPFEKAAFQKQNDTPKGPQPPTVSPIRSSRPPPAKRKKSQSRGNSQLLLS

SEQ ID NO: 908703 - protein, 656 aa, Homo sapiens
MALLPIERAARKQKAREAAAGIQWSEEETEDEEEEKEVTPESGPPKVEEADGGLQINVDEEPFVLPPAGEMEQDAQAPDLQRVHKRIQDIVGILRDFGAQREEGRSRSEYLNRLKKDLAIYYSYGDFLLGKLMDLFPLSELVEFLEANEVPRPVTLRTNTLKTRRRDLAQALINRGVNLDPLGKWSKTGLVVYDSSVPIGATPEYLAGHYMLQGASSMLPVMALAPQEHERILDMCCAPGGKTSYMAQLMKNTGVILANDANAERLKSVVGNLHRLGVTNTIISHYDGRQFPKVVGGFDRVLLDAPCSGTGVISKDPAVKTNKDEKDILRCAHLQKELLLSAIDSVNATSKTGGYLVYCTCSITVEENEWVVDYALKKRNVRLVPTGLDFGQEGFTRFRERRFHPSLRSTRRFYPHTHNMDGFFIAKFKKFSNSIPQSQTGNSETATPTNVDLPQVIPKSENSSQPAKKAKGAAKTKQQLQKQQHPKKASFQKLNGISKGADSELSTVPSVTKTQASSSFQDSSQPAGKAEGIREPKVTGKLKQRSPKLQSSKKVAFLRQNAPPKGTDTQTPAVLSPSKTQATLKPKDHHQPLGRAKGVEKQQLPEQPFEKAAFQKQNDTPKGPQPPTVSPIRSSRPPPAKRKKSQSRGNSQLLLS

SEQ ID NO: 908704 - protein, 236 aa, Homo sapiens
MGRKLDPTKEKRGPGRKARKQKGAETELVRFLPAVSDENSKRLSSRARKRAAKRRLGSVEAPKTNKSPEAKPLPGKLPKGISAGAVQTAGKKGPQSLFNAPRGKKRPAPGSDEEEEEEDSEEDGMVNHGDLWGSEDDADTVDDYGADSNSEDEEEGEALLPIERAARKQKAREAAAGIQWSEEETEDEEEEKEVTPESGPPKVEEADGGLQINVDGRAPLDGRAPLDGRAPLDGRA

SEQ ID NO: 908705 - protein, 102 aa, Homo sapiens
MGRKLDPTKEKRGPGRKARKQKGAETELVRFLPAVSDENSKRLSSRARKRAAKRRLGSVEAPKTNKSPEAKPLPGKLPKGISAGAVQTAGKKGPQSLFNAPL

SEQ ID NO: 908706 - protein, 235 aa, Homo sapiens
PSRYRYGNRLGGAISGCVDRTGVGTRPSAFPHSHIPAGRERSGEELHLPPAEISKNLQKCIPWYRFGLRWDQAKFRDRNGCALRPRVRVWTASSVVDESEEQDSPQPSPSPSPSPAASPAVTLRAAGGAWGSWTEEDYACPWAEKGGDSGGRGQGRMQALRVSQALIRSFSSTARNRFQNRVREKQKLFQEDNDIPLYLKGGIVDNILYRVTMTLCLGGTVYSLYSLGWASFPRN

SEQ ID NO: 908707 - protein, 276 aa, Homo sapiens
PSRYRYGNRLGGAISGCVDRTGVGTRPSAFPHSHIPAGRERSGEELHLPPAEISKNLQKCIPWYRFGLRWDQAKFRDRNGCALRPRVRVWTASSVVDESEEQDSPQPSPSPSPSPAASPAVTLRAAGGAWGSWTEEDYACPWAEKGGDSGGRGQGRMQALRVSQALIRSFSSTARNRFQNRVREKQKLFQVGGAGGVGIRRASRERAEPGQAGRALRSSQHPFLIRHPHIQEDNDIPLYLKGGIVDNILYRVTMTLCLGGTVYSLYSLGWASFPRN

SEQ ID NO: 908708 - protein, 235 aa, Homo sapiens; identical to SEQ ID NO: 908706

SEQ ID NO: 908709 - protein, 250 aa, Homo sapiens
PSRYRYGNRLGGAISGCVDRTGVGTRPSAFPHSHIPAGRERSGEELHLPPAEISKNLQKCIPWYRFGLRWDQAKFRDRNGCALRPRVRVWTASSVVDESEEQDSPQPSPSPSPSPAASPAVTLRAAGGAWGSWTEEDYACPWAEKGGDSGGRGQGRMQALRVSQALIRSFSSTARNRFQNRVREKQKLFQEDNDIPLYLKGGIVDNILYRVTMTLCLGGTVYSFVLLCWPTSQELDKRLRAEDIYSLITW

SEQ ID NO: 908710 - protein, 114 aa, Homo sapiens
RPPRTKSFWVLSLPGPSRQPGHPQARLQGESPPNPAGSSRVSQALIRSFSSTARNRFQNRVREKQKLFQEDNDIPLYLKGGIVDNILYRVTMTLCLGGTVYSLYSLGWASFPRN

SEQ ID NO: 908711 - protein, 318 aa, Homo sapiens
PSRYRYGNRLGGAISGCVDRTGVGTRPSAFPHSHIPAGRERSGEELHLPPAEISKNLQKCIPWYRFGLRWDQAKFRDRNGCALRPRVRVWTASSVVDESEEQDSPQPSPSPSPSPAASPAVTLRAAGGAWGSWTEEDYACPWAEKGGDSGGRGQGRMQALRVSQALIRSFSSTARNRFQNRVREKQKLFQEDNDIPLYLKGGIVDNILYRVTMTLCLGGTVYSLYSQEKLEQAEKKATDAEGRCGLPEPAHSAWLREELDRAQGSRLGYRPLQKLEEAEKAADESERGHEGHSKNRGHAGLRRKMELQEMQAEGGQAH

SEQ ID NO: 908712 - protein, 226 aa, Homo sapiens
PSRYRYGNRLGGAISGCVDRTGVGTRPSAFPHSHIPAGRERSGEELHLPPAEISKNLQKCIPWYRFGLRWDQAKFRDRNGCALRPRVRVWTASSVVDESEEQDSPQPSPSPSPSPAASPAVTLRAAGGAWGSWTEEDYACPWAEKGGDSGGRGQGRMQALRVSQALIRSFSSTARNRFQNREDNDIPLYLKGGIVDNILYRVTMTLCLGGTVYSLYSLGWASFPRN

SEQ ID NO: 908713 - protein, 413 aa, Homo sapiens
MKEVVYWSPKKVADWLLENAMPEYCEPLEHFTGQDLINLTQEDFKKPPLCRVSSDNGQRLLDMIETLKMEHHLEAHKNGHANGHLNIGVDIPTPDGSFSIKIKPNGMPNGYRKEMIKIPMPELERSQYPMEWGKTFLAFLYALSCFVLTTVMISVVHERVPPKEVQPPLPDTFFDHFNRVQWAFSICEINGMILVGLWLIQWLLLKYKSIISRRFFCIVGTLYLYRCITMYVTTLPVPGMHFNCSPKLFGDWEAQLRRIMKLIAGGGLSITGSHNMCGDYLYSGHTVMLTLTYLFIKEYSPRRLWWYHWICWLLSVVGIFCILLAHDHYTVDVVVAYYITTRLFWWYHTMANQQVLKEASQMNLLARVWWYRPFQYFEKNVQGIVPRSYHWPFPWPVVHLSRQVKYSRLVNDT

SEQ ID NO: 908714 - protein, 413 aa, Homo sapiens; identical to SEQ ID NO: 908713

SEQ ID NO: 908715 - protein, 413 aa, Homo sapiens; identical to SEQ ID NO: 908713

SEQ ID NO: 908716 - protein, 208 aa, Homo sapiens [sequence omitted]

SEQ ID NO: 908717 - protein, 413 aa, Homo sapiens; identical to SEQ ID NO: 908713

SEQ ID NO: 908718 - protein, 413 aa, Homo sapiens; identical to SEQ ID NO: 908713

SEQ ID NO: 908719 - protein, 87 aa, Homo sapiens
RGGKSKAFAPAGQRLRAAGGGQVGSEKDRPGLTALPSRLGSRSESAIGVRSPDAALPRISFRGGGSASGIPAAAVTPVQRDDSMYDP

SEQ ID NO: 908720 - protein, 205 aa, Homo sapiens
MDGDSSTTDASQLGISADYIGGSHYVIQPHDDTEDSMNDHEDTNGSKESFREQDIYLPIANVARIMKNAIPQTGKIAKDAKECVQECVSEFISFITSEASERCHQEKRKTINGEDILFAMSTLGFDSYVEPLKLYLQKFREAMKGEKGIGGAVTATDGLSEELTEEAFTNQLPAGLITTDGQQQNVMVYTTSYQQISGVQQIQFS

SEQ ID NO: 908721 - protein, 205 aa, Homo sapiens; identical to SEQ ID NO: 908720

SEQ ID NO: 908722 - protein, 205 aa, Homo sapiens; identical to SEQ ID NO: 908720

SEQ ID NO: 908723 - protein, 205 aa, Homo sapiens; identical to SEQ ID NO: 908720

SEQ ID NO: 908724 - protein, 207 aa, Homo sapiens
MTMDGDSSTTDASQLGISADYIGGSHYVIQPHDDTEDSMNDHEDTNGSKESFREQDIYLPIANVARIMKNAIPQTGKIAKDAKECVQECVSEFISFITSEASERCHQEKRKTINGEDILFAMSTLGFDSYVEPLKLYLQKFREAMKGEKGIGGAVTATDGLSEELTEEAFTNQLPAGLITTDGQQQNVMVYTTSYQQISGVQQIQFS

SEQ ID NO: 908725 - protein, 205 aa, Homo sapiens; identical to SEQ ID NO: 908720

SEQ ID NO: 908726 - protein, 189 aa, Homo sapiens
MTMDGDSSTTDASQLGISADYIGGSHYVIQPHDDTEDSMNDHEDTNGSKESFREQDIYLPIANVARIMKKCVSEFISFITSEASERCHQEKRKTINGEDILFAMSTLGFDSYVEPLKLYLQKFREAMKGEKGIGGAVTATDGLSEELTEEAFTNQLPAGLITTDGQQQNVMVYTTSYQQISGVQQIQFS

SEQ ID NO: 908727 - protein, 205 aa, Homo sapiens; identical to SEQ ID NO: 908720

SEQ ID NO: 908728 - protein, 205 aa, Homo sapiens; identical to SEQ ID NO: 908720

SEQ ID NO: 908729 - protein, 207 aa, Homo sapiens; identical to SEQ ID NO: 908724

SEQ ID NO: 908730 - protein, 208 aa, Homo sapiens
MNLMDGDSSTTDASQLGISADYIGGSHYVIQPHDDTEDSMNDHEDTNGSKESFREQDIYLPIANVARIMKNAIPQTGKIAKDAKECVQECVSEFISFITSEASERCHQEKRKTINGEDILFAMSTLGFDSYVEPLKLYLQKFREAMKGEKGIGGAVTATDGLSEELTEEAFTNQLPAGLITTDGQQQNVMVYTTSYQQISGVQQIQFS

SEQ ID NO: 908731 - protein, 1320 aa, Homo sapiens
AAASASQTRSGGGSEAGVRGGWAGSPSGGRSAVPPLPTPAPSRPPAPFPSGRSLNRARLAVLRGAAGKDGRGAAVRVASPPLQPLPAYPDPRGYGNVMEPPVITEQSPRRLVVFPTDDISLKCEASGKPEVQFRWTRDGVHFKPKEELGVTVYQSPHSGSFTITGNNSNFAQRFQGIYRCFASNKLGTAMSHEIRLMAEGAPKWPKETVKPVEVEEGESVVLPCNPPPSAEPLRIYWMNSKILHIKQDERVTMGQNGNLYFANVLTSDNHSDYICHAHFPGTRTIIQKEPIDLRVKATNSMIDRKPRLLFPTNSSSHLVALQGQPLVLECIAEGFPTPTIKWLRPSGPMPADRVTYQNHNKTLQLLKVGEEDDGEYRCLAENSLGSARHAYYVTVEAAPYWLHKPQSHLYGPGETARLDCQVQGRPQPEVTWRINGIPVEELAKDQKYRIQRGALILSNVQPSDTMVTQCEARNRHGLLLANAYIYVVQLPAKILTADNQTYMAVQGSTAYLLCKAFGAPVPSVQWLDEDGTTVLQDERFFPYANGTLGIRDLQANDTGRYFCLAANDQNNVTIMANLKVKDATQITQGPRSTIEKKGSRVTFTCQASFDPSLQPSITWRGDGRDLQELGDSDKYFIEDGRLVIHSLDYSDQGNYSCVASTELDVVESRAQLLVVGSPGPVPRLVLSDLHLLTQSQVRVSWSPAEDHNAPIEKYDIEFEDKEMAPEKWYSLGKVPGNQTSTTLKLSPYVHYTFRVTAINKYGPGEPSPVSETVVTPEAAPEKNPVDVKGEGNETTNMVITWKPLRWMDWNAPQVQYRVQWRPQGTRGPWQEQIVSDPFLVVSNTSTFVPYEIKVQAVNSQGKGPEPQVTIGYSGEDYPQAIPELEGIEILNSSAVLVKWRPVDLAQVKGHLRGYNVTYWREGSQRKHSKRHIHKDHVVVPANTTSVILSGLRPYSSYHLEVQAFNGRGSGPASEFTFSTPEGVPGHPEALHLECQSNTSLLLRWQPPLSHNGVLTGYVLSYHPLDEGGKGQLSFNLRDPELRTHNLTDLSPHLRYRFQLQATTKEGPGEAIVREGGTMALSGISDFGNISATAGENYSVVSWVPKEGQCNFRFHILFKALGEEKGGASLSPQYVSYNQSSYTQWDLQPDTDYEIHLFKERMFRHQMAVKTNGTGRVRLPPAGFATEGWFIGFVSAIILLLLVLLILCFIKRSKGGKYSVKDKEDTQVDSEARPMKDETFGEYSDDNEEKAFGSSQPSLNGDIKPLGSDDSLADYGGSVDVQFNEDGSFIGQYSGKKEKEAAGGNDSSGATSPINPAVALE

SEQ ID NO: 908732 - protein, 1320 aa, Homo sapiens; identical to SEQ ID NO: 908731

SEQ ID NO: 908733 - protein, 1185 aa, Homo sapiens
AAASASQTRSGGGSEAGVRGGWAGSPSGGRSAVPPLPTPAPSRPPAPFPSGRSLNRARLAVLRGAAGKDGRGAAVRVASPPLQPLPAYPDPRGYGNVMEPPVITEQSPRRLVVFPTDDISLKCEASGKPEVQFRWTRDGVHFKPKEELGVTVYQSPHSGSFTITGNNSNFAQRFQGIYRCFASNKLGTAMSHEIRLMAEVPRPPSNGCRPSGPMPADRVTYQNHNKTLQLLKVGEEDDGEYRCLAENSLGSARHAYYVTVEAAPYWLHKPQSHLYGPGETARLDCQVQGRPQPEVTWRINGIPVEELAKDQKYRIQRGALILSNVQPSDTMVTQCEARNRHGLLLANAYIYVVQLPAKILTADNQTYMAVQGSTAYLLCKAFGAPVPSVQWLDEDGTTVLQDERFFPYANGTLGIRDLQANDTGRYFCLAANDQNNVTIMANLKVKDATQITQGPRSTIEKKGSRVTFTCQASFDPSLQPSITWRGDGRDLQELGDSDKYFIEDGRLVIHSLDYSDQGNYSCVASTELDVVESRAQLLVVGSPGPVPRLVLSDLHLLTQSQVRVSWSPAEDHNAPIEKYDIEFEDKEMAPEKWYSLGKVPGNQTSTTLKLSPYVHYTFRVTAINKYGPGEPSPVSETVVTPEAAPEKNPVDVKGEGNETTNMVITWKPLRWMDWNAPQVQYRVQWRPQGTRGPWQEQIVSDPFLVVSNTSTFVPYEIKVQAVNSQGKGPEPQVTIGYSGEDYPQAIPELEGIEILNSSAVLVKWRPVDLAQVKGHLRGYNVTYWREGSQRKHSKRHIHKDHVVVPANTTSVILSGLRPYSSYHLEVQAFNGRGSGPASEFTFSTPEGVPGHPEALHLECQSNTSLLLRWQPPLSHNGVLTGYVLSYHPLDEGGKGQLSFNLRDPELRTHNLTDLSPHLRYRFQLQATTKEGPGEAIVREGGTMALSGISDFGNISATAGENYSVVSWVPKEGQCNFRFHILFKALGEEKGGASLSPQYVSYNQSSYTQWDLQPDTDYEIHLFKERMFRHQMAVKTNGTGRVRLPPAGFATEGWFIGFVSAIILLLLVLLILCFIKRSKGGKYSVKDKEDTQVDSEARPMKDETFGEYSDDNEEKAFGSSQPSLNGDIKPLGSDDSLADYGGSVDVQFNEDGSFIGQYSGKKEKEAAGGNDSSGATSPINPAVALE

SEQ ID NO: 908734 - protein, 931 aa, Homo sapiens
AALPFLPAAPYWLHKPQSHLYGPGETARLDCQVQGRPQPEVTWRINGIPVEELAKDQKYRIQRGALILSNVQPSDTMVTQCEARNRHGLLLANAYIYVVQLPAKILTADNQTYMAVQGSTAYLLCKAFGAPVPSVQWLDEDGTTVLQDERFFPYANGTLGIRDLQANDTGRYFCLAANDQNNVTIMANLKVKDATQITQGPRSTIEKKGSRVTFTCQASFDPSLQPSITWRGDGRDLQELGDSDKYFIEDGRLVIHSLDYSDQGNYSCVASTELDVVESRAQLLVVGSPGPVPRLVLSDLHLLTQSQVRVSWSPAEDHNAPIEKYDIEFEDKEMAPEKWYSLGKVPGNQTSTTLKLSPYVHYTFRVTAINKYGPGEPSPVSETVVTPEAAPEKNPVDVKGEGNETTNMVITWKPLRWMDWNAPQVQYRVQWRPQGTRGPWQEQIVSDPFLVVSNTSTFVPYEIKVQAVNSQGKGPEPQVTIGYSGEDYPQAIPELEGIEILNSSAVLVKWRPVDLAQVKGHLRGYNVTYWREGSQRKHSKRHIHKDHVVVPANTTSVILSGLRPYSSYHLEVQAFNGRGSGPASEFTFSTPEGVPGHPEALHLECQSNTSLLLRWQPPLSHNGVLTGYVLSYHPLDEGGKGQLSFNLRDPELRTHNLTDLSPHLRYRFQLQATTKEGPGEAIVREGGTMALSGISDFGNISATAGENYSVVSWVPKEGQCNFRFHILFKALGEEKGGASLSPQYVSYNQSSYTQWDLQPDTDYEIHLFKERMFRHQMAVKTNGTGRVRLPPAGFATEGWFIGFVSAIILLLLVLLILCFIKRSKGGKYSVKDKEDTQVDSEARPMKDETFGEYSDDNEEKAFGSSQPSLNGDIKPLGSDDSLADYGGSVDVQFNEDGSFIGQYSGKKEKEAAGGNDSSGATSPINPAVALE

SEQ ID NO: 908735 - protein, 1293 aa, Homo sapiens
AAASASQTRSGGGSEAGVRGGWAGSPSGGRSAVPPLPTPAPSRPPAPFPSGRSLNRARLAVLRGAAGKDGRGAAVRVASPPLQPLPAYPDPRGYGNVMEPPVITEQSPRRLVVFPTDDISLKCEASGKPEVQFRWTRDGVHFKPKEELGVTVYQSPHSGSFTITGNNSNFAQRFQGIYRCFASNKLGTAMSHEIRLMAEGAPKWPKETVKPVEVEEGESVVLPCNPPPSAEPLRIYWMNSKILHIKQDERVTMGQNGNLYFANVLTSDNHSDYICHAHFPGTRTIIQKEPIDLRVKATNSMIDRKPRLLFPTNSSSHLVALQGQPLVLECIAEGFPTPTIKWLRPSGPMPADRVTYQNHNKTLQLLKVGEEDDGEYRCLAENSLGSARHAYYVTVEAAPYWLHKPQSHLYGPGETARLDCQVQGRPQPEVTWRINGIPVEELAKDQKYRIQRGALILSNVQPSDTMVTQCEARNRHGLLLANAYIYVVQLPAKILTADNQTYMAVQGSTAYLLCKAFGAPVPSVQWLDEDGTTVLQDERFFPYANGTLGIRDLQANDTGRYFCLAANDQNNVTIMANLKVKDATQITQGPRSTIEKKGSRVTFTCQASFDPSLQPSITWRGDGRDLQELGDSDKYFIEDGRLVIHSLDYSDQGNYSCVASTELDVVESRAQLLVVGSPGPVPRLVLSDLHLLTQSQVRVSWSPAEDHNAPIEKYDIEFEDKEMAPEKWYSLGKVPGNQTSTTLKLSPYVHYTFRVTAINKYGPGEPSPVSETVVTPEAAPEKNPVDVKGEGNETTNMVITWKPLRWMDWNAPQVQYRVQWRPQGTRGPWQEQIVSDPFLVVSNTSTFVPYEIKVQAVNSQGKGPEPQVTIGYSGEDYPQAIPELEGIEILNSSAVLVKWRPVDLAQVKGHLRGYNVTYWREGSQRKHSKRHIHKDHVVVPANTTSVILSGLRPYSSYHLEVQAFNGRGSGPASEFTFSTPEGVPGHPEALHLECQSNTSLLLRWQPPLSHNGVLTGYVLSYHPLDEGGKGQLSFNLRDPELRTHNLTDLSPHLRYRFQLQATTKEGPGEAIVREGGTMALSGISDFGNISATAGENYSVVSWVPKEGQCNFRFHILFKALGEEKGGASLSPQYVSYNQSSYTQWDLQPDTDYEIHLFKERMFRHQMAVKTNGTGRVRLPPAGFATEGWFIGFVSAIILLLLVLLILCFIKRSKGGKYSVKDKEDTQVDSEARPMKDETFGEYSDFGTHHTTSKWPPSLPGCGAGTPPPTAHWPASSSRPHPPGPLSSPALPIV

SEQ ID NO: 908736 - protein, 1130 aa, Homo sapiens
AAASASQTRSGGGSEAGVRGGWAGSPSGGRSAVPPLPTPAPSRPPAPFPSGRSLNRARLAVLRGAAGKDGRGAAVRVASPPLQPLPAYPDPRGYGNVMEPPVITEQSPRRLVVFPTDDISLKCEASGKPEVQFRWTRDGVHFKPKEELGVTVYQSPHSGSFTITGNNSNFAQRFQGIYRCFASNKLGTAMSHEIRLMAEGAPKWPKETVKPVEVEEGESVVLPCNPPPSAEPLRIYWMNSKILHIKQDERVTMGQNGNLYFANVLTSDNHSDYICHAHFPGTRTIIQKEPIDLRVKATNSMIDRKPRLLFPTNSSSHLVALQGQPLVLECIAEGFPTPTIKWLRPSGPMPADRVTYQNHNKTLQLLKVGEEDDGEYRCLAENSLGSARHAYYVTVEAAPYWLHKPQSHLYGPGETARLDCQVQGRPQPEVTWRINGIPVEELAKDQKYRIQRGALILSNVQPSDTMVTQCEARNRHGLLLANAYIYVVQLPAKILTADNQTYMAVQGSTAYLLCKAFGAPVPSVQWLDEDGTTVLQDERFFPYANGTLGIRDLQANDTGRYFCLAANDQNNVTIMANLKVKDATQITQGPRSTIEKKGSRVTFTCQASFDPSLQPSITWRGDGRDLQELGDSDKYFIEDGRLVIHSLDYSDQGNYSCVASTELDVVESRAQLLVVGSPGPVPRLVLSDLHLLTQSQVRVSWSPAEDHNAPIEKYDIEFEDKEMAPEKWYSLGKVPGNQTSTTLKLSPYVHYTFRVTAINKYGPGEPSPVSETVVTPEAAPEKNPVDVKGEGNETTNMVITWKPLRWMDWNAPQVQYRVQWRPQGTRGPWQEQIVSDPFLVVSNTSTFVPYEIKVQAVNSQGKGPEPQVTIGYSGEDYPQAIPELEGIEILNSSAVLVKWRPVDLAQVKGHLRGYNVTYWREGSQRKHSKRHIHKDHVVVPANTTSVILSGLRPYSSYHLEVQAFNGRGSGPASEFTFSTPEGVPGHPEALHLECQSNTSLLLRWQPPLSHNGVLTGYVLSYHPLDEGGKGQLSFNLRDPELRTHNLTDLSPHLRYRFQLQATTKEGPGEAIVREGGTMALSGISDFGNISATAGENYSVVSWVPKEGQCNFRFHILFKALGEGEGGGRGQ

SEQ ID NO: 908737 - protein, 196 aa, Homo sapiens
AAASASQTRSGGGSEAGVRGGWAGSPSGGRSAVPPLPTPAPSRPPAPFPSGRSLNRARLAVLRGAAGKDGRGAAVRVASPPLQPLPAYPDPRGYEEVAEGSLGAYLRRYVGPLFIFYLLTFSLFRTLTPLPGLSWAQGGQEIARTLGTPGEKGRVEGAGRVRTMDRDRRGRRGDFSTRDSEPGAGPRGLGPPPCSP

SEQ ID NO: 908738 - protein, 104 aa, Homo sapiens
RSIGIADALGRRVRGRRARRLGGQPERWPQRRTLEIYRKEQKKLRIASDLITKRETRSARPSLPGLLHRAPKRLLPKFPAASSLLSIRRTISASRWRGPLPCSQ

SEQ ID NO: 908739 - protein, 1320 aa, Homo sapiens; identical to SEQ ID NO: 908731

SEQ ID NO: 908740 - protein, 1320 aa, Homo sapiens; identical to SEQ ID NO: 908731

SEQ ID NO: 908741 - protein, 1515 aa, Homo sapiens
AAASASQTRSGGGSEAGVRGGWAGSPSGGRSAVPPLPTPAPSRPPAPFPSGRSLNRARLAVLRGAAGKDGRGAAVRVASPPLQPLPAYPDPRGYGNVMEPPVITEQSPRRLVVFPTDDISLKCEASGKPEVQFRWTRDGVHFKPKEELGVTVYQSPHSGSFTITGNNSNFAQRFQGIYRCFASNKLGTAMSHEIRLMAEGAPKWPKETVKPVEVEEGESVVLPCNPPPSAEPLRIYWMNSKILHIKQDERVTMGQNGNLYFANVLTSDNHSDYICHAHFPGTRTIIQKEPIDLRVKATNSMIDRKPRLLFPTNSSSHLVALQGQPLVLECIAEGFPTPTIKWLRPSGPMPADRVTYQNHNKTLQLLKVGEEDDGEYRCLAENSLGSARHAYYVTVEAAPYWLHKPQSHLYGPGETARLDCQVQGRPQPEVTWRINGIPVEELAKDQKYRIQRGALILSNVQPSDTMVTQCEARNRHGLLLANAYIYVVQLPAKILTADNQTYMAVQGSTAYLLCKAFGAPVPSVQWLDEDGTTVLQDERFFPYANGTLGIRDLQANDTGRYFCLAANDQNNVTIMANLKVKDATQITQGPRSTIEKKGSRVTFTCQASFDPSLQPSITWRGDGRDLQELGDSDKYFIEDGRLVIHSLDYSDQGNYSCVASTELDVVESRAQLLVVGSPGPVPRLVLSDLHLLTQSQVRVSWSPAEDHNAPIEKYDIEFEDKEMAPEKWYSLGKVPGNQTSTTLKLSPYVHYTFRVTAINKYGPGEPSPVSETVVTPEAAPEKNPVDVKGEGNETTNMVITWKPLRWMDWNAPQVQYRVQWRPQGTRGPWQEQIVSDPFLVVSNTSTFVPYEIKVQAVNSQGKGPEPQVTIGYSGEDYPQAIPELEGIEILNSSAVLVKWRPVDLAQVKGHLRGYNVTYWREGSQRKHSKRHIHKDHVVVPANTTSVILSGLRPYSSYHLEVQAFNGRGSGPASEFTFSTPEGVPGHPEALHLECQSNTSLLLRWQPPLSHNGVLTGYVLSYHPLDEGGKGQLSFNLRDPELRTHNLTDLSPHLRYRFQLQATTKEGPGEAIVREGGTMALSGISDFGNISATAGENYSVVSWVPKEGQCNFRFHILFKALGEEKGGASLSPQYVSYNQSSYTQWDLQPDTDYEIHLFKERMFRHQMAVKTNGTGRVRLPPAGFATEGWFIGFVSAIILLLLVLLILCFIKRSKGGKYSVKDKEDTQVDSEARPMKDETFGEYSDQVSRGRSGCWHSAPPWPSHLTPSLSSLCCRVTSGPWRGKAGAVGRGQQQGLPIDNVRLVCHCPLAAGALTGLSLPSPQARQLLISGRGQHAPAPPLHTDTFTAPLSPREAPDSFPDRNQAPNPLAERTFSPSQSPGSGECPKMTAPDLPARVARAALSERILNKWKAGGRLPHPQPGSCRGSAVLSLAPALCLCSDNEEKAFGSSQPSLNGDIKPLGSDDSLADYGGSVDVQFNEDGSFIGQYSGKKEKEAAGGNDSSGATSPINPAVALE

SEQ ID NO: 908742 - protein, 1255 aa, Homo sapiens
AAASASQTRSGGGSEAGVRGGWAGSPSGGRSAVPPLPTPAPSRPPAPFPSGRSLNRARLAVLRGAAGKDGRGAAVRVASPPLQPLPAYPDPRGYGNVMEPPVITEQSPRRLVVFPTDDISLKCEASGKPEVQFRWTRDGVHFKPKEELGVTVYQSPHSGSFTITGNNSNFAQRFQGIYRCFASNKLGTAMSHEIRLMAEGAPKWPKETVKPVEVEEGESVVLPCNPPPSAEPLRIYWMNSKILHIKQDERVTMGQNGNLYFANVLTSDNHSDYICHAHFPGTRTIIQKEPIDLRVKATNSMIDRKPRLLFPTNSSSHLVALQGQPLVLECIAEGFPTPTIKWLRPSGPMPADRVTYQNHNKTLQLLKVGEEDDGEYRCLAENSLGSARHAYYVTVEAAPYWLHKPQSHLYGPGETARLDCQVQGRPQPEVTWRINGIPVEELAKDQKYRIQRGALILSNVQPSDTMVTQCEARNRHGLLLANAYIYVVQLPAKILTADNQTYMAVQGSTAYLLCKAFGAPVPSVQWLDEDGTTVLQDERFFPYANGTLGIRDLQANDTGRYFCLAANDQNNVTIMANLKVKDATQITQGPRSTIEKKGSRVTFTCQASFDPSLQPSITWRGDGRDLQELGDSDKYFIEDGRLVIHSLDYSDQGNYSCVASTELDVVESRAQLLVVGSPGPVPRLVLSDLHLLTQSQVRVSWSPAEDHNAPIEKYDIEFEDKEMAPEKWYSLGKVPGNQTSTTLKLSPYVHYTFRVTAINKYGPGEPSPVSETVVTPEAAPEKNPVDVKGEGNETTNMVITWKPLRWMDWNAPQVQYRVQWRPQGTRGPWQEQIVSDPFLVVSNTSTFVPYEIKVQAVNSQGKGPEPQVTIGYSGEDYPQAIPELEGIEILNSSAVLVKWRPVDLAQVKGHLRGYNVTYWREGSQRKHSKRHIHKDHVVVPANTTSVILSGLRPYSSYHLEVQAFNGRGSGPASEFTFSTPEGVPGHPEALHLECQSNTSLLLRWQPPLSHNGVLTGYVLSYHPLDEGGKGQLSFNLRDPELRTHNLTDLSPHLRYRFQLQATTKEGPGEAIVREGGTMALSGISDFGNISATAGENYSVVSWVPKEGQCNFRFHILFKALGEEKGGASLSPQYVSYNQSSYTQWDLQPDTDYEIHLFKERMFRHQMAVKTNGTGRVRLPPAGFATEGWFIGFVSAIILLLLVLLILCFIKRSKGGKYSVKDKEDTQVDSEARPMKDETFGEYSDTTRRLDMSGIL

SEQ ID NO: 908743 - protein, 419 aa, Homo sapiens
AAASASQTRSGGGSEAGVRGGWAGSPSGGRSAVPPLPTPAPSRPPAPFPSGRSLNRARLAVLRGAAGKDGRGAAVRVASPPLQPLPAYPDPRGYGNVMEPPVITEQSPRRLVVFPTDDISLKCEASGKPEVQFRWTRDGVHFKPKEELGVTVYQSPHSGSFTITGNNSNFAQRFQGIYRCFASNKLGTAMSHEIRLMAEGAPKWPKETVKPVEVEEGESVVLPCNPPPSAEPLRIYWMNSKILHIKQDERVTMGQNGNLYFANVLTSDNHSDYICHAHFPGTRTIIQKEPIDLRVKATNSMIDRKPRLLFPTNSSSHLVALQGQPLVLECIAEGFPTPTIKWLRPSGPMPADRVTYQNHNKTLQLLKVGEEDDGEYRCLAENSLGSARHAYYVTVEGMDLLGHRPHPPGPLSSPALPIV

SEQ ID NO: 908744 - protein, 585 aa, Homo sapiens
SGWDVGAGRQVVATTAKGAETVQAARLGQEDHVNGARGLPGWAGTMGCGCSSHPEDDWMENIDVCENCHYPIVPLDGKGTLLIRNGSEVRDPLVTYEGSNPPASPLQDNLVIALHSYEPSHDGDLGFEKGEQLRILEQSGEWWKAQSLTTGQEGFIPFNFVAKANSLEPEPWFFKNLSRKDAERQLLAPGNTHGSFLIRESESTAGSFSLSVRDFDQNQGEVVKHYKIRNLDNGGFYISPRITFPGLHELVRHYTNASDGLCTRLSRPCQTQKPQKPWWEDEWEVPRETLKLVERLGAGQFGEVWMGYYNGHTKVAVKSLKQGSMSPDAFLAEANLMKQLQHQRLVRLYAVVTQEPIYIITEYMENGSLVDFLKTPSGIKLTINKLLDMAAQVKETGEGGWAREQTSDVKTSGSGPLTVFGLQIAEGMAFIEERNYIHRDLRAANILVSDTLSCKIADFGLARLIEDNEYTAREGAKFPIKWTAPEAINYGTFTIKSDVWSFGILLTEIVTHGRIPYPGMTNPEVIQNLERGYRMVRPDNCPEELYQLMRLCWKERPEDRPTFDYLRSVLEDFFTATEGQYQPQP

SEQ ID NO: 908745 - protein, 546 aa, Homo sapiens
TCSLRAQREHRFGAGTPYFSFSVAGEWGSQDLTISGTMGCGCSSHPEDDWMENIDVCENCHYPIVPLDGKGTLLIRNGSEVRDPLVTYEGSNPPASPLQDNLVIALHSYEPSHDGDLGFEKGEQLRILEQSGEWWKAQSLTTGQEGFIPFNFVAKANSLEPEPWFFKNLSRKDAERQLLAPGNTHGSFLIRESESTAGSFSLSVRDFDQNQGEVVKHYKIRNLDNGGFYISPRITFPGLHELVRHYTNASDGLCTRLSRPCQTQKPQKPWWEDEWEVPRETLKLVERLGAGQFGEVWMGYYNGHTKVAVKSLKQGSMSPDAFLAEANLMKQLQHQRLVRLYAVVTQEPIYIITEYMENGSLVDFLKTPSGIKLTINKLLDMAAQIAEGMAFIEERNYIHRDLRAANILVSDTLSCKIADFGLARLIEDNEYTAREGAKFPIKWTAPEAINYGTFTIKSDVWSFGILLTEIVTHGRIPYPGMTNPEVIQNLERGYRMVRPDNCPEELYQLMRLCWKERPEDRPTFDYLRSVLEDFFTATEGQYQPQP

SEQ ID NO: 908746 - protein, 546 aa, Homo sapiens; identical to SEQ ID NO: 908745

SEQ ID NO: 908747 - protein, 503 aa, Homo sapiens
SGWDVGAGRQVVATTAKGAETVQAARLGQEDHVNGARGLPGWAGTMGCGCSSHPEDDWMENIDVCENCHYPIVPLDGKGTLLIRNGSEVRDPLVTYEGSNPPASPLQDNLVIALHSYEPSHDGDLGFEKGEQLRILEQSGEWWKAQSLTTGQEGFIPFNFVAKANSLEPEPWFFKNLSRKDAERQLLAPGNTHGSFLIRESESTAGSFSLSVRDFDQNQGEVVKHYKIRNLDNGGFYISPRITFPGLHELVRHYTRYYNGHTKVAVKSLKQGSMSPDAFLAEANLMKQLQHQRLVRLYAVVTQEPIYIITEYMENGSLVDFLKTPSGIKLTINKLLDMAAQIAEGMAFIEERNYIHRDLRAANILVSDTLSCKIADFGLARLIEDNEYTAREGAKFPIKWTAPEAINYGTFTIKSDVWSFGILLTEIVTHGRIPYPGMTNPEVIQNLERGYRMVRPDNCPEELYQLMRLCWKERPEDRPTFDYLRSVLEDFFTATEGQYQPQP

SEQ ID NO: 908748 - protein, 327 aa, Homo sapiens
TCSLRAQREHRFGAGTPYFSFSVAGEWGSQDLTISGTFGTFQGKAPLYLMLGEQIWEVPRETLKLVERLGAGQFGEVWMGYYNGHTKVAVKSLKQGSMSPDAFLAEANLMKQLQHQRLVRLYAVVTQEPIYIITEYMENGSLVDFLKTPSGIKLTINKLLDMAAQIAEGMAFIEERNYIHRDLRAANILVSDTLSCKIADFGLARLIEDNEYTAREGAKFPIKWTAPEAINYGTFTIKSDVWSFGILLTEIVTHGRIPYPGMTNPEVIQNLERGYRMVRPDNCPEELYQLMRLCWKERPEDRPTFDYLRSVLEDFFTATEGQYQPQP

SEQ ID NO: 908749 - protein, 468 aa, Homo sapiens
SGWDVGAGRQVVATTAKGAETVQAARLGQEDHVNGARGLPGWAGTMGCGCSSHPEDDWMENIDVCENCHYPIVPLDGKGTLLIRNGSEVRDPLVTYEGSNPPASPLQDNLVIALHSYEPSHDGDLGFEKGEQLRILEQSGEWWKAQSLTTGQEGFIPFNFVAKANSLEPEPWFFKNLSRKDAERQLLAPGNTHGSFLIRESESTAGSFSLSVRDFDQNQGEVVKHYKIRNLDNGGFYISPRITFPGLHELVRHYTNASDGLCTRLSRPCQTQKPQKPWWEDEWEVPRETLKLVERLGAGQFGEVWMGYYNGHTKVAVKSLKQGSMSPDAFLAEANLMKQLQHQRLVRLYAVVTQEPIYIITEYMENGSLVDFLKTPSGIKLTINKLLDMAAQIAEGMAFIEERNYIHRDLRAANILVSDTLSCKIADFGLARLIEDNEYTAREAAKFPIKWTAPEACANSLHSCSSPP

SEQ ID NO: 908750 - protein, 554 aa, Homo sapiens
SGWDVGAGRQVVATTAKGAETVQAARLGQEDHVNGARGLPGWAGTMGCGCSSHPEDDWMENIDVCENCHYPIVPLDGKGTLLIRNGSEVRDPLVTYEGSNPPASPLQDNLVIALHSYEPSHDGDLGFEKGEQLRILEQSGEWWKAQSLTTGQEGFIPFNFVAKANSLEPEPWFFKNLSRKDAERQLLAPGNTHGSFLIRESESTAGSFSLSVRDFDQNQGEVVKHYKIRNLDNGGFYISPRITFPGLHELVRHYTNASDGLCTRLSRPCQTQKPQKPWWEDEWEVPRETLKLVERLGAGQFGEVWMGYYNGHTKVAVKSLKQGSMSPDAFLAEANLMKQLQHQRLVRLYAVVTQEPIYIITEYMENGSLVDFLKTPSGIKLTINKLLDMAAQIAEGMAFIEERNYIHRDLRAANILVSDTLSCKIADFGLARLIEDNEYTAREGAKFPIKWTAPEAINYGTFTIKSDVWSFGILLTEIVTHGRIPYPGMTNPEVIQNLERGYRMVRPDNCPEELYQLMRLCWKERPEDRPTFDYLRSVLEDFFTATEGQYQPQP

SEQ ID NO: 908751 - protein, 576 aa, Homo sapiens
TCSLRAQREHRFGAGTPYFSFSVAGEWGSQDLTISGTMGCGCSSHPEDDWMENIDVCENCHYPIVPLDGKGTLLIRNGSEVRDPLVTYEGSNPPASPLQDNLVIALHSYEPSHDGDLGFEKGEQLRILEQSGEWWKAQSLTTGQEGFIPFNFVAKANSLEPEPWFFKNLSRKDAERQLLAPGNTHGSFLIRESESTAGSFSLSVRDFDQNQGEVVKHYKIRNLDNGGFYISPRITFPGLHELVRHYTNASDGLCTRLSRPCQTQKPQKPWWEDEWEVPRETLKLVERLGAGQFGEVWMGYYNGHTKVAVKSLKQGSMSPDAFLAEANLMKQLQHQRLVRLYAVVTQEPIYIITEYMENDTLLDSQLEEKGLGASPWGNLGQQLLLLPTGSLVDFLKTPSGIKLTINKLLDMAAQIAEGMAFIEERNYIHRDLRAANILVSDTLSCKIADFGLARLIEDNEYTAREGAKFPIKWTAPEAINYGTFTIKSDVWSFGILLTEIVTHGRIPYPGMTNPEVIQNLERGYRMVRPDNCPEELYQLMRLCWKERPEDRPTFDYLRSVLEDFFTATEGQYQPQP

SEQ ID NO: 908752 - protein, 612 aa, Homo sapiens
SGWDVGAGRQVVATTAKGAETVQAARLGQEDHVNGARGLPGWAGTMGCGCSSHPEDDWMENIDVCENCHYPIVPLDGKGTLLIRNGSEVRDPLVTYEGSNPPASPLQGDPRQQGLKDKACGSLAVGFHLSPTYFLPGLAFLVPHPVTPGFLPIPARFSLMPLVFTDNLVIALHSYEPSHDGDLGFEKGEQLRILEQSGEWWKAQSLTTGQEGFIPFNFVAKANSLEPEPWFFKNLSRKDAERQLLAPGNTHGSFLIRESESTAGSFSLSVRDFDQNQGEVVKHYKIRNLDNGGFYISPRITFPGLHELVRHYTNASDGLCTRLSRPCQTQKPQKPWWEDEWEVPRETLKLVERLGAGQFGEVWMGYYNGHTKVAVKSLKQGSMSPDAFLAEANLMKQLQHQRLVRLYAVVTQEPIYIITEYMENGSLVDFLKTPSGIKLTINKLLDMAAQIAEGMAFIEERNYIHRDLRAANILVSDTLSCKIADFGLARLIEDNEYTAREGAKFPIKWTAPEAINYGTFTIKSDVWSFGILLTEIVTHGRIPYPGMTNPEVIQNLERGYRMVRPDNCPEELYQLMRLCWKERPEDRPTFDYLRSVLEDFFTATEGQYQPQP

SEQ ID NO: 908753 - protein, 220 aa, Homo sapiens
MSDTLLDSQLEEKGLGASPWGNLGQQLLLLPTGSLVDFLKTPSGIKLTINKLLDMAAQIAEGMAFIEERNYIHRDLRAANILVSDTLSCKIADFGLARLIEDNEYTAREGAKFPIKWTAPEAINYGTFTIKSDVWSFGILLTEIVTHGRIPYPGMTNPEVIQNLERGYRMVRPDNCPEELYQLMRLCWKERPEDRPTFDYLRSVLEDFFTATEGQYQPQP

SEQ ID NO: 908754 - protein, 482 aa, Homo sapiens
SGWDVGAGRQVVATTAKGAETVQAARLGQEDHVNGARGLPGWAGTMGCGCSSHPEDDWMENIDVCENCHYPIVPLDGKGTLLIRNGSEVRDPLVTYEGSNPPASPLQDNLVIALHSYEPSHDGDLGFEKGEQLRILEQSGEWWKAQSLTTGQEGFIPFNFVAKANSLEPEPWFFKNLSRKDAERQLLAPGNTHGSFLIRESESTAGSFSLSVRDFDQNQGEVVKHYKIRNLDNGGFYISPRITFPGLHELVRHYTNASDGLCTRLSRPCQTQKPQKPWWEDEWEVPRETLKLVERLGAGQFGEVWMGYYNGHTKVAVKSLKQGSMSPDAFLAEANLMKQLQHQRLVRLYAVVTQEPIYIITEYMENGSLVDFLKTPSGIKLTINKLLDMAAQIAEGMAFIEERNYIHRDLRAANILVSDTLSCKIADFGLARLIEDIHHQVRCVVFWDPADGNCHPRPHPLPRDDQPGGDSEPGARLPHGAP

SEQ ID NO: 908755 - protein, 224 aa, Homo sapiens
MEKLLCFLVLTSLSHAFGQTDMSRKAFVFPKESDTSYVSLKAPLTKPLKAFTVCLHFYTELSSTRGYSIFSYATKRQDNEILIFWSKDIGYSFTVGGSEILFEVPEVTVAPVHICTSWESASGIVEFWVDGKPRVRKSLKKGYTVGAEASIILGQEQDSFGGNFEGSQSLVGDIGNVNMWDFVLSPDEINTIYLGGPFSPNVLNWRALKYEVQGEVFTKPQLWP

SEQ ID NO: 908756 - protein, 224 aa, Homo sapiens; identical to SEQ ID NO: 908755

SEQ ID NO: 908757 - protein, 224 aa, Homo sapiens; identical to SEQ ID NO: 908755

SEQ ID NO: 908758 - protein, 279 aa, Homo sapiens
MEKLLCFLVLTSLSHAFGQTDMSRKAFVFPKESDTSYVSLKAPLTKPLKAFTVCLHFYTELSSTRGYSIFSYATKRQDNEILIFWSKDIGYSFTVGGSEILFEVPEVTVAPVHICTSWESASGIVEFWVDGKPRVRKSLKKGYTVGAEASIILGQEQDSFGGNFEGSQSLVGDIGNVNMWDFVLSPDEINTIYLGGPFSPNVLNWRALKYEVQGEPEGTSRFFTPHGPHVSVSGTSRFFTLHGSHVSVSGPLFPYMHCRPAPPSSAPENGGKVSGLGAR

SEQ ID NO: 908759 - protein, 224 aa, Homo sapiens; identical to SEQ ID NO: 908755

SEQ ID NO: 908760 - protein, 224 aa, Homo sapiens; identical to SEQ ID NO: 908755

SEQ ID NO: 908761 - protein, 109 aa, Homo sapiens
MEKLLCFLVLTSLSHAFGQTDMSRKAFVFPKESDTSYVSLKAPLTKPLKAFTVCLHFYTELSSTRGYSIFSYATKRQDNEILIFWSKDIGYSFTVGGSEILFEVPEVTA

SEQ ID NO: 908762 - protein, 125 aa, Homo sapiens
MEKLLCFLVLTSLSHAFGQTDMSRKAFVFPKESDTSYVSLKAPLTKPLKAFTVCLHFYTELSSTRGYSIFSYATKRQDNEILIFWSKDIGYSFTVGGSEILFEVPEVTASSAPENGGKVSGLGAR

SEQ ID NO: 908763 - protein, 224 aa, Homo sapiens; identical to SEQ ID NO: 908755

SEQ ID NO: 908764 - protein, 229 aa, Homo sapiens
MEKLLCFLVLTSLSHAFGQTDMSRKAFVFPKESDTSYVSLKAPLTKPLKAFTVCLHFYTELSSTRGYSIFSYATKRQDNEILIFWSKDIGYSFTVGGSEILFEVPEVTVAPVHICTSWESASGIVEFWVDGKPRVRKSLKKGYTVGAEASLRIRTLARCLVWVQSAHHHVIELLGPGLLKWEAQQYHAVPPLSQSTLERPLELPQQSRSAFFPEQNEALGINMLLLPRT

SEQ ID NO: 908765 - protein, 173 aa, Homo sapiens
MEKLLCFLVLTSLSHAFGQTDMSRKAFVFPKESDTSYVSLKAPLTKPLKAFTVCLHFYTELSSTRGYSIFSYATKRQDNEILIFWSKDIGYSFTVGGSEILFEVPEVTVAPVHICTSWEPGLLKWEAQQYHAVPPLSQSTLERPLELPQQSRSAFFPEQNEALGINMLLLPRT

SEQ ID NO: 908766 - protein, 148 aa, Homo sapiens
MEKLLCFLVLTSLSHAFGQTDMSRKAFVFPKESDTSYVSLKAPLTKPLKAFTVCLHFYTELSSTRGYSIFSYATKRQDNEILIFWSKDIGYSFTVGGSEILFEVPEVTVAPVHICTSWELPFSTRTLWGCEFFLHPRIPNIPRPQEWT

SEQ ID NO: 908767 - protein, 127 aa, Homo sapiens
MEKLLCFLVLTSLSHAFGQTDMSRKAFVFPKESDTSYVSLKAPLTKPLKAFTVCLHFYTELSSTRCFLNFMALLGNSSPFPHEPCGAVNSFFIPAFPIYPGHKSGREPQGVLSEEPISHLPSSLSGG

SEQ ID NO: 908768 - protein, 137 aa, Homo sapiens
MEKLLCFLVLTSLSHAFGQTDMSRKAFVFPKESDTSYVSLKAPLTKPLKAFTVCLHFYTELSSTRGYSIFSYATKRQDNEILIFWSKDIGYSFTVGGSEILFEVPEVTVAPVHICTSWESASGIVEFWVDGKPRVRN

SEQ ID NO: 908769 - protein, 224 aa, Homo sapiens; identical to SEQ ID NO: 908755

SEQ ID NO: 908770 - protein, 179 aa, Homo sapiens
MEKLLCFLVLTSLSHAFGQTDMSRKAFVFPKESDTSYVSLKAPLTKPLKAFTVCLHFYTELSSTRGYSIFSYATKRQDNEILIFWSKDIGYSFTVGGSEILFEVPEVTVAPVHICTSWESASGIVEFWVDGKPRVRKSLKKGYTVGAEASIILGQEQDSFGGNFEGSQSLVGDIGNVNI

SEQ ID NO: 908771 - protein, 207 aa, Homo sapiens
MEKLLCFLVLTSLSHAFGQTDMSRKAFVFPKESDTSYVSLKAPLTKPLKAFTVCLHFYTELSSTRGYSIFSYATKRQDNEILIFWSKDIGYSFTVGGSEILFEVPEVTVAPVHICTSWESASGIVEFWVDGKPRVRKSLKKGYTVGAEASQSLVGDIGNVNMWDFVLSPDEINTIYLGGPFSPNVLNWRALKYEVQGEVFTKPQLWP

SEQ ID NO: 908772 - protein, 243 aa, Homo sapiens
MEKLLCFLVLTSLSHAFGQTDMSRKAFVFPKESDTSYVSLKAPLTKPLKAFTVCLHFYTELSSTRGYSIFSYATKRQDNEILIFWSKDIGYSFTVGGSEILFEVPEVTVAPVHICTSWESASGIVEFWVDGKPRVRKSLKKGYTVGAEASIILGQEQDSFGGNFEGSLKVPPGFLHRMGPTSLSLVPPAFLHCMVPTSLSLGLCSPICIAGLLHPPQRLRMEVKCLVWELVNYAGKRSKRIRI

SEQ ID NO: 908773 - protein, 168 aa, Homo sapiens
MEKLLCFLVLTSLSHAFGQTDMSRKAFVFPKESDTSYVSLKAPLTKPLKAFTVCLHFYTELSSTRGYSIFSYATKRQDNEILIFWSKDIGYSFTVGGSEILFEVPEVTVAPVHICTSWESASGIVEFWVDGKPRVRKSSLTMLGNGPKESEFEVFCFHFYFKLDRSWR

SEQ ID NO: 908774 - protein, 224 aa, Homo sapiens; identical to SEQ ID NO: 908755

SEQ ID NO: 908775 - protein, 224 aa, Homo sapiens; identical to SEQ ID NO: 908755

SEQ ID NO: 908776 - protein, 148 aa, Homo sapiens
MEKLLCFLVLTSLSHAFGQTDMSRKAFVFPKESDTSYVSLKAPLTKPLKAFTVCLHFYTELSSTRGYSIFSYATKRQDNEILIFWSKDIGYSFTVGGSEILFEVPEVTVAPVHICTSWESASGIVEFWVDGKPRVRNNTTQSLHFRAK

SEQ ID NO: 908777 - protein, 160 aa, Homo sapiens
MEKLLCFLVLTSLSHAFGQTDMSRKAFVFPKESDTSYVSLKAPLTKPLKAFTVCLHFYTELSSTRGYSIFSYATKRQDNEILIFWSKDIGYSFTVGGSEILFEVPEVTVAPVHICTSWESASGIVEFWVDGKPRVRNCQRSPSPISPAPYLEDSWIVTCS

SEQ ID NO: 908778 - protein, 343 aa, Homo sapiens
AGLPRTLRESGQPSRWTEMDSELKEEIPVHEEFILCGGAETQVLKCGPWTDLFHDQSVKRPKLLIFIIPGNPGFSAFYVPFAKALYSLTNRRFPVWTISHAGHALAPKDKKILTTSEDSNAQEIKDIYGLNGQIEHKLAFLRTHVPKDMKLVLIGHSIGSYFTLQMLKRVPELPVIRAFLLFPTIERMSESPNGRIATPLLCWFRYVLYVTGYLLLKPCPETIKSLLIRRGLQVMNLENEFSPLNILEPFCLANAAYLGGQEMMEVVKRDDETIKEHLCKLTFYYGTIDPWCPKEYYEDIKKDFPEGDIRLCEKNIPHAFITHFNQEMADMIADSLKDDLSKM

SEQ ID NO: 908779 - protein, 291 aa, Homo sapiens
AGLPRTLRESGQPSRWTGNPGFSAFYVPFAKALYSLTNRRFPVWTISHAGHALAPKDKKILTTSEDSNAQEIKDIYGLNGQIEHKLAFLRTHVPKDMKLVLIGHSIGSYFTLQMLKRVPELPVIRAFLLFPTIERMSESPNGRIATPLLCWFRYVLYVTGYLLLKPCPETIKSLLIRRGLQVMNLENEFSPLNILEPFCLANAAYLGGQEMMEVVKRDDETIKEHLCKLTFYYGTIDPWCPKEYYEDIKKDFPEGDIRLCEKNIPHAFITHFNQEMADMIADSLKDDLSKM

SEQ ID NO: 908780 - protein, 343 aa, Homo sapiens; identical to SEQ ID NO: 908778

SEQ ID NO: 908781 - protein, 343 aa, Homo sapiens; identical to SEQ ID NO: 908778

SEQ ID NO: 908782 - protein, 343 aa, Homo sapiens; identical to SEQ ID NO: 908778

SEQ ID NO: 908783 - protein, 343 aa, Homo sapiens; identical to SEQ ID NO: 908778

SEQ ID NO: 908784 - protein, 348 aa, Homo sapiens
SIGCWLVHCHRVPFDAYSSLLLCEEDVSIAQILVIALSDFRVVCPIKQSTIHVLPCWRCPQSVKRPKLLIFIIPGNPGFSAFYVPFAKALYSLTNRRFPVWTISHAGHALAPKDKKILTTSEDSNAQEIKDIYGLNGQIEHKLAFLRTHVPKDMKLVLIGHSIGSYFTLQMLKRVPELPVIRAFLLFPTIERMSESPNGRIATPLLCWFRYVLYVTGYLLLKPCPETIKSLLIRRGLQVMNLENEFSPLNILEPFCLANAAYLGGQEMMEVVKRDDETIKEHLCKLTFYYGTIDPWCPKEYYEDIKKDFPEGDIRLCEKNIPHAFITHFNQEMADMIADSLKDDLSKM

SEQ ID NO: 908785 - protein, 184 aa, Homo sapiens
AGLPRTLRESGQPSRWTEMDSELKEEIPVHEEFILCGGAETQVLKCGPWTDLFHDQSVKRPKLLIFIIPGNPGFSAFYVPFAKALYSLTNRRFPVWTISHAGHALAPKDKKILTTSEDSNAQEIKDIYGLNGQIEHKLAFLRTHVPKDMKLVLIGHSIGSYFTLQMLKRVPELPLMLPTLGAKK

SEQ ID NO: 908786 - protein, 196 aa, Homo sapiens
MAPPWVPAMGFTLAPSLGCFVGSRFVHGEGLRWYAGLQKPSWHPPHWVLGPVWGTLYSAMGYGSYLVWKELGGFTEKAVVPLGLYTGQLALNWAWPPIFFGARQMGWALVDLLLVSGAAAATYRGLVPGEPAGRPPALPLPGLAGLRDHTQLLRMAGQPWLAWGTAAARVSARPTRDCSCTSRCHHACDVVAVTLS

SEQ ID NO: 908787 - protein, 196 aa, Homo sapiens; identical to SEQ ID NO: 908786

SEQ ID NO: 908788 - protein, 98 aa, Homo sapiens
AAGRGGADAGTAAWLTPARQCPSRSVPSPLVRLLPGLERAGRLHREGCGSPGPLHWAAGPELGMAPHLLWCPTNGLGLGGSPAGQWGGGSHLPWPGTR

SEQ ID NO: 908789 - protein, 196 aa, Homo sapiens; identical to SEQ ID NO: 908786

SEQ ID NO: 908790 - protein, 199 aa, Homo sapiens
MAPPWVPAMGFTLAPSLGCFVGSRFVHGEGLRWYAGLQKPSWHPPHWVLGPVWGTLYSAMGYGSYLVWKELGGFTEKAVVPLGLYTGQLALNWAWPPIFFGARQMGWALVDLLLVSGAAAATYRGLVPGEPAGRPPALPLPGLAGLRDHTQLLRMAGQPWLAWGTAAARVDARGKRNGFPVALARAVSNEIVRFPTERA

SEQ ID NO: 908791 - protein, 196 aa, Homo sapiens; identical to SEQ ID NO: 908786

SEQ ID NO: 908792 - protein, 196 aa, Homo sapiens; identical to SEQ ID NO: 908786

SEQ ID NO: 908793 - protein, 196 aa, Homo sapiens; identical to SEQ ID NO: 908786

SEQ ID NO: 908794 - protein, 196 aa, Homo sapiens; identical to SEQ ID NO: 908786

SEQ ID NO: 908795 - protein, 360 aa, Homo sapiens
MIPLLLAALLCVPAGALTCYGDSGQPVDWFVVYKLPALRGSGEAAQRGLQYKYLDESSGGWRDGRALINSPEGAVGRSLQPLYRSNTSQLAFLLYNDQPPQPSKAQDSSMRGHTKGVLLLDHDGGFWLVHSVPNFPPPASSAAYSWPHSACTYGQTLLCVSFPFAQFSKMGKQLTYTYPWVYNYQLEGIFAQEFPDLENVVKGHHVSQEPWNSSITLTSQAGAVFQSFAKFSKFGDDLYSGWLAAALGTNLQVQFWHKTVGILPSNCSDIWQVLNVNQIAFPGPAGPSFNSTEDHSKWCVSPKGPWTCVGDMNRNQGEEQRGGGTLCAQLPALWKAFQPLVKNYQPCNGMARKPSRAYKI

SEQ ID NO: 908796 - protein, 360 aa, Homo sapiens; identical to SEQ ID NO: 908795

SEQ ID NO: 908797 - protein, 332 aa, Homo sapiens
MFVVYKLPALRGSGEAAQRGLQYKYLDESSGGWRDGRALINSPEGAVGRSLQPLYRSNTSQLAFLLYNDQPPQPSKAQDSSMRGHTKGVLLLDHDGGFWLVHSVPNFPPPASSAAYSWPHSACTYGQTLLCVSFPFAQFSKMGKQLTYTYPWVYNYQLEGIFAQEFPDLENVVKGHHVSQEPWNSSITLTSQAGAVFQSFAKFSKFGDDLYSGWLAAALGTNLQVQFWHKTVGILPSNCSDIWQVLNVNQIAFPGPAGPSFNSTEDHSKWCVSPKGPWTCVGDMNRNQGEEQRGGGTLCAQLPALWKAFQPLVKNYQPCNGMARKPSRAYKI

SEQ ID NO: 908798 - protein, 282 aa, Homo sapiens
MIPLLLAALLCVPAGALTCYGDSGQPVDWFVVYKLPALRGSGEAAQRGLQYKYLDESSGGWRDGRALINSPEGAVGRSLQPLYRSNTSQLAFLLYNDQPPQPSKAQDSSMRGHTKGVLLLDHDGGFWLVHSVPNFPPPASSAAYSWPHSACTYGQTLLCVSFPFAQFSKMGKQLTYTYPWVYNYQLEGIFAQEFPDLENVVKGHHVSQEPWNSSITLTSQAGAVFQSFAKFSKFGDDLYSGWLAAALGTNLQVQFWHKTVGILAPREAEAGESLELGRQRLS

SEQ ID NO: 908799 - protein, 360 aa, Homo sapiens; identical to SEQ ID NO: 908795

SEQ ID NO: 908800 - protein, 390 aa, Homo sapiens
MIPLLLAALLCVPAGALTCYGDSGQPVDWFVVYKLPALRGSGEAAQRGLQYKYLDESSGGWRDGRALINSPEGAVGRSLQPLYRSNTSQVKGAPGQLGAKSRAALPGRNFTLPPFIRPQLAFLLYNDQPPQPSKAQDSSMRGHTKGVLLLDHDGGFWLVHSVPNFPPPASSAAYSWPHSACTYGQTLLCVSFPFAQFSKMGKQLTYTYPWVYNYQLEGIFAQEFPDLENVVKGHHVSQEPWNSSITLTSQAGAVFQSFAKFSKFGDDLYSGWLAAALGTNLQVQFWHKTVGILPSNCSDIWQVLNVNQIAFPGPAGPSFNSTEDHSKWCVSPKGPWTCVGDMNRNQGEEQRGGGTLCAQLPALWKAFQPLVKNYQPCNGMARKPSRAYKI

SEQ ID NO: 908801 - protein, 366 aa, Homo sapiens
YCAGYLAGLNVNQIALPGTSGPSFNSTEDHSKWCVSPQGTWTCVGDMNRNQEEEQRGGGTLCAQLPALWKAFQPLVKNYQPCNGMAREPSRAYRIYPLWQSAGITGVSHCARPPLMPSFGPGVLLLDHDGGFWLVHSVPNFPPPASSAAYSWPHSACTYGQTLLCVSFPFAQFSKMGKQLTYTYPWVYNYQLEGIFAQEFPDLENVVKGHHVSQEPWNSSITLTSQAGAVFQSFAKFSKFGDDLYSGWLAAALGTNLQVQFWHKTVGILPSNCSDIWQVLNVNQIAFPGPAGPSFNSTEDHSKWCVSPKGPWTCVGDMNRNQGEEQRGGGTLCAQLPALWKAFQPLVKNYQPCNGMARKPSRAYKI

SEQ ID NO: 908802 - protein, 238 aa, Homo sapiens
MPPRKKRRQPSQKAPLLFHQQPLEGPKHSCASTQLPITHTRQVPSKPIDHSTITSWVSPDFDTAAGSLFPAYQKHQNRARHSSRKPTTSKFPHLTFESPQSSSSETLGIPLIRECPSESEKDVSRRPLVPVLSPQSCGNMSVQALQSLPYVFIPPDIQTPESSSVKEELIPQDQKENSLLSCTLHTGTPNSPEPGPVLVKDTPEDKYGIKVTWRRRQHLLAYLRERGKLSRSQFLVKS

SEQ ID NO: 908803 - protein, 220 aa, Homo sapiens
GLWAQGSLINLIPPPPPPIPGSKAVRSARSCGPVRPGLVSPDFDTAAGSLFPAYQKHQNRARHSSRKPTTSKFPHLTFESPQSSSSETLGIPLIRECPSESEKDVSRRPLVPVLSPQSCGNMSVQALQSLPYVFIPPDIQTPESSSVKEELIPQDQKENSLLSCTLHTGTPNSPEPGPVLVKDTPEDKYGIKVTWRRRQHLLAYLRERGKLSRSQFLVKS

SEQ ID NO: 908804 - protein, 146 aa, Homo sapiens
GLWAQGSLINLIPPPPPPDSGLEGCAVCQELRPRPARAGMGWNWSLSPNPKANSIMWLLTVPHSPVDASQKKTPPAFPESPAAVPPTTTGGPQTQLCIYTASHHSHSTGYHLILIQQQEACSQPTRNTKTGRDTQVENLPPPSFHI

SEQ ID NO: 908805 - protein, 128 aa, Homo sapiens
GLWAQGSLINLIPPPPPPDSGLEGCAVCQELRPRPARAGMGWNWSLSPNPKANSIMWLLTVPHSPVDASQKKTPPAFPESPAAVPPTTTGGPQTQLCIYTASHHSHSTGTQINHNYINLSKSYLPQHS

SEQ ID NO: 908806 - protein, 238 aa, Homo sapiens; identical to SEQ ID NO: 908802

SEQ ID NO: 908807 - protein, 238 aa, Homo sapiens; identical to SEQ ID NO: 908802

SEQ ID NO: 908808 - protein, 238 aa, Homo sapiens; identical to SEQ ID NO: 908802

SEQ ID NO: 908809 - protein, 174 aa, Homo sapiens
MRWKTTAGEIPRRCMTEEQQRTSGVEWSRCMCMNSRRNEAEKIDKGEKIPKVTRRERERGEEYRSTRLSEKMKISGYKVRGTDSVKWHLAVAENDDTVGKRRAHDEMKRSPEKTPECELEEAPEIRKRENEGDAGPREWLNGAKKMANGRVLGRGDNAVARDTRPDSVGPSANN

SEQ ID NO: 908810 - protein, 78 aa, Homo sapiens
DVAPGQRPAAQNGGGDDLLPAAEPVWRGGAEPAPGRQVFRGAGLADRGEGHAHWPGISLKMPLITPSTVHLFDFSSMA

SEQ ID NO: 908811 - protein, 136 aa, Homo sapiens
GTLRRVKGQRRKMAAAMTFCRLLNRCGEAARSLPLGARCFGVRVSPTGEKVTHTGQVYDDKDYRRIRFVGRQKEVNENFAIDLIAEQPVSEVETRVIACDGGGGALGHPKVYINLDKETKTGTCGYCGLQFRQHHH

SEQ ID NO: 908812 - protein, 136 aa, Homo sapiens; identical to SEQ ID NO: 908811

SEQ ID NO: 908813 - protein, 136 aa, Homo sapiens; identical to SEQ ID NO: 908811

SEQ ID NO: 908814 - protein, 136 aa, Homo sapiens; identical to SEQ ID NO: 908811

SEQ ID NO: 908815 - protein, 136 aa, Homo sapiens; identical to SEQ ID NO: 908811

SEQ ID NO: 908816 - protein, 136 aa, Homo sapiens; identical to SEQ ID NO: 908811

SEQ ID NO: 908817 - protein, 137 aa, Homo sapiens
GTLRRVKGQRRKMAAAMTFCRLLNRCGEAARSLPLGARCFGVRVSPTGEKVTHTGQVYDDKDYRRIRFVGRQKEVNENFAIDLIAEKPKKAPAKKGEKVPKGKKGKADAGKEGNNPAENGDAKTDQAQKAEGAGDAK

SEQ ID NO: 908818 - protein, 1435 aa, Homo sapiens
MAQCVQSVQELIPDSFVPCVAALCSDEAERLTRLNHLSFAELLKPFSRLTSEVHMRDPNNQLHVIKNLKIAVSNIVTQPPQPGAIRKLLNDVVSGSQPAEGLVANVITAGDYDLNISATTPWFESYRETFLQSMPASDHEFLNHYLACMLVASSSEAEPVEQFSKLSQEQHRIQHNSDYSYPKWFIPNTLKYYVLLHDVSAGDEQRAESIYEEMKQKYGTQGCYLLKINSRTSNRASDEQIPDPWSQYLQKNSIQNQESYEDGPCTITSNKNSDNNLLSLDGLDNEVKDGLPNNFRAHPLQLEQSSDPSNSIDGPDHLRSASSLHETKKGNTGIIHGACLTLTDHDRIRQFIQEFTFRGLLPHIEKTIRQLNDQLISRKGLSRSLFSATKKWFSGSKVPEKSINDLKNTSGLLYPPEAPELQIRKMADLCFLVQHYDLAYSCYHTAKKDFLNDQAMLYAAGALEMAAVSAFLQPGAPRPYPAHYMDTAIQTYRDICKNMVLAERCVLLSAELLKSQSKYSEAAALLIRLTSEDSDLRSALLLEQAAHCFINMKSPMVRKYAFHMILAGHRFSKAGQKKHALRCYCQAMQVYKGKGWSLAEDHINFTIGRQSYTLRQLDNAVSAFRHILINESKQSAAQQGAFLREYLYVYKNVSQLSPDGPLPQLPLPYINSSATRVFFGHDRRPADGEKQAATHVSLDQEYDSESSQQWRELEEQVVSVVNKGVIPSNFHPTQYCLNSYSDNSRFPLAVVEEPITVEVAFRNPLKVLLLLTDLSLLWKFHPKDFSGKDNEEVKQLVTSEPEMIGAEVISEFLINGEESKVARLKLFPHHIGELHILGVVYNLGTIQGSMTVDGIGALPGCHTGKYSLSMSVRGKQDLEIQGPRLNNTKEEKTSVKYGPDRRLDPIITEEMPLLEVFFIHFPTGLLCGEIRKAYVEFVNVSKCPLTGLKVVSKRPEFFTFGGNTAVLTPLSPSASENCSAYKTVVTDATSVCTALISSASSVDFGIGTGSQPEVIPVPLPDTVLLPGASVQLPMWLRGPDEEGVHEINFLFYYESVKKQPKIRHRILRHTAIICTSRSLNVRATVCRSNSLENEEGRGGNMLVFVDVENTNTSEAGVKEFHIVQVSSSSKHWKLQKSVNLSENKDTKLASREKGKFCFKAIRCEKEEAATQSSEKYTFADIIFGNEQIISSASPCADFFYRSLSSELKKPQAHLPVHTEKQSTEDAVRLIQKCSEVDLNIVILWKAYVVEDSKQLILEGQHHVILRTIGKEAFSYPQKQEPPEMELLKFFRPENITVSSRPSVEQLSSLIKTSLHYPESFNHPFHQKSLCLVPVTLLLSNCSKADVDVIVDLRHKTTSPEALEIHGSFTWLGQTQYKLQLKSQEIHSLQLKACFVHTGVYNLGTPRVFAKLSDQVTVFETSQQNSMPALIIISNV

SEQ ID NO: 908819 - protein, 1435 aa, Homo sapiens; identical to SEQ ID NO: 908818

SEQ ID NO: 908820 - protein, 1435 aa, Homo sapiens; identical to SEQ ID NO: 908818

SEQ ID NO: 908821 - protein, 799 aa, Homo sapiens
MAQCVQSVQELIPDSFVPCVAALCSDEAERLTRLNHLSFAELLKPFSRLTSEVHMRDPNNQLHVIKNLKIAVSNIVTQPPQPGAIRKLLNDVVSGSQPAEGLVANVITAGDYDLNISATTPWFESYRETFLQSMPASDHEFLNHYLACMLVASSSEAEPVEQFSKLSQEQHRIQHNSDYSYPKWFIPNTLKYYVLLHDVSAGDEQRAESIYEEMKQKYGTQGCYLLKINSRTSNRASDEQIPDPWSQYLQKNSIQNQESYEDGPCTITSNKNSDNNLLSLDGLDNEVKDGLPNNFRAHPLQLEQSSDPSNSIDGPDHLRSASSLHETKKGNTGIIHGACLTLTDHDRIRQFIQEFTFRGLLPHIEKTIRQLNDQLISRKGLSRSLFSATKKWFSGSKVPEKSINDLKNTSGLLYPPEAPELQIRKMADLCFLVQHYDLAYSCYHTAKKDFLNDQAMLYAAGALEMAAVSAFLQPGAPRPYPAHYMDTAIQTYRDICKNMVLAERCVLLSAELLKSQSKYSEAAALLIRLTSEDSDLRSALLLEQAAHCFINMKSPMVRKYAFHMILAGHRFSKAGQKKHALRCYCQAMQVYKGKGWSLAEDHINFTIGRQSYTLRQLDNAVSAFRHILINESKQSAAQQGAFLREYLYVYKNVSQLSPDGPLPQLPLPYINSSATRVFFGHDRRPADGEKQAATHVSLDQEYDSESSQQWRELEEQVVSVVNKGVIPSNFHPTQYCLNSYSDNSRFPLAVVEEPITVEVAFRNPLKVLLLLTDLSLLWKFHPKDFSGKDNEEVKQLVSY

SEQ ID NO: 908822 - protein, 1348 aa, Homo sapiens
MAQCVQSVQELIPDSFVPCVAALCSDEAERLTRLNHLSFAELLKPFSRLTSEVHMRDPNNQLHVIKNLKIAVSNIVTQPPQPGAIRKLLNDVVSGSQPAEGLVANVITAGDYDLNISATTPWFESYRETFLQSMPASDHEFLNHYLACMLVASSSEAEPVEQFSKLSQEQHRIQHNSDYSYPKWFIPNTLKYYVLLHDVSAGDEQRAESIYEEMKQKYGTQGCYLLKINSRTSNRASDEQIPDPWSQYLQKNSIQNQESYEDGPCTITSNKNSDNNLLSLDGLDNEVKDGLPNNFRAHPLQLEQSSDPSNSIDGPDHLRSASSLHETKKGNTGIIHGACLTLTDHDRIRQFIQEFTFRGLLPHIEKTIRQLNDQLISRKGLSRSLFSATKKWFSGSKVPEKSINDLKNTSGLLYPPEAPELQIRKMADLCFLVQHYDLAYSCYHTAKKDFLNDQAMLYAAGALEMAAVSAFLQPGAPRPYPAHYMDTAIQTYRDICKNMVLAERCVLLSAELLKSQSKYSEAAALLIRLTSEDSDLRSALLLEQAAHCFINMKSPMVRKYAFHMILAGHRFSKAGQKKHALRCYCQAMQVYKGKGWSLAEDHINFTIGRQSYTLRQLDNAVSAFRHILINESKQSAAQQGAFLREYLYVYKNVSQLSPDGPLPQLPLPYINSSATRVFFGHDRRPADGEKQAATHVSLDQEYDSESSQQWRELEEQVVSVVNKGVIPSNFHPTQYCLNSYSDNSRFPLAVVEEPITVEVAFRNPLKVLLLLTDLSLLWKFHPKDFSGKDNEEVKQLVTSEPEMIGAEVISEFLINGEESKVARLKLFPHHIGELHILGVVYNLGTIQGSMTVDGIGALPGCHTGKYSLSMSVRGKQDLEIQGPRLNNTKEEKTSVKYGPDRRLDPIITEEMPLLETLALAQEVNQQVIPVPLPDTVLLPGASVQLPMWLRGPDEEGVHEINFLFYYESVKKQPKIRHRILRHTAIICTSRSLNVRATVCRSNSLENEEGRGGNMLVFVDVENTNTSEAGVKEFHIVQVSSSSKHWKLQKSVNLSENKDTKLASREKGKFCFKAIRCEKEEAATQSSEKYTFADIIFGNEQIISSASPCADFFYRSLSSELKKPQAHLPVHTEKQSTEDAVRLIQKCSEVDLNIVILWKAYVVEDSKQLILEGQHHVILRTIGKEAFSYPQKQEPPEMELLKFFRPENITVSSRPSVEQLSSLIKTSLHYPESFNHPFHQKSLCLVPVTLLLSNCSKADVDVIVDLRHKTTSPEALEIHGSFTWLGQTQYKLQLKSQEIHSLQLKACFVHTGVYNLGTPRVFAKLSDQVTVFETSQQNSMPALIIISNV

SEQ ID NO: 908823 - protein, 1435 aa, Homo sapiens; identical to SEQ ID NO: 908818

SEQ ID NO: 908824 - protein, 1435 aa, Homo sapiens; identical to SEQ ID NO: 908818

SEQ ID NO: 908825 - protein, 688 aa, Homo sapiens
MAQCVQSVQELIPDSFVPCVAALCSDEAERLTRLNHLSFAELLKPFSRLTSEVHMRDPNNQLHVIKNLKIAVSNIVTQPPQPGAIRKLLNDVVSGSQPAEGLVANVITAGDYDLNISATTPWFESYRETFLQSMPASDHEFLNHYLACMLVASSSEAEPVEQFSKLSQEQHRIQHNSDYSYPKWFIPNTLKYYVLLHDVSAGDEQRAESIYEEMKQKYGTQGCYLLKINSRTSNRASDEQIPDPWSQYLQKNSIQNQESYEDGPCTITSNKNSDNNLLSLDGLDNEVKDGLPNNFRAHPLQLEQSSDPSNSIDGPDHLRSASSLHETKKGNTGIIHGACLTLTDHDRIRQFIQEFTFRGLLPHIEKTIRQLNDQLISRKGLSRSLFSATKKWFSGSKVPEKSINDLKNTSGLLYPPEAPELQIRKMADLCFLVQHYDLAYSCYHTAKKDFLNDQAMLYAAGALEMAAVSAFLQPGAPRPYPAHYMDTAIQTYRDICKNMVLAERCVLLSAELLKSQSKYSEAAALLIRLTSEDSDLRSALLLEQAAHCFINMKSPMVRKYAFHMILAGHRFSKAGQKKHALRCYCQAMQVYKGKGWSLAEDHINFTIGRQSYTLRQLDNAVSAFRHILINESKQSAAQQGAFLREYLYVYKNVSQLSPDGPLPQLPLPYINSSATRVFFGHDRRPADG

SEQ ID NO: 908826 - protein, 624 aa, Homo sapiens
MEIPGSLCKKVKLSNNAQNWGMQRATNVTYQAHHVSRNKRGQVVGTRGGFRGCTVWLTGLSGAGKTTVSMALEEYLVCHGIPCYTLDGDNIRQGLNKNLGFSPEDREENVRRIAEVAKLFADAGLVCITSFISPYTQDRNNARQIHEGASLPFFEVFVDAPLHVCEQRDVKGLYKKARAGEIKGFTGIDSEYEKPEAPELVLKTDSCDVNDCVQQVVELLQERDIVPVDASYEVKELYVPENKLHLAKTDAETLPALKINKVDMQWVQVLAEGWATPLNGFMREREYLQCLHFDCLLDGGVINLSVPIVLTATHEDKERLDGCTAFALMYEGRRVAILRNPEFFEHRKEERCARQWGTTCKNHPYIKMVMEQGDWLIGGDLQVLDRVYWNDGLDQYRLTPTELKQKFKDMNADAVFAFQLRNPVHNGHALLMQDTHKQLLERGYRRPVLLLHPLGGWTKDDDVPLMWRMKQHAAVLEEGVLNPETTVVAIFPSPMMYAGPTEVQWHCRARMVAGANFYIVGRDPAGMPHPETGKDLYEPSHGAKVLTMAPGLITLEIVPFRVAAYNKKKKRMDYYDSEHHEDFEFISGTRMRKLAREGQKPPEGFMAPKAWTVLTEYYKSLEKA

SEQ ID NO: 908827 - protein, 624 aa, Homo sapiens; identical to SEQ ID NO: 908826

SEQ ID NO: 908828 - protein, 656 aa, Homo sapiens
FRGCGASRLGPWVVARQRGAAQGGDLALAWRSVRSEPPFVGRTPPLPSASAQGMQRATNVTYQAHHVSRNKRGQVVGTRGGFRGCTVWLTGLSGAGKTTVSMALEEYLVCHGIPCYTLDGDNIRQGLNKNLGFSPEDREENVRRIAEVAKLFADAGLVCITSFISPYTQDRNNARQIHEGASLPFFEVFVDAPLHVCEQRDVKGLYKKARAGEIKGFTGIDSEYEKPEAPELVLKTDSCDVNDCVQQVVELLQERDIVPVDASYEVKELYVPENKLHLAKTDAETLPALKINKVDMQWVQVLAEGWATPLNGFMREREYLQCLHFDCLLDGGVINLSVPIVLTATHEDKERLDGCTAFALMYEGRRVAILRNPEFFEHRKEERCARQWGTTCKNHPYIKMVMEQGDWLIGGDLQVLDRVYWNDGLDQYRLTPTELKQKFKDMNADAVFAFQLRNPVHNGHALLMQDTHKQLLERGYRRPVLLLHPLGGWTKDDDVPLMWRMKQHAAVLEEGVLNPETTVVAIFPSPMMYAGPTEVQWHCRARMVAGANFYIVGRDPAGMPHPETGKDLYEPSHGAKVLTMAPGLITLEIVPFRVAAYNKKKKRMDYYDSEHHEDFEFISGTRMRKLAREGQKPPEGFMAPKAWTVLTEYYKSLEKA

SEQ ID NO: 908829 - protein, 507 aa, Homo sapiens
MEIPGSLCKKVKLSNNAQNWDRNNARQIHEGASLPFFEVFVDAPLHVCEQRDVKGLYKKARAGEIKGFTGIDSEYEKPEAPELVLKTDSCDVNDCVQQVVELLQERDIVPVDASYEVKELYVPENKLHLAKTDAETLPALKINKVDMQWVQVLAEGWATPLNGFMREREYLQCLHFDCLLDGGVINLSVPIVLTATHEDKERLDGCTAFALMYEGRRVAILRNPEFFEHRKEERCARQWGTTCKNHPYIKMVMEQGDWLIGGDLQVLDRVYWNDGLDQYRLTPTELKQKFKDMNADAVFAFQLRNPVHNGHALLMQDTHKQLLERGYRRPVLLLHPLGGWTKDDDVPLMWRMKQHAAVLEEGVLNPETTVVAIFPSPMMYAGPTEVQWHCRARMVAGANFYIVGRDPAGMPHPETGKDLYEPSHGAKVLTMAPGLITLEIVPFRVAAYNKKKKRMDYYDSEHHEDFEFISGTRMRKLAREGQKPPEGFMAPKAWTVLTEYYKSLEKA

SEQ ID NO: 908830 - protein, 331 aa, Homo sapiens
MEIPGSLCKKVKLSNNAQNWGMQRATNVTYQAHHVSRNKRGQVVGTRGGFRGCTVWLTGLSGAGKTTVSMALEEYLVCHGIPCYTLDGDNIRQGLNKNLGFSPEDREENVRRIAEVAKLFADAGLVCITSFISPYTQDRNNARQIHEGASLPFFEVFVDAPLHVCEQRDVKGLYKKARAGEIKGFTGIDSEYEKPEAPELVLKTDSCDVNDCVQQVVELLQERDIVPVDASYEVKELYVPENKLHLAKTDAETLPALKINKVDMQWVQVLAEGWATPLNGFMREREYLQCLNWKGLWKWGGINLVRPLIFKWDPLGIKEGLTVFPHLGFKF

SEQ ID NO: 908831 - protein, 624 aa, Homo sapiens; identical to SEQ ID NO: 908826

SEQ ID NO: 908832 - protein, 634 aa, Homo sapiens
GRVGRPTRRTHASDPRVGKKVKLSNNAQNWGMQRATNVTYQAHHVSRNKRGQVVGTRGGFRGCTVWLTGLSGAGKTTVSMALEEYLVCHGIPCYTLDGDNIRQGLNKNLGFSPEDREENVRRIAEVAKLFADAGLVCITSFISPYTQDRNNARQIHEGASLPFFEVFVDAPLHVCEQRDVKGLYKKARAGEIKGFTGIDSEYEKPEAPELVLKTDSCDVNDCVQQVVELLQERDIVPVDASYEVKELYVPENKLHLAKTDAETLPALKINKVDMQWVQVLAEGWATPLNGFMREREYLQCLHFDCLLDGGVINLSVPIVLTATHEDKERLDGCTAFALMYEGRRVAILRNPEFFEHRKEERCARQWGTTCKNHPYIKMVMEQGDWLIGGDLQVLDRVYWNDGLDQYRLTPTELKQKFKDMNADAVFAFQLRNPVHNGHALLMQDTHKQLLERGYRRPVLLLHPLGGWTKDDDVPLMWRMKQHAAVLEEGVLNPETTVVAIFPSPMMYAGPTEVQWHCRARMVAGANFYIVGRDPAGMPHPETGKDLYEPSHGAKVLTMAPGLITLEIVPFRVAAYNKKKKRMDYYDSEHHEDFEFISGTRMRKLAREGQKPPEGFMAPKAWTVLTEYYKSLEKA

SEQ ID NO: 908833 - protein, 579 aa, Homo sapiens
MEIPGSLCKKVKLSNNAQNWGMQRATNVTYQAHHVSRNKRGQVVGTRGGFRGCTVWLTGLSGAGKTTVSMALEEYLVCHGIPCYTLDGDNIRQGLNKNLGFSPEDREENVRRIAEVAKLFADAGLVCITSFISPYTQDRNNARQIHEGASLPFFEVFVDAPLHVCEQRDVKGLYKKARAGEIKGFTGIDSEYEKPEAPELVLKTDSCDVNDCVQQVVELLQERDIVPVDASYEVKELYVPENKLHLAKTDAETLPALKINKVDMQWVQVLAEGWATPLNGFMREREYLQCLHFDCLLDGGVINLSVPIVLTATHEDKERLDGCTAFALMYEGRRVAILRNPEFFEHRKEERCARQWGTTCKNHPYIKMVMEQGDWLIGGDLQVLDRVYWNDGLDQYRLTPTELKQKFKDMNADAVFAFQLRNPVHNGHALLMQDTHKQLLERGYRRPVLLLHPLGGWTKDDDVPLMWRMKQHAAVLEEGVLNPETTVVAIFPSPMMYAGPTEVQWHCRARMVAGANFYIVGRDPAGMPHPETGKDLYEPSHGAKVLTMAPGLITLEIVPFRVAAYNKKKKRMDYYDSEQ

SEQ ID NO: 908834 - protein, 745 aa, Homo sapiens
MGVPFFSSLRCMVDLGPCWAGGLTAEMKLLLALAGLLAILATPQPSEGAAPAVLGEVDTSLVLSSMEEAKQLVDKAYKERRESIKQRLRSGSASPMELLSYFKQPVAATRTAVRAADYLHVALDLLERKLRSLWRRPFNVTDVLTPAQLNVLSKSSGCAYQDVGVTCPEQDKYRTITGMCNNRRSPTLGASNRAFVRWLPAEYEDGFSLPYGWTPGVKRNGFPVALARAVSNEIVRFPTDQLTPDQERSLMFMQWGQLLDHDLDFTPEPAARASFVTGVNCETSCVQQPPCFPLKIPPNDPRIKNQADCIPFFRSCPACPGSNITIRNQINALTSFVDASMVYGSEEPLARNLRNMSNQLGLLAVNQRFQDNGRALLPFDNLHDDPCLLTNRSARIPCFLAGDTRSSEMPELTSMHTLLLREHNRLATELKSLNPRWDGERLYQEARKIVGAMVQIITYRDYLPLVLGPTAMRKYLPTYRSYNDSVDPRIANVFTNAFRYGHTLIQPFMFRLDNRYQPMEPNPRVPLSRVFFASWRVVLEGGIDPILRGLMATPAKLNRQNQIAVDEIRERLFEQVMRIGLDLPALNMQRSRDHGLPGYNAWRRFCGLPQPETVGQLGTVLRNLKLARKLMEQYGTPNNIDIWMGGVSEPLKRKGRVGPLLACIIGTQFRKLRDGDRFWWENEGVFSMQQRQALAQISLPRIICDNTGITTVSKNNIFMSNSYPRDFVNCSTLPALNLASWREAS

SEQ ID NO: 908835 - protein, 756 aa, Homo sapiens
MPELTSMHTLLLREHNRLDTELKSLNPRWDGERLYQEARKIVGAMVQIITYRDYQPSEGAALAVLGEVDTSLVLSSMEEAKQLVDKAYKERRESIKQRLRSGSASPMELLSYFKQPVAATRTAVRAADYLHVALDLLERKLRSLWRRPFNVTDVLTPAQLNVLSKSSGCAYQDVGVTCPEQDKYRTITGMCNNRRSPTLGASNRAFVRWLPAEYEDGFSLPYGWTPGVKRNGFPVALARAVSNEIVRFPTDQLTPDQERSLMFMQWGQLLDHDLDFTPEPAARASFVTGVNCETSCVQQPPCFPLKIPPNDPRIKNQADCIPFFRSCPACPGSNITIRNQINALTSFVDASMVYGSEEPLARNLRNMSNQLGLLAVNQRFQDNGRALLPFDNLHDDPCLLTNRSARIPCFLAGDTRSSEMPELTSMHTLLLREHNRLATELKSLNPRWDGERLYQEARKIVGAMVQIITYRDYLPLVLGPTAMRKYLPTYRSYNDSVDPRIANVFTNAFRYGHTLIQPFMFRLDNRYQPMEPNPRVPLSRVFFASWRVVLEGGIDPILRGLMATPAKLNRQNQIAVDEIRERLFEQVMRIGLDLPALNMQRSRDHGLPGYNAWRRFCGLPQPETVGQLGTVLRNLKLARKLMEQYGTPNNIDIWMGGVSEPLKRKGRVGPLLACIIGTQFRKLRDGDRFWWENEGVFSMQQRQALAQISLPRIICDNTGITTVSKNNIFMSNSYPRDFVNCSTLPALNLASWREAS

SEQ ID NO: 908836 - protein, 736 aa, Homo sapiens
MQWIPYSVIEYSGFHAAWKNASRLNAVDYVQHEMTSPGGAAPAVLGEVDTSLVLSSMEEAKQLVDKAYKERRESIKQRLRSGSASPMELLSYFKQPVAATRTAVRAADYLHVALDLLERKLRSLWRRPFNVTDVLTPAQLNVLSKSSGCAYQDVGVTCPEQDKYRTITGMCNNRRSPTLGASNRAFVRWLPAEYEDGFSLPYGWTPGVKRNGFPVALARAVSNEIVRFPTDQLTPDQERSLMFMQWGQLLDHDLDFTPEPAARASFVTGVNCETSCVQQPPCFPLKIPPNDPRIKNQADCIPFFRSCPACPGSNITIRNQINALTSFVDASMVYGSEEPLARNLRNMSNQLGLLAVNQRFQDNGRALLPFDNLHDDPCLLTNRSARIPCFLAGDTRSSEMPELTSMHTLLLREHNRLATELKSLNPRWDGERLYQEARKIVGAMVQIITYRDYLPLVLGPTAMRKYLPTYRSYNDSVDPRIANVFTNAFRYGHTLIQPFMFRLDNRYQPMEPNPRVPLSRVFFASWRVVLEGGIDPILRGLMATPAKLNRQNQIAVDEIRERLFEQVMRIGLDLPALNMQRSRDHGLPGYNAWRRFCGLPQPETVGQLGTVLRNLKLARKLMEQYGTPNNIDIWMGGVSEPLKRKGRVGPLLACIIGTQFRKLRDGDRFWWENEGVFSMQQRQALAQISLPRIICDNTGITTVSKNNIFMSNSYPRDFVNCSTLPALNLASWREAS

SEQ ID NO: 908837 - protein, 405 aa, Homo sapiens
MVYGSEEPLARNLRNMSNQLGLLAVNQRFQDNGRALLPFDNLHDDPCLLTNRSARIPCFLAGDTRSSEMPELTSMHTLLLREHNRLATELKSLNPRWDGERLYQEARKIVGAMVQIITYRDYLPLVLGPTAMRKYLPTYRSYNDSVDPRIANVFTNAFRYGHTLIQPFMFRLDNRYQPMEPNPRVPLSRVFFASWRVVLEGGIDPILRGLMATPAKLNRQNQIAVDEIRERLFEQVMRIGLDLPALNMQRSRDHGLPGYNAWRRFCGLPQPETVGQLGTVLRNLKLARKLMEQYGTPNNIDIWMGGVSEPLKRKGRVGPLLACIIGTQFRKLRDGDRFWWENEGVFSMQQRQALAQISLPRIICDNTGITTVSKNNIFMSNSYPRDFVNCSTLPALNLASWREAS

SEQ ID NO: 908838 - protein, 772 aa, Homo sapiens
MGVPFFSSLRCMVDLGPCWAGGLTAEMKLLLALAGLLAILATPQPSEGAAPAVLGEVDTSLVLSSMEEAKQLVDKAYKERRERWGTRHCPALGKDVPGLSEKQQAAGSLSIKQRLRSGSASPMELLSYFKQPVAATRTAVRAADYLHVALDLLERKLRSLWRRPFNVTDVLTPAQLNVLSKSSGCAYQDVGVTCPEQDKYRTITGMCNNRRSPTLGASNRAFVRWLPAEYEDGFSLPYGWTPGVKRNGFPVALARAVSNEIVRFPTDQLTPDQERSLMFMQWGQLLDHDLDFTPEPAARASFVTGVNCETSCVQQPPCFPLKIPPNDPRIKNQADCIPFFRSCPACPGSNITIRNQINALTSFVDASMVYGSEEPLARNLRNMSNQLGLLAVNQRFQDNGRALLPFDNLHDDPCLLTNRSARIPCFLAGDTRSSEMPELTSMHTLLLREHNRLATELKSLNPRWDGERLYQEARKIVGAMVQIITYRDYLPLVLGPTAMRKYLPTYRSYNDSVDPRIANVFTNAFRYGHTLIQPFMFRLDNRYQPMEPNPRVPLSRVFFASWRVVLEGGIDPILRGLMATPAKLNRQNQIAVDEIRERLFEQVMRIGLDLPALNMQRSRDHGLPGYNAWRRFCGLPQPETVGQLGTVLRNLKLARKLMEQYGTPNNIDIWMGGVSEPLKRKGRVGPLLACIIGTQFRKLRDGDRFWWENEGVFSMQQRQALAQISLPRIICDNTGITTVSKNNIFMSNSYPRDFVNCSTLPALNLASWREAS

SEQ ID NO: 908839 - protein, 567 aa, Homo sapiens
MCNNRRSPTLGASNRAFVRWLPAEYEDGFSLPYGWTPGVKRNGFPVALARAVSNEIVRFPTDQLTPDQERSLMFMQWGQLLDHDLDFTPEPAARASFVTGVNCETSCVQQPPCFPLKIPPNDPRIKNQADCIPFFRSCPACPGSNITIRNQINALTSFVDASMVYGSEEPLARNLRNMSNQLGLLAVNQRFQDNGRALLPFDNLHDDPCLLTNRSARIPCFLAGDTRSSEMPELTSMHTLLLREHNRLATELKSLNPRWDGERLYQEARKIVGAMVQIITYRDYLPLVLGPTAMRKYLPTYRSYNDSVDPRIANVFTNAFRYGHTLIQPFMFRLDNRYQPMEPNPRVPLSRVFFASWRVVLEGGIDPILRGLMATPAKLNRQNQIAVDEIRERLFEQVMRIGLDLPALNMQRSRDHGLPGYNAWRRFCGLPQPETVGQLGTVLRNLKLARKLMEQYGTPNNIDIWMGGVSEPLKRKGRVGPLLACIIGTQFRKLRDGDRFWWENEGVFSMQQRQALAQISLPRIICDNTGITTVSKNNIFMSNSYPRDFVNCSTLPALNLASWREAS

SEQ ID NO: 908840 - protein, 745 aa, Homo sapiens
MGVPFFSSLRCMVDLGPCWAGGLTAEMKLLLALAGLLAILATPQPSEGAAPAVLGEVDTSLVLSSMEEAKQLVDKAYKERRESIKQRLRSGSASPMELLSYFKQPVAATRTAVRAADYLHVALDLLERKLRSLWRRPFNVTDVLTPAQLNVLSKSSGCAYQDVGVTCPEQDKYRTITGMCNNRRSPTLGASNRAFVRWLPAEYEDGFSLPYGWTPGVKRNGFPVALARAVSNEIVRFPTDQLTPDQERSLMFMQSQRFSNQELEFHDYTAERASFLTGVKGETSCVQQPPCCSLKIPPNDPRIKNQADCIPFFRSCPACPGSNITIRNQINALTSFVDASMVYGSEEPLARNLRNMSNQLGLLAVNQRFQDNGRALLPFDNLHDDPCLLTNRSARIPCFLAGDTRSSEMPELTSMHTLLLREHNRLATELKSLNPRWDGERLYQEARKIVGAMVQIITYRDYLPLVLGPTAMRKYLPTYRSYNDSVDPRIANVFTNAFRYGHTLIQPFMFRLDNRYQPMEPNPRVPLSRVFFASWRVVLEGGIDPILRGLMATPAKLNRQNQIAVDEIRERLFEQVMRIGLDLPALNMQRSRDHGLPGYNAWRRFCGLPQPETVGQLGTVLRNLKLARKLMEQYGTPNNIDIWMGGVSEPLKRKGRVGPLLACIIGTQFRKLRDGDRFWWENEGVFSMQQRQALAQISLPRIICDNTGITTVSKNNIFMSNSYPRDFVNCSTLPALNLASWREAS

SEQ ID NO: 908841 - protein, 677 aa, Homo sapiens
MGVPFFSSLRCMVDLGPCWAGGLTAEMKLLLALAGLLAILATPQPSEGAAPAVLGEVDTSLVLSSMEEAKQLVDKAYKERRESIKQRLRSGSASPMELLSYFKQPVAATRTAVRAADYLHVALDLLERKLRSLWRRPFNVTDVLTPAQLNVLSKSSGCAYQDVGVTCPEQDKYRTITGMCNNRRSPTLGASNRAFVRWLPAEYEDGFSLPYGWTPGVKRNGFPVALARAVSNEIVRFPTDQLTPDQERSLMFMQWGQLLDHDLDFTPEPAARASFVTGVNCETSCVQQPPCFPLKIPPNDPRIKNQADCIPFFRSCPACPGSNITIRNQINALTSFVDASMVYGSEEPLARNLRNMSNQLGLLAVNQRFQDNGRALLPFDNLHDDPCLLTNRSARIPCFLAGDTRSSEMPELTSMHTLLLREHNRLATELKSLNPRWDGERLYQEARKIVGAMVQIITYRDYLPLVLGPTAMRKYLPTYRSYNDSVDPRIANVFTNAFRYGHTLIQPFMFRLDNRYQPMEPNPRVPLSRVFFASWRVVLEGGIDPILRGLMATPAKLNRQNQIAVDEIRERLFEQVMRIGLDLPALNMQRSRDHGLPGYNAWRRFCGLPQPETVGQLGTVLRNLKLARKLMEQYGTPNNIDIWMGGVSEPLKRKGRVGPLLACIIGTQFRKLRDGDR

SEQ ID NO: 908842 - protein, 616 aa, Homo sapiens
MGVPFFSSLRCMVDLGPCWAGGLTAEMKLLLALAGLLAILATPQPSEGAAPAVLGEVDTSLVLSSMEEAKQLVDKAYKERRESIKQRLRSGSASPMELLSYFKQPVAATRTAVRAADYLHVALDLLERKLRSLWRRPFNVTDVLTPAQLNVLSKSSGCAYQDVGVTCPEQDKYRTITGMCNNRRSPTLGASNRAFVRWLPAEYEDGFSLPYGWTPGVKRNGFPVALARAVSNEIVRFPTDQLTPDQERSLMFMQWGQLLDHDLDFTPEPAARASFVTGVNCETSCVQQPPCFPLKIPPNDPRIKNQADCIPFFRSCPACPGSNITIRNQINALTSFVDASMVYGSEEPLARNLRNMSNQLGLLAVNQRFQDNGRALLPFDNLHDDPCLLTNRSARIPCFLAGDTRSSEMPELTSMHTLLLREHNRLATELKSLNPRWDGERLYQEARKIVGAMVQIITYRDYLPLVLGPTAMRKYLPTYRSYNDSVDPRIANVFTNAFRYGHTLIQPFMFRLDNRYQPMEPNPRVPLSRVFFASWRVVLEGGIDPILRGLMATPAKLNRQNQIAVDEIRERLFEQVMRIGLDLPALNMQRSRDHGLPGEGLQESPLMLTSPELPPR

SEQ ID NO: 908843 - protein, 360 aa, Homo sapiens
MLVPDSAQSARIPASGRDTRSSEMPELTSMHTLLLREHNRLATELKSLNPRWDGERLYQEARKIVGAMVQIITYRDYLPLVLGPTAMRKYLPTYRSYNDSVDPRIANVFTNAFRYGHTLIQPFMFRLDNRYQPMEPNPRVPLSRVFFASWRVVLEGGIDPILRGLMATPAKLNRQNQIAVDEIRERLFEQVMRIGLDLPALNMQRSRDHGLPGYNAWRRFCGLPQPETVGQLGTVLRNLKLARKLMEQYGTPNNIDIWMGGVSEPLKRKGRVGPLLACIIGTQFRKLRDGDRFWWENEGVFSMQQRQALAQISLPRIICDNTGITTVSKNNIFMSNSYPRDFVNCSTLPALNLASWREAS

SEQ ID NO: 908844 - protein, 337 aa, Homo sapiens
MPELTSMHTLLLREHNRLATELKSLNPRWDGERLYQEARKIVGAMVQIITYRDYLPLVLGPTAMRKYLPTYRSYNDSVDPRIANVFTNAFRYGHTLIQPFMFRLDNRYQPMEPNPRVPLSRVFFASWRVVLEGGIDPILRGLMATPAKLNRQNQIAVDEIRERLFEQVMRIGLDLPALNMQRSRDHGLPGYNAWRRFCGLPQPETVGQLGTVLRNLKLARKLMEQYGTPNNIDIWMGGVSEPLKRKGRVGPLLACIIGTQFRKLRDGDRFWWENEGVFSMQQRQALAQISLPRIICDNTGITTVSKNNIFMSNSYPRDFVNCSTLPALNLASWREAS

SEQ ID NO: 908845 - protein, 293 aa, Homo sapiens
MVQIITYRDYLPLVLGPTAMRKYLPTYRSYNDSVDPRIANVFTNAFRYGHTLIQPFMFRLDNRYQPMEPNPRVPLSRVFFASWRVVLEGGIDPILRGLMATPAKLNRQNQIAVDEIRERLFEQVMRIGLDLPALNMQRSRDHGLPGYNAWRRFCGLPQPETVGQLGTVLRNLKLARKLMEQYGTPNNIDIWMGGVSEPLKRKGRVGPLLACIIGTQFRKLRDGDRFWWENEGVFSMQQRQALAQISLPRIICDNTGITTVSKNNIFMSNSYPRDFVNCSTLPALNLASWREAS

SEQ ID NO: 908846 - protein, 323 aa, Homo sapiens
VSWLAELDQWCLGGISQLQLGCVDDLWAQAMVQIITYRDYLPLVLGPTAMRKYLPTYRSYNDSVDPRIANVFTNAFRYGHTLIQPFMFRLDNRYQPMEPNPRVPLSRVFFASWRVVLEGGIDPILRGLMATPAKLNRQNQIAVDEIRERLFEQVMRIGLDLPALNMQRSRDHGLPGYNAWRRFCGLPQPETVGQLGTVLRNLKLARKLMEQYGTPNNIDIWMGGVSEPLKRKGRVGPLLACIIGTQFRKLRDGDRFWWENEGVFSMQQRQALAQISLPRIICDNTGITTVSKNNIFMSNSYPRDFVNCSTLPALNLASWREAS

SEQ ID NO: 908847 - protein, 195 aa, Homo sapiens [sequence omitted]

SEQ ID NO: 908848 - protein, 252 aa, Homo sapiens
VSQCSGTVTPHSCLVFRLHNRYVPLEPQPRVLLSRVFCALLEELVLECGIDPILRGLMATPAKLNRQNQIAVDEIRERLFEQVMRIGLDLPALNMQRSRDHGLPGYNAWRRFCGLPQPETVGQLGTVLRNLKLARKLMEQYGTPNNIDIWMGGVSEPLKRKGRVGPLLACIIGTQFRKLRDGDRFWWENEGVFSMQQRQALAQISLPRIICDNTGITTVSKNNIFMSNSYPRDFVNCSTLPALNLASWREAS

SEQ ID NO: 908849 - protein, 305 aa, Homo sapiens
MGVPFFSSLRCMVDLGPCWAGGLTAEMKLLLALAGLLAILATPQPSEGAAPAVLGEVDTSLVLSSMEEAKQLVDKAYKERRESIKQRLRSGSASPMELLSYFKQPVAATRTAVRAADYLHVALDLLERKLRSLWRRPFNVTDVLTPAQLNVLSKSSGCAYQDVGVTCPEQDKYRTITGMCNNRRSPTLGASNRAFVRWLPAEYEDGFSLPYGWTPGVKRNGFPVALARAVSNEIVRFPTDQLTPDQERSLMFMQWGQLLDHDLDFTPEPAARASFVTGVNCETSCVQQPPCFPLKIPPNTRRHKR

SEQ ID NO: 908850 - protein, 88 aa, Homo sapiens
ICVVAADQHRYRARCSPSMPGTELASRQQVRFNAVSVRQFTKCRGYELDMKRSFVCSCMCEVYKLAFHACVLSEHGECFMGYVYVPFM

SEQ ID NO: 908851 - protein, 764 aa, Homo sapiens
MGVPFFSSLRCMVDLGPCWAGGLTAEMKLLLALAGLLAILATPQPSEGAAPAVLGEVDTSLVLSSMEEAKQLVDKAYKERRESIKQRLRSGSASPMELLSYFKQPVAATRTAVRAADYLHVALDLLERKLRSLWRRPFNVTDVLTPAQLNVLSKSSGCAYQDVGVTCPEQDKYRTITGMCNNRRSPTLGASNRAFVRWLPAEYEDGFSLPYGWTPGVKRNGFPVALARAVSNEIVRFPTDQLTPDQERSLMFMQWGQLLDHDLDFTPEPAARASFVTGVNCETSCVQQPPCFPLKIPPNDPRIKNQADCIPFFRSCPACPGSNITIRNQINALTSFVDASMVYGSEEPLARNLRNMSNQLGLLAVNQRFQDNGRALLPFDNLHDDPCLLTNRSARIPCFLAGSFGVGTRGGIGDVPCWSHRDTRSSEMPELTSMHTLLLREHNRLATELKSLNPRWDGERLYQEARKIVGAMVQIITYRDYLPLVLGPTAMRKYLPTYRSYNDSVDPRIANVFTNAFRYGHTLIQPFMFRLDNRYQPMEPNPRVPLSRVFFASWRVVLEGGIDPILRGLMATPAKLNRQNQIAVDEIRERLFEQVMRIGLDLPALNMQRSRDHGLPGYNAWRRFCGLPQPETVGQLGTVLRNLKLARKLMEQYGTPNNIDIWMGGVSEPLKRKGRVGPLLACIIGTQFRKLRDGDRFWWENEGVFSMQQRQALAQISLPRIICDNTGITTVSKNNIFMSNSYPRDFVNCSTLPALNLASWREAS

SEQ ID NO: 908852 - protein, 699 aa, Homo sapiens
SLLWAAVLGEVDTSLVLSSMEEAKQLVDKAYKERRESIKQRLRSGSASPMELLSYFKQPVAATRTAVRAADYLHVALDLLERKLRSLWRRPFNVTDVLTPAQLNVLSKSSGCAYQDVGVTCPEQDKYRTITGMCNNRRSPTLGASNRAFVRWLPAEYEDGFSLPYGWTPGVKRNGFPVALARAVSNEIVRFPTDQLTPDQERSLMFMQWGQLLDHDLDFTPEPAARASFVTGVNCETSCVQQPPCFPLKIPPNDPRIKNQADCIPFFRSCPACPGSNITIRNQINALTSFVDASMVYGSEEPLARNLRNMSNQLGLLAVNQRFQDNGRALLPFDNLHDDPCLLTNRSARIPCFLAGDTRSSEMPELTSMHTLLLREHNRLATELKSLNPRWDGERLYQEARKIVGAMVQIITYRDYLPLVLGPTAMRKYLPTYRSYNDSVDPRIANVFTNAFRYGHTLIQPFMFRLDNRYQPMEPNPRVPLSRVFFASWRVVLEGGIDPILRGLMATPAKLNRQNQIAVDEIRERLFEQVMRIGLDLPALNMQRSRDHGLPGYNAWRRFCGLPQPETVGQLGTVLRNLKLARKLMEQYGTPNNIDIWMGGVSEPLKRKGRVGPLLACIIGTQFRKLRDGDRFWWENEGVFSMQQRQALAQISLPRIICDNTGITTVSKNNIFMSNSYPRDFVNCSTLPALNLASWREAS

SEQ ID NO: 908853 - protein, 429 aa, Homo sapiens
MGVPFFSSLRCMVDLGPCWAGGLTAEMKLLLALAGLLAILATPQPSEGAAPAVLGEVDTSLVLSSMEEAKQLVDKAYKERRESIKQRLRSGSASPMELLSYFKQPVAATRTAVRAADYLHVALDLLERKLRSLWRRPFNVTDVLTPAQLNVLSKSSGCAYQDVGVTCPEQDKYRTITGMCNNRRSPTLGASNRAFVRWLPAEYEDGFSLPYGWTPGVKRNGFPVALARAVSNEIVRFPTDQLTPDQERSLMFMQWGQLLDHDLDFTPEPAARASFVTGVNCETSCVQQPPCFPLKIPPNDPRIKNQADCIPFFRSCPACPGSNITIRNQINALTSFVDASMVYGSEEPLARNLRNMSNQLGLLAVNQRFQDNGRALLPFDNLHDDPCLLTNRSARIPCFLADHHLPGLPAPGAGANGHEEVPAHVPFLQ

SEQ ID NO: 908854 - protein, 567 aa, Homo sapiens; identical to SEQ ID NO: 908839

SEQ ID NO: 908855 - protein, 624 aa, Homo sapiens
MGVPFFSSLRCMVDLGPCWAGGLTAEMKLLLALAGLLAILATPQPSEGAAPAVLGEVDTSLVLSSMEEAKQLVDKAYKERRESIKQRLRSGSASPMELLSYFKQPVAATRTAVRAADYLHVALDLLERKLRSLWRRPFNVTDVLTPAQLNVLSKSSGCAYQDVGVTCPEQDKYRTITGMCNNRRSPTLGASNRAFVRWLPAEYEDGFSLPYGWTPGVKRNGFPVALARAVSNEIVRFPTDQLTPDQERSLMFMQWGQLLDHDLDFTPEPAARASFVTGVNCETSCVQQPPCFPLKIPPNDPRIKNQADCIPFFRSCPACPGSNITIRNQINALTSFVDASMVYGSEEPLARNLRNMSNQLGLLAVNQRFQDNGRALLPFDNLHDDPCLLTNRSARIPCFLAGDTRSSEMPELTSMHTLLLREHNRLATELKSLNPRWDGERLYQEARKIVGAMVQIITYRDYLPLVLGPTAMRKYLPTYRSYNDSVDPRIANVFTNAFRYGHTLIQPFMFRLDNRYQPMEPNPRVPLSRVFFASWRVVLEGGIDPILRGLMATPAKLNRQNQIAVDEIRERLFEQISLPRIICDNTGITTVSKNNIFMSNSYPRDFVNCSTLPALNLASWREAS

SEQ ID NO: 908856 - protein, 351 aa, Homo sapiens
IKSVQTRRDTRSSEMPELTSMHTLLLREHNRLATELKSLNPRWDGERLYQEARKIVGAMVQIITYRDYLPLVLGPTAMRKYLPTYRSYNDSVDPRIANVFTNAFRYGHTLIQPFMFRLDNRYQPMEPNPRVPLSRVFFASWRVVLEGGIDPILRGLMATPAKLNRQNQIAVDEIRERLFEQVMRIGLDLPALNMQRSRDHGLPGYNAWRRFCGLPQPETVGQLGTVLRNLKLARKLMEQYGTPNNIDIWMGGVSEPLKRKGRVGPLLACIIGTQFRKLRDGDRFWWENEGVFSMQQRQALAQISLPRIICDNTGITTVSKNNIFMSNSYPRDFVNCSTLPALNLASWREAS

SEQ ID NO: 908857 - protein, 274 aa, Homo sapiens
MRKYLPTYRSYNDSVDPRIANVFTNAFRYGHTLIQPFMFRLDNRYQPMEPNPRVPLSRVFFASWRVVLEGGIDPILRGLMATPAKLNRQNQIAVDEIRERLFEQVMRIGLDLPALNMQRSRDHGLPGYNAWRRFCGLPQPETVGQLGTVLRNLKLARKLMEQYGTPNNIDIWMGGVSEPLKRKGRVGPLLACIIGTQFRKLRDGDRFWWENEGVFSMQQRQALAQISLPRIICDNTGITTVSKNNIFMSNSYPRDFVNCSTLPALNLASWREAS

SEQ ID NO: 908858 - protein, 274 aa, Homo sapiens; identical to SEQ ID NO: 908857

SEQ ID NO: 908859 - protein, 476 aa, Homo sapiens
MGVPFFSSLRCMVDLGPCWAGGLTAEMKLLLALAGLLAILATPQPSEGAAPAVLGEVDTSLVLSSMEEAKQLVDKAYKERRESIKQRLRSGSASPMELLSYFKQPVAATRTAVRAADYLHVALDLLERKLRSLWRRPFNVTDVLTPAQLNVLSKSSGCAYQDVGVTCPEQDKYRTITGMCNNRRSPTLGASNRAFVRWLPAEYEDGFSLPYGWTPGVKRNGFPVALARAVSNEIVRFPTDQLTPDQERSLMFMQWGQLLDHDLDFTPEPAARASFVTGVNCETSCVQQPPCFPLKIPPNDPRIKNQADCIPFFRSCPACPGSNITIRNQINALTSFVDASMVYGSEEPLARNLRNMSNQLGLLAVNQRFQDNGRALLPFDNLHDDPCLLTNRSARIPCFLAGDTRSSEMPELTSMHTLLLREHNRLATELKSLNPRWDGERLYQEARKIVGAMVQVGRLEHRAHGIQMCPCNILAV

SEQ ID NO: 908860 - protein, 115 aa, Homo sapiens [sequence omitted]

SEQ ID NO: 908861 - protein, 197 aa, Homo sapiens
MGVPFFSSLRCMVDLGPCWAGGLTAEMKLLLALAGLLAILATPQPSEGAAPAVLGEVDTSLVLSSMEEAKQLVDKAYKERRESIKQRLRSGSASPMELLSYFKQPVAATRTAVRAADYLHVALDLLERKLRSLWRRPFNVTDVLTPAQLNVLSKSSGCAYQDVGVTCPEQDKYRTITGMCNNRRSPRWASLCLYKLR

SEQ ID NO: 908862 - protein, 67 aa, Homo sapiens
MRKYLPTYRSYNDSVDPRIANVFTNAFRYGHTLIQPFMFRLDNRYQPMEPPPHCTRVALGSSERPTK

SEQ ID NO: 908863 - protein, 162 aa, Homo sapiens
MRSEPLRKKKKVDPKKDQEAKERLKRKIRKLEKATQELIPIEDFITPLKFLDKARERPQVELTFEETERRALLLKKWSLYKQQERKMERDTIRAMLEAQQEALEELQLESPKLHAEAIKRDPNLFPFEKEGPHYTPPIPNYQPPEGRYNDITKVYTQVEFKR

SEQ ID NO: 908864 - protein, 162 aa, Homo sapiens; identical to SEQ ID NO: 908863

SEQ ID NO: 908865 - protein, 206 aa, Homo sapiens [sequence omitted]

SEQ ID NO: 908866 - protein, 206 aa, Homo sapiens [sequence omitted]

SEQ ID NO: 908867 - protein, 206 aa, Homo sapiens [sequence omitted]

SEQ ID NO: 908868 - protein, 122 aa, Homo sapiens
AGALGAWSAGPQQGAPRAGLWRGARPEAARVAMTASVLRSISLALRPTSGLLGTWQTQLRETHQRASLLSFWELIPMRSEPLRKKKKVDPKKDQEAKERLKRKIRKLEKATQERAASGGAHL

SEQ ID NO: 908869 - protein, 105 aa, Homo sapiens
PVPAPRALRLFLRALGQAASSPEPTGCLLSQRRPLITVAMPGGLLLGDVAPNFEANTTVGRIRFHDFLGDSWGILFSHPRDFTPVCTTELGRAAKLGTRICQEEC

SEQ ID NO: 908870 - protein, 98 aa, Homo sapiens
GRIDSFSFLSGPKTNTTRAVTGRNFDEILRGSHLSPADSRNTTGLPPPVDWTRMGIRVMVLSQPSPESKKPKKLFPKGVFTQRSSHLGKKYLRYTPQP

SEQ ID NO: 908871 - protein, 105 aa, Homo sapiens; identical to SEQ ID NO: 908869

SEQ ID NO: 908872 - protein, 105 aa, Homo sapiens; identical to SEQ ID NO: 908869

SEQ ID NO: 908873 - protein, 90 aa, Homo sapiens
THASRTRGPTGCLLSQRRPLITVAMPGGLLLGDVAPNFEANTTVGRIRFHDFLGDSWGILFSHPRDFTPVCTTELGRAAKLGTRICQEEC

SEQ ID NO: 908874 - protein, 105 aa, Homo sapiens; identical to SEQ ID NO: 908869

SEQ ID NO: 908875 - protein, 130 aa, Homo sapiens
MIGIGSCAILCGHAGSSRERMNTGHACDSSCGVCFFFGPDKKLKLSILYPATTGRNFDEILRGSHLSPADSRNTTGLPPPVDWTRMGIRVMVLSQPSPESKKPKKLFPKGVFTQRSSHLGKKYLRYTPQP

SEQ ID NO: 908876 - protein, 105 aa, Homo sapiens; identical to SEQ ID NO: 908869

SEQ ID NO: 908877 - protein, 130 aa, Homo sapiens; identical to SEQ ID NO: 908875

SEQ ID NO: 908878 - protein, 105 aa, Homo sapiens
AIKGVGRRYAHVVLRKADIDLTKRAGELTEDEVERVITIMQNPRQYKIPDWFLNRQKEKDGHGSRDLHPRVRPEFAKRNVKLIALSIDSVEDHLAWSKDINAYNV

SEQ ID NO: 908879 - protein, 105 aa, Homo sapiens; identical to SEQ ID NO: 908869

SEQ ID NO: 908880 - protein, 105 aa, Homo sapiens; identical to SEQ ID NO: 908869

SEQ ID NO: 908881 - protein, 69 aa, Homo sapiens
DACSERAASVVELQEAKKTFPERSLHPKELPSGQEIPPLHTPALSLLEKAGAVSQRMSAGQLCFPAAIP

SEQ ID NO: 908882 - protein, 105 aa, Homo sapiens; identical to SEQ ID NO: 908869

SEQ ID NO: 908883 - protein, 105 aa, Homo sapiens; identical to SEQ ID NO: 908869

SEQ ID NO: 908884 - protein, 105 aa, Homo sapiens; identical to SEQ ID NO: 908869

SEQ ID NO: 908885 - protein, 105 aa, Homo sapiens; identical to SEQ ID NO: 908869

SEQ ID NO: 908886 - protein, 105 aa, Homo sapiens; identical to SEQ ID NO: 908869

SEQ ID NO: 908887 - protein, 95 aa, Homo sapiens
KSGINAECPITAGPTGCLLSQRRPLITVAMPGGLLLGDVAPNFEANTTVGRIRFHDFLGDSWGILFSHPRDFTPVCTTELGRAAKLGTRICQEEC

SEQ ID NO: 908888 - protein, 105 aa, Homo sapiens; identical to SEQ ID NO: 908869

SEQ ID NO: 908889 - protein, 124 aa, Homo sapiens
PPSDRRTVPSVPPSDDPKGLPTTPATIMARPRQLVCNINEYSDGPTNAREFGHSRGVAMPGGLLLGDVAPNFEANTTVGRIRFHDFLGDSWGILFSHPRDFTPVCTTELGRAAKLGTRICQEEC

SEQ ID NO: 908890 - protein, 105 aa, Homo sapiens; identical to SEQ ID NO: 908869

SEQ ID NO: 908891 - protein, 105 aa, Homo sapiens; identical to SEQ ID NO: 908869

SEQ ID NO: 908892 - protein, 115 aa, Homo sapiens
QKLPGIGKGHACDSSCGVCFFFGPDKKLKLSILYPATTGRNFDEILRGSHLSPADSRNTTGLPPPVDWTRMGIRVMVLSQPSPESKKPKKLFPKGVFTQRSSHLGKKYLRYTPQP

SEQ ID NO: 908893 - protein, 105 aa, Homo sapiens; identical to SEQ ID NO: 908869

SEQ ID NO: 908894 - protein, 74 aa, Homo sapiens
MTNVYSLDGILVFGLLFVCTCAYFKKVPRLKTWLLSEKKGVWGVFYKAAVIGTRLHAAVAIACVVMAFYVLFIK

SEQ ID NO: 908895 - protein, 74 aa, Homo sapiens; identical to SEQ ID NO: 908894

SEQ ID NO: 908896 - protein, 74 aa, Homo sapiens; identical to SEQ ID NO: 908894

SEQ ID NO: 908897 - protein, 74 aa, Homo sapiens; identical to SEQ ID NO: 908894

SEQ ID NO: 908898 - protein, 113 aa, Homo sapiens
KKTKCDRITEKIIHYFFTWMTGLDLEYVFFFFITLQEAESGNISQKSDEEDFVKVEDLPLKLTIYSEADLRKKMVEEEQKNHLSGEICEMQTEELAGNSETLKEPETVGAQSI

SEQ ID NO: 908899 - protein, 2016 aa, Homo sapiens
MATGGGPFEDGMNDQDLPNWSNENVDDRLNNMDWGAQQKKANRSSEKNKKKFGVESDKRVTNDISPESSPGVGRRRTKTPHTFPHSRYMSQMSVPEQAELEKLKQRINFSDLDQRSIGSDSQGRATAANNKRQLSENRKPFNFLPMQINTNKSKDASTSPPNRETIGSAQCKELFASALSNDLLQNCQVSEEDGRGEPAMESSQIVSRLVQIRDYITKASSMREDLVEKNERSANVERLTHLIDHLKEQEKSYMKFLKKILARDPQQEPMEEIENLKKQHDLLKRMLQQQEQLRALQGRQAALLALQHKAEQAIAVMDDSVVAETAGSLSGVSITSELNEELNDLIQRFHNQLRDSQPPAVPDNRRQAESLSLTREVSQSRKPSASERLPDEKVELFSKMRVLQEKKQKMDKLLGELHTLRDQHLNNSSSSPQRSVDQRSTSAPSASVGLAPVVNGESNSLTSSVPYPTASLVSQNESENEGHLNPSEKLQKLNEVRKRLNELRELVHYYEQTSDMMTDAVNENRKDEETEESEYDSEHENSEPVTNIRNPQVASTWNEVNSHSNAQCVSNNRDGRTVNSNCEINNRSAANIRALNVPPSLDCRYNREGEQEIHVAQGEDDEEEEEEAEEEGVSGASLSSHRSSLVDEHPEDAEFEQKINRLMAAKQKLRQLQDLVAMVQDDDAAQGVISASASNLDDFYPAEEDTKQNSNNTRGNANKTQKDTGVNEKAREKFYEAKLQQQQRELKQLQEERKKLIDIQEKIQALQTACPDLQLSAASVGNCPTKKYMPAVTSTPTVNQHETSTSKSVFEPEDSSIVDNELWSEMRRHEMLREELRQRRKQLEALMAEHQRRQGLAETASPVAVSLRSDGSENLCTPQQSRTEKTMATWGGSTQCALDEEGDEDGYLSEGIVRTDEEEEEEQDASSNDNFSVCPSNSVNHNSYNRKETKNTWKNNCPFSADENYRPLAKTRQQNISMQRQENLRWVSELSYVEEKEQWQEQINQLKKQLDFSVSICQTLMQDQQTLSCLLQTLLTGPYSVMPSNVASPQVHFIMHQLNQCYTQLTWQQNNVQRLKQMLNELMRQQNQHPEKPGGKERGSSASHPPSPSLFCPFSFPTQPVNLFNIPGFTNFSSFAPGMNFSPLFPSNFGDFSQNISTPSEQQQPLAQNSSGKTEYMAFPKPFESSSSIGAEKPRNKKLPEEEVESSRTPWLYEQEGEVEKPFIKTGFSVSVEKSTSSNRKNQLDTNGRRRQFDEESLESFSSMPDPVDPTTVTKTFKTRKASAQASLASKDKTPKSKSKKRNSTQLKSRVKNIRYESASMSSTCEPCKSRNRHSAQTEEPVQAKVFSRKNHEQLEKIIKCNRSTEISSETGSDFSMFEALRDTIYSEVATLISQNESRPHFLIELFHELQLLNTDYLRQRALYALQDIVSRHISESHEKGENVKSVNSGTWIASNSELTPSESLATTDDETFEKNFERETHKISEQNDADNASVLSVSSNFEPFATDDLGNTVIHLDQALARMREYERMKTEAESNSNMRCICRIIEDGDGAGAETPVIENRSSQQPVSEVSTIPCPRIDTQQLDRQIKAIMKEVIPFLKEHMDEVCSSQLLTSVRRMVLTLTQQNDESKEFVKFFHKQLGSILQDSLAKFAGRKLKDCGEDLLVEISEVLFNELAFFKLMQDLDNNSITVKQRCKRKIEATGVIQSCAKEAKRILEDHGSPAGEIDDEDKDKDETETVKQTQTSEVYDGPKNVRSDISDQEEDEESEGCPVSINLSKAETQALTNYGSGEDENEDEEMEEFEEGPVDVQTSLQANTEATEENEHDEQVLQRDFKKTAESKNVPLEREATSKNDQNNCPVKPCYLNILEDEQPLNSAAHKESPPTVDSTQQPNPLPLRLPEMEPLVPRVKEVKSAQETPESSLAGSPDTESPVLVNDYEAESGNISQKSDEEDFVKVEDLPLKLTIYSEADLRKKMVEEEQKNHLSGEICEMQTEELAGNSETLKEPETVGAQSI

SEQ ID NO: 908900 - protein, 2016 aa, Homo sapiens; identical to SEQ ID NO: 908899

SEQ ID NO: 908901 - protein, 2055 aa, Homo sapiens
MATGGGPFEDGMNDQDLPNWSNENVDDRLNNMDWGAQQKKANRSSEKNKKKFGVESDKRVTNDISPESSPGVGRRRTKTPHTFPHSRYMSQMSVPEQAELEKLKQRINFSDLDQRSIGSDSQGRATAANNKRQLSENRKPFNFLPMQINTNKSKDASTSPPNRETIGSAQCKELFASALSNDLLQNCQVSEEDGRGEPAMESSQIVSRLVQIRDYITKASSMREDLVEKNERSANVERLTHLIDHLKEQEKSYMKFLKKILARENEEEDVRTIDSAVGSGSVAESTSLNIDVQSEASDTTARDPQQEPMEEIENLKKQHDLLKRMLQQQEQLRALQGRQAALLALQHKAEQAIAVMDDSVVAETAGSLSGVSITSELNEELNDLIQRFHNQLRDSQPPAVPDNRRQAESLSLTREVSQSRKPSASERLPDEKVELFSKMRVLQEKKQKMDKLLGELHTLRDQHLNNSSSSPQRSVDQRSTSAPSASVGLAPVVNGESNSLTSSVPYPTASLVSQNESENEGHLNPSEKLQKLNEVRKRLNELRELVHYYEQTSDMMTDAVNENRKDEETEESEYDSEHENSEPVTNIRNPQVASTWNEVNSHSNAQCVSNNRDGRTVNSNCEINNRSAANIRALNVPPSLDCRYNREGEQEIHVAQGEDDEEEEEEAEEEGVSGASLSSHRSSLVDEHPEDAEFEQKINRLMAAKQKLRQLQDLVAMVQDDDAAQGVISASASNLDDFYPAEEDTKQNSNNTRGNANKTQKDTGVNEKAREKFYEAKLQQQQRELKQLQEERKKLIDIQEKIQALQTACPDLQLSAASVGNCPTKKYMPAVTSTPTVNQHETSTSKSVFEPEDSSIVDNELWSEMRRHEMLREELRQRRKQLEALMAEHQRRQGLAETASPVAVSLRSDGSENLCTPQQSRTEKTMATWGGSTQCALDEEGDEDGYLSEGIVRTDEEEEEEQDASSNDNFSVCPSNSVNHNSYNRKETKNTWKNNCPFSADENYRPLAKTRQQNISMQRQENLRWVSELSYVEEKEQWQEQINQLKKQLDFSVSICQTLMQDQQTLSCLLQTLLTGPYSVMPSNVASPQVHFIMHQLNQCYTQLTWQQNNVQRLKQMLNELMRQQNQHPEKPGGKERGSSASHPPSPSLFCPFSFPTQPVNLFNIPGFTNFSSFAPGMNFSPLFPSNFGDFSQNISTPSEQQQPLAQNSSGKTEYMAFPKPFESSSSIGAEKPRNKKLPEEEVESSRTPWLYEQEGEVEKPFIKTGFSVSVEKSTSSNRKNQLDTNGRRRQFDEESLESFSSMPDPVDPTTVTKTFKTRKASAQASLASKDKTPKSKSKKRNSTQLKSRVKNIRYESASMSSTCEPCKSRNRHSAQTEEPVQAKVFSRKNHEQLEKIIKCNRSTEISSETGSDFSMFEALRDTIYSEVATLISQNESRPHFLIELFHELQLLNTDYLRQRALYALQDIVSRHISESHEKGENVKSVNSGTWIASNSELTPSESLATTDDETFEKNFERETHKISEQNDADNASVLSVSSNFEPFATDDLGNTVIHLDQALARMREYERMKTEAESNSNMRCICRIIEDGDGAGAETPVIENRSSQQPVSEVSTIPCPRIDTQQLDRQIKAIMKEVIPFLKEHMDEVCSSQLLTSVRRMVLTLTQQNDESKEFVKFFHKQLGSILQDSLAKFAGRKLKDCGEDLLVEISEVLFNELAFFKLMQDLDNNSITVKQRCKRKIEATGVIQSCAKEAKRILEDHGSPAGEIDDEDKDKDETETVKQTQTSEVYDGPKNVRSDISDQEEDEESEGCPVSINLSKAETQALTNYGSGEDENEDEEMEEFEEGPVDVQTSLQANTEATEENEHDEQVLQRDFKKTAESKNVPLEREATSKNDQNNCPVKPCYLNILEDEQPLNSAAHKESPPTVDSTQQPNPLPLRLPEMEPLVPRVKEVKSAQETPESSLAGSPDTESPVLVNDYEAESGNISQKSDEEDFVKVEDLPLKLTIYSEADLRKKMVEEEQKNHLSGEICEMQTEELAGNSETLKEPETVGAQSI

SEQ ID NO: 908902 - protein, 2016 aa, Homo sapiens; identical to SEQ ID NO: 908899

SEQ ID NO: 908903 - protein, 878 aa, Homo sapiens
MNFSPLFPSNFGDFSQNISTPSEQQQPLAQNSSGKTEYMAFPKPFESSSSIGAEKPRNKKLPEEEVESSRTPWLYEQEGEVEKPFIKTGFSVSVEKSTSSNRKNQLDTNGRRRQFDEESLESFSSMPDPVDPTTVTKTFKTRKASAQASLASKDKTPKSKSKKRNSTQLKSRVKNIRYESASMSSTCEPCKSRNRHSAQTEEPVQAKVFSRKNHEQLEKIIKCNRSTEISSETGSDFSMFEALRDTIYSEVATLISQNESRPHFLIELFHELQLLNTDYLRQRALYALQDIVSRHISESHEKGENVKSVNSGTWIASNSELTPSESLATTDDETFEKNFERETHKISEQNDADNASVLSVSSNFEPFATDDLGNTVIHLDQALARMREYERMKTEAESNSNMRCICRIIEDGDGAGAETPVIENRSSQQPVSEVSTIPCPRIDTQQLDRQIKAIMKEVIPFLKEHMDEVCSSQLLTSVRRMVLTLTQQNDESKEFVKFFHKQLGSILQDSLAKFAGRKLKDCGEDLLVEISEVLFNELAFFKLMQDLDNNSITVKQRCKRKIEATGVIQSCAKEAKRILEDHGSPAGEIDDEDKDKDETETVKQTQTSEVYDGPKNVRSDISDQEEDEESEGCPVSINLSKAETQALTNYGSGEDENEDEEMEEFEEGPVDVQTSLQANTEATEENEHDEQVLQRDFKKTAESKNVPLEREATSKNDQNNCPVKPCYLNILEDEQPLNSAAHKESPPTVDSTQQPNPLPLRLPEMEPLVPRVKEVKSAQETPESSLAGSPDTESPVLVNDYEAESGNISQKSDEEDFVKVEDLPLKLTIYSEADLRKKMVEEEQKNHLSGEICEMQTEELAGNSETLKEPETVGAQSI

SEQ ID NO: 908904 - protein, 2033 aa, Homo sapiens
MATGGGPFEDGMNDQDLPNWSNENVDDRLNNMDWGAQQKKANRSSEKNKKKFGVESDKRVTNDISPESSPGVGRRRTKTPHTFPHSRYMSQMSVPEQAELEKLKQRINFSDLDQRSIGSDSQGRATAANNKRQLSENRKPFNFLPMQINTNKSKDASTSPPNRETIGSAQCKELFASALSNDLLQNCQVSEEDGRGEPAMESSQIVSRLVQIRDYITKASSMREDLVEKNERSANVERLTHLIDHLKEQEKSYMKFLKKILARDPQQEPMEEIENLKKQHDLLKRMLQQQEQLRALQGRQAALLALQHKAEQAIAVMDDSVVAETAGSLSGVSITSELNEELNDLIQRFHNQLRDSQPPAVPDNRRQAESLSLTREVSQSRKPSASERLPDEKVELFSKMRVLQEKKQKMDKLLGELHTLRDQHLNNSSSSPQRSVDQRSTSAPSASVGLAPVVNGESNSLTSSVPYPTASLVSQNESENEGHLNPSEKLQKLNEVRKRLNELRELVHYYEQTSDMMTDAVNENRKDEETEESEYDSEHENSEPVTNIRNPQVASTWNEVNSHSNAQCVSNNRDGRTVNSNCEINNRSAANIRALNVPPSLDCRYNREGEQEIHVAQGEDDEEEEEEAEEEGVSGASLSSHRSSLVDEHPEDAEFEQKINRLMAAKQKLRQLQDLVAMVQDDDAAQGVISASASNLDDFYPAEEDTKQNSNNTRGNANKTQKDTGVNEKAREKFYEAKLQQQQRELKQLQEERKKLIDIQEKIQALQTACPDLQLSAASVGNCPTKKYMPAVTSTPTVNQHETSTSKSVFEPEDSSIVDNELWSEMRRHEMLREELRQRRKQLEALMAEHQRRQGLAETASPVAVSLRSDGSENLCTPQQSRTEKTMATWGGSTQCALDEEGDEDGYLSEGIVRTDEEEEEEQDASSNDNFSVCPSNSVNHNSYNRKETKNTWKNNCPFSADENYRPLAKTRQQNISMQRQENLRWVSELSYVEEKEQWQEQINQLKKQLDFSVSICQTLMQDQQTLSCLLQTLLTGPYSVMPSNVASPQVHFIMHQLNQCYTQLTWQQNNVQRLKQMLNELMRQQNQHPEKPGGKERGSSASHPPSPSLFCPFSFPTQPVNLFNIPGFTNFSSFAPGMNFSPLFPSNFGDFSQNISTPSEQQQPLAQNSSGKTEYMAFPKPFESSSSIGAEKPRNKKLPEEEVESSRTPWLYEQEGEVEKPFIKTGFSVSVEKSTSSNRKNQLDTNGRRRQFDEESLESFSSMPDPVDPTTVTKTFKTRKASAQASLASKDKTPKSKSKKRNSTQLKSRVKNIRYESASMSSTCEPCKSRNRHSAQTEEPVQAKVFSRKNHEQLEKIIKCNRSTEISSETGSDFSMFEALRDTIYSEVATLISQNESRPHFLIELFHELQLLNTDYLRQRALYALQDIVSRHISESHEKGENVKSVNSGTWIASNSELTPSESLATTDDETFEKNFERETHKISEQNDADNASVLSVSSNFEPFATDDLGNTVIHLDQALARMREYERMKTEAESNSNMRCICRIIEDGDGAGAETPVIENRSSQQPVSEVSTIPCPRIDTQQLDRQIKAIMKEVIPFLKEHMDEVCSSQLLTSVRRMVLTLTQQNDESKEFVKFFHKQLGSILQDSLAKFAGRKLKDCGEDLLVEISEVLFNELAFFKLMQDLDNNSITVKQRCKRKIEATGVIQSCAKEAKRILEDHGSPAGEIDDEDKDKDETETVKQTQTSEVYDGPKNVRSDISDQEEDEESEGCPVSINLSKAETQALTNYGSGEDENEDEEMEEFEEGPVDVQTSLQANTEATEENEHDEQVLQRDFKKTAESKNVPLEREATSKNDQNNCPVKPCYLNILEDEQPLNSAAHKESPPTVDSTQQPNPLPLRLPEMEPLVPRVKEVKSAQETPESSLAGSPDTESPVLVNDYEAESGNISQKSDEEDFVKVEDLPLKLTIYSEADLRKKMVEEEQKNHLSGEICEMQTEELAEFSKIFFSSLFTFIYSWVVFRGSSNSVLTYSMHI

SEQ ID NO: 908905 - protein, 1987 aa, Homo sapiens
MATGGGPFEDGMNDQDLPNWSNENVDDRLNNMDWGAQQKKANRSSEKNKKKFGVESDKRVTNDISPESSPGVGRRRTKTPHTFPHSRYMSQMSVPEQAELEKLKQRINFSDLDQRSIGSDSQGRATAANNKRQLSENRKPFNFLPMQINTNKSKDASTSPPNRETIGSAQCKELFASALSNDLLQNCQVSEEDGRGEPAMESSQIVSRLVQIRDYITKASSMREDLVEKNERSANVERLTHLIDHLKEQEKSYMKFLKKILARDPQQEPMEEIENLKKQHDLLKRMLQQQEQLRALQGRQAALLALQHKAEQAIAVMDDSVVAETAGSLSGVSITSELNEELNDLIQRFHNQLRDSQPPAVPDNRRQAESLSLTREVSQSRKPSASERLPDEKVELFSKMRVLQEKKQKMDKLLGELHTLRDQHLNNSSSSPQRSVDQRSTSAPSASVGLAPVVNGESNSLTSSVPYPTASLVSQNESENEGHLNPSEKLQKLNEVRKRLNELRELVHYYEQTSDMMTDAVNENRKDEETEESEYDSEHENSEPVTNIRNPQVASTWNEVNSHSNAQCVSNNRDGRTVNSNCEINNRSAANIRALNVPPSLDCRYNREGEQEIHVAQGEDDEEEEEEAEEEGVSGASLSSHRSSLVDEHPEDAEFEQKINRLMAAKQKLRQLQDLVAMVQDDDAAQGVISASASNLDDFYPAEEDTKQNSNNTRGNANKTQKDTGVNEKAREKFYEAKLQQQQRELKQLQEERKKLIDIQEKIQALQTACPDLQLSAASVGNCPTKKYMPAVTSTPTVNQHETSTSKSVFEPEDSSIVDNELWSEMRRHEMLREELRQRRKQLEALMAEHQRRQGLAETASPVAVSLRSDGSENLCTPQQSRTEKTMATWGGSTQCALDEEGDEDGYLSEGIVRTDEEEEEEQDASSNDNFSVCPSNSVNHNSYNRKETKNTWKNNCPFSADENYRPLAKTRQQNISMQRQENLRWVSELSYVEEKEQWQEQINQLKKQLDFSVSICQTLMQDQQTLSCLLQTLLTGPYSVMPSNVASPQVHFIMHQLNQCYTQLTWQQNNVQRLKQMLNELMRQQNQHPEKPGGKERGSSASHPPSPSLFCPFSFPTQPVNLFNIPGFTNFSSFAPGMNFSPLFPSNFGDFSQNISTPSEQQQPLAQNSSGKTEYMAFPKPFESSSSIGAEKPRNKKLPEEEVESSRTPWLYEQEGEVEKPFIKTGFSVSVEKSTSSNRKNQLDTNGRRRQFDEESLESFSSMPDPVDPTTVTKTFKTRKASAQASLASKDKTPKSKSKKRNSTQLKSRVKNIRYESASMSSTCEPCKSRNRHSAQTEEPVQAKVFSRKNHEQLEKIIKCNRSTEISSETGSDFSMFEALRDTIYSEVATLISQNESRPHFLIELFHELQLLNTDYLRQRALYALQDIVSRHISESHEKGENVKSVNSGTWIASNSELTPSESLATTDDETFEKNFERETHKISEQNDADNASVLSVSSNFEPFATDDLGNTVIHLDQALARMREYERMKTEAESNSNMRCICRIIEDGDGAGAETPVIENRSSQQPVSEVSTIPCPRIDTQQLDRQIKAIMKEVIPFLKEHMDEVCSSQLLTSVRRMVLTLTQQNDESKEFVKFFHKQLGSILQDSLAKFAGRKLKDCGEDLLVEISEVLFNELAFFKLMQDLDNNSITVKQRCKRKIEATGVIQSCAKEAKRILEDHGSPAGEIDDEDKDKDETETVKQTQTSEVYDGPKNVRSDISDQEEDEESEGCPVSINLSKAETQALTNYGSGEDENEDEEMEEFEEGPVDVQTSLQANTEATEENEHDEQVLQRDFKKTAESKNVPLEREATSKNDQNNCPVKPCYLNILEDEQPLNSAAHKESPPTVDSTQQPNPLPLRLPEMEPLVPRVKEVKSAQETPESSLAGSPDTESPVLVNDYEAESGNISQKSDEVEDLPLKLTIYSEADLRKKMVEEEQKNHVKCRPKN

SEQ ID NO: 908906 - protein, 1971 aa, Homo sapiens
MATGGGPFEDGMNDQDLPNWSNENVDDRLNNMDWGAQQKKANRSSEKNKKKFGVESDKRVTNDISPESSPGVGRRRTKTPHTFPHSRYMSQMSVPEQAELEKLKQRINFSDLDQRSIGSDSQGRATAANNKRQLSENRKPFNFLPMQINTNKSKDASTSPPNRETIGSAQCKELFASALSNDLLQNCQVSEEDGRGEPAMESSQIVSRLVQIRDYITKASSMREDLVEKNERSANVERLTHLIDHLKEQEKSYMKFLKKILARDPQQEPMEEIENLKKQHDLLKRMLQQQEQLRALQGRQAALLALQHKAEQAIAVMDDSVVAETAGSLSGVSITSELNEELNDLIQRFHNQLRDSQPPAVPDNRRQAESLSLTREVSQSRKPSASERLPDEKVELFSKMRVLQEKKQKMDKLLGELHTLRDQHLNNSSSSPQRSVDQRSTSAPSASVGLAPVVNGESNSLTSSVPYPTASLVSQNESENEGHLNPSEKLQKLNEVRKRLNELRELVHYYEQTSDMMTDAVNENRKDEETEESEYDSEHENSEPVTNIRNPQVASTWNEVNSHSNAQCVSNNRDGRTVNSNCEINNRSAANIRALNVPPSLDCRYNREGEQEIHVAQGEDDEEEEEEAEEEGVSGASLSSHRSSLVDEHPEDAEFEQKINRLMAAKQKLRQLQDLVAMVQDDDAAQGVISASASNLDDFYPAEEDTKQNSNNTRGNANKTQKDTGVNEKAREKFYEAKLQQQQRELKQLQEERKKLIDIQEKIQALQTACPDLQLSAASVGNCPTKKYMPAVTSTPTVNQHETSTSKSVFEPEDSSIVDNELWSEMRRHEMLREELRQRRKQLEALMAEHQRRQGLAETASPVAVSLRSDGSENLCTPQQSRTEKTMATWGGSTQCALDEEGDEDGYLSEGIVRTDEEEEEEQDASSNDNFSVCPSNSVNHNSYNRKETKNTWKNNCPFSADENYRPLAKTRQQNISMQRQENLRWVSELSYVEEKEQWQEQINQLKKQLDFSVSICQTLMQDQQTLSCLLQTLLTGPYSVMPSNVASPQVHFIMHQLNQCYTQLTWQQNNVQRLKQMLNELMRQQNQHPEKPGGKERGSSASHPPSPSLFCPFSFPTQPVNLFNIPGFTNFSSFAPGMNFSPLFPSNFGDFSQNISTPSEQQQPLAQNSSGKTEYMAFPKPFESSSSIGAEKPRNKKLPEEEVESSRTPWLYEQEGEVEKPFIKTGFSVSVEKSTSSNRKNQLDTNGRRRQFDEESLESFSSMPDPVDPTTVTKTFKTRKASAQASLASKDKTPKSKSKKRNSTQLKSRVKNIRYESASMSSTCEPCKSRNRHSAQTEEPVQAKVFSRKNHEQLEKIIKCNRSTEISSETGSDFSMFEALRDTIYSEVATLISQNESRPHFLIELFHELQLLNTDYLRQRALYALQDIVSRHISESHEKGENVKSVNSGTWIASNSELTPSESLATTDDETFEKNFERETHKISEQNDADNASVLSVSSNFEPFATDDLGNTVIHLDQALARMREYERMKTEAESNSNMRCICRIIEDGDGAGAETPVIENRSSQQPVSEVSTIPCPRIDTQQLDRQIKAIMKEVIPFLKEHMDEVCSSQLLTSVRRMVLTLTQQNDESKEFVKFFHKQLGSILQDSLAKFAGRKLKDCGEDLLVEISEVLFNELAFFKLMQDLDNNSITVKQRCKRKIEATGVIQSCAKEAKRILEDHGSPAGEIDDEDKDKDETETVKQTQTSEVYDGPKNVRSDISDQEEDEESEGCPVSINLSKAETQALTNYGSGEDENEDEEMEEFEEGPVDVQTSLQANTEATEENEHDEQVLQRDFKKTAESKNVPLEREATSKNDQNNCPVKPCYLNILEDEQPLNSAAHKESPPTVDSTQQPNPLPLRLPEMEPLVPRVKEVKSAQETPESSLAGSPDTESPVLVNDYICLLQFGVRVGFERDPLWPLEASRNQAKGVHC

SEQ ID NO: 908907 - protein, 114 aa, Homo sapiens [sequence omitted]

SEQ ID NO: 908908 - protein, 1472 aa, Homo sapiens
MATGGGPFEDGMNDQDLPNWSNENVDDRLNNMDWGAQQKKANRSSEKNKKKFGVESDKRVTNDISPESSPGVGRRRTKTPHTFPHSRYMSQMSVPEQAELEKLKQRINFSDLDQRSIGSDSQGRATAANNKRQLSENRKPFNFLPMQINTNKSKDASTSPPNRETIGSAQCKELFASALSNDLLQNCQVSEEDGRGEPAMESSQIVSRLVQIRDYITKASSMREDLVEKNERSANVERLTHLIDHLKEQEKSYMKFLKKILARDPQQEPMEEIENLKKQHDLLKRMLQQQEQLRALQGRQAALLALQHKAEQAIAVMDDSVVAETAGSLSGVSITSELNEELNDLIQRFHNQLRDSQPPAVPDNRRQAESLSLTREVSQSRKPSASERLPDEKVELFSKMRVLQEKKQKMDKLLGELHTLRDQHLNNSSSSPQRSVDQRSTSAPSASVGLAPVVNGESNSLTSSVPYPTASLVSQNESENEGHLNPSEKLQKLNEVRKRLNELRELVHYYEQTSDMMTDAVNENRKDEETEESEYDSEHENSEPVTNIRNPQVASTWNEVNSHSNAQCVSNNRDGRTVNSNCEINNRSAANIRALNVPPSLDCRYNREGEQEIHVAQGEDDEEEEEEAEEEGVSGASLSSHRSSLVDEHPEDAEFEQKINRLMAAKQKLRQLQDLVAMVQDDDAAQGVISASASNLDDFYPAEEDTKQNSNNTRGNANKTQKDTGVNEKAREKFYEAKLQQQQRELKQLQEERKKLIDIQEKIQALQTACPDLQLSAASVGNCPTKKYMPAVTSTPTVNQHETSTSKSVFEPEDSSIVDNELWSEMRRHEMLREELRQRRKQLEALMAEHQRRQGLAETASPVAVSLRSDGSENLCTPQQSRTEKTMATWGGSTQCALDEEGDEDGYLSEGIVRTDEEEEEEQDASSNDNFSVCPSNSVNHNSYNRKETKNTWKNNCPFSADENYRPLAKTRQQNISMQRQENLRWVSELSYVEEKEQWQEQINQLKKQLDFSVSICQTLMQDQQTLSCLLQTLLTGPYSVMPSNVASPQVHFIMHQLNQCYTQLTWQQNNVQRLKQMLNELMRQQNQHPEKPGGKERGSSASHPPSPSLFCPFSFPTQPVNLFNIPGFTNFSSFAPGMNFSPLFPSNFGDFSQNISTPSEQQQPLAQNSSGKTEYMAFPKPFESSSSIGAEKPRNKKLPEEEVESSRTPWLYEQEGEVEKPFIKTGFSVSVEKSTSSNRKNQLDTNGRRRQFDEESLESFSSMPDPVDPTTVTKTFKTRKASAQASLASKDKTPKSKSKKRNSTQLKSRVKNIRYESASMSSTCEPCKSRNRHSAQTEEPVQAKVFSRKNHEQLEKIIKCNRSTEISSETGSDFSMFEALRDTIYSEVATLISQNESRPHFLIELFHELQLLNTDYLRQRALYALQDIVSRHISESHEKGENVKSVNSGTWIASNSELTPSESLATTDDVS

SEQ ID NO: 908909 - protein, 530 aa, Homo sapiens
MATGGGPFEDGMNDQDLPNWSNENVDDRLNNMDWGAQQKKANRSSEKNKKKFGVESDKRVTNDISPESSPGVGRRRTKTPHTFPHSRYMSQMSVPEQAELEKLKQRINFSDLDQRSIGSDSQGRATAANNKRQLSENRKPFNFLPMQINTNKSKDASTSPPNRETIGSAQCKELFASALSNDLLQNCQVSEEDGRGEPAMESSQIVSRLVQIRDYITKASSMREDLVEKNERSANVERLTHLIDHLKEQEKSYMKFLKKILARENEEEDVRTIDSAVGSGSVAESTSLNIDVQSEASDTTARDPQQEPMEEIENLKKQHDLLKRMLQQQEQLRALQGRQAALLALQHKAEQAIAVMDDSVVAETAGSLSGVSITSELNEELNDLIQRFHNQLRDSQPPAVPDNRRQAESLSLTREVSQSRKPSASERLPDEKVELFSKMRVLQEKKQKMDKLLGELHTLRDQHLNNSSSSPQRSVDQRSTSAPSASVGLAPVVNGESNSLTSSVPYPTASLVSQNESENEGHLNPSEKLQ

SEQ ID NO: 908910 - protein, 2024 aa, Homo sapiens
MATGGGPFEDGMNDQDLPNWSNENVDDRLNNMDWGAQQKKANRSSEKNKKKFGVESDKRVTNDISPESSPGVGRRRTKTPHTFPHSRYMSQMSVPEQAELEKLKQRINFSDLDQRSIGSDSQGRATAANNKRQLSENRKPFNFLPMQINTNKSKDASTSPPNRETIGSAQCKELFASALSNDLLQNCQVSEEDGRGEPAMESSQIVSRLVQIRDYITKASSMREDLVEKNERSANVERLTHLIDHLKEQEKSYMKFLKKILARDPQQEPMEEIENLKKQHDLLKRMLQQQEQLRALQGRQAALLALQHKAEQAIAVMDDSVVAETAGSLSGVSITSELNEELNDLIQRFHNQLRDSQPPAVPDNRRQAESLSLTREVSQSRKPSASERLPDEKVELFSKMRVLQEKKQKMDKLLGELHTLRDQHLNNSSSSPQRSVDQRSTSAPSASVGLAPVVNGESNSLTSSVPYPTASLVSQNESENEGHLNPSEKLQKLNEVRKRLNELRELVHYYEQTSDMMTDAVNENRKDEETEESEYDSEHENSEPVTNIRNPQVASTWNEVNSHSNAQCVSNNRDGRTVNSNCEINNRSAANIRALNVPPSLDCRYNREGEQEIHVAQGEDDEEEEEEAEEEGVSGASLSSHRSSLVDEHPEDAEFEQKINRLMAAKQKLRQLQDLVAMVQDDDAAQGVISASASNLDDFYPAEEDTKQNSNNTRGNANKTQKDTGVNEKAREKFYEAKLQQQQRELKQLQEERKKLIDIQEKIQALQTACPDLQLSAASVGNCPTKKYMPAVTSTPTVNQHETSTSKSVFEPEDSSIVDNELWSEMRRHEMLREELRQRRKQLEALMAEHQRRQGLAETASPVAVSLRSDGSENLCTPQQSRTEKTMATWGGSTQCALDEEGDEDGYLSEGIVRTDEEEEEEQDASSNDNFSVCPSNSVNHNSYNRKETKNTWKNNCPFSADENYRPLAKTRQQNISMQRQENLRWVSELSYVEEKEQWQEQINQLKKQLDFSVSICQTLMQDQQTLSCLLQTLLTGPYSVMPSNVASPQVHFIMHQLNQCYTQLTWQQNNVQRLKQMLNELMRQQNQHPEKPGGKERGSSASHPPSPSLFCPFSFPTQPVNLFNIPGFTNFSSFAPGMNFSPLFPSNFGDFSQNISTPSEQQQPLAQNSSGKTEYMAFPKPFESSSSIGAEKPRNKKLPEEEVESSRTPWLYEQEGEVEKPFIKTGFSVSVEKSTSSNRKNQLDTNGRRRQFDEESLESFSSMPDPVDPTTVTKTFKTRKASAQASLASKDKTPKSKSKKRNSTQLKSRVKNIRYESASMSSTCEPCKSRNRHSAQTEEPVQAKVFSRKNHEQLEKIIKCNRSTEISSETGSDFSMFEALRDTIYSEVATLISQNESRPHFLIELFHELQLLNTDYLRQRALYALQDIVSRHISESHEKGENVKSVNSGTWIASNSELTPSESLATTDDETFEKNFERETHKISEQNDADNASVLSVSSNFEPFATDDLGNTVIHLDQALARMREYERMKTEAESNSNMRCICRIIEDGDGAGAGTTVNNLEETPVIENRSSQQPVSEVSTIPCPRIDTQQLDRQIKAIMKEVIPFLKEHMDEVCSSQLLTSVRRMVLTLTQQNDESKEFVKFFHKQLGSILQDSLAKFAGRKLKDCGEDLLVEISEVLFNELAFFKLMQDLDNNSITVKQRCKRKIEATGVIQSCAKEAKRILEDHGSPAGEIDDEDKDKDETETVKQTQTSEVYDGPKNVRSDISDQEEDEESEGCPVSINLSKAETQALTNYGSGEDENEDEEMEEFEEGPVDVQTSLQANTEATEENEHDEQVLQRDFKKTAESKNVPLEREATSKNDQNNCPVKPCYLNILEDEQPLNSAAHKESPPTVDSTQQPNPLPLRLPEMEPLVPRVKEVKSAQETPESSLAGSPDTESPVLVNDYEAESGNISQKSDEEDFVKVEDLPLKLTIYSEADLRKKMVEEEQKNHLSGEICEMQTEELAGNSETLKEPETVGAQSI

SEQ ID NO: 908911 - protein, 114 aa, Homo sapiens
FAAASTRVENIKTGSDFSMFEALRDTIYSEVATLISQNESRPHFLIELFHELQLLNTDYLRQRALYALQDIVSRHISESHEKGENVKSVNSGTWIASNSELTPSESLATTDDVS

SEQ ID NO: 908912 - protein, 1961 aa, Homo sapiens
MATGGGPFEDGMNDQDLPNWSNENVDDRLNNMDWGAQQKKANRSSEKNKKKFGVESDKRVTNDISPESSPGVGRRRTKTPHTFPHSRYMSQMSVPEQAELEKLKQRINFSDLDQRSIGSDSQGRATAANNKRQLSENRKPFNFLPMQINTNKSKDASTSPPNRETIGSAQCKELFASALSNDLLQNCQVSEEDGRGEPAMESSQIVSRLVQIRDYITKASSMREDLVEKNERSANVERLTHLIDHLKEQEKSYMKFLKKILARDPQQEPMEEIENLKKQHDLLKRMLQQQEQLRALQGRQAALLALQHKAEQAIAVMDDSVVAETAGSLSGVSITSELNEELNDLIQRFHNQLRDSQPPAVPDNRRQAESLSLTREVSQSRKPSASERLPDEKVELFSKMRVLQEKKQKMDKLLGELHTLRDQHLNNSSSSPQRSVDQRSTSAPSASVGLAPVVNGESNSLTSSVPYPTASLVSQNESENEGHLNPSEKLQKLNEVRKRLNELRELVHYYEQTSDMMTDAVNENRKDEETEESEYDSEHENSEPVTNIRNPQVASTWNEVNSHSNAQCVSNNRDGRTVNSNCEINNRSAANIRALNVPPSLDCRYNREGEQEIHVAQGEDDEEEEEEAEEEGVSGASLSSHRSSLVDEHPEDAEFEQKINRLMAAKQKLRQLQDLVAMVQDDDAAQGVISASASNLDDFYPAEEDTKQNSNNTRGNANKTQKDTGVNEKAREKFYEAKLQQQQRELKQLQEERKKLIDIQEKIQALQTACPDLQLSAASVGNCPTKKYMPAVTSTPTVNQHETSTSKSVFEPEDSSIVDNELWSEMRRHEMLREELRQRRKQLEALMAEHQRRQGLAETASPVAVSLRSDGSENLCTPQQSRTEKTMATWGGSTQCALDEEGDEDGYLSEGIVRTDEEEEEEQDASSNDNFSVCPSNSVNHNSYNRKETKNTWKNNCPFSADENYRPLAKTRQQNISMQRQENLRWVSELSYVEEKEQWQEQINQLKKQLDFSVSICQTLMQDQQTLSCLLQTLLTGPYSVMPSNVASPQVHFIMHQLNQCYTQLTWQQNNVQRLKQMLNELMRQQNQHPEKPGGKERGSSASHPPSPSLFCPFSFPTQPVNLFNIPGFTNFSSFAPGMNFSPLFPSNFGDFSQNISTPSEQQQPLAQNSSGKTEYMAFPKPFESSSSIGAEKPRNKKLPEEEVESSRTPWLYEQEGEVEKPFIKTGFSVSVEKSTSSNRKNQLDTNGRRRQFDEESLESFSSMPDPVDPTTVTKTFKTRKASAQASLASKDKTPKSKSKKRNSTQLKSRVKNIKTGSDFSMFEALRDTIYSEVATLISQNESRPHFLIELFHELQLLNTDYLRQRALYALQDIVSRHISESHEKGENVKSVNSGTWIASNSELTPSESLATTDDETFEKNFERETHKISEQNDADNASVLSVSSNFEPFATDDLGNTVIHLDQALARMREYERMKTEAESNSNMRCICRIIEDGDGAGAETPVIENRSSQQPVSEVSTIPCPRIDTQQLDRQIKAIMKEVIPFLKEHMDEVCSSQLLTSVRRMVLTLTQQNDESKEFVKFFHKQLGSILQDSLAKFAGRKLKDCGEDLLVEISEVLFNELAFFKLMQDLDNNSITVKQRCKRKIEATGVIQSCAKEAKRILEDHGSPAGEIDDEDKDKDETETVKQTQTSEVYDGPKNVRSDISDQEEDEESEGCPVSINLSKAETQALTNYGSGEDENEDEEMEEFEEGPVDVQTSLQANTEATEENEHDEQVLQRDFKKTAESKNVPLEREATSKNDQNNCPVKPCYLNILEDEQPLNSAAHKESPPTVDSTQQPNPLPLRLPEMEPLVPRVKEVKSAQETPESSLAGSPDTESPVLVNDYEAESGNISQKSDEEDFVKVEDLPLKLTIYSEADLRKKMVEEEQKNHLSGEICEMQTEELAGNSETLKEPETVGAQSI

SEQ ID NO: 908913 - protein, 1295 aa, Homo sapiens
ALDDPPDFTMSSKRCGNLKQQQRELKQLQEERKKLIDIQEKIQALQTACPDLQLSAASVGNCPTKKYMPAVTSTPTVNQHETSTSKSVFEPEDSSIVDNELWSEMRRHEMLREELRQRRKQLEALMAEHQRRQGLAETASPVAVSLRSDGSENLCTPQQSRTEKTMATWGGSTQCALDEEGDEDGYLSEGIVRTDEEEEEEQDASSNDNFSVCPSNSVNHNSYNRKETKNTWKNNCPFSADENYRPLAKTRQQNISMQRQENLRWVSELSYVEEKEQWQEQINQLKKQLDFSVSICQTLMQDQQTLSCLLQTLLTGPYSVMPSNVASPQVHFIMHQLNQCYTQLTWQQNNVQRLKQMLNELMRQQNQHPEKPGGKERGSSASHPPSPSLFCPFSFPTQPVNLFNIPGFTNFSSFAPGMNFSPLFPSNFGDFSQNISTPSEQQQPLAQNSSGKTEYMAFPKPFESSSSIGAEKPRNKKLPEEEVESSRTPWLYEQEGEVEKPFIKTGFSVSVEKSTSSNRKNQLDTNGRRRQFDEESLESFSSMPDPVDPTTVTKTFKTRKASAQASLASKDKTPKSKSKKRNSTQLKSRVKNIRYESASMSSTCEPCKSRNRHSAQTEEPVQAKVFSRKNHEQLEKIIKCNRSTEISSETGSDFSMFEALRDTIYSEVATLISQNESRPHFLIELFHELQLLNTDYLRQRALYALQDIVSRHISESHEKGENVKSVNSGTWIASNSELTPSESLATTDDETFEKNFERETHKISEQNDADNASVLSVSSNFEPFATDDLGNTVIHLDQALARMREYERMKTEAESNSNMRCICRIIEDGDGAGAETPVIENRSSQQPVSEVSTIPCPRIDTQQLDRQIKAIMKEVIPFLKEHMDEVCSSQLLTSVRRMVLTLTQQNDESKEFVKFFHKQLGSILQDSLAKFAGRKLKDCGEDLLVEISEVLFNELAFFKLMQDLDNNSITVKQRCKRKIEATGVIQSCAKEAKRILEDHGSPAGEIDDEDKDKDETETVKQTQTSEVYDGPKNVRSDISDQEEDEESEGCPVSINLSKAETQALTNYGSGEDENEDEEMEEFEEGPVDVQTSLQANTEATEENEHDEQVLQRDFKKTAESKNVPLEREATSKNDQNNCPVKPCYLNILEDEQPLNSAAHKESPPTVDSTQQPNPLPLRLPEMEPLVPRVKEVKSAQETPESSLAGSPDTESPVLVNDYEAESGNISQKSDEEDFVKVEDLPLKLTIYSEADLRKKMVEEEQKNHLSGEICEMQTEELAGNSETLKEPETVGAQSI

SEQ ID NO: 908914 - protein, 1906 aa, Homo sapiens
MATGGGPFEDGMNDQDLPNWSNENVDDRLNNMDWGAQQKKANRSSEKNKKKFGVESDKRVTNDISPESSPGVGRRRTKTPHTFPHSRYMSQMSVPEQAELEKLKQRINFSDLDQRSIGSDSQGRATAANNKRQLSENRKPFNFLPMQINTNKSKDASTSPPNRETIGSAQCKELFASALSNDLLQNCQVSEEDGRGEPAMESSQIVSRLVQIRDYITKASSMREDLVEKNERSANVERLTHLIDHLKEQEKSYMKFLKKILARDPQQEPMEEIENLKKQHDLLKRMLQQQEQLRALQGRQAALLALQHKAEQAIAVMDDSVVAETAGSLSGVSITSELNEELNDLIQRFHNQLRDSQPPAVPDNRRQAESLSLTREVSQSRKPSASERLPDEKVELFSKMRVLQEKKQKMDKLLGELHTLRDQHLNNSSSSPQRSVDQRSTSAPSASVGLAPVVNGESNSLTSSVPYPTASLVSQNESENEGHLNPSEKLQKLNEVRKRLNELRELVHYYEQTSDMMTDAVNENRKDEETEESEYDSEHENSEPVTNIRNPQVASTWNEVNSHSNAQCVSNNRDGRTVNSNCEINNRSAANIRALNVPPSLDCRYNREGEQEIHVAQGEDDEEEEEEAEEEGVSGASLSSHRSSLVDEHPEDAEFEQKINRLMAAKQKLRQLQDLVAMVQDDDAAQGVISASASNLDDFYPAEEDTKQNSNNTRGNANKTQKDTGVNEKAREKFYEAKLQQQQRELKQLQEERKKLIDIQEKIQALQTACPDLQLSAASVGNCPTKKYMPAVTSTPTVNQHETSTSKSVFEPEDSSIVDNELWSEMRRHEMLREELRQRRKQLEALMAEHQRRQGLAETASPVAVSLRSDGSENLCTPQQSRTEKTMATWGGSTQCALDEEGDEDGYLSEGIVRTDEEEEEEQDASSNDNFSVCPSNSVNHNSYNRKETKNTWKNNCPFSADENYRPLAKTRQQNISMQRQENLRWVSELSYVEEKEQWQEQINQLKKQLDFSVSICQTLMQDQQTLSCLLQTLLTGPYSVMPSNVASPQVHFIMHQLNQCYTQLTWQQNNVQRLKQMLNELMRQQNQHPEKPGGKERGSSASHPPSPSLFCPFSFPTQPVNLFNIPGFTNFSSFAPGMNFSPLFPSNFGDFSQNISTPSEQQQPLAQNSSGKTEYMAFPKPFESSSSIGAEKPRNKKLPEEEVESSRTPWLYEQEGEVEKPFIKTGFSVSVEKSTSSNRKNQLDTNGRRRQFDEESLESFSSMPDPVDPTTVTKTFKTRKASAQASLASKDKTPKSKSKKRNSTQLKSRVKNIRYESASMSSTCEPCKSRNRHSAQTEEPVQAKVFSRKNHEQLEKIIKCNRSTEISSETGSDFSMFEALRDTIYSEVATLISQNESRPHFLIELFHELQLLNTDYLRQRALYALQDIVSRHISESHEKGENVKSVNSGTWIASNSELTPSESLATTDDETFEKNFERETHKISEQNDADNASVLSVSSNFEPFATDDLGNTVIHLDQALARMREYERMKTEAESNSNMRCICRIIEDGDGAGAETPVIENRSSQQPVSEVSTIPCPRIDTQQLDRQIKAIMKEVIPFLKEHMDEVCSSQLLTSVRRMVLTLTQQNDESKEFVKFFHKQLGSILQDSLAKFAGRKLKDCGEDLLVEISEVLFNELAFFKLMQDLDNNSITVKQRCKRKIEATGVIQSCAKEAKRILEDHGSPAGEIDDEDKDKDETETVKQTQTSEVYDGPKNVRSDISDQEEDEESEGCPVSINLSKAETQALTNYGSGEDENEDEEMEEFEEGPVDVQTSLQANTEATEENEHDEQEAESGNISQKSDEEDFVKVEDLPLKLTIYSEADLRKKMVEEEQKNHLSGEICEMQTEELAGNSETLKEPETVGAQSI

SEQ ID NO: 908915 - protein, 1952 aa, Homo sapiens
MATGGGPFEDGMNDQDLPNWSNENVDDRLNNMDWGAQQKKANRSSEKNKKKFGVESDKRVTNDISPESSPGVGRRRTKTPHTFPHSRYMSQMSVPEQAELEKLKQRINFSDLDQRSIGSDSQGRATAANNKRQLSENRKPFNFLPMQINTNKSKDASTSPPNRETIGSAQCKELFASALSNDLLQNCQVSEEDGRGEPAMESSQIVSRLVQIRDYITKASSMREDLVEKNERSANVERLTHLIDHLKEQEKSYMKFLKKILARDPQQEPMEEIENLKKQHDLLKRMLQQQEQLRALQGRQAALLALQHKAEQAIAVMDDSVVAETAGSLSGVSITSELNEELNDLIQRFHNQLRDSQPPAVPDNRRQAESLSLTREVSQSRKPSASERLPDEKVELFSKMRVLQEKKQKMDKLLGELHTLRDQHLNNSSSSPQRSVDQRSTSAPSASVGLAPVVNGESNSLTSSVPYPTASLVSQNESENEGHLNPSEKLQKLNEVRKRLNELRELVHYYEQTSDMMTDAVNENRKDEETEESEYDSEHENSEPVTNIRNPQVASTWNEVNSHSNAQCVSNNRDGRTVNSNCEINNRSAANIRALNVPPSLDCRYNREGEQEIHVAQGEDDEEEEEEAEEEGVSGASLSSHRSSLVDEHPEDAEFEQKINRLMAAKQKLRQLQDLVAMVQDDDAAQGVISASASNLDDFYPAEEDTKQNSNNTRGNANKTQKDTGVNEKAREKFYEAKLQQQQRELKQLQEERKKLIDIQEKIQALQTACPDLQLSAASVGNCPTKKYMPAVTSTPTVNQHETSTSKSVFEPEDSSIVDNELWSEMRRHEMLREELRQRRKQLEALMAEHQRRQGLAETASPVAVSLRSDGSENLCTPQQSRTEKTMATWGGSTQCALDEEGDEDGYLSEGIVRTDEEEEEEQDASSNDNFSVCPSNSVNHNSYNRKETKNTWKNNCPFSADENYRPLAKTRQQNISMQRQENLRWVSELSYVEEKEQWQEQINQLKKQLDFSVSICQTLMQDQQTLSCLLQTLLTGPYSVMPSNVASPQVHFIMHQLNQCYTQLTWQQNNVQRLKQMLNELMRQQNQHPEKPGGKERGSSASHPPSPSLFCPFSFPTQPVNLFNIPGFTNFSSFAPGMNFSPLFPSNFGDFSQNISTPSEQQQPLAQNSSGKTEYMAFPKPFESSSSIGAEKPRNKKLPEEEVESSRTPWLYEQEGEVEKPFIKTGFSVSVEKSTSSNRKNQLDTNGRRRQFDEESLESFSSMPDPVDPTTVTKTFKTRKASAQASLASKDKTPKSKSKKRNSTQLKSRVKNIRYESASMSSTCEPCKSRNRHSAQTEEPVQAKVFSRKNHEQLEKIIKCNRSTEISSETGSDFSMFEALRDTIYSEVATLISQNESRPHFLIELFHELQLLNTDYLRQRALYALQDIVSRHISESHEKGENVKSVNSGTWIASNSELTPSESLATTDDETFEKNFERETHKISEQNDADNASVLSVSSNFEPFATDDLGNTVIHLDQALARMREYERMKTEAESNSNMRCICRIIEDGDGAGAETPVIENRSSQQPVSEVSTIPCPRIDTQQLDRQIKAIMKEVIPFLKEHMDEVCSSQLLTSVRRMVLTLTQQNDESKEFVKFFHKQLGSILQDSLAKFAGRKLKDCGEDLLVEISEVLFNELAFFKLMQDLDNNSITVKQRCKRKIEATGVIQSCAKEAKRILEDHGSPAGEIDDEDKDKDETETVKQTQTSEVYDGPKNVRSDISDQEEDEESEGCPVSINLSKAETQALTNYGSGEDENEDEEMEEFEEGPVDVQTSLQANTEATEENEHDEQVLQRDFKKTAESKNVPLEREATSKNDQNNCPVKPCYLNILEDEQPLNSAAHKESPPTVDSTQQPNPLPLRLPEMEPLVPRVKEVKSAQETPESSLAGSPDTESPVLVNDYVCIIYISKYFYFS

SEQ ID NO: 908916 - protein, 1956 aa, Homo sapiens
MATGGGPFEDGMNDQDLPNWSNENVDDRLNNMDWGAQQKKANRSSEKNKKKFGVESDKRVTNDISPESSPGVGRRRTKTPHTFPHSRYMSQMSVPEQAELEKLKQRINFSDLDQRSIGSDSQGRATAANNKRQLSENRKPFNFLPMQINTNKSKDASTSPPNRETIGSAQCKELFASALSNDLLQNCQVSEEDGRGEPAMESSQIVSRLVQIRDYITKASSMREDLVEKNERSANVERLTHLIDHLKEQEKSYMKFLKKILARDPQQEPMEEIENLKKQHDLLKRMLQQQEQLRALQGRQAALLALQHKAEQAIAVMDDSVVAETAGSLSGVSITSELNEELNDLIQRFHNQLRDSQPPAVPDNRRQAESLSLTREVSQSRKPSASERLPDEKVELFSKMRVLQEKKQKMDKLLGELHTLRDQHLNNSSSSPQRSVDQRSTSAPSASVGLAPVVNGESNSLTSSVPYPTASLVSQNESENEGHLNPSEKLQKLNEVRKRLNELRELVHYYEQTSDMMTDAVNENRKDEETEESEYDSEHENSEPVTNIRNPQVASTWNEVNSHSNAQCVSNNRDGRTVNSNCEINNRSAANIRALNVPPSLDCRYNREGEQEIHVAQGEDDEEEEEEAEEEGVSGASLSSHRSSLVDEHPEDAEFEQKINRLMAAKQKLRQLQDLVAMVQDDDAAQGVISASASNLDDFYPAEEDTKQNSNNTRGNANKTQKDTGVNEKAREKFYEAKLQQQQRELKQLQEERKKLIDIQEKIQALQTACPDLQLSAASVGNCPTKKYMPAVTSTPTVNQHETSTSKSVFEPEDSSIVDNELWSEMRRHEMLREELRQRRKQLEALMAEHQRRQGLAETASPVAVSLRSDGSENLCTPQQSRTEKTMATWGGSTQCALDEEGDEDGYLSEGIVRTDEEEEEEQDASSNDNFSVCPSNSVNHNSYNRKETKNTWKNNCPFSADENYRPLAKTRQQNISMQRQENLRWVSELSYVEEKEQWQEQINQLKKQLDFSVSICQTLMQDQQTLSCLLQTLLTGPYSVMPSNVASPQVHFIMHQLNQCYTQLTWQQNNVQRLKQMLNELMRQQNQHPEKPGGKERGSSASHPPSPSLFCPFSFPTQPVNLFNIPGFTNFSSFAPGMNFSPLFPSNFGDFSQNISTPSEQQQPLAQNSSGKTEYMAFPKPFESSSSIGAEKPRNKKLPEEEVESSRTPWLYEQEGEVEKPFIKTGFSVSVEKSTSSNRKNQLDTNGRRRQFDEESLESFSSMPDPVDPTTVTKTFKTRKASAQASLASKDKTPKSKSKKRNSTQLKSRVKNIRYESASMSSTCEPCKSRNRHSAQTEEPVQAKVFSRKNHEQLEKIIKCNRSTEISSETGSDFSMFEALRDTIYSEVATLISQNESRPHFLIELFHELQLLNTDYLRQRALYALQDIVSRHISESHEKGENVKSVNSGTWIASNSELTPSESLATTDDETFEKNFERETHKISEQNDADNASVLSVSSNFEPFATDDLGNTVIHLDQALARMREYERMKTEAESNSNMRCICRIIEDGDGAGAETPVIENRSSQQPVSEVSTIPCPRIDTQQLDRQIKAIMKEVIPFLKEHMDEVCSSQLLTSVRRMVLTLTQQNDESKEFVKFFHKQLGSILQDSLAKFAGRKLKDCGEDLLVEISEVLFNELAFFKLMQDLDNNSITVKQRCKRKIEATGVIQSCAKEAKRILEDHGSPAGEIDDEDKDKDETETVKQTQTSEVYDGPKNVRSDISDQEEDEESEGCPVSINLSKAETQALTNYGSGEDENEDEEMEEFEEGPVDVQTSLQANTEATEENEHDEQVLQRDFKKTAESKNVPLEREATSKNDQNNCPVKPCYLNILEDEQPLNSAAHKESPPTVDSTQQPNPLPLRLPEMEPLVPRVKEVKSAQETPESSLAGSPDTESPVLVNDYKQNLVIKVKSSVEPSGS

SEQ ID NO: 908917 - protein, 1491 aa, Homo sapiens
MATGGGPFEDGMNDQDLPNWSNENVDDRLNNMDWGAQQKKANRSSEKNKKKFGVESDKRVTNDISPESSPGVGRRRTKTPHTFPHSRYMSQMSVPEQAELEKLKQRINFSDLDQRSIGSDSQGRATAANNKRQLSENRKPFNFLPMQINTNKSKDASTSPPNRETIGSAQCKELFASALSNDLLQNCQVSEEDGRGEPAMESSQIVSRLVQIRDYITKASSMREDLVEKNERSANVERLTHLIDHLKEQEKSYMKFLKKILARDPQQEPMEEIENLKKQHDLLKRMLQQQEQLRALQGRQAALLALQHKAEQAIAVMDDSVVAETAGSLSGVSITSELNEELNDLIQRFHNQLRDSQPPAVPDNRRQAESLSLTREVSQSRKPSASERLPDEKVELFSKMRVLQEKKQKMDKLLGELHTLRDQHLNNSSSSPQRSVDQRSTSAPSASVGLAPVVNGESNSLTSSVPYPTASLVSQNESENEGHLNPSEKLQKLNEVRKRLNELRELVHYYEQTSDMMTDAVNENRKDEETEESEYDSEHENSEPVTNIRNPQVASTWNEVNSHSNAQCVSNNRDGRTVNSNCEINNRSAANIRALNVPPSLDCRYNREGEQEIHVAQGEDDEEEEEEAEEEGVSGASLSSHRSSLVDEHPEDAEFEQKINRLMAAKQKLRQLQDLVAMVQDDDAAQGVISASASNLDDFYPAEEDTKQNSNNTRGNANKTQKDTGVNEKAREKFYEAKLQQQQRELKQLQEERKKLIDIQEKIQALQTACPDLQLSAASVGNCPTKKYMPAVTSTPTVNQHETSTSKSVFEPEDSSIVDNELWSEMRRHEMLREELRQRRKQLEALMAEHQRRQGLAETASPVAVSLRSDGSENLCTPQQSRTEKTMATWGGSTQCALDEEGDEDGYLSEGIVRTDEEEEEEQDASSNDNFSVCPSNSVNHNSYNRKETKNTWKNNCPFSADENYRPLAKTRQQNISMQRQENLRWVSELSYVEEKEQWQEQINQLKKQLDFSVSICQTLMQDQQTLSCLLQTLLTGPYSVMPSNVASPQVHFIMHQLNQCYTQLTWQQNNVQRLKQMLNELMRQQNQHPEKPGGKERGSSASHPPSPSLFCPFSFPTQPVNLFNIPGFTNFSSFAPGMNFSPLFPSNFGDFSQNISTPSEQQQPLAQNSSGKTEYMAFPKPFESSSSIGAEKPRNKKLPEEEVESSRTPWLYEQEGEVEKPFIKTGFSVSVEKSTSSNRKNQLDTNGRRRQFDEESLESFSSMPDPVDPTTVTKTFKTRKASAQASLASKDKTPKSKSKKRNSTQLKSRVKNIRYESASMSSTCEPCKSRNRHSAQTEEPVQAKVFSRKNHEQLEKIIKCNRSTEISSAHARRILQQSNRNACNEAPETGSDFSMFEALRDTIYSEVATLISQNESRPHFLIELFHELQLLNTDYLRQRALYALQDIVSRHISESHEKGENVKSVNSGTWIASNSELTPSESLATTDDVS

SEQ ID NO: 908918 - protein, 311 aa, Homo sapiens
MATGGGPFEDGMNDQDLPNWSNENVDDRLNNMDWGAQQKKANRSSEKNKKKFGVESDKRVTNDISPESSPGVGRRRTKTPHTFPHSRYMSQMSVPEQAELEKLKQRINFSDLDQRSIGSDSQGRATAANNKRQLSENRKPFNFLPMQINTNKSKDASTSPPNRETIGSAQCKELFASALSNDLLQNCQVSEEDGRGEPAMESSQIVSRLVQIRDYITKASSMREDLVEKNERSANVERLTHLIDHLKEQEKSYMKFLKKILARDPQQEPMEEIENLKKQHDLLKRMLQQQEQLKPTEEALVNKARLLSINS

SEQ ID NO: 908919 - protein, 85 aa, Homo sapiens
SPALQDIRHQAKLIKHKKGIVNEQFLLQRLADGAIDLYAMVVVLSRASRSLSEGHPTAQHEKMLCDTWCIEAAARIREGHGRPAV

SEQ ID NO: 908920 - protein, 683 aa, Homo sapiens
GLQGTTAPSMPRGPQPSAARCTVDDESGLGAPGRGRAGRGRAGRQSWVRARASGARRDSEMQAARMAASLGRQLLRLGGGSSRLTALLGQPRPGPARRPYAGGAAQLALDKSDSHPSDALTRKKPAKAESKSFAVGMFKGQLTTDQVFPYPSVLNEEQTQFLKELVEPVSRFFEEVNDPAKNDALEMVEETTWQGLKELGAFGLQVPSELGGVGLCNTQYARLVEIVGMHDLGVGITLGAHQSIGFKGILLFGTKAQKEKYLPKLASGETVAAFCLTEPSSGSDAASIRTSAVPSPCGKYYTLNGSKLWISNGGLADIFTVFAKTPVTDPATGAVKEKITAFVVERGFGGITHGPPEKKMGIKASNTAEVFFDGVRVPSENVLGEVGSGFKVAMHILNNGRFGMAAALAGTMRGIIAKAVDHATNRTQFGEKIHNFGLIQEKLARMVMLQYVTESMAYMVSANMDQGATDFQIEAAISKIFGSEAAWKVTDECIQIMGGMGFMKEPGVERVLRDLRIFRIFEGTNDILRLFVALQGCMDKGKELSGLGSALKNPFGNAGLLLGEAGKQLRRRAGLGSGLSLSGLVHPELSRSGELAVRALEQFATVVEAKLIKHKKGIVNEQFLLQRLADGAIDLYAMVVVLSRASRSLSEGHPTAQHEKMLCDTWCIEAAARIREGHGRPAV

SEQ ID NO: 908921 - protein, 146 aa, Homo sapiens
MDKGKELSGLGSALKNPFGNAGLLLGEAGKQLRRRAGLGSGLSLSGLVHPELSRSGELAVRALEQFATVVEAKLIKHKKGIVNEQFLLQRLADGAIDLYAMVVVLSRASRSLSEGHPTAQHEKMLCDTWCIEAAARIREGHGRPAV

SEQ ID NO: 908922 - protein, 146 aa, Homo sapiens; identical to SEQ ID NO: 908921

SEQ ID NO: 908923 - protein, 143 aa, Homo sapiens
RLCLSAQIISRPWRLSTFLELERKKFPCHVTTDQVCHISRSVASTNLCTHPGIPINESSRERSTDIASLYKEVNDPAKNDALEMVEETTWQGLKELGAFGLQVPSELGGVGLCNTQVRAPYRHIPVCHTPAWQTQLFCHRPRD

SEQ ID NO: 908924 - protein, 146 aa, Homo sapiens; identical to SEQ ID NO: 908921

SEQ ID NO: 908925 - protein, 143 aa, Homo sapiens; identical to SEQ ID NO: 908923

SEQ ID NO: 908926 - protein, 143 aa, Homo sapiens; identical to SEQ ID NO: 908923

SEQ ID NO: 908927 - protein, 146 aa, Homo sapiens; identical to SEQ ID NO: 908921

SEQ ID NO: 908928 - protein, 107 aa, Homo sapiens
MDKGKELSGLGSALKNPFGNAGLLLGEAGKQLRRRAGLGSGLSLSGLVHPELSRSGELAVRALEQFATVVEAKLIKHKKGIVNEQFLLQRLADGAIDLYAMVVVLSR

SEQ ID NO: 908929 - protein, 143 aa, Homo sapiens; identical to SEQ ID NO: 908923

SEQ ID NO: 908930 - protein, 136 aa, Homo sapiens
MDKGKELSGLGSALKNPFGNAGLLLGEAGKQLRRRAGLGSGLSLSGLVHPELSRSGELAVRALEQFATVVEAKLIKHKKGIVNEQFLLQRLADGAIDLYAMVVVLSRASRSLSEGHPTAQHEAAARIREGHGRPAV

SEQ ID NO: 908931 - protein, 146 aa, Homo sapiens; identical to SEQ ID NO: 908921

SEQ ID NO: 908932 - protein, 143 aa, Homo sapiens; identical to SEQ ID NO: 908923

SEQ ID NO: 908933 - protein, 107 aa, Homo sapiens; identical to SEQ ID NO: 908928

SEQ ID NO: 908934 - protein, 165 aa, Homo sapiens
MDKGKELSGLGSALKNPFGNAGLLLGEAGKQLRRRAGLGSGLSLSGLVHPELSRSGELAVRALEQFATVVEAKLIKHKKGIVNEQFLLQRLADGAIDLYAMVVVLSRASRSLSEGHPTAQHEKMLCDTWCIELQLRITRRHARFLSNRALKRVRCSLHPNLFFPS

SEQ ID NO: 908935 - protein, 100 aa, Homo sapiens
MDKGKELSGLGSALKNPFGNAGLLLGEAGKQLRRRAGLGSGLSLSGLVHPELSRSGELAVRALEQFATVVEAKLIKHKKGIVNEQFLLQRRWMQSAALDA

SEQ ID NO: 908936 - protein, 143 aa, Homo sapiens; identical to SEQ ID NO: 908923

SEQ ID NO: 908937 - protein, 143 aa, Homo sapiens; identical to SEQ ID NO: 908923

SEQ ID NO: 908938 - protein, 85 aa, Homo sapiens; identical to SEQ ID NO: 908919

SEQ ID NO: 908939 - protein, 185 aa, Homo sapiens
LVLARDLELGGSAGLYGKGKELSGLGSALKNPFGNAGLLLGEAGKQLRRRAGLGSGLSLSGLVHSEMQAARMAASLGRQLLRLGGGSSRLTALLGQPRPGPARRPYAGGAAQLALDKSDSHPSDALTRKKPAKAESKSFAVGMFKGQLTTDQVFPYPSVLHEEQTQVLKELVVGHQPTWLLSPGR

SEQ ID NO: 908940 - protein, 143 aa, Homo sapiens; identical to SEQ ID NO: 908923

SEQ ID NO: 908941 - protein, 143 aa, Homo sapiens; identical to SEQ ID NO: 908923

SEQ ID NO: 908942 - protein, 146 aa, Homo sapiens; identical to SEQ ID NO: 908921

SEQ ID NO: 908943 - protein, 75 aa, Homo sapiens
YGCENLQKGIVNEQFLLQRLADGAIDLYAMVVVLSRASRSLSEGHPTAQHEKMLCDTWCIEAAARIREGHGRPAV

SEQ ID NO: 908944 - protein, 107 aa, Homo sapiens; identical to SEQ ID NO: 908928

SEQ ID NO: 908945 - protein, 195 aa, Homo sapiens
MHPNHGGYGLHEGFMKEPGVERVLRDLRIFRIFEGTNDILRLFVALQGCMDKGKELSGLGSALKNPFGNAGLLLGEAGKQLRRRAGLGSGLSLSGLVHPELSRSGELAVRALEQFATVVEAKLIKHKKGIVNEQFLLQRLADGAIDLYAMVVVLSRASRSLSEGHPTAQHEKMLCDTWCIEAAARIREGHGRPAV

SEQ ID NO: 908946 - protein, 152 aa, Homo sapiens
MDKGKELSGLGSALKNPFGNAGLLLGEAGKQLRRRAGLGSGLSLSGLVHPELSRSGELAVRALEQFATVVEAKLIKHKKGIVSCSSDPRRAWPPCSLTPGSKSSTATSKASPRPWWSGVVWSPATHLASEYSRPGPVPVMCLPSSQSRSPFP

SEQ ID NO: 908947 - protein, 143 aa, Homo sapiens; identical to SEQ ID NO: 908923

SEQ ID NO: 908948 - protein, 107 aa, Homo sapiens; identical to SEQ ID NO: 908928

SEQ ID NO: 908949 - protein, 143 aa, Homo sapiens; identical to SEQ ID NO: 908923

SEQ ID NO: 908950 - protein, 143 aa, Homo sapiens; identical to SEQ ID NO: 908923

SEQ ID NO: 908951 - protein, 143 aa, Homo sapiens; identical to SEQ ID NO: 908923

SEQ ID NO: 908952 - protein, 76 aa, Homo sapiens
ALEHPPDEEGEEEGSESESRSVKVKIKLGRKEKAQDRLKGGRRRPSRGSRAKPVVSDDDSEEEQEEDRSGSGSEED

SEQ ID NO: 908953 - protein, 1389 aa, Homo sapiens
MSTPDPPLGGTPRPGPSPGPGPSPGAMLGPSPGPSPGSAHSMMGPSPGPPSAGHPIPTQGPGGYPQDNMHQMHKPMESMHEKGMSDDPRYNQMKGMGMRSGGHAGMGPPPSPMDQHSQGYPSPLGGSEHASSPVPASGPSSGPQMSSGPGGAPLDGADPQALGQQNRGPTPFNQNQLHQLRAQIMAYKMLARGQPLPDHLQMAVQGKRPMPGMQQQMPTLPPPSVSATGPGPGPGPGPGPGPGPAPPNYSRPHGMGGPNMPPPGPSGVPPGMPGQPPGGPPKPWPEGPMANAAAPTSTPQKLIPPQPTGRPSPAPPAVPPAASPVMPPQTQSPGQPAQPAPMVPLHQKQSRITPIQKPRGLDPVEILQEREYRLQARIAHRIQELENLPGSLAGDLRTKATIELKALRLLNFQRQLRQEVVVCMRRDTALETALNAKAYKRSKRQSLREARITEKLEKQQKIEQERKRRQKHQEYLNSILQHAKDFKEYHRSVTGKIQKLTKAVATYHANTEREQKKENERIEKERMRRLMAEDEEGYRKLIDQKKDKRLAYLLQQTDEYVANLTELVRQHKAAQVAKEKKKKKKKKKAENAEGQTPAIGPDGEPLDETSQMSDLPVKVIHVESGKILTGTDAPKAGQLEAWLEMNPGYEVAPRSDSEESGSEEEEEEEEEEQPQAAQPPTLPVEEKKKIPDPDSDDVSEVDARHIIENAKQDVDDEYGVSQALARGLQSYYAVAHAVTERVDKQSALMVNGVLKQYQIKGLEWLVSLYNNNLNGILADEMGLGKTIQTIALITYLMEHKRINGPFLIIVPLSTLSNWAYEFDKWAPSVVKVSYKGSPAARRAFVPQLRSGKFNVLLTTYEYIIKDKHILAKIRWKYMIVDEGHRMKNHHCKLTQVLNTHYVAPRRLLLTGTPLQNKLPELWALLNFLLPTIFKSCSTFEQWFNAPFAMTGEKVDLNEEETILIIRRLHKVLRPFLLRRLKKEVEAQLPEKVEYVIKCDMSALQRVLYRHMQAKGVLLTDGSEKDKKGKGGTKTLMNTIMQLRKICNHPYMFQHIEESFSEHLGFTGGIVQGLDLYRASGKFELLDRILPKLRATNHKVLLFCQMTSLMTIMEDYFAYRGFKYLRLDGTTKAEDRGMLLKTFNEPGSEYFIFLLSTRAGGLGLNLQSADTVIIFDSDWNPHQDLQAQDRAHRIGQQNEVRVLRLCTVNSVEEKILAAAKYKLNVDQKVIQAGMFDQKSSSHERRAFLQAILEHEEQDESRHCSTGSGSASFAHTAPPPAGVNPDLEEPPLKEEDEVPDDETVNQMIARHEEEFDLFMRMDLDRRREEARNPKRKPRLMEEDELPSWIIKDDAEVERLTCEEEEEKMFGRGSRHRKEVDYSDSLTEKQWL

SEQ ID NO: 908954 - protein, 1389 aa, Homo sapiens; identical to SEQ ID NO: 908953

SEQ ID NO: 908955 - protein, 1389 aa, Homo sapiens; identical to SEQ ID NO: 908953

SEQ ID NO: 908956 - protein, 1356 aa, Homo sapiens
MSTPDPPLGGTPRPGPSPGPGPSPGAMLGPSPGPSPGSAHSMMGPSPGPPSAGHPIPTQGPGGYPQDNMHQMHKPMESMHEKGMSDDPRYNQMKGMGMRSGGHAGMGPPPSPMDQHSQGYPSPLGGSEHASSPVPASGPSSGPQMSSGPGGAPLDGADPQALGQQNRGPTPFNQNQLHQLRAQIMAYKMLARGQPLPDHLQMAVQGKRPMPGMQQQMPTLPPPSVSATGPGPGPGPGPGPGPGPAPPNYSRPHGMGGPNMPPPGPSGVPPGMPGQPPGGPPKPWPEGPMANAAAPTSTPQKLIPPQPTGRPSPAPPAVPPAASPVMPPQTQSPGQPAQPAPMVPLHQKQSRITPIQKPRGLDPVEILQEREYRLQARIAHRIQELENLPGSLAGDLRTKATIELKALRLLNFQRQLRQEVVVCMRRDTALETALNAKAYKRSKRQSLREARITEKLEKQQKIEQERKRRQKHQEYLNSILQHAKDFKEYHRSVTGKIQKLTKAVATYHANTEREQKKENERIEKERMRRLMAEDEEGYRKLIDQKKDKRLAYLLQQTDEYVANLTELVRQHKAAQVAKEKKKKKKKKKAENAEGQTPAIGPDGEPLDETSQMSDLPVKVIHVESGKILTGTDAPKAGQLEAWLEMNPGYEVAPRSDSEESGSEEEEEEEEEEQPQAAQPPTLPVEEKKKIPDPDSDDVSEVDARHIIENAKQDVDDEYGVSQALARGLQSYYAVAHAVTERVDKQSALMVNGVLKQYQIKGLEWLVSLYNNNLNGILADEMGLGKTIQTIALITYLMEHKRINGPFLIIVPLSTLSNWAYEFDKWAPSVVKVSYKGSPAARRAFVPQLRSGKFNVLLTTYEYIIKDKHILAKIRWKYMIVDEGHRMKNHHCKLTQVLNTHYVAPRRLLLTGTPLQNKLPELWALLNFLLPTIFKSCSTFEQWFNAPFAMTGEKVDLNEEETILIIRRLHKVLRPFLLRRLKKEVEAQLPEKVEYVIKCDMSALQRVLYRHMQAKGVLLTDGSEKDKKGKGGTKTLMNTIMQLRKICNHPYMFQHIEESFSEHLGFTGGIVQGLDLYRASGKFELLDRILPKLRATNHKVLLFCQMTSLMTIMEDYFAYRGFKYLRLDGTTKAEDRGMLLKTFNEPGSEYFIFLLSTRAGGLGLNLQSADTVIIFDSDWNPHQDLQAQDRAHRIGQQNEVRVLRLCTVNSVEEKILAAAKYKLNVDQKVIQAGMFDQKSSSHERRAFLQAILEHEEQDEEEDEVPDDETVNQMIARHEEEFDLFMRMDLDRRREEARNPKRKPRLMEEDELPSWIIKDDAEVERLTCEEEEEKMFGRGSRHRKEVDYSDSLTEKQWL

SEQ ID NO: 908957 - protein, 1497 aa, Homo sapiens
WGRPQCREAVAAAAPAERRGGWGARAAWRPRDPLRARSRRGRRTKLAPLARHPYSRPPNYSGCNNRQALGLFWLRGNGSDPNVAFLAKLRSGLSQTSRYVRRRPDTGISGPLGLADLKCLKNVSFQIFKESRRPLSAAPVKMSTPDPPLGGTPRPGPSPGPGPSPGAMLGPSPGPSPGSAHSMMGPSPGPPSAGHPIPTQGPGGYPQDNMHQMHKPMESMHEKGMSDDPRYNQMKGMGMRSGGHAGMGPPPSPMDQHSQGYPSPLGGSEHASSPVPASGPSSGPQMSSGPGGAPLDGADPQALGQQNRGPTPFNQNQLHQLRAQIMAYKMLARGQPLPDHLQMAVQGKRPMPGMQQQMPTLPPPSVSATGPGPGPGPGPGPGPGPAPPNYSRPHGMGGPNMPPPGPSGVPPGMPGQPPGGPPKPWPEGPMANAAAPTSTPQKLIPPQPTGRPSPAPPAVPPAASPVMPPQTQSPGQPAQPAPMVPLHQKQSRITPIQKPRGLDPVEILQEREYRLQARIAHRIQELENLPGSLAGDLRTKATIELKALRLLNFQRQLRQEVVVCMRRDTALETALNAKAYKRSKRQSLREARITEKLEKQQKIEQERKRRQKHQEYLNSILQHAKDFKEYHRSVTGKIQKLTKAVATYHANTEREQKKENERIEKERMRRLMAEDEEGYRKLIDQKKDKRLAYLLQQTDEYVANLTELVRQHKAAQVAKEKKKKKKKKKAENAEGQTPAIGPDGEPLDETSQMSDLPVKVIHVESGKILTGTDAPKAGQLEAWLEMNPGYEVAPRSDSEESGSEEEEEEEEEEQPQAAQPPTLPVEEKKKIPDPDSDDVSEVDARHIIENAKQDVDDEYGVSQALARGLQSYYAVAHAVTERVDKQSALMVNGVLKQYQIKGLEWLVSLYNNNLNGILADEMGLGKTIQTIALITYLMEHKRINGPFLIIVPLSTLSNWAYEFDKWAPSVVKVSYKGSPAARRAFVPQLRSGKFNVLLTTYEYIIKDKHILAKIRWKYMIVDEGHRMKNHHCKLTQVLNTHYVAPRRLLLTGTPLQNKLPELWALLNFLLPTIFKSCSTFEQWFNAPFAMTGEKVDLNEEETILIIRRLHKVLRPFLLRRLKKEVEAQLPEKVEYVIKCDMSALQRVLYRHMQAKGVLLTDGSEKDKKGKGGTKTLMNTIMQLRKICNHPYMFQHIEESFSEHLGFTGGIVQGLDLYRASGKFELLDRILPKLRATNHKVLLFCQMTSLMTIMEDYFAYRGFKYLRLDGTTKAEDRGMLLKTFNEPGSEYFIFLLSTRAGGLGLNLQSADTVIIFDSDWNPHQDLQAQDRAHRIGQQNEVRVLRLCTVNSVEEKILAAAKYKLNVDQKVIQAGMFDQKSSSHERRAFLQAILEHEEQDEEEDEVPDDETVNQMIARHEEEFDLFMRMDLDRRREEARNPKRKPRLMEEDELPSWIIKDDAEVERLTCEEEEEKMFGRGSRHRKEVDYSDSLTEKQWL

SEQ ID NO: 908958 - protein, 1031 aa, Homo sapiens
MPPQTQSPGQPAQPAPMVPLHQKQSRITPIQKPRGLDPVEILQEREYRLQARIAHRIQELENLPGSLAGDLRTKATIELKALRLLNFQRQLRQEVVVCMRRDTALETALNAKAYKRSKRQSLREARITEKLEKQQKIEQERKRRQKHQEYLNSILQHAKDFKEYHRSVTGKIQKLTKAVATYHANTEREQKKENERIEKERMRRLMAEDEEGYRKLIDQKKDKRLAYLLQQTDEYVANLTELVRQHKAAQVAKEKKKKKKKKKAENAEGQTPAIGPDGEPLDETSQMSDLPVKVIHVESGKILTGTDAPKAGQLEAWLEMNPGYEVAPRSDSEESGSEEEEEEEEEEQPQAAQPPTLPVEEKKKIPDPDSDDVSEVDARHIIENAKQDVDDEYGVSQALARGLQSYYAVAHAVTERVDKQSALMVNGVLKQYQIKGLEWLVSLYNNNLNGILADEMGLGKTIQTIALITYLMEHKRINGPFLIIVPLSTLSNWAYEFDKWAPSVVKVSYKGSPAARRAFVPQLRSGKFNVLLTTYEYIIKDKHILAKIRWKYMIVDEGHRMKNHHCKLTQVLNTHYVAPRRLLLTGTPLQNKLPELWALLNFLLPTIFKSCSTFEQWFNAPFAMTGEKVDLNEEETILIIRRLHKVLRPFLLRRLKKEVEAQLPEKVEYVIKCDMSALQRVLYRHMQAKGVLLTDGSEKDKKGKGGTKTLMNTIMQLRKICNHPYMFQHIEESFSEHLGFTGGIVQGLDLYRASGKFELLDRILPKLRATNHKVLLFCQMTSLMTIMEDYFAYRGFKYLRLDGTTKAEDRGMLLKTFNEPGSEYFIFLLSTRAGGLGLNLQSADTVIIFDSDWNPHQDLQAQDRAHRIGQQNEVRVLRLCTVNSVEEKILAAAKYKLNVDQKVIQAGMFDQKSSSHERRAFLQAILEHEEQDEEEDEVPDDETVNQMIARHEEEFDLFMRMDLDRRREEARNPKRKPRLMEEDELPSWIIKDDAEVERLTCEEEEEKMFGRGSRHRKEVDYSDSLTEKQWL

SEQ ID NO: 908959 - protein, 1004 aa, Homo sapiens
MCTQLITGTRPVEILQEREYRLQARIAHRIQELENLPGSLAGDLRTKATIELKALRLLNFQRQLRQEVVVCMRRDTALETALNAKAYKRSKRQSLREARITEKLEKQQKIEQERKRRQKHQEYLNSILQHAKDFKEYHRSVTGKIQKLTKAVATYHANTEREQKKENERIEKERMRRLMAEDEEGYRKLIDQKKDKRLAYLLQQTDEYVANLTELVRQHKAAQVAKEKKKKKKKKKAENAEGQTPAIGPDGEPLDETSQMSDLPVKVIHVESGKILTGTDAPKAGQLEAWLEMNPGYEVAPRSDSEESGSEEEEEEEEEEQPQAAQPPTLPVEEKKKIPDPDSDDVSEVDARHIIENAKQDVDDEYGVSQALARGLQSYYAVAHAVTERVDKQSALMVNGVLKQYQIKGLEWLVSLYNNNLNGILADEMGLGKTIQTIALITYLMEHKRINGPFLIIVPLSTLSNWAYEFDKWAPSVVKVSYKGSPAARRAFVPQLRSGKFNVLLTTYEYIIKDKHILAKIRWKYMIVDEGHRMKNHHCKLTQVLNTHYVAPRRLLLTGTPLQNKLPELWALLNFLLPTIFKSCSTFEQWFNAPFAMTGEKVDLNEEETILIIRRLHKVLRPFLLRRLKKEVEAQLPEKVEYVIKCDMSALQRVLYRHMQAKGVLLTDGSEKDKKGKGGTKTLMNTIMQLRKICNHPYMFQHIEESFSEHLGFTGGIVQGLDLYRASGKFELLDRILPKLRATNHKVLLFCQMTSLMTIMEDYFAYRGFKYLRLDGTTKAEDRGMLLKTFNEPGSEYFIFLLSTRAGGLGLNLQSADTVIIFDSDWNPHQDLQAQDRAHRIGQQNEVRVLRLCTVNSVEEKILAAAKYKLNVDQKVIQAGMFDQKSSSHERRAFLQAILEHEEQDEEEDEVPDDETVNQMIARHEEEFDLFMRMDLDRRREEARNPKRKPRLMEEDELPSWIIKDDAEVERLTCEEEEEKMFGRGSRHRKEVDYSDSLTEKQWL

SEQ ID NO: 908960 - protein, 1004 aa, Homo sapiens
IRGSHQHWTRPCEILQEREYRLQARIAHRIQELENLPGSLAGDLRTKATIELKALRLLNFQRQLRQEVVVCMRRDTALETALNAKAYKRSKRQSLREARITEKLEKQQKIEQERKRRQKHQEYLNSILQHAKDFKEYHRSVTGKIQKLTKAVATYHANTEREQKKENERIEKERMRRLMAEDEEGYRKLIDQKKDKRLAYLLQQTDEYVANLTELVRQHKAAQVAKEKKKKKKKKKAENAEGQTPAIGPDGEPLDETSQMSDLPVKVIHVESGKILTGTDAPKAGQLEAWLEMNPGYEVAPRSDSEESGSEEEEEEEEEEQPQAAQPPTLPVEEKKKIPDPDSDDVSEVDARHIIENAKQDVDDEYGVSQALARGLQSYYAVAHAVTERVDKQSALMVNGVLKQYQIKGLEWLVSLYNNNLNGILADEMGLGKTIQTIALITYLMEHKRINGPFLIIVPLSTLSNWAYEFDKWAPSVVKVSYKGSPAARRAFVPQLRSGKFNVLLTTYEYIIKDKHILAKIRWKYMIVDEGHRMKNHHCKLTQVLNTHYVAPRRLLLTGTPLQNKLPELWALLNFLLPTIFKSCSTFEQWFNAPFAMTGEKVDLNEEETILIIRRLHKVLRPFLLRRLKKEVEAQLPEKVEYVIKCDMSALQRVLYRHMQAKGVLLTDGSEKDKKGKGGTKTLMNTIMQLRKICNHPYMFQHIEESFSEHLGFTGGIVQGLDLYRASGKFELLDRILPKLRATNHKVLLFCQMTSLMTIMEDYFAYRGFKYLRLDGTTKAEDRGMLLKTFNEPGSEYFIFLLSTRAGGLGLNLQSADTVIIFDSDWNPHQDLQAQDRAHRIGQQNEVRVLRLCTVNSVEEKILAAAKYKLNVDQKVIQAGMFDQKSSSHERRAFLQAILEHEEQDEEEDEVPDDETVNQMIARHEEEFDLFMRMDLDRRREEARNPKRKPRLMEEDELPSWIIKDDAEVERLTCEEEEEKMFGRGSRHRKEVDYSDSLTEKQWL

SEQ ID NO: 908961 - protein, 905 aa, Homo sapiens
MVGLCKKQQKIEQERKRRQKHQEYLNSILQHAKDFKEYHRSVTGKIQKLTKAVATYHANTEREQKKENERIEKERMRRLMAEDEEGYRKLIDQKKDKRLAYLLQQTDEYVANLTELVRQHKAAQVAKEKKKKKKKKKAENAEGQTPAIGPDGEPLDETSQMSDLPVKVIHVESGKILTGTDAPKAGQLEAWLEMNPGYEVAPRSDSEESGSEEEEEEEEEEQPQAAQPPTLPVEEKKKIPDPDSDDVSEVDARHIIENAKQDVDDEYGVSQALARGLQSYYAVAHAVTERVDKQSALMVNGVLKQYQIKGLEWLVSLYNNNLNGILADEMGLGKTIQTIALITYLMEHKRINGPFLIIVPLSTLSNWAYEFDKWAPSVVKVSYKGSPAARRAFVPQLRSGKFNVLLTTYEYIIKDKHILAKIRWKYMIVDEGHRMKNHHCKLTQVLNTHYVAPRRLLLTGTPLQNKLPELWALLNFLLPTIFKSCSTFEQWFNAPFAMTGEKVDLNEEETILIIRRLHKVLRPFLLRRLKKEVEAQLPEKVEYVIKCDMSALQRVLYRHMQAKGVLLTDGSEKDKKGKGGTKTLMNTIMQLRKICNHPYMFQHIEESFSEHLGFTGGIVQGLDLYRASGKFELLDRILPKLRATNHKVLLFCQMTSLMTIMEDYFAYRGFKYLRLDGTTKAEDRGMLLKTFNEPGSEYFIFLLSTRAGGLGLNLQSADTVIIFDSDWNPHQDLQAQDRAHRIGQQNEVRVLRLCTVNSVEEKILAAAKYKLNVDQKVIQAGMFDQKSSSHERRAFLQAILEHEEQDEEEDEVPDDETVNQMIARHEEEFDLFMRMDLDRRREEARNPKRKPRLMEEDELPSWIIKDDAEVERLTCEEEEEKMFGRGSRHRKEVDYSDSLTEKQWL

SEQ ID NO: 908962 - protein, 831 aa, Homo sapiens
GKTNTTARYEAWVVSLLAKKKDKRLAYLLQQTDEYVANLTELVRQHKAAQVAKEKKKKKKKKKAENAEGQTPAIGPDGEPLDETSQMSDLPVKVIHVESGKILTGTDAPKAGQLEAWLEMNPGYEVAPRSDSEESGSEEEEEEEEEEQPQAAQPPTLPVEEKKKIPDPDSDDVSEVDARHIIENAKQDVDDEYGVSQALARGLQSYYAVAHAVTERVDKQSALMVNGVLKQYQIKGLEWLVSLYNNNLNGILADEMGLGKTIQTIALITYLMEHKRINGPFLIIVPLSTLSNWAYEFDKWAPSVVKVSYKGSPAARRAFVPQLRSGKFNVLLTTYEYIIKDKHILAKIRWKYMIVDEGHRMKNHHCKLTQVLNTHYVAPRRLLLTGTPLQNKLPELWALLNFLLPTIFKSCSTFEQWFNAPFAMTGEKVDLNEEETILIIRRLHKVLRPFLLRRLKKEVEAQLPEKVEYVIKCDMSALQRVLYRHMQAKGVLLTDGSEKDKKGKGGTKTLMNTIMQLRKICNHPYMFQHIEESFSEHLGFTGGIVQGLDLYRASGKFELLDRILPKLRATNHKVLLFCQMTSLMTIMEDYFAYRGFKYLRLDGTTKAEDRGMLLKTFNEPGSEYFIFLLSTRAGGLGLNLQSADTVIIFDSDWNPHQDLQAQDRAHRIGQQNEVRVLRLCTVNSVEEKILAAAKYKLNVDQKVIQAGMFDQKSSSHERRAFLQAILEHEEQDEEEDEVPDDETVNQMIARHEEEFDLFMRMDLDRRREEARNPKRKPRLMEEDELPSWIIKDDAEVERLTCEEEEEKMFGRGSRHRKEVDYSDSLTEKQWL

SEQ ID NO: 908963 - protein, 1356 aa, Homo sapiens; identical to SEQ ID NO: 908956

SEQ ID NO: 908964 - protein, 482 aa, Homo sapiens
DAIKDLLIWKKKKKKKKKLTQVLNTHYVAPRRLLLTGTPLQNKLPELWALLNFLLPTIFKSCSTFEQWFNAPFAMTGEKVDLNEEETILIIRRLHKVLRPFLLRRLKKEVEAQLPEKVEYVIKCDMSALQRVLYRHMQAKGVLLTDGSEKDKKGKGGTKTLMNTIMQLRKICNHPYMFQHIEESFSEHLGFTGGIVQGLDLYRASGKFELLDRILPKLRATNHKVLLFCQMTSLMTIMEDYFAYRGFKYLRLDGTTKAEDRGMLLKTFNEPGSEYFIFLLSTRAGGLGLNLQSADTVIIFDSDWNPHQDLQAQDRAHRIGQQNEVRVLRLCTVNSVEEKILAAAKYKLNVDQKVIQAGMFDQKSSSHERRAFLQAILEHEEQDEEEDEVPDDETVNQMIARHEEEFDLFMRMDLDRRREEARNPKRKPRLMEEDELPSWIIKDDAEVERLTCEEEEEKMFGRGSRHRKEVDYSDSLTEKQWL

SEQ ID NO: 908965 - protein, 503 aa, Homo sapiens
GKTNTTARYEAWVVSLLAKIRWKYMIVDEGHRMKNHHCKLTQVLNTHYVAPRRLLLTGTPLQNKLPELWALLNFLLPTIFKSCSTFEQWFNAPFAMTGEKVDLNEEETILIIRRLHKVLRPFLLRRLKKEVEAQLPEKVEYVIKCDMSALQRVLYRHMQAKGVLLTDGSEKDKKGKGGTKTLMNTIMQLRKICNHPYMFQHIEESFSEHLGFTGGIVQGLDLYRASGKFELLDRILPKLRATNHKVLLFCQMTSLMTIMEDYFAYRGFKYLRLDGTTKAEDRGMLLKTFNEPGSEYFIFLLSTRAGGLGLNLQSADTVIIFDSDWNPHQDLQAQDRAHRIGQQNEVRVLRLCTVNSVEEKILAAAKYKLNVDQKVIQAGMFDQKSSSHERRAFLQAILEHEEQDEEEDEVPDDETVNQMIARHEEEFDLFMRMDLDRRREEARNPKRKPRLMEEDELPSWIIKDDAEVERLTCEEEEEKMFGRGSRHRKEVDYSDSLTEKQWL

SEQ ID NO: 908966 - protein, 380 aa, Homo sapiens
MICYNRNSSASFNNHVLGPRYNLSKASTVNVSDSSAMWLRRNFERRKCQSTGKGGTKTLMNTIMQLRKICNHPYMFQHIEESFSEHLGFTGGIVQGLDLYRASGKFELLDRILPKLRATNHKVLLFCQMTSLMTIMEDYFAYRGFKYLRLDGTTKAEDRGMLLKTFNEPGSEYFIFLLSTRAGGLGLNLQSADTVIIFDSDWNPHQDLQAQDRAHRIGQQNEVRVLRLCTVNSVEEKILAAAKYKLNVDQKVIQAGMFDQKSSSHERRAFLQAILEHEEQDEEEDEVPDDETVNQMIARHEEEFDLFMRMDLDRRREEARNPKRKPRLMEEDELPSWIIKDDAEVERLTCEEEEEKMFGRGSRHRKEVDYSDSLTEKQWL

SEQ ID NO: 908967 - protein, 343 aa, Homo sapiens
NLARYEAGVNSAEGGKGGTKTLMNTIMQLRKICNHPYMFQHIEESFSEHLGFTGGIVQGLDLYRASGKFELLDRILPKLRATNHKVLLFCQMTSLMTIMEDYFAYRGFKYLRLDGTTKAEDRGMLLKTFNEPGSEYFIFLLSTRAGGLGLNLQSADTVIIFDSDWNPHQDLQAQDRAHRIGQQNEVRVLRLCTVNSVEEKILAAAKYKLNVDQKVIQAGMFDQKSSSHERRAFLQAILEHEEQDEEEDEVPDDETVNQMIARHEEEFDLFMRMDLDRRREEARNPKRKPRLMEEDELPSWIIKDDAEVERLTCEEEEEKMFGRGSRHRKEVDYSDSLTEKQWL

SEQ ID NO: 908968 - protein, 1303 aa, Homo sapiens
MSTPDPPLGGTPRPGPSPGPGPSPGAMLGPSPGPSPGSAHSMMGPSPGPPSAGHPIPTQGPGGYPQDNMHQMHKPMESMHEKGMSDDPRYNQMKGMGMRSGGHAGMGPPPSPMDQHSQGYPSPLGGSEHASSPVPASGPSSGPQMSSGPGGAPLDGADPQALGQQNRGPTPFNQNQLHQLRAQIMAYKMLARGQPLPDHLQMAVQGKRPMPGMQQQMPTLPPPSVSATGPGPGPGPGPGPGPGPAPPNYSRPHGMGGPNMPPPGPSGVPPGMPGQPPGGPPKPWPEGPMANAAAPTSTPQKLIPPQPTGRPSPAPPAVPPAASPVMPPQTQSPGQPAQPAPMVPLHQKQSRITPIQKPRGLDPVEILQEREYRLQARIAHRIQELENLPGSLAGDLRTKATIELKALRLLNFQRQLRQEVVVCMRRDTALETALNAKAYKRSKRQSLREARITEKLEKQQKIEQERKRRQKHQEYLNSILQHAKDFKEYHRSVTGKIQKLTKAVATYHANTEREQKKENERIEKERMRRLMAEDEEGYRKLIDQKKDKRLAYLLQQTDEYVANLTELVRQHKAAQVAKEKKKKKKKKKAENAEGQTPAIGPDGEPLDETSQMSDLPVKVIHVESGKILTGTDAPKAGQLEAWLEMNPGYEVAPRSDSEESGSEEEEEEEEEEQPQAAQPPTLPVEEKKKIPDPDSDDVSEVDARHIIENAKQDVDDEYGVSQALARGLQSYYAVAHAVTERVDKQSALMVNGVLKQYQIKGLEWLVSLYNNNLNGILADEMGLGKTIQTIALITYLMEHKRINGPFLIIVPLSTLSNWAYEFDKWAPSVVKVSYKGSPAARRAFVPQLRSGKFNVLLTTYEYIIKDKHILAKIRWKYMIVDEGHRMKNHHCKLTQVLNTHYVAPRRLLLTGTPLQNKLPELWALLNFLLPTIFKSCSTFEQWFNAPFAMTGEKVDLNEEETILIIRRLHKVLRPFLLRRLKKEVEAQLPEKVEYVIKCDMSALQRVLYRHMQAKGVLLTDGSEKDKKGKGGTKTLMNTIMQLRKICNHPYMFQHIEESFSEHLGFTGGIVQGLDLYRASGKFELLDRILPKLRATNHKVLLFCQMTSLMTIMEDYFAYRGFKYLRLDGTTKAEDRGMLLKTFNEPGSEYFIFLLSTRAGGLGLNLQSADTVIIFDSDWNPHQDLQAQDRAHRIGQQNEVRVLRLCTVNSVEEKILAAAKYKLNVDQKVIQAGMFDQKSSSHERRAFLQAILEHEEQDEEEDEVPDDETVNQMIARHEEEFDLFMRMDLERMARRRPAPQLGIL

SEQ ID NO: 908969 - protein, 1282 aa, Homo sapiens
MSTPDPPLGGTPRPGPSPGPGPSPGAMLGPSPGPSPGSAHSMMGPSPGPPSAGHPIPTQGPGGYPQDNMHQMHKPMESMHEKGMSDDPRYNQMKGMGMRSGGHAGMGPPPSPMDQHSQGYPSPLGGSEHASSPVPASGPSSGPQMSSGPGGAPLDGADPQALGQQNRGPTPFNQNQLHQLRAQIMAYKMLARGQPLPDHLQMAVQGKRPMPGMQQQMPTLPPPSVSATGPGPGPGPGPGPGPGPAPPNYSRPHGMGGPNMPPPGPSGVPPGMPGQPPGGPPKPWPEGPMANAAAPTSTPQKLIPPQPTGRPSPAPPAVPPAASPVMPPQTQSPGQPAQPAPMVPLHQKQSRITPIQKPRGLDPVEILQEREYRLQARIAHRIQELENLPGSLAGDLRTKATIELKALRLLNFQRQLRQEVVVCMRRDTALETALNAKAYKRSKRQSLREARITEKLEKQQKIEQERKRRQKHQEYLNSILQHAKDFKEYHRSVTGKIQKLTKAVATYHANTEREQKKENERIEKERMRRLMAEDEEGYRKLIDQKKDKRLAYLLQQTDEYVANLTELVRQHKAAQVAKEKKKKKKKKKAENAEGQTPAIGPDGEPLDETSQMSDLPVKVIHVESGKILTGTDAPKAGQLEAWLEMNPGYEVAPRSDSEESGSEEEEEEEEEEQPQAAQPPTLPVEEKKKIPDPDSDDVSEVDARHIIENAKQDVDDEYGVSQALARGLQSYYAVAHAVTERVDKQSALMVNGVLKQYQIKGLEWLVSLYNNNLNGILADEMGLGKTIQTIALITYLMEHKRINGPFLIIVPLSTLSNWAYEFDKWAPSVVKVSYKGSPAARRAFVPQLRSGKFNVLLTTYEYIIKDKHILAKIRWKYMIVDEGHRMKNHHCKLTQVLNTHYVAPRRLLLTGTPLQNKLPELWALLNFLLPTIFKSCSTFEQWFNAPFAMTGEKVDLNEEETILIIRRLHKVLRPFLLRRLKKEVEAQLPEKVEYVIKCDMSALQRVLYRHMQAKGVLLTDGSEKDKKGKGGTKTLMNTIMQLRKICNHPYMFQHIEESFSEHLGFTGGIVQGLDLYRASGKFELLDRILPKLRATNHKVLLFCQMTSLMTIMEDYFAYRGFKYLRLDGTTKAEDRGMLLKTFNEPGSEYFIFLLSTRAGGLGLNLQSADTVIIFDSDWNPHQDLQAQDRAHRIGQQNEVRVLRLCTVNSVEEKILAAAKYKLNVDQKVIQAGMFDQKSSSHERRAFLQAILEHEEQDELYLAAARIFSSTLLTVQRRSTRTS

SEQ ID NO: 908970 - protein, 186 aa, Homo sapiens
MKKIVDAVIKYKDSSSGRQLSEVFIQLPSRKELPEYYELIRKPVDFKKIKERIRNHKYRSLNDLEKDVMLLCQNAQTFNLEGSLIYEDSIVLQSVFTSVRQKIEKEDDSEGEESEEEEEGEEEGSESESRSVKVKIKLGRKEKAQDRLKGGRRRPSRGSRAKPVVSDDDSEEEQEEDRSGSGSEED

SEQ ID NO: 908971 - protein, 283 aa, Homo sapiens
MTQPAVWHVGYNSSVAFSSAHVRQRKAIEEGTLEEIEEEVRQKKSSRKRKRDSDAGSSTPTTSTRSRDKDDESKKQKKRGRPPAEKLSPNPPNLTKKMKKIVDAVIKYKDSSSGRQLSEVFIQLPSRKELPEYYELIRKPVDFKKIKERIRNHKYRSLNDLEKDVMLLCQNAQTFNLEGSLIYEDSIVLQSVFTSVRQKIEKEDDSEGEESEEEEEGEEEGSESESRSVKVKIKLGRKEKAQDRLKGGRRRPSRGSRAKPVVSDDDSEEEQEEDRSGSGSEED

SEQ ID NO: 908972 - protein, 708 aa, Homo sapiens
MSTPDPPLGGTPRPGPSPGPGPSPGAMLGPSPGPSPGSAHSMMGPSPGPPSAGHPIPTQGPGGYPQDNMHQMHKPMESMHEKGMSDDPRYNQMKGMGMRSGGHAGMGPPPSPMDQHSQGYPSPLGGSEHASSPVPASGPSSGPQMSSGPGGAPLDGADPQALGQQNRGPTPFNQNQLHQLRAQIMAYKMLARGQPLPDHLQMAVQGKRPMPGMQQQMPTLPPPSVSATGPGPGPGPGPGPGPGPAPPNYSRPHGMGGPNMPPPGPSGVPPGMPGQPPGGPPKPWPEGPMANAAAPTSTPQKLIPPQPTGRPSPAPPAVPPAASPVMPPQTQSPGQPAQPAPMVPLHQKQSRITPIQKPRGLDPVEILQEREYRLQARIAHRIQELENLPGSLAGDLRTKATIELKALRLLNFQRQLRQEVVVCMRRDTALETALNAKAYKRSKRQSLREARITEKLEKQQKIEQERKRRQKHQEYLNSILQHAKDFKEYHRSVTGKIQKLTKAVATYHANTEREQKKENERIEKERMRRLMAEDEEGYRKLIDQKKDKRLAYLLQQTDEYVANLTELVRQHKAAQVAKEKKKKKKKKKAENAEGQTPAIGPDGEPLDETSQMSDLPVKVIHVESGKILTGTDAPKAGQLEAWLEMNPGYEVAPRSDSEESGSEEEEEEEEEEQPQAAQPPTLPVEEKKKIPDPDSDDVSEVDARHIIE

SEQ ID NO: 908973 - protein, 51 aa, Homo sapiens
MCPLQVEYVIKCDMSALQRVLYRHMQAKGVLLTDGSEKDKKVGPRVPQLHS

SEQ ID NO: 908974 - protein, 284 aa, Homo sapiens
NLARYEAGVNSAEGPSPGAMLGPSPGPSPGSAHSMMGPSPGPPSAGHPIPTQGPGGYPQDNMHQMHKPMESMHEKGMSDDPRYNQMKGMGMRSGGHAGMGPPPSPMDQHSQGYPSPLGGSEHASSPVPASGPSSGPQMSSGPGGAPLDGADPQALGQQNRGPTPFNQNQLHQLRAQIMAYKMLARGQPLPDHLQMAVQGKRPMPGMQQQMPTLPPPSVSATGPGPGPGPGPGPGPGPAPPNYSRPHGMGGPNASPGPRALPRMQAALEGSSLLRPGMLCPSLKF

SEQ ID NO: 908975 - protein, 1356 aa, Homo sapiens; identical to SEQ ID NO: 908956

SEQ ID NO: 908976 - protein, 1356 aa, Homo sapiens; identical to SEQ ID NO: 908956

SEQ ID NO: 908977 - protein, 1356 aa, Homo sapiens; identical to SEQ ID NO: 908956

SEQ ID NO: 908978 - protein, 1234 aa, Homo sapiens
MSTPDPPLGGTPRPGPSPGPGPSPGAMLGPSPGPSPGSAHSMMGPSPGPPSAGHPIPTQGPGGYPQDNMHQMHKPMESMHEKGMSDDPRYNQMKGMGMRSGGHAGMGPPPSPMDQHSQGYPSPLGGSEHASSPVPASGPSSGPQMSSGPGGAPLDGADPQALGQQNRGPTPFNQNQLHQLRAQIMAYKMLARGQPLPDHLQMAVQGKRPMPGMQQQMPTLPPPSVSATGPGPGPGPGPGPGPGPAPPNYSRPHGMGGPNMPPPGPSGVPPGMPGQPPGGPPKPWPEGPMANAAAPTSTPQKLIPPQPTGRPSPAPPAVPPAASPVMPPQTQSPGQPAQPAPMVPLHQKQSRITPIQKPRGLDPVEILQEREYRLQARIAHRIQELENLPGSLAGDLRTKATIELKALRLLNFQRQLRQEVVVCMRRDTALETALNAKAYKRSKRQSLREARITEKLEKQQKIEQERKRRQKHQEYLNSILQHAKDFKEYHRSVTGKIQKLTKAVATYHANTEREQKKENERIEKERMRRLMAEDEEGYRKLIDQKKDKRLAYLLQQTDEYVANLTELVRQHKAAQVAKEKKKKKKKKKAENAEGQTPAIGPDGEPLDETSQMSDLPVKVIHVESGKILTGTDAPKAGQLEAWLEMNPGYEVAPRSDSEESGSEEEEEEEEEEQPQAAQPPTLPVEEKKKIPDPDSDDVSEVDARHIIENAKQDVDDEYGVSQALARGLQSYYAVAHAVTERVDKQSALMVNGVLKQYQIKGLEWLVSLYNNNLNGILADEMGLGKTIQTIALITYLMEHKRINGPFLIIVPLSTLSNWAYEFDKWAPSVVKVSYKGSPAARRAFVPQLRSGKFNVLLTTYEYIIKDKHILAKIRWKYMIVDEGHRMKNHHCKLTQVLNTHYVAPRRLLLTGTPLQNKLPELWALLNFLLPTIFKSCSTFEQWFNAPFAMTGEKVDLNEEETILIIRRLHKVLRPFLLRRLKKEVEAQLPEKVEYVIKCDMSALQRVLYRHMQAKGVLLTDGSEKDKKGKGGTKTLMNTIMQLRKICNHPYMFQHIEESFSEHLGFTGGIVQGLDLYRASGKFELLDRILPKLRATNHKVLLFCQMTSLMTIMEDYFAYRGFKYLRLDGTTKAEDRGMLLKTFNEPGSEYFIFLLSTRAGGLGLNLQSADTVIIFDSDWNPHQDLQAQDRAHRIGQQNEVERLTCEEEEEKMFGRGSRHRKEVDYSDSLTEKQWL

SEQ ID NO: 908979 - protein, 830 aa, Homo sapiens
MRRLMAEDEEGYRKLIDQKKDKRLAYLLQQTDEYVANLTELVRQHKAAQVAKEKKKKKKKKKAENAEGQTPAIGPDGEPLDETSQMSDLPVKVIHVESGKILTGTDAPKAGQLEAWLEMNPGYEVAPRSDSEESGSEEEEEEEEEEQPQAAQPPTLPVEEKKKIPDPDSDDVSEVDARHIIENAKQDVDDEYGVSQALARGLQSYYAVAHAVTERVDKQSALMVNGVLKQYQIKGLEWLVSLYNNNLNGILADEMGLGKTIQTIALITYLMEHKRINGPFLIIVPLSTLSNWAYEFDKWAPSVVKVSYKGSPAARRAFVPQLRSGKFNVLLTTYEYIIKDKHILAKIRWKYMIVDEGHRMKNHHCKLTQVLNTHYVAPRRLLLTGTPLQNKLPELWALLNFLLPTIFKSCSTFEQWFNAPFAMTGEKVDLNEEETILIIRRLHKVLRPFLLRRLKKEVEAQLPEKVEYVIKCDMSALQRVLYRHMQAKGVLLTDGSEKDKKGKGGTKTLMNTIMQLRKICNHPYMFQHIEESFSEHLGFTGGIVQGLDLYRASGKFELLDRILPKLRATNHKVLLFCQMTSLMTIMEDYFAYRGFKYLRLDGTTKAEDRGMLLKTFNEPGSEYFIFLLSTRAGGLGLNLQSADTVIIFDSDWNPHQDLQAQDRAHRIGQQNEVRVLRLCTVNSVEEKILAAAKYKLNVDQKVIQAGMFDQKSSSHERRAFLQAILEHEEQDEEEDEVPDDETVNQMIARHEEEFDLFMRMDLDRRREEARNPKRKPRLMEEDELPSWIIKDDAEVERLTCEEEEEKMFGRGSRHRKEVDYSDSLTEKQWL

SEQ ID NO: 908980 - protein, 846 aa, Homo sapiens
AAAYYYYYCSEFKLLTMYGDMAEDEEGYRKLIDQKKDKRLAYLLQQTDEYVANLTELVRQHKAAQVAKEKKKKKKKKKAENAEGQTPAIGPDGEPLDETSQMSDLPVKVIHVESGKILTGTDAPKAGQLEAWLEMNPGYEVAPRSDSEESGSEEEEEEEEEEQPQAAQPPTLPVEEKKKIPDPDSDDVSEVDARHIIENAKQDVDDEYGVSQALARGLQSYYAVAHAVTERVDKQSALMVNGVLKQYQIKGLEWLVSLYNNNLNGILADEMGLGKTIQTIALITYLMEHKRINGPFLIIVPLSTLSNWAYEFDKWAPSVVKVSYKGSPAARRAFVPQLRSGKFNVLLTTYEYIIKDKHILAKIRWKYMIVDEGHRMKNHHCKLTQVLNTHYVAPRRLLLTGTPLQNKLPELWALLNFLLPTIFKSCSTFEQWFNAPFAMTGEKVDLNEEETILIIRRLHKVLRPFLLRRLKKEVEAQLPEKVEYVIKCDMSALQRVLYRHMQAKGVLLTDGSEKDKKGKGGTKTLMNTIMQLRKICNHPYMFQHIEESFSEHLGFTGGIVQGLDLYRASGKFELLDRILPKLRATNHKVLLFCQMTSLMTIMEDYFAYRGFKYLRLDGTTKAEDRGMLLKTFNEPGSEYFIFLLSTRAGGLGLNLQSADTVIIFDSDWNPHQDLQAQDRAHRIGQQNEVRVLRLCTVNSVEEKILAAAKYKLNVDQKVIQAGMFDQKSSSHERRAFLQAILEHEEQDEEEDEVPDDETVNQMIARHEEEFDLFMRMDLDRRREEARNPKRKPRLMEEDELPSWIIKDDAEVERLTCEEEEEKMFGRGSRHRKEVDYSDSLTEKQWL

SEQ ID NO: 908981 - protein, 768 aa, Homo sapiens
MACREDTIDHKRCLLVHSLSDSMGHGIVGLQATCMSGKILTGTDAPKAGQLEAWLEMNPGYEVAPRSDSEESGSEEEEEEEEEEQPQAAQPPTLPVEEKKKIPDPDSDDVSEVDARHIIENAKQDVDDEYGVSQALARGLQSYYAVAHAVTERVDKQSALMVNGVLKQYQIKGLEWLVSLYNNNLNGILADEMGLGKTIQTIALITYLMEHKRINGPFLIIVPLSTLSNWAYEFDKWAPSVVKVSYKGSPAARRAFVPQLRSGKFNVLLTTYEYIIKDKHILAKIRWKYMIVDEGHRMKNHHCKLTQVLNTHYVAPRRLLLTGTPLQNKLPELWALLNFLLPTIFKSCSTFEQWFNAPFAMTGEKVDLNEEETILIIRRLHKVLRPFLLRRLKKEVEAQLPEKVEYVIKCDMSALQRVLYRHMQAKGVLLTDGSEKDKKGKGGTKTLMNTIMQLRKICNHPYMFQHIEESFSEHLGFTGGIVQGLDLYRASGKFELLDRILPKLRATNHKVLLFCQMTSLMTIMEDYFAYRGFKYLRLDGTTKAEDRGMLLKTFNEPGSEYFIFLLSTRAGGLGLNLQSADTVIIFDSDWNPHQDLQAQDRAHRIGQQNEVRVLRLCTVNSVEEKILAAAKYKLNVDQKVIQAGMFDQKSSSHERRAFLQAILEHEEQDEEEDEVPDDETVNQMIARHEEEFDLFMRMDLDRRREEARNPKRKPRLMEEDELPSWIIKDDAEVERLTCEEEEEKMFGRGSRHRKEVDYSDSLTEKQWL

SEQ ID NO: 908982 - protein, 564 aa, Homo sapiens
MHMQLLLCREEIYTCCPGWSRTLSNWAYEFDKWAPSVVKVSYKGSPAARRAFVPQLRSGKFNVLLTTYEYIIKDKHILAKIRWKYMIVDEGHRMKNHHCKLTQVLNTHYVAPRRLLLTGTPLQNKLPELWALLNFLLPTIFKSCSTFEQWFNAPFAMTGEKVDLNEEETILIIRRLHKVLRPFLLRRLKKEVEAQLPEKVEYVIKCDMSALQRVLYRHMQAKGVLLTDGSEKDKKGKGGTKTLMNTIMQLRKICNHPYMFQHIEESFSEHLGFTGGIVQGLDLYRASGKFELLDRILPKLRATNHKVLLFCQMTSLMTIMEDYFAYRGFKYLRLDGTTKAEDRGMLLKTFNEPGSEYFIFLLSTRAGGLGLNLQSADTVIIFDSDWNPHQDLQAQDRAHRIGQQNEVRVLRLCTVNSVEEKILAAAKYKLNVDQKVIQAGMFDQKSSSHERRAFLQAILEHEEQDEEEDEVPDDETVNQMIARHEEEFDLFMRMDLDRRREEARNPKRKPRLMEEDELPSWIIKDDAEVERLTCEEEEEKMFGRGSRHRKEVDYSDSLTEKQWL

SEQ ID NO: 908983 - protein, 1356 aa, Homo sapiens; identical to SEQ ID NO: 908956

SEQ ID NO: 908984 - protein, 340 aa, Homo sapiens
PYMFQHIEEWLQIFRSCMMVFIRLLVRKICNHPYMFQHIEESFSEHLGFTGGIVQGLDLYRASGKFELLDRILPKLRATNHKVLLFCQMTSLMTIMEDYFAYRGFKYLRLDGTTKAEDRGMLLKTFNEPGSEYFIFLLSTRAGGLGLNLQSADTVIIFDSDWNPHQDLQAQDRAHRIGQQNEVRVLRLCTVNSVEEKILAAAKYKLNVDQKVIQAGMFDQKSSSHERRAFLQAILEHEEQDEEEDEVPDDETVNQMIARHEEEFDLFMRMDLDRRREEARNPKRKPRLMEEDELPSWIIKDDAEVERLTCEEEEEKMFGRGSRHRKEVDYSDSLTEKQWL

SEQ ID NO: 908985 - protein, 1340 aa, Homo sapiens
MSTPDPPLGGTPRPGPSPGPGPSPGAMLGPSPGPSPGSAHSMMGPSPGPPSAGHPIPTQGPGGYPQDNMHQMHKPMESMHEKGMSDDPRYNQMKGMGMRSGGHAGMGPPPSPMDQHSQGYPSPLGGSEHASSPVPASGPSSGPQMSSGPGGAPLDGADPQALGQQNRGPTPFNQNQLHQLRAQIMAYKMLARGQPLPDHLQMAVQGKRPMPGMQQQMPTLPPPSVSATGPGPGPGPGPGPGPGPAPPNYSRPHGMGGPNMPPPGPSGVPPGMPGQPPGGPPKPWPEGPMANAAAPTSTPQKLIPPQPTGRPSPAPPAVPPAASPVMPPQTQSPGQPAQPAPMVPLHQKQSRITPIQKPRGLDPVEILQEREYRLQARIAHRIQELENLPGSLAGDLRTKATIELKALRLLNFQRQLRQEVVVCMRRDTALETALNAKAYKRSKRQSLREARITEKLEKQQKIEQERKRRQKHQEYLNSILQHAKDFKEYHRSVTGKIQKLTKAVATYHANTEREQKKENERIEKERMRRLMAEDEEGYRKLIDQKKDKRLAYLLQQTDEYVANLTELVRQHKAAQVAKEKKKKKKKKKAENAEGQTPAIGPDGEPLDETSQMSDLPVKVIHVESGKILTGTDAPKAGQLEAWLEMNPGYEVAPRSDSEESGSEEEEEEEEEEQPQAAQPPTLPVEEKKKIPDPDSDDVSEVDARHIIENAKQDVDDEYGVSQALARGLQSYYAVAHAVTERVDKQSALMVNGVLKQYQIKGLEWLVSLYNNNLNGILADEMGLGKTIQTIALITYLMEHKRINGPFLIIVPLSTLSNWAYEFDKWAPSVVKVSYKGSPAARRAFVPQLRSGKFNVLLTTYEYIIKDKHILAKIRWKYMIVDEGHRMKNHHCKLTQVLNTHYVAPRRLLLTGTPLQNKLPELWALLNFLLPTIFKSCSTFEQWFNAPFAMTGEKVDLNEEETILIIRRLHKVLRPFLLRRLKKEVEAQLPEKVEYVIKCDMSALQRVLYRHMQAKGVLLTDGSEKDKKGKGGTKTLMNTIMQLRKICNHPYMFQHIEESFSEHLGFTGGIVQGLDLYRASGKFELLDRILPKLRATNHKVLLFCQMTSLMTIMEDYFAYRGFKYLRLDGTTKAEDRGMLLKTFNEPGSEYFIFLLSTRAGGLGLNLQSADTVIIFDSDWNPHQDLQAQDRAHRIGQQNEVRVLRLCTVNSVEEKILAAAKYKLNVDQKVIQAGMFDQKSSSHERRAFLQAILEHEEQDESRHCSTGSGSASFAHTAPPPAGVNPDLEEPPLKEEDEVPDDETVNQMIARHEEEFDLFMRMTGRSREPHPRTPLKDTPCLTE

SEQ ID NO: 908986 - protein, 1207 aa, Homo sapiens
MSTPDPPLGGTPRPGPSPGPGPSPGAMLGPSPGPSPGSAHSMMGPSPGPPSAGHPIPTQGPGGYPQDNMHQMHKPMESMHEKGMSDDPRYNQMKGMGMRSGGHAGMGPPPSPMDQHSQGYPSPLGGSEHASSPVPASGPSSGPQMSSGPGGAPLDGADPQALGQQNRGPTPFNQNQLHQLRAQIMAYKMLARGQPLPDHLQMAVQGKRPMPGMQQQMPTLPPPSVSATGPGPGPGPGPGPGPGPAPPNYSRPHGMGGPNMPPPGPSGVPPGMPGQPPGGPPKPWPEGPMANAAAPTSTPQKLIPPQPTGRPSPAPPAVPPAASPVMPPQTQSPGQPAQPAPMVPLHQKQSRITPIQKPRGLDPVEILQEREYRLQARIAHRIQELENLPGSLAGDLRTKATIELKALRLLNFQRQLRQEVVVCMRRDTALETALNAKAYKRSKRQSLREARITEKLEKQQKIEQERKRRQKHQEYLNSILQHAKDFKEYHRSVTGKIQKLTKAVATYHANTEREQKKENERIEKERMRRLMAEDEEGYRKLIDQKKDKRLAYLLQQTDEYVANLTELVRQHKAAQVAKEKKKKKKKKKAENAEGQTPAIGPDGEPLDETSQMSDLPVKVIHVESGKILTGTDAPKAGQLEAWLEMNPGYEVAPRSDSEESGSEEEEEEEEEEQPQAAQPPTLPVEEKKKIPDPDSDDVSEVDARHIIENAKQDVDDEYGVSQALARGLQSYYAVAHAVTERVDKQSALMVNGVLKQYQIKGLEWLVSLYNNNLNGILADEMGLGKTIQTIALITYLMEHKRINGPFLIIVPLSTLSNWAYEFDKWAPSVVKVSYKGSPAARRAFVPQLRSGKFNVLLTTYEYIIKDKHILAKIRWKYMIVDEGHRMKNHHCKLTQVLNTHYVAPRRLLLTGTPLQNKLPELWALLNFLLPTIFKSCSTFEQWFNAPFAMTGEKVDLNEEETILIIRRLHKVLRPFLLRRLKKEVEAQLPEKVEYVIKCDMSALQRVLYRHMQAKGVLLTDGSEKDKKGKGGTKTLMNTIMQLRKICNHPYMFQHIEESFSEHLGFTGGIVQGLDLYRASGKFELLDRILPKLRATNHKVLLFCQMTSLMTIMEDYFAYRGFKYLRLDGTTKAEDRGMLLKTFNEPGSEYFIFLLSTRAGGLGLNLQSADTVIIFDSDWNPHQVKAGRAPGRGEGRGCLQNLEETALA

SEQ ID NO: 908987 - protein, 288 aa, Homo sapiens
MPSQQSPKVLTHSSINSKVQVQSPISDKQWKAIEEGTLEEIEEEVRQKKSSRKRKRDSDAGSSTPTTSTRSRDKDDESKKQKKRGRPPAEKLSPNPPNLTKKMKKIVDAVIKYKDSSSGRQLSEVFIQLPSRKELPEYYELIRKPVDFKKIKERIRNHKYRSLNDLEKDVMLLCQNAQTFNLEGSLIYEDSIVLQSVFTSVRQKIEKEDDSEGEESEEEEEGEEEGSESESRSVKVKIKLGRKEKAQDRLKGGRRRPSRGSRAKPVVSDDDSEEEQEEDRSGSGSEED

SEQ ID NO: 908988 - protein, 73 aa, Homo sapiens
MRSRLPCEGLVARHPRELRVPSVRFWIDWPWVLTDMHIVPPHCSNPHAFVAEDEEGYRKLIDQKKDKRLAYLL

SEQ ID NO: 908989 - protein, 796 aa, Homo sapiens [sequence omitted]

SEQ ID NO: 908990 - protein, 796 aa, Homo sapiens [sequence omitted]

SEQ ID NO: 908991 - protein, 415 aa, Homo sapiens
MFLAPSYIHEVQENAAAGTVVGRVHAKDPDAANSPIRYSIDRHTDLDRFFTINPEDGFIKTTKPLDREETAWLNITVFAAEIHNRHQEAKVPVAIRVLDVNDNAPKFAAPYEGFICESDQTKPLSNQPIVTISADDKDDTANGPRFIFSLPPEIIHNPNFTVRDNRDNTAGVYARRGGFSRQKQDLYLLPIVISDGGIPPMSSTNTLTIKVCGCDVNGALLSCNAEAYILNAGLSTGALIAILACIVILLVIVVLFVTLRRQKKEPLIVFEEEDVRENIITYDDEGGGEEDTEAFDIATLQNPDGINGFIPRKDIKPEYQYMPRPGLRPAPNSVDVDDFINTRIQEADNDPTAPPYDSIQIYGYEGRGSVAGSLSSLESATTDSDLDYDYLQNWGPRFKKLADLYGSKDTFDDDS

SEQ ID NO: 908992 - protein, 856 aa, Homo sapiens
MKENYCLQAALVCLGMLCHSHAFAPERRGHLRPSFHGHHEKGKEGQVLQRSKRGWVWNQFFVIEEYTGPDPVLVGRLHSDIDSGDGNIKYILSGEGAGTIFVIDDKSGNIHATKTLDREERAQYTLMAQAVDRDTNRPLEPPSEFIVKVQDINDNPPEFLHETYHANVPERSNVGTSVIQVTASDADDPTYGNSAKLVYSILEGQPYFSVEAQTGIIRTALPNMDREAKEEYHVVIQAKDMGGHMGGLSGTTKVTITLTDVNDNPPKFPQSVYQMSVSEAAVPGEEVGRVKAKDPDIGENGLVTYNIVDGDGMESFEITTDYETQEGVIKLKKPVDFETKRAYSLKVEAANVHIDPKFISNGPFKDTVTVKIAVEDADEPPMFLAPSYIHEVQENAAAGTVVGRVHAKDPDAANSPIRYSIDRHTDLDRFFTINPEDGFIKTTKPLDREETAWLNITVFAAEIHNRHQEAKVPVAIRVLDVNDNAPKFAAPYEGFICESDQTKPLSNQPIVTISADDKDDTANGPRFIFSLPPEIIHNPNFTVRDNRDNTAGVYARRGGFSRQKQDLYLLPIVISDGGIPPMSSTNTLTIKVCGCDVNGALLSCNAEAYILNAGLSTGALIAILACIVILLGCPSLMEPPSPREDMRLLYLGFQLMLFSYVKVNRRFCLLGVFIKLPFLYVVATESPTITYVIVVLFVTLRRQKKEPLIVFEEEDVRENIITYDDEGGGEEDTEAFDIATLQNPDGINGFIPRKDIKPEYQYMPRPGLRPAPNSVDVDDFINTRIQEADNDPTAPPYDSIQIYGYEGRGSVAGSLSSLESATTDSDLDYDYLQNWGPRFKKLADLYGSKDTFDDDS

SEQ ID NO: 908993 - protein, 796 aa, Homo sapiens [sequence omitted]

SEQ ID NO: 908994 - protein, 106 aa, Homo sapiens
LHSDIDSGDGNIKYILSGEGAGTIFVIDDKSGNIHATKTLDREERAQYTLMAQAVDRDTNRPLEPPSEFIVKVQDINDNPPEFLHETYHANVPERSNVGAYGVGGL

SEQ ID NO: 908995 - protein, 245 aa, Homo sapiens
MEETIKDPPTSAVLLDHCHFSQVIFNSVEKFYIPGGDVTCHYTFTQHFIPRRKDWIGIFRVGWKTTREYYTFMWVTLPIDLNNKSAKQQEVQFKAYYLPKDDEYYQFCYVDEDGVVRGASIPFQFRPENEEDILVVTTQGKVERTIEQEQARSYAHTENPGADRTDWNQASRRPHTPEHARLQLHTASPRREHRNPLPEPSTKTLAPLKQRQRTPQDYRGRQNLLPRGTHHRHSGMSSENPRTLG

SEQ ID NO: 908996 - protein, 128 aa, Homo sapiens
MKKQQELMDENFDLSKRLSENEIICNALQRQKERLEGENDLLKRENSRLLSYMGLDFNSLPYQVPTSDEGGARQNPGLAYGNPYSGIQESSSPSPLSIKKCPICKADDICDHTLERSTVPSSTERSTV

SEQ ID NO: 908997 - protein, 446 aa, Homo sapiens
MEETIKDPPTSAVLLDHCHFSQVIFNSVEKFYIPGGDVTCHYTFTQHFIPRRKDWIGIFRVGWKTTREYYTFMWVTLPIDLNNKSAKQQEVQFKAYYLPKDDEYYQFCYVDEDGVVRGASIPFQFRPENEEDILVVTTQGEVEEIEQHNKELCKENQELKDSCISLQKQNSDMQAELQKKQEELETLQSINKKLELKVKEQKDYWETELLQLKEQNQKMSSENEKMGIRVDQLQAQLSTQEKEMEKLVQGDQDKTEQLEQLKKENDHLFLSLTEQRKDQKKLEQTVEQMKQNETTAMKKQQELMDENFDLSKRLSENEIICNALQRQKERLEGENDLLKRENSRLLSYMGLDFNSLPYQVPTSDEGGARQNPGLAYGNPYSGIQESSSPSPLSIKKCPICKADDICDHTLEQQQMQPLCFNCPICDKIFPATEKQIFEDHVFCHSL

SEQ ID NO: 908998 - protein, 463 aa, Homo sapiens
LTASTSRGKSAEAWTPTMEETIKDPPTSAVLLDHCHFSQVIFNSVEKFYIPGGDVTCHYTFTQHFIPRRKDWIGIFRVGWKTTREYYTFMWVTLPIDLNNKSAKQQEVQFKAYYLPKDDEYYQFCYVDEDGVVRGASIPFQFRPENEEDILVVTTQGEVEEIEQHNKELCKENQELKDSCISLQKQNSDMQAELQKKQEELETLQSINKKLELKVKEQKDYWETELLQLKEQNQKMSSENEKMGIRVDQLQAQLSTQEKEMEKLVQGDQDKTEQLEQLKKENDHLFLSLTEQRKDQKKLEQTVEQMKQNETTAMKKQQELMDENFDLSKRLSENEIICNALQRQKERLEGENDLLKRENSRLLSYMGLDFNSLPYQVPTSDEGGARQNPGLAYGNPYSGIQESSSPSPLSIKKCPICKADDICDHTLEQQQMQPLCFNCPICDKIFPATEKQIFEDHVFCHSL

SEQ ID NO: 908999 - protein, 446 aa, Homo sapiens; identical to SEQ ID NO: 908997

SEQ ID NO: 909000 - protein, 381 aa, Homo sapiens
MEETIKDPPTSAVLLDHCHFSQVIFNSVEKFYIPGGDVTCHYTFTQHFIPRRKDWIGIFRVGWKTTREYYTFMWVTLPIDLNNKSAKQQEVQFKAYYLPKDDEYYQFCYVDEDGVVRGASIPFQFRPENEEDILVVTTQGEVEEIEQHNKELCKENQELKDSCISLQKQNSDMQAELQKKQEELETLQSINKKLELKVKEQKDYWETELLQLKEQNQKMSSENEKMGIRVDQLQAQLSTQEKEMEKLVQGDQDKTEQLEQLKKENDHLFLSLTEQRKDQKKLEQTVEQMKQNETTAMKKQQELMDENFDLSKRLSENEIICNALQRQKERLEGENDLLKRENSRLLSYMGLDFNSLPYQVPTSDEGGARPLHQEMPYLQSR

SEQ ID NO: 909001 - protein, 470 aa, Homo sapiens
MEETIKDPPTSAVLLDHCHFSQVIFNSVEKFYIPGGDVTCHYTFTQHFIPRRKDWIGIFRAFKCFQDKLEQELLKWRSQGQKLQVGWKTTREYYTFMWVTLPIDLNNKSAKQQEVQFKAYYLPKDDEYYQFCYVDEDGVVRGASIPFQFRPENEEDILVVTTQGEVEEIEQHNKELCKENQELKDSCISLQKQNSDMQAELQKKQEELETLQSINKKLELKVKEQKDYWETELLQLKEQNQKMSSENEKMGIRVDQLQAQLSTQEKEMEKLVQGDQDKTEQLEQLKKENDHLFLSLTEQRKDQKKLEQTVEQMKQNETTAMKKQQELMDENFDLSKRLSENEIICNALQRQKERLEGENDLLKRENSRLLSYMGLDFNSLPYQVPTSDEGGARQNPGLAYGNPYSGIQESSSPSPLSIKKCPICKADDICDHTLEQQQMQPLCFNCPICDKIFPATEKQIFEDHVFCHSL

SEQ ID NO: 909002 - protein, 406 aa, Homo sapiens
MDNITYSIIGNTIASKGLYVVGWKTTREYYTFMWVTLPIDLNNKSAKQQEVQFKAYYLPKDDEYYQFCYVDEDGVVRGASIPFQFRPENEEDILVVTTQGEVEEIEQHNKELCKENQELKDSCISLQKQNSDMQAELQKKQEELETLQSINKKLELKVKEQKDYWETELLQLKEQNQKMSSENEKMGIRVDQLQAQLSTQEKEMEKLVQGDQDKTEQLEQLKKENDHLFLSLTEQRKDQKKLEQTVEQMKQNETTAMKKQQELMDENFDLSKRLSENEIICNALQRQKERLEGENDLLKRENSRLLSYMGLDFNSLPYQVPTSDEGGARQNPGLAYGNPYSGIQESSSPSPLSIKKCPICKADDICDHTLEQQQMQPLCFNCPICDKIFPATEKQIFEDHVFCHSL

SEQ ID NO: 909003 - protein, 301 aa, Homo sapiens
EDILVVTTQGEVEEIDSCISLQKQNSDMQAELQKKQEELETLQSINKKLELKVKEQKDYWETELLQLKEQNQKMSSENEKMGIRVDQLQAQLSTQEKEMEKLVQGDQDKTEQLEQLKKENDHLFLSLTEQRKDQKKLEQTVEQMKQNETTAMKKQQELMDENFDLSKRLSENEIICNALQRQKERLEGENDLLKRENSRLLSYMGLDFNSLPYQVPTSDEGGARQNPGLAYGNPYSGIQESSSPSPLSIKKCPICKADDICDHTLEQQQMQPLCFNCPICDKIFPATEKQIFEDHVFCHSL

SEQ ID NO: 909004 - protein, 185 aa, Homo sapiens
IASGARDDYGLTEQRKDQKKLEQTVEQMKQNETTAMKKQQELMDENFDLSKRLSENEIICNALQRQKERLEGENDLLKRENSRLLSYMGLDFNSLPYQVPTSDEGGARQNPGLAYGNPYSGIQESSSPSPLSIKKCPICKADDICDHTLEQQQMQPLCFNCPICDKIFPATEKQIFEDHVFCHSL

SEQ ID NO: 909005 - protein, 446 aa, Homo sapiens; identical to SEQ ID NO: 908997

SEQ ID NO: 909006 - protein, 146 aa, Homo sapiens
MDENFEPLSESNVWSENEIICNALQRQKERLEGENDLLKRENSRLLSYMGLDFNSLPYQVPTSDEGGARQNPGLAYGNPYSGIQESSSPSPLSIKKCPICKADDICDHTLEQQQMQPLCFNCPICDKIFPATEKQIFEDHVFCHSL

SEQ ID NO: 909007 - protein, 126 aa, Homo sapiens
HNIITATTDLYTRPPRLLGTRRHYMLTIMGLDFNSLPYQVPTSDEGGARQNPGLAYGNPYSGIQESSSPSPLSIKKCPICKADDICDHTLEQQQMQPLCFNCPICDKIFPATEKQIFEDHVFCHSL

SEQ ID NO: 909008 - protein, 70 aa, Homo sapiens
EITTWNSSNNNLLTKLSIKKCPICKADDICDHTLEQQQMQPLCFNCPICDKIFPATEKQIFEDHVFCHSL

SEQ ID NO: 909009 - protein, 317 aa, Homo sapiens
MEETIKDPPTSAVLLDHCHFSQVIFNSVEKFYIPGGDVTCHYTFTQHFIPRRKDWIGIFRVGWKTTREYYTFMWVTLPIDLNNKSAKQQEVQFKAYYLPKDDEYYQFCYVDEDGVVRGASIPFQFRPENEEDILVVTTQGEVEEIEQHNKELCKENQELKDSCISLQKQNSDMQAELQKKQEELETLQSINKKLELKVKEQKDYWETELLQLKEQNQKMSSENEKMGIRVDQLQAQLSTQEKEMEKLVQGDQDKTEQLEQLKKENDHLFLSLTEQRKDQKKLEQTVEQMKQNETTAMKKQQELMACLSLDGYVGGSL

SEQ ID NO: 909010 - protein, 264 aa, Homo sapiens
MEETIKDPPTSAVLLDHCHFSQVIFNSVEKFYIPGGDVTCHYTFTQHFIPRRKDWIGIFRVGWKTTREYYTFMWVTLPIDLNNKSAKQQEVQFKAYYLPKDDEYYQFCYVDEDGVVRGASIPFQFRPENEEDILVVTTQGEVEEIEQHNKELCKENQELKDSCISLQKQNSDMQAELQKKQEELETLQSINKKLELKVKEQKDYWETELLQLKEQNQKMSSENEKMGIRVDQLQVGNAICLSKDIFLALPLLQFGGLERCISLQ

SEQ ID NO: 909011 - protein, 264 aa, Homo sapiens; identical to SEQ ID NO: 909010

SEQ ID NO: 909012 - protein, 446 aa, Homo sapiens; identical to SEQ ID NO: 908997

SEQ ID NO: 909013 - protein, 446 aa, Homo sapiens; identical to SEQ ID NO: 908997

SEQ ID NO: 909014 - protein, 446 aa, Homo sapiens; identical to SEQ ID NO: 908997

SEQ ID NO: 909015 - protein, 446 aa, Homo sapiens; identical to SEQ ID NO: 908997

SEQ ID NO: 909016 - protein, 415 aa, Homo sapiens
MEETIKDPPTSAVLLDHCHFSQVIFNSVEKFYIPGGDVTCHYTFTQHFIPRRKDWIGIFRVGWKTTREYYTFMWVTLPIDLNNKSAKQQEVQFKAYYLPKDDEYYQFCYVDEDGVVRGASIPFQFRPENEEDILVVTTQGEVEEIEQHNKELCKENQELKDSCISLQKQNSDMQAELQKKQEELETLQSINKKLELKVKEQKDYWETELLQLKEQNQKMSSENEKMGIRVDQLQAQLSTQEKEMEKLVQGDQDKTEQLEQLKKENDHLFLSLTEQRKDQKKLEQTVEQMKQNETTAMKKQQELMDENFDLSKRLSENEIICNALQRQKERLEGENDVSKKVLPPARSPSRNALSAKQMIFVITPWSNSRCSPFVSIVQFVTRSSQLQRSRSLKTTCSATLSEYPNLLDVYRDFIE

SEQ ID NO: 909017 - protein, 360 aa, Homo sapiens [sequence omitted]

SEQ ID NO: 909018 - protein, 412 aa, Homo sapiens
GAATSSRIPTQHYIALDRRIGLASLDVGWKTTREYYTFMWVTLPIDLNNKSAKQQEVQFKAYYLPKDDEYYQFCYVDEDGVVRGASIPFQFRPENEEDILVVTTQGEVEEIEQHNKELCKENQELKDSCISLQKQNSDMQAELQKKQEELETLQSINKKLELKVKEQKDYWETELLQLKEQNQKMSSENEKMGIRVDQLQAQLSTQEKEMEKLVQGDQDKTEQLEQLKKENDHLFLSLTEQRKDQKKLEQTVEQMKQNETTAMKKQQELMDENFDLSKRLSENEIICNALQRQKERLEGENDLLKRENSRLLSYMGLDFNSLPYQVPTSDEGGARQNPGLAYGNPYSGIQESSSPSPLSIKKCPICKADDICDHTLEQQQMQPLCFNCPICDKIFPATEKQIFEDHVFCHSL

SEQ ID NO: 909019 - protein, 179 aa, Homo sapiens
STHASPTRRGRVGRLEQTVEQMKQNETTAMKKQQELMDENFDLSKRLSENEIICNALQRQKERLEGENDLLKRENSRLLSYMGLDFNSLPYQVPTSDEGGARQNPGLAYGNPYSGIQESSSPSPLSIKKCPICKADDICDHTLEQQQMQPLCFNCPICDKIFPATEKQIFEDHVFCHSL

SEQ ID NO: 909020 - protein, 150 aa, Homo sapiens
MKKQQELMDENFDLSKRLSENEIICNALQRQKERLEGENDLLKRENSRLLSYMGLDFNSLPYQVPTSDEGGARQNPGLAYGNPYSGIQESSSPSPLSIKKCPICKADDICDHTLEQQQMQPLCFNCPICDKIFPATEKQIFEDHVFCHSL

SEQ ID NO: 909021 - protein, 69 aa, Homo sapiens
GPSLLLNQESLPPALSIKKCPICKADDICDHTLEQQQMQPLCFNCPICDKIFPATEKQIFEDHVFCHSL

SEQ ID NO: 909022 - protein, 339 aa, Homo sapiens
MEETIKDPPTSAVLLDHCHFSQVIFNSVEKFYIPGGDVTCHYTFTQHFIPRRKDWIGIFRVGWKTTREYYTFMWVTLPIDLNNKSAKQQEVQFKAYYLPKDDEYYQFCYVDEDGVVRGASIPFQFRPENEEDILVVTTQGEVEEIEQHNKELCKENQELKDSCISLQKQNSDMQAELQKKQEELETLQSINKKLELKVKEQKDYWETELLQLKEQNQKMSSENEKMGIRVDQLQAQLSTQEKEMEKLVQGDQDKTEQLEQLKKENDHLFLSLTEQRKDQKKLEQTVEQMKQNETTAMKKQQELMDENFDLSKRLSENEIICNALQRQKERLEGENDVSV

SEQ ID NO: 909023 - protein, 278 aa, Homo sapiens
MEETIKDPPTSAVLLDHCHFSQVIFNSVEKFYIPGGDVTCHYTFTQHFIPRRKDWIGIFRVGWKTTREYYTFMWVTLPIDLNNKSAKQQEVQFKAYYLPKDDEYYQFCYVDEDGVVRGASIPFQFRPENEEDILVVTTQGEVEEIEQHNKELCKENQELKDSCISLQKQNSDMQAELQKKQEELETLQSINKKLELKVKEQKDYWETELLQLKEQNQKMSSENEKMGIRVDQLQAQLSTQEKEMEKLVQGDQDKTEQLEQLKKENDHLFLSLTEQVES

SEQ ID NO: 909024 - protein, 375 aa, Homo sapiens
RQGCTVRSFWSSRCILRARPELESPAPPAFRPAMAAVALMPPPLLLLLLLASPPAASAPSARDPFAPQLGDTQNCQLRCRDRDLGPQPSQAGLEGASESPYDRAVLISACERGCRLFSICRFVARSSKPNATQTECEAACVEAYVKEAEQQACSHGCWSQPAEPEPEQKRKVLEAPSGALSLLDLFSTLCNDLVNSAQGFVSSTWTYYLQTDNGKVVVFQTQPIVESLGFQGGRLQRVEVTWRGSHPEALEVHVDPVGPLDKVRKAKIRVKTSSKAKVESEEPQDNDFLSCMSRRSGLPRWILACCLFLSVLVMLWLSCSTLVTAPGQHLKFQPLTLEQHKGFMMEPDWPLYPPPSHACEDSLPPYKLKLDLTKL

SEQ ID NO: 909025 - protein, 342 aa, Homo sapiens
MAAVALMPPPLLLLLLLASPPAASAPSARDPFAPQLGDTQNCQLRCRDRDLGPQPSQAGLEGASESPYDRAVLISACERGCRLFSICRFVARSSKPNATQTECEAACVEAYVKEAEQQACSHGCWSQPAEPEPEQKRKVLEAPSGALSLLDLFSTLCNDLVNSAQGFVSSTWTYYLQTDNGKVVVFQTQPIVESLGFQGGRLQRVEVTWRGSHPEALEVHVDPVGPLDKVRKAKIRVKTSSKAKVESEEPQDNDFLSCMSRRSGLPRWILACCLFLSVLVMLWLSCSTLVTAPGQHLKFQPLTLEQHKGFMMEPDWPLYPPPSHACEDSLPPYKLKLDLTKL

SEQ ID NO: 909026 - protein, 309 aa, Homo sapiens
MAAVALMPPPLLLLLLLASPPAASAPSARDPFAPQLGDTQNCQLRCRDRDLGPQPSQAGLEGASESPYDRAVLISACERGCRLFSICRFVARSSKPNATQTECEAACVEAYVKEAEQQACSHGCWSQPAEPEPEQKRKVLEAPSGALSLLDLFSTLCNDLVNSAQGFVSSTWTYYLQTDNGKVVVFQTQPIVESLGFQGGRLQRVEVTWRGSHPEALEVHVDPVGPLDKVRKAKIRVKTSSKAKALGSASLDPGLLPLPLRAGDAVAELLHPGDRAWPAPQVPASDPGAAQGLHDGARLAPVPAAVPRL

SEQ ID NO: 909027 - protein, 287 aa, Homo sapiens
MAAVALMPPPLLLLLLLASPPAASAPSARDPFAPQLGDTQNCQLRCRDRDLGPQPSQAGLEGASESPYDRAVLISACERGCRLFSICRFVARSSKPNATQTECEAACVEAYVKEAEQQACSHGCWSQPAEPEPEQKRKVLEAPSGALSLLDLFSTLCNDLVNSAQGFVSSTWTYYLQTDNGKVVVFQTQPIVESLGFQGGRLQRVEVTWRGSHPEALEVHVGKVQPRPVFLPWVAPLPQGVGLANRPSRIGISISQVLGSMAHPPGLHGLFPRVPWSTSQGSMVHFS

SEQ ID NO: 909028 - protein, 342 aa, Homo sapiens; identical to SEQ ID NO: 909025

SEQ ID NO: 909029 - protein, 373 aa, Homo sapiens
RLVRPRCGCSRCILRARPELESPAPPAFRPAMAAVALMPPPLLLLLLLASPPAASAPSARDPFAPQLGDTQNCQLRCRDRDLGPQPSQAGLEGASESPYDRAVLISACERGCRLFSICRFVARSSKPNATQTECEAACVEAYVKEAEQQACSHGCWSQPAEPEPEQKRKVLEAPSGALSLLDLFSTLCNDLVNSAQGFVSSTWTYYLQTDNGKVVVFQTQPIVESLGFQGGRLQRVEVTWRGSHPEALEVHVDPVGPLDKVRKAKIRVKTSSKAKVESEEPQDNDFLSCMSRRSGLPRWILACCLFLSVLVMLWLSCSTLVTAPGQHLKFQPLTLEQHKGFMMEPDWPLYPPPSHACEDSLPPYKLKLDLTKL

SEQ ID NO: 909030 - protein, 286 aa, Homo sapiens
MAAVALMPPPLLLLLLLASPPAASAPSARDPFAPQLGDTQNCQLRCRDRDLGPQPSQAGLEGASESPYDRAVLISACERGCRLFSICRFVARSSKPNATQTECEAACVEAYVKEAEQQACSHGCWSQPAEPEPEQKRKVLEAPSGALSLLDLFSTLCNDLVNSAQGFVSSTWTYYLQTDNGKVVVFQTQPIVESLGFQGGRLQRVEVTWRGSHPEALEVHVDPVGPLDKVRKAKIRVKTSSKAKVESEEPQDNDFLSCMSRWVAGPWGWEGGGTGGTGLPGPGLGS

SEQ ID NO: 909031 - protein, 104 aa, Homo sapiens
NLGGGGCSELRWRHCTPAWVTERDSLKKRKKIKQSEVGRRQSGLGARPLPVPPLPSSPLFLQPLTLEQHKGFMMEPDWPLYPPPSHACEDSLPPYKLKLDLTKL

SEQ ID NO: 909032 - protein, 110 aa, Homo sapiens
VTVMHVMAASMARGGVSARFCCRLPGHLVEQTWGHFRVGGGGGAGDNQKVSSDRLAPGGRGGRGRPGAARGRGERGVRRPLRPADPSEWQSRGQCSSPGPAPRGGPGRGL

SEQ ID NO: 909033 - protein, 187 aa, Homo sapiens
MALGTQGRLLLDRDSKDTQTRISQKGRRLQPPGTPSAPPQRRPRKQLNPCRGTERVDPGFEGVTLKFQIKPDSSLQIIPTYSLPCSSRSQESPADAVGGPAAHPGGTEAHSAGSEALEPRRCASCRTQRTPLWRDAEDGTPLCNACGIRYKKYGTRCSSCWLVPRKNVQPKRLCGRCGVSLDPIQEG

SEQ ID NO: 909034 - protein, 187 aa, Homo sapiens; identical to SEQ ID NO: 909033

SEQ ID NO: 909035 - protein, 187 aa, Homo sapiens; identical to SEQ ID NO: 909033

SEQ ID NO: 909036 - protein, 67 aa, Homo sapiens
WVSSGGPSGTGPGEIREGAGLGRNGGRANPGLLNASKASGAALSEPGAAGRIPLPGEAEDPRMLQNQ

SEQ ID NO: 909037 - protein, 167 aa, Homo sapiens
ARRSRSPNRVFQARARRERRTRAARSGPGTYSTRALSPSSSSAFALPSVPRVNVVFVDRSGQRIPVSGRVGDNVLHLAQRHGVDLEGACEASLACSTCHVYVSEDHLDLLPPPEEREDDMLDMAPLLQENSRLGCQIVLTPELEGAEFTLPKITRNFYVDGHVPKPH

SEQ ID NO: 909038 - protein, 143 aa, Homo sapiens
GAALGTYSTRALSPSSSSAFALPSVPRVNVVFVDRSGQRIPVSGRVGDNVLHLAQRHGVDLEGACEASLACSTCHVYVSEDHLDLLPPPEEREDDMLDMAPLLQENSRLGCQIVLTPELEGAEFTLPKITRNFYVDGHVPKPH

SEQ ID NO: 909039 - protein, 280 aa, Homo sapiens
VTVMHVMAASMARGGVSARFCCRLPGHLVEQTWGHFRVGGGGGAGDNQKVSSDRLAPGGRGGRGRPGAARGRVSAGGQVPHSSSHGIPLVPILPCSFISRSPFCFALFSTCASSLNSYFLTLDSTRALSPSSSSAFALPSVPRVNVVFVDRSGQRIPVSGRVGDNVLHLAQRHGVDLEGACEASLACSTCHVYVSEDHLDLLPPPEEREDDMLDMAPLLQENSRLGCQIVLTPELEGAEFTLPKITRNFYVDGHVPNPCEGQHPCLGESPMSRLWWGQGP

SEQ ID NO: 909040 - protein, 802 aa, Homo sapiens
MGYLRIFSPHPAKTGDGAQAEDLLLEVDLRDPVLQVEVGKFVSGTEMLHLAVLHSRKLCVYSVSGTLGNVEHGNQCQMKLMYEHNLQRTACNMTYGSFGGVKGRDLICIQSMDGMLMVFEQESYAFGRFLPGFLLPGPLAYSSRTDSFLTVSSCQQVESYKYQVLAFATDADKRQETEQQKLGSGKRLVVDWTLNIGEQALDICIVSFNQSASSVFVLGERNFFCLKDNGQIRFMKKLDWSPSCFLPYCSVSEGTINTLIGNHNNMLHIYQDVTLKWATQLPHIPVAVRVGCLHDLKGVIVTLSDDGHLQCSYLGTDPSLFQAPNVQSRELNYDELDVEMKELQKIIKDVNKSQGVWPMTEREDDLNVSVVVSPNFDSVSQATDVEVGTDLVPSVTVKVTLQNRVILQKAKLSVYVQPPLELTCDQFTFEFMSIPRVIQCKFRLPLKLICLPGQPSKTASHKITIDTNKSPVSLLSLFPGFASQSDDDQVNVMGFHFLGGARITVLASKTSQRYRIQSEQFEDLWLITNELILRLQEYFEKQGVKDFACSFSGSIPLQEYFELIDHHFELRINGEKLEELLSERAVQFRAIQRRLLARFKDKTPAPLQHLDTLLDGTYKQVIALADAVEENQGNLFQSFTRLKSATHLVILLIALWQKLSADQVAILEAAFLPLQEDTQELGWEETVDAAISHLLKTCLSKSSKEQALNLNSQLNIPKDTSQLKKHITLLCDRLSKGGRLCLSTDAAAPQTMVMPGGCTTIPESDLEERSVEQDSTELFTNHRHLTAETPRPEVSPLQGVSE

SEQ ID NO: 909041 - protein, 802 aa, Homo sapiens; identical to SEQ ID NO: 909040

SEQ ID NO: 909042 - protein, 802 aa, Homo sapiens; identical to SEQ ID NO: 909040

SEQ ID NO: 909043 - protein, 407 aa, Homo sapiens
IGKGQAHRDRSSSGFWVSSRTSSTVFQPSGCFKPEGKSIPRVIQCKFRLPLKLICLPGQPSKTASHKITIDTNKSPVSLLSLFPGFASQSDDDQVNVMGFHFLGGARITVLASKTSQRYRIQSEQFEDLWLITNELILRLQEYFEKQGVKDFACSFSGSIPLQEYFELIDHHFELRINGEKLEELLSERAVQFRAIQRRLLARFKDKTPAPLQHLDTLLDGTYKQVIALADAVEENQGNLFQSFTRLKSATHLVILLIALWQKLSADQVAILEAAFLPLQEDTQELGWEETVDAAISHLLKTCLSKSSKEQALNLNSQLNIPKDTSQLKKHITLLCDRLSKGGRLCLSTDAAAPQTMVMPGGCTTIPESDLEERSVEQDSTELFTNHRHLTAETPRPEVSPLQGVSE

SEQ ID NO: 909044 - protein, 887 aa, Homo sapiens
MSLFKARDWWSTILGDKEEFDQGCLCLANVDNSGNGQDKIIVGSFMGYLRIFSPHPAKTGDGAQAEDLLLEVDLRDPVLQVEVGKFVSGTEMLHLAVLHSRKLCVYSVSGTLGNVEHGNQCQMKLMYEHNLQRTACNMTYGSFGGVKGRDLICIQSMDGMLMVFEQESYAFGRFLPGFLLPGPLAYSSRTDSFLTVSSCQQVESYKYQVLAFATDADKRQETEQQKLGSGKRLVVDWTLNIGEQALDICIVSFNQSASSVFVLGERNFFCLKDNGQIRFMKKLDWSPSCFLPYCSVSEGTINTLIGNHNNMLHIYQDVTLKWATQLPHIPVAVRVGCLHDLKGVIVTLSDDGHLQCSYLGTDPSLFQAPNVQSRELNYDELDVEMKELQKIIKDVNKSQGVWPMTEREDDLNVSVVVSPNFDSVSQATDVEVGTDLVPSVTVKVTLQNRVILQKAKLSVYVQPPLELTCDQFTFEFMTPDLTRTVSFSVYLKRSYTPSELEGNAVVSYSRPTDRNPDGIPRVIQCKFRLPLKLICLPGQPSKTASHKITIDTNKSPVSLLSLFPGFASQSDDDQVNVMGFHFLGGARITVLASKTSQRYRIQSEQFEDLWLITNELILRLQEYFEKQGVKDFACSFSGSIPLQEYFELIDHHFELRINGEKLEELLSERAVQFRAIQRRLLARFKDKTPAPLQHLDTLLDGTYKQVIALADAVEENQGNLFQSFTRLKSATHLVILLIALWQKLSADQVAILEAAFLPLQEDTQELGWEETVDAAISHLLKTCLSKSSKEQALNLNSQLNIPKDTSQLKKHITLLCDRLSKGGRLCLSTDAAAPQTMVMPGGCTTIPESDLEERSVEQDSTELFTNHRHLTAETPRPGKRLDGLHKR

SEQ ID NO: 909045 - protein, 945 aa, Homo sapiens
MSLFKARDWWSTILGDKEEFDQGCLCLANVDNSGNGQDKIIVGSFMGYLRIFSPHPAKTGDGAQAEDLLLEVDLRDPVLQVEVGKFVSGTEMLHLAVLHSRKLCVYSVSGTLGNVEHGNQCQMKLMYEHNLQRTACNMTYGSFGGVKGRDLICIQSMDGMLMVFEQESYAFGRFLPGFLLPGPLAYSSRTDSFLTVSSCQQVESYKYQVLAFATDADKRQETEQQKLGSGKRLVVDWTLNIGEQALDICIVSFNQSASSVFVLGERNFFCLKDNGQIRFMKKLDWSPSCFLPYCSVSEGTINTLIGNHNNMLHIYQDVTLKWATQLPHIPVAVRVGCLHDLKGVIVTLSDDGHLQCSYLGTDPSLFQAPNVQSRELNYDELDVEMKELQKIIKDVNKSQGVWPMTEREDDLNVSVVVSPNFDSVSQATDVEVGTDLVPSVTVKVTLQNRVILQKAKLSVYVQPPLELTCDQFTFEFMTPDLTRTVSFSVYLKRSYTPSELEGNAVVSYSRPTDRNPDGIPRVIQCKFRLPLKLICLPGQPSKTASHKITIDTNKSPVSLLSLFPGFASQSDDDQVNVMGFHFLGGARITVLASKTSQRYRIQSEQFEDLWLITNELILRLQEYFEKQGVKDFACSFSGSIPLQEYFELIDHHFELRINGEKLEELLSERAVQFRAIQRRLLARFKDKTPAPLQHLDTLLDGTYKQVIALADAVEENQGNLFQSFTRLKSATHLVILLIALWQKLSADQVAILEAAFLPLQEDTQELVRTCKPVVGTASIIEVSALGRYHMAIRFSKGWEETVDAAISHLLKTCLSKSSKEQALNLNSQLNIPKDTSQLKKHITLLCDRLSKGGRLCLSTDAAAPQTMVMPGGCTTIPESDLEERSVEQDSTELFTNHRHLTAETPRPGGVFLHKLSLLAAIHVRCDLLLLAFHHDCEATPATWNC

SEQ ID NO: 909046 - protein, 704 aa, Homo sapiens
MSLFKARDWWSTILGDKEEFDQGCLCLANVDNSGNGQDKIIVGSFMGYLRIFSPHPAKTGDGAQAEDLLLEVDLRDPVLQVEVGKFVSGTEMLHLAVLHSRKLCVYSVSGTLGNVEHGNQCQMKLMYEHNLQRTACNMTYGSFGGVKGRDLICIQSMDGMLMVFEQESYAFGRFLPGFLLPGPLAYSSRTDSFLTVSSCQQVESYKYQVLAFATDADKRQETEQQKLGSGKRLVVDWTLNIGEQALDICIVSFNQSASSVFVLGERNFFCLKDNGQIRFMKKLDWSPSCFLPYCSVSEGTINTLIGNHNNMLHIYQDVTLKWATQLPHIPVAVRVGCLHDLKGVIVTLSDDGHLQCSYLGTDPSLFQAPNVQSRELNYDELDVEMKELQKIIKDVNKSQGVWPMTEREDDLNVSVVVSPNFDSVSQATDVEVGTDLVPSVTVKVTLQNRVILQKAKLSVYVQPPLELTCDQFTFEFMTPDLTRTVSFSVYLKRSYTPSELEGNAVVSYSRPTDRNPDGIPRVIQCKFRLPLKLICLPGQPSKTASHKITIDTNKSPVSLLSLFPGFASQSDDDQVNVMGFHFLGGARITVLASKTSQRYRIQSEQFEDLWLITNELILRLQEYFEKQGVKDFACSFSGSIPLQEYFELIDHHFELRINGEKLEELLSERAVQFRAIQRRLLARFKDKTPAPLQHLDTLFCQERK

SEQ ID NO: 909047 - protein, 847 aa, Homo sapiens
MSLFKARDWWSTILGDKEEFDQGCLCLANVDNSGNGQDKIIVGSFMGYLRIFSPHPAKTGDGAQAEDLLLEVDLRDPVLQVEVGKFVSGTEMLHLAVLHSRKLCVYSVSGTLGNVEHGNQCQMKLMYEHNLQRTACNMTYGSFGGVKGRDLICIQSMDGMLMVFEQESYAFGRFLPGFLLPGPLAYSSRTDSFLTVSSCQQVESYKYQVLAFATDADKRQETEQQKLGSGKRLVVDWTLNIGEQALDICIVSFNQSASSVFVLGERNFFCLKDNGQIRFMKKLDWSPSCFLPYCSVSEGTINTLIGNHNNMLHIYQDVTLKWATQLPHIPVAVRVGCLHDLKGVIVTLSDDGHLQCSYLGTDPSLFQAPNVQSRELNYDELDVEMKELQKIIKDVNKSQGVWPMTEREDDLNVSVVVSPNFDSVSQATDVEVGTDLVPSVTVKVTLQNRVILQKAKLSVYVQPPLELTCDQFTFEFMSIPRVIQCKFRLPLKLICLPGQPSKTASHKITIDTNKSPVSLLSLFPGFASQSDDDQVNVMGFHFLGGARITVLASKTSQRYRIQSEQFEDLWLITNELILRLQEYFEKQGVKDFACSFSGSIPLQEYFELIDHHFELRINGEKLEELLSERAVQFRAIQRRLLARFKDKTPAPLQHLDTLLDGTYKQVIALADAVEENQGNLFQSFTRLKSATHLVILLIALWQKLSADQVAILEAAFLPLQEDTQELGWEETVDAAISHLLKTCLSKSSKEQALNLNSQLNIPKDTSQLKKHITLLCDRLSKGGRLCLSTDAAAPQTMVMPGGCTTIPESDLEERSVEQDSTELFTNHRHLTAETPRPEVSPLQGVSE

SEQ ID NO: 909048 - protein, 887 aa, Homo sapiens
MSLFKARDWWSTILGDKEEFDQGCLCLANVDNSGNGQDKIIVGSFMGYLRIFSPHPAKTGDGAQAEDLLLEVDLRDPVLQVEVGKFVSGTEMLHLAVLHSRKLCVYSVSGTLGNVEHGNQCQMKLMYEHNLQRTACNMTYGSFGGVKGRDLICIQSMDGMLMVFEQESYAFGRFLPGFLLPGPLAYSSRTDSFLTVSSCQQVESYKYQVLAFATDADKRQETEQQKLGSGKRLVVDWTLNIGEQALDICIVSFNQSASSVFVLGERNFFCLKDNGQIRFMKKLDWSPSCFLPYCSVSEGTINTLIGNHNNMLHIYQDVTLKWATQLPHIPVAVRVGCLHDLKGVIVTLSDDGHLQCSYLGTDPSLFQAPNVQSRELNYDELDVEMKELQKIIKDVNKSQGVWPMTEREDDLNVSVVVSPNFDSVSQATDVEVGTDLVPSVTVKVTLQNRVILQKAKLSVYVQPPLELTCDQFTFEFMTPDLTRTVSFSVYLKRSYTPSELEGNAVVSYSRPTDRNPDGIPRVIQCKFRLPLKLICLPGQPSKTASHKITIDTNKSPVSLLSLFPGFASQSDDDQVNVMGFHFLGGARITVLASKTSQRYRIQSEQFEDLWLITNELILRLQEYFEKQGVKDFACSFSGSIPLQEYFELIDHHFELRINGEKLEELLSERAVQFRAIQRRLLARFKDKTPAPLQHLDTLLDGTYKQVIALADAVEENQGNLFQSFTRLKSATHLVILLIALWQKLSADQVAILEAAFLPLQEDTQELGWEETVDAAISHLLKTCLSKSSKEQALNLNSQLNIPKDTSQLKKHITLLCDRLSKGGRLCLSTDAAAPQTMVMPGGCTTIPESDLEERSVEQDSTELFTNHRHLTAETPRPEVSPLQGVSE

SEQ ID NO: 909049 - protein, 917 aa, Homo sapiens
MSLFKARDWWSTILGDKEEFDQGCLCLANVDNSGNGQDKIIVGSFMGYLRIFSPHPAKTGDGAQAEDLLLEVDLRDPVLQVEVGKFVSGTEMLHLAVLHSRKLCVYSVSGTLGNVEHGNQCQMKLMYEHNLQRTACNMTYGSFGGVKGRDLICIQSMDGMLMVFEQESYAFGRFLPGFLLPGPLAYSSRTDSFLTVSSCQQVESYKYQVLAFATDADKRQETEQQKLGSGKRLVVDWTLNIGEQALDICIVSFNQSASSVFVLGERNFFCLKDNGQIRFMKKLDWSPSCFLPYCSVSEGTINTLIGNHNNMLHIYQDVTLKWATQLPHIPVAVRVGCLHDLKGVIVTLSDDGHLQCSYLGTDPSLFQAPNVQSRELNYDELDVEMKELQKIIKDVNKSQGVWPMTEREDDLNVSVVVSPNFDSVSQATDVEVGTDLVPSVTVKVTLQNRVILQKAKLSVYVQPPLELTCDQFTFEFMTPDLTRTVSFSVYLKRSYTPSELEGNAVVSYSRPTDRNPDGIPRVIQCKFRLPLKLICLPGQPSKTASHKITIDTNKSPVSLLSLFPGFASQSDDDQVNVMGFHFLGGARITVLASKTSQRYRIQSEQFEDLWLITNELILRLQEYFEKQGVKDFACSFSGSIPLQEYFELIDHHFELRINGEKLEELLSERAVQFRAIQRRLLARFKDKTPAPLQHLDTLLDGTYKQVIALADAVEENQGNLFQSFTRLKSATHLVILLIALWQKLSADQVAILEAAFLPLQEDTQELVRTCKPVVGTASIIEVSALGRYHMAIRFSKGWEETVDAAISHLLKTCLSKSSKEQALNLNSQLNIPKDTSQLKKHITLLCDRLSKGGRLCLSTDAAAPQTMVMPGGCTTIPESDLEERSVEQDSTELFTNHRHLTAETPRPEVSPLQGVSE

SEQ ID NO: 909050 - protein, 268 aa, Homo sapiens
TIKVLRDLSSDRSNPGRFLSTSNSSLQKDKRNKAYFTKRPSPVNDIILTNPVLGWVWDFELIDHHFELRINGEKLEELLSERAVQFRAIQRRLLARFKDKTPAPLQHLDTLLDGTYKQVIALADAVEENQGNLFQSFTRLKSATHLVILLIALWQKLSADQVAILEAAFLPLQEDTQELGWEETVDAAISHLLKTCLSKSSKEQALNLNSQLNIPKDTSQLKKHITLLCDRLSKGGRLCLSTDAAAPQTMVMPGGCTTIPESDLEERS

SEQ ID NO: 909051 - protein, 712 aa, Homo sapiens
MSLFKARDWWSTILGDKEEFDQGCLCLANVDNSGNGQDKIIVGSFMGYLRIFSPHPAKTGDGAQAEDLLLEVDLRDPVLQVEVGKFVSGTEMLHLAVLHSRKLCVYSVSGTLGNVEHGNQCQMKLMYEHNLQRTACNMTYGSFGGVKGRDLICIQSMDGMLMVFEQESYAFGRFLPGFLLPGPLAYSSRTDSFLTVSSCQQVESYKYQVLAFATDADKRQETEQQKLGSGKRLVVDWTLNIGEQALDICIVSFNQSASSVFVLGERNFFCLKDNGQIRFMKKLDWSPSCFLPYCSVSEGTINTLIGNHNNMLHIYQDVTLKWATQLPHIPVAVRVGCLHDLKGVIVTLSDDGHLQCSYLGTDPSLFQAPNVQSRELNYDELDVEMKELQKIIKDVNKSQGVWPMTEREDDLNVSVVVSPNFDSVSQATDVEVGTDLVPSVTVKVTLQNRVILQKAKLSVYVQPPLELTCDQFTFEFMTPDLTRTVSFSVYLKRSYTPSELEGNAVVSYSRPTDRNPDGIPRVIQCKFRLPLKLICLPGQPSKTASHKITIDTNKSPVSLLSLFPGFASQSDDDQVNVMGFHFLGGARITVLASKTSQRYRIQSEQFEDLWLITNELILRLQEYFEKQGVKDFACSFSGSIPLQEYFELIDHHFELRINGEKLEELLSERAVQFRAIQRRLLARFKDKTPAPLQHLDTLLDGTYKQTQWWKGI

SEQ ID NO: 909052 - protein, 93 aa, Homo sapiens
QRRERVWFGELRYPTSGRQEPQLCGMGTEQGCWIPVSSDKGSCPQVMERSFHMPSYGTQTLEGGVEKPHSLLSANPLWQQRALDPPHQMELTQ

SEQ ID NO: 909053 - protein, 233 aa, Homo sapiens
MSPTAPRRATGTYVITPAPSPEERTPMRGLLPPSRELCQFPTLNWWELRHAGHGQQQKVIVVAVCVVVLVMLLLLSLWGAHYYRTQKLLSKNPKNPYEESSRDVRSRRPADTEDGMSSCPQPWFVVIKEHQDLKNGGQPVAGEDGQAADGSMQPTSWRQEPQLCGMGTEQGCWIPVSSDKGSCPQVMERSFHMPSYGTQTLEGGVEKPHSLLSANPLWQQRALDPPHQMELTQ

SEQ ID NO: 909054 - protein, 1129 aa, Homo sapiens
MDFHYNEKRIYWVDLERQLLQRVFLNGSRQERVCNIEKNVSGMAINWINEEVIWSNQQEGIITVTDMKGNNSHILLSALKYPANVAVDPVERFIFWSSEVAGSLYRADLDGVGVKALLETSEKITAVSLDVLDKRLFWIQYNREGSNSLICSCDYDGGSVHISKHPTQHNLFAMSLFGDRIFYSTWKMKTIWIANKHTGKDMVRINLHSSFVPLGELKVVHPLAQPKAEDDTWEPEQKLCKLRKGNCSSTVCGQDLQSHLCMCAEGYALSRDRKYCEDVNECAFWNHGCTLGCKNTPGSYYCTCPVGFVLLPDGKRCHQLVSCPRNVSECSHDCVLTSEGPLCFCPEGSVLERDGKTCSGCSSPDNGGCSQLCVPLSPVSWECDCFPGYDLQLDEKSCAASGPQPFLLFANSQDIRHMHFDGTDYGTLLSQQMGMVYALDHDPVENKIYFAHTALKWIERANMDGSQRERLIEEGVDVPEGLAVDWIGRRFYWTDRGKSLIGRSDLNGKRSKIITKENISQPRGIAVHPMAKRLFWTDTGINPRIESSSLQGLGRLVIASSDLIWPSGITIDFLTDKLYWCDAKQSVIEMANLDGSKRRRLTQNDVGHPFAVAVFEDYVWFSDWAMPSVIRVNKRTGKDRVRLQGSMLKPSSLVVVHPLAKPGADPCLYQNGGCEHICKKRLGTAWCSCREGFMKASDGKTCLALDGHQLLAGGEVDLKNQVTPLDILSKTRVSEDNITESQHMLVAEIMVSDQDDCAPVGCSMYARCISEGEDATCQCLKGFAGDGKLCSDIDECEMGVPVCPPASSKCINTEGGYVCRCSEGYQGDGIHCLDIDECQLGVHSCGENASCTNTEGGYTCMCAGRLSEPGLICPDSTPPPHLREDDHHYSVRNSDSECPLSHDGYCLHDGVCMYIEALDKYACNCVVGYIGERCQYRDLKWWELRHAGHGQQQKVIVVAVCVVVLVMLLLLSLWGAHYYRTQKLLSKNPKNPYEESSRDVRSRRPADTEDGMSSCPQPWFVVIKEHQDLKNGGQPVAGEDGQAADGSMQPTSWRQEPQLCGMGTEQGCWIPVSSDKGSCPQVMERSFHMPSYGTQTLEGGVEKPHSLLSANPLWQQRALDPPHQMELTQ

SEQ ID NO: 909055 - protein, 877 aa, Homo sapiens
MLLTLIILLPVVSKFSFVSLSAPQHWSCPEGTLAGNGNSTCVGPAPFLIFSHGNSIFRIDTEGTNYEQLVVDAGVSVIMDFHYNEKRIYWVDLERQLLQRVFLNGSRQERVCNIEKNVSGMAINWINEEVIWSNQQEGIITVTDMKGNNSHILLSALKYPANVAVDPVERFIFWSSEVAGSLYRADLDGVGVKALLETSEKITAVSLDVLDKRLFWIQYNREGSNSLICSCDYDGGSVHISKHPTQHNLFAMSLFGDRIFYSTWKMKTIWIANKHTGKDMVRINLHSSFVPLGELKVVHPLAQPKAEDDTWEPEQKLCKLRKGNCSSTVCGQDLQSHLCMCAEGYALSRDRKYCEDVNECAFWNHGCTLGCKNTPGSYYCTCPVGFVLLPDGKRCHQLVSCPRNVSECSHDCVLTSEGPLCFCPEGSVLERDGKTCSGCSSPDNGGCSQLCVPLSPVSWECDCFPGYDLQLDEKSCAASGPQPFLLFANSQDIRHMHFDGTDYGTLLSQQMGMVYALDHDPVENKIYFAHTALKWIERANMDGSQRERLIEEGVDVPEGLAVDWIGRRFYWTDRGKSLIGRSDLNGKRSKIITKENISQPRGIAVHPMAKRLFWTDTGINPRIESSSLQGLGRLVIASSDLIWPSGITIDFLTDKLYWCDAKQSVIEMANLDGSKRRRLTQNDVGHPFAVAVFEDYVWFSDWAMPSVIRVNKRTGKDRVRLQGSMLKPSSLVVVHPLAKPGADPCLYQNGGCEHICKKRLGTAWCSCREGFMKASDGKTCLALDGHQLLAGGEVDLKNQVTPLDILSKTRVSEDNITESQHMLVAEIMVSDQDDCAPVGCSMYARCISEGEDATCQCLKGFAGDGKLCSVIRAPVPR

SEQ ID NO: 909056 - protein, 1133 aa, Homo sapiens
MLLTLIILLPVVSKFSFVSLSAPQHWSCPEGTLAGNGNSTCVGPAPFLIFSHGNSIFRIDTEGTNYEQLVVDAGVSVIMDFHYNEKRIYWVDLERQLLQRVFLNGSRQERVCNIEKNVSGMAINWINEEVIWSNQQEGIITVTDMKGNNSHILLSALKYPANVAVDPVERFIFWSSEVAGSLYRADLDGVGVKALLETSEKITAVSLDVLDKRLFWIQYNREGSNSLICSCDYDGGSVHISKHPTQHNLFAMSLFGDRIFYSTWKMKTIWIANKHTGKDMVRINLHSSFVPLGELKVVHPLAQPKAEDDTWEPEQKLCKLRKGNCSSTVCGQDLQSHLCMCAEGYALSRDRKYCEDVNECAFWNHGCTLGCKNTPGSYYCTCPVGFVLLPDGKRCHQLVSCPRNVSECSHDCVLTSEGPLCFCPEGSVLERDGKTCSGCSSPDNGGCSQLCVPLSPVSWECDCFPGYDLQLDEKSCAASGPQPFLLFANSQDIRHMHFDGTDYGTLLSQQMGMVYALDHDPVENKIYFAHTALKWIERANMDGSQRERLIEEGVDVPEGLAVDWIGRRFYWTDRGKSLIGRSDLNGKRSKIITKENISQPRGIAVHPMAKRLFWTDTGINPRIESSSLQGLGRLVIASSDLIWPSGITIDFLTDKLYWCDAKQSVIEMANLDGSKRRRLTQNDVGHPFAVAVFEDYVWFSDWAMPSVIRVNKRTGKDRVRLQGSMLKPSSLVVVHPLAKPGADPCLYQNGGCEHICKKRLGTAWCSCREGFMKASDGKTCLALDGHQLLAGGEVDLKNQVTPLDILSKTRVSEDNITESQHMLVAEIMVSDQDDCAPVGCSMYARCISEGEDATCQCLKGFAGDGKLCSDIDECEMGVPVCPPASSKCINTEGGYVCRCSEGYQGDGIHCLDIDECQLGVHSCGENASCTNTEGGYTCMCAGRLSEPGLICPDSTPPPHLREDDHHYSVRNSDSECPLSHDGYCLHDGVCMYIEALDKYACNCVVGYIGERCQYRDLKWWELRHAGHGQQQKVIVVAVCVVVLVMLLLLSLWGAHYYRTQKLLSKNPKNPYEESSRDVRSRRPADTEDGMSSCPQPWGQCNQLHGGRSPSYVEWAQSKAAGFQYPVIRAPVPR

SEQ ID NO: 909057 - protein, 1133 aa, Homo sapiens; identical to SEQ ID NO: 909056

SEQ ID NO: 909058 - protein, 1152 aa, Homo sapiens
MLLTLIILLPVVSKFSFVSLSAPQHWSCPEGTLAGNGNSTCVGPAPFLIFSHGNSIFRIDTEGTNYEQLVVDAGVSVIMDFHYNEKRIYWVDLERQLLQRVFLNGSRQERVCNIEKNVSGMAINWINEEVIWSNQQEGIITVTDMKGNNSHILLSALKYPANVAVDPVERFIFWSSEVAGSLYRADLDGVGVKALLETSEKITAVSLDVLDKRLFWIQYNREGSNSLICSCDYDGGSVHISKHPTQHNLFAMSLFGDRIFYSTWKMKTIWIANKHTGKDMVRINLHSSFVPLGELKVVHPLAQPKAEDDTWEPEQKLCKLRKGNCSSTVCGQDLQSHLCMCAEGYALSRDRKYCEDVNECAFWNHGCTLGCKNTPGSYYCTCPVGFVLLPDGKRCHQLVSCPRNVSECSHDCVLTSEGPLCFCPEGSVLERDGKTCSGCSSPDNGGCSQLCVPLSPVSWECDCFPGYDLQLDEKSCAASGPQPFLLFANSQDIRHMHFDGTDYGTLLSQQMGMVYALDHDPVENKIYFAHTALKWIERANMDGSQRERLIEEGVDVPEGLAVDWIGRRFYWTDRGKSLIGRSDLNGKRSKIITKENISQPRGIAVHPMAKRLFWTDTGINPRIESSSLQGLGRLVIASSDLIWPSGITIDFLTDKLYWCDAKQSVIEMANLDGSKRRRLTQNDVGHPFAVAVFEDYVWFSDWAMPSVIRVNKRTGKDRVRLQGSMLKPSSLVVVHPLAKPGADPCLYQNGGCEHICKKRLGTAWCSCREGFMKASDGKTCLALDGHQLLAGGEVDLKNQVTPLDILSKTRVSEDNITESQHMLVAEIMVSDQDDCAPVGCSMYARCISEGEDATCQCLKGFAGDGKLCSDIDECEMGVPVCPPASSKCINTEGGYVCRCSEGYQGDGIHCLDIDECQLGVHSCGENASCTNTEGGYTCMCAGRLSEPGLICPDSTPPPHLREDDHHYSVRNSDSECPLSHDGYCLHDGVCMYIEALDKYACNCVVGYIGERCQYRDLKWWELRHAGHGQQQKVIVVAVCVVVLVMLLLLSLWGAHYYRTQKLLSKNPKNPYEESSRDVRSRRPADTEDGMSSCPQPWGQCNQLHGGRSPSYVEWAQSKAAGFQYPVIRAPVPRIFPLGVIAQNLYVFSVTRL

SEQ ID NO: 909059 - protein, 687 aa, Homo sapiens
MLLTLIILLPVVSKFSFVSLSAPQHWSCPEGTLAGNGNSTCVGPAPFLIFSHGNSIFRIDTEGTNYEQLVVDAGVSVIMDFHYNEKRIYWVDLERQLLQRVFLNGSRQERVCNIEKNVSGMAINWINEEVIWSNQQEGIITVTDMKGNNSHILLSALKYPANVAVDPVERFIFWSSEVAGSLYRADLDGVGVKALLETSEKITAVSLDVLDKRLFWIQYNREGSNSLICSCDYDGGSVHISKHPTQHNLFAMSLFGDRIFYSTWKMKTIWIANKHTGKDMVRINLHSSFVPLGELKVVHPLAQPKAEDDTWEPEQKLCKLRKGNCSSTVCGQDLQSHLCMCAEGYALSRDRKYCEDVNECAFWNHGCTLGCKNTPGSYYCTCPVGFVLLPDGKRCHQLVSCPRNVSECSHDCVLTSEGPLCFCPEGSVLERDGKTCSGCSSPDNGGCSQLCVPLSPVSWECDCFPGYDLQLDEKSCAASGPQPFLLFANSQDIRHMHFDGTDYGTLLSQQMGMVYALDHDPVENKIYFAHTALKWIERANMDGSQRERLIEEGVDVPEGLAVDWIGRRFYWTDRGKSLIGRSDLNGKRSKIITKENISQPRGIAVHPMAKRLFWTDTGINPRIESSSLQGLGRLVIASSDLIWPSGITIDFLTDKLYWCDAKQSVIEMANLDGSKRRRLTQNDVGRS

SEQ ID NO: 909060 - protein, 1207 aa, Homo sapiens
MLLTLIILLPVVSKFSFVSLSAPQHWSCPEGTLAGNGNSTCVGPAPFLIFSHGNSIFRIDTEGTNYEQLVVDAGVSVIMDFHYNEKRIYWVDLERQLLQRVFLNGSRQERVCNIEKNVSGMAINWINEEVIWSNQQEGIITVTDMKGNNSHILLSALKYPANVAVDPVERFIFWSSEVAGSLYRADLDGVGVKALLETSEKITAVSLDVLDKRLFWIQYNREGSNSLICSCDYDGGSVHISKHPTQHNLFAMSLFGDRIFYSTWKMKTIWIANKHTGKDMVRINLHSSFVPLGELKVVHPLAQPKAEDDTWEPEQKLCKLRKGNCSSTVCGQDLQSHLCMCAEGYALSRDRKYCEDVNECAFWNHGCTLGCKNTPGSYYCTCPVGFVLLPDGKRCHQLVSCPRNVSECSHDCVLTSEGPLCFCPEGSVLERDGKTCSGCSSPDNGGCSQLCVPLSPVSWECDCFPGYDLQLDEKSCAASGPQPFLLFANSQDIRHMHFDGTDYGTLLSQQMGMVYALDHDPVENKIYFAHTALKWIERANMDGSQRERLIEEGVDVPEGLAVDWIGRRFYWTDRGKSLIGRSDLNGKRSKIITKENISQPRGIAVHPMAKRLFWTDTGINPRIESSSLQGLGRLVIASSDLIWPSGITIDFLTDKLYWCDAKQSVIEMANLDGSKRRRLTQNDVGHPFAVAVFEDYVWFSDWAMPSVIRVNKRTGKDRVRLQGSMLKPSSLVVVHPLAKPGADPCLYQNGGCEHICKKRLGTAWCSCREGFMKASDGKTCLALDGHQLLAGGEVDLKNQVTPLDILSKTRVSEDNITESQHMLVAEIMVSDQDDCAPVGCSMYARCISEGEDATCQCLKGFAGDGKLCSDIDECEMGVPVCPPASSKCINTEGGYVCRCSEGYQGDGIHCLDIDECQLGVHSCGENASCTNTEGGYTCMCAGRLSEPGLICPDSTPPPHLREDDHHYSVRNSDSECPLSHDGYCLHDGVCMYIEALDKYACNCVVGYIGERCQYRDLKWWELRHAGHGQQQKVIVVAVCVVVLVMLLLLSLWGAHYYRTQKLLSKNPKNPYEESSRDVRSRRPADTEDGMSSCPQPWFVVIKEHQDLKNGGQPVAGEDGQAADGSMQPTSWRQEPQLCGMGTEQGCWIPVSSDKGSCPQVMERSFHMPSYGTQTLEGGVEKPHSLLSANPLWQQRALDPPHQMELTQ

SEQ ID NO: 909061 - protein, 93 aa, Homo sapiens
QGVLGEISLEGLEVNHLCWEPQLCGMGTEQGCWIPVSSDKGSCPQVMERSFHMPSYGTQTLEGGVEKPHSLLSANPLWQQRALDPPHQMELTQ

SEQ ID NO: 909062 - protein, 1133 aa, Homo sapiens; identical to SEQ ID NO: 909056

SEQ ID NO: 909063 - protein, 1207 aa, Homo sapiens; identical to SEQ ID NO: 909060

SEQ ID NO: 909064 - protein, 1133 aa, Homo sapiens; identical to SEQ ID NO: 909056

SEQ ID NO: 909065 - protein, 891 aa, Homo sapiens
MLLTLIILLPVVSKFSFVSLSAPQHWSCPEGTLAGNGNSTCVGPAPFLIFSHGNSIFRIDTEGTNYEQLVVDAGVSVIMDFHYNEKRIYWVDLERQLLQRVFLNGSRQERVCNIEKNVSGMAINWINEEVIWSNQQEGIITVTDMKGNNSHILLSALKYPANVAVDPVERFIFWSSEVAGSLYRADLDGVGVKALLETSEKITAVSLDVLDKRLFWIQYNREGSNSLICSCDYDGGSVHISKHPTQHNLFAMSLFGDRIFYSTWKMKTIWIANKHTGKDMVRINLHSSFVPLGELKVVHPLAQPKAEDDTWEPEQKLCKLRKGNCSSTVCGQDLQSHLCMCAEGYALSRDRKYCEDVNECAFWNHGCTLGCKNTPGSYYCTCPVGFVLLPDGKRCHQLVSCPRNVSECSHDCVLTSEGPLCFCPEGSVLERDGKTCSGCSSPDNGGCSQLCVPLSPVSWECDCFPGYDLQLDEKSCAASGPQPFLLFANSQDIRHMHFDGTDYGTLLSQQMGMVYALDHDPVENKIYFAHTALKWIERANMDGSQRERLIEEGVDVPEGLAVDWIGRRFYWTDRGKSLIGRSDLNGKRSKIITKENISQPRGIAVHPMAKRLFWTDTGINPRIESSSLQGLGRLVIASSDLIWPSGITIDFLTDKLYWCDAKQSVIEMANLDGSKRRRLTQNDVGHPFAVAVFEDYVWFSDWAMPSVIRVNKRTGKDRVRLQGSMLKPSSLVVVHPLAKPGADPCLYQNGGCEHICKKRLGTAWCSCREGFMKASDGKTCLALDGHQLLAGGEVDLKNQVTPLDILSKTRVSEDNITESQHMLVAEIMVSDQDDCAPVGCSMYARCISEGEDATCQCLKGFAGDGKLCSDIDECEMGVRLAYAADQHPSLP

SEQ ID NO: 909066 - protein, 611 aa, Homo sapiens
MSCKKQRSRKHSVNEKCNMKIEHYFSPVSKEQQNNCSTSLMRMESRGDPRATTNTQAQRFHSPKKNPEDQTMPQNRTIYVTLKVNHRRNQDMKLKLTHSENSSLYMALNTLQAVRKEIETHQGQEMLVRGTEGIKEYINLGMPLSCFPEGGQVVITFSQSKSKQKEDNHIFGRQDKASTECVKFYIHAIGIGKCKRRIVKCGKLHKKGRKLCVYAFKGETIKDALCKDGRFLSFLENDDWKLIENNDTILESTQPVDELEGRYFQVEVEKRMVPSAAASQNPESEKRNTCVLREQIVAQYPSLKRESEKIIENFKKKMKVKNGETLFELHRTTFGKVTKNSSSIKVVKLLVRLSDSVGYLFWDSATTGYATCFVFKGLFILTCRHVIDSIVGDGIEPSKWATIIGQCVRVTFGYEELKDKETNYFFVEPWFEIHNEELDYAVLKLKENGQQVPMELYNGITPVPLSGLIHIIGHPYGEKKQIDACAVIPQGQRAKKCQERVQSKKAESPEYVHMYTQRSFQKIVHNPDVITYDTEFFFGASGSPVFDSKGSLVAMHAAGFAYTYQNETRSIIEFGSTMESILLDIKQRHKPWYEEVFVNQQDVEMMSDEDL

SEQ ID NO: 909067 - protein, 611 aa, Homo sapiens; identical to SEQ ID NO: 909066

SEQ ID NO: 909068 - protein, 569 aa, Homo sapiens [sequence omitted]

SEQ ID NO: 909069 - protein, 468 aa, Homo sapiens
MSCKKQRSRKHSVNEKCNMKIEHYFSPVSKEQQNNCSTSLMRMESRGDPRATTNTQAQRFHSPKKNPEDQTMPQNRTIYVTLKVNHRRNQDMKLKLTHSENSSLYMALNTLQAVRKEIETHQGQEMLVRGTEGIKEYINLGMPLSCFPEGGQVVITFSQSKSKQKEDNHIFGRQDKASTECVKFYIHAIGIGKCKRRIVKCGKLHKKGRKLCVYAFKGETIKDALCKDGRFLSFLENDDWKLIENNDTILESTQPVDELEGRYFQVEVEKRMVPSAAASQNPESEKRNTCVLREQIVAQYPSLKRESEKIIENFKKKMKVKNGETLFELHRTTFGKVTKNSSSIKVVKLLVRLSDSVGYLFWDSATTGYATCFVFKGLFILTCRHVIDSIVGDGIEPSKWATIIGQCVRVTFGYEELKDKETNYFFVEPWFEISYSHRVFSSFISLPKFICYSAGTKTCSSHDSLHLT

SEQ ID NO: 909070 - protein, 611 aa, Homo sapiens; identical to SEQ ID NO: 909066

SEQ ID NO: 909071 - protein, 611 aa, Homo sapiens; identical to SEQ ID NO: 909066

SEQ ID NO: 909072 - protein, 135 aa, Homo sapiens
QGDYRISLFGGFGYSERAEKCTERVQSKKAESPEYVHMYTQRSFQKIVHNPDVITYDTEFFFGASGSPVFDSKGSLVAMHAAGFAYTYQNETRSIIEFGSTMESILLDIKQRHKPWYEEVFVNQQDVEMMSDEDL

SEQ ID NO: 909073 - protein, 1498 aa, Homo sapiens
MDGASAEQDGLQEDRSHSGPSSLPEAPLKPPGPLVPPDQQDKVQCAEVNRASTEGESPDGPGQGGLCQNGPTPPFPDPPSSLDPTTSPVGPDASPGVAGFHDNLRKSQGTSAEGSVRKEALQSLRLSLPMQETQLCSTDSPLPLEKEEQVRLQARKWLEEQLKQYRVKRQQERSSQPATKTRLFSTLDPELMLNPENLPRASTLAMTKEYSFLRTSVPRGPKVGSLGLPAHPREKKTSKSSKIRSLADYRTEDSNAGNSGGNVPAPDSTKGSLKQNRSSAASVVSEISLSPDTDDRLENTSLAGDSVSEVDGNDSDSSSYSSASTRGTYGILSKTVGTQDTPYMVNGQEIPADTLGQFPSIKDVLQAAAAEHQDQGQEVNGEVRSRRDSICSSVSLESSAAETQEEMLQVLKEKMRLEGQLEALSLEASQALKEKAELQAQLAALSTKLQAQVECSHSSQQRQDSLSSEVDTLKQSCWDLERAMTDLQNMLEAKNASLASSNNDLQVAEEQYQRLMAKVEDMQRSMLSKDNTVHDLRQQMTALQSQLQQVQLERTTLTSKLKASQAEISSLQSVRQWYQQQLALAQEARVRLQGEMAHIQVGQMTQAGILEHLKLENVSLSQQLTETQHRSMKEKGRIAAQLQGIEADMLDQEAAFMQIQEAKTMVEEDLQRRLEEFEGERERLQRMADSAASLEQQLEQVKLTLLQRDQQLEALQQEHLDLMKQLTLTQEALQSREQSLDALQTHYDELQARLGELQGEAASREDTICLLQNEKIILEAALQAAKSGKEELDRGARRLEEGTEETSETLEKLREELAIKSGQVEHLQQETAALKKQMQKIKEQFLQQKVMVEAYRRDATSKDQLISELKATRKRLDSELKELRQELMQVHGEKRTAEAELSRLHREVAQVRQHMADLEGHLQSAQKERDEMETHLQSLQFDKEQMVAVTEANEALKKQIEELQQEARKAITEQKQKMRRLGSDLTSAQKEMKTKHKAYENAVGILSRRLQEALAAKEAADAELGQLRAQGGSSDSSLALHERIQALEAELQAVSHSKTLLEKELQEVIALTSQELEESREKVLELEDELQESRGFRKKIKRLEESNKKLALELEHEKGKLTGLGQSNAALREHNSILETALAKREADLVQLNLQVQAVLQRKEEEDRQMKHLVQALQASLEKEKEKVNSLKEQVAAAKVEAGHNRRHFKAASLELSEVKKELQAKEHLVQKLQAEADDLQIREGKHSQEIAQFQAELAEARAQLQLLQKQLDEQLSKQPVGNQEMENLKWEVDQKEREIQSLKQQLDLTEQQGRKELEGLQQLLQNVKSELEMAQEDLSMTQKDKFMLQAKVSELKNNMKTLLQQNQQLKLDLRRGAAKTRKEPKGEASSSNPATPIKIPDCPVPASLLEELLRPPPAVSKEPLKNLNSCLQQLKQEMDSLQRQMEEHALTVHESLSSWTPLEPATASPVPPGGHAGPRGDPQRHSQSRASKEGPGE

SEQ ID NO: 909074 - protein, 729 aa, Homo sapiens
EQGRFRTGDSAALQAAKSGKEELDRGARRLEEGTEETSETLEKLREELAIKSGQVEHLQQETAALKKQMQKIKEQFLQQKVMVEAYRRDATSKDQLISELKATRKRLDSELKELRQELMQVHGEKRTAEAELSRLHREVAQVRQHMADLEGHLQSAQKERDEMETHLQSLQFDKEQMVAVTEANEALKKQIEELQQEARKAITEQKQKMRRLGSDLTSAQKEMKTKHKAYENAVGILSRRLQEALAAKEAADAELGQLRAQGGSSDSSLALHERIQALEAELQAVSHSKTLLEKELQEVIALTSQELEESREKVLELEDELQESRGFRKKIKRLEESNKKLALELEHEKGKLTGLGQSNAALREHNSILETALAKREADLVQLNLQVQAVLQRKEEEDRQMKHLVQALQASLEKEKEKVNSLKEQVAAAKVEAGHNRRHFKAASLELSEVKKELQAKEHLVQKLQAEADDLQIREGKHSQEIAQFQAELAEARAQLQLLQKQLDEQLSKQPVGNQEMENLKWEVDQKEREIQSLKQQLDLTEQQGRKELEGLQQLLQNVKSELEMAQEDLSMTQKDKFMLQAKVSELKNNMKTLLQQNQQLKLDLRRGAAKTRKEPKGEASSSNPATPIKIPDCPVPASLLEELLRPPPAVSKEPLKNLNSCLQQLKQEMDSLQRQMEEHALTVHESLSSWTPLEPATASPVPPGGHAGPRGDPQRHSQSRASKEGPGE

SEQ ID NO: 909075 - protein, 1458 aa, Homo sapiens
MDGASAEQDGLQEDRSHSGPSSLPEAPLKPPGPLVPPDQQDKVQCAEVNRASTEGESPDGPGQGGLCQNGPTPPFPDPPSSLDPTTSPVGPDASPGSTDSPLPLEKEEQVRLQARKWLEEQLKQYRVKRQQERSSQPATKTRLFSTLDPELMLNPENLPRASTLAMTKEYSFLRTSVPRGPKVGSLGLPAHPREKKTSKSSKIRSLADYRTEDSNAGNSGGNVPAPDSTKGSLKQNRSSAASVVSEISLSPDTDDRLENTSLAGDSVSEVDGNDSDSSSYSSASTRGTYGILSKTVGTQDTPYMVNGQEIPADTLGQFPSIKDVLQAAAAEHQDQGQEVNGEVRSRRDSICSSVSLESSAAETQEEMLQVLKEKMRLEGQLEALSLEASQALKEKAELQAQLAALSTKLQAQVECSHSSQQRQDSLSSEVDTLKQSCWDLERAMTDLQNMLEAKNASLASSNNDLQVAEEQYQRLMAKVEDMQRSMLSKDNTVHDLRQQMTALQSQLQQVQLERTTLTSKLKASQAEISSLQSVRQWYQQQLALAQEARVRLQGEMAHIQVGQMTQAGILEHLKLENVSLSQQLTETQHRSMKEKGRIAAQLQGIEADMLDQEAAFMQIQEAKTMVEEDLQRRLEEFEGERERLQRMADSAASLEQQLEQVKLTLLQRDQQLEALQQEHLDLMKQLTLTQEALQSREQSLDALQTHYDELQARLGELQGEAASREDTICLLQNEKIILEAALQAAKSGKEELDRGARRLEEGTEETSETLEKLREELAIKSGQVEHLQQETAALKKQMQKIKEQFLQQKVMVEAYRRDATSKDQLISELKATRKRLDSELKELRQELMQVHGEKRTAEAELSRLHREVAQVRQHMADLEGHLQSAQKERDEMETHLQSLQFDKEQMVAVTEANEALKKQIEELQQEARKAITEQKQKMRRLGSDLTSAQKEMKTKHKAYENAVGILSRRLQEALAAKEAADAELGQLRAQGGSSDSSLALHERIQALEAELQAVSHSKTLLEKELQEVIALTSQELEESREKVLELEDELQESRGFRKKIKRLEESNKKLALELEHEKGKLTGLGQSNAALREHNSILETALAKREADLVQLNLQVQAVLQRKEEEDRQMKHLVQALQASLEKEKEKVNSLKEQVAAAKVEAGHNRRHFKAASLELSEVKKELQAKEHLVQKLQAEADDLQIREGKHSQEIAQFQAELAEARAQLQLLQKQLDEQLSKQPVGNQEMENLKWEVDQKEREIQSLKQQLDLTEQQGRKELEGLQQLLQNVKSELEMAQEDLSMTQKDKFMLQAKVSELKNNMKTLLQQNQQLKLDLRRGAAKTRKEPKGEASSSNPATPIKIPDCPVPASLLEELLRPPPAVSKEPLKNLNSCLQQLKQEMDSLQRQMEEHALTVHESLSSWTPLEPATASPVPPGGHAGPRGDPQRHSQSRASKEGPGE

SEQ ID NO: 909076 - protein, 1480 aa, Homo sapiens
VQGDRTTQLELTLRGYTSEPWTSLASAISNSQELLEGESPDGPGQGGLCQNGPTPPFPDPPSSLDPTTSPVGPDASPGVAGFHDNLRKSQGTSAEGSVRKEALQSLRLSLPMQETQLCSTDSPLPLEKEEQVRLQARKWLEEQLKQYRVKRQQERSSQPATKTRLFSTLDPELMLNPENLPRASTLAMTKEYSFLRTSVPRGPKVGSLGLPAHPREKKTSKSSKIRSLADYRTEDSNAGNSGGNVPAPDSTKGSLKQNRSSAASVVSEISLSPDTDDRLENTSLAGDSVSEVDGNDSDSSSYSSASTRGTYGILSKTVGTQDTPYMVNGQEIPADTLGQFPSIKDVLQAAAAEHQDQGQEVNGEVRSRRDSICSSVSLESSAAETQEEMLQVLKEKMRLEGQLEALSLEASQALKEKAELQAQLAALSTKLQAQVECSHSSQQRQDSLSSEVDTLKQSCWDLERAMTDLQNMLEAKNASLASSNNDLQVAEEQYQRLMAKVEDMQRSMLSKDNTVHDLRQQMTALQSQLQQVQLERTTLTSKLKASQAEISSLQSVRQWYQQQLALAQEARVRLQGEMAHIQVGQMTQAGILEHLKLENVSLSQQLTETQHRSMKEKGRIAAQLQGIEADMLDQEAAFMQIQEAKTMVEEDLQRRLEEFEGERERLQRMADSAASLEQQLEQVKLTLLQRDQQLEALQQEHLDLMKQLTLTQEALQSREQSLDALQTHYDELQARLGELQGEAASREDTICLLQNEKIILEAALQAAKSGKEELDRGARRLEEGTEETSETLEKLREELAIKSGQVEHLQQETAALKKQMQKIKEQFLQQKVMVEAYRRDATSKDQLISELKATRKRLDSELKELRQELMQVHGEKRTAEAELSRLHREVAQVRQHMADLEGHLQSAQKERDEMETHLQSLQFDKEQMVAVTEANEALKKQIEELQQEARKAITEQKQKMRRLGSDLTSAQKEMKTKHKAYENAVGILSRRLQEALAAKEAADAELGQLRAQGGSSDSSLALHERIQALEAELQAVSHSKTLLEKELQEVIALTSQELEESREKVLELEDELQESRGFRKKIKRLEESNKKLALELEHEKGKLTGLGQSNAALREHNSILETALAKREADLVQLNLQVQAVLQRKEEEDRQMKHLVQALQASLEKEKEKVNSLKEQVAAAKVEAGHNRRHFKAASLELSEVKKELQAKEHLVQKLQAEADDLQIREGKHSQEIAQFQAELAEARAQLQLLQKQLDEQLSKQPVGNQEMENLKWEVDQKEREIQSLKQQLDLTEQQGRKELEGLQQLLQNVKSELEMAQEDLSMTQKDKFMLQAKVSELKNNMKTLLQQNQQLKLDLRRGAAKTRKEPKGEASSSNPATPIKIPDCPVPASLLEELLRPPPAVSKEPLKNLNSCLQQLKQEMDSLQRQMEEHALTVHESLSSWTPLEPATASPVPPGGHAGPRGDPQRHSQSRASKEGPGE

SEQ ID NO: 909077 - protein, 107 aa, Homo sapiens
DFSLMGSPQVDVHHVFFFLLGQTNSENTEGKVALCSHPGFPVLLQSSRSPGSFVVTPASCGKQRRLPEETGRHREEGGCALPGVSETDALFKISTTCVRSSVSYPKS

SEQ ID NO: 909078 - protein, 313 aa, Homo sapiens
LRGRAATNSVAAAKVEAGHNRRHFKAASLELSEVKKELQAKEHLVQKLQAEADDLQIREGKHSQEIAQFQAELAEARAQLQLLQKQLDEQLSKQPVGNQEMENLKWEVDQKEREIQSLKQQLDLTEQQGRKELEGLQQLLQNVKSELEMAQEDLSMTQKDKFMLQAKVSELKNNMKTLLQQNQQLKLDLRRGAAKTRKEPKGEASSSNPATPIKIPDCPVPASLLEELLRPPPAVSKEPLKNLNSCLQQLKQEMDSLQRQMEEHALTVHESLSSWTPLEPATASPVPPGGHAGPRGDPQRHSQSRASKEGPGE

SEQ ID NO: 909079 - protein, 308 aa, Homo sapiens
FPGALSVTSVRMCPLLELSVTFVQMCSPPGGFSVTSVQTDSPLQAEADDLQIREGKHSQEIAQFQAELAEARAQLQLLQKQLDEQLSKQPVGNQEMENLKWEVDQKEREIQSLKQQLDLTEQQGRKELEGLQQLLQNVKSELEMAQEDLSMTQKDKFMLQAKVSELKNNMKTLLQQNQQLKLDLRRGAAKTRKEPKGEASSSNPATPIKIPDCPVPASLLEELLRPPPAVSKEPLKNLNSCLQQLKQEMDSLQRQMEEHALTVHESLSSWTPLEPATASPVPPGGHAGPRGDPQRHSQSRASKEGPGE

SEQ ID NO: 909080 - protein, 1196 aa, Homo sapiens
MDGASAEQDGLQEDRSHSGPSSLPEAPLKPPGPLVPPDQQDKVQCAEVNRASTEGESPDGPGQGGLCQNGPTPPFPDPPSSLDPTTSPVGPDASPGSTDSPLPLEKEEQVRLQARKWLEEQLKQYRVKRQQERSSQPATKTRLFSTLDPELMLNPENLPRASTLAMTKEYSFLRTSVPRGPKVGSLGLPAHPREKKTSKSSKIRSLADYRTEDSNAGNSGGNVPAPDSTKGSLKQNRSSAASVVSEISLSPDTDDRLENTSLAGDSVSEVDGNDSDSSSYSSASTRGTYGILSKTVGTQDTPYMVNGQEIPADTLGQFPSIKDVLQAAAAEHQDQGQEVNGEVRSRRDSICSSVSLESSAAETQEEMLQVLKEKMRLEGQLEALSLEASQALKEKAELQAQLAALSTKLQAQVECSHSSQQRQDSLSSEVDTLKQSCWDLERAMTDLQNMLEAKNASLASSNNDLQVAEEQYQRLMAKVEDMQRSMLSKDNTVHDLRQQMTALQSQLQQVQLERTTLTSKLKASQAEISSLQSVRQWYQQQLALAQEARVRLQGEMAHIQVGQMTQAGILEHLKLENVSLSQQLTETQHRSMKEKGRIAAQLQGIEADMLDQEAAFMQIQEAKTMVEEDLQRRLEEFEGERERLQRMADSAASLEQQLEQVKLTLLQRDQQLEALQQEHLDLMKQLTLTQEALQSREQSLDALQTHYDELQARLGELQGEAASREDTICLLQNEKIILEAALQAAKSGKEELDRGARRLEEGTEETSETLEKLREELAIKSGQVEHLQQETAALKKQMQKIKEQFLQQKVMVEAYRRDATSKDQLISELKATRKRLDSELKELRQELMQVHGEKRTAEAELSRLHREVAQVRQHMADLEGHLQSAQKERDEMETHLQSLQFDKEQMVAVTEANEALKKQIEELQQEARKAITEQKQKMRRLGSDLTSAQKEMKTKHKAYENAVGILSRRLQEALAAKEAADAELGQLRAQGGSSDSSLALHERIQALEAELQAVSHSKTLLEKELQEVIALTSQELEESREKVLELEDELQESRGFRKKIKRLEESNKKLALELEHEKGKLTGLGQSNAALREHNSILETALAKREADLVQLNLQVQAVLQRKSHATSRTKSHTRGPEVPHHEPRKEPPNERRLVVAGCPRWNLSSTLNLPKEPHEEPREEPRHEPREEPPNAPRM

SEQ ID NO: 909081 - protein, 78 aa, Homo sapiens
RLRRSIRAGRPPGLPEQQETGCVAVLPRLVWNSWPQAILPPQPPKVLVLQAVYLKWQEGNKSSDITQIEEELFFPRLP

SEQ ID NO: 909082 - protein, 103 aa, Homo sapiens
DFSLMGSPQVDVHHVFFFLLGQTNSENTEGKVALCSHPGFPVLLQSSRSPGSFVVTPASCGKQRRLPEETGRHREEGGCALPGVSETDALFKISTTCVRRDLS

SEQ ID NO: 909083 - protein, 198 aa, Homo sapiens
HGRLLRIKLMFGPTSVPRGPKVGSLGLPAHPREKKTSKSSKIRSLADYRTEDSNAGNSGGNVPAPDSTKGSLKQNRSSAASVVSEISLSPDTDDRLENTSLAGDSVSEVDGNDSDSSSYSSASTRGTYGILSKTVGTQDTPYMVNGQEIPADTLGQFPSIKDVLQAAAAEHQDQGQEVNGEVRSRRDSICSRWWGQQR

SEQ ID NO: 909084 - protein, 1369 aa, Homo sapiens
MQETQLCSTDSPLPLEKEEQVRLQARKWLEEQLKQYRVKRQQERSSQPATKTRLFSTLDPELMLNPENLPRASTLAMTKEYSFLRTSVPRGPKVGSLGLPAHPREKKTSKSSKIRSLADYRTEDSNAGNSGGNVPAPDSTKGSLKQNRSSAASVVSEISLSPDTDDRLENTSLAGDSVSEVDGNDSDSSSYSSASTRGTYGILSKTVGTQDTPYMVNGQEIPADTLGQFPSIKDVLQAAAAEHQDQGQEVNGEVRSRRDSICSSVSLESSAAETQEEMLQVLKEKMRLEGQLEALSLEASQALKEKAELQAQLAALSTKLQAQVECSHSSQQRQDSLSSEVDTLKQSCWDLERAMTDLQNMLEAKNASLASSNNDLQVAEEQYQRLMAKVEDMQRSMLSKDNTVHDLRQQMTALQSQLQQVQLERTTLTSKLKASQAEISSLQSVRQWYQQQLALAQEARVRLQGEMAHIQVGQMTQAGILEHLKLENVSLSQQLTETQHRSMKEKGRIAAQLQGIEADMLDQEAAFMQIQEAKTMVEEDLQRRLEEFEGERERLQRMADSAASLEQQLEQVKLTLLQRDQQLEALQQEHLDLMKQLTLTQEALQSREQSLDALQTHYDELQARLGELQGEAASREDTICLLQNEKIILEAALQAAKSGKEELDRGARRLEEGTEETSETLEKLREELAIKSGQVEHLQQETAALKKQMQKIKEQFLQQKVMVEAYRRDATSKDQLISELKATRKRLDSELKELRQELMQVHGEKRTAEAELSRLHREVAQVRQHMADLEGHLQSAQKERDEMETHLQSLQFDKEQMVAVTEANEALKKQIEELQQEARKAITEQKQKMRRLGSDLTSAQKEMKTKHKAYENAVGILSRRLQEALAAKEAADAELGQLRAQGGSSDSSLALHERIQALEAELQAVSHSKTLLEKELQEVIALTSQELEESREKVLELEDELQESRGFRKKIKRLEESNKKLALELEHEKGKLTGLGQSNAALREHNSILETALAKREADLVQLNLQVQAVLQRKEEEDRQMKHLVQALQASLEKEKEKVNSLKEQVAAAKVEAGHNRRHFKAASLELSEVKKELQAKEHLVQKLQAEADDLQIREGKHSQEIAQFQAELAEARAQLQLLQKQLDEQLSKQPVGNQEMENLKWEVDQKEREIQSLKQQLDLTEQQGRKELEGLQQLLQNVKSELEMAQEDLSMTQKDKFMLQAKVSELKNNMKTLLQQNQQLKLDLRRGAAKTRKEPKGEASSSNPATPIKIPDCPVPASLLEELLRPPPAVSKEPLKNLNSCLQQLKQEMDSLQRQMEEHALTVHESLSSWTPLEPATASPVPPGGHAGPRGDPQRHSQSRASKEGPGE

SEQ ID NO: 909085 - protein, 661 aa, Homo sapiens
MQKIKEQFLQQKVMVEAYRRDATSKDQLISELKATRKRLDSELKELRQELMQVHGEKRTAEAELSRLHREVAQVRQHMADLEGHLQSAQKERDEMETHLQSLQFDKEQMVAVTEANEALKKQIEELQQEARKAITEQKQKMRRLGSDLTSAQKEMKTKHKAYENAVGILSRRLQEALAAKEAADAELGQLRAQGGSSDSSLALHERIQALEAELQAVSHSKTLLEKELQEVIALTSQELEESREKVLELEDELQESRGFRKKIKRLEESNKKLALELEHEKGKLTGLGQSNAALREHNSILETALAKREADLVQLNLQVQAVLQRKEEEDRQMKHLVQALQASLEKEKEKVNSLKEQVAAAKVEAGHNRRHFKAASLELSEVKKELQAKEHLVQKLQAEADDLQIREGKHSQEIAQFQAELAEARAQLQLLQKQLDEQLSKQPVGNQEMENLKWEVDQKEREIQSLKQQLDLTEQQGRKELEGLQQLLQNVKSELEMAQEDLSMTQKDKFMLQAKVSELKNNMKTLLQQNQQLKLDLRRGAAKTRKEPKGEASSSNPATPIKIPDCPVPASLLEELLRPPPAVSKEPLKNLNSCLQQLKQEMDSLQRQMEEHALTVHESLSSWTPLEPATASPVPPGGHAGPRGDPQRHSQSRASKEGPGE

SEQ ID NO: 909086 - protein, 1262 aa, Homo sapiens
MDGASAEQDGLQEDRSHSGPSSLPEAPLKPPGPLVPPDQQDKVQCAEVNRASTEGESPDGPGQGGLCQNGPTPPFPDPPSSLDPTTSPVGPDASPGSTDSPLPLEKEEQVRLQARKWLEEQLKQYRVKRQQERSSQPATKTRLFSTLDPELMLNPENLPRASTLAMTKEYSFLRTSVPRGPKVGSLGLPAHPREKKTSKSSKIRSLADYRTEDSNAGNSGGNVPAPDSTKGSLKQNRSSAASVVSEISLSPDTDDRLENTSLAGDSVSEVDGNDSDSSSYSSASTRGTYGILSKTVGTQDTPYMVNGQEIPADTLGQFPSIKDVLQAAAAEHQDQGQEVNGEVRSRRDSICSSVSLESSAAETQEEMLQVLKEKMRLEGQLEALSLEASQALKEKAELQAQLAALSTKLQAQVECSHSSQQRQDSLSSEVDTLKQSCWDLERAMTDLQNMLEAKNASLASSNNDLQVAEEQYQRLMAKVEDMQRSMLSKDNTVHDLRQQMTALQSQLQQVQLERTTLTSKLKASQAEISSLQSVRQWYQQQLALAQEARVRLQGEMAHIQVGQMTQAGILEHLKLENVSLSQQLTETQHRSMKEKGRIAAQLQGIEADMLDQEAAFMQIQEAKTMVEEDLQRRLEEFEGERERLQRMADSAASLEQQLEQVKLTLLQRDQQLEALQQEHLDLMKQLTLTQEALQSREQSLDALQTHYDELQARLGELQGEAASREDTICLLQNEKIILEAALQAAKSGKEELDRGARRLEEGTEETSETLEKLREELAIKSGQVEHLQQETAALKKQMQKIKEQFLQQKVMVEAYRRDATSKDQLISELKATRKRLDSELKELRQELMQVHGEKRTAEAELSRLHREVAQVRQHMADLEGHLQSAQKERDEMETHLQSLQFDKEQMVAVTEANEALKKQIEELQQEARKAITEQKQKMRRLGSDLTSAQKEMKTKHKAYENAVGILSRRLQEALAAKEAADAELGQLRAQGGSSDSSLALHERIQALEAELQAVSHSKTLLEKELQEVIALTSQELEESREKVLELEDELQESRGFRKKIKRLEESNKKLALELEHEKGKLTGLGQSNAALREHNSILETALAKREADLVQLNLQVQAVLQRKEEEDRQMKHLVQALQASLEKEKEKVNSLKEQVAAAKVEAGHNRRHFKAASLELSEVKKELQAKEHLVQKLQAEADDLQIREGKHSQEIAQFQAELAEARAQLQLLQKQLDEQLSKQPVGNQEMENLKWEVDQKERERQV

SEQ ID NO: 909087 - protein, 729 aa, Homo sapiens; identical to SEQ ID NO: 909074

SEQ ID NO: 909088 - protein, 165 aa, Homo sapiens
MDGASAEQDGLQEDRSHSGPSSLPEAPLKPPGPLVPPDQQDKVQCAEVNRASTEGESPDGPGQGGLCQNGPTPPFPDPPSSLDPTTSPVGPDASPGSTDSPLPLEKEEQVRLQARKWLEEQLKQYRVKRQQERVSLPLPNKLMESFLCQRQLLVPHNPGTCHWLL

SEQ ID NO: 909089 - protein, 107 aa, Homo sapiens
LQRKEEEDRQMKHLVQALQASLEKEKEKVNSLKEQVRATFRLTGRSRGRSSAKKSMQGPSHTSLLPAVTQSKGVLQLLVTEAAEHLLWSVEGGVRLNGSAAVRAWGQ

SEQ ID NO: 909090 - protein, 268 aa, Homo sapiens
RRIRHEGSRGGWAGEMAASGESGTSGGGGSTEEAFMTFYSEVKQIEKRDSVLTSKNQIERLTRPGSSYFNLNPFEVLQIDPEVTDEEIKKRFRQLSILVHPDKNQDDADRAQKAFEAVDKAYKLLLDQEQKKRALDVIQAGKEYVEHTVKERKKQLKKEGKPTIVEEDDPELFKQAVYKQTMKLFAELEIKRKEREAKEMHERKRQREEEIEAQEKAKREREWQKNFEESRDGRVDSWRNFQANTKGKKEKKNRTFLRPPKVKMEQRE

SEQ ID NO: 909091 - protein, 256 aa, Homo sapiens
RRIRHEGSRGGWAGEMAASGESGTSGGGGSTEEAFMTFYSEVKQIEKRDSVLTSKNQIERLTRPGSSYFNLNPFEVLQIDPEVTDEEIKKRFRQLSILVHPDKNQDDADRAQKAFEAVDKAYKLLLDQEQKKRALDVIQAGKEYVEHTKKKKKERTTKKKKTKKKNFWGVGPERRVFKNHFRGGAAAPLVYVNTVPRHLVPRGNTGGQEQRRGLSSTNIKKTPGENTETVREQIPKGPAKPRGGPTPETPGTRIKE

SEQ ID NO: 909092 - protein, 109 aa, Homo sapiens
MCVGRAEGPPREEFRKRPIAWGRAGAPGGKGDNGDISGAAQGKPGDQDTGRGIAHTNIKKTARGGQNGTVCREHNPQMGESRGAQYRGTPKQRRESQRELRRSPIYSPA

SEQ ID NO: 909093 - protein, 268 aa, Homo sapiens; identical to SEQ ID NO: 909090

SEQ ID NO: 909094 - protein, 268 aa, Homo sapiens; identical to SEQ ID NO: 909090

SEQ ID NO: 909095 - protein, 268 aa, Homo sapiens; identical to SEQ ID NO: 909090

SEQ ID NO: 909096 - protein, 180 aa, Homo sapiens
RRIRHEGSRGGWAGEMAASGESGTSGGGGSTEEAFMTFYSEVKQIEKRDSVLTSKNQIERLTRPGSSYFNLNPFEVLQIDPEVTDEEIKKRFRQLSILVHPDKNQDDADRAQKAFEAVDKAYKLLLDQEQKKRALDVIQAGKEYVEHTVKERKKQLKKEGKPTIVEEDDPELETTKGRRD

SEQ ID NO: 909097 - protein, 133 aa, Homo sapiens
LIKPPQERIVEHTVKERKKQLKKEGKPTIVEEDDPELFKQAVYKQTMKLFAELEIKRKEREAKEMHERKRQREEEIEAQEKAKREREWQKNFEESRDGRVDSWRNFQANTKGKKEKKNRTFLRPPKVKMEQRE

SEQ ID NO: 909098 - protein, 111 aa, Homo sapiens
RRIRHEGSRGGWAGEMAASGESGTSGGGGSTEEAFMTFYSESWKLKGKREKPKRCMKGNDKGKKRLKLKKKPNGKESGRKTLRKVEMVVWTAGETSKPIRRGRKRRKIGPS

SEQ ID NO: 909099 - protein, 268 aa, Homo sapiens; identical to SEQ ID NO: 909090

SEQ ID NO: 909100 - protein, 114 aa, Homo sapiens
MMLTEHKRLLKVKERKKQLKKEGKPTIVEEDDPELFKQAVYKQTMKLFAELEIKRKEREAKEMHERKRQREEEIEAQEKAKREREWQKNFEGKCPRWSGMMVRNFVDSLWKSSN

SEQ ID NO: 909101 - protein, 139 aa, Homo sapiens
RRIRHEGSRGGWAGEMAASGESGTSGGGGSTEEAFMTFYSEVKQIEKRDSVLTSKNQIERLTRPGSSYFNLNPFEVLQIDPEVTDEEIKKRFRQLSILVHPDKNQDDADRAQKAFEAVDKAYKLLLDQEQKKRALEGAP

SEQ ID NO: 909102 - protein, 256 aa, Homo sapiens
RRIRHEGSRGGWAGEMAASGESGTSGGGGSTEEAFMTFYSEVKQIEKRDSVLTSKNQIERLTRPGSSYFNLNPFEVLQIDPEVTDEEIKKRFRQLSILVHPDKNQDDADRAQKAFEAVDKAYKLLLDQEQKKRALDVIQAGKEYVEHTVKERKKQLKKEGKPTIVEEDDPELFKQAVYKQTMKLFAELEIKRKEREAKEMHERKRQREEEIEAQEKAKREREWQKNFEESRDGRVDSWRNFQANTKGKKEKKIGPF

SEQ ID NO: 909103 - protein, 133 aa, Homo sapiens; identical to SEQ ID NO: 909097

SEQ ID NO: 909104 - protein, 268 aa, Homo sapiens; identical to SEQ ID NO: 909090

SEQ ID NO: 909105 - protein, 268 aa, Homo sapiens; identical to SEQ ID NO: 909090

SEQ ID NO: 909106 - protein, 268 aa, Homo sapiens; identical to SEQ ID NO: 909090

SEQ ID NO: 909107 - protein, 268 aa, Homo sapiens; identical to SEQ ID NO: 909090

SEQ ID NO: 909108 - protein, 249 aa, Homo sapiens
RRIRHEGSRGGWAGEMAASGESGTSGGGGSTEEAFMTFYSEVLQIDPEVTDEEIKKRFRQLSILVHPDKNQDDADRAQKAFEAVDKAYKLLLDQEQKKRALDVIQAGKEYVEHTVKERKKQLKKEGKPTIVEEDDPELFKQAVYKQTMKLFAELEIKRKEREAKEMHERKRQREEEIEAQEKAKREREWQKNFEESRDGRVDSWRNFQANTKGKKEKTPKVTGTEPFPCYLPSCFEGLILSSHFHPNIE

SEQ ID NO: 909109 - protein, 251 aa, Homo sapiens
RRIRHEGSRGGWAGEMAASGESGTSGGGGSTEEAFMTFYSEVKQIEKRDSVLTSKNQIERLTRPGSSYFNLNPFEVLQIDPEVTDEEIKKRFRQLSILVHPDKNQDDADRAQKAFEAVDKAYKLLLDQEQKKRALDVIQAGKEYVEHTVKERKKQLKKEGKPTIVEEDDPELFKQAVYKQTMKLFAELEIKRKEREAKEMHERKRQREEEIEAQEKAKREREWQKNFEGKCPRWSGMMVRNFVDSLWKSSN

SEQ ID NO: 909110 - protein, 177 aa, Homo sapiens
ALCFAVSRSLLLTCLVPAALLGLRYYYSRKVIRAYLECALHTDMADIEQYYMKPPGSCFWVAVLDGNVVGIVAARAHEEDNTVELLRMSVDSRFRGKGIAKALGRKVLEFAVVHNYSAVVLGTTAVKVAAHKLYESLGFRHMGASDHYVLPGMTLSLAERLFFQVRYHRYRLQLREE

SEQ ID NO: 909111 - protein, 177 aa, Homo sapiens; identical to SEQ ID NO: 909110

SEQ ID NO: 909112 - protein, 177 aa, Homo sapiens; identical to SEQ ID NO: 909110

SEQ ID NO: 909113 - protein, 68 aa, Homo sapiens
HEARALAHHAPRAARPDRGLSRARHGKAEPPKGVMINDLMINLDASSHASGHPTGNDTPAPGIRLSST

SEQ ID NO: 909114 - protein, 171 aa, Homo sapiens
MATQRKHLVKDFNPYITCYICKGYLIKPTTVTECLHTFCKTCIVQHFEDSNDCPRCGNQVHETNPLEMLRLDNTLEEIIFKLVPGLREQELERESEFWKKNKPQENGQDDTSKADKPKVDEEGDENEDDKDYHRSDPQIAICLDCLRNNGQSGDNVVKGLTDTKFLRCSNT

SEQ ID NO: 909115 - protein, 100 aa, Homo sapiens
RVGGVALGGGTGPGPRGPPRPVGPEPSGPTEPARSRLQGESRRGAGTGQAAAGAVSVSLSFTLRPARWRARSGGGGGRWTWESGTTKRSDDQRSHDKSGC

SEQ ID NO: 909116 - protein, 171 aa, Homo sapiens; identical to SEQ ID NO: 909114

SEQ ID NO: 909117 - protein, 66 aa, Homo sapiens
DTSKADKPKVDEEGDENEDDKDYHRSDPQIAICLDCLRNNGQSGDNVVKVSEQVLWYFYDQFIVNP

SEQ ID NO: 909118 - protein, 100 aa, Homo sapiens; identical to SEQ ID NO: 909115

SEQ ID NO: 909119 - protein, 100 aa, Homo sapiens; identical to SEQ ID NO: 909115

SEQ ID NO: 909120 - protein, 85 aa, Homo sapiens
GKLVKGFTIAARNGAEYRDPRAPRLGLVLTLIAPLVSSLCYCSHSDSYYISPKPLQHILNCVQVVIIKNSLLSLSLSLLTHPKIS

SEQ ID NO: 909121 - protein, 150 aa, Homo sapiens
CRKHRLLLEEDNKMLVNELNHSKEKECQYEKEKAEREVAVRQLQQKRDDVLNKGSATKALLDASSRHCTYLENGMQDSRKKLDQMRSQFQEIQDQLTATIRCTKEMEGDTQKLEVEHVMMRKIIKKQDDQIERLEKILQHSSLMLQVFES

SEQ ID NO: 909122 - protein, 150 aa, Homo sapiens; identical to SEQ ID NO: 909121

SEQ ID NO: 909123 - protein, 112 aa, Homo sapiens
CRKHRLLLEEDNKMLVNELNHSKEKECQYEKEKAEREVAVRQLQQKRDDVLNKGSATKALLDASSRHCTYLENGMQDSRKKLDQMRSQFQEIQDQLTATIRCTKEMEGDTQK

SEQ ID NO: 909124 - protein, 101 aa, Homo sapiens
CRKHRLLLEEDNKMLVNELNHSKEKECQYEKEKAEREVAVRQLQQKRDDVLNKGSATKALLDASSRHCTYLENGMQDSRKKLDQMRSQVCMQLCTPTTVNL

SEQ ID NO: 909125 - protein, 118 aa, Homo sapiens
MQQITQLIEVMLVGRGGDQAVGQATLGIDTNVGLHAKVPLIAFLGLMHLRIALLLFVLGRAGCLNDGGIDQGALSHHDACFGQPAIDGLEQLAGQLMLLQQVAEIHDGGAVRQGAIQG

SEQ ID NO: 909126 - protein, 503 aa, Homo sapiens
MEEHGVTQTEHMATIEAHAVAQQVQQVHVATYTEHSMLSADEDSPSSPEDTSYDDSDILNSTAADEVTAHLAAAGPVGMAAAAAVATGKKRKRPHVFESNPSIRKRQQTRLLRKLRATLDEYTTRVGQQAIVLCISPSKPNPVFKVFGAAPLENVVRKYKSMILEDLESALAEHAPAPQEVNSELPPLTIDGIPVSVDKMTQAQLRAFIPEMLKYSTGRGKPGWGKESCKPIWWPEDIPWANVRSDVRTEEQKQRVSWTQALRTIVKNCYKQHGREDLLYAFEDQQTQTQATATHSIAHLVPSQTVVQTFSNPDGTVSLIQVGTGATVATLADASELPTTVTVAQVNYSAVADGEVEQNWATLQGGEMTIQTTQASEATQAVASLAEAAVAASQEMQQGATVTMALNSEAAAHAVATLAEATLQGGGQIVLSGETAAAVGALTGVQDANGLVQIPVSMYQTVVTSLAQGNGPVQVAMAPVTTRISDSAVTMDGQAVEVVTLEQ

SEQ ID NO: 909127 - protein, 503 aa, Homo sapiens; identical to SEQ ID NO: 909126

SEQ ID NO: 909128 - protein, 503 aa, Homo sapiens; identical to SEQ ID NO: 909126

SEQ ID NO: 909129 - protein, 503 aa, Homo sapiens; identical to SEQ ID NO: 909126

SEQ ID NO: 909130 - protein, 416 aa, Homo sapiens [sequence omitted]

SEQ ID NO: 909131 - protein, 503 aa, Homo sapiens; identical to SEQ ID NO: 909126

SEQ ID NO: 909132 - protein, 503 aa, Homo sapiens; identical to SEQ ID NO: 909126

SEQ ID NO: 909133 - protein, 503 aa, Homo sapiens; identical to SEQ ID NO: 909126

SEQ ID NO: 909134 - protein, 451 aa, Homo sapiens
MEEHGVTQTEHMATIEAHAVAQQVQQVHVATYTEHSMLSADEDSPSSPEDTSYDDSDILNSTAADEVTAHLAAAGPVGMAAAAAVATGKKRKRPHVFESNPSIRKRQQTRLLRKLRATLDEYTTRVGQQAIVLCISPSKPNPVFKVFGAAPLENVVRKYKSMILEDLESALAEHAPAPQEVNSELPPLTIDGIPVSVDKMTQAQLRAFIPEMLKYSTGRGKPGWGKESCKPIWWPEDIPWANVRSDVRTEEQKQRVSWTQALRTIVKNCYKQHGREDLLYAFEDQQTQTQATATHSIAHLVPSQTVVQTFSNPDGTVSLIQVGTGATVATLADASELPTTVTVAQVNYSAVADGEVEQNWATLQGGEMTIQTTQASEATQAVASLAEAAVAASQEMQQGATVTMALNSEAAAHAVATLAEATLQGGGQIVLSGETAAAVGALTGVQDANGY

SEQ ID NO: 909135 - protein, 76 aa, Homo sapiens
MAETDPKTVQDLTSVVQTLLQQMQDKFQTMSDQIIGRIDDMSSRIDDLEKNIADLMTQAGVEELESENKIPATQKS

SEQ ID NO: 909136 - protein, 76 aa, Homo sapiens; identical to SEQ ID NO: 909135

SEQ ID NO: 909137 - protein, 76 aa, Homo sapiens; identical to SEQ ID NO: 909135

SEQ ID NO: 909138 - protein, 76 aa, Homo sapiens; identical to SEQ ID NO: 909135

SEQ ID NO: 909139 - protein, 104 aa, Homo sapiens
ARTTAAEKTNRRGPTEEHDITAKLGIGEMAETDPKTVQDLTSVVQTLLQQMQDKFQTMSDQIIGRIDDMSSRIDDLEKNIADLMTQAGVEELESENKIPATQKS

SEQ ID NO: 909140 - protein, 76 aa, Homo sapiens; identical to SEQ ID NO: 909135

SEQ ID NO: 909141 - protein, 76 aa, Homo sapiens; identical to SEQ ID NO: 909135

SEQ ID NO: 909142 - protein, 45 aa, Homo sapiens
MAETDPKTVQDLTSVVRDGCEGRRPRPSRAAPGQALLDRGAPTAA

SEQ ID NO: 909143 - protein, 104 aa, Homo sapiens; identical to SEQ ID NO: 909139

SEQ ID NO: 909144 - protein, 104 aa, Homo sapiens; identical to SEQ ID NO: 909139

SEQ ID NO: 909145 - protein, 76 aa, Homo sapiens; identical to SEQ ID NO: 909135

SEQ ID NO: 909146 - protein, 76 aa, Homo sapiens; identical to SEQ ID NO: 909135

SEQ ID NO: 909147 - protein, 76 aa, Homo sapiens; identical to SEQ ID NO: 909135

SEQ ID NO: 909148 - protein, 76 aa, Homo sapiens; identical to SEQ ID NO: 909135

SEQ ID NO: 909149 - protein, 76 aa, Homo sapiens; identical to SEQ ID NO: 909135

SEQ ID NO: 909150 - protein, 308 aa, Homo sapiens
MVSDEDELNLLVIVVDANPIWWGKQALKESQFTLSKCIDAVMVLGNSHLFMNRSNKLAVIASHIQESRFLYPGKNGRLGDFFGDPGNPPEFNPSGSKDGKYELLTSANEVIVEEIKDLMTKSDIKGQHTETLLAGSLAKALCYIHRMNKEVKDNQEMKSRILVIKAAEDSALQYMNFMNVIFAAQKQNILIDACVLDSDSGLLQQACDITGGLYLKVPQMPSLLQYLLWVFLPDQDQRSQLILPPPVHVDYRAACFCHRNLIEIGYVCSVCLSIFCNFSPICTTCETAFKISLPPVLKAKKKKLKVSA

SEQ ID NO: 909151 - protein, 310 aa, Homo sapiens
LGGAGRWAAQDLRRSPDHHLLCAEVLGQPWFQTFTLSKCIDAVMVLGNSHLFMNRSNKLAVIASHIQESRFLYPGKNGRLGDFFGDPGNPPEFNPSGSKDGKYELLTSANEVIVEEIKDLMTKSDIKGQHTETLLAGSLAKALCYIHRMNKEVKDNQEMKSRILVIKAAEDSALQYMNFMNVIFAAQKQNILIDACVLDSDSGLLQQACDITGGLYLKVPQMPSLLQYLLWVFLPDQDQRSQLILPPPVHVDYRAACFCHRNLIEIGYVCSVCLSIFCNFSPICTTCETAFKISLPPVLKAKKKKLKVSA

SEQ ID NO: 909152 - protein, 162 aa, Homo sapiens
MNKEVKDNQEMKSRILVIKAAEDSALQYMNFMNVIFAAQKQNILIDACVLDSDSGLLQQACDITGGLYLKVPQMPSLLQYLLWVFLPDQDQRSQLILPPPVHVDYRAACFCHRNLIEIGYVCSVCLSIFCNFSPICTTCETAFKISLPPVLKAKKKKLKVSA

SEQ ID NO: 909153 - protein, 265 aa, Homo sapiens
MVSDEDELNLLVIVVDANPIWWGKQALKESQFTLSKCIDAVMVLGNSHLFMNRSNKLAVIASHIQESRFLYPGKNGRLGDFFGDPGNPPEFNPSGSKDGKYELLTSANEVIVEEIKDLMTKSDIKGQHTETLLAGSLAKALCYIHRMNKEVKDNQEMKSRILACDITGGLYLKVPQMPSLLQYLLWVFLPDQDQRSQLILPPPVHVDYRAACFCHRNLIEIGYVCSVCLSIFCNFSPICTTCETAFKISLPPVLKAKKKKLKVSA

SEQ ID NO: 909154 - protein, 241 aa, Homo sapiens
MVSDEDELNLLVIVVDANPIWWGKQALKESQFTLSKCIDAVMVLGNSHLFMNRSNKLAVIASHIQESRFLYPGKNGRLGDFFGDPGNPPEFNPSGSKDGKYELLTSANEVIVEEIKDLMTKSDIKGQHTETLLAGSLAKALCYIHRMNKEVKDNQEMKSRILACDITGGLYLKVPQMPSLLQYLLWVFLPDQDQRSQLILPPPVHVDYRAACFCHRNLIEIGYVCSVCLSIFCNFSPICTT

SEQ ID NO: 909155 - protein, 147 aa, Homo sapiens
MVSDEDELNLLVIVVDANPIWWGKQALKESQFTLSKCIDAVMVLGNSHLFMNRSNKLAVIASHIQESRFLYPGKNGRLGDFFGDPGNPPEFNPSGSKDGKYELLTSANEVIVEEIKDLMTKSDIKGQHTETLLAGSLAKALCCILGV

SEQ ID NO: 909156 - protein, 308 aa, Homo sapiens; identical to SEQ ID NO: 909150

SEQ ID NO: 909157 - protein, 308 aa, Homo sapiens; identical to SEQ ID NO: 909150

SEQ ID NO: 909158 - protein, 241 aa, Homo sapiens [sequence omitted]

SEQ ID NO: 909159 - protein, 224 aa, Homo sapiens
MVLGNSHLFMNRSNKLAVIASHIQESRFLYPGKNGRLGDFFGDPGNPPEFNPSGSKDGKYELLTSANEVIVEEIKDLMTKSDIKGQHTETLLAGSLAKALCYIHRMNKEVKDNQEMKSRILACDITGGLYLKVPQMPSLLQYLLWVFLPDQDQRSQLILPPPVHVDYRAACFCHRNLIEIGYVCSVCLSIFCNFSPICTTCETAFKISLPPVLKAKKKKLKVSA

SEQ ID NO: 909160 - protein, 197 aa, Homo sapiens
MVSDEDELNLLVIVVDANPIWWGKQALKESQFTLSKCIDAVMVLGNSHLFMNRSNKLAVIASHIQESRFLYPGKNGRLGDFFGDPGNPPEFNPSGSKDGKYELLTSANEVIVEEIKDLMTKSDIKGQHTETLLAGSLAKALCYIHRMNKEVKDNQEMKSRILACDITGGLYLKVPQMPSLLQYLLWVFLPDQDQRSR

SEQ ID NO: 909161 - protein, 69 aa, Homo sapiens
AVVSTQSAHYGGAAGTRVGWRLPDVGSLLGRVLRPCLPLYFSTLGHDAAVPDLGGVQPRCRESFTSLTL

SEQ ID NO: 909162 - protein, 69 aa, Homo sapiens; identical to SEQ ID NO: 909161

SEQ ID NO: 909163 - protein, 69 aa, Homo sapiens; identical to SEQ ID NO: 909161

SEQ ID NO: 909164 - protein, 69 aa, Homo sapiens; identical to SEQ ID NO: 909161

SEQ ID NO: 909165 - protein, 69 aa, Homo sapiens; identical to SEQ ID NO: 909161

SEQ ID NO: 909166 - protein, 69 aa, Homo sapiens; identical to SEQ ID NO: 909161

SEQ ID NO: 909167 - protein, 69 aa, Homo sapiens; identical to SEQ ID NO: 909161

SEQ ID NO: 909168 - protein, 69 aa, Homo sapiens; identical to SEQ ID NO: 909161

SEQ ID NO: 909169 - protein, 69 aa, Homo sapiens; identical to SEQ ID NO: 909161

SEQ ID NO: 909170 - protein, 69 aa, Homo sapiens; identical to SEQ ID NO: 909161

SEQ ID NO: 909171 - protein, 69 aa, Homo sapiens; identical to SEQ ID NO: 909161

SEQ ID NO: 909172 - protein, 69 aa, Homo sapiens; identical to SEQ ID NO: 909161

SEQ ID NO: 909173 - protein, 69 aa, Homo sapiens; identical to SEQ ID NO: 909161

SEQ ID NO: 909174 - protein, 69 aa, Homo sapiens; identical to SEQ ID NO: 909161

SEQ ID NO: 909175 - protein, 69 aa, Homo sapiens; identical to SEQ ID NO: 909161

SEQ ID NO: 909176 - protein, 69 aa, Homo sapiens; identical to SEQ ID NO: 909161

SEQ ID NO: 909177 - protein, 69 aa, Homo sapiens; identical to SEQ ID NO: 909161

SEQ ID NO: 909178 - protein, 69 aa, Homo sapiens; identical to SEQ ID NO: 909161

SEQ ID NO: 909179 - protein, 69 aa, Homo sapiens; identical to SEQ ID NO: 909161

SEQ ID NO: 909180 - protein, 69 aa, Homo sapiens; identical to SEQ ID NO: 909161

SEQ ID NO: 909181 - protein, 69 aa, Homo sapiens; identical to SEQ ID NO: 909161

SEQ ID NO: 909182 - protein, 69 aa, Homo sapiens; identical to SEQ ID NO: 909161

SEQ ID NO: 909183 - protein, 69 aa, Homo sapiens; identical to SEQ ID NO: 909161

SEQ ID NO: 909184 - protein, 69 aa, Homo sapiens; identical to SEQ ID NO: 909161

SEQ ID NO: 909185 - protein, 69 aa, Homo sapiens; identical to SEQ ID NO: 909161

SEQ ID NO: 909186 - protein, 69 aa, Homo sapiens; identical to SEQ ID NO: 909161

SEQ ID NO: 909187 - protein, 69 aa, Homo sapiens; identical to SEQ ID NO: 909161

SEQ ID NO: 909188 - protein, 69 aa, Homo sapiens; identical to SEQ ID NO: 909161

SEQ ID NO: 909189 - protein, 69 aa, Homo sapiens; identical to SEQ ID NO: 909161

SEQ ID NO: 909190 - protein, 42 aa, Homo sapiens
MGTVCVQHVTDDLVCLVYYAHLVIHADHSSGVSQKFAGIQQV

SEQ ID NO: 909191 - protein, 725 aa, Homo sapiens
MADEDLIFRLEGVDGGQSPRAGHDGDSDGDSDDEEGYFICPITDDPSSNQNVNSKVNKYYSNLTKSERYSSSGSPANSFHFKEAWKHAIQKAKHMPDPWAEFHLEDIATERATRHRYNAVTGEWLDDEVLIKMASQPFGRGAMRECFRTKKLSNFLHAQQWKGASNYVAKRYIEPVDRDVYFEDVRLQMEAKLWGEEYNRHKPPKQVDIMQMCIIELKDRPGKPLFHLEHYIEGKYIKYNSNSGFVRDDNIRLTPQAFSHFTFERSGHQLIVVDIQGVGDLYTDPQIHTETGTDFGDGNLGVRGMALFFYSHACNRICESMGLAPFDLSPRERDAVNQNTKLLQSAKTILRGTEEKCGSPRVRTLSGSRPPLLRPLSENSGDENMSDVTFDSLPSSPSSATPHSQKLDHLHWPVFSDLDNMASRDHDHLDNHRESENSGDSGYPSEKRGELDDPEPREHGHSYSNRKYESDEDSLGSSGRVCVEKWNLLNSSRLHLPRASAVALEVQRLNALDLEKKIGKSILGKVHLAMVRYHEGGRFCEKGEEWDQESAVFHLEHAANLGELEAIVGLGLMYSQLPHHILADVSLKETEENKTKGFDYLLKAAEAGDRQSMILVARAFDSGQNLSPDRCQDWLEALHWYNTALEMTDCDEGGEYDGMQDEPRYMMLAREAEMLFTGGYGLEKDPQRSGDLYTQAAEAAMEAMKGRLANQYYQKAEEAWAQMEE

SEQ ID NO: 909192 - protein, 725 aa, Homo sapiens; identical to SEQ ID NO: 909191

SEQ ID NO: 909193 - protein, 725 aa, Homo sapiens; identical to SEQ ID NO: 909191

SEQ ID NO: 909194 - protein, 725 aa, Homo sapiens; identical to SEQ ID NO: 909191

SEQ ID NO: 909195 - protein, 725 aa, Homo sapiens; identical to SEQ ID NO: 909191

SEQ ID NO: 909196 - protein, 730 aa, Homo sapiens
MADEDLIFRLEGVDGGQSPRAGHDGDSDGDSDDEEGYFICPITDDPSSNQNVNSKVNKYYSNLTKSERYSSSGSPANSFHFKEAWKHAIQKAKHMPDPWAEFHLEDIATERATRHRYNAVTGEWLDDEVLIKMASQPFGRGAMRECFRTKKLSNFLHAQQWKGASNYVAKRYIEPVDRDVYFEDVRLQMEAKLWGEEYNRHKPPKQVDIMQMCIIELKDRPGKPLFHLEHYIEGKYIKYNSNSGFVRDDNIRLTPQAFSHFTFERSGHQLIVVDIQGVGDLYTDPQIHTETGTDFGDGNLGVRGMALFFYSHACNRICESMGLAPFDLSPRERDAVNQNTKLLQSAKTILRGTEEKCGSPRVRTLSGSRPPLLRPLSENSGDENMSDVTFDSLPSSPSSATPHSQKLDHLHWPVFSDLDNMASRDHDHLDNHRESENSGDSGYPSEKRGELDDPEPREHGHSYSNRKYESDEDSLGSSGRVCVEKWNLLNSSRLHLPRASAVALEVQRLNALDLEKKIGKSILGKVHLAMVRYHEGGRFCEKGEEWDQESAVFHLEHAANLGELEAIVGLGLMYSQLPHHILADVSLKETEENKTKGFDYLLKAAEAGDRQSMILVARAFDSGQNLSPDRCQDWLEALHWYNTALEMTDCDEGGEYDGMQDEPRYMMLAREAEMLFTGGYGLEKDPQRSGDLYTQAAEAAMEAMKAVPPPLVHLIEQSWLFLITPLYSAW

SEQ ID NO: 909197 - protein, 280 aa, Homo sapiens [sequence omitted]

SEQ ID NO: 909198 - protein, 725 aa, Homo sapiens; identical to SEQ ID NO: 909191

SEQ ID NO: 909199 - protein, 725 aa, Homo sapiens; identical to SEQ ID NO: 909191

SEQ ID NO: 909200 - protein, 725 aa, Homo sapiens; identical to SEQ ID NO: 909191

SEQ ID NO: 909201 - protein, 725 aa, Homo sapiens; identical to SEQ ID NO: 909191

SEQ ID NO: 909202 - protein, 71 aa, Homo sapiens
NAGHAKNLTQNPGHSSPTGTISETIFKCKKQVKAQEIGRARIIIQYFHFTNGETEVLPARFFFTVSLLASH

SEQ ID NO: 909203 - protein, 493 aa, Homo sapiens
MADEDLIFRLEGVDGGQSPRAGHDGDSDGDSDDEEGYFICPITDDPSSNQNVNSKVNKYYSNLTKSERYSSSGSPANSFHFKEAWKHAIQKAKHMPDPWAEFHLEDIATERATRHRYNAVTGEWLDDEVLIKMASQPFGRGAMRECFRTKKLSNFLHAQQWKGASNYVAKRYIEPVDRDVYFEDVRLQMEAKLWGEEYNRHKPPKQVDIMQMCIIELKDRPGKPLFHLEHYIEGKYIKYNSNSGFVRDDNIRLTPQAFSHFTFERSGHQLIVVDIQGVGDLYTDPQIHTETGTDFGDGNLGVRGMALFFYSHACNRICESMGLAPFDLSPRERDAVNQNTKLLQSAKTILRGTEEKCGSPRVRTLSGSRPPLLRPLSENSGDENMSDVTFDSLPSSPSSATPHSQKLDHLHWPVFSDLDNMASRDHDHLDNHRESENSGDSGYPSEKRGELDDPEPREHVRNPQEMRPVSPVALFILQENENSPSWRGNMSGS

SEQ ID NO: 909204 - protein, 350 aa, Homo sapiens
MGSKKLKRVGLSQELCDRLSRHQILTCQDFLCLSPLELMKVTGLSYRGVHELLCMVSRACAPKMQTAYGIKAQRSADFSPAFLSTTLSALDEALHGGVACGSLTEITGPPGCGKTQFCIMMSILATLPTNMGGLEGAVVYIDTESAFSAERLVEIAESRFPRYFNTEEKLLLTSSKVHLYRELTCDEVLQRIESLEEEIISKGIKLVILDSVASVVRKEFDAQLQGNLKERNKFLAREASSLKYLAEEFSIPVILTNQITTHLSGALASQADLVSPADDLSLSEGTSGSSCVIAALGNTWSHSVNTRLILQYLDSERRQILIAKSPLAPFTSFVYTIKEEGLVLQAYGNS

SEQ ID NO: 909205 - protein, 350 aa, Homo sapiens
MGSKKLKRVGLSQELCDRLSRHQILTCQDFLCLSPLELMKVTGLSYRGVHELLCMVSRACAPKMQTAYGIKAQRSADFSPAFLSTTLSALDEALHGGVACGSLTEITGPPGCGKTQFCIMMSILATLPTNMGGLEGAVVYIDTESAFSAERLVEIAESRFPRYFNTEEKLLLTSSKVHLYRELTCDEVLQRIESLEEEIISKGIKLVILDSVASVVRKEFDAQLQGNLKERNKFLAREASSLKYLAEEFSIPVILTNQITTHLSGALASQADLVSPADDLSLSEGTSGSSCVIAALGNTWSHSVNTRLILQYLDSERRQILIAKSPLAPFTSFVYTIKEEGLVLQGQEKP

SEQ ID NO: 909206 - protein, 348 aa, Homo sapiens
MGSKKLKRVGLSQELCDRLSRHQILTCQDFLCLSPLELMKVTGLSYRGVHELLCMVSRACAPKMQTAYGIKAQRSADFSPAFLSTTLSALDEALHGGVACGSLTEITGPPGCGKTQFCIMMSILATLPTNMGGLEGAVVYIDTESAFSAERLVEIAESRFPRYFNTEEKLLLTSSKVHLYRELTCDEVLQRIESLEEEIISKGIKLVILDSVASVVRKEFDAQLQGNLKERNKFLAREASSLKYLAEEFSIPVILTNQITTHLSGALASQADLVSPADDLSLSEGTSGSSCVIAALGNTWSHSVNTRLILQYLDSERRQILIAKSPLAPFTSFVYTIKEEGLVLQAGK

SEQ ID NO: 909207 - protein, 220 aa, Homo sapiens
MGGLEGAVVYIDTESAFSAERLVEIAESRFPRYFNTEEKLLLTSSKVHLYRELTCDEVLQRIESLEEEIISKGIKLVILDSVASVVRKEFDAQLQGNLKERNKFLAREASSLKYLAEEFSIPVILTNQITTHLSGALASQADLVSPADDLSLSEGTSGSSCVIAALGNTWSHSVNTRLILQYLDSERRQILIAKSPLAPFTSFVYTIKEEGLVLQAYGNS

SEQ ID NO: 909208 - protein, 350 aa, Homo sapiens; identical to SEQ ID NO: 909204

SEQ ID NO: 909209 - protein, 279 aa, Homo sapiens
MGSKKLKRVGLSQELCDRLSRHQILTCQDFLCLSPLELMKVTGLSYRGVHELLCMVSRACAPKMQTAYGIKAQRSADFSPAFLSTTLSALDEALHGGVACGSLTEITGPPGCGKTQFCIMMSILATLPTNMGGLEGAVVYIDTESAFSAERLVEIAESRFPRYFNTEEKLLLTSSKVHLYRELTCDEVLQRIESLEEEIISKGIKLVILDSVASVVRKEFDAQLQGNLKERNKFLAREASSLKYLAEEFSIPVSFSFFLFFLFLSFVSFILHSLTYGIK

SEQ ID NO: 909210 - protein, 350 aa, Homo sapiens; identical to SEQ ID NO: 909204

SEQ ID NO: 909211 - protein, 88 aa, Homo sapiens
GARCIAAIMGDTHDGLKDSYCQVPSGSLHLICLHHQGGRPGSSSWKMKTLTLIQDFENCRNPLVGHEVELMNHNQHLKTERERRQKKE

SEQ ID NO: 909212 - protein, 384 aa, Homo sapiens
MGSKKLKRVGLSQELCDRLSRHQILTCQDFLCLSPLELMKVTGLSYRGVHELLCMVSRACAPKMQTAYGIKAQRSADFSPAFLSTTLSALDEALHGGVACGSLTEITGPPGCGKTQFCIMMSILATLPTNMGGLEGAVVYIDTESAFSAERLVEIAESRFPRYFNTEEKLLLTSSKVHLYRELTCDEVLQRIESLEEEIISKGIKLVILDSVASVVRKEFDAQLQGNLKERNKFLAREASSLKYLAEEFSIPVILTNQITTHLSGALASQADLVSPADDLSLSEGTSGSSCVIAALGNTWSHSVNTRLILQYLDSERRQILIAKSPLAPFTSFVYTIKEEGLVLQETTFCSVTQAELNWAPEILPPQPPEQLGLQMCHHTQLIF

SEQ ID NO: 909213 - protein, 359 aa, Homo sapiens
LLFFAGSGGMGSKKLKRVGLSQELCDRLSRHQILTCQDFLCLSPLELMKVTGLSYRGVHELLCMVSRACAPKMQTAYGIKAQRSADFSPAFLSTTLSALDEALHGGVACGSLTEITGPPGCGKTQFCIMMSILATLPTNMGGLEGAVVYIDTESAFSAERLVEIAESRFPRYFNTEEKLLLTSSKVHLYRELTCDEVLQRIESLEEEIISKGIKLVILDSVASVVRKEFDAQLQGNLKERNKFLAREASSLKYLAEEFSIPVILTNQITTHLSGALASQADLVSPADDLSLSEGTSGSSCVIAALGNTWSHSVNTRLILQYLDSERRQILIAKSPLAPFTSFVYTIKEEGLVLQAYGNS

SEQ ID NO: 909214 - protein, 277 aa, Homo sapiens
MSAPAAKVSKKELNSNHDGADETSEKEQQEAIEHIDEVQNEIDRLNEQASEEILKVEQKYNKLRQPFFQKRSELIAKIPNFWVTTFVNHPQVSALLGEEDEEALHYLTRVEVTEFEDIKSGYRIDFYFDENPYFENKVLSKEFHLNESGDPSSKSTEIKWKSGKDLTKRSSQTQNKASRKRQHEEPESFFTWFTDHSDAGADELGEVIKDDIWPNPLQYYLVPDMDDEEGEGEEDDDDDEEEEGLEDIDEEGDEDEGEEDEDDDEGEEGEEDEGEDD

SEQ ID NO: 909215 - protein, 354 aa, Homo sapiens
TSLFFHIVMQLGFSALCFLYPCVRSSYYDQMIILSRIGCPDQNGDRVERCDSKALDEGHSPSLLSPSPLPPRPRSSTMSAPAAKVSKKELNSNHDGADETSEKEQQEAIEHIDEVQNEIDRLNEQASEEILKVEQKYNKLRQPFFQKRSELIAKIPNFWVTTFVNHPQVSALLGEEDEEALHYLTRVEVTEFEDIKSGYRIDFYFDENPYFENKVLSKEFHLNESGDPSSKSTEIKWKSGKDLTKRSSQTQNKASRKRQHEEPESFFTWFTDHSDAGADELGEVIKDDIWPNPLQYYLVPDMDDEEGEGEEDDDDDEEEEGLEDIDEEGDEDEGEEDEDDDEGEEGEEDEGEDD

SEQ ID NO: 909216 - protein, 277 aa, Homo sapiens; identical to SEQ ID NO: 909214

SEQ ID NO: 909217 - protein, 316 aa, Homo sapiens
AAAPSRQRAEKPGAATSVSGVLEMAKKAGLCLGGSRQGGCQSGMVTGNEPRDLALSHPLSFVGEKEQQEAIEHIDEVQNEIDRLNEQASEEILKVEQKYNKLRQPFFQKRSELIAKIPNFWVTTFVNHPQVSALLGEEDEEALHYLTRVEVTEFEDIKSGYRIDFYFDENPYFENKVLSKEFHLNESGDPSSKSTEIKWKSGKDLTKRSSQTQNKASRKRQHEEPESFFTWFTDHSDAGADELGEVIKDDIWPNPLQYYLVPDMDDEEGEGEEDDDDDEEEEGLEDIDEEGDEDEGEEDEDDDEGEEGEEDEGEDD

SEQ ID NO: 909218 - protein, 277 aa, Homo sapiens; identical to SEQ ID NO: 909214

SEQ ID NO: 909219 - protein, 247 aa, Homo sapiens
SSGRPGGAQNEIDRLNEQASEEILKVEQKYNKLRQPFFQKRSELIAKIPNFWVTTFVNHPQVSALLGEEDEEALHYLTRVEVTEFEDIKSGYRIDFYFDENPYFENKVLSKEFHLNESGDPSSKSTEIKWKSGKDLTKRSSQTQNKASRKRQHEEPESFFTWFTDHSDAGADELGEVIKDDIWPNPLQYYLVPDMDDEEGEGEEDDDDDEEEEGLEDIDEEGDEDEGEEDEDDDEGEEGEEDEGEDD

SEQ ID NO: 909220 - protein, 196 aa, Homo sapiens
MNLVPDMDDEEGEGEEDEDEEALHYLTRVEVTEFEDIKSGYRIDFYFDENPYFENKVLSKEFHLNESGDPSSKSTEIKWKSGKDLTKRSSQTQNKASRKRQHEEPESFFTWFTDHSDAGADELGEVIKDDIWPNPLQYYLVPDMDDEEGEGEEDDDDDEEEEGLEDIDEEGDEDEGEEDEDDDEGEEGEEDEGEDD

SEQ ID NO: 909221 - protein, 120 aa, Homo sapiens
LFRYSFKDLTKRSSQTQNKASRKRQHEEPESFFTWFTDHSDAGADELGEVIKDDIWPNPLQYYLVPDMDDEEGEGEEDDDDDEEEEGLEDIDEEGDEDEGEEDEDDDEGEEGEEDEGEDD

SEQ ID NO: 909222 - protein, 277 aa, Homo sapiens; identical to SEQ ID NO: 909214

SEQ ID NO: 909223 - protein, 277 aa, Homo sapiens; identical to SEQ ID NO: 909214

SEQ ID NO: 909224 - protein, 277 aa, Homo sapiens; identical to SEQ ID NO: 909214

SEQ ID NO: 909225 - protein, 277 aa, Homo sapiens; identical to SEQ ID NO: 909214

SEQ ID NO: 909226 - protein, 277 aa, Homo sapiens; identical to SEQ ID NO: 909214

SEQ ID NO: 909227 - protein, 277 aa, Homo sapiens; identical to SEQ ID NO: 909214

SEQ ID NO: 909228 - protein, 277 aa, Homo sapiens; identical to SEQ ID NO: 909214

SEQ ID NO: 909229 - protein, 279 aa, Homo sapiens
MSAPAAKVSKKELNSNHDGADETSEKEQQEAIEHIDEVQNEIDRLNEQASEEILKVEQKYNKLRQPFFQKRSELIAKIPNFWVTTFVNHPQVSALLGEEDEEALHYLTRVEVTEFEDIKSGYRIDFYFDENPYFENKVLSKEFHLNESGDPSSKSTEIKWKSGKDLTKRSSQTQNKASRKRQHEEPESFFTWFTDHSDAGADELGEVIKDDIWPNPLQYYLVPDMDDEEGEGEEDDDDDEEEEGYSRPLVKKVEEDEAGGRFVAFSGEGQSLRKKGRKP

SEQ ID NO: 909230 - protein, 236 aa, Homo sapiens
MSAPAAKVSKKELNSNHDGADETSEKEQQEAIEHIDEVQNEIDRLNEQASEEILKVEQKYNKLRQPFFQKRSELIAKIPNFWVTTFVNHPQVSALLGEEDEEALHYLTRVEVTEFEDIKSGYRIDFYFDENPYFENKVLSKEFHLNESGDPSSKSTEIKWKSGKDLTKRSSQTQNKASRKRQHEEPESFFTWFTDHSDAGADELGEVIKDDIWPNPLQYYLVLDMDDEASSEGREL

SEQ ID NO: 909231 - protein, 243 aa, Homo sapiens
MSAPAAKVSKKELNSNHDGADETSEKEQQEAIEHIDEVQNEIDRLNEQASEEILKVEQKYNKLRQPFFQKRSELIAKIPNFWVTTFVNHPQVSALLGEEDEEALHYLTRVEVTEFEDIKSGYRIDFYFDENPYFENKVLSKEFHLNESGDPSSKSTEIKWKSGKDLTKRSSQTQNKASRKRQHEEPESFFTWFTDHSDAGADELGEVIKDDIWPLSVHTCKAKTLLQTRMSTEPAGRSGIHHA

SEQ ID NO: 909232 - protein, 190 aa, Homo sapiens
MSAPAAKVSKKELNSNHDGADETSEKEQQEAIEHIDEVQNEIDRLNEQASEEILKVEQKYNKLRQPFFQKRSELIAKIPNFWVTTFVNHPQVSALLGEEDEEALHYLTRVEVTEFEDIKSGYRIDFYFDENPYFENKVLSKEFHLNESGDPSSKSTEIKWKSGKDLTKRSSQTQNKASRKRQLVNFCFTV

SEQ ID NO: 909233 - protein, 116 aa, Homo sapiens
VCVPLSCKYPFQAGRLQCRFKPLAPGAVSVFSLLPDGRGDSWSGSGTSLTAWPLNASLHSRLKRRNQDHLLLWDRRRHRPLQACRRREVRFCAKFYWRFKGFARIDSLIFTPQSLL

SEQ ID NO: 909234 - protein, 290 aa, Homo sapiens
MAPKRQSPLPPQKKKPRPPPALGPEETSASAGLPKKGEKEQQEAIEHIDEVQNEIDRLNEQASEEILKVEQKYNKLRQPFFQKRSELIAKIPNFWVTTFVNHPQVSALLGEEDEEALHYLTRVEVTEFEDIKSGYRIDFYFDENPYFENKVLSKEFHLNESGDPSSKSTEIKWKSGKDLTKRSSQTQNKASRKRQHEEPESFFTWFTDHSDAGADELGEVIKDDIWPNPLQYYLVPDMDDEEGEGEEDDDDDEEEEGLEDIDEEGDEDEGEEDEDDDEGEEGEEDEGEDD

SEQ ID NO: 909235 - protein, 255 aa, Homo sapiens
MKEKEQQEAIEHIDEVQNEIDRLNEQASEEILKVEQKYNKLRQPFFQKRSELIAKIPNFWVTTFVNHPQVSALLGEEDEEALHYLTRVEVTEFEDIKSGYRIDFYFDENPYFENKVLSKEFHLNESGDPSSKSTEIKWKSGKDLTKRSSQTQNKASRKRQHEEPESFFTWFTDHSDAGADELGEVIKDDIWPNPLQYYLVPDMDDEEGEGEEDDDDDEEEEGLEDIDEEGDEDEGEEDEDDDEGEEGEEDEGEDD

SEQ ID NO: 909236 - protein, 273 aa, Homo sapiens
RGSPPFFKFSPTTDGADETSEKEQQEAIEHIDEVQNEIDRLNEQASEEILKVEQKYNKLRQPFFQKRSELIAKIPNFWVTTFVNHPQVSALLGEEDEEALHYLTRVEVTEFEDIKSGYRIDFYFDENPYFENKVLSKEFHLNESGDPSSKSTEIKWKSGKDLTKRSSQTQNKASRKRQHEEPESFFTWFTDHSDAGADELGEVIKDDIWPNPLQYYLVPDMDDEEGEGEEDDDDDEEEEGLEDIDEEGDEDEGEEDEDDDEGEEGEEDEGEDD

SEQ ID NO: 909237 - protein, 277 aa, Homo sapiens; identical to SEQ ID NO: 909214

SEQ ID NO: 909238 - protein, 164 aa, Homo sapiens
KYQREYTAYRIDFYFDENPYFENKVLSKEFHLNESGDPSSKSTEIKWKSGKDLTKRSSQTQNKASRKRQHEEPESFFTWFTDHSDAGADELGEVIKDDIWPNPLQYYLVPDMDDEEGEGEEDDDDDEEEEGLEDIDEEGDEDEGEEDEDDDEGEEGEEDEGEDD

SEQ ID NO: 909239 - protein, 277 aa, Homo sapiens; identical to SEQ ID NO: 909214

SEQ ID NO: 909240 - protein, 277 aa, Homo sapiens; identical to SEQ ID NO: 909214

SEQ ID NO: 909241 - protein, 277 aa, Homo sapiens; identical to SEQ ID NO: 909214

SEQ ID NO: 909242 - protein, 277 aa, Homo sapiens; identical to SEQ ID NO: 909214

SEQ ID NO: 909243 - protein, 277 aa, Homo sapiens; identical to SEQ ID NO: 909214

SEQ ID NO: 909244 - protein, 283 aa, Homo sapiens
MSAPAAKVSKKELNSNHDGADETSEKEQQEAIEHIDEVQNEIDRLNEQASEEILKVEQKYNKLRQPFFQKRSELIAKIPNFWVTTFVNHPQVSALLGEEDEEALHYLTRVEVTEFEDIKSGYRIDFYFDENPYFENKVLSKEFHLNESGDPSSKSTEIKWKSGKDLTKRSSQTQNKASRKRQHEEPESFFTWFTDHSDAGADELGEVIKDDIWPNPLQYYLVPDMDDEEGEGEEDDDDDEEEEGLEDIDEEGDEDEGEEDEEALHYLTRVEVTEFEDIKSGTE

SEQ ID NO: 909245 - protein, 274 aa, Homo sapiens
MSAPAAKVSKKELNSNHDGADETSEKEQQEAIEHIDEVQNEIDRLNEQASEEILKVEQKYNKLRQPFFQKRSELIAKIPNFWVTTFVNHPQVSALLGEEDEEALHYLTRVEVTEFEDIKSGYRIDFYFDENPYFENKVLSKEFHLNESGDPSSKSTEIKWKSGKDLTKRSSQTQNKASRKRQHEEPESFFTWFTDHSDAGADELGEVIKDDIWPNPLQYYLVPDMDDEEGEGEEDDDDDEEEEGCLKSQMMTWDSAFLIKFLLPCKIKAFLHIK

SEQ ID NO: 909246 - protein, 218 aa, Homo sapiens
MSAPAAKVSKKELNSNHDGADETSEKEQQEAIEHIDEVQNEIDRLNEQASEEILKVEQKYNKLRQPFFQKRSELIAKIPNFWVTTFVNHPQVSALLGEEDEEALHYLTRVEVTEFEDIKSGYRIDFYFDENPYFENKVLSKEFHLNESGDPSSKSTEIKWKSGKDLTKRSSQTQNKASRKRQHEEPESFFTWFTDHSDAGADYLWLVPSPSLNKILKC

SEQ ID NO: 909247 - protein, 1414 aa, Homo sapiens
SKNSVSLSWQQPAFDGGSKITGYIVERRDLPDGRWTKASFTNVTETQFIISGLTQNSQYEFRVFARNAVGSISNPSEVVGPITCIDSYGGPVIDLPLEYTEVVKYRAGTSVKLRAGISGKPAPTIEWYKDDKELQTNALVCVENTTDLASILIKDADRLNSGCYELKLRNAMGSASATIRVQILDKPGPPGGPIEFKTVTAEKITLLWRPPADDGGAKITHYIVEKRETSRVVWSMVSEHLEECIITTTKIIKGNEYIFRVRAVNKYGIGEPLESDSVVAKNAFVTPGPPGIPEVTKITKNSMTVVWSRPIADGGSDISGYFLEKRDKKSLGWFKVLKETIRDTRQKVTGLTENSDYQYRVCAVNAAGQGPFSEPSEFYKAADPIDPPGPPAKIRIADSTKSSITLGWSKPVYDGGSAVTGYVVEIRQGEEEEWTTVSTKGEVRTTEYVVSNLKPGVNYYFRVSAVNCAGQGEPIEMNEPVQAKDILEAPEIDLDVALRTSVIAKAGEDVQVLIPFKGRPPPTVTWRKDEKNLGSDADTALKTLIHPHYSPFLKLLSNDTGKYILTIENGVGEPKSSTVSVKVLDTPAACQKLQVKHVSRGTVTLLWDPPLIDGGSPIINYVIEKRDATKRTWSVVSHKCSSTSFKLIDLSEKTPFFFRVLAENEIGIGEPCETTEPVKAAEVPAPIRDLSMKDSTKTSVILSWTKPDFDGGSVITEYVVERKGKGEQTWSHAGISKTCEIEVSQLKEQSVLEFRVFAKNEKGLSDPVTIGPITVKELIITPEVDLSDIPGAQVTVRIGHNVHLELPYKGKPKPSISWLKDGLPLKESEFVRFSKTENKITLSIKNAKKEHGGKYTVILDNAVCRIAVPITVITLGPPSKPKGPIRFDEIKADSVILSWDVPEDNGGGEITCYSIEKRETSQTNWKMVCSSVARTTFKVPNLVKDAEYQFRVRAENRYGVSQPLVSSIIVAKHQFRIPGPPGKPVIYNVTSDGMSLTWDAPVYDGGSEVTGFHVEKKERNSILWQKVNTSPISGREYRATGLVEGLDYQFRVYAENSAGLSSPSDPSKFTLAVSPVDPPGTPDYIDVTRETITLKWNPPLRDGGSKIVGYSIEKRQGNERWVRCNFTDVSECQYTVTGLSPGDRYEFRIIARNAVGTISPPSQSSGIIMTRDENVPPIVEFGPEYFDGLIIKSGESLRIKALVQGRPVPRVTWFKDGVEIEKRMNMEITDVLGSTSLFVRDATRDHRGVYTVEAKNASGSAKAEIKVKVQDTPGKVVGPIRFTNITGEKMTLWWDAPLNDGCAPITHYIIEKRETSRLAWALIEDKCEAQSYTAIKLINGNEYQFRVSAVNKFGVGRPLDSDPVVAQIQYTVPDAPGIPEPSNITGNSITLTWARPESDGGSEIQQYIHHDGPE

SEQ ID NO: 909248 - protein, 1214 aa, Homo sapiens
SKNSVSLSWQQPAFDGGSKITGYIVERRDLPDGRWTKASFTNVTETQFIISGLTQNSQYEFRVFARNAVGSISNPSEVVGPITCIDSYGGPVIDLPLEYTEVVKYRAGTSVKLRAGISGKPAPTIEWYKDDKELQTNALVCVENTTDLASILIKDADRLNSGCYELKLRNAMGSASATIRVQILDKPGPPGGPIEFKTVTAEKITLLWRPPADDGGAKITHYIVEKRETSRVVWSMVSEHLEECIITTTKIIKGNEYIFRVRAVNKYGIGEPLESDSVVAKNAFVTPGPPGIPEVTKITKNSMTVVWSRPIADGGSDISGYFLEKRDKKSLGWFKVLKETIRDTRQKVTGLTENSDYQYRVCAVNAAGQGPFSEPSEFYKAADPIDPPGPPAKIRIADSTKSSITLGWSKPVYDGGSAVTGYVVEIRQGEEEEWTTVSTKGEVRTTEYVVSNLKPGVNYYFRVSAVNCAGQGEPIEMNEPVQAKDILEAPEIDLDVALRTSVIAKAGEDVQVLIPFKGRPPPTVTWRKDEKNLGSDADTALKTLIHPHYSPFLKLLSNDTGKYILTIENGVGEPKSSTVSVKVLDTPAACQKLQVKHVSRGTVTLLWDPPLIDGGSPIINYVIEKRDATKRTWSVVSHKCSSTSFKLIDLSEKTPFFFRVLAENEIGIGEPCETTEPVKAAEVPAPIRDLSMKDSTKTSVILSWTKPDFDGGSVITEYVVERKGKGEQTWSHAGISKTCEIEVSQLKEQSVLEFRVFAKNEKGLSDPVTIGPITVKELIITPEVDLSDIPGAQVTVRIGHNVHLELPYKGKPKPSISWLKDGLPLKESEFVRFSKTENKITLSIKNAKKEHGGKYTVILDNAVCRIAVPITVITLGPPSKPKGPIRFDEIKADSVILSWDVPEDNGGGEITCYSIEKRETSQTNWKMVCSSVARTTFKVPNLVKDAEYQFRVRAENRYGVSQPLVSSIIVAKHQFRIPGPPGKPVIYNVTSDGMSLTWDAPVYDGGSEVTGFHVEKKERNSILWQKVNTSPISGREYRATGLVEGLDYQFRVYAENSAGLSSPSDPSKFTLAVSPVDPPGTPDYIDVTRETITLKWNPPLRDGGSKIVGYSIEKRQGNERWVRCNFTDVSECQYTVTGLSPGDRYEFRIIARNAVGTISPPSQSSGIIMTRDENGKHLQLISNETKSIHIFKKHIWPLARKMVTETNYPRLLSG

SEQ ID NO: 909249 - protein, 890 aa, Homo sapiens
SKNSVSLSWQQPAFDGGSKITGYIVERRDLPDGRWTKASFTNVTETQFIISGLTQNSQYEFRVFARNAVGSISNPSEVVGPITCIDSYGGPVIDLPLEYTEVVKYRAGTSVKLRAGISGKPAPTIEWYKDDKELQTNALVCVENTTDLASILIKDADRLNSGCYELKLRNAMGSASATIRVQILDKPGPPGGPIEFKTVTAEKITLLWRPPADDGGAKITHYIVEKRETSRVVWSMVSEHLEECIITTTKIIKGNEYIFRVRAVNKYGIGEPLESDSVVAKNAFVTPGPPGIPEVTKITKNSMTVVWSRPIADGGSDISGYFLEKRDKKSLGWFKVLKETIRDTRQKVTGLTENSDYQYRVCAVNAAGQGPFSEPSEFYKAADPIDPPGPPAKIRIADSTKSSITLGWSKPVYDGGSAVTGYVVEIRQGEEEEWTTVSTKGEVRTTEYVVSNLKPGVNYYFRVSAVNCAGQGEPIEMNEPVQAKDILEAPEIDLDVALRTSVIAKAGEDVQVLIPFKGRPPPTVTWRKDEKNLGSDADTALKTLIHPHYSPFLKLLSNDTGKYILTIENGVGEPKSSTVSVKVLDTPAACQKLQVKHVSRGTVTLLWDPPLIDGGSPIINYVIEKRDATKRTWSVVSHKCSSTSFKLIDLSEKTPFFFRVLAENEIGIGEPCETTEPVKAAEVPAPIRDLSMKDSTKTSVILSWTKPDFDGGSVITEYVVERKGKGEQTWSHAGISKTCEIEVSQLKEQSVLEFRVFAKNEKGLSDPVTIGPITVKELIITPEVDLSDIPGAQVTVRIGHNVHLELPYKGKPKPSISWLKDGLPLKESEFVRFSKTENKITLSIKNAKKEHGGKYTVILDNAVCRIAVPNSNFIFCKDSEEGWSLLRQIY

SEQ ID NO: 909250 - protein, 1988 aa, Homo sapiens
SKNSVSLSWQQPAFDGGSKITGYIVERRDLPDGRWTKASFTNVTETQFIISGLTQNSQYEFRVFARNAVGSISNPSEVVGPITCIDSYGGPVIDLPLEYTEVVKYRAGTSVKLRAGISGKPAPTIEWYKDDKELQTNALVCVENTTDLASILIKDADRLNSGCYELKLRNAMGSASATIRVQILDKPGPPGGPIEFKTVTAEKITLLWRPPADDGGAKITHYIVEKRETSRVVWSMVSEHLEECIITTTKIIKGNEYIFRVRAVNKYGIGEPLESDSVVAKNAFVTPGPPGIPEVTKITKNSMTVVWSRPIADGGSDISGYFLEKRDKKSLGWFKVLKETIRDTRQKVTGLTENSDYQYRVCAVNAAGQGPFSEPSEFYKAADPIDPPGPPAKIRIADSTKSSITLGWSKPVYDGGSAVTGYVVEIRQGEEEEWTTVSTKGEVRTTEYVVSNLKPGVNYYFRVSAVNCAGQGEPIEMNEPVQAKDILEAPEIDLDVALRTSVIAKAGEDVQVLIPFKGRPPPTVTWRKDEKNLGSDADTALKTLIHPHYSPFLKLLSNDTGKYILTIENGVGEPKSSTVSVKVLDTPAACQKLQVKHVSRGTVTLLWDPPLIDGGSPIINYVIEKRDATKRTWSVVSHKCSSTSFKLIDLSEKTPFFFRVLAENEIGIGEPCETTEPVKAAEVPAPIRDLSMKDSTKTSVILSWTKPDFDGGSVITEYVVERKGKGEQTWSHAGISKTCEIEVSQLKEQSVLEFRVFAKNEKGLSDPVTIGPITVKELIITPEVDLSDIPGAQVTVRIGHNVHLELPYKGKPKPSISWLKDGLPLKESEFVRFSKTENKITLSIKNAKKEHGGKYTVILDNAVCRIAVPITVITLGPPSKPKGPIRFDEIKADSVILSWDVPEDNGGGEITCYSIEKRETSQTNWKMVCSSVARTTFKVPNLVKDAEYQFRVRAENRYGVSQPLVSSIIVAKHQFRIPGPPGKPVIYNVTSDGMSLTWDAPVYDGGSEVTGFHVEKKERNSILWQKVNTSPISGREYRATGLVEGLDYQFRVYAENSAGLSSPSDPSKFTLAVSPVDPPGTPDYIDVTRETITLKWNPPLRDGGSKIVGYSIEKRQGNERWVRCNFTDVSECQYTVTGLSPGDRYEFRIIARNAVGTISPPSQSSGIIMTRDENVPPIVEFGPEYFDGLIIKSGESLRIKALVQGRPVPRVTWFKDGVEIEKRMNMEITDVLGSTSLFVRDATRDHRGVYTVEAKNASGSAKAEIKVKVQDTPGKVVGPIRFTNITGEKMTLWWDAPLNDGCAPITHYIIEKRETSRLAWALIEDKCEAQSYTAIKLINGNEYQFRVSAVNKFGVGRPLDSDPVVAQIQYTVPDAPGIPEPSNITGNSITLTWARPESDGGSEIQQYILERREKKSTRWVKVISKRPISETRFKVTGLTEGNEYEFHVMAENAAGVGPASGISRLIKCREPVNPPGPPTVVKVTDTSKTTVSLEWSKPVFDGGMEIIGYIIEMCKADLGDWHKVNAEACVKTRYTVTDLQAGEEYKFRVSAINGAGKGDSCEVTGTIKAVDRLTAPELDIDANFKQTHVVRAGASIRLFIAYQGRPTPTAVWSKPDSNLSLRADIHTTDSFSTLTVENCNRNDAGKYTLTVENNSGSKSITFTVKVLDTPGPPGPITFKDVTRGSATLMWDAPLLDGGARIHHYVVEKREASRRSWQVISEKCTRQIFKVNDLAEGVPYYFRVSAVNEYGVGEPYEMPEPIVATEQPAPPRRLDVVDTSKSSAVLAWLKPDHDGGSRITGYLLEMRQKGSDFWVEAGHTKQLTFTVERLVEKTEYEFRVKAKNDAGYSEPREAFSSVIIKEPQIEPTADLTGITNQLITCKAGSPFTIDVPISGRPAPKVTWKLEEMRLKETDRVSITTTKDRTTLTVKDSMRGDSGRYFLTLENTAGVKTFSVTVVVIGRPGPVTGPIEVSSVSAESCVLSWGEPKD

SEQ ID NO: 909251 - protein, 1309 aa, Homo sapiens
QLRMTDVFVESFIEEITYRSWYFSWTKPDFDGGSVITEYVVERKGKGEQTWSHAGISKTCEIEVSQLKEQSVLEFRVFAKNEKGLSDPVTIGPITVKELIITPEVDLSDIPGAQVTVRIGHNVHLELPYKGKPKPSISWLKDGLPLKESEFVRFSKTENKITLSIKNAKKEHGGKYTVILDNAVCRIAVPITVITLGPPSKPKGPIRFDEIKADSVILSWDVPEDNGGGEITCYSIEKRETSQTNWKMVCSSVARTTFKVPNLVKDAEYQFRVRAENRYGVSQPLVSSIIVAKHQFRIPGPPGKPVIYNVTSDGMSLTWDAPVYDGGSEVTGFHVEKKERNSILWQKVNTSPISGREYRATGLVEGLDYQFRVYAENSAGLSSPSDPSKFTLAVSPVDPPGTPDYIDVTRETITLKWNPPLRDGGSKIVGYSIEKRQGNERWVRCNFTDVSECQYTVTGLSPGDRYEFRIIARNAVGTISPPSQSSGIIMTRDENVPPIVEFGPEYFDGLIIKSGESLRIKALVQGRPVPRVTWFKDGVEIEKRMNMEITDVLGSTSLFVRDATRDHRGVYTVEAKNASGSAKAEIKVKVQDTPGKVVGPIRFTNITGEKMTLWWDAPLNDGCAPITHYIIEKRETSRLAWALIEDKCEAQSYTAIKLINGNEYQFRVSAVNKFGVGRPLDSDPVVAQIQYTVPDAPGIPEPSNITGNSITLTWARPESDGGSEIQQYILERREKKSTRWVKVISKRPISETRFKVTGLTEGNEYEFHVMAENAAGVGPASGISRLIKCREPVNPPGPPTVVKVTDTSKTTVSLEWSKPVFDGGMEIIGYIIEMCKADLGDWHKVNAEACVKTRYTVTDLQAGEEYKFRVSAINGAGKGDSCEVTGTIKAVDRLTAPELDIDANFKQTHVVRAGASIRLFIAYQGRPTPTAVWSKPDSNLSLRADIHTTDSFSTLTVENCNRNDAGKYTLTVENNSGSKSITFTVKVLDTPGPPGPITFKDVTRGSATLMWDAPLLDGGARIHHYVVEKREASRRSWQVISEKCTRQIFKVNDLAEGVPYYFRVSAVNEYGVGEPYEMPEPIVATEQPAPPRRLDVVDTSKSSAVLAWLKPDHDGGSRITGYLLEMRQKGSDFWVEAGHTKQLTFTVERLVEKTEYEFRVKAKNDAGYSEPREAFSSVIIKEPQIEPTADLTGITNQLITCKAGSPFTIDVPISGRPAPKVTWKLEEMRLKETDRVSITTTKDRTTLTVKDSMRGDSGRYFLTLENTAGVKTFSVTVVVIGRPGPVTGPIEVSSVSAESCVLSWGEPKD

SEQ ID NO: 909252 - protein, 149 aa, Homo sapiens
MNKNQVPKLQPQITMIPPSAQPPRTQTPPLGQTPQLGLKTNPPLIQEKPAKTSKKPPPSKEELLKLTETVVTEYLNSGNANEAVNGVREMRAPKHFLPEMLSKVIILSLDRSDEDKEKASSLISLLKQEGIATSDNFMQLGGESLVNSR

SEQ ID NO: 909253 - protein, 86 aa, Homo sapiens
TQPSSRQRSAPLTPLAQPQRLREYGFAHCGGAAPQPSSALWLLLAALRGLVADGNRAADWAAKEPFGETLVGSAAPRVISSASDTP

SEQ ID NO: 909254 - protein, 701 aa, Homo sapiens
MLGNIKFIGELGKLDLIHESILHKCIKTLLEKKKRVQLKDMGEDLECLCQIMRTVGPRLDHERAKSLMDQYFARMCSLMLSKELPARIRFLLQDTVELREHHWVPRKAFLDNGPKTINQIRQDAVKDLGVFIPAPMAQGMRSDFFLEGPFMPPRMKMDRDPLGGLADMFGQMPGSGIGTGPGVIQDRFSPTMGRHRSNQLFNGHGGHIMPPTQSQFGEMGGKFMKSQGLSQLYHNQSQGLLSQLQGQSKDMPPRFSKKGQLNADEISLRPAQSFLMNKNQVPKLQPQITMIPPSAQPPRTQTPPLGQTPQLGLKTNPPLIQEKPAKTSKKPPPSKEELLKLTETVVTEYLNSGNANEAVNGVREMRAPKHFLPEMLSKVIILSLDRSDEDKEKASSLISLLKQEGIATSDNFMQAFLNVLDQCPKLEVDIPLVKSYLAQFAARAIISELVSISELAQPLESGTHFPLFLLCLQQLAKLQDREWLTELFQQSKVNMQKMLPEIDQNKDRMLEILEGKGLSFLFPLLKLEKELLKQIKLDPSPQTIYKWIKDNISPKLHVDKGFVNILMTSFLQYISSEVNPPSDETDSSSAPSKEQLEQEKQLLLSFKPVMQKFLHDHVDLQVSALYALQVHCYNSNFPKGMLLRFFVHFYDMEIIEEEAFLAWKEDITQEFPGKGKALFQVNQWLTWLETAEEEESEEEAD

SEQ ID NO: 909255 - protein, 169 aa, Homo sapiens
VQNGGRRRSRVGRPFFSISSALQTPGKSWLLFSLPVADGVEGKRQCWPGRRAVMAGWPTPAGTRPWRTEARLCSDGEGAWLGPLAPWREARGPAGKARPLARDQGTAGVPEPGLPAGRCVGPGVGRGCPSSGRKERVMISAPFVSRGGRGEAVVSPGGIYGAGGGPLGG

SEQ ID NO: 909256 - protein, 451 aa, Homo sapiens
MPPRFSKKGQLNADEISLRPAQSFLMNKNQVPKLQPQITMIPPSAQPPRTQTPPLGQTPQLGLKTNPPLIQEKPAKTSKKPPPSKEELLKLTETVVTEYLNSGNANEAVNGVREMRAPKHFLPEMLSKVIILSLDRSDEDKEKASSLISLLKQEGIATSDNFMQAFLNVLDQCPKLEVDIPLVKSYLAQFAARAIISELVSISELAQPLESGTHFPLFLLCLQQLAKLQDREWLTELFQQSKVNMQKMLPEIDQNKDRMLEILEGKGLSFLFPLLKLEKELLKQIKLDPSPQTIYKWIKDNISPKLHVDKGFVNILMTSFLQYISSEVNPPSDETDSSSAPSKEQLEQEKQLLLSFKPVMQKFLHDHVDLQVSALYALQVHCYNSNFPKGMLLRFFVHFYDMEIIEEEAFLAWKEDITQEFPGKGKALFQVNQWLTWLETAEEEESEEEAD

SEQ ID NO: 909257 - protein, 625 aa, Homo sapiens
TTYFRTTYFRKTINQIRQDAVKDLGVFIPAPMAQGMRSDFFLEGPFMPPRMKMDRDPLGGLADMFGQMPGSGIGTGPGVIQDRFSPTMGRHRSNQLFNGHGGHIMPPTQSQFGEMGGKFMKSQGLSQLYHNQSQGLLSQLQGQSKDMPPRFSKKGQLNADEISLRPAQSFLMNKNQVPKLQPQITMIPPSAQPPRTQTPPLGQTPQLGLKTNPPLIQEKPAKTSKKPPPSKEELLKLTVSFKYPIFSVIEPVFEIENTLKILVFSQETVVTEYLNSGNANEAVNGVREMRAPKHFLPEMLSKVIILSLDRSDEDKEKASSLISLLKQEGIATSDNFMQAFLNVLDQCPKLEVDIPLVKSYLAQFAARAIISELVSISELAQPLESGTHFPLFLLCLQQLAKLQDREWLTELFQQSKVNMQKMLPEIDQNKDRMLEILEGKGLSFLFPLLKLEKELLKQIKLDPSPQTIYKWIKDNISPKLHVDKGFVNILMTSFLQYISSEVNPPSDETDSSSAPSKEQLEQEKQLLLSFKPVMQKFLHDHVDLQVSALYALQVHCYNSNFPKGMLLRFFVHFYDMEIIEEEAFLAWKEDITQEFPGKGKALFQVNQWLTWLETAEEEESEEEAD

SEQ ID NO: 909258 - protein, 427 aa, Homo sapiens
TTYFRTTYFRKTINQIRQDAVKDLGVFIPAPMAQGMRSDFFLEGPFMPPRMKMDRDPLGGLADMFGQMPGSGIGTGPGVIQDRFSPTMGRHRSNQLFNGHGGHIMPPTQSQFGEMGGKFMKSQGLSQLYHNQSQGLLSQLQGQSKDMPPRFSKKGQLNADEISLRPAQSFLMNKNQVPKLQPQITMIPPSAQPPRTQTPPLGQTPQLGLKTNPPLIQEKPAKTSKKPPPSKEELLKLTETVVTEYLNSGNANEAVNGVREMRAPKHFLPEMLSKVIILSLDRSDEDKEKASSLISLLKQEGIATSDNFMQAFLNVLDQCPKLEVDIPLVKSYLAQFAARAIISELVSISELAQPLESGTHFPLFLLCLQQLAKLQDREWLTELFQQSKVNMQKMLPGKRMLTCLFCFFNIISRDFRYLEWIYVGQTV

SEQ ID NO: 909259 - protein, 291 aa, Homo sapiens
TTYFRTTYFRKTINQIRQDAVKDLGVFIPAPMAQGMRSDFFLEGPFMPPRMKMDRDPLGGLADMFGQMPGSGIGTGPGVIQDRFSPTMGRHRSNQLFNGHGGHIMPPTQSQFGEMGGKFMKSQGLSQLYHNQSQGLLSQLQGQSKDMPPRFSKKGQLNADEISLRPAQSFLMNKNQVPKLQPQITMIPPSAQPPRTQTPPLGQTPQLGLKTNPPLIQEKPAKTSKKPPPSKEELLKLTETVVTEYLNSGNANEAVNGVREMRAPKHFLPEMLSKVIILSLDRSDEDKEKLS

SEQ ID NO: 909260 - protein, 616 aa, Homo sapiens
TTYFRTTYFRKTINQIRQDAVKDLGVFIPAPMAQGMRSDFFLEGPFMPPRMKMDRDPLGGLADMFGQMPGSGIGTGPGVIQDRFSPTMGRHRSNQLFNGHGGHIMPPTQSQFGEMGGKFMKSQGLSQLYHNQSQGLLSQLQGQSKDMPPRFSKKGQLNADEISLRPAQSFLMNKNQVPKLQPQITMIPPSAQPPRTQTPPLGQTPQLGLKTNPPLIQEKPAKTSKKPPPSKEELLKLTETVVTEYLNSGNANEAVNGVREMRAPKHFLPEMLSKVIILSLDRSDEDKEKASSLISLLKQEGIATSDNFMQAFLNVLDQCPKLEVDIPLVKSYLAQFAARAIISELVSISELAQPLESGTHFPLFLLCLQQLAKLQDREWLTELFQQSKVNMQKMLPEIDQNKDRMLEILEGKGLSFLFPLLKLEKELLKQIKLDPSPQTIYKWIKDNISPKLHVDKGFVNILMTSFLQYISSEVNPPSDETDSSSALTVLWKEQRMNLFHRWVGFTSKEQLEQEKQLLLSFKPVMQKFLHDHVDLQVSALYALQVHCYNSNFPKGMLLRFFVHFYDMEIIEEEAFLAWKEDITQEFPGKGKALFQVNQWLTWLETAEEEESEEEAD

SEQ ID NO: 909261 - protein, 404 aa, Homo sapiens
TTYFRTTYFRKTINQIRQDAVKDLGVFIPAPMAQGMRSDFFLEGPFMPPRMKMDRDPLGGLADMFGQMPGSGIGTGPGVIQDRFSPTMGRHRSNQLFNGHGGHIMPPTQSQFGEMGGKFMKSQGLSQLYHNQSQGLLSQLQGQSKDMPPRFSKKGQLNADEISLRPAQSFLMNKNQVPKLQPQITMIPPSAQPPRTQTPPLGQTPQLGLKTNPPLIQEKPAKTSKKPPPSKEELLKLTETVVTEYLNSGNANEAVNGVREMRAPKHFLPEMLSKVIILSLDRSDEDKEKASSLISLLKQEGIATSDNFMQAFLNVLDQCPKLEVDIPLVKSYLAQFAARAIISELVSISELAQPLESGTHFPLFLLCLQQLAKLQDREWLTELFQQSKVNMQKMLPVTSLPNFM

SEQ ID NO: 909262 - protein, 597 aa, Homo sapiens
TTYFRTTYFRKTINQIRQDAVKDLGVFIPAPMAQGMRSDFFLEGPFMPPRMKMDRDPLGGLADMFGQMPGSGIGTGPGVIQDRFSPTMGRHRSNQLFNGHGGHIMPPTQSQFGEMGGKFMKSQGLSQLYHNQSQGLLSQLQGQSKDMPPRFSKKGQLNADEISLRPAQSFLMNKNQVPKLQPQITMIPPSAQPPRTQTPPLGQTPQLGLKTNPPLIQEKPAKTSKKPPPSKEELLKLTETVVTEYLNSGNANEAVNGVREMRAPKHFLPEMLSKVIILSLDRSDEDKEKASSLISLLKQEGIATSDNFMQAFLNVLDQCPKLEVDIPLVKSYLAQFAARAIISELVSISELAQPLESGTHFPLFLLCLQQLAKLQDREWLTELFQQSKVNMQKMLPEIDQNKDRMLEILEGKGLSFLFPLLKLEKELLKQIKLDPSPQTIYKWIKDNISPKLHVDKGFVNILMTSFLQYISSEVNPPSDETDSSSAPSKEQLEQEKQLLLSFKPVMQKFLHDHVDLQVSALYALQVHCYNSNFPKGMLLRFFVHFYDMEIIEEEAFLAWKEDITQEFPGKGKALFQVNQWLTWLETAEEEESEEEAD

SEQ ID NO: 909263 - protein, 597 aa, Homo sapiens; identical to SEQ ID NO: 909262

SEQ ID NO: 909264 - protein, 597 aa, Homo sapiens; identical to SEQ ID NO: 909262

SEQ ID NO: 909265 - protein, 597 aa, Homo sapiens; identical to SEQ ID NO: 909262

SEQ ID NO: 909266 - protein, 597 aa, Homo sapiens; identical to SEQ ID NO: 909262

SEQ ID NO: 909267 - protein, 597 aa, Homo sapiens; identical to SEQ ID NO: 909262

SEQ ID NO: 909268 - protein, 80 aa, Homo sapiens
TTYFRTTYFRKTINQIRQDAVKDLGVFIPAPMAQGMRSDFFLEGPFMPPRMKMDRDPLGGLADMFGQMPGESVANLVRNC

SEQ ID NO: 909269 - protein, 851 aa, Homo sapiens
TTYFRTTYFRKTINQIRQDAVKDLGVFIPAPMAQGMRSDFFLEGPFMPPRMKMDRDPLGGLADMFGQMPGSGIGTGPGVIQDRFSPTMGRHRSNQLFNGHGGHIMPPTQSQFGEMGGKFMKSQGLSQLYHNQSQGLLSQLQGQSKDMPPRFSKKGQLNADEISLRPAQSFLMNKNQVPKLQPQITMIPPSAQPPRTQTPPLGQTPQLGLKTNPPLIQEKPAKTSKKPPPSKEELLKLTETVVTEYLNSGNANEAVNGVREMRAPKHFLPEMLSKVIILSLDRSDEDKEKASSLISLLKQEGIATSDNFMQAFLNVLDQCPKLEVDIPLVKSYLAQFAARAIISELVSISELAQPLESGTHFPLFLLCLQQLAKLQDREWLTELFQQSKVNMQKMLPEIDQNKDRMLEILEGKGLSFLFPLLKLEKELLKQIKLDPSPQTIYKWIKDNISPKLHVDKGFVNILMTSFLQYISSEVNPPSDETDSSSAPSKEQLEQEKQLLLSFKPVMQKFLHDHVDLQVSALYALQVHCYNSNFPKACHFAYLCTSMTWKHYPTSKKLYLGLWPRQNTNPTDVTRRNKAKGYRYPELHIQLGLTPWVQPTLVCTAHKYNITKRRANAWHIHPKPQGQTSALTHFGWPQNPYRGHGLELTLVKTLARLKEILQNPTMAVNHTIHTIPRTGLNIDKQPSKKSNIYINKTYAKTATGYTTPTPCNISPPYSIGQLTAVTINLSALTTRINIGFPYHHYPNITTFLNTPTINKPPHSHNRSTLTPNSQPLSYTPQIYPHFHSHTPSTTGYKPPKPSHTLTPEPNTTDSTAKRGTQQECHKTTVNSGAQKDTPLYPLRGLRRHKRKC

SEQ ID NO: 909270 - protein, 447 aa, Homo sapiens
TTYFRTTYFRKTINQIRQDAVKDLGVFIPAPMAQGMRSDFFLEGPFMPPRMKMDRDPLGGLADMFGQMPGSGIGTGPGVIQDRFSPTMGRHRSNQLFNGHGGHIMPPTQSQFGEMGGKFMKSQGLSQLYHNQSQGLLSQLQGQSKDMPPRFSKKGQLNADEISLRPAQSFLMNKNQVPKLQPQITMIPPSAQPPRTQTPPLGQTPQLGLKTNPPLIQEKPAKTSKKPPPSKEELLKLTETVVTEYLNSGNANEAVNGVREMRAPKHFLPEMLSKVIILSLDRSDEDKEKASSLISLLKQEGIATSDNFMQAFLNVLDQCPKLEVDIPLVKSYLAQFAARAIISELVSISELAQPLESGTHFPLFLLCLQQLAKLQDREWLTELFQQSKVNMQKMLPEIDQNKDRMLEILEGKGLSFLFPLLKLEKELLKQIKLDPSPTRIKDAEQNN

SEQ ID NO: 909271 - protein, 310 aa, Homo sapiens
TTYFRTTYFRKTINQIRQDAVKDLGVFIPAPMAQGMRSDFFLEGPFMPPRMKMDRDPLGGLADMFGQMPGSGIGTGPGVIQDRFSPTMGRHRSNQLFNGHGGHIMPPTQSQFGEMGGKFMKSQGLSQLYHNQSQGLLSQLQGQSKDMPPRFSKKGQLNADEISLRPAQSFLMNKNQVPKLQPQITMIPPSAQPPRTQTPPLGQTPQLGLKTNPPLIQEKPAKTSKKPPPSKEELLKLTETVVTEYLNSGNANEAVNGVREMRAPKHFLPEMLSKVIILSLDRSDEDKEKASSLISLLKQELGGESLVNSR

SEQ ID NO: 909272 - protein, 251 aa, Homo sapiens
TTYFRTTYFRKTINQIRQDAVKDLGVFIPAPMAQGMRSDFFLEGPFMPPRMKMDRDPLGGLADMFGQMPGSGIGTGPGVIQDRFSPTMGRHRSNQLFNGHGGHIMPPTQSQFGEMGGKFMKSQGLSQLYHNQSQGLLSQLQGQSKDMPPRFSKKGQLNADEISLRPAQSFLMNKNQVPKLQPQITMIPPSAQPPRTQTPPLGQTPQLGLKTNPPLIQEKPAKTSKKPPPSKEELLKLTGAVVTGAVVTGAV

SEQ ID NO: 909273 - protein, 213 aa, Homo sapiens
TTYFRTTYFRKTINQIRQDAVKDLGVFIPAPMAQGMRSDFFLEGPFMPPRMKMDRDPLGGLADMFGQMPGSGIGTGPGVIQDRFSPTMGRHRSNQLFNGHGGHIMPPTQSQFGEMGGKFMKSQGLSQLYHNQSQGLLSQLQGQSKDMPPRFSKKGQLNADEISLRPAQSFLMNKNQVPKLQPQITMIPPSAQPPRTQTPPLGQVDAAANLVVV

SEQ ID NO: 909274 - protein, 169 aa, Homo sapiens
TTYFRTTYFRKTINQIRQDAVKDLGVFIPAPMAQGMRSDFFLEGPFMPPRMKMDRDPLGGLADMFGQMPGSGIGTGPGVIQDRFSPTMGRHRSNQLFNGHGGHIMPPTQSQFGEMGGKFMKSQGLSQLYHNQSQGLLSQLQGQSKDMPPRFSKRISLKRILKRMRSSRV

SEQ ID NO: 909275 - protein, 127 aa, Homo sapiens
TTYFRTTYFRKTINQIRQDAVKDLGVFIPAPMAQGMRSDFFLEGPFMPPRMKMDRDPLGGLADMFGQMPGSGIGTGPGVIQDRFSPTMGRHRSNQLFNGHGGHIMPPTQSQFGEMGGKFMKSQVSNI

SEQ ID NO: 909276 - protein, 78 aa, Homo sapiens
TTYFRTTYFRKTINQIRQDAVKDLGVFIPAPMAQGMRSDFFLEGPFMPPRMKMDRDPLGGLADMFGQMPVAKSRYDVL

SEQ ID NO: 909277 - protein, 195 aa, Homo sapiens
MQKMLPEIDQNKDRMLEILEGKGLSFLFPLLKLEKELLKQIKLDPSPQTIYKWIKDNISPKLHVDKGFVNILMTSFLQYISSEVNPPSDETDSSSAPSKEQLEQEKQLLLSFKPVMQKFLHDHVDLQVSALYALQVHCYNSNFPKEEFQRMLFGFCAFMTWNWRGVLGGRRYYQSSERRLSGISATVDVDEMREG

SEQ ID NO: 909278 - protein, 86 aa, Homo sapiens; identical to SEQ ID NO: 909253

SEQ ID NO: 909279 - protein, 597 aa, Homo sapiens; identical to SEQ ID NO: 909262

SEQ ID NO: 909280 - protein, 559 aa, Homo sapiens
TTYFRTTYFRKTINQIRQDAVKDLGVFIPAPMAQGMRSDFFLEGPFMPPRMKMDRDPLGGLADMFGQMPGSGIGTGPGVIQDRFSPTMGRHRSNQLFNGHGGHIMPPTQSQFGEMGGKFMKSQISLRPAQSFLMNKNQVPKLQPQITMIPPSAQPPRTQTPPLGQTPQLGLKTNPPLIQEKPAKTSKKPPPSKEELLKLTETVVTEYLNSGNANEAVNGVREMRAPKHFLPEMLSKVIILSLDRSDEDKEKASSLISLLKQEGIATSDNFMQAFLNVLDQCPKLEVDIPLVKSYLAQFAARAIISELVSISELAQPLESGTHFPLFLLCLQQLAKLQDREWLTELFQQSKVNMQKMLPEIDQNKDRMLEILEGKGLSFLFPLLKLEKELLKQIKLDPSPQTIYKWIKDNISPKLHVDKGFVNILMTSFLQYISSEVNPPSDETDSSSAPSKEQLEQEKQLLLSFKPVMQKFLHDHVDLQVSALYALQVHCYNSNFPKGMLLRFFVHFYDMEIIEEEAFLAWKEDITQEFPGKGKALFQVNQWLTWLETAEEEESEEEAD

SEQ ID NO: 909281 - protein, 597 aa, Homo sapiens; identical to SEQ ID NO: 909262

SEQ ID NO: 909282 - protein, 603 aa, Homo sapiens
TTYFRTTYFRKTINQIRQDAVKDLGVFIPAPMAQGMRSDFFLEGPFMPPRMKMDRDPLGGLADMFGQMPGSGIGTGPGVIQDRFSPTMGRHRSNQLFNGHGGHIMPPTQSQFGEMGGKFMKSQGLSQLYHNQSQGLLSQLQGQSKDMPPRFSKKGQLNADEISLRPAQSFLMNKNQVPKLQPQITMIPPSAQPPRTQTPPLGQTPQLGLKTNPPLIQEKPAKTSKKPPPSKEELLKLTETVVTEYLNSGNANEAVNGVREMRAPKHFLPEMLSKVIILSLDRSDEDKEKASSLISLLKQEGIATSDNFMQAFLNVLDQCPKLEVDIPLVKSYLAQFAARAIISELVSISELAQPLESGTHFPLFLLCLQQLAKLQDREWLTELFQQSKVNMQKMLPGGFVSSEIDQNKDRMLEILEGKGLSFLFPLLKLEKELLKQIKLDPSPQTIYKWIKDNISPKLHVDKGFVNILMTSFLQYISSEVNPPSDETDSSSAPSKEQLEQEKQLLLSFKPVMQKFLHDHVDLQVSALYALQVHCYNSNFPKGMLLRFFVHFYDMEIIEEEAFLAWKEDITQEFPGKGKALFQVNQWLTWLETAEEEESEEEAD

SEQ ID NO: 909283 - protein, 465 aa, Homo sapiens
TTYFRTTYFRKTINQIRQDAVKDLGVFIPAPMAQGMRSDFFLEGPFMPPRMKMDRDPLGGLADMFGQMPGSGIGTGPGVIQDRFSPTMGRHRSNQLFNGHGGHIMPPTQSQFGEMGGKFMKSQGLSQLYHNQSQGLLSQLQGQSKDMPPRFSKKGQLNADEISLRPAQSFLMNKNQVPKLQPQITMIPPSAQPPRTQTPPLGQTPQLGLKTNPPLIQEKPAKTSKKPPPSKEELLKLTETVVTEYLNSGNANEAVNGVREMRAPKHFLPEMLSKVIILSLDRSDEDKEKASSLISLLKQEGIATSDNFMQAFLNVLDQCPKLEVDIPLVKSYLAQFAARAIISELVSISELAQPLESGTHFPLFLLCLQQLAKLQDREWLTELFQQSKVNMQKMLPEIDQNKDRMLEILEGKGLSFLFPLLKLEKELLKQIKLDPSPQTIYKWIKDNISPKLHVDKGFVNILMTR

SEQ ID NO: 909284 - protein, 597 aa, Homo sapiens; identical to SEQ ID NO: 909262

SEQ ID NO: 909285 - protein, 597 aa, Homo sapiens; identical to SEQ ID NO: 909262

SEQ ID NO: 909286 - protein, 597 aa, Homo sapiens; identical to SEQ ID NO: 909262

SEQ ID NO: 909287 - protein, 597 aa, Homo sapiens; identical to SEQ ID NO: 909262

SEQ ID NO: 909288 - protein, 597 aa, Homo sapiens; identical to SEQ ID NO: 909262

SEQ ID NO: 909289 - protein, 593 aa, Homo sapiens
TTYFRTTYFRKTINQIRQDAVKDLGVFIPAPMAQGMRSDFFLEGPFMPPRMKMDRDPLGGLADMFGQMPGSGIGTGPGVIQDRFSPTMGRHRSNQLFNGHGGHIMPPTQSQFGEMGGKFMKSQGLSQLYHNQSQGLLSQLQGQSKDMPPRFSKKGQLNADEISLRPAQSFLMNKNQVPKLQPQITMIPPSAQPPRTQTPPLGQTPQLGLKTNPPLIQEKPAKTSKKPPPSKEELLKLTETVVTEYLNSGNANEAVNGVREMRAPKHFLPEMLSKVIILSLDRSDEDKEKASSLISLLKQEGIATSDNFMQAFLNVLDQCPKLEVDIPLVKSYLAQFAARAIISELVSISELAQPLESGTHFPLFLLCLQQLAKLQDREWLTELFQQSKVNMQKMLPEIDQNKDRMLEILEGKGLSFLFPLLKLEKELLKQIKLDPSPQTIYKWIKDNISPKLHVDKGFVNILMTSFLQYISSEVNPPSDETDSSSAPSKEQLEQEKQLLLSFKPVMQKFLHDHVDLQVSALYALQVHCYNSNFPKGMLLRFFVHFYDMEIIEEEAFLAWKEDITQEFPGKGKALFQGKSFVKNLVCLLQFAWY

SEQ ID NO: 909290 - protein, 470 aa, Homo sapiens
TTYFRTTYFRKTINQIRQDAVKDLGVFIPAPMAQGMRSDFFLEGPFMPPRMKMDRDPLGGLADMFGQMPGSGIGTGPGVIQDRFSPTMGRHRSNQLFNGHGGHIMPPTQSQFGEMGGKFMKSQGLSQLYHNQSQGLLSQLQGQSKDMPPRFSKKGQLNADEISLRPAQSFLMNKNQVPKLQPQITMIPPSAQPPRTQTPPLGQTPQLGLKTNPPLIQEKPAKTSKKPPPSKEELLKLTETVVTEYLNSGNANEAVNGVREMRAPKHFLPEMLSKVIILSLDRSDEDKEKASSLISLLKQEGIATSDNFMQAFLNVLDQCPKLEVDIPLVKSYLAQFAARAIISELVSISELAQPLESGTHFPLFLLCLQQLAKLQDREWLTELFQQSKVNMQKMLPEIDQNKDRMLEILEGKGLSFLFPLLKLEKELLKQIKLDPSPQTIYKWIKERPKKEIKKKRWNRPKMSLAQIKDR

SEQ ID NO: 909291 - protein, 275 aa, Homo sapiens
TTYFRTTYFRKTINQIRQDAVKDLGVFIPAPMAQGMRSDFFLEGPFMPPRMKMDRDPLGGLADMFGQMPGSGIGTGPGVIQDRFSPTMGRHRSNQLFNGHGGHIMPPTQSQFGEMGGKFMKSQGLSQLYHNQSQGLLSQLQGQSKDMPPRFSKKGQLNADEISLRPAQSFLMNKNQVPKLQPQITMIPPSAQPPRTQTPPLGQTPQLGLKTNPPLIQEKPAKTSKKPPPSKEELLKLTETVVTEWSSKLLRRTIHQATPSLAIDTQENKYVSSQK

SEQ ID NO: 909292 - protein, 222 aa, Homo sapiens
TTYFRTTYFRKTINQIRQDAVKDLGVFIPAPMAQGMRSDFFLEGPFMPPRMKMDRDPLGGLADMFGQMPGSGIGTGPGVIQDRFSPTMGRHRSNQLFNGHGGHIMPPTQSQFGEMGGKFMKSQGLSQLYHNQSQGLLSQLQGQSKDMPPRFSKKGQLNADEISLRPAQSFLMNKNQVPKLQPQITMIPPSAQPPRTQTPPLGQTPQLGANIYIPSESRFGGD

SEQ ID NO: 909293 - protein, 196 aa, Homo sapiens
TTYFRTTYFRKTINQIRQDAVKDLGVFIPAPMAQGMRSDFFLEGPFMPPRMKMDRDPLGGLADMFGQMPGSGIGTGPGVIQDRFSPTMGRHRSNQLFNGHGGHIMPPTQSQFGEMGGKFMKSQGLSQLYHNQSQGLLSQLQGQSKDMPPRFSKKGQLNADEISLRPAQSFLMNKNQVPKLQPQITMIPSLRGPLES

SEQ ID NO: 909294 - protein, 954 aa, Homo sapiens
MTAREHSPRHGARARAMQRASTIDVAADMLGLSLAGNIQDPDEPILEFSLACSELHTPSLDRKPNSFVAVSVTTPPQAFWTKHAQTEIIEGTNNPIFLSSIAFFQDSLINQMTQVKLSVYDVKDRSQGTMYLLGSGTFIVKDLLQDRHHRLHLTLRSAESDRVGNITVIGWQMEEKSDQRPPVTRSVDTVNGRMVLPVDESLTEALGIRSKYASLRKDTLLKSVFGGAICRMYRFPTTDGNHLRILEQMAESVLSLHVPRQFVKLLLEEDAARVCELEELGELSPCWESLRRQIVTQYQTIILTYQENLTDLHQYRGPSFKASSLKADKKLEFVPTNLHIQRMRVQDDGGSDQNYDIVTIGAPAAHCQGFKSGGLRKKLHKFEETKKHFEECCTSSGCQSIIYIPQDVVRAKEIIAQINTLKTQVSYYAERLSRAAKDRSATGLERTLAILADKTRQLVTVCDCKLLANSIHGLNAARPDYIASKASPTSTEEEQVMLRNDQDTLMARWTGRNSRSSLQVDWHEEEWEKVWLNVDKSLECIIQRVDKLLQKERLHGEGCEDVFPCAGSCTSKKDCSPPPEESSPGEWSEALYPLLTTLTDCVAMMSDKAKKAMVFLLMQDSAPTIATYLSLQYRRDVVFCQTLTALICGFIIKLRNCLHDDGFLRQLYTIGLLAQFESLLSTYGEELAMLEDMSLGIMDLRNVTFKVTQATSSASADMLPVITGNRDGFNVRVPLPGPLFDALPREIQSGMLLRVQPVLFNVGINEQQTLAERFGDTSLQEVINVESLVRLNSYFEQFKEVLPEDCLPRSRSQTCLPELLRFLGQNVHARKNKNVDILWQAAEICRRLNGVRFTSCKSAKDRTAMSVTLEQCLILQHEHGMAPQVFTQALECMRSIGTREVVTQKNLSGLVPIRDLRLDPSLLCSIPLLALSPNLLIVWLFLSIAYLVTKLRCK

SEQ ID NO: 909295 - protein, 938 aa, Homo sapiens
MTAREHSPRHGARARAMQRASTIDVAADMLGLSLAGNIQDPDEPILEFSLACSELHTPSLDRKPNSFVAVSVTTPPQAFWTKHAQTEIIEGTNNPIFLSSIAFFQDSLINQMTQVKLSVYDVKDRSQGTMYLLGSGTFIVKDLLQDRHHRLHLTLRSAESDRVGNITVIGWQMEEKSDQRPPVTRSVDTVNGRMVLPVDESLTEALGIRSKYASLRKDTLLKSVFGGAICRMYRFPTTDGNHLRILEQMAESVLSLHVPRQFVKLLLEEDAARVCELEELGELSPCWESLRRQIVTQYQTIILTYQENLTDLHQYRGPSFKASSLKADKKLEFVPTNLHIQRMRVQDDGGSDQNYDIVTIGAPAAHCQGFKSGGLRKKLHKFEETKKHFEECCTSSGCQSIIYIPQDVVRAKEIIAQINTLKTQVSYYAERLSRAAKDRSATGLERTLAILADKTRQLVTVCDCKLLANSIHGLNAARPDYIASKASPTSTEEEQVMLRNDQDTLMARWTGRNSRSSLQVDWHEEEWEKVWLNVDKSLECIIQRVDKLLQKERLHGEGCEDVFPCAGSCTSKKDCSPPPEESSPGEWSEALYPLLTTLTDCVAMMSDKAKKAMVFLLMQDSAPTIATYLSLQYRRDVVFCQTLTALICGFIIKLRNCLHDDGFLRQLYTIGLLAQFESLLSTYGEELAMLEDMSLGIMDLRNVTFKVTQATSSASADMLPVITGNRDGFNVRVPLPGPLFDALPREIQSGMLLRVQPVLFNVGINEQQTLAERFGDTSLQEVINVESLVRLNSYFEQFKEVLPEDCLPRSRSQTCLPELLRFLGQNVHARKNKNVDILWQAAEICRRLNGVRFTSCKSAKDRTAMSVTLEQCLILQHEHGMAPQVFTQALECMRSEGCRRENTMKNVGSRKYAFNSLQLKAFPKHYRPPEGTYGKVET

SEQ ID NO: 909296 - protein, 977 aa, Homo sapiens
MTAREHSPRHGARARAMQRASTIDVAADMLGLSLAGNIQDPDEPILEFSLACSELHTPSLDRKPNSFVAVSVTTPPQAFWTKHAQTEIIEGTNNPIFLSSIAFFQDSLINQMTQVKLSVYDVKDRSQGTMYLLGSGTFIVKDLLQDRHHRLHLTLRSAESDRVGNITVIGWQMEEKSDQRPPVTRSVDTVNGRMVLPVDESLTEALGIRSKYASLRKDTLLKSVFGGAICRMYRFPTTDGNHLRILEQMAESVLSLHVPRQFVKLLLEEDAARVCELEELGELSPCWESLRRQIVTQYQTIILTYQENLTDLHQYRGPSFKASSLKADKKLEFVPTNLHIQRMRVQDDGGSDQNYDIVTIGAPAAHCQGFKSGGLRKKLHKFEETKKHFEECCTSSGCQSIIYIPQDVVRAKEIIAQINTLKTQVSYYAERLSRAAKDRSATGLERTLAILADKTRQLVTVCDCKLLANSIHGLNAARPDYIASKASPTSTEEEQVMLRNDQDTLMARWTGRNSRSSLQVDWHEEEWEKVWLNVDKSLECIIQRVDKLLQKERLHGEGCEDVFPCAGSCTSKKGNPDSHAYWIRPEDPFCDVPSSPCPSTMPSTACHPHLTTHCSPPPEESSPGEWSEALYPLLTTLTDCVAMMSDKAKKAMVFLLMQDSAPTIATYLSLQYRRDVVFCQTLTALICGFIIKLRNCLHDDGFLRQLYTIGLLAQFESLLSTYGEELAMLEDMSLGIMDLRNVTFKVTQATSSASADMLPVITGNRDGFNVRVPLPGPLFDALPREIQSGMLLRVQPVLFNVGINEQQTLAERFGDTSLQEVINVESLVRLNSYFEQFKEVLPEDCLPRSRSQTCLPELLRFLGQNVHARKNKNVDILWQAAEICRRLNGVRFTSCKSAKDRTAMSVTLEQCLILQHEHGMAPQVFTQALECMRSEGCRRENTMKNVGSRKYAFNSLQLKAFPKHYRPPEGTYGKVET

SEQ ID NO: 909297 - protein, 829 aa, Homo sapiens
MTLTSKGTVLSSHKIDLTQTMYLLGSGTFIVKDLLQDRHHRLHLTLRSAESDRVGNITVIGWQMEEKSDQRPPVTRSVDTVNGRMVLPVDESLTEALGIRSKYASLRKDTLLKSVFGGAICRMYRFPTTDGNHLRILEQMAESVLSLHVPRQFVKLLLEEDAARVCELEELGELSPCWESLRRQIVTQYQTIILTYQENLTDLHQYRGPSFKASSLKADKKLEFVPTNLHIQRMRVQDDGGSDQNYDIVTIGAPAAHCQGFKSGGLRKKLHKFEETKKHFEECCTSSGCQSIIYIPQDVVRAKEIIAQINTLKTQVSYYAERLSRAAKDRSATGLERTLAILADKTRQLVTVCDCKLLANSIHGLNAARPDYIASKASPTSTEEEQVMLRNDQDTLMARWTGRNSRSSLQVDWHEEEWEKVWLNVDKSLECIIQRVDKLLQKERLHGEGCEDVFPCAGSCTSKKDCSPPPEESSPGEWSEALYPLLTTLTDCVAMMSDKAKKAMVFLLMQDSAPTIATYLSLQYRRDVVFCQTLTALICGFIIKLRNCLHDDGFLRQLYTIGLLAQFESLLSTYGEELAMLEDMSLGIMDLRNVTFKVTQATSSASADMLPVITGNRDGFNVRVPLPGPLFDALPREIQSGMLLRVQPVLFNVGINEQQTLAERFGDTSLQEVINVESLVRLNSYFEQFKEVLPEDCLPRSRSQTCLPELLRFLGQNVHARKNKNVDILWQAAEICRRLNGVRFTSCKSAKDRTAMSVTLEQCLILQHEHGMAPQVFTQALECMRSEGCRRENTMKNVGSRKYAFNSLQLKAFPKHYRPPEGTYGKVET

SEQ ID NO: 909298 - protein, 717 aa, Homo sapiens
MTAREHSPRHGARARAMQRASTIDVAADMLGLSLAGNIQDPDEPILEFSLACSELHTPSLDRKPNSFVAVSVTTPPQAFWTKHAQTEIIEGTNNPIFLSSIAFFQDSLINQMTQVKLSVYDVKDRSQGTMYLLGSGTFIVKDLLQDRHHRLHLTLRSAESDRVGNITVIGWQMEEKSDQRPPVTRSVDTVNGRMVLPVDESLTEALGIRSKYASLRKDTLLKSVFGGAICRMYRFPTTDGNHLRILEQMAESVLSLHVPRQFVKLLLEEDAARVCELEELGELSPCWESLRRQIVTQYQTIILTYQENLTDLHQYRGPSFKASSLKADKKLEFVPTNLHIQRMRVQDDGGSDQNYDIVTIGAPAAHCQGFKSGGLRKKLHKFEETKKHFEECCTSSGCQSIIYIPQDVVRAKEIIAQINTLKTQVSYYAERLSRAAKDRSATGLERTLAILADKTRQLVTVCDCKLLANSIHGLNAARPDYIASKASPTSTEEEQVMLRNDQDTLMARWTGRNSRSSLQVDWHEEEWEKVWLNVDKSLECIIQRVDKLLQKERLHGEGCEDVFPCAGSCTSKKGNPDSHAYWIRPEDPFCDVPSSPCPSTMPSTACHPHLTTRAYASMLPICCLHFTLCCFHLSVSLTPCPPPPCRLQGGLPGGAGASQCMEQQAVRAESPVAFPCNWSPCVILHLCQSESQGPLEIHHHGYKGWAPGLFRFVKQSE

SEQ ID NO: 909299 - protein, 938 aa, Homo sapiens; identical to SEQ ID NO: 909295

SEQ ID NO: 909300 - protein, 938 aa, Homo sapiens; identical to SEQ ID NO: 909295

SEQ ID NO: 909301 - protein, 816 aa, Homo sapiens
MTAREHSPRHGARARAMQRASTIDVAADMLGLSLAGNIQDPDEPILEFSLACSELHTPSLDRKPNSFVAVSVTTPPQAFWTKHAQTEIIEGTNNPIFLSSIAFFQDSLINQMTQVKLSVYDVKDRSQGTMYLLGSGTFIVKDLLQDRHHRLHLTLRSAESDRVGNITVIGWQMEEKSDQRPPVTRSVDTVNGRMVLPVDESLTEALGIRSKYASLRKDTLLKSVFGGAICRMYRFPTTDGNHLRILEQMAESVLSLHVPRQFVKLLLEEDAARVCELEELGELSPCWESLRRQIVTQYQTIILTYQENLTDLHQYRGPSFKASSLKADKKLEFVPTNLHIQRMRVQDDGGSDQNYDIVTIGAPAAHCQGFKSGGLRKKLHKFEETKKHFEECCTSSGCQSIIYIPQDVVRAKEIIAQINTLKTQVSYYAERLSRAAKDRSATGLERTLAILADKTRQLVTVCDCKLLANSIHGLNAARPDYIASKASPTSTEEEQVMLRNDQDTLMARWTGRNSRSSLQVDWHEEEWEKVWLNVDKSLECIIQRVDKLLQKERLHGEGCEDVFPCAGSCTSKKDCSPPPEESSPGEWSEALYPLLTTLTDCVAMMSDKAKKAMVFLLMQDSAPTIATYLSLQYRRDVVFCQTLTALICGFIIKLRNCLHDDGFLRQLYTIGLLAQFESLLSTYGEELAMLEDMSLGIMDLRNVTFKVTQATSSASADMLPVITGNRDGFNVRVPLPGPLFDALPREIQSGMLLRVQPVLFNVGINEQQTLAERFGDTSLQEVINVESLVRLNSYFEQFKEVLPEDSYVTWLLPMLS

SEQ ID NO: 909302 - protein, 182 aa, Homo sapiens
MEKLLLHTPKAIGQPFYNSLGFSSSPSPIGMPLPSQTPGHSLTPPPSLSSHGSSSSLHLGGLTNGSGRYISAAPGAEAKYRSASSTSSLFSSSSQLFPPSRLRYNRSDIMPSGRSRLLEDFRNNRFPNLQLRDLIGPSACAATTSSIGICGGLDPRRVQPPLRPYRHATTSSTRISKIRPSD

SEQ ID NO: 909303 - protein, 1064 aa, Homo sapiens
MNHDFQALALESRGMGELLPTKKFWEPDDSTKDGQKGIFLGDDEWRETAWGASHHSMSQPIMVQRRSGQGFHGNSEVNAILSPRSESGGLGVSMVEYVLSSSPADKLDSRFRKGNFGTRDAETDGPEKGDQKGKASPFEEDQNRDLKQGDDDDSKINGRGLPNGMDADCKDFNRTPGSRQASPTEVVERLGPNTNPSEGLGPLPNPTANKPLVEEFSNPETQNLDAMEQVGLESLQFDYPGNQVPMDSSGATVGLFDYNSQQQLFQRTNALTVQQLTAAQQQQYALAAAQQPHIAGVFSAGLAPAAFVPNPYIISAAPPGTDPYTAAGLAAAATLAGPAVVPPQYYGVPWGVYPANLFQQQAAAAANNTASQQAASQAQPGQQQVLRAGAGQRPLTPNQGQQGQQAESLAAAAAANPTLAFGQGLATGMPGYQVLAPTAYYDQTGALVVGPGARTGLGAPVRLMAPTPVLISSAAAQAAAAAAAGGTASSLTGSTNGLFRPIGTQPPQQQQQQPSTNLQSNSFYGSSSLTNSSQSSSLFSHGPGQPGSTSLGFGSGNSLGAAIGSALSGFGSSVGSSASSSATRRESLSTSSDLYKRSSSSLAPIGQPFYNSLGFSSSPSPIGMPLPSQTPGHSLTPPPSLSSHGSSSSLHLGGLTNGSGRYISAAPGAEAKYRSASSTSSLFSSSSQLFPPSRLRYNRSDIMPSGRSRLLEDFRNNRFPNLQLRDLIGHIVEFSQDQHGSRFIQQKLERATPAERQMVFNEILQAAYQLMTDVFGNYVIQKFFEFGSLDQKLALATRIRGHVLPLALQMYGCRVIQKALESISSDQQSEMVKELDGHVLKCVKDQNGNHVVQKCIECVQPQSLQFIIDAFKGQVFVLSTHPYGCRVIQRILEHCTAEQTLPILEELHQHTEQLVQDQYGNYVIQHVLEHGRPEDKSKIVSEIRGKVLALSQHKFASNVVEKCVTHASRAERALLIDEVCCQNDGPHSALYTMMKDQYANYVVQKMIDMAEPAQRKIIMHKIRPHITTLRKYTYGKHILAKLEKYYLKNSPDLGPIGGPPNGML

SEQ ID NO: 909304 - protein, 1064 aa, Homo sapiens; identical to SEQ ID NO: 909303

SEQ ID NO: 909305 - protein, 636 aa, Homo sapiens [sequence omitted]

SEQ ID NO: 909306 - protein, 1064 aa, Homo sapiens; identical to SEQ ID NO: 909303

SEQ ID NO: 909307 - protein, 362 aa, Homo sapiens
MPSGRSRLLEDFRNNRFPNLQLRDLIGHIVEFSQDQHGSRFIQQKLERATPAERQMVFNEILQAAYQLMTDVFGNYVIQKFFEFGSLDQKLALATRIRGHVLPLALQMYGCRVIQKALESISSDQQSEMVKELDGHVLKCVKDQNGNHVVQKCIECVQPQSLQFIIDAFKGQVFVLSTHPYGCRVIQRILEHCTAEQTLPILEELHQHTEQLVQDQYGNYVIQHVLEHGRPEDKSKIVSEIRGKVLALSQHKFASNVVEKCVTHASRAERALLIDEVCCQNDGPHSALYTMMKDQYANYVVQKMIDMAEPAQRKIIMHKIRPHITTLRKYTYGKHILAKLEKYYLKNSPDLGPIGGPPNGML

SEQ ID NO: 909308 - protein, 1029 aa, Homo sapiens
MNHDFQALALESRGMGELLPTKKFWEPDDSTKDGQKGIFLGDDEWRETAWGASHHSMSQPIMVQRRSGQGFHGNSEVNAILSPRSESGGLGVSMVEYVLSSSPADKLDSRFRKGNFGTRDAETDGPEKGDQKGKASPFEEDQNRDLKQGDDDDSKINGRGLPNGMDADCKDFNRTPGSRQASPTEVVERLGPNTNPSEGLGPLPNPTANKPLVEEFSNPETQNLDAMEQVGLESLQFDYPGNQVPMDSSGATVGLFDYNSQQQLFQRTNALTVQQLTAAQQQQYALAAAQQPHIAGVFSAGLAPAAFVPNPYIISAAPPGTDPYTAAGLAAAATLAGPAVVPPQYYGVPWGVYPANLFQQQAAAAANNTASQQAASQAQPGQQQVLRAGAGQRPLTPNQGQQGQQAESLAAAAAANPTLAFGQGLATGMPGYQVLAPTAYYDQTGALVVGPGARTGLGAPVRLMAPTPVLISSAAAQAAAAAAAGGTASSLTGSTNGLFRPIGTQPPQQQQQQPSTNLQSNSFYGSSSLTNSSQSSSLFSHGPGQPGSTSLGFGSGNSLGAAIGSALSGFGSSVGSSASSSATRRESLSTSSDLYKRSSSSLAPIGQPFYNSLGFSSSPSPIGMPLPSQTPGHSLTPPPSLSSHGSSSSLHLGGLTNGSGRYISAAPGAEAKYRSASSTSSLFSSSSQLFPPSRLRYNRSDIMPSGRSRLLEDFRNNRFPNLQLRDLIGHIVEFSQDQHGSRFIQQKLERATPAERQMVFNEILQAAYQLMTDVFGNYVIQKFFEFGSLDQKLALATRIRGHVLPLALQMYGCRVIQKALESISSDQQSEMVKELDGHVLKCVKDQNGNHVVQKCIECVQPQSLQFIIDAFKGQVFVLSTHPYGCRVIQRILEHCTAEQTLPILEELHQHTEQLVQDQYGNYVIQHVLEHGRPEDKSKIVSEIRGKVLALSQHKFASNVVEKCVTHASRAERALLIDEVCCQNDGPHSALYTMMKDQYANYVVQKMIDMAEPAQRKIIMHKVIQHVTLR

SEQ ID NO: 909309 - protein, 775 aa, Homo sapiens
MNHDFQALALESRGMGELLPTKKFWEPDDSTKDGQKGIFLGDDEWRETAWGASHHSMSQPIMVQRRSGQGFHGNSEVNAILSPRSESGGLGVSMVEYVLSSSPADKLDSRFRKGNFGTRDAETDGPEKGDQKGKASPFEEDQNRDLKQGDDDDSKINGRGLPNGMDADCKDFNRTPGSRQASPTEVVERLGPNTNPSEGLGPLPNPTANKPLVEEFSNPETQNLDAMEQVGLESLQFDYPGNQVPMDSSGATVGLFDYNSQQQLFQRTNALTVQQLTAAQQQQYALAAAQQPHIAGVFSAGLAPAAFVPNPYIISAAPPGTDPYTAAGLAAAATLAGPAVVPPQYYGVPWGVYPANLFQQQAAAAANNTASQQAASQAQPGQQQVLRAGAGQRPLTPNQGQQGQQAESLAAAAAANPTLAFGQGLATGMPGYQVLAPTAYYDQTGALVVGPGARTGLGAPVRLMAPTPVLISSAAAQAAAAAAAGGTASSLTGSTNGLFRPIGTQPPQQQQQQPSTNLQSNSFYGSSSLTNSSQSSSLFSHGPGQPGSTSLGFGSGNSLGAAIGSALSGFGSSVGSSASSSATRRESLSTSSDLYKRSSSSLAPIGQPFYNSLGFSSSPSPIGMPLPSQTPGHSLTPPPSLSSHGSSSSLHLGGLTNGSGRYISAAPGAEAKYRSASSTSSLFSSSSQLFPPSRLRYNRSDIMPSGRSRLLEDFRNNRFPNLQLRDLIGHIVEFSQDQHGSRLSSTSSNCLMIRLGALGGLAPGSKDWPWELQFG

SEQ ID NO: 909310 - protein, 191 aa, Homo sapiens
GGGEGRAGGGGSHVVVSLCVSPSVLRWFGGGGGGEGGGGVGGEGGRWRKKTLPPPKAEEGEDRQERRRRVPNGRCPRLRQLRPQQPCKSVRVRSFSGPLAPSRMAPQALCGGLGGSRSPAGGRIGPAECPGRCGLGPARTMQGEGCRKGVCACGGGGAAPAAFPLPSLCGAAASGAWGADPVLPPIRRAGG

SEQ ID NO: 909311 - protein, 1064 aa, Homo sapiens; identical to SEQ ID NO: 909303

SEQ ID NO: 909312 - protein, 985 aa, Homo sapiens
MNHDFQALALESRGMGELLPTKKFWEPDDSTKDGQKGIFLGDDEWRETAWGASHHSMSQPIMVQRRSGQGFHGNSEVNAILSPRSESGGLGVSMVEYVLSSSPADKLDSRFRKGNFGTRDAETDGPEKGDQKGKASPFEEDQNRDLKQGDDDDSKINGRGLPNGMDADCKDFNRTPGSRQASPTEVVERLGPNTNPSEGLGPLPNPTANKPLVEEFSNPETQNLDAMEQVGLESLQFDYPGNQVPMDSSGATVGLFDYNSQQQLFQRTNALTVQQLTAAQQQQYALAAAQQPHIAGVFSAGLAPAAFVPNPYIISAAPPGTDPYTAAGLAAAATLAGPAVVPPQYYGVPWGVYPANLFQQQAAAAANNTASQQAASQAQPGQQQVLRAGAGQRPLTPNQGQQGQQAESLAAAAAANPTLAFGQGLATGMPGYQVLAPTAYYDQTGALVVGPGARTGLGAPVRLMAPTPVLISSAAAQAAAAAAAGGTASSLTGSTNGLFRPIGTQPPQQQQQQPSTNLQSNSFYGSSSLTNSSQSSSLFSHGPGQPGSTSLGFGSGNSLGAAIGSALSGFGSSGGLTNGSGRYISAAPGAEAKYRSASSTSSLFSSSSQLFPPSRLRYNRSDIMPSGRSRLLEDFRNNRFPNLQLRDLIGHIVEFSQDQHGSRFIQQKLERATPAERQMVFNEILQAAYQLMTDVFGNYVIQKFFEFGSLDQKLALATRIRGHVLPLALQMYGCRVIQKALESISSDQQSEMVKELDGHVLKCVKDQNGNHVVQKCIECVQPQSLQFIIDAFKGQVFVLSTHPYGCRVIQRILEHCTAEQTLPILEELHQHTEQLVQDQYGNYVIQHVLEHGRPEDKSKIVSEIRGKVLALSQHKFASNVVEKCVTHASRAERALLIDEVCCQNDGPHSALYTMMKDQYANYVVQKMIDMAEPAQRKIIMHKIRPHITTLRKYTYGKHILAKLEKYYLKNSPDLGPIGGPPNGML

SEQ ID NO: 909313 - protein, 636 aa, Homo sapiens [sequence omitted]

SEQ ID NO: 909314 - protein, 1064 aa, Homo sapiens; identical to SEQ ID NO: 909303

SEQ ID NO: 909315 - protein, 1064 aa, Homo sapiens; identical to SEQ ID NO: 909303

SEQ ID NO: 909316 - protein, 451 aa, Homo sapiens
TSGEGPGELADPARRWGPAGSVARAAERQGGGGCCAGCSEEEALGGAHGWPGSCAEHESPVLRRGQTWHSAGGRYLKYTLDQYVENDYTIVYFHYGLNSRNKPSLGWLQSAYKEFDRKYKKNLKALYVVHPTSFIKVLWNILKPLISHKFGKKVIYFNYLSELHEHLKYDQLVIPPEVLRYDEKLQSLHEGRTPPPTKTPPPRPPLPTQQFGVSLQYLKDKNQGELIPPVLRFTVTYLREKGLRTEGLFRRSASVQTVREIQRLYNQGKPVNFDDYGDIHIPAVILKTFLRELPQPLLTFQAYEQILGITCVESSLRVTGCRQILRSLPEHNYVVLRYLMGFLHAVSRESIFNKMNSSNLACVFGLNLIWPSQGVSSLSALVPLNMFTELLIEYYEKIFSTPEAPGEHGLAPWEQGSRAAPLQEAVPRTQATGLTKPTLPPSPLMAARRRL

SEQ ID NO: 909317 - protein, 287 aa, Homo sapiens
MAPMPTGQKLLDSLAETWDFFFSDVLPMLQAIFYPVQGKEPSVRQLALLHFRNAITLSVKLEDALARAHARVPPAIVQMLLVLQGVHESRGVTEDYLRLETLVQKVVSPYLGTYGLHSSEGPFTHSCILEKRLLRRSRSGDVLAKNPVVRSKSYNTPLLNPVQEHEAEGAAAGGTSIRRHSVSEMTSCPEPQGFSDPPGQGPTGTFRSSPAPHSGPCPSRLYPTTQPPEQGLDPTRSSLPRSSPENLVDQILESVDSDSEGIFIDFGRGRGSGMSDLEGSGGRQSVV

SEQ ID NO: 909318 - protein, 287 aa, Homo sapiens; identical to SEQ ID NO: 909317

SEQ ID NO: 909319 - protein, 511 aa, Homo sapiens
TSGEGPGERQTRHAGGGRRGPWPELQRDKAAAAAVLGAVRKRPSVVPMAGQDPALSTSHPFYDVARHGILQVAGDDRFGRRVVTFSCCRMPPSHELDHQRLLEYLKYTLDQYVENDYTIVYFHYGLNSRNKPSLGWLQSAYKEFDRKDGDLTMWPRLVSNSKLKRSSHLSLPKYWDYRYKKNLKALYVVHPTSFIKVLWNILKPLISHKFGKKVIYFNYLSELHEHLKYDQLVIPPEVLRYDEKLQSLHEGRTPPPTKTPPPRPPLPTQQFGVSLQYLKDKNQGELIPPVLRFTVTYLREKGLRTEGLFRRSASVQTVREIQRLYNQGKPVNFDDYGDIHIPAVILKTFLRELPQPLLTFQAYEQILGITCVESSLRVTGCRQILRSLPEHNYVVLRYLMGFLHAVSRESIFNKMNSSNLACVFGLNLIWPSQGVSSLSALVPLNMFTELLIEYYEKIFSTPEAPGEHGLAPWEQGSRAAPLQEAVPRTQATGLTKPTLPPSPLMAARRRL

SEQ ID NO: 909320 - protein, 643 aa, Homo sapiens
MRTLRRLKFMSSPSLSDLGKREPAAAADERGTQQRRACANATWNSIHNGVIAVFQRKGLPDQELFSLNEGVRQLLKTELGSFFTEYLQNQLLTKGMVILRDKIRFYEGQKLLDSLAETWDFFFSDVLPMLQAIFYPVQGKEPSVRQLALLHFRNAITLSVKLEDALARAHARVPPAIVQMLLVLQGVHESRGVTEDYLRLETLVQKVVSPYLGTYGLHSSEGPFTHSCILELQRDKAAAAAVLGAVRKRPSVVPMAGQDPALSTSHPFYDVARHGILQVAGDDRFGRRVVTFSCCRMPPSHELDHQRLLEYKKNLKALYVVHPTSFIKVLWNILKPLISHKFGKKVIYFNYLSELHEHLKYDQLVIPPEVLRYDEKLQSLHEGRTPPPTKTPPPRPPLPTQQFGVSLQYLKDKNQGELIPPVLRFTVTYLREKGLRTEGLFRRSASVQTVREIQRLYNQGKPVNFDDYGDIHIPAVILKTFLRELPQPLLTFQAYEQILGITCVESSLRVTGCRQILRSLPEHNYVVLRYLMGFLHAVSRESIFNKMNSSNLACVFGLNLIWPSQGVSSLSALVPLNMFTELLIEYYEKIFSTPEAPGEHGLAPWEQGSRAAPLQEAVPRTQATGLTKPTLPPSPLMAARRRL

SEQ ID NO: 909321 - protein, 581 aa, Homo sapiens
MSAAPKARHPVCLVLSRVSELTPRRVQTSAKVAEQRRPVGWDSTCAHPGSIPPPESSRHPASIHNGVIAVFQRKGLPDQELFSLNEGVRQLLKTELGSFFTEYLQNQLLTKGMVILRDKIRFYEELQRDKAAAAAVLGAVRKRPSVVPMAGQDPALSTSHPFYDVARHGILQVAGDDRFGRRVVTFSCCRMPPSHELDHQRLLEYLKYTLDQYVENDYTIVYFHYGLNSRNKPSLGWLQSAYKEFDRKYKKNLKALYVVHPTSFIKVLWNILKPLISHKFGKKVIYFNYLSELHEHLKYDQLVIPPEVLRYDEKLQSLHEGRTPPPTKTPPPRPPLPTQQFGVSLQYLKDKNQGELIPPVLRFTVTYLREKGLRTEGLFRRSASVQTVREIQRLYNQGKPVNFDDYGDIHIPAVILKTFLRELPQPLLTFQAYEQILGITCVESSLRVTGCRQILRSLPEHNYVVLRYLMGFLHAVSRESIFNKMNSSNLACVFGLNLIWPSQGVSSLSALVPLNMFTELLIEYYEKIFSTPEAPGEHGLAPWEQGSRAAPLQEAVPRTQATGLTKPTLPPSPLMAARRRL

SEQ ID NO: 909322 - protein, 548 aa, Homo sapiens
MRTLRRLKFMSSPSLSDLGKREPAAAADERGTQQRRACANATWNSIHNGVIAVFQRKGLPDQELFSLNEGVRQLLKTELGSFFTEYLQNQLLTKGMVILRDKIRFYEGQKLLDSLAETWDFFFSDVLPMLQAIFYPVQGKEPSVRQLALLHFRNAITLSVKLEDALARAHARVPPAIVQMLLVLQGVHESRGVTEDYLRLETLVQKVVSPYLGTYGLHSSEGPFTHSCILELQRDKAAAAAVLGAVRKRPSVVPMAGQDPALSTSHPFYDVARHGILQVAGDDRFGRRVVTFSCCRMPPSHELDHQRLLEYLKYTLDQYVENDYTIVYFHYGLNSRNKPSLGWLQSAYKEFDRKYKKNLKALYVVHPTSFIKVLWNILKPLISHKFGKKVIYFNYLSELHEHLKYDQLVIPPEVLRYDEKLQSLHEGRTPPPTKTPPPRPPLPTQQFGVSLQYLKDKNQGELIPPVLRFTVTYLREKGLRTEGLFRRSASVQTVREIQRLYNQGKPVNFDDYGDIHIPAVILKTFLRELPQPLLTFQAYEQILGITCA

SEQ ID NO: 909323 - protein, 379 aa, Homo sapiens
MSSPSLSDLGKREPAAAADERGTQQRRACANATWNSIHNGVIAVFQRKGLPDQELFSLNEGVRQLLKTELGSFFTEYLQNQLLTKGMVILRDKIRFYEGQKLLDSLAETWDFFFSDVLPMLQAIFYPVQGKEPSVRQLALLHFRNAITLSVKLEDALARAHARVPPAIVQMLLVLQGVHESRGVTEDYLRLETLVQKVVSPYLGTYGLHSSEGPFTHSCILEKRLLRRSRSGDVLAKNPVVRSKSYNTPLLNPVQEHEAEGAAAGGTSIRRHSVSEMTSCPEPQGFSDPPGQGPTGTFRSSPAPHSGPCPSRLYPTTQPPEQGLDPTRSSLPRSSPENLVDQILESVDSDSEGIFIDFGRGRGSGMSDLEGSGGRQSVV

SEQ ID NO: 909324 - protein, 398 aa, Homo sapiens
LEIPALFGWRLPRAGHQRLLEYLKYTLDQYVENDYTIVYFHYGLNSRNKPSLGWLQSAYKEFDRKYKKNLKALYVVHPTSFIKVLWNILKPLISHKFGKKVIYFNYLSELHEHLKYDQLVIPPEVLRYDEKLQSLHEGRTPPPTKTPPPRPPLPTQQFGVSLQYLKDKNQGELIPPVLRFTVTYLREKGLRTEGLFRRSASVQTVREIQRLYNQGKPVNFDDYGDIHIPAVILKTFLRELPQPLLTFQAYEQILGITCVESSLRVTGCRQILRSLPEHNYVVLRYLMGFLHAVSRESIFNKMNSSNLACVFGLNLIWPSQGVSSLSALVPLNMFTELLIEYYEKIFSTPEAPGEHGLAPWEQGSRAAPLQEAVPRTQATGLTKPTLPPSPLMAARRRL

SEQ ID NO: 909325 - protein, 282 aa, Homo sapiens
MRTLRRLKFMSSPSLSDLGKREPAAAADERGTQQRRACANATWNSIHNGVIAVFQRKGLPDQELFSLNEGVRQLLKTELGSFFTEYLQNQLLTKGMVILRDKIRFYEGQKLLDSLAETWDFFFSDVLPMLQAIFYPVQGKEPSVRQLALLHFRNAITLSVKLEDALARAHARVPPAIVQMLLVLQGVHESRGVTEDYLRLETLVQKVVSPYLGTYGLHSSEGPFTHSCILELQRDKAAAAAVLGAVRKRPSVVPMAGQDPALSTSHPFYDVARHGILQVAGI

SEQ ID NO: 909326 - protein, 368 aa, Homo sapiens
SAAPSPGPGLRLRLRLWLCAVAAAAAARGPRLKFMSSPSLSDLGKREPAAAADERGTQQRRACANATWNSIHNGVIAVFQRKGLPDQELFSLNEGVRQLLKTELGSFFTEYLQNQLLTKGMVILRDKIRFYEGQKLLDSLAETWDFFFSDVLPMLQAIFYPVQGKEPSVRQLALLHFRNAITLSVKLEDALARAHARVPPAIVQMLLVLQGVHESRGVTEDYLRLETLVQKVVSPYLGTYGLHSSEGPFTHSCILEKRLLRRSRSGDVLAKNPVVRSKSYNTPLLNPVQEHEAEGAAAGGTSIRRHSVSEMTSCPEPQGFSDPPGQGPTGTFRSSPAPHSGPCPSRLYPTPAHRECKPSGLCPRRAPK

SEQ ID NO: 909327 - protein, 416 aa, Homo sapiens
MRTLRRLKFMSSPSLSDLGKREPAAAADERGTQQRRACANATWNSIHNGVIAVFQRKGLPDQELFSLNEGVRQLLKTELGSFFTEYLQNQLLTKGMVILRDKIRFYEGQKLLDSLAETWDFFFSDVLPMLQAIFYPVQGKEPSVRQLALLHFRNAITLSVKLEDALARAHARVPPAIVQMLLVLQGVHESRGVTEDYLRLETLVQKVVSPYLGTYGLHSSEGPFTHSCILELQRDKAAAAAVLGAVRKRPSVVPMAGQDPALSTSHPFYDVARHGILQVAGDDRFGRRVVTFSCCRMPPSHELDHQRLLEYLKYTLDQYVENDYTIVYFHYGLNSRNKPSLGWLQSAYKEFDRKYKKNLKALYVVHPTSFIKVLWNILKPLISHKFGKKVIYFNYLSELHEHLKYDQLVIPPEVLR

SEQ ID NO: 909328 - protein, 388 aa, Homo sapiens
MRTLRRLKFMSSPSLSDLGKREPAAAADERGTQQRRACANATWNSIHNGVIAVFQRKGLPDQELFSLNEGVRQLLKTELGSFFTEYLQNQLLTKGMVILRDKIRFYEGQKLLDSLAETWDFFFSDVLPMLQAIFYPVQGKEPSVRQLALLHFRNAITLSVKLEDALARAHARVPPAIVQMLLVLQGVHESRGVTEDYLRLETLVQKVVSPYLGTYGLHSSEGPFTHSCILEKRLLRRSRSGDVLAKNPVVRSKSYNTPLLNPVQEHEAEGAAAGGTSIRRHSVSEMTSCPEPQGFSDPPGQGPTGTFRSSPAPHSGPCPSRLYPTTQPPEQGLDPTRSSLPRSSPENLVDQILESVDSDSEGIFIDFGRGRGSGMSDLEGSGGRQSVV

SEQ ID NO: 909329 - protein, 287 aa, Homo sapiens; identical to SEQ ID NO: 909317

SEQ ID NO: 909330 - protein, 762 aa, Homo sapiens
MRTLRRLKFMSSPSLSDLGKREPAAAADERGTQQRRACANATWNSIHNGVIAVFQRKGLPDQELFSLNEGVRQLLKTELGSFFTEYLQNQLLTKGMVILRDKIRFYEETHLSRCVPIPLRLASPAPIASLDALPPGSPPCLTLCTLFFLRRGAAIGRGLRGSPDLTTGRAGLALGPLGHLTVVHPFLGGSASVCLVGGRSPLATALMILLSVPLPCHVMDGQLFGAQLGPQCPASAPAHSRCSVFVGGADSVGEGGRRSVGRRNQLLSRVVEEDLMRLGCELKLLCQAHLCGSHLCQAYLRGSHLCRSHLCQVYLCGSYLCRSPDAGLTCAECTYLCGSHLCQAYCRGLTCERLTCARCIPVWLSLVWVWYVTKAWELAAVICQEQTLSQVPCALGSFHALSSGRPIPLLPHFINGRLRLSSGPRAIEQLSCGAGHRPWAGAARGLSPGPPLPHPLMTHPGLSGGICPRQSGPVVMAPMPTGQKLLDSLAETWDFFFSDVLPMLQAIFYPVQGKEPSVRQLALLHFRNAITLSVKLEDALARAHARVPPAIVQMLLVLQGVHESRGVTEDYLRLETLVQKVVSPYLGTYGLHSSEGPFTHSCILEKRLLRRSRSGDVLAKNPVVRSKSYNTPLLNPVQEHEAEGAAAGGTSIRRHSVSEMTSCPEPQGFSDPPGQGPTGTFRSSPAPHSGPCPSRLYPTTQPPEQGLDPTRSSLPRSSPENLVDQILESVDSDSEGIFIDFGRGRGSGMSDLEGSGGRQSVV

SEQ ID NO: 909331 - protein, 511 aa, Homo sapiens; identical to SEQ ID NO: 909319

SEQ ID NO: 909332 - protein, 413 aa, Homo sapiens
SAAPSPGPGLRLRLRLWLCAVAAAAAARGPRLKFMSSPSLSDLGKREPAAAADERGTQQRRACANATWNSIHNGVIAVFQRKGLPDQELFSLNEGVRQLLKTELGSFFTEYLQNQLLTKGMVILRDKIRFYEGQKLLDSLAETWDFFFSDVLPMLQAIFYPVQGKEPSVRQLALLHFRNAITLSVKLEDALARAHARVPPAIVQMLLVLQGVHESRGVTEDYLRLETLVQKVVSPYLGTYGLHSSEGPFTHSCILEKRLLRRSRSGDVLAKNPVVRSKSYNTPLLNPVQEHEAEGAAAGGTSIRRHSVSEMTSCPEPQGFSDPPGQGPTGTFRSSPAPHSGPCPSRLYPTTQPPEQGLDPTRSSLPRSSPENLVDQILESVDSDSEGIFIDFGRGRGSGMSDLEGSGGRQSVV

SEQ ID NO: 909333 - protein, 341 aa, Homo sapiens
TSGEGPGERQTRHAGGGRRGPWPELQRDKAAAAAVLGAVRKRPSVVPMAGQDPALSTSHPFYDVARHGILQVAGDDRFGRRVVTFSCCRMPPSHELDHQRLLEYLKYTLDQYVENDYTIVYFHYGLNSRNKPSLGWLQSAYKEFDRKYKKNLKALYVVHPTSFIKVLWNILKPLISHKFGKKVIYFNYLSELHEHLKYDQLVIPPEVLRYDEKLQSLHEGRTPPPTKTPPPRPPLPTQQFGVSLQYLKDKNQGELIPPVLRFTVTYLREKGLRTEGLFRRSASVQTVREIQRLYNQGKPVNFDDYGDIHIPAVILKTFLRELPQPLLTFQAYEQILGITCA

SEQ ID NO: 909334 - protein, 391 aa, Homo sapiens
MPPSHELDHQRLLEYLKYTLDQYVENDYTIVYFHYGLNSRNKPSLGWLQSAYKEFDRKYKKNLKALYVVHPTSFIKVLWNILKPLISHKFGKKVIYFNYLSELHEHLKYDQLVIPPEVLRYDEKLQSLHEGRTPPPTKTPPPRPPLPTQQFGVSLQYLKDKNQGELIPPVLRFTVTYLREKGLRTEGLFRRSASVQTVREIQRLYNQGKPVNFDDYGDIHIPAVILKTFLRELPQPLLTFQAYEQILGITCVESSLRVTGCRQILRSLPEHNYVVLRYLMGFLHAVSRESIFNKMNSSNLACVFGLNLIWPSQGVSSLSALVPLNMFTELLIEYYEKIFSTPEAPGEHGLAPWEQGSRAAPLQEAVPRTQATGLTKPTLPPSPLMAARRRL

SEQ ID NO: 909335 - protein, 180 aa, Homo sapiens
MWDSPSSELSFLHPVLLPGRDAALPLAPLELSREPHALPGVESSLRVTGCRQILRSLPEHNYVVLRYLMGFLHAVSRESIFNKMNSSNLACVFGLNLIWPSQGVSSLSALVPLNMFTELLIEYYEKIFSTPEAPGEHGLAPWEQGSRAAPLQEAVPRTQATGLTKPTLPPSPLMAARRRL

SEQ ID NO: 909336 - protein, 345 aa, Homo sapiens
MSAAPKARHPVCLVLSRVSELTPRRVQTSAKVAEQRRPVGWDSTCAHPGSIPPPESSRHPASIHNGVIAVFQRKGLPDQELFSLNEGVRQLLKTELGSFFTEYLQNQLLTKGMVILRDKIRFYEELQRDKAAAAAVLGAVRKRPSVVPMAGQDPALSTSHPFYDVARHGILQVAGDDRFGRRVVTFSCCRMPPSHELDHQRLLEYLKYTLDQYVENDYTIVYFHYGLNSRNKPSLGWLQSAYKEFDRKDGDLTMWPRLVSNSKLKRSSHLSLPKYWDYRQEPPCQANTLVLKGPDSQHFSFAGLLLYCNNSAGLCSSKTLWTLKCEFHVIFTCHEIFFCFFFSTT

SEQ ID NO: 909337 - protein, 389 aa, Homo sapiens
MRTLRRLKFMSSPSLSDLGKREPAAAADERGTQQRRACANATWNSIHNGVIAVFQRKGLPDQELFSLNEGVRQLLKTELGSFFTEYLQNQLLTKGMVILRDKIRFYEGQKLLDSLAETWDFFFSDVLPMLQAIFYPVQGKEPSVRQLALLHFRNAITLSVKLEDALARAHARVPPAIVQMLLVLQGVHESRGVTEDYLRLETLVQKVVSPYLGTYGLHSSEGPFTHSCILELQRDKAAAAAVLGAVRKRPSVVPMAGQDPALSTSHPFYDVARHGILQVAGDDRFGRRVVTFSCCRMPPSHELDHQRLLEYLKYTLDQYVENDYTIVYFHYGLNSRNKPSLGWLQSAYKEFDRKYVPASLQGRGCGLLVAGGGIVATRGRRVCSGGGVW

SEQ ID NO: 909338 - protein, 344 aa, Homo sapiens
IRGRVDRQKGTKPLRGTRHNRLLWDSLQPIFIAQVSEAAMAEVPELASEMMAYYSGNEDDLFFEADGPKQMKCSFQDLDLCPLDGGIQLRISDHHYSKGFRQAASVVVAMDKLRKMLVPCPQTFQENDLSTFFPFIFEEEPIFFDTWDNEAYVHDAPVRSLNCTLRDSQQKSLVMSGPYELKALHLQGQDMEQQVVFSMSFVQGEESNDKIPVALGLKEKNLYLSCVLKDDKPTLQLESVDPKNYPKKKMEKRFVFNKIEINNKLELGWPSQWVPCLSGKNGASGARRRIMVPPWGSKSANIGDGATRGEDKVKLTDCSHRWVVSPESGRVGPAQYAPFCAPSP

SEQ ID NO: 909339 - protein, 153 aa, Homo sapiens
KFLSLLLLLLKAIKTAREKLADTKPLRGTRHNRLLWDSLQPIFIAQVSEAAMAEVPELASEMMAYYSGNEDDLFFEADGPKQMKCSFQDLDLCPLDGGIQLRISDHHYSKGFRQAASVVVAMDKLRKMLVPCPQTFQENDLSTFFPFIFEEGS

SEQ ID NO: 909340 - protein, 356 aa, Homo sapiens
KFLSLLLLLLKAIKTAREKLADTKPLRGTRHNRLLWDSLQPIFIAQVSEAAMAEVPELASEMMAYYSGNEDDLFFEADGPKQMKCSFQDLDLCPLDGGIQLRISDHHYSKGFRQAASVVVAMDKLRKMLVPCPQTFQENDLSTFFPFIFEEEPIFFDTWDNEAYVHDAPVRSLNCTLRDSQQKSLVMSGPYELKALHLQGQDMEQQVVFSMSFVQGEESNDKIPVALGLKEKNLYLSCVLKDDKPTLQLESVDPKNYPKKKMEKRFVFNKIEINNKLELGWPSQWVPCLSGKNGASGARRRIMVPPWGSKSANIGDGATRGEDKVKLTDCSHRWVVSPESGRVGPAQYAPFCAPSP

SEQ ID NO: 909341 - protein, 110 aa, Homo sapiens [sequence omitted]

SEQ ID NO: 909342 - protein, 101 aa, Homo sapiens
IRGRVDRQKGTKPLRGTRHNRLLWDSLQPIFIAQVSEAAMAEVPELASEMMAYYSGNEDDLFFEADGPKQMKCSLDLTSASDAHQLDLDTLQQLASVCACS

SEQ ID NO: 909343 - protein, 320 aa, Homo sapiens
KFLSLLLLLLKAIKTAREKLADTKPLRGTRHNRLLWDSLQPIFIAQVSEAAMAEVPELASEMMAYYSGNEDDLFFEADGPKQMKCSFQDLDLCPLDGGIQLRISDHHYSKGFRQAASVVVAMDKLRKMLVPCPQTFQENDLSTFFPFIFEEEPIFFDTWDNEAYVHDAPVRSLNCTLRDSQQKSLVMSGPYELKALHLQGQDMEQQVVFSMSFVQGEESNDKIPVALGLKEKNLYLSCVLKDDKPTLQLESVDPKNYPKKKMEKRFVFNKIEINNKLEFESAQFPNWYISTSQAENMPVFLGGTKGGQDITDFTMQFVSS

SEQ ID NO: 909344 - protein, 308 aa, Homo sapiens
IRGRVDRQKGTKPLRGTRHNRLLWDSLQPIFIAQVSEAAMAEVPELASEMMAYYSGNEDDLFFEADGPKQMKCSFQDLDLCPLDGGIQLRISDHHYSKGFRQAASVVVAMDKLRKMLVPCPQTFQENDLSTFFPFIFEEEPIFFDTWDNEAYVHDAPVRSLNCTLRDSQQKSLVMSGPYELKALHLQGQDMEQQVVFSMSFVQGEESNDKIPVALGLKEKNLYLSCVLKDDKPTLQLESVDPKNYPKKKMEKRFVFNKIEINNKLEFESAQFPNWYISTSQAENMPVFLGGTKGGQDITDFTMQFVSS

SEQ ID NO: 909345 - protein, 300 aa, Homo sapiens
MHWMLREITHERSRHGEVTHFLLFTQVSEAAMAEVPELASEMMAYYSGNEDDLFFEADGPKQMKCSFQDLDLCPLDGGIQLRISDHHYSKGFRQAASVVVAMDKLRKMLVPCPQTFQENDLSTFFPFIFEEEPIFFDTWDNEAYVHDAPVRSLNCTLRDSQQKSLVMSGPYELKALHLQGQDMEQQVVFSMSFVQGEESNDKIPVALGLKEKNLYLSCVLKDDKPTLQLESVDPKNYPKKKMEKRFVFNKIEINNKLEFESAQFPNWYISTSQAENMPVFLGGTKGGQDITDFTMQFVSS

SEQ ID NO: 909346 - protein, 153 aa, Homo sapiens; identical to SEQ ID NO: 909339

SEQ ID NO: 909347 - protein, 164 aa, Homo sapiens
MIYCLGGKTDDKKCTNRVFIFNPKKGDWKDLAPMKIPRSMFGVAVHKGKIVIAGGVTEDGLSASVEAFDLTTNKWDVMTEFPQERSSISLVSLAGSLYAIGGFAMIQLESKEFAPTEVNDIWNGFGGLAFLQRSGGLRATLLQSVGVTVNLLTVYVARGPFGGR

SEQ ID NO: 909348 - protein, 159 aa, Homo sapiens
MIYCLGGKTDDKKCTNRVFIFNPKKGDWKDLAPMKIPRSMFGVAVHKGKIVIAGGVTEDGLSASVEAFDLTTNKWDVMTEFPQERSSISLVSLAGSLYAIGGFAMIQLESKEFAPTEVNDIWKYEDDKKEWAGMLKEIRYASGASCLATRLNLFKLSKL

SEQ ID NO: 909349 - protein, 606 aa, Homo sapiens
MDSQRELAEELRLYQSTLLQDGLKDLLDEKKFIDCTLKAGDKSLPCHRLILSACSPYFREYFLSEIDEAKKKEVVLDNVDPAILDLIIKYLYSASIDLNDGNVQDIFALASRFQIPSVFTVCVSYLQKRLAPGNCLAILRLGLLLDCPRLAISAREFVSDRFVQICKEEDFMQLSPQELISVISNDSLNVEKEEAVFEAVMKWVRTDKENRVKNLSEVFDCIRFRLMTEKYFKDHVEKDDIIKSNPDLQKKIKVLKDAFAGKLPEPSKNAAKTGAGEVNGDVGDEDLLPGYLNDIPRHGMFVKDLILLVNDTAAVAYDPTENECYLTALAEQIPRNHSSIVTQQNQIYVVGGLYVDEENKDQPLQSYFFQLDSIASEWVGLPPLPSARCLFGLGEVDDKIYVVAGKDLQTEASLDSVLCYDPVAAKWNEVKKLPIKVYGHNVISHKGMIYCLGGKTDDKKCTNRVFIFNPKKGDWKDLAPMKIPRSMFGVAVHKGKIVIAGGVTEDGLSASVEAFDLTTNKWDVMTEFPQERSSISLVSLAGSLYAIGGFAMIQLESKEFAPTEVNDIWKYEDDKKEWAGMLKEIRYASGASCLATRLNLFKLSKL

SEQ ID NO: 909350 - protein, 606 aa, Homo sapiens; identical to SEQ ID NO: 909349

SEQ ID NO: 909351 - protein, 606 aa, Homo sapiens; identical to SEQ ID NO: 909349

SEQ ID NO: 909352 - protein, 637 aa, Homo sapiens
MDSQRELAEELRLYQSTLLQDGLKDLLDEKKFIDCTLKAGDKSLPCHRLILSACSPYFREYFLSEIDEAKKKEVVLDNVDPAILDLIIKYLYSASIDLNDGNVQDIFALASRFQIPSVFTVCVSYLQKRLAPGNCLAILRLGLLLDCPRLAISAREFVSDRFVQICKEEDFMQLSPQELISVISNDSLNVEKEEAVFEAVMKWVRTDKENRVKNLSEVFDCIRFRLMTEKYFKDHVEKDDIIKSNPDLQKKIKVLKDAFAGKLPEPSKNAAKTGAGEVNGDVGDEDLLPGYLNDIPRHGMFVKDLILLVNDTAAVAYDPTENECYLTALAEQIPRNHSSIVTQQNQIYVVGGLYVDEENKDQPLQSYFFQLDSIASEWVGLPPLPSARCLFGLGEVDDKIYVVAGKDLQTEASLDSVLCYDPVAAKWNEVKKLPIKVYGHNVISHKGMIYCLGGKTDDKKCTNRVFIFNPKKGDWKDLAPMKIPRSMFGVAVHKGKIVIAGGVTEDGLSASVEAFDLTTNKWDVMTEFPQERSSISLVSLAGSLYAIGGFAMIQLESKEFAPTEVNDIWKEIHAFGESEIVTSMRALLHGLPFASGAVAITRLILHRLTGPGPLCGGGGRGGQSSVRVRPLFPSRPG

SEQ ID NO: 909353 - protein, 1031 aa, Homo sapiens
GNAPRPPPPPRLPPAAVLAAAVAAAAALPRRGAALKGGTPPPGALAARAPREPVAAMPPRAPPAPGPRPPPRAAAATDTAAGAGGAGGAGGAGGPGFRPLAPRPWRWLLLLALPAACSAPPPRPVYTNHWAVQVLGGPAEADRVAAAHGYLNLGQIGNLEDYYHFYHSKTFKRSTLSSRGPHTFLRMDPQVKWLQQQEVKRRVKRQVRSDPQALYFNDPIWSNMWYLHCGDKNSRCRSEMNVQAAWKRGYTGKNVVVTILDDGIERNHPDLAPNYDSYASYDVNGNDYDPSPRYDASNENKHGTRCAGEVAASANNSYCIVGIAYNAKIGGIRMLDGDVTDVVEAKSLGIRPNYIDIYSASWGPDDDGKTVDGPGRLAKQAFEYGIKKGRQGLGSIFVWASGNGGREGDYCSCDGYTNSIYTISVSSATENGYKPWYLEECASTLATTYSSGAFYERKIVTTDLRQRCTDGHTGTSVSAPMVAGIIALALEANSQLTWRDVQHLLVKTSRPAHLKASDWKVNGAGHKVSHFYGFGLVDAEALVVEAKKWTAVPSQHMCVAASDKRPRSIPLVQVLRTTALTSACAEHSDQRVVYLEHVVVRTSISHPRRGDLQIYLVSPSGTKSQLLAKRLLDLSNEGFTNWEFMTVHCWGEKAEGQWTLEIQDLPSQVRNPEKQGKLKEWSLILYGTAEHPYHTFSAHQSRSRMLELSAPELEPPKAALSPSQVEVPEDEEDYTAQSTPGSANILQTSVCHPECGDKGCDGPNADQCLNCVHFSLGSVKTSRKCVSVCPLGYFGDTAARRCRRCHKGCETCSSRAATQCLSCRRGFYHHQEMNTCVTLCPAGFYADESQKNCLKCHPSCKKCVDEPEKCTVCKEGFSLARGSCIPDCEPGTYFDSELIRCGECHHTCGTCVGPGREECIHCAKNFHFHDWKCVPACGEGFYPEEMPGLPHKVCRRYGPPGGERQATVSSKGVPGGQSLSASSPGAGEGMLHHPTVDRSPFTELLRGLRPFVHWMHICWVPAVGRHRAAAG

SEQ ID NO: 909354 - protein, 135 aa, Homo sapiens
LTTTDQPTLRVTRYLRLPFETTGTKVPQGREHPVAKIVVLNPGMTFVLPRGHLATSGDILGCHNWKDVLTSSGWRPGMLLSTLQCTAAPMTKNCPDQNVNSAEVEKFRPKEMESKKKIVCNFIEIPSMNKTTYGL

SEQ ID NO: 909355 - protein, 1025 aa, Homo sapiens
GNAPRPPPPPRLPPAAVLAAAVAAAAALPRRGAALKGGTPPPGALAARAPREPVAAMPPRAPPAPGPRPPPRAAAATDTAAGAGGAGGAGGAGGPGFRPLAPRPWRWLLLLALPAACSAPPPRPVYTNHWAVQVLGGPAEADRVAAAHGYLNLGQIGNLEDYYHFYHSKTFKRSTLSSRGPHTFLRMDPQVKWLQQQEVKRRVKRQVRSDPQALYFNDPIWSNMWYLHCGDKNSRCRSEMNVQAAWKRGYTGKNVVVTILDDGIERNHPDLAPNYDSYASYDVNGNDYDPSPRYDASNENKHGTRCAGEVAASANNSYCIVGIAYNAKIGGIRMLDGDVTDVVEAKSLGIRPNYIDIYSASWGPDDDGKTVDGPGRLAKQAFEYGIKKGRQGLGSIFVWASGNGGREGDYCSCDGYTNSIYTISVSSATENGYKPWYLEECASTLATTYSSGAFYERKIVTTDLRQRCTDGHTGTSVSAPMVAGIIALALEANSQLTWRDVQHLLVKTSRPAHLKASDWKVNGAGHKVSHFYGFGLVDAEALVVEAKKWTAVPSQHMCVAASDKRPRSIPLVQVLRTTALTSACAEHSDQRVVYLEHVVVRTSISHPRRGDLQIYLVSPSGTKSQLLAKRLLDLSNEGFTNWEFMTVHCWGEKAEGQWTLEIQDLPSQVRNPEKQGKLKEWSLILYGTAEHPYHTFSAHQSRSRMLELSAPELEPPKAALSPSQVEVPEDEEDYTAQSTPGSANILQTSVCHPECGDKGCDGPNADQCLNCVHFSLGSVKTSRKCVSVCPLGYFGDTAARRCRRCHKGCETCSSRAATQCLSCRRGFYHHQEMNTCVTLCPAGFYADESQKNCLKCHPSCKKCVDEPEKCTVCKEGFSLARGSCIPDCEPGTYFDSELIRCGECHHTCGTCVGPGREECIHCAKNFHFHDWKCVPACGEGFYPEEMPGLPHKVCRRCDENCLSCAGSSRNCSRCKTGFTQLGTSCITNHTCSNADETFCEMVKSNRLCERKLFIQFCCRTCLLAG

SEQ ID NO: 909356 - protein, 977 aa, Homo sapiens
GNAPRPPPPPRLPPAAVLAAAVAAAAALPRRGAALKGGTPPPGALAARAPREPVAAMPPRAPPAPGPRPPPRAAAATDTAAGAGGAGGAGGAGGPGFRPLAPRPWRWLLLLALPAACSAPPPRPVYTNHWAVQVLGGPAEADRVAAAHGYLNLGQIGNLEDYYHFYHSKTFKRSTLSSRGPHTFLRMDPQVKWLQQQEVKRRVKRQVRSDPQALYFNDPIWSNMWYLDSYASYDVNGNDYDPSPRYDASNENKHGTRCAGEVAASANNSYCIVGIAYNAKIGGIRMLDGDVTDVVEAKSLGIRPNYIDIYSASWGPDDDGKTVDGPGRLAKQAFEYGIKKGRQGLGSIFVWASGNGGREGDYCSCDGYTNSIYTISVSSATENGYKPWYLEECASTLATTYSSGAFYERKIVTTDLRQRCTDGHTGTSVSAPMVAGIIALALEANSQLTWRDVQHLLVKTSRPAHLKASDWKVNGAGHKVSHFYGFGLVDAEALVVEAKKWTAVPSQHMCVAASDKRPRSIPLVQVLRTTALTSACAEHSDQRVVYLEHVVVRTSISHPRRGDLQIYLVSPSGTKSQLLAKRLLDLSNEGFTNWEFMTVHCWGEKAEGQWTLEIQDLPSQVRNPEKQGKLKEWSLILYGTAEHPYHTFSAHQSRSRMLELSAPELEPPKAALSPSQVEVPEDEEDYTAQSTPGSANILQTSVCHPECGDKGCDGPNADQCLNCVHFSLGSVKTSRKCVSVCPLGYFGDTAARRCRRCHKGCETCSSRAATQCLSCRRGFYHHQEMNTCVTLCPAGFYADESQKNCLKCHPSCKKCVDEPEKCTVCKEGFSLARGSCIPDCEPGTYFDSELIRCGECHHTCGTCVGPGREECIHCAKNFHFHDWKCVPACGEGFYPEEMPGLPHKVCRRCDENCLSCAGSSRNCSRCKTGFTQLGTSCITNHTCSNADETFCEMVKSNRLCERKLFIQFCCRTCLLAG

SEQ ID NO: 909357 - protein, 661 aa, Homo sapiens
GNAPRPPPPPRLPPAAVLAAAVAAAAALPRRGAALKGGTPPPGALAARAPREPVAAMPPRAPPAPGPRPPPRAAAATDTAAGAGGAGGAGGAGGPGFRPLAPRPWRWLLLLALPAACSAPPPRPVYTNHWAVQVLGGPAEADRVAAAHGYLNLGQIGNLEDYYHFYHSKTFKRSTLSSRGPHTFLRMDPQVKWLQQQEVKRRVKRQVRSDPQALYFNDPIWSNMWYLHCGDKNSRCRSEMNVQAAWKRGYTGKNVVVTILDDGIERNHPDLAPNYDSYASYDVNGNDYDPSPRYDASNENKHGTRCAGEVAASANNSYCIVGIAYNAKIGGIRMLDGDVTDVVEAKSLGIRPNYIDIYSASWGPDDDGKTVDGPGRLAKQAFEYGIKKGRQGLGSIFVWASGNGGREGDYCSCDGYTNSIYTISVSSATENGYKPWYLEECASTLATTYSSGAFYERKIVTTDLRQRCTDGHTGTSVSAPMVAGIIALALEANSQLTWRDVQHLLVKTSRPAHLKASDWKVNGAGHKVSHFYGFGLVDAEALVVEAKKWTAVPSQHMCVAASDKRPRSIPLVQVLRTTALTSACAEHSDQRVVYLEHVVVRTSISHPRRGDLQIYLVSPSGTKSQLLAKRWKFLKMRKITQVCAIRSVVTKAVMAPMQTSA

SEQ ID NO: 909358 - protein, 102 aa, Homo sapiens
GLGALGPWVLQTTDISLNDSARPWFSSHQWHCLCDENCLSCAGSSRNCSRCKTGFTQLGTSCITNHTCSNADETFCEMVKSNRLCERKLFIQFCCRTCLLAG

SEQ ID NO: 909359 - protein, 1025 aa, Homo sapiens; identical to SEQ ID NO: 909355

SEQ ID NO: 909360 - protein, 708 aa, Homo sapiens
GNAPRPPPPPRLPPAAVLAAAVAAAAALPRRGAALKGGTPPPGALAARAPREPVAAMPPRAPPAPGPRPPPRAAAATDTAAGAGGAGGAGGAGGPGFRPLAPRPWRWLLLLALPAACSAPPPRPVYTNHWAVQVLGGPAEADRVAAAHGYLNLGQIGNLEDYYHFYHSKTFKRSTLSSRGPHTFLRMDPQVKWLQQQEVKRRVKRQVRSDPQALYFNDPIWSNMWYLHCGDKNSRCRSEMNVQAAWKRGYTGKNVVVTILDDGIERNHPDLAPNYDSYASYDVNGNDYDPSPRYDASNENKHGTRCAGEVAASANNSYCIVGIAYNAKIGGIRMLDGDVTDVVEAKSLGIRPNYIDIYSASWGPDDDGKTVDGPGRLAKQAFEYGIKKGRQGLGSIFVWASGNGGREGDYCSCDGYTNSIYTISVSSATENGYKPWYLEECASTLATTYSSGAFYERKIVTTDLRQRCTDGHTGTSVSAPMVAGIIALALEANSQLTWRDVQHLLVKTSRPAHLKASDWKVNGAGHKVSHFYGFGLVDAEALVVEAKKWTAVPSQHMCVAASDKRPRSIPLVQVLRTTALTSACAEHSDQRVVYLEHVVVRTSISHPRRGDLQIYLVSPSGTKSQLLAKRLLDLSNEGFTNWEFMTVHCWGEKAEGQWTLEIQDLPSQVRNPEKQGDLETPVANQLTTEEREPGLKHVFRWQIEQELW

SEQ ID NO: 909361 - protein, 1110 aa, Homo sapiens
GNAPRPPPPPRLPPAAVLAAAVAAAAALPRRGAALKGGTPPPGALAARAPREPVAAMPPRAPPAPGPRPPPRAAAATDTAAGAGGAGGAGGAGGPGFRPLAPRPWRWLLLLALPAACSAPPPRPVYTNHWAVQVLGGPAEADRVAAAHGYLNLGQIGNLEDYYHFYHSKTFKRSTLSSRGPHTFLRMDPQVKWLQQQEVKRRVKRQVRSDPQALYFNDPIWSNMWYLHCGDKNSRCRSEMNVQAAWKRGYTGKNVVVTILDDGIERNHPDLAPNYDSYASYDVNGNDYDPSPRYDASNENKHGTRCAGEVAASANNSYCIVGIAYNAKIGGIRMLDGDVTDVVEAKSLGIRPNYIDIYSASWGPDDDGKTVDGPGRLAKQAFEYGIKKGRQGLGSIFVWASGNGGREGDYCSCDGYTNSIYTISVSSATENGYKPWYLEECASTLATTYSSGAFYERKIVTTDLRQRCTDGHTGTSVSAPMVAGIIALALEANSQLTWRDVQHLLVKTSRPAHLKASDWKVNGAGHKVSHFYGFGLVDAEALVVEAKKWTAVPSQHMCVAASDKRPRSIPLVQVLRTTALTSACAEHSDQRVVYLEHVVVRTSISHPRRGDLQIYLVSPSGTKSQLLAKRLLDLSNEGFTNWEFMTVHCWGEKAEGQWTLEIQDLPSQVRNPEKQGKLKEWSLILYGTAEHPYHTFSAHQSRSRMLELSAPELEPPKAALSPSQVEVPEDEEDYTAQSTPGSANILQTSVCHPECGDKGCDGPNADQCLNCVHFSLGSVKTSRKCVSVCPLGYFGDTAARRCRRCHKGCETCSSRAATQCLSCRRGFYHHQEMNTCVTLCPAGFYADESQKNCLKCHPSCKKCVDEPEKCTVCKEGFSLARGSCIPDCEPGTYFDSELIRCGECHHTCGTCVGPGREECIHCAKNFHFHDWKCVPACGEGFYPEEMPGLPHKVCRRCDENCLSCAGSSRNCSRCKTGFTQLGTSCITNHTCSNADETFCEMVKSNRLCERKLFIQFCCRTCLLAGGHLATSGDILGCHNWKDVLTSSGWRPGMLLSTLQCTAAPMTKNCPDQNVNSAEVEKFRPKEMESKKKIVCNFIEIPSMNKTTYGL

SEQ ID NO: 909362 - protein, 445 aa, Homo sapiens
GNAPRPPPPPRLPPAAVLAAAVAAAAALPRRGAALKGGTPPPGALAARAPREPVAAMPPRAPPAPGPRPPPRAAAATDTAAGAGGAGGAGGAGGPGFRPLAPRPWRWLLLLALPAACSAPPPRPVYTNHWAVQVLGGPAEADRVAAAHGYLNLGQIGNLEDYYHFYHSKTFKRSTLSSRGPHTFLRMDPQVKWLQQQEVKRRVKRQVRSDPQALYFNDPIWSNMWYLDSYASYDVNGNDYDPSPRYDASNENKHGTRCAGEVAASANNSYCIVGIAYNAKIGGIRMLDGDVTDVVEAKSLGIRPNYIDIYSASWGPDDDGKTVDGPGRLAKQAFEYGIKKGRQGLGSIFVWASGNGGREGDYCSCDGYTNSIYTISVSSATENGYKPWYLEECASTLATTYSSGAFYERKIVTTDLRQRCTDGHTGTSVSAPMVAGIIALALEAK

SEQ ID NO: 909363 - protein, 1018 aa, Homo sapiens
GNAPRPPPPPRLPPAAVLAAAVAAAAALPRRGAALKGGTPPPGALAARAPREPVAAMPPRAPPAPGPRPPPRAAAATDTAAGAGGAGGAGGAGGPGFRPLAPRPWRWLLLLALPAACSAPPPRPVYTNHWAVQVLGGPAEADRVAAAHGYLNLGQIGNLEDYYHFYHSKTFKRSTLSSRGPHTFLRMDPQVKWLQQQEVKRRVKRQVRSDPQALYFNDPIWSNMWYLHCGDKNSRCRSEMNVQAAWKRGYTGKNVVVTILDDGIERNHPDLAPNYDSYASYDVNGNDYDPSPRYDASNENKHGTRCAGEVAASANNSYCIVGIAYNAKIGGIRMLDGDVTDVVEAKSLGIRPNYIDIYSASWGPDDDGKTVDGPGRLAKQAFEYGIKKGRQGLGSIFVWASGNGGREGDYCSCDGYTNSIYTISVSSATENGYKPWYLEECASTLATTYSSGAFYERKIVTTDLRQRCTDGHTGTSVSAPMVAGIIALALEANSQLTWRDVQHLLVKTSRPAHLKASDWKVNGAGHKVSHFYGFGLVDAEALVVEAKKWTAVPSQHMCVAASDKRPRSIPLVQVLRTTALTSACAEHSDQRVVYLEHVVVRTSISHPRRGDLQIYLVSPSGTKSQLLAKRLLDLSNEGFTNWEFMTVHCWGEKAEGQWTLEIQDLPSQVRNPEKQGKLKEWSLILYGTAEHPYHTFSAHQSRSRMLELSAPELEPPKAALSPSQVEVPEDEEDYTGVCHPECGDKGCDGPNADQCLNCVHFSLGSVKTSRKCVSVCPLGYFGDTAARRCRRCHKGCETCSSRAATQCLSCRRGFYHHQEMNTCVTLCPAGFYADESQKNCLKCHPSCKKCVDEPEKCTVCKEGFSLARGSCIPDCEPGTYFDSELIRCGECHHTCGTCVGPGREECIHCAKNFHFHDWKCVPACGEGFYPEEMPGLPHKVCRRYGPPGGERQATVSSKGVPGGQSLSASSPGAGEGMLHHPTVDRSPFTELLRGLRPFVHWMHICWVPAVGRHRAAAG

SEQ ID NO: 909364 - protein, 497 aa, Homo sapiens
MWYLHCGDKNSRCRSEMNVQAAWKRGYTGKNVVVTILDDGIERNHPDLAPNYDSYASYDVNGNDYDPSPRYDASNENKHGTRCAGEVAASANNSYCIVGIAYNAKIGGIRMLDGDVTDVVEAKSLGIRPNYIDIYSASWGPDDDGKTVDGPGRLAKQAFEYGIKKGRQGLGSIFVWASGNGGREGDYCSCDGYTNSIYTISVSSATENGYKPWYLEECASTLATTYSSGAFYERKIVTTDLRQRCTDGHTGTSVSAPMVAGIIALALEANSQLTWRDVQHLLVKTSRPAHLKASDWKVNGAGHKVSHFYGFGLVDAEALVVEAKKWTAVPSQHMCVAASDKRPRSIPLVQVLRTTALTSACAEHSDQRVVYLEHVVVRTSISHPRRGDLQIYLVSPSGTKSQLLAKRLLDLSNEGFTNWEFMTVHCWGEKAEGQWTLEIQDLPSQVRNPEKQGDLETPVANQLTTEERFVSTLSILFHWSVYLSWSQYHIVLITVAL

SEQ ID NO: 909365 - protein, 1012 aa, Homo sapiens
GNAPRPPPPPRLPPAAVLAAAVAAAAALPRRGAALKGGTPPPGALAARAPREPVAAMPPRAPPAPGPRPPPRAAAATDTAAGAGGAGGAGGAGGPGFRPLAPRPWRWLLLLALPAACSAPPPRPVYTNHWAVQVLGGPAEADRVAAAHGYLNLGQIGNLEDYYHFYHSKTFKRSTLSSRGPHTFLRMDPQVKWLQQQEVKRRVKRQVRSDPQALYFNDPIWSNMWYLHCGDKNSRCRSEMNVQAAWKRGYTGKNVVVTILDDGIERNHPDLAPNYDSYASYDVNGNDYDPSPRYDASNENKHGTRCAGEVAASANNSYCIVGIAYNAKIGGIRMLDGDVTDVVEAKSLGIRPNYIDIYSASWGPDDDGKTVDGPGRLAKQAFEYGIKKGRQGLGSIFVWASGNGGREGDYCSCDGYTNSIYTISVSSATENGYKPWYLEECASTLATTYSSGAFYERKIVTTDLRQRCTDGHTGTSVSAPMVAGIIALALEANSQLTWRDVQHLLVKTSRPAHLKASDWKVNGAGHKVSHFYGFGLVDAEALVVEAKKWTAVPSQHMCVAASDKRPRSIPLVQVLRTTALTSACAEHSDQRVVYLEHVVVRTSISHPRRGDLQIYLVSPSGTKSQLLAKRLLDLSNEGFTNWEFMTVHCWGEKAEGQWTLEIQDLPSQVRNPEKQGKLKEWSLILYGTAEHPYHTFSAHQSRSRMLELSAPELEPPKAALSPSQVEVPEDEEDYTGVCHPECGDKGCDGPNADQCLNCVHFSLGSVKTSRKCVSVCPLGYFGDTAARRCRRCHKGCETCSSRAATQCLSCRRGFYHHQEMNTCVTLCPAGFYADESQKNCLKCHPSCKKCVDEPEKCTVCKEGFSLARGSCIPDCEPGTYFDSELIRCGECHHTCGTCVGPGREECIHCAKNFHFHDWKCVPACGEGFYPEEMPGLPHKVCRRCDENCLSCAGSSRNCSRCKTGFTQLGTSCITNHTCSNADETFCEMVKSNRLCERKLFIQFCCRTCLLAG

SEQ ID NO: 909366 - protein, 1007 aa, Homo sapiens
GNAPRPPPPPRLPPAAVLAAAVAAAAALPRRGAALKGGTPPPGALAARAPREPVAAMPPRAPPAPGPRPPPRAAAATDTAAGAGGAGGAGGAGGPGFRPLAPRPWRWLLLLALPAACSAPPPRPVYTNHWAVQVLGGPAEADRVAAAHGYLNLGQIGNLEDYYHFYHSKTFKRSTLSSRGPHTFLRMDPQVKWLQQQEVKRRVKRQVRSDPQALYFNDPIWSNMWYLHCGDKNSRCRSEMNVQAAWKRGYTGKNVVVTILDDGIERNHPDLAPNYDSYASYDVNGNDYDPSPRYDASNENKHGTRCAGEVAASANNSYCIVGIAYNAKIGGIRMLDGDVTDVVEAKSLGIRPNYIDIYSASWGPDDDGKTVDGPGRLAKQAFEYGIKKGRQGLGSIFVWASGNGGREGDYCSCDGYTNSIYTISVSSATENGYKPWYLEECASTLATTYSSGAFYERKIVTTDLRQRCTDGHTGTSVSAPMVAGIIALALEANSQLTWRDVQHLLVKTSRPAHLKASDWKVNGAGHKVSHFYGFGLVDAEALVVEAKKWTAVPSQHMCVAASDKRPRSIPLVQVLRTTALTSACAEHSDQRVVYLEHVVVRTSISHPRRGDLQIYLVSPSGTKSQLLAKRLLDLSNEGFTNWEFMTVHCWGEKAEGQWTLEIQDLPSQVRNPEKQGKLKEWSLILYGTAEHPYHTFSAHQSRSRMLELSAPELEPPKAALSPSQVEVPEDEEDYTAQSTPGSANILQTSVCHPECGDKGCDGPNADQCLNCVHFSLGSVKTSRKCVSVCPLGYFGDTAARRCRRCHKGCETCSSRAATQCLSCRRGFYHHQEMNTCVTLCPAGFYADESQKNCLKCHPSCKKCVDEPEKCTVCKEGFSLARGSCIPDCEPGTYFDSELIRCGECHHTCGTCVGPGREECIHCAKPEEMPGLPHKVCRRCDENCLSCAGSSRNCSRCKTGFTQLGTSCITNHTCSNADETFCEMVKSNRLCERKLFIQFCCRTCLLAG

SEQ ID NO: 909367 - protein, 856 aa, Homo sapiens
GNAPRPPPPPRLPPAAVLAAAVAAAAALPRRGAALKGGTPPPGALAARAPREPVAAMPPRAPPAPGPRPPPRAAAATDTAAGAGGAGGAGGAGGPGFRPLAPRPWRWLLLLALPAACSAPPPRPVYTNHWAVQVLGGPAEADRVAAAHGYLNLGQIGNLEDYYHFYHSKTFKRSTLSSRGPHTFLRMDPQVKWLQQQEVKRRVKRQVRSDPQALYFNDPIWSNMWYLHCGDKNSRCRSEMNVQAAWKRGYTGKNVVVTILDDGIERNHPDLAPNYDSYASYDVNGNDYDPSPRYDASNENKHGTRCAGEVAASANNSYCIVGIAYNAKIGGIRMLDGDVTDVVEAKSLGIRPNYIDIYSASWGPDDDGKTVDGPGRLAKQAFEYGIKKGRQGLGSIFVWASGNGGREGDYCSCDGYTNSIYTISVSSATENGYKPWYLEECASTLATTYSSGAFYERKIVTTDLRQRCTDGHTGTSVSAPMVAGIIALALEANSQLTWRDVQHLLVKTSRPAHLKASDWKVNGAGHKVSHFYGFGLVDAEALVVEAKKWTAVPSQHMCVAASDKRPSQSTPGSANILQTSVCHPECGDKGCDGPNADQCLNCVHFSLGSVKTSRKCVSVCPLGYFGDTAARRCRRCHKGCETCSSRAATQCLSCRRGFYHHQEMNTCVTLCPAGFYADESQKNCLKCHPSCKKCVDEPEKCTVCKEGFSLARGSCIPDCEPGTYFDSELIRCGECHHTCGTCVGPGREECIHCAKNFHFHDWKCVPACGEGFYPEEMPGLPHKVCRRCDENCLSCAGSSRNCSRCKTGFTQLGTSCITNHTCSNADETFCEMVKSNRLCERKLFIQFCCRTCLLAG

SEQ ID NO: 909368 - protein, 1025 aa, Homo sapiens; identical to SEQ ID NO: 909355

SEQ ID NO: 909369 - protein, 1023 aa, Homo sapiens
GNAPRPPPPPRLPPAAVLAAAVAAAAALPRRGAALKGGTPPPGALAARAPREPVAAMPPRAPPAPGPRPPPRAAAATDTAAGAGGAGGAGGAGGPGFRPLAPRPWRWLLLLALPAACSAPPPRPVYTNHWAVQVLGGPAEADRVAAAHGYLNLGQIGNLEDYYHFYHSKTFKRSTLSSRGPHTFLRMDPQVKWLQQQEVKRRVKRQVRSDPQALYFNDPIWSNMWYLHCGDKNSRCRSEMNVQAAWKRGYTGKNVVVTILDDGIERNHPDLAPNYDSYASYDVNGNDYDPSPRYDASNENKHGTRCAGEVAASANNSYCIVGIAYNAKIGGIRMLDGDVTDVVEAKSLGIRPNYIDIYSASWGPDDDGKTVDGPGRLAKQAFEYGIKKGRQGLGSIFVWASGNGGREGDYCSCDGYTNSIYTISVSSATENGYKPWYLEECASTLATTYSSGAFYERKIVTTDLRQRCTDGHTGTSVSAPMVAGIIALALEANSQLTWRDVQHLLVKTSRPAHLKASDWKVNGAGHKVSHFYGFGLVDAEALVVEAKKWTAVPSQHMCVAASDKRPRSIPLVQVLRTTALTSACAEHSDQRVVYLEHVVVRTSISHPRRGDLQIYLVSPSGTKSQLLAKRLLDLSNEGFTNWEFMTVHCWGEKAEGQWTLEIQDLPSQVRNPEKQGKLKEWSLILYGTAEHPYHTFSAHQSRSRMLELSAPELEPPKAALSPSQVEVPEDEEDYTAQSTPGSANILQTSVCHPECGDKGCDGPNADQCLNCVHFSLGSVKTSRKCVSVCPLGYFGDTAARRCRRCHKGCETCSSRAATQCLSCRRGFYHHQEMNTCVTLCPAGFYADESQKNCLKCHPSCKKCVDEPEKCTVCKEGFSLARGSCIPDCEPGTYFDSELIRCGECHHTCGTCVGPGREECIHCAKNFHFHDWKCVPACGEGFYPEEMPGLPHKVCRRCDENCLSCAGSSRNCSRCKTGFTQLGTSCITNHTCSNGDIWQRLETFWVVTTGRMYSHPVGGGQECC

SEQ ID NO: 909370 - protein, 778 aa, Homo sapiens
GNAPRPPPPPRLPPAAVLAAAVAAAAALPRRGAALKGGTPPPGALAARAPREPVAAMPPRAPPAPGPRPPPRAAAATDTAAGAGGAGGAGGAGGPGFRPLAPRPWRWLLLLALPAACSAPPPRPVYTNHWAVQVLGGPAEADRVAAAHGYLNLGQIGNLEDYYHFYHSKTFKRSTLSSRGPHTFLRMDPQVKWLQQQEVKRRVKRQVRSDPQALYFNDPIWSNMWYLHCGDKNSRCRSEMNVQAAWKRGYTGKNVVVTILDDGIERNHPDLAPNYDSYASYDVNGNDYDPSPRYDASNENKHGTRCAGEVAASANNSYCIVGIAYNAKIGGIRMLDGDVTDVVEAKSLGIRPNYIDIYSASWGPDDDGKTVDGPGRLAKQAFEYGIKKGRQGLGSIFVWASGNGGREGDYCSCDGYTNSIYTISVSSATENGYKPWYLEECASTLATTYSSGAFYERKIVTTDLRQRCTDGHTGTSVSAPMVAGIIALALEANSQLTWRDVQHLLVKTSRPAHLKASDWKVNGAGHKVSHFYGFGLVDAEALVVEAKKWTAVPSQHMCVAASDKRPRSIPLVQVLRTTALTSACAEHSDQRVVYLEHVVVRTSISHPRRGDLQIYLVSPSGTKSQLLAKRLLDLSNEGFTNWEFMTVHCWGEKAEGQWTLEIQDLPSQVRNPEKQGKLKEWSLILYGTAEHPYHTFSAHQSRSRMLELSAPELEPPKAALSPSQVEVPEDEEDYTAQSTPGSANILQTRDIWQRLETFWVVTTGRMYSHPVGGGQECC

SEQ ID NO: 909371 - protein, 1907 aa, Homo sapiens
MAPEPAPGRTMVPLVPALVMLGLVAGAHGDSKPVFIKVPEDQTGLSGGVASFVCQATGEPKPRITWMKKGKKVSSQRFEVIEFDDGAGSVLRIQPLRVQRDEAIYECTATNSLGEINTSAKLSVLEEEQLPPGFPSIDMGPQLKVVEKARTATMLCAAGGNPDPEISWFKDFLPVDPATSNGRIKQLRSGALQIESSEESDQGKYECVATNSAGTRYSAPANLYVRVRRVAPRFSIPPSSQEVMPGGSVNLTCVAVGAPMPYVKWMMGAEELTKEDEMPVGRNVLELSNVVRSANYTCVAISSLGMIEATAQVTVKALPKPPIDLVVTETTATSVTLTWDSGNSEPVTYYGIQYRAAGTEGPFQEVDGVATTRYSIGGLSPFSEYAFRVLAVNSIGRGPPSEAVRARTGEQAPSSPPRRVQARMLSASTMLVQWEPPEEPNGLVRGYRVYYTPDSRRPPNAWHKHNTDAGLLTTVGSLLPGITYSLRVLAFTAVGDGPPSPTIQVKTQQGVPAQPADFQAEVESDTRIQLSWLLPPQERIIMYELVYWAAEDEDQQHKVTFDPTSSYTLEDLKPDTLYRFQLAARSDMGVGVFTPTIEARTAQSTPSAPPQKVMCVSMGSTTVRVSWVPPPADSRNGVITQYSVAYEAVDGEDRGRHVVDGISREHSSWDLVGLEKWTEYRVWVRAHTDVGPGPESSPVLVRTDEDVPSGPPRKVEVEPLNSTAVHVYWKLPVPSKQHGQIRGYQVTYVRLENGEPRGLPIIQDVMLAEAQWRPEESEDYETTISGLTPETTYSVTVAAYTTKGDGARSKPKIVTTTGAVPGRPTMMISTTAMNTALLQWHPPKELPGELLGYRLQYCRADEARPNTIDFGKDDQHFTVTGLHKGTTYIFRLAAKNRAGLGEEFEKEIRTPEDLPSGFPQNLHVTGLTTSTTELAWDPPVLAERNGRIISYTVVFRDINSQQELQNITTDTRFTLTGLKPDTTYDIKVRAWTSKGSGPLSPSIQSRTMPVEQVFAKNFRVAAAMKTSVLLSWEVPDSYKSAVPFKILYNGQSVEVDGHSMRKLIADLQPNTEYSFVLMNRGSSAGGLQHLVSIRTAPDLLPHKPLPASAYIEDGRFDLSMPHVQDPSLVRWFYIVVVPIDRVGGSMLTPRWSTPEELELDELLEAIEQGGEEQRRRRRQAERLKPYVAAQLDVLPETFTLGDKKNYRGFYNRPLSPDLSYQCFVLASLKEPMDQKRYASSPYSDEIVVQVTPAQQQEEPEMLWVTGPVLAVILIILIVIAILLFKRKRTHSPSSKDEQSIGLKDSLLAHSSDPVEMRRLNYQTPGMRDHPPIPITDLADNIERLKANDGLKFSQEYESIDPGQQFTWENSNLEVNKPKNRYANVIAYDHSRVILTSIDGVPGSDYINANYIDGYRKQNAYIATQGPLPETMGDFWRMVWEQRTATVVMMTRLEEKSRVKCDQYWPARGTETCGLIQVTLLDTVELATYTVRTFALHKSGSSEKRELRQFQFMAWPDHGVPEYPTPILAFLRRVKACNPLDAGPMVVHCSAGVGRTGCFIVIDAMLERMKHEKTVDIYGHVTCMRSQRNYMVQTEDQYVFIHEALLEAATCGHTEVPARNLYAHIQKLGQVPPGESVTAMELEFKLLASSKAHTSRFISANLPCNKFKNRLVNIMPYELTRVCLQPIRGVEGSDYINASFLDGYRQQKAYIATQGPLAESTEDFWRMLWEHNSTIIVMLTKLREMGREKCHQYWPAERSARYQYFVVDPMAEYNMPQYILREFKVTDARDGQSRTIRQFQFTDWPEQGVPKTGEGFIDFIGQVHKTKEQFGQDGPITVHCSAGVGRTGVFITLSIVLERMRYEGVVDMFQTVKTLRTQRPAMVQTEDQYQLCYRAALEYLGSFDHYAT

SEQ ID NO: 909372 - protein, 122 aa, Homo sapiens
EPGVVLGCYPHGYFEAQKPSLCPPWARSLPGQALSRSESFTILSPFLSLSRGQWRPEESEDYVSNRCANADKTWVKLGSWDAPPLPPFLLACTAKIHRALATSGENWRLDTSTELSSDWHFL

SEQ ID NO: 909373 - protein, 101 aa, Homo sapiens
PDKPDSPEKYDRRDKQQAHAQAGVRGVCQVGALVTGCPFSISPPGSFVRERSMELELRVRLSERPVPVGLVGAPTSPTEDQYQLCYRAALEYLGSFDHYAT

SEQ ID NO: 909374 - protein, 1898 aa, Homo sapiens
MAPEPAPGRTMVPLVPALVMLGLVAGAHGDSKPVFIKVPEDQTGLSGGVASFVCQATGEPKPRITWMKKGKKVSSQRFEVIEFDDGAGSVLRIQPLRVQRDEAIYECTATNSLGEINTSAKLSVLEEEQLPPGFPSIDMGPQLKVVEKARTATMLCAAGGNPDPEISWFKDFLPVDPATSNGRIKQLRSGALQIESSEESDQGKYECVATNSAGTRYSAPANLYVRVRRVAPRFSIPPSSQEVMPGGSVNLTCVAVGAPMPYVKWMMGAEELTKEDEMPVGRNVLELSNVVRSANYTCVAISSLGMIEATAQVTVKALPKPPIDLVVTETTATSVTLTWDSGNSEPVTYYGIQYRAAGTEGPFQEVDGVATTRYSIGGLSPFSEYAFRVLAVNSIGRGPPSEAVRARTGEQAPSSPPRRVQARMLSASTMLVQWEPPEEPNGLVRGYRVYYTPDSRRPPNAWHKHNTDAGLLTTVGSLLPGITYSLRVLAFTAVGDGPPSPTIQVKTQQGVPAQPADFQAEVESDTRIQLSWLLPPQERIIMYELVYWAAEDEDQQHKVTFDPTSSYTLEDLKPDTLYRFQLAARSDMGVGVFTPTIEARTAQSTPSAPPQKVMCVSMGSTTVRVSWVPPPADSRNGVITQYSVAYEAVDGEDRGRHVVDGISREHSSWDLVGLEKWTEYRVWVRAHTDVGPGPESSPVLVRTDEDVPSGPPRKVEVEPLNSTAVHVYWKLPVPSKQHGQIRGYQVTYVRLENGEPRGLPIIQDVMLAEAQETTISGLTPETTYSVTVAAYTTKGDGARSKPKIVTTTGAVPGRPTMMISTTAMNTALLQWHPPKELPGELLGYRLQYCRADEARPNTIDFGKDDQHFTVTGLHKGTTYIFRLAAKNRAGLGEEFEKEIRTPEDLPSGFPQNLHVTGLTTSTTELAWDPPVLAERNGRIISYTVVFRDINSQQELQNITTDTRFTLTGLKPDTTYDIKVRAWTSKGSGPLSPSIQSRTMPVEQVFAKNFRVAAAMKTSVLLSWEVPDSYKSAVPFKILYNGQSVEVDGHSMRKLIADLQPNTEYSFVLMNRGSSAGGLQHLVSIRTAPDLLPHKPLPASAYIEDGRFDLSMPHVQDPSLVRWFYIVVVPIDRVGGSMLTPRWSTPEELELDELLEAIEQGGEEQRRRRRQAERLKPYVAAQLDVLPETFTLGDKKNYRGFYNRPLSPDLSYQCFVLASLKEPMDQKRYASSPYSDEIVVQVTPAQQQEEPEMLWVTGPVLAVILIILIVIAILLFKRKRTHSPSSKDEQSIGLKDSLLAHSSDPVEMRRLNYQTPGMRDHPPIPITDLADNIERLKANDGLKFSQEYESIDPGQQFTWENSNLEVNKPKNRYANVIAYDHSRVILTSIDGVPGSDYINANYIDGYRKQNAYIATQGPLPETMGDFWRMVWEQRTATVVMMTRLEEKSRVKCDQYWPARGTETCGLIQVTLLDTVELATYTVRTFALHKSGSSEKRELRQFQFMAWPDHGVPEYPTPILAFLRRVKACNPLDAGPMVVHCSAGVGRTGCFIVIDAMLERMKHEKTVDIYGHVTCMRSQRNYMVQTEDQYVFIHEALLEAATCGHTEVPARNLYAHIQKLGQVPPGESVTAMELEFKLLASSKAHTSRFISANLPCNKFKNRLVNIMPYELTRVCLQPIRGVEGSDYINASFLDGYRQQKAYIATQGPLAESTEDFWRMLWEHNSTIIVMLTKLREMGREKCHQYWPAERSARYQYFVVDPMAEYNMPQYILREFKVTDARDGQSRTIRQFQFTDWPEQGVPKTGEGFIDFIGQVHKTKEQFGQDGPITVHCSAGVGRTGVFITLSIVLERMRYEGVVDMFQTVKTLRTQRPAMVQTEDQYQLCYRAALEYLGSFDHYAT

SEQ ID NO: 909375 - protein, 1933 aa, Homo sapiens
MAPEPAPGRTMVPLVPALVMLGLVAGAHGDSKPVFIKVPEDQTGLSGGVASFVCQATGEPKPRITWMKKGKKVSSQRFEVIEFDDGAGSVLRIQPLRVQRDEAIYECTATNSLGEINTSAKLSVLEEEQLPPGFPSIDMGPQLKVVEKARTATMLCAAGGNPDPEISWFKDFLPVDPATSNGRIKQLRSGALQIESSEESDQGKYECVATNSAGTRYSAPANLYVRVRRVAPRFSIPPSSQEVMPGGSVNLTCVAVGAPMPYVKWMMGAEELTKEDEMPVGRNVLELSNVVRSANYTCVAISSLGMIEATAQVTVKALPKPPIDLVVTETTATSVTLTWDSGNSEPVTYYGIQYRAAGTEGPFQEVDGVATTRYSIGGLSPFSEYAFRVLAVNSIGRGPPSEAVRARTGEQAPSSPPRRVQARMLSASTMLVQWEPPEEPNGLVRGYRVYYTPDSRRPPNAWHKHNTDAGLLTTVGSLLPGITYSLRVLAFTAVGDGPPSPTIQVKTQQGVPAQPADFQAEVESDTRIQLSWLLPPQERIIMYELVYWAAEDEDQQHKVTFDPTSSYTLEDLKPDTLYRFQLAARSDMGVGVFTPTIEARTAQSTPSAPPQKVMCVSMGSTTVRVSWVPPPADSRNGVITQYSVAYEAVDGEDRGRHVVDGISREHSSWDLVGLEKWTEYRVWVRAHTDVGPGPESSPVLVRTDEDVPSGPPRKVEVEPLNSTAVHVYWKLPVPSKQHGQIRGYQVTYVRLENGEPRGLPIIQDVMLAEAQWRPEESEDYETTISGLTPETTYSVTVAAYTTKGDGARSKPKIVTTTGAGELRGQDGPEGGAAGGQRQSPARGPSVPGRPTMMISTTAMNTALLQWHPPKELPGELLGYRLQYCRADEARPNTIDFGKDDQHFTVTGLHKGTTYIFRLAAKNRAGLGEEFEKEIRTPEDLPSGFPQNLHVTGLTTSTTELAWDPPVLAERNGRIISYTVVFRDINSQQELQNITTDTRFTLTGLKPDTTYDIKVRAWTSKGSGPLSPSIQSRTMPVEQVFAKNFRVAAAMKTSVLLSWEVPDSYKSAVPFKILYNGQSVEVDGHSMRKLIADLQPNTEYSFVLMNRGSSAGGLQHLVSIRTAPDLLPHKPLPASAYIEDGRFDLSMPHVQDPSLVRWFYIVVVPIDRVGGSMLTPRWSTPEELELDELLEAIEQGGEEQRRRRRQAERLKPYVAAQLDVLPETFTLGDKKNYRGFYNRPLSPDLSYQCFVLASLKEPMDQKRYASSPYSDEIVVQVTPAQQQEEPEMLWVTGPVLAVILIILIVIAILLFKRKRTHSPSSKDEQSIGLKDSLLAHSSDPVEMRRLNYQTPGMRDHPPIPITDLADNIERLKANDGLKFSQEYESIDPGQQFTWENSNLEVNKPKNRYANVIAYDHSRVILTSIDGVPGSDYINANYIDGYRKQNAYIATQGPLPETMGDFWRMVWEQRTATVVMMTRLEEKSRVKCDQYWPARGTETCGLIQVTLLDTVELATYTVRTFALHKSGSSEKRELRQFQFMAWPDHGVPEYPTPILAFLRRVKACNPLDAGPMVVHCSAGVGRTGCFIVIDAMLERMKHEKTVDIYGHVTCMRSQRNYMVQTEDQYVFIHEALLEAATCGHTEVPARNLYAHIQKLGQVPPGESVTAMELEFKLLASSKAHTSRFISANLPCNKFKNRLVNIMPYELTRVCLQPIRGVEGSDYINASFLDGYRQQKAYIATQGPLAESTEDFWRMLWEHNSTIIVMLTKLREMGREKCHQYWPAERSARYQYFVVDPMAEYNMPQYILREFKVTDARDGQSRTIRQFQFTDWPEQGVPKTGEGFIDFIGQVHKTKEQFGQDGPITVHCSAGVGRTGVFITLSIVLERMRYEGVVDMFQTVKTLRTQRPAMVQTEDQYQLCYRAALEYLGSFDHYAT

SEQ ID NO: 909376 - protein, 1758 aa, Homo sapiens
MGAWLQDLSLSKSSCSRQSLSVGATSRLEVGGVGVDDELGSGGATPPVSEHGFGSDQRGFLNEGPLPFHAVVCPARPVSASLPPPAVRRVAPRFSIPPSSQEVMPGGSVNLTCVAVGAPMPYVKWMMGAEELTKEDEMPVGRNVLELSNVVRSANYTCVAISSLGMIEATAQVTVKALPKPPIDLVVTETTATSVTLTWDSGNSEPVTYYGIQYRAAGTEGPFQEVDGVATTRYSIGGLSPFSEYAFRVLAVNSIGRGPPSEAVRARTGEQAPSSPPRRVQARMLSASTMLVQWEPPEEPNGLVRGYRVYYTPDSRRPPNAWHKHNTDAGLLTTVGSLLPGITYSLRVLAFTAVGDGPPSPTIQVKTQQGVPAQPADFQAEVESDTRIQLSWLLPPQERIIMYELVYWAAEDEDQQHKVTFDPTSSYTLEDLKPDTLYRFQLAARSDMGVGVFTPTIEARTAQSTPSAPPQKVMCVSMGSTTVRVSWVPPPADSRNGVITQYSVAYEAVDGEDRGRHVVDGISREHSSWDLVGLEKWTEYRVWVRAHTDVGPGPESSPVLVRTDEDVPSGPPRKVEVEPLNSTAVHVYWKLPVPSKQHGQIRGYQVTYVRLENGEPRGLPIIQDVMLAEAQETTISGLTPETTYSVTVAAYTTKGDGARSKPKIVTTTGAVPGRPTMMISTTAMNTALLQWHPPKELPGELLGYRLQYCRADEARPNTIDFGKDDQHFTVTGLHKGTTYIFRLAAKNRAGLGEEFEKEIRTPEDLPSGFPQNLHVTGLTTSTTELAWDPPVLAERNGRIISYTVVFRDINSQQELQNITTDTRFTLTGLKPDTTYDIKVRAWTSKGSGPLSPSIQSRTMPVEQVFAKNFRVAAAMKTSVLLSWEVPDSYKSAVPFKILYNGQSVEVDGHSMRKLIADLQPNTEYSFVLMNRGSSAGGLQHLVSIRTAPDLLPHKPLPASAYIEDGRFDLSMPHVQDPSLVRWFYIVVVPIDRVGGSMLTPRWSTPEELELDELLEAIEQGGEEQRRRRRQAERLKPYVAAQLDVLPETFTLGDKKNYRGFYNRPLSPDLSYQCFVLASLKEPMDQKRYASSPYSDEIVVQVTPAQQQEEPEMLWVTGPVLAVILIILIVIAILLFKRKRTHSPSSKDEQSIGLKDSLLAHSSDPVEMRRLNYQTPGMRDHPPIPITDLADNIERLKANDGLKFSQEYESIDPGQQFTWENSNLEVNKPKNRYANVIAYDHSRVILTSIDGVPGSDYINANYIDGYRKQNAYIATQGPLPETMGDFWRMVWEQRTATVVMMTRLEEKSRVKCDQYWPARGTETCGLIQVTLLDTVELATYTVRTFALHKSGSSEKRELRQFQFMAWPDHGVPEYPTPILAFLRRVKACNPLDAGPMVVHCSAGVGRTGCFIVIDAMLERMKHEKTVDIYGHVTCMRSQRNYMVQTEDQYVFIHEALLEAATCGHTEVPARNLYAHIQKLGQVPPGESVTAMELEFKLLASSKAHTSRFISANLPCNKFKNRLVNIMPYELTRVCLQPIRGVEGSDYINASFLDGYRQQKAYIATQGPLAESTEDFWRMLWEHNSTIIVMLTKLREMGREKCHQYWPAERSARYQYFVVDPMAEYNMPQYILREFKVTDARDGQSRTIRQFQFTDWPEQGVPKTGEGFIDFIGQVHKTKEQFGQDGPITVHCSAGVGRTGVFITLSIVLERMRYEGVVDMFQTVKTLRTQRPAMVQTEDQYQLCYRAALEYLGSFDHYAT

SEQ ID NO: 909377 - protein, 1305 aa, Homo sapiens
RERRERWRRQRRRLQLRLRLGLGLRLRLRLRVSWVPPPADSRNGVITQYSVAYEAVDGEDRGRHVVDGISREHSSWDLVGLEKWTEYRVWVRAHTDVGPGPESSPVLVRTDEDVPSGPPRKVEVEPLNSTAVHVYWKLPVPSKQHGQIRGYQVTYVRLENGEPRGLPIIQDVMLAEAQETTISGLTPETTYSVTVAAYTTKGDGARSKPKIVTTTGAVPGRPTMMISTTAMNTALLQWHPPKELPGELLGYRLQYCRADEARPNTIDFGKDDQHFTVTGLHKGTTYIFRLAAKNRAGLGEEFEKEIRTPEDLPSGFPQNLHVTGLTTSTTELAWDPPVLAERNGRIISYTVVFRDINSQQELQNITTDTRFTLTGLKPDTTYDIKVRAWTSKGSGPLSPSIQSRTMPVEQVFAKNFRVAAAMKTSVLLSWEVPDSYKSAVPFKILYNGQSVEVDGHSMRKLIADLQPNTEYSFVLMNRGSSAGGLQHLVSIRTAPDLLPHKPLPASAYIEDGRFDLSMPHVQDPSLVRWFYIVVVPIDRVGGSMLTPRWSTPEELELDELLEAIEQGGEEQRRRRRQAERLKPYVAAQLDVLPETFTLGDKKNYRGFYNRPLSPDLSYQCFVLASLKEPMDQKRYASSPYSDEIVVQVTPAQQQEEPEMLWVTGPVLAVILIILIVIAILLFKRKRTHSPSSKDEQSIGLKDSLLAHSSDPVEMRRLNYQTPGMRDHPPIPITDLADNIERLKANDGLKFSQEYESIDPGQQFTWENSNLEVNKPKNRYANVIAYDHSRVILTSIDGVPGSDYINANYIDGYRKQNAYIATQGPLPETMGDFWRMVWEQRTATVVMMTRLEEKSRVKCDQYWPARGTETCGLIQVTLLDTVELATYTVRTFALHKSGSSEKRELRQFQFMAWPDHGVPEYPTPILAFLRRVKACNPLDAGPMVVHCSAGVGRTGCFIVIDAMLERMKHEKTVDIYGHVTCMRSQRNYMVQTEDQYVFIHEALLEAATCGHTEVPARNLYAHIQKLGQVPPGESVTAMELEFKLLASSKAHTSRFISANLPCNKFKNRLVNIMPYELTRVCLQPIRGVEGSDYINASFLDGYRQQKAYIATQGPLAESTEDFWRMLWEHNSTIIVMLTKLREMGREKCHQYWPAERSARYQYFVVDPMAEYNMPQYILREFKVTDARDGQSRTIRQFQFTDWPEQGVPKTGEGFIDFIGQVHKTKEQFGQDGPITVHCSAGVGRTGVFITLSIVLERMRYEGVVDMFQTVKTLRTQRPAMVQTEDQYQLCYRAALEYLGSFDHYAT

SEQ ID NO: 909378 - protein, 768 aa, Homo sapiens
RLILMDPYRRYGGATEELELDELLEAIEQGGEEQRRRRRQAERLKPYVAAQLDVLPETFTLGDKKNYRGFYNRPLSPDLSYQCFVLASLKEPMDQKRYASSPYSDEIVVQVTPAQQQEEPEMLWVTGPVLAVILIILIVIAILLFKRKRTHSPSSKDEQSIGLKDSLLAHSSDPVEMRRLNYQTPGMRDHPPIPITDLADNIERLKANDGLKFSQEYESIDPGQQFTWENSNLEVNKPKNRYANVIAYDHSRVILTSIDGVPGSDYINANYIDGYRKQNAYIATQGPLPETMGDFWRMVWEQRTATVVMMTRLEEKSRVKCDQYWPARGTETCGLIQVTLLDTVELATYTVRTFALHKSGSSEKRELRQFQFMAWPDHGVPEYPTPILAFLRRVKACNPLDAGPMVVHCSAGVGRTGCFIVIDAMLERMKHEKTVDIYGHVTCMRSQRNYMVQTEDQYVFIHEALLEAATCGHTEVPARNLYAHIQKLGQVPPGESVTAMELEFKLLASSKAHTSRFISANLPCNKFKNRLVNIMPYELTRVCLQPIRGVEGSDYINASFLDGYRQQKAYIATQGPLAESTEDFWRMLWEHNSTIIVMLTKLREMGREKCHQYWPAERSARYQYFVVDPMAEYNMPQYILREFKVTDARDGQSRTIRQFQFTDWPEQGVPKTGEGFIDFIGQVHKTKEQFGQDGPITVHCSAGVGRTGVFITLSIVLERMRYEGVVDMFQTVKTLRTQRPAMVQTEDQYQLCYRAALEYLGSFDHYAT

SEQ ID NO: 909379 - protein, 638 aa, Homo sapiens
PPPSLSLHVLLSPCHQFQVLHGHTCSHVHIHALGLSLPHCSSLTLMLPVYALPPLGMRDHPPIPITDLADNIERLKANDGLKFSQEYESIDPGQQFTWENSNLEVNKPKNRYANVIAYDHSRVILTSIDGVPGSDYINANYIDGYRKQNAYIATQGPLPETMGDFWRMVWEQRTATVVMMTRLEEKSRVKCDQYWPARGTETCGLIQVTLLDTVELATYTVRTFALHKSGSSEKRELRQFQFMAWPDHGVPEYPTPILAFLRRVKACNPLDAGPMVVHCSAGVGRTGCFIVIDAMLERMKHEKTVDIYGHVTCMRSQRNYMVQTEDQYVFIHEALLEAATCGHTEVPARNLYAHIQKLGQVPPGESVTAMELEFKLLASSKAHTSRFISANLPCNKFKNRLVNIMPYELTRVCLQPIRGVEGSDYINASFLDGYRQQKAYIATQGPLAESTEDFWRMLWEHNSTIIVMLTKLREMGREKCHQYWPAERSARYQYFVVDPMAEYNMPQYILREFKVTDARDGQSRTIRQFQFTDWPEQGVPKTGEGFIDFIGQVHKTKEQFGQDGPITVHCSAGVGRTGVFITLSIVLERMRYEGVVDMFQTVKTLRTQRPAMVQTEDQYQLCYRAALEYLGSFDHYAT

SEQ ID NO: 909380 - protein, 1898 aa, Homo sapiens; identical to SEQ ID NO: 909374

SEQ ID NO: 909381 - protein, 1898 aa, Homo sapiens; identical to SEQ ID NO: 909374

SEQ ID NO: 909382 - protein, 1898 aa, Homo sapiens; identical to SEQ ID NO: 909374

SEQ ID NO: 909383 - protein, 1898 aa, Homo sapiens; identical to SEQ ID NO: 909374

SEQ ID NO: 909384 - protein, 1866 aa, Homo sapiens
MAPEPAPGRTMVPLVPALVMLGLVAGAHGDSKPVFIKVPEDQTGLSGGVASFVCQATGEPKPRITWMKKGKKVSSQRFEVIEFDDGAGSVLRIQPLRVQRDEAIYECTATNSLGEINTSAKLSVLEEEQLPPGFPSIDMGPQLKVVEKARTATMLCAAGGNPDPEISWFKDFLPVDPATSNGRIKQLRSGALQIESSEESDQGKYECVATNSAGTRYSAPANLYVRVRRVAPRFSIPPSSQEVMPGGSVNLTCVAVGAPMPYVKWMMGAEELTKEDEMPVGRNVLELSNVVRSANYTCVAISSLGMIEATAQVTVKALPKPPIDLVVTETTATSVTLTWDSGNSEPVTYYGIQYRAAGTEGPFQEVDGVATTRYSIGGLSPFSEYAFRVLAVNSIGRGPPSEAVRARTGEQAPSSPPRRVQARMLSASTMLVQWEPPEEPNGLVRGYRVYYTPDSRRPPNAWHKHNTDAGLLTTVGSLLPGITYSLRVLAFTAVGDGPPSPTIQVKTQQGVPAQPADFQAEVESDTRIQLSWLLPPQERIIMYELVYWAAEDEDQQHKVTFDPTSSYTLEDLKPDTLYRFQLAARSDMGVGVFTPTIEARTAQSTPSAPPQKVMCVSMGSTTVRVSWVPPPADSRNGVITQYSVAYEAVDGEDRGRHVVDGISREHSSWDLVGLEKWTEYRVWVRAHTDVGPGPESSPVLVRTDEDVPSGPPRKVEVEPLNSTAVHVYWKLPVPSKQHGQIRGYQVTYVRLENGEPRGLPIIQDVMLAEAQETTISGLTPETTYSVTVAAYTTKGDGARSKPKIVTTTGAVPGRPTMMISTTAMNTALLQWHPPKELPGELLGYRLQYCRADEARPNTIDFGKDDQHFTVTGLHKGTTYIFRLAAKNRAGLGEEFEKEIRTPEDLPSGFPQNLHVTGLTTSTTELAWDPPVLAERNGRIISYTVVFRDINSQQELQNITTDTRFTLTGLKPDTTYDIKVRAWTSKGSGPLSPSIQSRTMPVEQVFAKNFRVAAAMKTSVLLSWEVPDSYKSAVPFKILYNGQSVEVDGHSMRKLIADLQPNTEYSFVLMNRGSSAGGLQHLVSIRTAPDLLPHKPLPASAYIEDGRFDLSMPHVQDPSLVRWFYIVVVPIDRVGGSMLTPRWSTPEELELDELLEAIEQGGEEQRRRRRQAERLKPYVAAQLDVLPETFTLGDKKNYRGFYNRPLSPDLSYQCFVLASLKEPMDQKRYASSPYSDEIVVQVTPAQQQEEPEMLWVTGPVLAVILIILIVIAILLFKRKRTHSPSSKDEQSIGLKDSLLAHSSDPVEMRRLNYQTPGMRDHPPIPITDLADNIERLKANDGLKFSQEYESIDPGQQFTWENSNLEVNKPKNRYANVIAYDHSRVILTSIDGVPGSDYINANYIDGYRKQNAYIATQGPLPETMGDFWRMVWEQRTATVVMMTRLEEKSRVKCDQYWPARGTETCGLIQVTLLDTVELATYTVRTFALHKSGSSEKRELRQFQFMAWPDHGVPEYPTPILAFLRRVKACNPLDAGPMVVHCSAGVGRTGCFIVIDAMLERMKHEKTVDIYGHVTCMRSQRNYMVQTEDQYVFIHEALLEAATCGHTEVPARNLYAHIQKLGQVPPGESVTAMELEFKLLASSKAHTSRFISANLPCNKFKNRLVNIMPYELTRVCLQPIRGVEGSDYINASFLDGYRQQKAYIATQGPLAESTEDFWRMLWEHNSTIIVMLTKLREMGREKCHQYWPAERSARYQYFVVDPMAEYNMPQYILREFKVTDARDGQSRTIRQFQFTDWPEQGVPKTGEGFIDFIGQVHKTKEQFGQDGPITVHCSAGVGRTGVFITLSIVLERMRYEGVAGLSGPGQWAW

SEQ ID NO: 909385 - protein, 1898 aa, Homo sapiens; identical to SEQ ID NO: 909374

SEQ ID NO: 909386 - protein, 128 aa, Homo sapiens
ITIVFAKVMRNALPGSPRHICGSGLWMLNTHWDRRPAFLITIVFAKVKTKTKNHKNKKQKKQKTQEKKKESALGFCFKPSRGEATPCAWGSRGSCWLTWAHRAWLWSPALQYGVVFVGCGVWLCGQGE

SEQ ID NO: 909387 - protein, 1790 aa, Homo sapiens
MAPEPAPGRTMVPLVPALVMLGLVAGAHGDSKPVFIKVPEDQTGLSGGVASFVCQATGEPKPRITWMKKGKKVSSQRFEVIEFDDGAGSVLRIQPLRVQRDEAIYECTATNSLGEINTSAKLSVLEEEQLPPGFPSIDMGPQLKVVEKARTATMLCAAGGNPDPEISWFKDFLPVDPATSNGRIKQLRSGALQIESSEESDQGKYECVATNSAGTRYSAPANLYVRVRRVAPRFSIPPSSQEVMPGGSVNLTCVAVGAPMPYVKWMMGAEELTKEDEMPVGRNVLELSNVVRSANYTCVAISSLGMIEATAQVTVKALPKPPIDLVVTETTATSVTLTWDSGNSEPVTYYGIQYRAAGTEGPFQEVDGVATTRYSIGGLSPFSEYAFRVLAVNSIGRGPPSEAVRARTGEQAPSSPPRRVQARMLSASTMLVQWEPPEEPNGLVRGYRVYYTPDSRRPPNAWHKHNTDAGLLTTVGSLLPGITYSLRVLAFTAVGDGPPSPTIQVKTQQGVPAQPADFQAEVESDTRIQLSWLLPPQERIIMYELVYWAAEDEDQQHKVTFDPTSSYTLEDLKPDTLYRFQLAARSDMGVGVFTPTIEARTAQSTPSAPPQKVMCVSMGSTTVRVSWVPPPADSRNGVITQYSVAYEAVDGEDRGRHVVDGISREHSSWDLVGLEKWTEYRVWVRAHTDVGPGPESSPVLVRTDEDVPSGPPRKVEVEPLNSTAVHVYWKLPVPSKQHGQIRGYQVTYVRLENGEPRGLPIIQDVMLAEAQETTISGLTPETTYSVTVAAYTTKGDGARSKPKIVTTTGAVPGRPTMMISTTAMNTALLQWHPPKELPGELLGYRLQYCRADEARPNTIDFGKDDQHFTVTGLHKGTTYIFRLAAKNRAGLGEEFEKEIRTPEDLPSGFPQNLHVTGLTTSTTELAWDPPVLAERNGRIISYTVVFRDINSQQELQNITTDTRFTLTGLKPDTTYDIKVRAWTSKGSGPLSPSIQSRTMPVEQVFAKNFRVAAAMKTSVLLSWEVPDSYKSAVPFKILYNGQSVEVDGHSMRKLIADLQPNTEYSFVLMNRGSSAGGLQHLVSIRTAPDLLPHKPLPASAYIEDGRFDLSMPHVQDPSLVRWFYIVVVPIDRVGGSMLTPRWSTPEELELDELLEAIEQGGEEQRRRRRQAERLKPYVAAQLDVLPETFTLGDKKNYRGFYNRPLSPDLSYQCFVLASLKEPMDQKRYASSPYSDEIVVQVTPAQQQEEPEMLWVTGPVLAVILIILIVIAILLFKRKRTHSPSSKDEQSIGLKDSLLAHSSDPVEMRRLNYQTPGMRDHPPIPITDLADNIERLKANDGLKFSQEYESIDPGQQFTWENSNLEVNKPKNRYANVIAYDHSRVILTSIDGVPGSDYINANYIDGYRKQNAYIATQGPLPETMGDFWRMVWEQRTATVVMMTRLEEKSRVKCDQYWPARGTETCGLIQVTLLDTVELATYTVRTFALHKSGSSEKRELRQFQFMAWPDHGVPEYPTPILAFLRRVKACNPLDAGPMVVHCSAGVGRTGCFIVIDAMLERMKHEKTVDIYGHVTCMRSQRNYMVQTEDQYVFIHEALLEAATCGHTEVPARNLYAHIQKLGQVPPGESVTAMELEFKLLASSKAHTSRFISANLPCNKFKNRLVNIMPYELTRVCLQPIRGVEGSDYINASFLDGYRQQKAYIATQGPLAESTEDFWRMLWEHNSTIIVMLTKLREMGRKMPRTGRERSVVRTCRCRGGHLAVSGGSPIRWRRKRVRHMAAGCHGGRSAGPG

SEQ ID NO: 909388 - protein, 1335 aa, Homo sapiens
MAPEPAPGRTMVPLVPALVMLGLVAGAHGDSKPVFIKVPEDQTGLSGGVASFVCQATGEPKPRITWMKKGKKVSSQRFEVIEFDDGAGSVLRIQPLRVQRDEAIYECTATNSLGEINTSAKLSVLEEEQLPPGFPSIDMGPQLKVVEKARTATMLCAAGGNPDPEISWFKDFLPVDPATSNGRIKQLRSGALQIESSEESDQGKYECVATNSAGTRYSAPANLYVRVRRVAPRFSIPPSSQEVMPGGSVNLTCVAVGAPMPYVKWMMGAEELTKEDEMPVGRNVLELSNVVRSANYTCVAISSLGMIEATAQVTVKALPKPPIDLVVTETTATSVTLTWDSGNSEPVTYYGIQYRAAGTEGPFQEVDGVATTRYSIGGLSPFSEYAFRVLAVNSIGRGPPSEAVRARTGEQAPSSPPRRVQARMLSASTMLVQWEPPEEPNGLVRGYRVYYTPDSRRPPNAWHKHNTDAGLLTTVGSLLPGITYSLRVLAFTAVGDGPPSPTIQVKTQQGVPAQPADFQAEVESDTRIQLSWLLPPQERIIMYELVYWAAEDEDQQHKVTFDPTSSYTLEDLKPDTLYRFQLAARSDMGVGVFTPTIEARTAQSTPSAPPQKVMCVSMGSTTVRVSWVPPPADSRNGVITQYSVAYEAVDGEDRGRHVVDGISREHSSWDLVGLEKWTEYRVWVRAHTDVGPGPESSPVLVRTDEDVPSGPPRKVEVEPLNSTAVHVYWKLPVPSKQHGQIRGYQVTYVRLENGEPRGLPIIQDVMLAEAQETTISGLTPETTYSVTVAAYTTKGDGARSKPKIVTTTGAVPGRPTMMISTTAMNTALLQWHPPKELPGELLGYRLQYCRADEARPNTIDFGKDDQHFTVTGLHKGTTYIFRLAAKNRAGLGEEFEKEIRTPEDLPSGFPQNLHVTGLTTSTTELAWDPPVLAERNGRIISYTVVFRDINSQQELQNITTDTRFTLTGLKPDTTYDIKVRAWTSKGSGPLSPSIQSRTMPVEQVFAKNFRVAAAMKTSVLLSWEVPDSYKSAVPFKILYNGQSVEVDGHSMRKLIADLQPNTEYSFVLMNRGSSAGGLQHLVSIRTAPDLLPHKPLPASAYIEDGRFDLSMPHVQDPSLVRWFYIVVVPIDRVGGSMLTPRWSTPEELELDELLEAIEQGGEEQRRRRRQAERLKPYVAAQLDVLPETFTLGDKKNYRGFYNRPLSPDLSYQCFVLASLKEPMDQKRYASSPYSDEIVVQVTPAQQQEEPEMLWVTGPVLAVILIILIVIAILLFKRKRTHSPSSKDEQSIGLKDSLLAHSSDPVEMRRLNYQTPVRETTHNPPIRYPMGNLRVT

SEQ ID NO: 909389 - protein, 1049 aa, Homo sapiens
MAPEPAPGRTMVPLVPALVMLGLVAGAHGDSKPVFIKVPEDQTGLSGGVASFVCQATGEPKPRITWMKKGKKVSSQRFEVIEFDDGAGSVLRIQPLRVQRDEAIYECTATNSLGEINTSAKLSVLEEEQLPPGFPSIDMGPQLKVVEKARTATMLCAAGGNPDPEISWFKDFLPVDPATSNGRIKQLRSGALQIESSEESDQGKYECVATNSAGTRYSAPANLYVRVRRVAPRFSIPPSSQEVMPGGSVNLTCVAVGAPMPYVKWMMGAEELTKEDEMPVGRNVLELSNVVRSANYTCVAISSLGMIEATAQVTVKALPKPPIDLVVTETTATSVTLTWDSGNSEPVTYYGIQYRAAGTEGPFQEVDGVATTRYSIGGLSPFSEYAFRVLAVNSIGRGPPSEAVRARTGEQAPSSPPRRVQARMLSASTMLVQWEPPEEPNGLVRGYRVYYTPDSRRPPNAWHKHNTDAGLLTTVGSLLPGITYSLRVLAFTAVGDGPPSPTIQVKTQQGVPAQPADFQAEVESDTRIQLSWLLPPQERIIMYELVYWAAEDEDQQHKVTFDPTSSYTLEDLKPDTLYRFQLAARSDMGVGVFTPTIEARTAQSTPSAPPQKVMCVSMGSTTVRVSWVPPPADSRNGVITQYSVAYEAVDGEDRGRHVVDGISREHSSWDLVGLEKWTEYRVWVRAHTDVGPGPESSPVLVRTDEDVPSGPPRKVEVEPLNSTAVHVYWKLPVPSKQHGQIRGYQVTYVRLENGEPRGLPIIQDVMLAEAQWRPEESEDYETTISGLTPETTYSVTVAAYTTKGDGARSKPKIVTTTGAVPGRPTMMISTTAMNTALLQWHPPKELPGELLGYRLQYCRADEARPNTIDFGKDDQHFTVTGLHKGTTYIFRLAAKNRAGLGEEFEKEIRTPEDLPSGFPQNLHVTGLTTSTTELAWDPPVLAERNGRIISYTVVFRDINSQQELQNITTDTRFTLTGLKPDTTYDIKVRAWTSKGSGPLSPSIQSRTMPVEQGVCCGHGIPSRVWLHLGVSALLEPLTSGDCDPPASGV

SEQ ID NO: 909390 - protein, 840 aa, Homo sapiens
MAPEPAPGRTMVPLVPALVMLGLVAGAHGDSKPVFIKVPEDQTGLSGGVASFVCQATGEPKPRITWMKKGKKVSSQRFEVIEFDDGAGSVLRIQPLRVQRDEAIYECTATNSLGEINTSAKLSVLEEEQLPPGFPSIDMGPQLKVVEKARTATMLCAAGGNPDPEISWFKDFLPVDPATSNGRIKQLRSGALQIESSEESDQGKYECVATNSAGTRYSAPANLYVRVRRVAPRFSIPPSSQEVMPGGSVNLTCVAVGAPMPYVKWMMGAEELTKEDEMPVGRNVLELSNVVRSANYTCVAISSLGMIEATAQVTVKALPKPPIDLVVTETTATSVTLTWDSGNSEPVTYYGIQYRAAGTEGPFQEVDGVATTRYSIGGLSPFSEYAFRVLAVNSIGRGPPSEAVRARTGEQAPSSPPRRVQARMLSASTMLVQWEPPEEPNGLVRGYRVYYTPDSRRPPNAWHKHNTDAGLLTTVGSLLPGITYSLRVLAFTAVGDGPPSPTIQVKTQQGVPAQPADFQAEVESDTRIQLSWLLPPQERIIMYELVYWAAEDEDQQHKVTFDPTSSYTLEDLKPDTLYRFQLAARSDMGVGVFTPTIEARTAQSTPSAPPQKVMCVSMGSTTVRVSWVPPPADSRNGVITQYSVAYEAVDGEDRGRHVVDGISREHSSWDLVGLEKWTEYRVWVRAHTDVGPGPESSPVLVRTDEDVPSGPPRKVEVEPLNSTAVHVYWKLPVPSKQHGQIRGYQVTYVRLENGEPRGLPIIQDVMLAEAQWRPEESEDYVSNRCANADKTWVKLGSWDAPPLPPFLLACTAKIHRALATSGENWRLDTSTELSSDWHFL

SEQ ID NO: 909391 - protein, 569 aa, Homo sapiens
MAPEPAPGRTMVPLVPALVMLGLVAGAHGDSKPVFIKVPEDQTGLSGGVASFVCQATGEPKPRITWMKKGKKVSSQRFEVIEFDDGAGSVLRIQPLRVQRDEAIYECTATNSLGEINTSAKLSVLEEEQLPPGFPSIDMGPQLKVVEKARTATMLCAAGGNPDPEISWFKDFLPVDPATSNGRIKQLRSGALQIESSEESDQGKYECVATNSAGTRYSAPANLYVRVRRVAPRFSIPPSSQEVMPGGSVNLTCVAVGAPMPYVKWMMGAEELTKEDEMPVGRNVLELSNVVRSANYTCVAISSLGMIEATAQVTVKALPKPPIDLVVTETTATSVTLTWDSGNSEPVTYYGIQYRAAGTEGPFQEVDGVATTRYSIGGLSPFSEYAFRVLAVNSIGRGPPSEAVRARTGEQAPSSPPRRVQARMLSASTMLVQWEPPEEPNGLVRGYRVYYTPDSRRPPNAWHKHNTDAGLLTTVGSLLPGITYSLRVLAFTAVGDGPPSPTIQVKTQQGVPAQPADFQAEVESDTRIQLSWLLPPQERIIMYELVYWAAEDEDQQHKVKSTLQGFPCL

SEQ ID NO: 909392 - protein, 199 aa, Homo sapiens [sequence omitted]

SEQ ID NO: 909393 - protein, 117 aa, Homo sapiens
PPPSLSLHVLLSPCHQFQVLHGHTCSHVHIHALGLSLPHCSSLTLMLPVYALPPLGMRDHPPIPITDLADNIERLKANDGLKFSQEYEVRCSRPLPCAWPRPTQTSSCPVLGPSCGG

SEQ ID NO: 909394 - protein, 81 aa, Homo sapiens
MLAVGDASPDICGEMKCLHLSLPGGRPQVYHTTYLPLLLATLMGLSTSSFYLKCYSSQHPADTAQTSPLAHTPTGLGVSSW

SEQ ID NO: 909395 - protein, 1898 aa, Homo sapiens; identical to SEQ ID NO: 909374

SEQ ID NO: 909396 - protein, 1753 aa, Homo sapiens
IQGHEWQNPLEEIFLAVSKGKGVPFPLVGNPMHTSNGRIKQLRSGALQIESSEESDQGKYECVATNSAGTRYSAPANLYVRVRRVAPRFSIPPSSQEVMPGGSVNLTCVAVGAPMPYVKWMMGAEELTKEDEMPVGRNVLELSNVVRSANYTCVAISSLGMIEATAQVTVKALPKPPIDLVVTETTATSVTLTWDSGNSEPVTYYGIQYRAAGTEGPFQEVDGVATTRYSIGGLSPFSEYAFRVLAVNSIGRGPPSEAVRARTGEQAPSSPPRRVQARMLSASTMLVQWEPPEEPNGLVRGYRVYYTPDSRRPPNAWHKHNTDAGLLTTVGSLLPGITYSLRVLAFTAVGDGPPSPTIQVKTQQGVPAQPADFQAEVESDTRIQLSWLLPPQERIIMYELVYWAAEDEDQQHKVTFDPTSSYTLEDLKPDTLYRFQLAARSDMGVGVFTPTIEARTAQSTPSAPPQKVMCVSMGSTTVRVSWVPPPADSRNGVITQYSVAYEAVDGEDRGRHVVDGISREHSSWDLVGLEKWTEYRVWVRAHTDVGPGPESSPVLVRTDEDVPSGPPRKVEVEPLNSTAVHVYWKLPVPSKQHGQIRGYQVTYVRLENGEPRGLPIIQDVMLAEAQETTISGLTPETTYSVTVAAYTTKGDGARSKPKIVTTTGAVPGRPTMMISTTAMNTALLQWHPPKELPGELLGYRLQYCRADEARPNTIDFGKDDQHFTVTGLHKGTTYIFRLAAKNRAGLGEEFEKEIRTPEDLPSGFPQNLHVTGLTTSTTELAWDPPVLAERNGRIISYTVVFRDINSQQELQNITTDTRFTLTGLKPDTTYDIKVRAWTSKGSGPLSPSIQSRTMPVEQVFAKNFRVAAAMKTSVLLSWEVPDSYKSAVPFKILYNGQSVEVDGHSMRKLIADLQPNTEYSFVLMNRGSSAGGLQHLVSIRTAPDLLPHKPLPASAYIEDGRFDLSMPHVQDPSLVRWFYIVVVPIDRVGGSMLTPRWSTPEELELDELLEAIEQGGEEQRRRRRQAERLKPYVAAQLDVLPETFTLGDKKNYRGFYNRPLSPDLSYQCFVLASLKEPMDQKRYASSPYSDEIVVQVTPAQQQEEPEMLWVTGPVLAVILIILIVIAILLFKRKRTHSPSSKDEQSIGLKDSLLAHSSDPVEMRRLNYQTPGMRDHPPIPITDLADNIERLKANDGLKFSQEYESIDPGQQFTWENSNLEVNKPKNRYANVIAYDHSRVILTSIDGVPGSDYINANYIDGYRKQNAYIATQGPLPETMGDFWRMVWEQRTATVVMMTRLEEKSRVKCDQYWPARGTETCGLIQVTLLDTVELATYTVRTFALHKSGSSEKRELRQFQFMAWPDHGVPEYPTPILAFLRRVKACNPLDAGPMVVHCSAGVGRTGCFIVIDAMLERMKHEKTVDIYGHVTCMRSQRNYMVQTEDQYVFIHEALLEAATCGHTEVPARNLYAHIQKLGQVPPGESVTAMELEFKLLASSKAHTSRFISANLPCNKFKNRLVNIMPYELTRVCLQPIRGVEGSDYINASFLDGYRQQKAYIATQGPLAESTEDFWRMLWEHNSTIIVMLTKLREMGREKCHQYWPAERSARYQYFVVDPMAEYNMPQYILREFKVTDARDGQSRTIRQFQFTDWPEQGVPKTGEGFIDFIGQVHKTKEQFGQDGPITVHCSAGVGRTGVFITLSIVLERMRYEGVVDMFQTVKTLRTQRPAMVQTEDQYQLCYRAALEYLGSFDHYAT

SEQ ID NO: 909397 - protein, 1082 aa, Homo sapiens [sequence omitted]

SEQ ID NO: 909398 - protein, 1898 aa, Homo sapiens; identical to SEQ ID NO: 909374

SEQ ID NO: 909399 - protein, 1898 aa, Homo sapiens; identical to SEQ ID NO: 909374

SEQ ID NO: 909400 - protein, 1898 aa, Homo sapiens; identical to SEQ ID NO: 909374

SEQ ID NO: 909401 - protein, 1910 aa, Homo sapiens
MAPEPAPGRTMVPLVPALVMLGLVAGAHGDSKPVFIKVPEDQTGLSGGVASFVCQATGEPKPRITWMKKGKKVSSQRFEVIEFDDGAGSVLRIQPLRVQRDEAIYECTATNSLGEINTSAKLSVLEEEQLPPGFPSIDMGPQLKVVEKARTATMLCAAGGNPDPEISWFKDFLPVDPATSNGRIKQLRSGALQIESSEESDQGKYECVATNSAGTRYSAPANLYVRVRRVAPRFSIPPSSQEVMPGGSVNLTCVAVGAPMPYVKWMMGAEELTKEDEMPVGRNVLELSNVVRSANYTCVAISSLGMIEATAQVTVKALPKPPIDLVVTETTATSVTLTWDSGNSEPVTYYGIQYRAAGTEGPFQEVDGVATTRYSIGGLSPFSEYAFRVLAVNSIGRGPPSEAVRARTGEQAPSSPPRRVQARMLSASTMLVQWEPPEEPNGLVRGYRVYYTPDSRRPPNAWHKHNTDAGLLTTVGSLLPGITYSLRVLAFTAVGDGPPSPTIQVKTQQGVPAQPADFQAEVESDTRIQLSWLLPPQERIIMYELVYWAAEDEDQQHKVTFDPTSSYTLEDLKPDTLYRFQLAARSDMGVGVFTPTIEARTAQSTPSAPPQKVMCVSMGSTTVRVSWVPPPADSRNGVITQYSVAYEAVDGEDRGRHVVDGISREHSSWDLVGLEKWTEYRVWVRAHTDVGPGPESSPVLVRTDEDVPSGPPRKVEVEPLNSTAVHVYWKLPVPSKQHGQIRGYQVTYVRLENGEPRGLPIIQDVMLAEAQETTISGLTPETTYSVTVAAYTTKGDGARSKPKIVTTTGAVPGRPTMMISTTAMNTALLQWHPPKELPGELLGYRLQYCRADEARPNTIDFGKDDQHFTVTGLHKGTTYIFRLAAKNRAGLGEEFEKEIRTPEDLPSGFPQNLHVTGLTTSTTELAWDPPVLAERNGRIISYTVVFRDINSQQELQNITTDTRFTLTGLKPDTTYDIKVRAWTSKGSGPLSPSIQSRTMPVEQVFAKNFRVAAAMKTSVLLSWEVPDSYKSAVPFKILYNGQSVEVDGHSMRKLIADLQPNTEYSFVLMNRGSSAGGLQHLVSIRTAPDLLPHKPLPASAYIEDGRFDLSMPHVQDPSLVRWFYIVVVPIDRVGGSMLTPRWSTPEELELDELLEAIEQGGEEQRRRRRQAERLKPYVAAQLDVLPETFTLGDKKNYRGFYNRPLSPDLSYQCFVLASLKEPMDQKRYASSPYSDEIVVQVTPAQQQEEPEMLWVTGPVLAVILIILIVIAILLFKRKRTHSPSSKDEQSIGLKDSLLAHSSDPVEMRRLNYQTPGMRDHPPIPITDLADNIERLKANDGLKFSQEYESIDPGQQFTWENSNLEVNKPKNRYANVIAYDHSRVILTSIDGVPGSDYINANYIDGYRKQNAYIATQGPLPETMGDFWRMVWEQRTATVVMMTRLEEKSRVKCDQYWPARGTETCGLIQVTLLDTVELATYTVRTFALHKSGSSEKRELRQFQFMAWPDHGVPEYPTPILAFLRRVKACNPLDAGPMVVHCSAGVGRTGCFIVIDAMLERMKHEKTVDIYGHVTCMRSQRNYMVQTEDQYVFIHEALLEAATCGHTEVPARNLYAHIQKLGQVPPGESVTAMELEFKLLASSKAHTSRFISANLPCNKFKNRLVNIMPYELTRVCLQPIRGVEGSDYINASFLDGYRQQKAYIATQGPLAESTEDFWRMLWEHNSTIIVMLTKLREMGREKCHQYWPAERSARYQYFVVDPMAEYNMPQYILREFKVTDARDGQSRTIRQFQFTDWPEQGVPKTGEGFIDFIGQVHKTKEQFGQDGPITVHCSAGVGRTGVFITLSIVLERMRYEGVVDMFQTVKTLRTQRPAMVQTEDQYQLCYRAALEYLPSIAVWCGVCRLWGLAVWPR

SEQ ID NO: 909402 - protein, 1577 aa, Homo sapiens
MAPEPAPGRTMVPLVPALVMLGLVAGAHGDSKPVFIKVPEDQTGLSGGVASFVCQATGEPKPRITWMKKGKKVSSQRFEVIEFDDGAGSVLRIQPLRVQRDEAIYECTATNSLGEINTSAKLSVLEEEQLPPGFPSIDMGPQLKVVEKARTATMLCAAGGNPDPEISWFKDFLPVDPATSNGRIKQLRSGALQIESSEESDQGKYECVATNSAGTRYSAPANLYVRVRRVAPRFSIPPSSQEVMPGGSVNLTCVAVGAPMPYVKWMMGAEELTKEDEMPVGRNVLELSNVVRSANYTCVAISSLGMIEATAQVTVKALPKPPIDLVVTETTATSVTLTWDSGNSEPVTYYGIQYRAAGTEGPFQEVDGVATTRYSIGGLSPFSEYAFRVLAVNSIGRGPPSEAVRARTGEQAPSSPPRRVQARMLSASTMLVQWEPPEEPNGLVRGYRVYYTPDSRRPPNAWHKHNTDAGLLTTVGSLLPGITYSLRVLAFTAVGDGPPSPTIQVKTQQGVPAQPADFQAEVESDTRIQLSWLLPPQERIIMYELVYWAAEDEDQQHKVTFDPTSSYTLEDLKPDTLYRFQLAARSDMGVGVFTPTIEARTAQSTPSAPPQKVMCVSMGSTTVRVSWVPPPADSRNGVITQYSVAYEAVDGEDRGRHVVDGISREHSSWDLVGLEKWTEYRVWVRAHTDVGPGPESSPVLVRTDEDVPSGPPRKVEVEPLNSTAVHVYWKLPVPSKQHGQIRGYQVTYVRLENGEPRGLPIIQDVMLAEAQETTISGLTPETTYSVTVAAYTTKGDGARSKPKIVTTTGAVPGRPTMMISTTAMNTALLQWHPPKELPGELLGYRLQYCRADEARPNTIDFGKDDQHFTVTGLHKGTTYIFRLAAKNRAGLGEEFEKEIRTPEDLPSGFPQNLHVTGLTTSTTELAWDPPVLAERNGRIISYTVVFRDINSQQELQNITTDTRFTLTGLKPDTTYDIKVRAWTSKGSGPLSPSIQSRTMPVEQVFAKNFRVAAAMKTSVLLSWEVPDSYKSAVPFKILYNGQSVEVDGHSMRKLIADLQPNTEYSFVLMNRGSSAGGLQHLVSIRTAPDLLPHKPLPASAYIEDGRFDLSMPHVQDPSLVRWFYIVVVPIDRVGGSMLTPRWSTPEELELDELLEAIEQGGEEQRRRRRQAERLKPYVAAQLDVLPETFTLGDKKNYRGFYNRPLSPDLSYQCFVLASLKEPMDQKRYASSPYSDEIVVQVTPAQQQEEPEMLWVTGPVLAVILIILIVIAILLFKRKRTHSPSSKDEQSIGLKDSLLAHSSDPVEMRRLNYQTPGMRDHPPIPITDLADNIERLKANDGLKFSQEYESIDPGQQFTWENSNLEVNKPKNRYANVIAYDHSRVILTSIDGVPGSDYINANYIDGYRKQNAYIATQGPLPETMGDFWRMVWEQRTATVVMMTRLEEKSRVKCDQYWPARGTETCGLIQVTLLDTVELATYTVRTFALHKSGSSEKRELRQFQFMAWPDHGVPEYPTPILAFLRRVKACNPLDAGPMVVHCSAGVGRTGCFIVIDAMLERMKHEKIGNTHPWSSIPVCV

SEQ ID NO: 909403 - protein, 1638 aa, Homo sapiens
MAPEPAPGRTMVPLVPALVMLGLVAGAHGDSKPVFIKVPEDQTGLSGGVASFVCQATGEPKPRITWMKKGKKVSSQRFEVIEFDDGAGSVLRIQPLRVQRDEAIYECTATNSLGEINTSAKLSVLEEEQLPPGFPSIDMGPQLKVVEKARTATMLCAAGGNPDPEISWFKDFLPVDPATSNGRIKQLRSGALQIESSEESDQGKYECVATNSAGTRYSAPANLYVRVRRVAPRFSIPPSSQEVMPGGSVNLTCVAVGAPMPYVKWMMGAEELTKEDEMPVGRNVLELSNVVRSANYTCVAISSLGMIEATAQVTVKALPKPPIDLVVTETTATSVTLTWDSGNSEPVTYYGIQYRAAGTEGPFQEVDGVATTRYSIGGLSPFSEYAFRVLAVNSIGRGPPSEAVRARTGEQAPSSPPRRVQARMLSASTMLVQWEPPEEPNGLVRGYRVYYTPDSRRPPNAWHKHNTDAGLLTTVGSLLPGITYSLRVLAFTAVGDGPPSPTIQVKTQQGVPAQPADFQAEVESDTRIQLSWLLPPQERIIMYELVYWAAEDEDQQHKVTFDPTSSYTLEDLKPDTLYRFQLAARSDMGVGVFTPTIEARTAQSTPSAPPQKVMCVSMGSTTVRVSWVPPPADSRNGVITQYSVAYEAVDGEDRGRHVVDGISREHSSWDLVGLEKWTEYRVWVRAHTDVGPGPESSPVLVRTDEDVPSGPPRKVEVEPLNSTAVHVYWKLPVPSKQHGQIRGYQVTYVRLENGEPRGLPIIQDVMLAEAQETTISGLTPETTYSVTVAAYTTKGDGARSKPKIVTTTGAVPGRPTMMISTTAMNTALLQWHPPKELPGELLGYRLQYCRADEARPNTIDFGKDDQHFTVTGLHKGTTYIFRLAAKNRAGLGEEFEKEIRTPEDLPSGFPQNLHVTGLTTSTTELAWDPPVLAERNGRIISYTVVFRDINSQQELQNITTDTRFTLTGLKPDTTYDIKVRAWTSKGSGPLSPSIQSRTMPVEQVFAKNFRVAAAMKTSVLLSWEVPDSYKSAVPFKILYNGQSVEVDGHSMRKLIADLQPNTEYSFVLMNRGSSAGGLQHLVSIRTAPDLLPHKPLPASAYIEDGRFDLSMPHVQDPSLVRWFYIVVVPIDRVGGSMLTPRWSTPEELELDELLEAIEQGGEEQRRRRRQAERLKPYVAAQLDVLPETFTLGDKKNYRGFYNRPLSPDLSYQCFVLASLKEPMDQKRYASSPYSDEIVVQVTPAQQQEEPEMLWVTGPVLAVILIILIVIAILLFKRKRTHSPSSKDEQSIGLKDSLLAHSSDPVEMRRLNYQTPGMRDHPPIPITDLADNIERLKANDGLKFSQEYESIDPGQQFTWENSNLEVNKPKNRYANVIAYDHSRVILTSIDGVPGSDYINANYIDGYRKQNAYIATQGPLPETMGDFWRMVWEQRTATVVMMTRLEEKSRVKCDQYWPARGTETCGLIQVTLLDTVELATYTVRTFALHKSGSSEKRELRQFQFMAWPDHGVPEYPTPILAFLRRVKACNPLDAGPMVVHCSAGVGRTGCFIVIDAMLERMKHEKTVDIYGHVTCMRSQRNYMVQTEDQYVFIHEALLEAATCGHTEVPALQQVQEPAGEHHALRIDPCVSAAHPWCGGL

SEQ ID NO: 909404 - protein, 1362 aa, Homo sapiens
MAPEPAPGRTMVPLVPALVMLGLVAGAHGDSKPVFIKVPEDQTGLSGGVASFVCQATGEPKPRITWMKKGKKVSSQRFEVIEFDDGAGSVLRIQPLRVQRDEAIYECTATNSLGEINTSAKLSVLEEEQLPPGFPSIDMGPQLKVVEKARTATMLCAAGGNPDPEISWFKDFLPVDPATSNGRIKQLRSGALQIESSEESDQGKYECVATNSAGTRYSAPANLYVRVRRVAPRFSIPPSSQEVMPGGSVNLTCVAVGAPMPYVKWMMGAEELTKEDEMPVGRNVLELSNVVRSANYTCVAISSLGMIEATAQVTVKALPKPPIDLVVTETTATSVTLTWDSGNSEPVTYYGIQYRAAGTEGPFQEVDGVATTRYSIGGLSPFSEYAFRVLAVNSIGRGPPSEAVRARTGEQAPSSPPRRVQARMLSASTMLVQWEPPEEPNGLVRGYRVYYTPDSRRPPNAWHKHNTDAGLLTTVGSLLPGITYSLRVLAFTAVGDGPPSPTIQVKTQQGVPAQPADFQAEVESDTRIQLSWLLPPQERIIMYELVYWAAEDEDQQHKVTFDPTSSYTLEDLKPDTLYRFQLAARSDMGVGVFTPTIEARTAQSTPSAPPQKVMCVSMGSTTVRVSWVPPPADSRNGVITQYSVAYEAVDGEDRGRHVVDGISREHSSWDLVGLEKWTEYRVWVRAHTDVGPGPESSPVLVRTDEDVPSGPPRKVEVEPLNSTAVHVYWKLPVPSKQHGQIRGYQVTYVRLENGEPRGLPIIQDVMLAEAQETTISGLTPETTYSVTVAAYTTKGDGARSKPKIVTTTGAVPGRPTMMISTTAMNTALLQWHPPKELPGELLGYRLQYCRADEARPNTIDFGKDDQHFTVTGLHKGTTYIFRLAAKNRAGLGEEFEKEIRTPEDLPSGFPQNLHVTGLTTSTTELAWDPPVLAERNGRIISYTVVFRDINSQQELQNITTDTRFTLTGLKPDTTYDIKVRAWTSKGSGPLSPSIQSRTMPVEQVFAKNFRVAAAMKTSVLLSWEVPDSYKSAVPFKILYNGQSVEVDGHSMRKLIADLQPNTEYSFVLMNRGSSAGGLQHLVSIRTAPDLLPHKPLPASAYIEDGRFDLSMPHVQDPSLVRWFYIVVVPIDRVGGSMLTPRWSTPEELELDELLEAIEQGGEEQRRRRRQAERLKPYVAAQLDVLPETFTLGDKKNYRGFYNRPLSPDLSYQCFVLASLKEPMDQKRYASSPYSDEIVVQVTPAQQQEEPEMLWVTGPVLAVILIILIVIAILLFKRKRTHSPSSKDEQSIGLKDSLLAHSSDPVEMRRLNYQTPGMRDHPPIPITDLADNIERLKANDGLKFSQEYESIDLTASPLERYDS

SEQ ID NO: 909405 - protein, 464 aa, Homo sapiens
MAPEPAPGRTMVPLVPALVMLGLVAGAHGDSKPVFIKVPEDQTGLSGGVASFVCQATGEPKPRITWMKKGKKVSSQRFEVIEFDDGAGSVLRIQPLRVQRDEAIYECTATNSLGEINTSAKLSVLEEEQLPPGFPSIDMGPQLKVVEKARTATMLCAAGGNPDPEISWFKDFLPVDPATSNGRIKQLRSGALQIESSEESDQGKYECVATNSAGTRYSAPANLYVRGKDSGSAWPLSPQSCAAPAGLSAQSPWCRHARDCHGPSLFSFLLLSAAAATAPTGQVPGVCHYFAFLPCRPMGKQPLLGAFVSFVGLAAWARSPMGIWSHPIRLLGVCACVCAHTGTLICVKCMHTWPGFPSVHPPACRSMVGSRTTMALGFGVVRPQERTRPGEPILWPGLPGAFLEEPLCSAVSPCGYVASGEHLVCSRCSLLGASGQCAFWKSKFPAERNLGTVLGFPISAMLTA

SEQ ID NO: 909406 - protein, 1049 aa, Homo sapiens; identical to SEQ ID NO: 909389

SEQ ID NO: 909407 - protein, 592 aa, Homo sapiens
AEFQQSASCRRLRGGGGPGTPGRGGALLASLLPPCRTPPDPPAGPRRCTRPLLSPPGKLSAPPRPSPVIRRGSSPATPPQGLLPTSRPAAPATAGSRNMSTTLLSAFYDVDFLCKTEKSLANLNLNNMLDKKAVGTPVAAAPSSGFAPGFLRRHSASNLHALAHPAPSPGSCSPKFPGAANGSSCGSAAAGGPTSYGTLKEPSGGGGTALLNKENKFRDRSFSENGDRSQHLLHLQQQQKGGGGSQINSTRYKTELCRPFEESGTCKYGEKCQFAHGFHELRSLTRHPKYKTELCRTFHTIGFCPYGPRCHFIHNADERRPAPSGGASGDLRAFGTRDALHLGFPREPRPKLHHSLSFSGFPSGHHQPPGGLESPLLLDSPTSRTPPPPSCSSASSCSSSASSCSSASAASTPSGAPTCCASAAAAAAAALLYGTGGAEDLLAPGAPCAACSSASCANNAFAFGPELSSLITPLAIQTHNFAAVAAAAYYRSQQQQQQQGLAPPAQPPAPPSATLPAGAAAPPSPPFSFQLPRRLSDSPVFDAPPSPPDSLSDRDSYLSGSLSSGSLSGSESPSLDPGRRLPIFSRLSISDD

SEQ ID NO: 909408 - protein, 593 aa, Homo sapiens
SGVPAVRELPSAPRGGRAGHPGARRSAPRFSPSPLPHSAGPSRRPAPLHSPSPLVRAGPKGVAVSASVDREKEAAERLAHKAIGAGLGARAACAVGSRNMSTTLLSAFYDVDFLCKTEKSLANLNLNNMLDKKAVGTPVAAAPSSGFAPGFLRRHSASNLHALAHPAPSPGSCSPKFPGAANGSSCGSAAAGGPTSYGTLKEPSGGGGTALLNKENKFRDRSFSENGDRSQHLLHLQQQQKGGGGSQINSTRYKTELCRPFEESGTCKYGEKCQFAHGFHELRSLTRHPKYKTELCRTFHTIGFCPYGPRCHFIHNADERRPAPSGGASGDLRAFGTRDALHLGFPREPRPKLHHSLSFSGFPSGHHQPPGGLESPLLLDSPTSRTPPPPSCSSASSCSSSASSCSSASAASTPSGAPTCCASAAAAAAAALLYGTGGAEDLLAPGAPCAACSSASCANNAFAFGPELSSLITPLAIQTHNFAAVAAAAYYRSQQQQQQQGLAPPAQPPAPPSATLPAGAAAPPSPPFSFQLPRRLSDSPVFDAPPSPPDSLSDRDSYLSGSLSSGSLSGSESPSLDPGRRLPIFSRLSISDD

SEQ ID NO: 909409 - protein, 592 aa, Homo sapiens; identical to SEQ ID NO: 909407

SEQ ID NO: 909410 - protein, 592 aa, Homo sapiens; identical to SEQ ID NO: 909407

SEQ ID NO: 909411 - protein, 592 aa, Homo sapiens; identical to SEQ ID NO: 909407

SEQ ID NO: 909412 - protein, 592 aa, Homo sapiens; identical to SEQ ID NO: 909407

SEQ ID NO: 909413 - protein, 579 aa, Homo sapiens
AEFQQSASCRRLRGGGGPGTPGRGGALLASLLPPCRTPPDPPAGPRRCTRPLLSPPGKLSAPPRPSPVIRRGSSPATPPQGLLPTSRPAAPATAGSRNMSTTLLSAFYDVDFLCKTEKSLANLNLNNMLDKKAVGTPVAAAPSSGFAPGFLRRHSASNLHALAHPAPSPGSCSPKFPGAANGSSCGSAAAGGPTSYGTLKEPSGGGGTALLNKENKFRDRSFSENGDRSQHLLHLQQQQKGGGGSQINSTRYKTELCRPFEESGTCKYGEKCQFAHGFHELRSLTRHPKYKTELCRTFHTIGFCPYGPRCHFIHNADERRPAPSGGASGDLRAFGTRDALHLGFPREPRPKLHHSLSFSGFPSGHHQPPGGLESPLLLDSPTSRTPPPPSCSSASSCSSSASSCSSASAASTPSGAPTCCASAAAAAAAALLYGTGGAEDLLAPGAPCAACSSASCANNAFAFGPELSSLITPLAIQTHNFAAVAAAAYYRSQQQQQQQGLAPPAQPPAPPSATLPAGAAAPPSPPFSFQLPRRLSDSPVFDAPPSPPLSSGSLSGSESPSLDPGRRLPIFSRLSISDD

SEQ ID NO: 909414 - protein, 542 aa, Homo sapiens
AEFQQSASCRRLRGGGGPGTPGRGGALLASLLPPCRTPPDPPAGPRRCTRPLLSPPGKLSAPPRPSPVIRRGSSPATPPQGLLPTSRPAAPATAGSRNMSTTLLSAFYDVDFLCKTEKSLANLNLNNMLDKKAVGTPVAAAPSSGFAPGFLRRHSASNLHALAHPAPSPGSCSPKFPGAANGSSCGSAAAGGPTSYGTLKEPSGGGGTALLNKENKFRDRSFSENGDRSQHLLHLQQQQKGGGGSQINSTRYKTELCRPFEESGTCKYGEKCQFAHGFHELRSLTRHPKYKTELCRTFHTIGFCPYGPRCHFIHNADERRPAPSGGASGDLRAFGTRDALHLGFPREPRPKLHHSLSFSGFPSGHHQPPGGLESPLLLDSPTSRTPPPPSCSSASSCSSSASSCSSASAASTPSGAPTCCASAAAAAAAALLYGTGGAEDLLAPGAPCAACSSASCANNAFAFGPELSSLITPTTAVSSSSSSRAWRPPRSRRRRPARPSPPGPPHLPRRPSASSCRAACPTRPCSTRPPAPRTRCRTATAT

SEQ ID NO: 909415 - protein, 528 aa, Homo sapiens
AEFQQSASCRRLRGGGGPGTPGRGGALLASLLPPCRTPPDPPAGPRRCTRPLLSPPGKLSAPPRPSPVIRRGSSPATPPQGLLPTSRPAAPATAGSRNMSTTLLSAFYDVDFLCKTEKSLANLNLNNMLDKKAVGTPVAAAPSSGFAPGFLRRHSASNLHALAHPAPSPGSCSPKFPGAANGSSCGSAAAGGPTSYGTLKEPSGGGGTALLNKENKFRDRSFSENGDRSQHLLHLQQQQKGGGGSQINSTRYKTELCRPFEESGTCKYGEKCQFAHGFHELRSLTRHPKYKTELCRTFHTIGFCPYGPRCHFIHNADERRPAPSGGASGDLRAFGTRDALHLGFPREPRPKLHHSLSFSGFPSGHHQPPGGLESPLLLDSPTSRTPPPPSCSSASSCSSSASSCSSASAASTPSGAPTCCASAAAAAAAALLYGTGGAEDLLAPGAPCAACSSASCANNAFAFGPELSSLITPLAIQTHNFAAVAAAASAAPPVRLARVRRAPQPPGLAVGPRQLPKRLPELRQPQRL

SEQ ID NO: 909416 - protein, 493 aa, Homo sapiens
AEFQQSASCRRLRGGGGPGTPGRGGALLASLLPPCRTPPDPPAGPRRCTRPLLSPPGKLSAPPRPSPVIRRGSSPATPPQGLLPTSRPAAPATAGSRNMSTTLLSAFYDVDFLCKTEKSLANLNLNNMLDKKAVGTPVAAAPSSGFAPGFLRRHSASNLHALAHPAPSPGSCSPKFPGAANGSSCGSAAAGGPTSYGTLKEPSGGGGTALLNKENKFRDRSFSENGDRSQHLLHLQQQQKGGGGSQINSTRYKTELCRPFEESGTCKYGEKCQFAHGFHELRSLTRHPKYKTELCRTFHTIGFCPYGPRCHFIHNADERRPAPSGGASGDLRAFGTRDALHLGFPREPRPKLHHSLSFSGFPSGHHQPPGGLESPLLLDSPTSRTPPPPSCSSASSCSSSASSCSSASAASTPSGAPTCCASAAAAAAAALLYGTGGAEDLLAPGAPCAACSSASCANNAFALSSGSLSGSESPSLDPGRRLPIFSRLSISDD

SEQ ID NO: 909417 - protein, 482 aa, Homo sapiens
AEFQQSASCRRLRGGGGPGTPGRGGALLASLLPPCRTPPDPPAGPRRCTRPLLSPPGKLSAPPRPSPVIRRGSSPATPPQGLLPTSRPAAPATAGSRNMSTTLLSAFYDVDFLCKTEKSLANLNLNNMLDKKAVGTPVAAAPSSGFAPGFLRRHSASNLHALAHPAPSPGSCSPKFPGAANGSSCGSAAAGGPTSYGTLKEPSGGGGTALLNKENKFRDRSFSENGDRSQHLLHLQQQQKGGGGSQINSTRYKTELCRPFEESGTCKYGEKCQFAHGFHELRSLTRHPKYKTELCRTFHTIGFCPYGPRCHFIHNADERRPAPSGGASGDLRAFGTRDALHLGFPREPRPKLHHSLSFSGFPSGHHQPPGGLESPLLLDSPTSRTPPPPSCSSASSCSSSALPQSAAAAAAGPGAPRAAAGAAQRDPPRRGRRTSLAALQLPAAAPPVRLARVRRAPQPPGLAVGPRQLPKRLPELRQPQRL

SEQ ID NO: 909418 - protein, 592 aa, Homo sapiens; identical to SEQ ID NO: 909407

SEQ ID NO: 909419 - protein, 129 aa, Homo sapiens
AEFQQSASCRRLRGGGGPGTPGRGGALLASLLPPCRTPPDPPAGPRRCTRPLLSPPGKLSAPPRPSPVIRRGSSPATPPQGLLPTSRPAAPATAGSRNMSTTLLSAFYDVDFLCKTEKSLANLNLNNLP

SEQ ID NO: 909420 - protein, 152 aa, Homo sapiens
MSTTLLSAFYDVDFLCKVGQGAGPAGSSRCSSWTLPLSPGSGGRPSRPAFQVGKVPGFAKECPSALEAGRAARRAPVSRLSFSTADRGHAARGFPDRLRAAHLGSRGGGSRVETQRGPRWASSPLPLRPARSCWFCACIGGGWRPSRDPPRV

SEQ ID NO: 909421 - protein, 494 aa, Homo sapiens
MSTTLLSAFYDVDFLCKTEKSLANLNLNNMLDKKAVGTPVAAAPSSGFAPGFLRRHSASNLHALAHPAPSPGSCSPKFPGAANGSSCGSAAAGGPTSYGTLKEPSGGGGTALLNKENKFRDRSFSENGDRSQHLLHLQQQQKGGGGSQINSTRYKTELCRPFEESGTCKYGEKCQFAHGFHELRSLTRHPKYKTELCRTFHTIGFCPYGPRCHFIHNADERRPAPSGGASGDLRAFGTRDALHLGFPREPRPKLHHSLSFSGFPSGHHQPPGGLESPLLLDSPTSRTPPPPSCSSASSCSSSASSCSSASAASTPSGAPTCCASAAAAAAAALLYGTGGAEDLLAPGAPCAACSSASCANNAFAFGPELSSLITPLAIQTHNFAAVAAAAYYRSQQQQQQQGLAPPAQPPAPPSATLPAGAAAPPSPPFSFQLPRRLSDSPVFDAPPSPPDSLSDRDSYLSGSLSSGSLSGSESPSLDPGRRLPIFSRLSISDD

SEQ ID NO: 909422 - protein, 592 aa, Homo sapiens; identical to SEQ ID NO: 909407

SEQ ID NO: 909423 - protein, 531 aa, Homo sapiens
AEFQQSASCRRLRGGGGPGTPGRGGALLASLLPPCRTPPDPPAGPRRCTRPLLSPPGKLSAPPRPSPVIRRGSSPATPPQGLLPTSRPAAPATAGSRNMSTTLLSAFYDVDFLCKTEKSLANLNLNNMLDKKAVGTPVAAAPSSGFAPGFLRRHSASNLHALAHPAPSPGSCSPKFPGAANGSSCGSAAAGGPTSYGTLKEPSGGGGTALLNKENKFRDRSFSENGDRSQHLLHLQQQQKGGGGSQINSTRYKTELCRPFEESGTCKYGEKCLWHARCVAPGLPAGAAAQAAPQPQLLGLPVGPPSAPGRPRVAAAARQPHVAHAAAALLLFGLVLLLLRLLLFLGLRGLHALGRPDMLRLRGGRAAAALLYGTGGAEDLLAPGAPCAACSSASCANNAFAFGPELSSLITPLAIQTHNFAAVAAAAYYRSQQQQQQQGLAPPAQPPAPPSATLPAGAAAPPSPPFSFQLPRRLSDSPVFDAPPSPPDSLSDRDSYLSGSLSSGSLSGSESPSLDPGRRLPIFSRLSISDD

SEQ ID NO: 909424 - protein, 592 aa, Homo sapiens; identical to SEQ ID NO: 909407

SEQ ID NO: 909425 - protein, 592 aa, Homo sapiens; identical to SEQ ID NO: 909407

SEQ ID NO: 909426 - protein, 566 aa, Homo sapiens
AEFQQSASCRRLRGGGGPGTPGRGGALLASLLPPCRTPPDPPAGPRRCTRPLLSPPGKLSAPPRPSPVIRRGSSPATPPQGLLPTSRPAAPATAGSRNMSTTLLSAFYDVDFLCKTEKSLANLNLNNMLDKKAVGTPVAAAPSSGFAPGFLRRHSASNLHALAHPAPSPGSCSPKFPGAANGSSCGSAAAGGPTSYGTLKEPSGGGGTALLNKENKFRDRSFSENGDRSQHLLHLQQQQKGGGGSQINSTRYKTELCRPFEESGTCKYGEKCQFAHGFHELRSLTRHPKYKTELCRTFHTIGFCPYGPRCHFIHNADERRPAPSGGASGDLRAFGTRDALHLGFPREPRPKLHHSLSFSGFPSGHHQPPGGLESPLLLDSPTSRTPPPPSCSSASSCSSSASSCSSASAASTPSGAPTCCASAAAAAAAALLYGTGGAEDLLAPGAPCAACSSASCANNAFAFGPELSSLITPLAIQTHNFAAVAAAAYYRSQQQQQQQGLAPPAQPPAPPSATLPAGAAAPPSPPFSFQLPRRLSDSPVFDAPPSPPLDPGRRLPIFSRLSISDD

SEQ ID NO: 909427 - protein, 522 aa, Homo sapiens
AEFQQSASCRRLRGGGGPGTPGRGGALLASLLPPCRTPPDPPAGPRRCTRPLLSPPGKLSAPPRPSPVIRRGSSPATPPQGLLPTSRPAAPATAGSRNMSTTLLSAFYDVDFLCKTEKSLANLNLNNMLDKKAVGTPVAAAPSSGFAPGFLRRHSASNLHALAHPAPSPGSCSPKFPGAANGSSCGSAAAGGPTSYGTLKEPSGGGGTALLNKENKFRDRSFSENGDRSQHLLHLQQQQKGGGGSQINSTRYKTELCRPFEESGTCKYGEKCQFAHGFHELRSLTRHPKYKTELCRTFHTIGFCPYGPRCHFIHNADERRPAPSGGASGDLRAFGTRDALHLGFPREPRPKLHHSLSFSGFPSGHHQPPGGLESPLLLDSPTSRTPPPPSCSSASSCSSSASSCSSASAASTPSGAPTCCASAAAAAAAALLYGTGGAEDLLAPGAPCAACSSASCANNAFAFGPELSSLITPLAIQTHNFAAVAAAAYYRSQQQQQQQGLAPPAQPPAPPSATLPAGAAAP

SEQ ID NO: 909428 - protein, 502 aa, Homo sapiens
AEFQQSASCRRLRGGGGPGTPGRGGALLASLLPPCRTPPDPPAGPRRCTRPLLSPPGKLSAPPRPSPVIRRGSSPATPPQGLLPTSRPAAPATAGSRNMSTTLLSAFYDVDFLCKTEKSLANLNLNNMLDKKAVGTPVAAAPSSGFAPGFLRRHSASNLHALAHPAPSPGSCSPKFPGAANGSSCGSAAAGGPTSYGTLKEPSGGGGTALLNKENKFRDRSFSENGDRSQHLLHLQQQQKGGGGSQINSTRYKTELCRPFEESGTCKYGEKCQFAHGFHELRSLTRHPKYKTELCRTFHTIGFCPYGPRCHFIHNADERRPAPSGGASGDLRAFGTRDALHLGFPREPRPKLHHSLSFSGFPSGHHQPPGGLESPLLLDSPTSRTPPPPSCSSASSCSSSASSCSSASAASTPSGAPTCCASAAAAAAAALLYGTGGAEDLLAPGAPCAACSSASCANNAFAFGPELSSLITPLAIQTHNFAAVAAAASSTSSYQPPFHLFT

SEQ ID NO: 909429 - protein, 224 aa, Homo sapiens
SSRCSSWTLPLSPGSGGRPSRPAFQVGKVPGFAKECPSALEAGRAARRAPVSRLSFSTADRGHAARGFPDRLRAAHLGSRGGGSRVETQRGPRWASSPLPLLQMWEPFSWKKFLIVSQTGVNKPASRHLAKPISFLKSNIFCQEYALIVSPQPIGVFCFLTELYMSGGEKTLAFQRSILVTWFHCHHLVDVQFRTILSAPSGSLAQSLLCNCWRITAEFLAVLS

SEQ ID NO: 909430 - protein, 129 aa, Homo sapiens; identical to SEQ ID NO: 909419

SEQ ID NO: 909431 - protein, 488 aa, Homo sapiens
ASGDWSVRAEVCATRAGSLPESFPGRGPCGGCVSAWPGQALVLPGRRARGGRGLGWPPAQALDGSRMGKAKVPASKRAPSSPVAKPGPVKTLTRKKNKKKKRFWKSKAREVSKKPASGPGAVVRPPKAPEDFSQNWKALQEWLLKQKSQAPEKPLVISQMGSKKKPKIIQQNKKETSPQVKGEEMPAGKDQEASRGSVPSGSKMDRRAPVPRTKASGTEHNKKGTKERTNGDIVPERGDIEHKKRKAKEAAPAPPTEEDIWFDDVDPADIEAAIGPEAAKIARKQLGQSEGSVSLSLVKEQAFGGLTRALALDCEMVGVGPKGEESMAARVSIVNQYGKCVYDKYVKPTEPVTDYRTAVSGIRPENLKQGEELEVVQKEVAEMLKGRILVGHALHNDLKVLFLDHPKKKIRDTQKYKPFKSQVKSGRPSLRLLSEKILGLQVQQAEHCSIQDAQAAMRLYVMVKKEWESMARDRRPLLTAPDHCSDDA

SEQ ID NO: 909432 - protein, 285 aa, Homo sapiens
MDRRAPVPRTKASGTEHNKKGTKERTNGDIVPERGDIEHKKRKAKEAAPAPPTEEDIWFDDVDPADIEAAIGPEAAKIARKQLGQSEGSVSLSLVKEQAFGGLTRALALDCEMVGVGPKGEESMAARVSIVNQYGKCVYDKYVKPTEPVTDYRTAVSGIRPENLKQGEELEVVQKEVAEMLKGRILVGHALHNDLKVLFLDHPKKKIRDTQKYKPFKSQVKSGRPSLRLLSEKILGLQVQQAEHCSIQDAQAAMRLYVMVKKEWESMARDRRPLLTAPDHCSDDA

SEQ ID NO: 909433 - protein, 173 aa, Homo sapiens
MVGVGPKGEESMAARVSIVNQYGKCVYDKYVKPTEPVTDYRTAVSGIRPENLKQGEELEVVQKEVAEMLKGRILVGHALHNDLKVLFLDHPKKKIRDTQKYKPFKSQVKSGRPSLRLLSEKILGLQVQQAEHCSIQDAQAAMRLYVMVKKEWESMARDRRPLLTAPDHCSDDA

SEQ ID NO: 909434 - protein, 373 aa, Homo sapiens
ASGDWSVRAEVCATRAGSLPESFPGRGPCGGCVSAWPGQALVLPGRRARGGRGLGWPPAQALDGSRMGKAKVPASKRAPSSPVAKPGPVKTLTRKKNKKKKRFWKSKAREVSKKPASGPGAVVRPPKAPEDFSQNWKALQEWLLKQKSQAPEKPLVISQMGSKKKPKIIQQNKKETSPQVKGEEMPAGKDQEASRGSVPSGSKMDRRAPVPRTKASGTEHNKKGTKERTNGDIVPERGDIEHKKRKAKEAAPAPPTEEDIWFDDVDPADIEAAIGPEAAKIARKQLGQSEGSVSLSLVKEQAFGGLTRALALDCEMVGVGPKGEESMAARVSIVNQYGKCVYDKYVKPTEPVTDYRTAVSGIRPENLKQGEAM

SEQ ID NO: 909435 - protein, 488 aa, Homo sapiens; identical to SEQ ID NO: 909431

SEQ ID NO: 909436 - protein, 470 aa, Homo sapiens
ASGDWSVRAEVCATRAGSLPESFPGRGPCGGCVSAWPGQALVLPGRRARGGRGLGWPPAQALDGSRMGKAKVPASKRAPSSPVAKPGPVKTLTRKKNKKKKRFWKSKAREVSKKPASGPGAVVRPPKAPEDFSQNWKALQEMGSKKKPKIIQQNKKETSPQVKGEEMPAGKDQEASRGSVPSGSKMDRRAPVPRTKASGTEHNKKGTKERTNGDIVPERGDIEHKKRKAKEAAPAPPTEEDIWFDDVDPADIEAAIGPEAAKIARKQLGQSEGSVSLSLVKEQAFGGLTRALALDCEMVGVGPKGEESMAARVSIVNQYGKCVYDKYVKPTEPVTDYRTAVSGIRPENLKQGEELEVVQKEVAEMLKGRILVGHALHNDLKVLFLDHPKKKIRDTQKYKPFKSQVKSGRPSLRLLSEKILGLQVQQAEHCSIQDAQAAMRLYVMVKKEWESMARDRRPLLTAPDHCSDDA

SEQ ID NO: 909437 - protein, 173 aa, Homo sapiens; identical to SEQ ID NO: 909433

SEQ ID NO: 909438 - protein, 502 aa, Homo sapiens
MPLVKRNIEPRHLCRGALPEGITSELECVTNSTLAAIIRQLSSLSKHAEDIFGELFNEANNFYIRANSLQDRIDRLAVKVTQLDSTVEEVSLQDINMKKAFKSSTVQDQQVVSKNSIPNPVADIYNQSDKPPPLNILTPYRDDKKDGLKFYTDPSYFFDLWKEKMLQDTEDKRKEKRRQKEQKRIDGTTREVKKVRKARNRRQEWNMMAYDKELRPDNRLSQSVYHGASSEGSLSPDTRSHASDVTDYSYPATPNHSLHPQPVTPSYAAGDVPPHGPASQAAEHEYRPPSASARHMALNRPQQPPPPPPPQAPEGSQASAPMAPADYGMLPAQIIEYYNPSGPPPPPPPPVIPSAQTAFVSPLQMPMQPPFPASASSTHAAPPHPPSTGLLVTAPPPPGPPPPPPGPPGPGSSLSSSPMHGPPVAEAKRQEPAQPPISDARSDLLAAIRMGIQLKKVQEQREQEAKREPVVNDVATILSRRIAVEYSDSDDDSEFDENDWSD

SEQ ID NO: 909439 - protein, 433 aa, Homo sapiens
QKCTLKNDQKGKFYVVYIFLLSLQDINMKKAFKSSTVQDQQVVSKNSIPNPVADIYNQSDKPPPLNILTPYRDDKKDGLKFYTDPSYFFDLWKEKMLQDTEDKRKEKRRQKEQKRIDGTTREVKKVRKARNRRQEWNMMAYDKELRPDNRLSQSVYHGASSEGSLSPDTRSHASDVTDYSYPATPNHSLHPQPVTPSYAAGDVPPHGPASQAAEHEYRPPSASARHMALNRPQQPPPPPPPQAPEGSQASAPMAPADYGMLPAQIIEYYNPSGPPPPPPPPVIPSAQTAFVSPLQMPMQPPFPASASSTHAAPPHPPSTGLLVTAPPPPGPPPPPPGPPGPGSSLSSSPMHGPPVAEAKRQEPAQPPISDARSDLLAAIRMGIQLKKVQEQREQEAKREPVVNDVATILSRRIAVEYSDSDDDSEFDENDWSD

SEQ ID NO: 909440 - protein, 321 aa, Homo sapiens
MPLVKRNIEPRHLCRGALPEGITSELECVTNSTLAAIIRQLSSLSKHAEDIFGELFNEANNFYIRANSLQDRIDRLAVKVTQLDSTVEEVSLQDINMKKAFKSSTVQDQQVVSKNSIPNPVADIYNQSDKPPPLNILTPYRDDKKDGLKFYTDPSYFFDLWKEKMLQDTEDKRKEKRRQKEQKRIDGTTREVKKVRKARNRRQEWNMMAYDKELRPDNRLSQSVYHGASSEGSLSPDTRCVCVTAPSALMLGQLGTTWFYYHLKCINSFGVYMALDVLRFSLKIVYLYFDFEIILEDSVILHWVPLILENLSDLKCIVEFI

SEQ ID NO: 909441 - protein, 502 aa, Homo sapiens; identical to SEQ ID NO: 909438

SEQ ID NO: 909442 - protein, 260 aa, Homo sapiens
MPLVKRNIEPRHLCRGALPEGITSELECVTNSTLAAIIRQLSSLSKHAEDIFGELFNEANNFYIRANSLQDRIDRLAVKVTQLDSTVEEVSLQDINMKKAFKSSTVQDQQVVSKNSIPNPVADIYNQSDKPPPLNILTPYRDDKKDGLKFYTDPSYFFDLWKEKMLQDTEDKRKEKRRQKEQKRIDGTTREVKKVRKARNRRQEWNMMAYDKELRPDNRLSQSVYHGASSEGSLSPDTRSHASDVTDYSYPATPNHSSAE

SEQ ID NO: 909443 - protein, 187 aa, Homo sapiens
MPLVKRNIEPRHLCRGALPEGITSELECVTNSTLAAIIRQLSSLSKHAEDIFGELFNEANNFYIRANSLQDRIDRLAVKVTQLDSTVEEVSLQDINMKKAFKSSTVQDQQVVSKNSIPNPVADIYNQSDKPPPLNILTPYRDDKKDGLKFYTDPSYFFDLWKEKMLQDTEDKRKEKRRQKVNNFSMG

SEQ ID NO: 909444 - protein, 1531 aa, Homo sapiens
MEVSPLQPVNENMQVNKIKKNEDAKKRLSVERIYQKKTQLEHILLRPDTYIGSVELVTQQMWVYDEDVGINYREVTFVPGLYKIFDEILVNAADNKQRDPKMSCIRVTIDPENNLISIWNNGKGIPVVEHKVEKMYVPALIFGQLLTSSNYDDDEKKVTGGRNGYGAKLCNIFSTKFTVETASREYKKMFKQTWMDNMGRAGEMELKPFNGEDYTCITFQPDLSKFKMQSLDKDIVALMVRRAYDIAGSTKDVKVFLNGNKLPVKGFRSYVDMYLKDKLDETGNSLKVIHEQVNHRWEVCLTMSEKGFQQISFVNSIATSKGGRHVDYVADQIVTKLVDVVKKKNKGGVAVKAHQVKNHMWIFVNALIENPTFDSQTKENMTLQPKSFGSTCQLSEKFIKAAIGCGIVESILNWVKFKAQVQLNKKCSAVKHNRIKGIPKLDDANDAGGRNSTECTLILTEGDSAKTLAVSGLGVVGRDKYGVFPLRGKILNVREASHKQIMENAEINNIIKIVGLQYKKNYEDEDSLKTLRYGKIMIMTDQDQDGSHIKGLLINFIHHNWPSLLRHRFLEEFITPIVKVSKNKQEMAFYSLPEFEEWKSSTPNHKKWKVKYYKGLGTSTSKEAKEYFADMKRHRIQFKYSGPEDDAAISLAFSKKQIDDRKEWLTNFMEDRRQRKLLGLPEDYLYGQTTTYLTYNDFINKELILFSNSDNERSIPSMVDGLKPGQRKVLFTCFKRNDKREVKVAQLAGSVAEMSSYHHGEMSLMMTIINLAQNFVGSNNLNLLQPIGQFGTRLHGGKDSASPRYIFTMLSSLARLLFPPKDDHTLKFLYDDNQRVEPEWYIPIIPMVLINGAEGIGTGWSCKIPNFDVREIVNNIRRLMDGEEPLPMLPSYKNFKGTIEELAPNQYVISGEVAILNSTTIEISELPVRTWTQTYKEQVLEPMLNGTEKTPPLITDYREYHTDTTVKFVVKMTEEKLAEAERVGLHKVFKLQTSLTCNSMVLFDHVGCLKKYDTVLDILRDFFELRLKYYGLRKEWLLGMLGAESAKLNNQARFILEKIDGKIIIENKPKKELIKVLIQRGYDSDPVKAWKEAQQKVPDEEENEESDNEKETEKSDSVTDSGPTFNYLLDMPLWYLTKEKKDELCRLRNEKEQELDTLKRKSPSDLWKEDLATFIEELEAVEAKEKQDEQVGLPGKGGKAKGKKTQMAEVLPSPRGQRVIPRITIEMKAEAEKKNKKKIKNENTEGSPQEDGVELEGLKQRLEKKQKREPGTKTKKQTTLAFKPIKKGKKRNPWSDSESDRSSDESNFDVPPRETEPRRAATKTKFTMDLDSDEDFSDFDEKTDDEDFVPSDASPPKTKTSPKLSNKELKPQKSVVSDLEADDVKGSVPLSSSPPATHFPDETEITNPVPKKNVTVKKTAAKSQSSTSTTGAKKRAAPKGTKRDPALNSGVSQKPDPAKTKNRRKRKPSTSDDSDSNFEKIVSKAVTSKKSKGESDDFHMDFDSAVAPRAKSVRAKKPIKYLEESDEDDLF

SEQ ID NO: 909445 - protein, 1531 aa, Homo sapiens; identical to SEQ ID NO: 909444

SEQ ID NO: 909446 - protein, 1557 aa, Homo sapiens
MEVSPLQPVNENMQVNKIKKNEDAKKRLSVERIYQKKTQLEHILLRPDTYIGSVELVTQQMWVYDEDVGINYREVTFVPGLYKIFDEILVNAADNKQRDPKMSCIRVTIDPENNLISIWNNGKGIPVVEHKVEKMYVPALIFGQLLTSSNYDDDEKKVTGGRNGYGAKLCNIFSTKFTVETASREYKKMFKQTWMDNMGRAGEMELKPFNGEDYTCITFQPDLSKFKMQSLDKDIVALMVRRAYDIAGSTKDVKVFLNGNKLPVKGFRSYVDMYLKDKLDETGNSLKVIHEQVNHRWEVCLTMSEKGFQQISFVNSIATSKGGRHVDYVADQIVTKLVDVVKKKNKGGVAVKAHQVKNHMWIFVNALIENPTFDSQTKENMTLQPKSFGSTCQLSEKFIKAAHLYSRFLIDPFFPNMIPNMNLLVFKAIGCGIVESILNWVKFKAQVQLNKKCSAVKHNRIKGIPKLDDANDAGGRNSTECTLILTEGDSAKTLAVSGLGVVGRDKYGVFPLRGKILNVREASHKQIMENAEINNIIKIVGLQYKKNYEDEDSLKTLRYGKIMIMTDQDQDGSHIKGLLINFIHHNWPSLLRHRFLEEFITPIVKVSKNKQEMAFYSLPEFEEWKSSTPNHKKWKVKYYKGLGTSTSKEAKEYFADMKRHRIQFKYSGPEDDAAISLAFSKKQIDDRKEWLTNFMEDRRQRKLLGLPEDYLYGQTTTYLTYNDFINKELILFSNSDNERSIPSMVDGLKPGQRKVLFTCFKRNDKREVKVAQLAGSVAEMSSYHHGEMSLMMTIINLAQNFVGSNNLNLLQPIGQFGTRLHGGKDSASPRYIFTMLSSLARLLFPPKDDHTLKFLYDDNQRVEPEWYIPIIPMVLINGAEGIGTGWSCKIPNFDVREIVNNIRRLMDGEEPLPMLPSYKNFKGTIEELAPNQYVISGEVAILNSTTIEISELPVRTWTQTYKEQVLEPMLNGTEKTPPLITDYREYHTDTTVKFVVKMTEEKLAEAERVGLHKVFKLQTSLTCNSMVLFDHVGCLKKYDTVLDILRDFFELRLKYYGLRKEWLLGMLGAESAKLNNQARFILEKIDGKIIIENKPKKELIKVLIQRGYDSDPVKAWKEAQQKVPDEEENEESDNEKETEKSDSVTDSGPTFNYLLDMPLWYLTKEKKDELCRLRNEKEQELDTLKRKSPSDLWKEDLATFIEELEAVEAKEKQDEQVGLPGKGGKAKGKKTQMAEVLPSPRGQRVIPRITIEMKAEAEKKNKKKIKNENTEGSPQEDGVELEGLKQRLEKKQKREPGTKTKKQTTLAFKPIKKGKKRNPWSDSESDRSSDESNFDVPPRETEPRRAATKTKFTMDLDSDEDFSDFDEKTDDEDFVPSDASPPKTKTSPKLSNKELKPQKSVVSDLEADDVKGSVPLSSSPPATHFPDETEITNPVPKKNVTVKKTAAKSQSSTSTTGAKKRAAPKGTKRDPALNSGVSQKPDPAKTKNRRKRKPSTSDDSDSNFEKIVSKAVTSKKSKGESDDFHMDFDSAVAPRAKSVRAKKPIKYLEESDEDDLF

SEQ ID NO: 909447 - protein, 1573 aa, Homo sapiens
ARASLWPPVTGEALGLRSGRRPAWEPIFSIPGSGVIVERRKPLLVLSSEPVNENMQVNKIKKNEDAKKRLSVERIYQKKTQLEHILLRPDTYIGSVELVTQQMWVYDEDVGINYREVTFVPGLYKIFDEILVNAADNKQRDPKMSCIRVTIDPENNLISIWNNGKGIPVVEHKVEKMYVPALIFGQLLTSSNYDDDEKKVTGGRNGYGAKLCNIFSTKFTVETASREYKKMFKQTWMDNMGRAGEMELKPFNGEDYTCITFQPDLSKFKMQSLDKDIVALMVRRAYDIAGSTKDVKVFLNGNKLPVKGFRSYVDMYLKDKLDETGNSLKVIHEQVNHRWEVCLTMSEKGFQQISFVNSIATSKGGRHVDYVADQIVTKLVDVVKKKNKGGVAVKAHQVKNHMWIFVNALIENPTFDSQTKENMTLQPKSFGSTCQLSEKFIKAAIGCGIVESILNWVKFKAQVQLNKKCSAVKHNRIKGIPKLDDANDAGGRNSTECTLILTEGDSAKTLAVSGLGVVGRDKYGVFPLRGKILNVREASHKQIMENAEINNIIKIVGLQYKKNYEDEDSLKTLRYGKIMIMTDQDQDGSHIKGLLINFIHHNWPSLLRHRFLEEFITPIVKVSKNKQEMAFYSLPEFEEWKSSTPNHKKWKVKYYKGLGTSTSKEAKEYFADMKRHRIQFKYSGPEDDAAISLAFSKKQIDDRKEWLTNFMEDRRQRKLLGLPEDYLYGQTTTYLTYNDFINKELILFSNSDNERSIPSMVDGLKPGQRKVLFTCFKRNDKREVKVAQLAGSVAEMSSYHHGEMSLMMTIINLAQNFVGSNNLNLLQPIGQFGTRLHGGKDSASPRYIFTMLSSLARLLFPPKDDHTLKFLYDDNQRVEPEWYIPIIPMVLINGAEGIGTGWSCKIPNFDVREIVNNIRRLMDGEEPLPMLPSYKNFKGTIEELAPNQYVISGEVAILNSTTIEISELPVRTWTQTYKEQVLEPMLNGTEKTPPLITDYREYHTDTTVKFVVKMTEEKLAEAERVGLHKVFKLQTSLTCNSMVLFDHVGCLKKYDTVLDILRDFFELRLKYYGLRKEWLLGMLGAESAKLNNQARFILEKIDGKIIIENKPKKELIKVLIQRGYDSDPVKAWKEAQQKVPDEEENEESDNEKETEKSDSVTDSGPTFNYLLDMPLWYLTKEKKDELCRLRNEKEQELDTLKRKSPSDLWKEDLATFIEELEAVEAKEKQDEQVGLPGKGGKAKGKKTQMAEVLPSPRGQRVIPRITIEMKAEAEKKNKKKIKNENTEGSPQEDGVELEGLKQRLEKKQKREPGTKTKKQTTLAFKPIKKGKKRNPWSDSESDRSSDESNFDVPPRETEPRRAATKTKFTMDLDSDEDFSDFDEKTDDEDFVPSDASPPKTKTSPKLSNKELKPQKSVVSDLEADDVKGSVPLSSSPPATHFPDETEITNPVPKKNVTVKKTAAKSQSSTSTTGAKKRAAPKGTKRDPALNSGVSQKPDPAKTKNRRKRKPSTSDDSDSNFEKIVSKAVTSKKSKGESDDFHMDFDSAVAPRAKSVRAKKPIKYLEESDEDDLF

SEQ ID NO: 909448 - protein, 1090 aa, Homo sapiens
MYIFILGGRNSTECTLILTEGDSAKTLAVSGLGVVGRDKYGVFPLRGKILNVREASHKQIMENAEINNIIKIVGLQYKKNYEDEDSLKTLRYGKIMIMTDQDQDGSHIKGLLINFIHHNWPSLLRHRFLEEFITPIVKVSKNKQEMAFYSLPEFEEWKSSTPNHKKWKVKYYKGLGTSTSKEAKEYFADMKRHRIQFKYSGPEDDAAISLAFSKKQIDDRKEWLTNFMEDRRQRKLLGLPEDYLYGQTTTYLTYNDFINKELILFSNSDNERSIPSMVDGLKPGQRKVLFTCFKRNDKREVKVAQLAGSVAEMSSYHHGEMSLMMTIINLAQNFVGSNNLNLLQPIGQFGTRLHGGKDSASPRYIFTMLSSLARLLFPPKDDHTLKFLYDDNQRVEPEWYIPIIPMVLINGAEGIGTGWSCKIPNFDVREIVNNIRRLMDGEEPLPMLPSYKNFKGTIEELAPNQYVISGEVAILNSTTIEISELPVRTWTQTYKEQVLEPMLNGTEKTPPLITDYREYHTDTTVKFVVKMTEEKLAEAERVGLHKVFKLQTSLTCNSMVLFDHVGCLKKYDTVLDILRDFFELRLKYYGLRKEWLLGMLGAESAKLNNQARFILEKIDGKIIIENKPKKELIKVLIQRGYDSDPVKAWKEAQQKVPDEEENEESDNEKETEKSDSVTDSGPTFNYLLDMPLWYLTKEKKDELCRLRNEKEQELDTLKRKSPSDLWKEDLATFIEELEAVEAKEKQDEQVGLPGKGGKAKGKKTQMAEVLPSPRGQRVIPRITIEMKAEAEKKNKKKIKNENTEGSPQEDGVELEGLKQRLEKKQKREPGTKTKKQTTLAFKPIKKGKKRNPWSDSESDRSSDESNFDVPPRETEPRRAATKTKFTMDLDSDEDFSDFDEKTDDEDFVPSDASPPKTKTSPKLSNKELKPQKSVVSDLEADDVKGSVPLSSSPPATHFPDETEITNPVPKKNVTVKKTAAKSQSSTSTTGAKKRAAPKGTKRDPALNSGVSQKPDPAKTKNRRKRKPSTSDDSDSNFEKIVSKAVTSKKSKGESDDFHMDFDSAVAPRAKSVRAKKPIKYLEESDEDDLF

SEQ ID NO: 909449 - protein, 677 aa, Homo sapiens
PAEDEARTCNILGRPQLNETQGQAMGCPRLQPPLLPSYKNFKGTIEELAPNQYVISGEVAILNSTTIEISELPVRTWTQTYKEQVLEPMLNGTEKTPPLITDYREYHTDTTVKFVVKMTEEKLAEAERVGLHKVFKLQTSLTCNSMVLFDHVGCLKKYDTVLDILRDFFELRLKYYGLRKEWLLGMLGAESAKLNNQARFILEKIDGKIIIENKPKKELIKVLIQRGYDSDPVKAWKEAQQKVPDEEENEESDNEKETEKSDSVTDSGPTFNYLLDMPLWYLTKEKKDELCRLRNEKEQELDTLKRKSPSDLWKEDLATFIEELEAVEAKEKQDEQVGLPGKGGKAKGKKTQMAEVLPSPRGQRVIPRITIEMKAEAEKKNKKKIKNENTEGSPQEDGVELEGLKQRLEKKQKREPGTKTKKQTTLAFKPIKKGKKRNPWSDSESDRSSDESNFDVPPRETEPRRAATKTKFTMDLDSDEDFSDFDEKTDDEDFVPSDASPPKTKTSPKLSNKELKPQKSVVSDLEADDVKGSVPLSSSPPATHFPDETEITNPVPKKNVTVKKTAAKSQSSTSTTGAKKRAAPKGTKRDPALNSGVSQKPDPAKTKNRRKRKPSTSDDSDSNFEKIVSKAVTSKKSKGESDDFHMDFDSAVAPRAKSVRAKKPIKYLEESDEDDLF

SEQ ID NO: 909450 - protein, 1531 aa, Homo sapiens; identical to SEQ ID NO: 909444

SEQ ID NO: 909451 - protein, 1531 aa, Homo sapiens; identical to SEQ ID NO: 909444

SEQ ID NO: 909452 - protein, 507 aa, Homo sapiens
MEVSPLQPVNENMQVNKIKKNEDAKKRLSVERIYQKKTQLEHILLRPDTYIGSVELVTQQMWVYDEDVGINYREVTFVPGLYKIFDEILVNAADNKQRDPKMSCIRVTIDPENNLISIWNNGKGIPVVEHKVEKMYVPALIFGQLLTSSNYDDDEKKVTGGRNGYGAKLCNIFSTKFTVETASREYKKMFKQTWMDNMGRAGEMELKPFNGEDYTCITFQPDLSKFKMQSLDKDIVALMVRRAYDIAGSTKDVKVFLNGNKLPVKGFRSYVDMYLKDKLDETGNSLKVIHEQVNHRWEVCLTMSEKGFQQISFVNSIATSKGGRHVDYVADQIVTKLVDVVKKKNKGGVAVKAHQVKNHMWIFVNALIENPTFDSQTKENMTLQPKSFGSTCQLSEKFIKAAIGCGIVESILNWVKFKAQVQLNKKCSAVKHNRIKGIPKLDDANDAGGRNSTECTLILTEGDSAKTLAVSGLGVVGRDKYGVFPLRGKILNVREASHKQIMENAEN

SEQ ID NO: 909453 - protein, 433 aa, Homo sapiens
MEVSPLQPVNENMQVNKIKKNEDAKKRLSVERIYQKKTQLEHILLRPDTYIGSVELVTQQMWVYDEDVGINYREVTFVPGLYKIFDEILVNAADNKQRDPKMSCIRVTIDPENNLISIWNNGKGIPVVEHKVEKMYVPALIFGQLLTSSNYDDDEKKVTGGRNGYGAKLCNIFSTKFTVETASREYKKMFKQTWMDNMGRAGEMELKPFNGEDYTCITFQPDLSKFKMQSLDKDIVALMVRRAYDIAGSTKDVKVFLNGNKLPVKGFRSYVDMYLKDKLDETGNSLKVIHEQVNHRWEVCLTMSEKGFQQISFVNSIATSKGGRHVDYVADQIVTKLVDVVKKKNKGGVAVKAHQVKNHMWIFVNALIENPTFDSQTKENMTLQPKSFGSTCQLSEKFIKAAHLYSRFLIDPFFPNMIPNMNLLVFRPLAVVL

SEQ ID NO: 909454 - protein, 1531 aa, Homo sapiens; identical to SEQ ID NO: 909444

SEQ ID NO: 909455 - protein, 1531 aa, Homo sapiens; identical to SEQ ID NO: 909444

SEQ ID NO: 909456 - protein, 1531 aa, Homo sapiens; identical to SEQ ID NO: 909444

SEQ ID NO: 909457 - protein, 1512 aa, Homo sapiens
MEVSPLQPVNENMQVNKIKKNEDAKKRLSVERIYQKKTQLEHILLRPDTYIGSVELVTQQMWVYDEDVGINYREVTFVPGLYKIFDEILVNAADNKQRDPKMSCIRVTIDPENNLISIWNNGKGIPVVEHKVEKMYVPALIFGQLLTSSNYDDDEKKVTGGRNGYGAKLCNIFSTKFTVETASREYKKMFKQTWMDNMGRAGEMELKPFNGEDYTCITFQPDLSKFKMQSLDKDIVALMVRRAYDIAGSTKDVKVFLNGNKLPVKGFRSYVDMYLKDKLDETGNSLKVIHEQVNHRWEVCLTMSEKGFQQISFVNSIATSKGGRHVDYVADQIVTKLVDVVKKKNKGGVAVKAHQVKNHMWIFVNALIENPTFDSQTKENMTLQPKSFGSTCQLSEKFIKAAIGCGIVESILNWVKFKAQVQLNKKCSAVKHNRIKGIPKLDDANDAGGRNSTECTLILTEGDSAKTLAVSGLGVVGRDKYGVFPLRGKILNVREASHKQIMENAEINNIIKIVGLQYKKNYEDEDSLKTLRYGKIMIMTDQDQDGSHIKGLLINFIHHNWPSLLRHRFLEEFITPIVKVSKNKQEMAFYSLPEFEEWKSSTPNHKKWKVKYYKGLGTSTSKEAKEYFADMKRHRIQFKYSGPEDDAAISLAFSKKQIDDRKEWLTNFMEDRRQRKLLGLPEDYLYGQTTTYLTYNDFINKELILFSNSDNERSIPSMVDGLKPGQRKVLFTCFKRNDKREVKVAQLAGSVAEMSSYHHGEMSLMMTIINLAQNFVGSNNLNLLQPIGQFGTRLHGGKDSASPRYIFTMLSSLARLLFPPKDDHTLKFLYDDNQRVEPEWYIPIIPMVLINGAEGIGTGWSCKIPNFDVREIVNNIRRLMDGEEPLPMLPSYKNFKGTIEELAPNQYVISGEVAILNSTTIEISELPVRTWTQTYKEQVLEPMLNGTEKTPPLITDYREYHTDTTVKFVVKMTEEKLAEAERVGLHKVFKLQTSLTCNSMVLFDHVGCLKKYDTVLDILRDFFELRLKYYGLRKEWLLGMLGAESAKLNNQARFILEKIDGKIIIENKPKKELIKVLIQRGYDSDPVKAWKEAQQKVPDEEENEESDNEKETEKSDSVTDSGPTFNYLLDMPLWYLTKEKKDELCRLRNEKEQELDTLKRKSPSDLWKEDLATFIEELEAVEAKEKQDEQVGLPGKGGKAKGKKTQMAEVLPSPRGQRVIPRITIEMKAEAEKKNKKKIKNENTEGSPQEDGVELEGLKQRLEKKQKREPGTKTKKQTTLAFKPIKNNFDVPPRETEPRRAATKTKFTMDLDSDEDFSDFDEKTDDEDFVPSDASPPKTKTSPKLSNKELKPQKSVVSDLEADDVKGSVPLSSSPPATHFPDETEITNPVPKKNVTVKKTAAKSQSSTSTTGAKKRAAPKGTKRDPALNSGVSQKPDPAKTKNRRKRKPSTSDDSDSNFEKIVSKAVTSKKSKGESDDFHMDFDSAVAPRAKSVRAKKPIKYLEESDEDDLF

SEQ ID NO: 909458 - protein, 1531 aa, Homo sapiens; identical to SEQ ID NO: 909444

SEQ ID NO: 909459 - protein, 650 aa, Homo sapiens
EISMVVELRIATSPLSQSFHVLTGSSEISMVVELRIATSPLITELPVRTWTQTYKEQVLEPMLNGTEKTPPLITDYREYHTDTTVKFVVKMTEEKLAEAERVGLHKVFKLQTSLTCNSMVLFDHVGCLKKYDTVLDILRDFFELRLKYYGLRKEWLLGMLGAESAKLNNQARFILEKIDGKIIIENKPKKELIKVLIQRGYDSDPVKAWKEAQQKVPDEEENEESDNEKETEKSDSVTDSGPTFNYLLDMPLWYLTKEKKDELCRLRNEKEQELDTLKRKSPSDLWKEDLATFIEELEAVEAKEKQDEQVGLPGKGGKAKGKKTQMAEVLPSPRGQRVIPRITIEMKAEAEKKNKKKIKNENTEGSPQEDGVELEGLKQRLEKKQKREPGTKTKKQTTLAFKPIKKGKKRNPWSDSESDRSSDESNFDVPPRETEPRRAATKTKFTMDLDSDEDFSDFDEKTDDEDFVPSDASPPKTKTSPKLSNKELKPQKSVVSDLEADDVKGSVPLSSSPPATHFPDETEITNPVPKKNVTVKKTAAKSQSSTSTTGAKKRAAPKGTKRDPALNSGVSQKPDPAKTKNRRKRKPSTSDDSDSNFEKIVSKAVTSKKSKGESDDFHMDFDSAVAPRAKSVRAKKPIKYLEESDEDDLF

SEQ ID NO: 909460 - protein, 310 aa, Homo sapiens
RIPLLSESRCKKEEKKKIKNENTEGSPQEDGVELEGLKQRLEKKQKREPGTKTKKQTTLAFKPIKKGKKRNPWSDSESDRSSDESNFDVPPRETEPRRAATKTKFTMDLDSDEDFSDFDEKTDDEDFVPSDASPPKTKTSPKLSNKELKPQKSVVSDLEADDVKGSVPLSSSPPATHFPDETEITNPVPKKNVTVKKTAAKSQSSTSTTGAKKRAAPKGTKRDPALNSGVSQKPDPAKTKNRRKRKPSTSDDSDSNFEKIVSKAVTSKKSKGESDDFHMDFDSAVAPRAKSVRAKKPIKYLEESDEDDLF

SEQ ID NO: 909461 - protein, 1101 aa, Homo sapiens
MEVSPLQPVNENMQVNKIKKNEDAKKRLSVERIYQKKTQLEHILLRPDTYIGSVELVTQQMWVYDEDVGINYREVTFVPGLYKIFDEILVNAADNKQRDPKMSCIRVTIDPENNLISIWNNGKGIPVVEHKVEKMYVPALIFGQLLTSSNYDDDEKKVTGGRNGYGAKLCNIFSTKFTVETASREYKKMFKQTWMDNMGRAGEMELKPFNGEDYTCITFQPDLSKFKMQSLDKDIVALMVRRAYDIAGSTKDVKVFLNGNKLPVKGFRSYVDMYLKDKLDETGNSLKVIHEQVNHRWEVCLTMSEKGFQQISFVNSIATSKGGRHVDYVADQIVTKLVDVVKKKNKGGVAVKAHQVKNHMWIFVNALIENPTFDSQTKENMTLQPKSFGSTCQLSEKFIKAAIGCGIVESILNWVKFKAQVQLNKKCSAVKHNRIKGIPKLDDANDAGGRNSTECTLILTEGDSAKTLAVSGLGVVGRDKYGVFPLRGKILNVREASHKQIMENAEINNIIKIVGLQYKKNYEDEDSLKTLRYGKIMIMTDQDQDGSHIKGLLINFIHHNWPSLLRHRFLEEFITPIVKVSKNKQEMAFYSLPEFEEWKSSTPNHKKWKVKYYKGLGTSTSKEAKEYFADMKRHRIQFKYSGPEDDAAISLAFSKKQIDDRKEWLTNFMEDRRQRKLLGLPEDYLYGQTTTYLTYNDFINKELILFSNSDNERSIPSMVDGLKPGQRKVLFTCFKRNDKREVKVAQLAGSVAEMSSYHHGEMSLMMTIINLAQNFVGSNNLNLLQPIGQFGTRLHGGKDSASPRYIFTMLSSLARLLFPPKDDHTLKFLYDDNQRVEPEWYIPIIPMVLINGAEGIGTGWSCKIPNFDVREIVNNIRRLMDGEEPLPMLPSYKNFKGTIEELAPNQYVISGEVAILNSTTIEISELPVRTWTQTYKEQVLEPMLNGTEKTPPLITDYREYHTDTTVKFVVKMTEEKLAEAERVGLHKVFKLQTSLTCNSMVLFDHVGCLKKYDTVLDILRDFFELRLKYYGLRKEWLLGMLGAESAKLNNQARFILEKIDGKIIIGNKLEKFIKSDSEGNDRTVKAGRSRKVHEKNGGGEE

SEQ ID NO: 909462 - protein, 759 aa, Homo sapiens
MEVSPLQPVNENMQVNKIKKNEDAKKRLSVERIYQKKTQLEHILLRPDTYIGSVELVTQQMWVYDEDVGINYREVTFVPGLYKIFDEILVNAADNKQRDPKMSCIRVTIDPENNLISIWNNGKGIPVVEHKVEKMYVPALIFGQLLTSSNYDDDEKKVTGGRNGYGAKLCNIFSTKFTVETASREYKKMFKQTWMDNMGRAGEMELKPFNGEDYTCITFQPDLSKFKMQSLDKDIVALMVRRAYDIAGSTKDVKVFLNGNKLPVKGFRSYVDMYLKDKLDETGNSLKVIHEQVNHRWEVCLTMSEKGFQQISFVNSIATSKGGRHVDYVADQIVTKLVDVVKKKNKGGVAVKAHQVKNHMWIFVNALIENPTFDSQTKENMTLQPKSFGSTCQLSEKFIKAAHLYSRFLIDPFFPNMIPNMNLLVFKAIGCGIVESILNWVKFKAQVQLNKKCSAVKHNRIKGIPKLDDANDAGGRNSTECTLILTEGDSAKTLAVSGLGVVGRDKYGVFPLRGKILNVREASHKQIMENAEINNIIKIVGLQYKKNYEDEDSLKTLRYGKIMIMTDQDQDGSHIKGLLINFIHHNWPSLLRHRFLEEFITPIVKVSKNKQEMAFYSLPEFEEWKSSTPNHKKWKVKYYKGLGTSTSKEAKEYFADMKRHRIQFKYSGPEDDAAISLAFSKKQIDDRKEWLTNFMEDRRQRKLLGLPEDYLYGQTTTYLTYNDFINKELILFSNSDNPGGTIPLLLGGNGFWKTPGSKK

SEQ ID NO: 909463 - protein, 145 aa, Homo sapiens
HPAFVTGKPNAALWLSAWIMILEGGGVMNLNPGNNLLHQPPAWTDSYSTCNVSSGFFGGQWHEIHPQYWTKYQVWEWLQHLLDTNQLDANCIPFQEFDINGEHLCSMSLQEFTRAAGTAGQLLYSNLQHLKWNGDSLFLCLSLPC

SEQ ID NO: 909464 - protein, 300 aa, Homo sapiens
MILEGGGVMNLNPGNNLLHQPPAWTDSYSTCNVSSGFFGGQWHEIHPQYWTKYQVWEWLQHLLDTNQLDANCIPFQEFDINGEHLCSMSLQEFTRAAGTAGQLLYSNLQHLKWNGQCSSDLFQSTHNVIVKTEQTEPSIMNTWKDENYLYDTNYGSTVDLLDSKTFCRAQISMTTTSHLPVAESPDMKKEQDPPAKCHTKKHNPRGTHLWEFIRDILLNPDKNPGLIKWEDRSEGVFRFLKSEAVAQLWGKKKNNSSMTYEKLSRAMRYYYKREILERVDGRRLVYKFGKNARGWRENEN

SEQ ID NO: 909465 - protein, 277 aa, Homo sapiens
MILEGGGVMNLNPGNNLLHQPPAWTDSYSTCNVSSGFFGGQWHEIHPQYWTKYQVWEWLQHLLDTNQLDANCIPFQEFDINGEHLCSMSLQEFTRAAGTAGQLLYSNLQHLKWNGQCSSDLFQSTHNVIVKTEQTEPSIMNTWKDENYLYDTNYGSTVAESPDMKKEQDPPAKCHTKKHNPRGTHLWEFIRDILLNPDKNPGLIKWEDRSEGVFRFLKSEAVAQLWGKKKNNSSMTYEKLSRAMRYYYKREILERVDGRRLVYKFGKNARGWRENEN

SEQ ID NO: 909466 - protein, 743 aa, Homo sapiens
MCHVLLDFPCFSLVGCNSLCPLPLSLIFPEREFLPNIYFQGNCKLSQPCYMPSDAGLSFPLPQNFGQTMDVFLSEHESHIQMVSTYEVQQYLSSLMNCLLHWYLNVPSCECTIFEMYLPTPQMPTLFLLQKYIPLNKYMVSIYYDKVSEVIFEVIQRQVKQSVTSSIQFTKENKTALRDLYRKAEHDKAIRNTKHVSWREEDSEPLKQVGGIGNDFTGWSEFERWVGIQQELRGRTQAELKEQHREKTSYWLLEEELVKSLNAIARQLYTYISVGDEDYYKVTEEGSDIMIAIMTRLGQWDISPVSRSIIWTTLRKSKGIVEKRTLISGLIFSGKWSEFGGVCVCVCVCVCMYKREKMKRVSEREEEENDLGMDNKLINCRNDSNALAFMIFYFGGGGGMSSEHFSSLVLIQCPGVGSRLEEDMKMHFCSITHAGTYTDCGCVSEISGSQQYIPVSDTMARNSQGSLMRLLPVFAVSSGFFGGQWHEIHPQYWTKYQVWEWLQHLLDTNQLDANCIPFQEFDINGEHLCSMSLQEFTRAAGTAGQLLYSNLQHLKWNGQCSSDLFQSTHNVIVKTEQTEPSIMNTWKDENYLYDTNYGSTVDLLDSKTFCRAQISMTTTSHLPVAESPDMKKEQDPPAKCHTKKHNPRGTHLWEFIRDILLNPDKNPGLIKWEDRSEGVFRFLKSEAVAQLWGKKKNNSSMTYEKLSRAMRYYYKREILERVDGRRLVYKFGKNARGWRENEN

SEQ ID NO: 909467 - protein, 157 aa, Homo sapiens
MNTGKRNYYIHSRAQYLLDSKTFCRAQISMTTTSHLPVAESPDMKKEQDPPAKCHTKKHNPRGTHLWEFIRDILLNPDKNPGLIKWEDRSEGVFRFLKSEAVAQLWGKKKNNSSMTYEKLSRAMRYYYKREILERVDGRRLVYKFGKNARGWRENEN

SEQ ID NO: 909468 - protein, 217 aa, Homo sapiens
MEIMILEGGGVMNLNPGNNLLHQPPAWTDSYSTCNVSSGFFGGQWHEIHPQYWTKYQVWEWLQHLLDTNQLDANCIPFQEFDINGEHLCSMSLQEFTRAAGTAGQLLYSNLQHLKWNGQCSSDLFQSTHNVIVKTEQTEPSIMNTWKDENYLYDTNYGSTVDLLDSKTFCRAQISMTTTSHLPVAESPDMKKEQDSNSKTKNNNNKKSRSHGTCIHM

SEQ ID NO: 909469 - protein, 300 aa, Homo sapiens; identical to SEQ ID NO: 909464

SEQ ID NO: 909470 - protein, 303 aa, Homo sapiens
MEIMILEGGGVMNLNPGNNLLHQPPAWTDSYSTCNVSSGFFGGQWHEIHPQYWTKYQVWEWLQHLLDTNQLDANCIPFQEFDINGEHLCSMSLQEFTRAAGTAGQLLYSNLQHLKWNGQCSSDLFQSTHNVIVKTEQTEPSIMNTWKDENYLYDTNYGSTVDLLDSKTFCRAQISMTTTSHLPVAESPDMKKEQDPPAKCHTKKHNPRGTHLWEFIRDILLNPDKNPGLIKWEDRSEGVFRFLKSEAVAQLWGKKKNNSSMTYEKLSRAMRYYYKREILERVDGRRLVYKFGKNARGWRENEN

SEQ ID NO: 909471 - protein, 251 aa, Homo sapiens
MAVADGGEAAGCNLTSSYLDANCIPFQEFDINGEHLCSMSLQEFTRAAGTAGQLLYSNLQHLKWNGQCSSDLFQSTHNVIVKTEQTEPSIMNTWKDENYLYDTNYGSTVDLLDSKTFCRAQISMTTTSHLPVAESPDMKKEQDPPAKCHTKKHNPRGTHLWEFIRDILLNPDKNPGLIKWEDRSEGVFRFLKSEAVAQLWGKKKNNSSMTYEKLSRAMRYYYKREILERVDGRRLVYKFGKNARGWRENEN

SEQ ID NO: 909472 - protein, 350 aa, Homo sapiens
MNPRGLFQDFNPSKFLIYTCLLLFSVLLPLRLDGIIQWSYWAVFAPIWLWKLLVVAGASVGAGVWARNPRYRTEGEACVEFKAMLIAVGIHLLLLMFEVLVCDRVERGTHFWLLVFMPLFFVSPVSVAACVWGFRHDRSLELEILCSVNILQFIFIALKLDRIIHWPWLVVFVPLWILMSFLCLVVLYYIVWSLLFLRSLDVVAEQRRTHVTMAISWITIVVPLLTFEVLLVHRLDGHNTFSYVSIFVPLWLSLLTLMATTFRRKGGNHWWFGIRRDFCQFLLEIFPFLREYGNISYDLHHEDSEDAEETSVPEAPKIAPIFGKKARVVITQSPGKYVPPPPKLNIDMPD

SEQ ID NO: 909473 - protein, 350 aa, Homo sapiens; identical to SEQ ID NO: 909472

SEQ ID NO: 909474 - protein, 350 aa, Homo sapiens; identical to SEQ ID NO: 909472

SEQ ID NO: 909475 - protein, 350 aa, Homo sapiens; identical to SEQ ID NO: 909472

SEQ ID NO: 909476 - protein, 350 aa, Homo sapiens; identical to SEQ ID NO: 909472

SEQ ID NO: 909477 - protein, 350 aa, Homo sapiens; identical to SEQ ID NO: 909472

SEQ ID NO: 909478 - protein, 333 aa, Homo sapiens
MEDLEEDVRFIVDETLDFGGLSPSDSREEEDITVLVTPEKPLRRGLSHRSDPNAVAPAPQGVRLSLGPLSPEKLEEILDEANRLAAQLEQCALQDRESAGEGLGPRRVKPSPRRETFVLKDSPVRDLLPTVNSLTRSTPSPSSLTPRLRSNDRKGSVRALRATSGKRPSNMKRESPTCNLFPASKSPASSPLTRSTPPVRGRAGPSGRAAASPPTPIRSVLAPQPSTSNSQRLPRPQGAAAKSSSQLPIPSAIPRPASRMPLTSRSVPPGRGALPPDSLSTRKGLPRPSTAGHRVRESGHKVPVSQRLNLPVMGATRSNLQPPRKVAVPGPTR

SEQ ID NO: 909479 - protein, 317 aa, Homo sapiens
MEDLEEDVRFIVDETLDFGGLSPSDSREEEDITVLVTPEKPLRRGLSHRSDPNAVAPAPQGVRLSLGPLSPEKLEEILDEANRLAAQLEQCALQDRESAGEGLGPRRVKPSPRRETFVLKDSPVRDLLPTVNSLTRSTPSPSSLTPRLRSNDRKGSVRALRATSGKRPSNMKRESPTCNLFPASKSPASSPLTRSTPPVRGRAGPSGRAAASEETRAAKLRGAAAKSSSQLPIPSAIPRPASRMPLTSRSVPPGRGALPPDSLSTRKGLPRPSTAGHRVRESGHKVPVSQRLNLPVMGATRSNLQPPRKVAVPGPTR

SEQ ID NO: 909480 - protein, 310 aa, Homo sapiens
MEDLEEDVRFIVDETLDFGGLSPSDSREEEDITVLVTPEKPLRRGLSHRSDPNAVAPAPQGVRLSLGPLSPEKLEEILDEANRLAAQLEQCALQDRESAGEGLGPRRVKPSPRRETFVLKDSPVRDLLPTVNSLTRSTPSPSSLTPRLRSNDRKGSVRALRATSGKRPSNMKRESPTCNLFPASKSPASSPLTRSTPPVRGRAGPSGRAAASEETRAAKLRACQPNATHQPECATWQRCPTSGFSVNSKRASKTKHCRTQSAGKWTQGSCFPATKSSCHGCHSQQSAAPQESGSPRTYQVKRSGQQARLQ

SEQ ID NO: 909481 - protein, 333 aa, Homo sapiens; identical to SEQ ID NO: 909478

SEQ ID NO: 909482 - protein, 415 aa, Homo sapiens
MEDLEEDVRFIVDETLDFGGLSPSDSREEEDITVLVTPEKPLRRGLSHRSDPNAVAPAPQGVRLSLGPLSPEKLEEILDEANRLAAQLEQCALQDRESAGEGLGPRRVKPSPRRETFVLKDSPVRDLLPTVNSLTRSTPSPSSLTPRLRSNDRKGSVRALRATSGKRPSNMKRESPTCNLFPASKSPASSPLTRSTPPVRGRAGPSGRAAASEETRAAKLRVSGSGEFVGLTLKFLHPSPPGPPTPIRSVLAPQPSTSNSQRLPRPQGAAAKSSSQLPIPSAIPRPASRMPLTSRSVPPGRGALPPDSLSTRKGLPRPSTAGHRVRESGHKGKRSGGRMPALAQRVLTLPELSTVTTFAILIAIQLEDGETELQRGYGAGQSLSLSFQIPHGQGESTNPTLAPFIQYFFSRSVKL

SEQ ID NO: 909483 - protein, 333 aa, Homo sapiens; identical to SEQ ID NO: 909478

SEQ ID NO: 909484 - protein, 160 aa, Homo sapiens
MEDLEEDVRFIVDETLDFGGLSPSDRSHPLAICSLHPKAQHLLLLPDRLPQSGGEPGPVGEQQPAHPPPSDPSWPHSLLPATLNACPGRREQLLNLPVNCPFPRPSPGLPAECHSPAGVCHLAEVPYLRILCQLEKGFQDQALQDTECGKVDTRFLFPSD

SEQ ID NO: 909485 - protein, 310 aa, Homo sapiens; identical to SEQ ID NO: 909480

SEQ ID NO: 909486 - protein, 175 aa, Homo sapiens
MEDLEEDVRFIVDETLDFGGLSPSDSREEEDITVLVTPEKPLRRGLSHRSDPNAVAPAPQGVRLSLGPLSPEKLEEILDEANRLAAQLEQCALQDRESAGEGLGPRRVKPSPRRETFVLKDSPVRDLLPTVNSLTRSTPSPSSLTPRLRSNDRKGSVRALRATSGKRPSNMKRVS

SEQ ID NO: 909487 - protein, 139 aa, Homo sapiens
MEDLEEDVRFIVDETLDFGGLSPSDSREEEDITVLVTPEKPLRRGLSHRSDPNAVAPAPQGVRLSLGPLSPEKLEEILDEANRLAAQLEQCALQDRESAGEGLGPRRVKPSPRRETFVLKDSPVRDLLPTVNFSGLKED

SEQ ID NO: 909488 - protein, 98 aa, Homo sapiens
HEGCLEVGGAGLKAANRAIMSHKQIYYSDKYDDEEFEYRHVMLPKDIAKLVPKTHLMSESEWRNLGVQQSQGWVHYMIHEPEPHILLFRRPLPKKPKK

SEQ ID NO: 909489 - protein, 333 aa, Homo sapiens; identical to SEQ ID NO: 909478

SEQ ID NO: 909490 - protein, 363 aa, Homo sapiens
MEDLEEDVRFIVDETLDFGGLSPSDSREEEDITVLVTPEKPLRRGLSHRSDPNAVAPAPQGVRLSLGPLSPEKLEEILDEANRLAAQLEQCALQDRESAGEGLGPRRVKPSPRRETFVLKDSPVRDLLPTVNSLTRSTPSPSSLTPRLRSNDRKGSVRALRATSGKRPSNMKRESPTCNLFPASKSPASSPLTRSTPPVRGRAGPSGRAAASEETRAAKLRVSGSGEFVGLTLKFLHPSPPGPPTPIRSVLAPQPSTSNSQRLPRPQGAAAKSSSQLPIPSAIPRPASRMPLTSRSVPPGRGALPPDSLSTRKGLPRPSTAGHRVRESGHKVPVSQRLNLPVMGATRSNLQPPRKVAVPGPTR

SEQ ID NO: 909491 - protein, 333 aa, Homo sapiens; identical to SEQ ID NO: 909478

SEQ ID NO: 909492 - protein, 333 aa, Homo sapiens; identical to SEQ ID NO: 909478

SEQ ID NO: 909493 - protein, 333 aa, Homo sapiens; identical to SEQ ID NO: 909478

SEQ ID NO: 909494 - protein, 269 aa, Homo sapiens
MEDLEEDVRFIVDETLDFGGLSPSDSREEEDITVLVTPEKPLRRGLSHRSDPNAVAPAPQGVRLSLGPLSPEKLEEILDEANRLAAQLEQCALQDRESAGEGLGPRRVKPSPRRETFVLKDSPVRDLLPTVNSLTRSTPSPSSLTPRLRSNDRKGSVRALRATSGKRPSNMKRAHPPPSDPSWPHSLLPATLNACPGRREQLLNLPVNCPFPRPSPGLPAECHSPAGVCHLAEVPYLRILCQLEKGFQDQALQDTECGKVDTRFLFPSD

SEQ ID NO: 909495 - protein, 317 aa, Homo sapiens; identical to SEQ ID NO: 909479

SEQ ID NO: 909496 - protein, 205 aa, Homo sapiens
MEDLEEDVRFIVDETLDFGGLSPSDSREEEDITVLVTPEKPLRRGLSHRSDPNAVAPAPQGVRLSLGPLSPEKLEEILDEANRLAAQLEQCALQDRESAGEGLGPRRVKPSPRRETFVLKDSPVRDLLPTVNSLTRSTPSPSSLTPRLRSNDRKGSVRALRATSGKRPSNMKRSHHLQSVLIQKPDLLSYDDPSREAAMKTEGQR

SEQ ID NO: 909497 - protein, 139 aa, Homo sapiens; identical to SEQ ID NO: 909487

SEQ ID NO: 909498 - protein, 471 aa, Homo sapiens
MTGQARFHRGAEACRAIRQCRSRRPRAAHPEGRAGSGRGSRHASPGVRRGGFSLLLLNLEEYYFEQHRANHILHKGSHHERKIRGSLKICSKSVIFEPDSISQPIIKIPLRDCIKIGKHGENGANRHFTKAKSGGISLIFSQVYFIKEHNVVAPYKIERGKMEYVFELDVPGKVEDVVETLLQLHRASCLDKLGDQTAMITAILQSRLARTSFDKNRFQNISEKLHMECKAEMVTPLVTNPGHVCITDTNLYFQPLNGYPKPVVQITLQDVRRIYKRRHGLMPLGLEVFCTEDDLCSDIYLKFYEPQDRDDLYFYIATYLEHHVAEHTAESYMLQWQRGHLSNYQYLLHLNNLADRSCNDLSQYPVFPWIIHDYSSSELDLSNPGTFRDLSKPVGALNKERLERLLTRYQEMPEPKFMYGSHYSSPGYVLFYLVRIAPEYMLCLQNGRFDNADRMFNRFDTNALLIIFNTF

SEQ ID NO: 909499 - protein, 478 aa, Homo sapiens
MTGQARFHRGAEACRAIRQCRSRRPRAAHPEGRAGSGRGSRHASPGVRRGGFSLLLLNLEEYYFEQHRANHILHKGSHHERKIRGSLKICSKSVIFEPDSISQPIIKIPLRDCIKIGKHGENGANRHFTKAKSGGISLIFSQVYFIKEHNVVAPYKIERGKMEYVFELDVPGKVEDVVETLLQLHRASCLDKLGDQTAMITAILQSRLARTSFDKNRFQNISEKLHMECKAEMVTPLVTNPGHVCITDTNLYFQPLNGYPKPVVQITLQDVRRIYKRRHGLMPLGLEVFCTEDDLCSDIYLKFYEPQDRDDLYFYIATYLEHHVAEHTAESYMLQWQRGHLSNYQYLLHLNNLADRSCNDLSQYPVFPWIIHDYSSSELDLSNPGTFRDLSKPVGALNKERLERLLTRYQEMPEPKFMYGSHYSSPGYVLFYLVRIAPEYMLCLQNGRFDNADRMFNSYLANFGKKTGSWNGWQPGIF

SEQ ID NO: 909500 - protein, 310 aa, Homo sapiens
MEYVFELDVPGKVEDVVETLLQLHRASCLDKLGDQTAMITAILQSRLARTSFDKNRFQNISEKLHMECKAEMVTPLVTNPGHVCITDTNLYFQPLNGYPKPVVQITLQDVRRIYKRRHGLMPLGLEVFCTEDDLCSDIYLKFYEPQDRDDLYFYIATYLEHHVAEHTAESYMLQWQRGHLSNYQYLLHLNNLADRSCNDLSQYPVFPWIIHDYSSSELDLSNPGTFRDLSKPVGALNKERLERLLTRYQEMPEPKFMYGSHYSSPGYVLFYLVRIAPEYMLCLQNGRFDNADRMFNRFDTNALLIIFNTF

SEQ ID NO: 909501 - protein, 440 aa, Homo sapiens
MAFIRKKQQEQQLQLYSKERFSLLLLNLEEYYFEQHRANHILHKGSHHERKIRGSLKICSKSVIFEPDSISQPIIKIPLRDCIKIGKHGENGANRHFTKAKSGGISLIFSQVYFIKEHNVVAPYKIERGKMEYVFELDVPGKVEDVVETLLQLHRASCLDKLGDQTAMITAILQSRLARTSFDKNRFQNISEKLHMECKAEMVTPLVTNPGHVCITDTNLYFQPLNGYPKPVVQITLQDVRRIYKRRHGLMPLGLEVFCTEDDLCSDIYLKFYEPQDRDDLYFYIATYLEHHVAEHTAESYMLQWQRGHLSNYQYLLHLNNLADRSCNDLSQYPVFPWIIHDYSSSELDLSNPGTFRDLSKPVGALNKERLERLLTRYQEMPEPKFMYGSHYSSPGYVLFYLVRIAPEYMLCLQNGRFDNADRMFNRFDTNALLIIFNTF

SEQ ID NO: 909502 - protein, 524 aa, Homo sapiens
MTGQARFHRGAEACRAIRQCRSRRPRAAHPEGRAGSGRGSRHASPGVRRGGFSLLLLNLEEYYFEQHRANHILHKGSHHERKIRGSLKICSKSVIFEPDSISQPIIKIPLRDCIKIGKHGENGANRHFTKAKSGGISLIFSQVYFIKEHNVVAPYKIERGKMEYVFELDVPGKVEDVVETLLQLHRASCLDKLGDQTAMITAILQSRLARTSFDKNRFQNISEKLHMECKAEMVTPLVTNPGHVCITDTNLYFQPLNGYPKPVVQITLQDVRRIYKRRHGLMPLGLEVFCTEDDLCSDIYLKFYEPQDRDDLYFYIATYLEHHVAEHTAESYMLQWQRGHLSNYQYLLHLNNLADRSCNDLSQYPVFPWIIHDYSSSELDLSNPGTFRDLSKPVGALNKERLERLLTRYQEMPEPKFMYGSHYSSPGYVLFYLVRIAPEYMLCLQNGRFDNADRMFNSIAETWKNCLDGATDFKELIPEFYGDDVSFLVNSLKLDLGKRQGGQMVDDVELPPWASSPEDFLQKA

SEQ ID NO: 909503 - protein, 180 aa, Homo sapiens
MTGQARFHRGAEACRAIRQCRSRRPRAAHPEGRAGSGRGSRHASPGVRRGGFSLLLLNLEEYYFEQHRANHILHKGSHHERKIRGSLKICSKSVIFEPDSISQPIIKIPLRDCIKIGKHGENGANRHFTKAKSGGISLIFSQVYFIKEHNVVAPYKIERVSKAFHVFPAIYIVILNNKIL

SEQ ID NO: 909504 - protein, 80 aa, Homo sapiens
SGRAHGMWARLTALLYPQVCIPFDQANLDRQACQSGYRIQSSPNRLNRGRPSTTWAADGDFKIKVCGLVTGNQPSPVAPQ

SEQ ID NO: 909505 - protein, 102 aa, Homo sapiens
MACGLVASNLNLKPGECLRVRGEVAPDAKELRAEPGQRQQQPVPALQPSLPTPDGDRQNTIVCNSKGTAGPGGPKQREAVFPFPALGRCCRGVHHLFDQGQP

SEQ ID NO: 909506 - protein, 102 aa, Homo sapiens; identical to SEQ ID NO: 909505

SEQ ID NO: 909507 - protein, 102 aa, Homo sapiens; identical to SEQ ID NO: 909505

SEQ ID NO: 909508 - protein, 102 aa, Homo sapiens; identical to SEQ ID NO: 909505

SEQ ID NO: 909509 - protein, 102 aa, Homo sapiens; identical to SEQ ID NO: 909505

SEQ ID NO: 909510 - protein, 59 aa, Homo sapiens
MGGGYEQQAPLWPRNKRKQAKGGNTERSTHAAERDEPSRGQSRGDSKGEQMRAPKVRDD

SEQ ID NO: 909511 - protein, 122 aa, Homo sapiens
MACGLVASNLNLKPGECLRVRGEVAPDAKELRAEPGQRQQQPVPALQPSLPTPDGDRQNTIVCNSKGTAGPGGPKQREAVFPFPALGRCCRGVHHLRPADGDFKIKVCGLVTGNQPSPVAPQ

SEQ ID NO: 909512 - protein, 118 aa, Homo sapiens
MACGLVASNLNLKPGECLRVRGEVAPDAKELRAEPGQRQQQPVPALQPSLPTPDGDRQNTIVCNSKGTAGPGGPSSCRLSIPSALKCGEVCITFDRPPDRKLPDDIQSSHRFLRPYYC

SEQ ID NO: 909513 - protein, 101 aa, Homo sapiens
MACGLVASNLNLKPGECLRVRGEVAPDAKELRAEPGQRQQQPVPALQPSLPTPDGDRQNTIVCNSKGTAGPGGPTLDAVSGVGCSHALDAVSALMQSARDV

SEQ ID NO: 909514 - protein, 100 aa, Homo sapiens
MACGLVASNLNLKPGECLRVRGEVAPDAKELRAEPGQRQQQPVPALQPSLQTPDGDRQNTIVCNSKGTPKEQRPQKSKDSKRAKTPKEQRPKELRPHKSL

SEQ ID NO: 909515 - protein, 165 aa, Homo sapiens
MTARYEAGWLSLGWSLLTAGAPAREHPPGLNHGLWSGRQQPSFVLNLGKDSNNLCLHFNPRFQRPTAIAKTPSCATAKGRRGLGDRSSGRLSFPFQPWEGVAEVCITFDQANLDRQACQSGYRIQSSPNRLNRGRPSTTWAADGDFKIKVCGLVTGNQPSPVAPQ

SEQ ID NO: 909516 - protein, 102 aa, Homo sapiens; identical to SEQ ID NO: 909505

SEQ ID NO: 909517 - protein, 115 aa, Homo sapiens
MPGHNAQRARHEEQRQARENTEAPERRDRREAGKHGAARSTNTVDNRGHPRGDVSRHEPQSDRGRREQATDRENVNAATLKHTEERHRRQGEETISADMERRRDSGKADRRRRMN

SEQ ID NO: 909518 - protein, 102 aa, Homo sapiens; identical to SEQ ID NO: 909505

SEQ ID NO: 909519 - protein, 102 aa, Homo sapiens; identical to SEQ ID NO: 909505

SEQ ID NO: 909520 - protein, 102 aa, Homo sapiens; identical to SEQ ID NO: 909505

SEQ ID NO: 909521 - protein, 163 aa, Homo sapiens
MACGLVASNLNLKPGECLRVRGEVAPDAKELRAEPGQRQQQPVPALQPSLPTPDGDRQNTIVCNSKGTAGPGGPKQREAVFPFPALGRCCRGVHHLRPGATVTCQSLARLDTEFPKFIQIGLQPWEGHRTTIGSIDRSTFERSTMLWFFDLKDQPKSPLAPPK

SEQ ID NO: 909522 - protein, 112 aa, Homo sapiens
MACGLVASNLNLKPGECLRVRGEVAPDAKELRAEPGQRQQQPVPALQPSLPTPDGDRQNTIVCNSKGTAGPGGPKQREAVFPFPALGRCCRWAADRNRGPGTGAGWAGAGLG

SEQ ID NO: 909523 - protein, 114 aa, Homo sapiens
APENAEKLPGPETSCPGWALLGNLKPGECLRVRGEVAPDAKELRAEPGQRQQQPVPALQPSLPTPDGDRQNTIVCNSKGTAGPGGPKQREAVFPFPALGRCCRGVHHLFDQGQP

SEQ ID NO: 909524 - protein, 130 aa, Homo sapiens
MPTRYPSFVLNLGKDSNNLCLHFNPRFQRPTAIAKTPSCATAKGRRGLGDRSSGRLSFPFQPWEGVAEVCITFDQANLDRQACQSGYRIQSSPNRLNRGRPSTTWAADGDFKIKVCGLVTGNQPSPVAPQ

SEQ ID NO: 909525 - protein, 75 aa, Homo sapiens
AREREREREREREVCITFDQANLDRQACQSGYRIQSSPNRLNRGRPSTTWAADGDFKIKVCGLVTGNQPSPVAPQ

SEQ ID NO: 909526 - protein, 559 aa, Homo sapiens
LIEGRPAQVAGAKPQSGVGISRLGLGPRLLRDPPLGPSRSPRGSSGRLSWREKVDKSYFQEKMTFNSFEGSKTCVPADINKEEEFVEEFNRLKTFANFPSGSPVSASTLARAGFLYTGEGDTVRCFSCHAAVDRWQYGDSAVGRHRKVSPNCRFINGFYLENSATQSTNSGIQNGQYKVENYLGSRDHFALDRPSETHADYLLRTGQVVDISDTIYPRNPAMYSEEARLKSFQNWPDYAHLTPRELASAGLYYTGIGDQVQCFCCGGKLKNWEPCDRAWSEHRRHFPNCFFVLGRNLNIRSESDAVSSDRNFPNSTNLPRNPSMADYEARIFTFGTWIYSVNKEQLARAGFYALGEGDKVKCFHCGGGLTDWKPSEDPWEQHAKWYPGCKYLLEQKGQEYINNIHLTHSLEECLVRTTEKTPSLTRRIDDTIFQNPMVQEAIRMGFSFKDIKKIMEEKIQISGSNYKSLEVLVADLVNAQKDSMQDESSQTSLQKEISTEEQLRRLQEEKLCKICMDRNIAIVFVPCGHLVTCKQCAEAVDKCPMCYTVITFKQKIFMS

SEQ ID NO: 909527 - protein, 559 aa, Homo sapiens; identical to SEQ ID NO: 909526

SEQ ID NO: 909528 - protein, 147 aa, Homo sapiens
MVSRVRTTEKTPSLTRRIDDTIFQNPMVQEAIRMGFSFKDIKKIMEEKIQISGSNYKSLEVLVADLVNAQKDSMQDESSQTSLQKEISTEEQLRRLQEEKLCKICMDRNIAIVFVPCGHLVTCKQCAEAVDKCPMCYTVITFKQYPD

SEQ ID NO: 909529 - protein, 256 aa, Homo sapiens
LIEGRPAQVAGAKPQSGVGISRLGLGPRLLRDPPLGPSRSPRGSSGRLSWRGEGDKVKCFHCGGGLTDWKPSEDPWEQHAKWYPGCKYLLEQKGQEYINNIHLTHSLEECLVRTTEKTPSLTRRIDDTIFQNPMVQEAIRMGFSFKDIKKIMEEKIQISGSNYKSLEVLVADLVNAQKDSMQDESSQTSLQKEISTEEQLRRLQEEKLCKICMDRNIAIVFVPCGHLVTCKQCAEAVDKCPMCYTVITFKQKIFMS

SEQ ID NO: 909530 - protein, 990 aa, Homo sapiens
ANSFDDRFLVTAGADGNIFVFNIFSEFMLRKDMKAKVPSPRFGIETEPIPEDIEDPKAYSIENARRKREHDKLMKEVGEIKARKREQIKALRSEFCNLLEMNEKLPKHMQFKRTDFDVDSQIRAEMHRKTAFKIQQVEKELAWEKEKHELGLMKLKNRFRDPLESDTIVVHAILSDHKISSYRLVQPSKYSKFKRASQSERKPSKLDRFEKEGPGRKDSQRDAGGSVTIQEESIIEKGKKFRPKTLSEIIVENQIEKTRKLILKAERAQLKIQQRKKEWEELYKSKPGDDYEDPKDLQAIKEAQVYMGDFNLKTAPDYKIPEHMRINAAKKEEELGHLDSLVHGNKRHMNKCILSLRDLKVAVVEEIQCLVQELKNIQSTLHISKHIPIPKIPQIHPEEVPEKRFQYDEETLLNFKQQQMKSKDEKSPGVEQTGSGGPVGGFLKLSSRKDGDLTTRDSISRSSKASTFSLDIPKCLEFEKAEPTDVELEIMKRDEIKHVYMQQYLVNRIKELVVTFDAELRLLRHQKLKLDTQMKLSDLHHVTLFQEILLLKNFEKQENILQERVNSLDKEEQYMQWKINETLKEMEEKKNEITKLQEQEKALYAGFQAAIGENNKFANFLMKVLKKRIKRVKKKEVEGDADEDEESEESSEEESSLESDEDESESEDEVFDDSICPTNCDVALFELALHLREKRLDIEEALVEEKKIVDNLKKEYDTLSKKVKIVATNLNAAEEALEAYQREKQQRLNELLVVIPLKLHQIEYVVFGEIPSDLSGTLVFSNHALRRLQERIRELQEENSKQQKLNKEWRERRKQLIREKREMTKTIHKMEETVRQLMISKFGRVVNLEALQTLSVNTTLEELKIRKLRKELANAKEMKMWEEKIAQMRWELMMKTKEHTRKLYQMNDLCIEKKKLDSRLNTLQNQQGNAFQGPREADVVAREEVTELIQLQAERISALKEEIALLRRKGGLILPPIQSPREKEIQPADL

SEQ ID NO: 909531 - protein, 934 aa, Homo sapiens
ANSFDDRFLVTAGADGNIFVFNIFSEFMLRKDMKAKVPSPRFGIETEPIPEDIEDPKAYSIENARRKREHDKLMKEVGEIKARKREQIKALRSEFCNLLEMNEKLPKHMQFKRTDFDVDSQIRAEMHRKTAFKIQQVEKELAWEKEKHELGLMKLKNRFRDPLESDTIVVHAILSDHKISSYRLVQPSKYSKFKRASQSERKPSKLDRFEKEGPGRKDSQRDAGGSVTIQEESIIEKGKKFRPKTLSEIIVENQIEKTRKLILKAERAQLKIQQRKKEWEELYKSKPGDDYEDPKDLQAIKEAQVYMGDFNLKTAPDYKIPEHMRINAAKKEEELGHLDSLVHGNKRHMNKCILSLRDLKVAVVEEIQCLVQELKNIQSTLHISKHIPIPKIPQIHPEEVPEKRFQYDEETLLNFKQQQMKSKDEKSPGVEQTGSGGPVGGFLKLSSRKDGDLTTRDSISRSSKASTFSLDIPKCLEFEKAEPTDVELEIMKRDEIKHVYMQQYLVNRIKELVVTFDAELRLLRHQKLKLDTQMKLSDLHHVTLFQEILLLKNFEKQENILQERVNSLDKEEQYMQWKINETLKEMEEKKNEITKLQEQEKALYAGFQAAIGENNKFANFLMKVLKKRIKRVKKKEVEGDADEDEESEESSEEESSLESDEDESESEDEVFDDSICPTNCDVALFELALHLREKRLDIEEALVEEKKIVDNLKKEYDTLSKKVKIVATNLNAAEEALEAYQREKQQRLNELLVVIPLKLHQIEYVVFGEIPSDLSGTLVFSNHALRRLQERIRELQEENSKQQKLNKEWRERRKQLIREKREMTKTIHKMEETVRQLMISKFGRVVNLEALQTLSVNTTLEELKIRKLRKELANAKEMKMWEEKIAQMRWELMMKTKEHTRKLYQMNDLCIEKKKLDSRLNTLQNQQNPGNGLS

SEQ ID NO: 909532 - protein, 132 aa, Homo sapiens
ALEELFISPKAHISNGGILAEELKAPEIKEQWLFRVTVRPALITDTQYKGMEFFTCQMMLQQGAVFFQQGNAFQGPREADVVAREEVTELIQLQAERISALKEEIALLRRKGGLILPPIQSPREKEIQPADL

SEQ ID NO: 909533 - protein, 128 aa, Homo sapiens
MDYYRKYAAIFLVTLSVFLHVLHSAPDVQDCPECTLQENPFFSQPGAPILQCMGCCFSRAYPTPLRSKKTMLVQKNVTSESHLLCSLNPYNRVTVMGGFKRGEPTRACPLAVLVIITNLKLFLPKCCL

SEQ ID NO: 909534 - protein, 128 aa, Homo sapiens; identical to SEQ ID NO: 909533

SEQ ID NO: 909535 - protein, 128 aa, Homo sapiens; identical to SEQ ID NO: 909533

SEQ ID NO: 909536 - protein, 128 aa, Homo sapiens; identical to SEQ ID NO: 909533

SEQ ID NO: 909537 - protein, 128 aa, Homo sapiens; identical to SEQ ID NO: 909533

SEQ ID NO: 909538 - protein, 128 aa, Homo sapiens; identical to SEQ ID NO: 909533

SEQ ID NO: 909539 - protein, 128 aa, Homo sapiens; identical to SEQ ID NO: 909533

SEQ ID NO: 909540 - protein, 128 aa, Homo sapiens; identical to SEQ ID NO: 909533

SEQ ID NO: 909541 - protein, 157 aa, Homo sapiens
FLFFVSVVFVWCVSFFFSLVCLIKLTTSAMDYYRKYAAIFLVTLSVFLHVLHSAPDVQDCPECTLQENPFFSQPGAPILQCMGCCFSRAYPTPLRSKKTMLVQKNVTSESHLLCSLNPYNRVTVMGGFKSGEPTRACPLAVLVIITNLKLFLPKCCL

SEQ ID NO: 909542 - protein, 159 aa, Homo sapiens
MDYYRKYAAIFLVTLSVFLHVLHSAPDVQETGFHHVAQAALKLLSSSNPPTKASQSARITDCPECTLQENPFFSQPGAPILQCMGCCFSRAYPTPLRSKKTMLVQKNVTSESHLLCSLNPYNRVTVMGGFKSGEPTRACPLAVLVIITNLKLFLPKCCL

SEQ ID NO: 909543 - protein, 128 aa, Homo sapiens; identical to SEQ ID NO: 909533

SEQ ID NO: 909544 - protein, 128 aa, Homo sapiens; identical to SEQ ID NO: 909533

SEQ ID NO: 909545 - protein, 128 aa, Homo sapiens; identical to SEQ ID NO: 909533

SEQ ID NO: 909546 - protein, 128 aa, Homo sapiens; identical to SEQ ID NO: 909533

SEQ ID NO: 909547 - protein, 128 aa, Homo sapiens; identical to SEQ ID NO: 909533

SEQ ID NO: 909548 - protein, 128 aa, Homo sapiens; identical to SEQ ID NO: 909533

SEQ ID NO: 909549 - protein, 128 aa, Homo sapiens; identical to SEQ ID NO: 909533

SEQ ID NO: 909550 - protein, 151 aa, Homo sapiens
LERIKQHNQTPSRETHGITLESAMDYYRKYAAIFLVTLSVFLHVLHSAPDVQDCPECTLQENPFFSQPGAPILQCMGCCFSRAYPTPLRSKKTMLVQKNVTSESHLLCSLNPYNRVTVMGGFKSGEPTRACPLAVLVIITNLKLFLPKCCL

SEQ ID NO: 909551 - protein, 128 aa, Homo sapiens; identical to SEQ ID NO: 909533

SEQ ID NO: 909552 - protein, 102 aa, Homo sapiens
MDYYRKYAAIFLVTLSVFLHVLHSAPDVQDCPECTLQENPFFSQPGAPILQCMGCCFSRAYPTPLRSKKTMLVQKNVTSESHLLCSLNPYNRVRTSRSPEAF

SEQ ID NO: 909553 - protein, 452 aa, Homo sapiens
MQRQAPYNIRRSSTSGDTEEEEEEEVVPFSSDEQKRRSEAASGVLRRTAPREHSYVLSAAKKSTGSPTQETQAPFIAKRVEVVEEDGPSEKSQDPPALARSTPGSNSSRGEEIVRLQILTPRAGLRLVAPDVEGMSSSATSVSAVPADRKSNSTAAQEDAKADPKGALADYEGKDVATRVGEAWQERPGAPRGGQGDPAVPAQQPADPSTPERQSSPSGSEQLVRRESCGSSVLTDFEGKDVATKVGEAWQDRPGAPRGGQGDPAVPTQQPADPSTPEQQNSPSGSEQFVRRESCTSRVRSPSSCMVTVTVTATSEQPHIYIPAPASELDSSSTTKGILFVKEYVNASEVSSGKPVSARYSNVSSIEDSFAMEKKPPCGSTPYSERTTGGICTYCNREIRDCPKITLEHLGICCHEYCFKCGICSKPMGDLLDQIFIHRDTIHCGKCYEKLF

SEQ ID NO: 909554 - protein, 491 aa, Homo sapiens
MQRQAPYNIRRSSTSGDTEEEEEEEVVPFSSDEQKRRSEAASGVLRRTAPREHSYVLSAAKKSTGSPTQETQAPFIAKRVEVVEEDGPSEKSQDPPALARSTPGSNRSSPGNKDKEAPCSRELQRDLAGEEAFRAPNTDAARSSAQLSDGNVGSGATGSRPEGLAAVDIGSERGSSSATSVSAVPADRKSNSTAAQEDAKADPKGALADYEGKDVATRVGEAWQERPGAPRGGQGDPAVPAQQPADPSTPERQSSPSGSEQLVRRESCGSSVLTDFEGKDVATKVGEAWQDRPGAPRGGQGDPAVPTQQPADPSTPEQQNSPSGSEQFVRRESCTSRVRSPSSCMVTVTVTATSEQPHIYIPAPASELDSSSTTKGILFVKEYVNASEVSSGKPVSARYSNVSSIEDSFAMEKKPPCGSTPYSERTTGGICTYCNREIRDCPKITLEHLGICCHEYCFKCGICSKPMGDLLDQIFIHRDTIHCGKCYEKLF

SEQ ID NO: 909555 - protein, 550 aa, Homo sapiens
MQRQAPYNIRRSSTSGDTEEEEEEEVVPFSSDEQKRRSEAASGVLRRTAPREHSYVLSAAKKSTGSPTQETQAPFIAKRVEVVEEDGPSEKSQDPPALARSTPGSNSADGGRTKASRAIWIECLPSMPSPAGSQELSSRGEEIVRLQILTPRAGLRLVAPDVEGMRSSPGNKDKEAPCSRELQRDLAGEEAFRAPNTDAARSSAQLSDGNVGSGATGSRPEGLAAVDIGSERGSSSATSVSAVPADRKSNSTAAQEDAKADPKGALADYEGKDVATRVGEAWQERPGAPRGGQGDPAVPAQQPADPSTPERQSSPSGSEQLVRRESCGSSVLTDFEGKDVATKVGEAWQDRPGAPRGGQGDPAVPTQQPADPSTPEQQNSPSGSEQFVRRESCTSRVRSPSSCMVTVTVTATSEQPHIYIPAPASELDSSSTTKGILFVKEYVNASEVSSGKPVSARYSNVSSIEDSFAMEKKPPCGSTPYSERTTGGICTYCNREIRDCPKITLEHLGICCHEYCFKCGICSKPMGDLLDQIFIHRDTIHCGKCYEKLF

SEQ ID NO: 909556 - protein, 520 aa, Homo sapiens
MQRQAPYNIRRSSTSGDTEEEEEEEVVPFSSDEQKRRSEAASGVLRRTAPREHSYVLSAAKKSTGSPTQETQAPFIAKRVEVVEEDGPSEKSQDPPALARSTPGSNSSRGEEIVRLQILTPRAGLRLVAPDVEGMRSSPGNKDKEAPCSRELQRDLAGEEAFRAPNTDAARSSAQLSDGNVGSGATGSRPEGLAAVDIGSERGSSSATSVSAVPADRKSNSTAAQEDAKADPKGALADYEGKDVATRVGEAWQERPGAPRGGQGDPAVPAQQPADPSTPERQSSPSGSEQLVRRESCGSSVLTDFEGKDVATKVGEAWQDRPGAPRGGQGDPAVPTQQPADPSTPEQQNSPSGSEQFVRRESCTSRVRSPSSCMVTVTVTATSEQPHIYIPAPASELDSSSTTKGILFVKEYVNASEVSSGKPVSARYSNVSSIEDSFAMEKKPPCGSTPYSERTTGGICTYCNREIRDCPKITLEHLGICCHEYCFKCGICSKPMGDLLDQIFIHRDTIHCGKCYEKLF

SEQ ID NO: 909557 - protein, 422 aa, Homo sapiens
MQRQAPYNIRRSSTSGDTEEEEEEEVVPFSSDEQKRRSEAASGVLRRTAPREHSYVLSAAKKSTGSPTQETQAPFIAKRVEVVEEDGPSEKSQDPPALARSTPGSNSADGGRTKASRAIWIECLPSMPSPAGSQELRSSPGNKDKEAPCSRELQRDLAGEEAFRAPNTDAASSSATSVSAVPADRKSNSTAAQEDAKADPKGVLTDFEGKDVATKVGEAWQDRPGAPRGGQGDPAVPTQQPADPSTPEQQNSPSGSEQFVRRESCTSRVRSPSSCMVTVTVTATSEQPHIYIPAPASELDSSSTTKGILFVKEYVNASEVSSGKPVSARYSNVSSIEDSFAMEKKPPCGSTPYSERTTGGICTYCNREIRDCPKITLEHLGICCHEYCFKCGICSKPMGDLLDQIFIHRDTIHCGKCYEKLF

SEQ ID NO: 909558 - protein, 491 aa, Homo sapiens; identical to SEQ ID NO: 909554

SEQ ID NO: 909559 - protein, 491 aa, Homo sapiens; identical to SEQ ID NO: 909554

SEQ ID NO: 909560 - protein, 458 aa, Homo sapiens
MQRQAPYNIRRSSTSGDTEEEEEEEVVPFSSDEQKRRSEAASGVLRRTAPREHSYVLSAAKKSTGSPTQETQAPFIAKRVEVVEEDGPSEKSQDPPALARSTPGSNRSSPGNKDKEAPCSRELQRDLAGEEAFRAPNTDAASSSATSVSAVPADRKSNSTAAQEDAKADPKGALADYEGKDVATRVGEAWQERPGAPRGGQGDPAVPAQQPADPSTPERQSSPSGSEQLVRRESCGSSVLTDFEGKDVATKVGEAWQDRPGAPRGGQGDPAVPTQQPADPSTPEQQNSPSGSEQFVRRESCTSRVRSPSSCMVTVTVTATSEQPHIYIPAPASELDSSSTTKGILFVKEYVNASEVSSGKPVSARYSNVSSIEDSFAMEKKPPCGSTPYSERTTGGICTYCNREIRDCPKITLEHLGICCHEYCFKCGICSKPMGDLLDQIFIHRDTIHCGKCYEKLF

SEQ ID NO: 909561 - protein, 552 aa, Homo sapiens
MQRQAPYNIRRSSTSGDTEEEEEEEVVPFSSDEQKRRSEAASGVLRRTAPREHSYVLSAAKKSTGSPTQETQAPFIAKRVEVVEEDGPSEKSQDPPALARSTPGSNSSRGEEIVRLQILTPRAGLRLVAPDVEGMRSSPGNKDKEAPCSRELQRDLAGEEAFRAPNTDAARSSAQLSDGNVGSGATGSRPEGLAAVDIGSERGRLCAAASFASFLEDQDGHSANSQSCKPRPAAISSSATSVSAVPADRKSNSTAAQEDAKADPKGALADYEGKDVATRVGEAWQERPGAPRGGQGDPAVPAQQPADPSTPERQSSPSGSEQLVRRESCGSSVLTDFEGKDVATKVGEAWQDRPGAPRGGQGDPAVPTQQPADPSTPEQQNSPSGSEQFVRRESCTSRVRSPSSCMVTVTVTATSEQPHIYIPAPASELDSSSTTKGILFVKEYVNASEVSSGKPVSARYSNVSSIEDSFAMEKKPPCGSTPYSERTTGGICTYCNREIRDCPKITLEHLGICCHEYCFKCGICSKPMGDLLDQIFIHRDTIHCGKCYEKLF

SEQ ID NO: 909562 - protein, 322 aa, Homo sapiens
ELGLGGDSLEAMPVPAARGRPRITNGPEELAAPSPAALADYEGKDVATRVGEAWQERPGAPRGGQGDPAVPAQQPADPSTPERQSSPSGSEQLVRRESCGSSVLTDFEGKDVATKVGEAWQDRPGAPRGGQGDPAVPTQQPADPSTPEQQNSPSGSEQFVRRESCTSRVRSPSSCMVTVTVTATSEQPHIYIPAPASELDSSSTTKGILFVKEYVNASEVSSGKPVSARYSNVSSIEDSFAMEKKPPCGSTPYSERTTGGICTYCNREIRDCPKITLEHLGICCHEYCFKCGICSKPMGDLLDQIFIHRDTIHCGKCYEKLF

SEQ ID NO: 909563 - protein, 491 aa, Homo sapiens; identical to SEQ ID NO: 909554

SEQ ID NO: 909564 - protein, 101 aa, Homo sapiens
SLIHMDCQVCEAQYTCAATSSGCLNVQDYLKKRLIDLKAHLMIGHGAECQSPVLILDAQGLAVLQGSSFLSRGQQVKLEPEMPLCPLRAPKISASSRTYQK

SEQ ID NO: 909565 - protein, 485 aa, Homo sapiens
RHCSCSPRGRRSNPDPAAPAPSAAAASAPQSGERSPEPAAPGWLQLLQVTVLLPSLHVLRMVWWYLGKIQPGPEMKCKRLCISRLLITNRRARLRFKFSKVAAPNPIPVPFFQCEGHSFHEEGKCTYISIDQVPRTYAIMISRPAWLWGAEMGANEHGVCIANEAINTREPAAEIEALLGMDLVRLGLERGETAKEALDVIVSLLEEHGQGGNYFEDANSCHSFQSAYLIVDRDEAWVLETIGKYWAAEKVTEGVRCICSQLSLTTKMDAEHPELRSYAQSQGWWTGEGEFNFSEVFSPVEDHLDCGAGKDSLEKQEESITVQTMMNTLRDKASGVCIDSEFFLTTASGVSVLPQNRSSPCIHYFTGTPDPSRSIFKPFIFVDDVKLVPKTQSPCFGDDDPAKKEPRFQEKPDRRHELYKAHEWARAIIESDQEQGRKLRSTMLELEKQGLEAMEEILTSSEPLDPAEVGDLFYDCVDTEIKFFK

SEQ ID NO: 909566 - protein, 485 aa, Homo sapiens; identical to SEQ ID NO: 909565

SEQ ID NO: 909567 - protein, 485 aa, Homo sapiens; identical to SEQ ID NO: 909565

SEQ ID NO: 909568 - protein, 428 aa, Homo sapiens
RPLLQLPGPLPTRRMAAAPPSYCFVAFPPRAKDGLVVFGKNSARPRDEVQEVVYFSAADHEPESKVECTYISIDQVPRTYAIMISRPAWLWGAEMGANEHGVCIANEAINTREPAAEIEALLGMDLVRLGLERGETAKEALDVIVSLLEEHGQGGNYFEDANSCHSFQSAYLIVDRDEAWVLETIGKYWAAEKVTEGVRCICSQLSLTTKMDAEHPELRSYAQSQGWWTGEGEFNFSEVFSPVEDHLDCGAGKDSLEKQEESITVQTMMNTLRDKASGVCIDSEFFLTTASGVSVLPQNRSSPCIHYFTGTPDPSRSIFKPFIFVDDVKLVPKTQSPCFGDDDPAKKEPRFQEKPDRRHELYKAHEWARAIIESDQEQGRKLRSTMLELEKQGLEAMEEILTSSEPLDPAEVGDLFYDCVDTEIKFFK

SEQ ID NO: 909569 - protein, 414 aa, Homo sapiens
MAAAPPSYCFVAFPPRAKDGLVVFGKNSARPRDEVQEVVYFSAADHEPESKVECTYISIDQVPRTYAIMISRPAWLWGAEMGANEHGVCIANEAINTREPAAEIEALLGMDLVRLGLERGETAKEALDVIVSLLEEHGQGGNYFEDANSCHSFQSAYLIVDRDEAWVLETIGKYWAAEKVTEGVRCICSQLSLTTKMDAEHPELRSYAQSQGWWTGEGEFNFSEVFSPVEDHLDCGAGKDSLEKQEESITVQTMMNTLRDKASGVCIDSEFFLTTASGVSVLPQNRSSPCIHYFTGTPDPSRSIFKPFIFVDDVKLVPKTQSPCFGDDDPAKKEPRFQEKPDRRHELYKAHEWARAIIESDQEQGRKLRSTMLELEKQGLEAMEEILTSSEPLDPAEVGDLFYDCVDTEIKFFK

SEQ ID NO: 909570 - protein, 414 aa, Homo sapiens; identical to SEQ ID NO: 909569

SEQ ID NO: 909571 - protein, 414 aa, Homo sapiens; identical to SEQ ID NO: 909569

SEQ ID NO: 909572 - protein, 266 aa, Homo sapiens
MAAAPPSYCFVAFPPRAKDGLVVFGKNSARPRDEVQEVVYFSAADHEPESKVECTYISIDQVPRTYAIMISRPAWLWGAEMGANEHGVCIANEAINTREPAAEIEALLGMDLVRLGLERGETAKEALDVIVSLLEEHGQGGNYFEDANSCHSFQSAYLIVDRDEAWVLETIGKYWAAEKVTEGVRCICSQLSLTTKMDAEHPELRSYAQSQGWWTGEGEFNFSEVFSPVEDHLDCGAGKDSLEKQEGELVSPSRFSFSYPFSCSCF

SEQ ID NO: 909573 - protein, 162 aa, Homo sapiens
ASSVPETLTRDIGKYWAAEKVTEGVRCICSQLSLTTKMDAEHPELRSYAQSQGWWTGEGEFNFSEVFSPVEDHLDCGAGKDSLEKQEESITVQTMMNTLRDKASGVCIDSEFFLTTASGVSVLPQNRSSPCIHYFTGTPDPSRSIFKPLIFVDDVSVSGPSW

SEQ ID NO: 909574 - protein, 485 aa, Homo sapiens; identical to SEQ ID NO: 909565

SEQ ID NO: 909575 - protein, 414 aa, Homo sapiens; identical to SEQ ID NO: 909569

SEQ ID NO: 909576 - protein, 255 aa, Homo sapiens
ASSVPETLTRDIGKYWAAEKVTEGVRCICSQLSLTTKMDAEHPELRSYAQSQGWWTGEGEFNFSEVFSPVEDHLDCGAGKDSLEKQEESITVQTMMNTLRDKASGVCIDSEFFLTTASGVSVLPQNRSSPCIHYFTGTPDPSRSIFKPFIFVDDVKLVPKTQSPCFGDDDPAKKEPRFQEKPDRRHELYKAHEWARAIIESDQEQGRKLRSTMLELEKQGLEAMEEILTSSEPLDPAEVGDLFYDCVDTEIKFFK

SEQ ID NO: 909577 - protein, 414 aa, Homo sapiens; identical to SEQ ID NO: 909569

SEQ ID NO: 909578 - protein, 414 aa, Homo sapiens; identical to SEQ ID NO: 909569

SEQ ID NO: 909579 - protein, 282 aa, Homo sapiens
MISPVLLPACFSTEDHYSAAVPFLDKWPTTLSRHLGGPCQVDAHCSAGHSCIFTVSGTSSCCPFPEAVACGDGHHCCPRGFHCSADGRSCFQRSGNNSVGAIQCPDSQFECPDFSTCCVMVDGSWGCCPMPQASCCEDRVHCCPHGAFCDLVHTRCITPTGTHPLAKKLPAQRTNRAVALSSSVMCPDARSRCPDGSTCCELAQWEVWLLPNAQQARVVPIPALWPRPVCCLIRVGLSRDRPRLSLSAGPWVSLPRRARAPAARGGGHSSVGPSSGFTATPA

SEQ ID NO: 909580 - protein, 111 aa, Homo sapiens
MASSQGGPALLQPVPADVVSSQGVPSILQPAPAEVISSQATPPLLQPAPQLSVDLTEVEVLGEDNVENINPRTSEQHRQGSDGNHTIPASSLHSMTNFISGLQRLHGMLDS

SEQ ID NO: 909581 - protein, 490 aa, Homo sapiens
MPTALPATPASLPSQGLPVAAPSQRPWHAGMAITAAHGASTAVQTGDPASKDQVTTPWVPSSALIVSSNARTSPRAVLWSMAPGGAAPCPRLPAVKTGCTAVRTVPSATWFTPAASHPRAPTPWQRSSLPRGLTGQWPCPARSCVRTHGPGALMVLPAVSLPSGKYGCCPMPNATCCSDHLHCCPQDTVCDLIQSKCLSKENATTDLLTKLPAHTVGDVKCDMEVSCPDGYTCCRLQSGAWGCCPFTQAVCCEDHIHCCPAGFTCDTQKGTCEQGPHQVPWMEKAPAHLSLPDPQALKRDVPCDNVSSCPSSDTCCQLTSGEWGCCPIPEAVCCSDHQHCCPQGYTCVAEGQCQRGSEIVAGLEKMPARRASLSHPRDIGCDQHTSCPVGQTCCPSLGGSWACCQLPHAVCCEDRQHCCPAGYTCNVKARSCEKEVVSAQPATFLARSPHVGVKDVECGEGHFCHDNQTCCRDNRQGWACCPYRQGRLLC

SEQ ID NO: 909582 - protein, 139 aa, Homo sapiens
QSHTTLEGNMVESALIGQRASLSHPRDIGCDQHTSCPVGQTCCPSLGGSWACCQLPHAVCCEDRQHCCPAGYTCNVKARSCEKEVVSAQPATFLARSPHVGVKDVECGEGHFCHDNQTCCRDNRQGWACCPYRQGRLLC

SEQ ID NO: 909583 - protein, 490 aa, Homo sapiens; identical to SEQ ID NO: 909581

SEQ ID NO: 909584 - protein, 337 aa, Homo sapiens
MVLPAVSLPSGKYGCCPMPNATCCSDHLHCCPQDTVCDLIQSKCLSKENATTDLLTKLPAHTVGDVKCDMEVSCPDGYTCCRLQSGAWGCCPFTQAVCCEDHIHCCPAGFTCDTQKGTCEQGPHQVPWMEKAPAHLSLPDPQALKRDVPCDNVSSCPSSDTCCQLTSGEWGCCPIPEAVCCSDHQHCCPQGYTCVAEGQCQRGSEIVAGLEKMPARRASLSHPRDIGCDQHTSCPVGQTCCPSLGGSWACCQLPHAVCCEDRQHCCPAGYTCNVKARSCEKEVVSAQPATFLARSPHVGVKDVECGEGHFCHDNQTCCRDNRQGWACCPYRQGRLLC

SEQ ID NO: 909585 - protein, 626 aa, Homo sapiens
MPTALPATPASLPSQGLPVAAPSQRPWHAGMAITAAHGASTAVQTGDPASKDQVTTPWVPSSALIVSSNARTSPRAVLWSMAPGGAAPCPRLPAVKTGCTAVRTVPSATWFTPAASHPRAPTPWQRSSLPRGLTGQWPCPARSCVRTHGPGALMVLPAVSLPSGKYGCCPMPNATCCSDHLHCCPQDTVCDLIQSKCLSKENATTDLLTKLPAHTVGDVKCDMEVSCPDGYTCCRLQSGAWGCCPFTQAVCCEDHIHCCPAGFTCDTQKGTCEQGPHQVPWVALTAGLVAGTRCPDGQFCPVACCLDPGGASYSCCRPLLDKWPTTLSRHLGGPCQVDAHCSAGHSCIFTVSGTSSCCPFPEAVACGDGHHCCPRGFHCSADGRSCFQRSGNNSVGAIQCPDSQFECPDFSTCCVMVMEKAPAHLSLPDPQALKRDVPCDNVSSCPSSDTCCQLTSGEWGCCPIPEAVCCSDHQHCCPQGYTCVAEGQCQRGSEIVAGLEKMPARRASLSHPRDIGCDQHTSCPVGQTCCPSLGGSWACCQLPHAVCCEDRQHCCPAGYTCNVKARSCEKEVVSAQPATFLARSPHVGVKDVECGEGHFCHDNQTCCRDNRQGWACCPYRQGRLLC

SEQ ID NO: 909586 - protein, 282 aa, Homo sapiens
VLSAAHTVGDVKCDMEVSCPDGYTCCRLQSGAWGCCPFTQAVCCEDHIHCCPAGFTCDTQKGTCEQGPHQVPWMEKAPAHLSLPDPQALKRDVPCDNVSSCPSSDTCCQLTSGEWGCCPIPEAVCCSDHQHCCPQGYTCVAEGQCQRGSEIVAGLEKMPARRASLSHPRDIGCDQHTSCPVGQTCCPSLGGSWACCQLPHAVCCEDRQHCCPAGYTCNVKARSCEKEVVSAQPATFLARSPHVGVKDVECGEGHFCHDNQTCCRDNRQGWACCPYRQGRLLC

SEQ ID NO: 909587 - protein, 389 aa, Homo sapiens
MPTALPATPASLPSQGLPVAAPSQRPWHAGMAITAAHGASTAVQTGDPASKDQVTTPWVPSSALIVSSNARTSPRAVLWSMAPGGAAPCPRLPAVKTGCTAVRTVPSATWFTPAASHPRAPTPWQRSSLPRGLTGQWPCPARSCVRTHGPGALMVLPAVSLPSGKYGCCPMPNATCCSDHLHCCPQDTVCDLIQSKCLSKENATTDLLTKLPAHTVGDVKCDMEVSCPDGYTCCRLQSGAWGCCPFTQAVCCEDHIHCCPAGFTCDTQKGTCEQGPHQVPWMEKAPAHLSLPDPQALKRDVPCDNVSSCPSSDTCCQLTSGEWGCCPIPEAVCCSDHQHCCPQGYTCVAEGQCQRGSEIVAGLEKMPARRASLSHPSLPPSWPVALTWV

SEQ ID NO: 909588 - protein, 584 aa, Homo sapiens
MPTALPATPASLPSQGLPVAAPSQRPWHAGMAITAAHGASTAVQTGDPASKDQVTTPWVPSSALIVSSNARTSPRAVLWSMAPGGAAPCPRLPAVKTGCTAVRTVPSATWFTPAASHPRAPTPWQRSSLPRGLTGQWPCPARSCVRTHGPGALMVLPAVSLPSGKYGCCPMPNATCCSDHLHCCPQDTVCDLIQSKCLSKENATTDLLTKLPAHTVGDVKCDMEVSCPDGYTCCRLQSGAWGCCPFTQAVCCEDHIHCCPAGFTCDTQKGTCEQGPHQVPWMEKAPAHLSLPDPQALKRDVPCDNVSSCPSSDTCCQLTSGEWGCCPIPEAVCCSDHQHCCPQGYTCVAEGQCQRGSEIVAGLEKMPARRASLSHPRDIGCDQHTSCPVGQTCCPSLGGSWACCQLPHAVCCEDRQHCCPAGYTCNVKARSCEKEVVSAQPATFLARSPHVGVKDVECGEGHFCHDNQTCCRDNRQGWACCPYRQGQCQPPSWGWVWPGTRSHLVQPSRPPLTIQGVCCADRRHCCPAGFPLRSQGYQVFAQGGPALGRPFEGPSLETAAVRDSTEDSAALGTPLGGCPLLRPP

SEQ ID NO: 909589 - protein, 490 aa, Homo sapiens; identical to SEQ ID NO: 909581

SEQ ID NO: 909590 - protein, 271 aa, Homo sapiens
KAGFRIGRGDRGVGRRQTMWTLVSWVALTAGLVAGTRCPDGQFCPVACCLDPGGASYSCCRPLLDKWPTTLSRHLGGPCQVDAHCSAGHSCIFTVSGTSSCCPFPEAVACGDGHHCCPRGFHCSADGRSCFQRSGNNSVGAIQCPDSQFECPDFSTCCVMVDGSWGCCPMPQASCCEDRVHCCPHGAFCDLVHTRCITPTGTHPLAKKLPAQRTNRAVALSSSVMCPDARSRCPDGSTCCELAQWEVWLLPNAQRHLLLRSPALLPPRHCV

SEQ ID NO: 909591 - protein, 433 aa, Homo sapiens
MPTALPATPASLPSQGLPVAAPSQRPWHAGMAITAAHGASTAVQTGDPASKDQVTTPWVPSSALIVSSNARTSPRAVLWSMAPGGAAPCPRLPAVKTGCTAVRTVPSATWFTPAASHPRAPTPWQRSSLPRGLTGQWPCPARSCVRTHGPGALMVLPAVSLPSGKYGCCPMPNATCCSDHLHCCPQDTVCDLIQSKCLSKENATTDLLTKLPAHTVGDVKCDMEVSCPDGYTCCRLQSGAWGCCPFTQAVCCEDHIHCCPAGFTCDTQKGTCEQGPHQVPWMEKAPAHLSLPDPQALKRDVPCDNVSSCPSSDTCCQLTSGEWGCCPIPEAVCCSDHQHCCPQGYTCVAEGQCQRGSEIVAGLEKMPARRASLSHPRDIGCDQHTSCPVGQTCCPSLGRGLPGSNRHSRRGLKWNTVNHTRGVNTRGLILISV

SEQ ID NO: 909592 - protein, 271 aa, Homo sapiens; identical to SEQ ID NO: 909590

SEQ ID NO: 909593 - protein, 271 aa, Homo sapiens; identical to SEQ ID NO: 909590

SEQ ID NO: 909594 - protein, 271 aa, Homo sapiens; identical to SEQ ID NO: 909590

SEQ ID NO: 909595 - protein, 271 aa, Homo sapiens; identical to SEQ ID NO: 909590

SEQ ID NO: 909596 - protein, 273 aa, Homo sapiens
KAGFRIGRGDRGVGRRQTMWTLVSWVALTAGLVAGTRCPDGQFCPVACCLDPGGASYSCCRPLLDKWPTTLSRHLGGPCQVDAHCSAGHSCIFTVSGTSSCCPFPEAVACGDGHHCCPRGFHCSADGRSCFQRSGNNSVGAIQCPDSQFECPDFSTCCVMVDGSWGCCPMPQASCCEDRVHCCPHGAFCDLVHTRCITPTGTHPLAKKLPAQRTNRAVALSSSVMCPDARSRCPDGSTCCELAQWEVWLLPNAQQATGVRSLTGAQDMVWLIR

SEQ ID NO: 909597 - protein, 279 aa, Homo sapiens
KAGFRIGRGDRGVGRRQTMWTLVSWVALTAGLVAGTRCPDGQFCPVACCLDPGGASYSCCRPLLDKWPTTLSRHLGGPCQVDAHCSAGHSCIFTVSGTSSCCPFPEAVACGDGHHCCPRGFHCSADGRSCFQRSGNNSVGAIQCPERLVLDGSIEFPAVPCLSSQGPAHLLWLCNHLGFIISSLRVSVRPGEYREETNIWLKPSFSCCENKWMSLSPPSCCSGLAALRPGHWAPRPRKVFPVKDFDDDGQAETAALTDRLLALYPQILFDSVHTCTGIV

SEQ ID NO: 909598 - protein, 255 aa, Homo sapiens
MWTLVSWVALTAGLVAGTRCPDGQFCPVACCLDPGGASYSCCRPLLDKWPTTLSRHLGGPCQVDAHCSAGHSCIFTVSGTSSCCPFPEAVACGDGHHCCPRGFHCSADGRSCFQRSGNNSVGAIQCPDSQFECPDFSTCCVMVDGSWGCCPMPQASCCEDRVHCCPHGAFCDLVHTRCITPTGTHPLAKKLPAQRTNRAVALSSSVMCPDARSRCPDGSTCCELAQWEVWLLPNAQQATGVRSLTGAQDMVWLIR

SEQ ID NO: 909599 - protein, 229 aa, Homo sapiens
MWTLVSWVALTAGLVAGTRCPDGQFCPVACCLDPGGASYSCCRPLLDKWPTTLSRHLGGPCQVDAHCSAGHSCIFTVSGTSSCCPFPEAVACGDGHHCCPRGFHCSADGRSCFQRSGNNSVGAIQCPDSQFECPDFSTCCVMVDGSWGCCPMPQASCCEDRVHCCPHGAFCDLVHTRCITPTGTHPLAKKLPAQRTNRADGPLSSSGQCCPGRNVSPGGPWNGVPTLAC

SEQ ID NO: 909600 - protein, 253 aa, Homo sapiens
MWTLVSWVALTAGLVAGTRCPDGQFCPVACCLDPGGASYSCCRPLLDKWPTTLSRHLGGPCQVDAHCSAGHSCIFTVSGTSSCCPFPEAVACGDGHHCCPRGFHCSADGRSCFQRSGNNSVGAIQCPDSQFECPDFSTCCVMVDGSWGCCPMPQASCCEDRVHCCPHGAFCDLVHTRCITPTGTHPLAKKLPAQRTNRAVALSSSVMCPDARSRCPDGSTCCELAQWEVWLLPNAQRHLLLRSPALLPPRHCV

SEQ ID NO: 909601 - protein, 157 aa, Homo sapiens
TLLRVTRKPRGTAVYVVLPDPQALKRDVPCDNVSSCPSSDTCCQLTSGEWGCCPIPEAVCCSDHQHCCPQGYTCVAEGQCQRGSEIVAGLEKMPARRASLSHPRDIGCDQHTSCPVGQTCCPSLGGSWACCQLPHCEDLQHLPRLAYTTQPMNSGEQ

SEQ ID NO: 909602 - protein, 410 aa, Homo sapiens
MAPGGAAPCPRLPAVKTGCTAVRTVPSATWFTPAASHPRAPTPWQRSSLPRGLTGQWPCPARSCVRTHGPGALMVLPAVSLPSGKYGCCPMPNATCCSDHLHCCPQDTVCDLIQSKCLSKENATTDLLTKLPAHTVGDVKCDMEVSCPDGYTCCRLQSGAWGCCPFTQAVCCEDHIHCCPAGFTCDTQKGTCEQGPHQVPWMEKAPAHLSLPDPQALKRDVPCDNVSSCPSSDTCCQLTSGEWGCCPIPEAVCCSDHQHCCPQGYTCVAEGQCQRGSEIVAGLEKMPARRASLSHPRDIGCDQHTSCPVGQTCCPSLGGSWACCQLPHAVCCEDRQHCCPAGYTCNVKARSCEKEVVSAQPATFLARSPHVGVKDVECGEGHFCHDNQTCCRDNRQGWACCPYRQGRLLC

SEQ ID NO: 909603 - protein, 403 aa, Homo sapiens
MPTALPATPASLPSQGLPVAAPSQRPWHAGMAITAAHGASTAVQTGDPASKDQVTTPWVPSSALIVSSNARTSPRAVLWSMAPGGAAPCPRLPAVKTGCTAVCDLIQSKCLSKENATTDLLTKLPAHTVGDVKCDMEVSCPDGYTCCRLQSGAWGCCPFTQAVCCEDHIHCCPAGFTCDTQKGTCEQGPHQVPWMEKAPAHLSLPDPQALKRDVPCDNVSSCPSSDTCCQLTSGEWGCCPIPEAVCCSDHQHCCPQGYTCVAEGQCQRGSEIVAGLEKMPARRASLSHPRDIGCDQHTSCPVGQTCCPSLGGSWACCQLPHAVCCEDRQHCCPAGYTCNVKARSCEKEVVSAQPATFLARSPHVGVKDVECGEGHFCHDNQTCCRDNRQGWACCPYRQGRLLC

SEQ ID NO: 909604 - protein, 490 aa, Homo sapiens; identical to SEQ ID NO: 909581

SEQ ID NO: 909605 - protein, 490 aa, Homo sapiens; identical to SEQ ID NO: 909581

SEQ ID NO: 909606 - protein, 490 aa, Homo sapiens; identical to SEQ ID NO: 909581

SEQ ID NO: 909607 - protein, 412 aa, Homo sapiens
MPTALPATPASLPSQGLPVAAPSQRPWHAGMAITAAHGASTAVQTGDPASKDQVTTPWVPSSALIVSSNARTSPRAVLWSMAPGGAAPCPRLPAVKTGCTAVRTVPSATWFTPAASHPRAPTPWQRSSLPRGLTGQWPCPARSCVRTHGPGALMVLPAVSLPSGKYGCCPMPNATCCSDHLHCCPQDTVCDLIQSKCLSKENATTDLLTKLPAHTVGDVKCDMEVSCPDGYTCCRLQSGAWGCCPFTQAVCCEDHIHCCPAGFTCDTQKGTCEQGPHQVPWMEKAPAHLSLPDPQALKRDVPCDNVSSCPSSDTCCQLTSGEWGCCPIPEAVCCEDRQHCCPAGYTCNVKARSCEKEVVSAQPATFLARSPHVGVKDVECGEGHFCHDNQTCCRDNRQGWACCPYRQGRLLC

SEQ ID NO: 909608 - protein, 402 aa, Homo sapiens
MPTALPATPASLPSQGLPVAAPSQRPWHAGMAITAAHGASTAVQTGDPASKDQVTTPWVPSSALIVSSNARTSPRAVLWSMAPGGAAPCPRLPAVKTGCTAVRTVPSATWFTPAASHPRAPTPWQRSSLPRGLTGQWPCPARSCVRTHGPGALMVLPAVSLPSGKYGCCPMPNATCCSDHLHCCPQDTVCDLIQSKCLSKENATTDLLTKLPAHTVGDVKCDMEVSCPDGYTCCRLQSGAWGCCPFTQAVCCEDHIHCCPAGFTCDTQKGTCEQGPHQVPWMEKAPAHLSLPDPQALKRDVPCDNVSSCPSSDTCCQLTSGEWGCCPIPEKGVCVRTPGWWPRGNVLLREARNETAEEKRARVLSPQTGPPAGDPPREGTLGTTGTRPKPPGRTPPGPPPGP

SEQ ID NO: 909609 - protein, 271 aa, Homo sapiens; identical to SEQ ID NO: 909590

SEQ ID NO: 909610 - protein, 271 aa, Homo sapiens; identical to SEQ ID NO: 909590

SEQ ID NO: 909611 - protein, 270 aa, Homo sapiens
KAGFRIGRGDRGVGRRQTMWTLVSWVALTAGLVAGTRCPDGQFCPVACCLDPGGASYSCCRPLLDKWPTTLSRHLGGPCQVDAHCSAGHSCIFTVSGTSSCCPFPEAVACGDGHHCCPRGFHCSADGRSCFQRSGNNSVGAIQCPDSQFECPDFSTCCVMVDGSWGCCPMPQASCCEDRVHCCPHGAFCDLVHTRCITPTGTHPLAKKLPAQRTNRAVALSSSVMCPDARSRCPDGSTCCELAQWEVWLLPNAQQALCRHCCAQNGCRPY

SEQ ID NO: 909612 - protein, 306 aa, Homo sapiens
MGESPSLSGLVVSWVILSTGNNSVGAIQCPDSQFECPDFSTCCVMVDGSWGCCPMPQVQIWGRWGYVEGSGGRVGGQGQGVKTESGPFFLRLPAVKTGCTAVRTVPSATWFTPAASHPRAPTPWQRSSLPRGLTGQGEEVGEHQARGWGGASLTPSVGKSFLHPGCPSRLLLFQWPCPARSCVRTHGPGALMVLPAVSLPSGKYGCCPMPNLSEGLEPAWLCAPSHLALTRTLQGLCGMGLAGCLLGAWLMQGSCYPLVGDWGSASHQPGCSLCATEPGSDKDPPLSPLSHLLLRSPALLPPRHCV

SEQ ID NO: 909613 - protein, 58 aa, Homo sapiens
WFCMTFRKVFSNSVKTRKFRFVAELKGLDPARVNVPVIGGHAGKTIIPLISQVHAYDP

SEQ ID NO: 909614 - protein, 282 aa, Homo sapiens
DRKSGHSREAPESRRWAVWRSLESLPRHQLLCLPVGAPPAPAMLSALARPASAALRRSFSTSAQNNAKVAVLGASGGIGQPLSLLLKNSPLVSRLTLYDIAHTPGVAADLSHIETKAAVKGYLGPEQLPDCLKGCDVVVIPAGVPRKPGMTRDDLFNTNATIVATLTAACAQHCPEAMICVIANPVNSTIPITAEVFKKHGVYNPNKIFGVTTLDIVRANTFVAELKGLDPARVNVPVIGGHAGKTIIPLISQCTPKVDFPQDQLTALTGADPGGRHGGGQG

SEQ ID NO: 909615 - protein, 282 aa, Homo sapiens; identical to SEQ ID NO: 909614

SEQ ID NO: 909616 - protein, 277 aa, Homo sapiens
KARYEAGCESAEVWRSLESLPRHQLLCLPVGAPPAPAMLSALARPASAALRRSFSTSAQNNAKVAVLGASGGIGQPLSLLLKNSPLVSRLTLYDIAHTPGVAADLSHIETKAAVKGYLGPEQLPDCLKGCDVVVIPAGVPRKPGMTRDDLFNTNATIVATLTAACAQHCPEAMICVIANPVNSTIPITAEVFKKHGVYNPNKIFGVTTLDIVRANTFVAELKGLDPARVNVPVIGGHAGKTIIPLISQCTPKVDFPQDQLTALTGADPGGRHGGGQG

SEQ ID NO: 909617 - protein, 282 aa, Homo sapiens; identical to SEQ ID NO: 909614

SEQ ID NO: 909618 - protein, 282 aa, Homo sapiens; identical to SEQ ID NO: 909614

SEQ ID NO: 909619 - protein, 282 aa, Homo sapiens; identical to SEQ ID NO: 909614

SEQ ID NO: 909620 - protein, 282 aa, Homo sapiens; identical to SEQ ID NO: 909614

SEQ ID NO: 909621 - protein, 240 aa, Homo sapiens
MLSALARPASAALRRSFSTSAQNNAKVAVLGASGGIGQPLSLLLKNSPLVSRLTLYDIAHTPGVAADLSHIETKAAVKGYLGPEQLPDCLKGCDVVVIPAGVPRKPGMTRDDLFNTNATIVATLTAACAQHCPEAMICVIANPVNSTIPITAEVFKKHGVYNPNKIFGVTTLDIVRANTFVAELKGLDPARVNVPVIGGHAGKTIIPLISQCTPKVDFPQDQLTALTGADPGGRHGGGQG

SEQ ID NO: 909622 - protein, 282 aa, Homo sapiens; identical to SEQ ID NO: 909614

SEQ ID NO: 909623 - protein, 282 aa, Homo sapiens; identical to SEQ ID NO: 909614

SEQ ID NO: 909624 - protein, 244 aa, Homo sapiens
HVHATAIKGAVHATAIKGAVHATAIKGAVHATAIKNSSFNEQPLSLLLKNSPLVSRLTLYDIAHTPGVAADLSHIETKAAVKGYLGPEQLPDCLKGCDVVVIPAGVPRKPGMTRDDLFNTNATIVATLTAACAQHCPEAMICVIANPVNSTIPITAEVFKKHGVYNPNKIFGVTTLDIVRANTFVAELKGLDPARVNVPVIGGHAGKTIIPLISQCTPKVDFPQDQLTALTGADPGGRHGGGQG

SEQ ID NO: 909625 - protein, 304 aa, Homo sapiens
DRKSGHSREAPESRRWAVWRSLESLPRHQLLCLPVGAPPAPAMLSALARPASAALRRSFSTSAQNNAKVAVLGASGGIGQPLSLLLKNSPLVSRLTLYDIAHTPGVAADLSHIETKAAVKGTGRADPGDLLPVPSEARIRVLSYLGPEQLPDCLKGCDVVVIPAGVPRKPGMTRDDLFNTNATIVATLTAACAQHCPEAMICVIANPVNSTIPITAEVFKKHGVYNPNKIFGVTTLDIVRANTFVAELKGLDPARVNVPVIGGHAGKTIIPLISQCTPKVDFPQDQLTALTGADPGGRHGGGQG

SEQ ID NO: 909626 - protein, 226 aa, Homo sapiens
RPEVRSLSRGPREQALGSVEVVGVTSASPAPVPASRCPSRSSHALRPRPACQRCSPPQLQHLGPGYLGPEQLPDCLKGCDVVVIPAGVPRKPGMTRDDLFNTNATIVATLTAACAQHCPEAMICVIANPVNSTIPITAEVFKKHGVYNPNKIFGVTTLDIVRANTFVAELKGLDPARVNVPVIGGHAGKTIIPLISQCTPKVDFPQDQLTALTGADPGGRHGGGQG

SEQ ID NO: 909627 - protein, 230 aa, Homo sapiens
DRKSGHSREAPESRRWAVWRSLESLPRHQLLCLPVGAPPAPAMLSALARPASAALRRSFSTSAQNNAKVAVLGASGGIGQPLSLLLKNSPLVSRLTLYDIAHTPGVAADLSHIETKAAVKGYLGPEQLPDCLKGCDVVVIPAGVPRKPGMTRDDLFNTNATIVATLTAACAQHCPEAMICVIANPVNSTIPITAEVFKKHGVYNPNKMVWIQLESTSLSLVAMLGRPSSP

SEQ ID NO: 909628 - protein, 204 aa, Homo sapiens
DRKSGHSREAPESRRWAVWRSLESLPRHQLLCLPVGAPPAPAMLSALARPASAALRRSFSTSAQNNAKVAVLGASGGIGQPLSLLLKNSPLVSRLTLYDIAHTPGVAADLSHIETKAAVKGYLGPEQLPDCLKGCDVVVIPAGVPRKPGMTRDDLFNTNATIVATLTAACAQHCPEAMICVIANPVNSTIPIPHIIGENHVPDM

SEQ ID NO: 909629 - protein, 80 aa, Homo sapiens
GRVGREDELGDGIRDHLLLKRGDFADAQVSGEDDLGCHPRAEGLHQEGGRFREDPEVSRCDGWPVSLIYEGIMSLQSRCR

SEQ ID NO: 909630 - protein, 282 aa, Homo sapiens; identical to SEQ ID NO: 909614

SEQ ID NO: 909631 - protein, 282 aa, Homo sapiens; identical to SEQ ID NO: 909614

SEQ ID NO: 909632 - protein, 282 aa, Homo sapiens; identical to SEQ ID NO: 909614

SEQ ID NO: 909633 - protein, 282 aa, Homo sapiens; identical to SEQ ID NO: 909614

SEQ ID NO: 909634 - protein, 262 aa, Homo sapiens
QLLRFRTHASRCLPVGAPPAPAMLSALARPASAALRRSFSTSAQNNAKVAVLGASGGIGQPLSLLLKNSPLVSRLTLYDIAHTPGVAADLSHIETKAAVKGYLGPEQLPDCLKGCDVVVIPAGVPRKPGMTRDDLFNTNATIVATLTAACAQHCPEAMICVIANPVNSTIPITAEVFKKHGVYNPNKIFGVTTLDIVRANTFVAELKGLDPARVNVPVIGGHAGKTIIPLISQCTPKVDFPQDQLTALTGADPGGRHGGGQG

SEQ ID NO: 909635 - protein, 282 aa, Homo sapiens; identical to SEQ ID NO: 909614

SEQ ID NO: 909636 - protein, 282 aa, Homo sapiens; identical to SEQ ID NO: 909614

SEQ ID NO: 909637 - protein, 282 aa, Homo sapiens; identical to SEQ ID NO: 909614

SEQ ID NO: 909638 - protein, 282 aa, Homo sapiens; identical to SEQ ID NO: 909614

SEQ ID NO: 909639 - protein, 195 aa, Homo sapiens
DRKSGHSREAPESRRWAVWRSLESLPRHQLLCLPVGAPPAPAMLSALARPASAALRRSFSTSAQNNAKVAVLGASGGIGQPLSLLLKNSPLVSRLTLYDIAHTPGVAADLSHIETKAAVKGYLGPEQLPDCLKGCDVVVIPAGVPRKPGMTRDDLFNTNATIVATLTAACAQHCPEAMICVIANPVIHHPHKREV

SEQ ID NO: 909640 - protein, 238 aa, Homo sapiens
MALVPCQVLRMAILLSYCSILCNYKAIEMPSHQTYGGSWKFLTFIDLVIQAVFFGICVLTDLSSLLTRGSGNQEQERQLKKLISLRDWMLAVLAFPVGVFVVAVFWIIYAYDREMIYPKLLDNFIPGWLNHGMHTTVLPFILIEMRTSHHQYPSRSSGLTAICTFSVGYILWVCWVHHVTGMWVYPFLEHIGPGARIIFFGSTTILMNFLYLLGEVLNNYIWDTQKSMEEEKEKPKLE

SEQ ID NO: 909641 - protein, 135 aa, Homo sapiens
MIYPKLLDNFIPGWLNHGMHTTVLPFILIEMRTSHHQYPSRSSGLTAICTFSVGYILWVCWVHHVTGMWVYPFLEHIGPGARIIFFGSTTILMNFLYLLGEVLNNYIWDTQKSCAFGSAAIWQYESLKSRGPELF

SEQ ID NO: 909642 - protein, 238 aa, Homo sapiens; identical to SEQ ID NO: 909640

SEQ ID NO: 909643 - protein, 238 aa, Homo sapiens; identical to SEQ ID NO: 909640

SEQ ID NO: 909644 - protein, 238 aa, Homo sapiens; identical to SEQ ID NO: 909640

SEQ ID NO: 909645 - protein, 209 aa, Homo sapiens
IDFSTEYAFKYVTDHGLQVIQAVFFGICVLTDLSSLLTRGSGNQEQERQLKKLISLRDWMLAVLAFPVGVFVVAVFWIIYAYDREMIYPKLLDNFIPGWLNHGMHTTVLPFILIEMRTSHHQYPSRSSGLTAICTFSVGYILWVCWVHHVTGMWVYPFLEHIGPGARIIFFGSTTILMNFLYLLGEVLNNYIWDTQKSMEEEKEKPKLE

SEQ ID NO: 909646 - protein, 239 aa, Homo sapiens
MALVPCQVLRMAILLSYCSILCNYKAIEMPSHQTYGGSWKFLTFIDLVIQAVFFGICVLTDLSSLLTRGSGNQEQERQLKKLISLRDWMLAVLAFPVGVFVVAVFWIIYAYDREMIYPKLLDNFIPGWLNHGMHTTVLPFILIEMRTSHHQYPSRSSGLTAICTFSVGYILWVCWVHHVTGMWVYPFLEHIGPGARIIFFGSTTILMNFLYLLGEVLNNYIWDTQKNMKIKFMYLGPSS

SEQ ID NO: 909647 - protein, 220 aa, Homo sapiens
APARPAPPSRPPSLPPSRSRPLANMALVPCQVLRMAILLSYCSILCNYKAIEMPSHQTYGGSWKFLTFIDLVIQAVFFGICVLTDLSSLLTRGSGNQEQERQLKKLISLRDWMLAVLAFPVGVFVVAVFWIIYAYDREMIYPKLLDNFIPGWLNHGMGVLGASCNWHVGVPFPGTHWPRSQNHLLWVYNHLNELPVPAGRSSEQLYLGYTEKYGRRERKA

SEQ ID NO: 909648 - protein, 238 aa, Homo sapiens; identical to SEQ ID NO: 909640

SEQ ID NO: 909649 - protein, 239 aa, Homo sapiens; identical to SEQ ID NO: 909646

SEQ ID NO: 909650 - protein, 249 aa, Homo sapiens
MALVPCQVLRMAILLSYCSILCNYKAIEMPSHQTYGGSWKFLTFIDLVIQAVFFGICVLTDLSSLLTRGSGNQEQERQLKKLISLRDWMLAVLAFPVGVFVVAVFWIIYAYDREMIYPKLLDNFIPGWLNHGMHTTVLPFILIEMRTSHHQYPSRSSGLTAICTFSVGYILWVCWVHHVTGMWVYPFLEHIGPGARIIFFGSTTILMNFLYLLGEVLNNYIWDTQKSCAFGSAAIWQYESLKSRGPELF

SEQ ID NO: 909651 - protein, 257 aa, Homo sapiens
MALVPCQVLRMAILLSYCSILCNYKAIEMPSHQTYGGSWKFLTFIDLVIQAVFFGICVLTDLSSLLTRGSGNQEQERQLKKLISLRDWMLAVLAFPVGVFVVAVFWIIYAYDREMIYPKLLDNFIPGWLNHGMHTTVLPFILIEMRTSHHQYPSRSSGLTAICTFSVGYILWVCWVHHVTGMWVYPFLEHIGPGARIIFFGSTTILMNFLYLLGEDPLAPIRHGKAIPYSFLFRKALPFYDIAIANIRLFFLRDEVA

SEQ ID NO: 909652 - protein, 137 aa, Homo sapiens
MALVPCQVLRMAILLSYCSILCNYKAIEMPSHQTYGGSWKFLTFIDLVIQAVFFGICVLTDLSSLLTRGSGNQEQERQLKKLISLRDWMLAVLAFPVGVFVVAVFWIIYAYDREMIYPKLLDNFIPGWLNHGMHFKA

SEQ ID NO: 909653 - protein, 271 aa, Homo sapiens
SGSVPSLRAVTLTTKVCRFILEVTETTNLPADTNSRHIIKVLRMAILLSYCSILCNYKAIEMPSHQTYGGSWKFLTFIDLVIQAVFFGICVLTDLSSLLTRGSGNQEQERQLKKLISLRDWMLAVLAFPVGVFVVAVFWIIYAYDREMIYPKLLDNFIPGWLNHGMHTTVLPFILIEMRTSHHQYPSRSSGLTAICTFSVGYILWVCWVHHVTGMWVYPFLEHIGPGARIIFFGSTTILMNFLYLLGEVLNNYIWDTQKSMEEEKEKPKLE

SEQ ID NO: 909654 - protein, 71 aa, Homo sapiens
APARPAPPSRPPSLPPSRSRPLANMALVPCQVLRMAILLSYCSILCNYKAIEMPSHQTYGGSWKFLTFIDL

SEQ ID NO: 909655 - protein, 238 aa, Homo sapiens; identical to SEQ ID NO: 909640

SEQ ID NO: 909656 - protein, 283 aa, Homo sapiens
PTSHRARFPLEISAHFPSPRSTQRSHPHLGCLGGASWPGVPGPCERRSRMTKVLRMAILLSYCSILCNYKAIEMPSHQTYGGSWKFLTFIDLVIQAVFFGICVLTDLSSLLTRGSGNQEQERQLKKLISLRDWMLAVLAFPVGVFVVAVFWIIYAYDREMIYPKLLDNFIPGWLNHGMHTTVLPFILIEMRTSHHQYPSRSSGLTAICTFSVGYILWVCWVHHVTGMWVYPFLEHIGPGARIIFFGSTTILMNFLYLLGEVLNNYIWDTQKSMEEEKEKPKLE

SEQ ID NO: 909657 - protein, 318 aa, Homo sapiens
SGSVPSLRAVTLTTKVCRFILEVTETTNLPADTNSRHIIKVLRMAILLSYCSILCNYKAIEMPSHQTYGGSWKFLTFIDLMESHSVTRLECSGTISAHCNLCLLCSSYSPASASRVAGTTGVCHHARVIQAVFFGICVLTDLSSLLTRGSGNQEQERQLKKLISLRDWMLAVLAFPVGVFVVAVFWIIYAYDREMIYPKLLDNFIPGWLNHGMHTTVLPFILIEMRTSHHQYPSRSSGLTAICTFSVGYILWVCWVHHVTGMWVYPFLEHIGPGARIIFFGSTTILMNFLYLLGEVLNNYIWDTQKSMEEEKEKPKLE

SEQ ID NO: 909658 - protein, 186 aa, Homo sapiens
MALVPCQVLRMAILLSYCSILCNYKAIEMPSHQTYGGSWKFLTFIDLFVVAVFWIIYAYDREMIYPKLLDNFIPGWLNHGMHTTVLPFILIEMRTSHHQYPSRSSGLTAICTFSVGYILWVCWVHHVTGMWVYPFLEHIGPGARIIFFGSTTILMNFLYLLGEVLNNYIWDTQKSMEEEKEKPKLE

SEQ ID NO: 909659 - protein, 101 aa, Homo sapiens
CRLISEDPAGCFHQYPSRSSGLTAICTFSVGYILWVCWVHHVTGMWVYPFLEHIGPGARIIFFGSTTILMNFLYLLGEVLNNYIWDTQKSMEEEKEKPKLE

SEQ ID NO: 909660 - protein, 269 aa, Homo sapiens
APARPAPPSRPPSLPPSRSRPLANMALVPCQVLRMAILLSYCSILCNYKAIEMPSHQTYGGSWKFLTFIDLVIQAVFFGICVLTDLSSLLTRGSGNQEQERQLKKLISLRDWMLAVLAFPVGVFVVAVFWIIYAYDREMIYPKLLDNFIPGWLNHGMHTTVLPFILIEMRTSHHQYPSRSSGLTAICTFSVGYILWVCWVHHVTGMWVYPFLEHIGPGARIIFFGSTTILMNFLYLLGEVLNNYIWDTQKKPPSWQDMKIKFMYLGPSS

SEQ ID NO: 909661 - protein, 258 aa, Homo sapiens
MALVPCQVLRMAILLSYCSILCNYKAIEMPSHQTYGGSWKFLTFIDLVIQAVFFGICVLTDLSSLLTRGSGNQEQERQLKKLISLRDWMLAVLAFPVGVFVVAVFWIIYAYDREMIYPKLLDNFIPGWLNHGMHTTVLPFILIEMRTSHHQYPSRSSGLTAICTFSVGYILWVCWVHHVTGMWVYPFLEHIGPGARIIFFGSTTILMNFLYLLGEVLNNYIWDTQKSKYCLREHKTRELLPATVYAETEGKFHCSLFF

SEQ ID NO: 909662 - protein, 779 aa, Homo sapiens [sequence omitted]

SEQ ID NO: 909663 - protein, 526 aa, Homo sapiens
MLPTWWIVSSWLVWGVILFVYLVIRALRLWRTAKLQVTLKKYSVHLEDMATNSRAFTNLVRKALRLIQETEVISRGFTLVSAACPFNKAGQHPSQHLIGLRKAVYRTLRANFQAARLATLYMLKNYPLNSESDNVTNYICVVPFKELGLGLSEEQISEEEAHNFTDGFSLPALKVLFQLWVAQSSEFFRRVIILEDELEKLVCTKETQELVSEAYPILEQKLKLIQPHVQASNNCWEEAISQVDKLLRRNTDKKGKPEIACENPHCTVVPLKQPTLHIADKDPIPEEQELEAYVDDIDIDSDFRKDDFYYLSQEDKERQKREHEESKRVLQELKSVLGFKASEAERQKWKQLLFSDHAVLKSLSPVDPVEPISNSEPSMNSDMGKVSKNDTEEESNKSATTDNEISRTEYLCENSLEGKNKDNSSNEVFPQGAEERMCYQCESEDEPQADGSGLTTAPPTPRDSLQPSIKQRLARLQLSPDFTFTAGLAAEVAARSLSFTTMQEQTFGDEEEEQIIEENKNEIEEK

SEQ ID NO: 909664 - protein, 565 aa, Homo sapiens
MLKEWAIKQGILLKVAETIKSWIFFSQCNKKDDLLHKLDIGFRLDSLHTILQQEVLLQEDVELIELLDPSILSAGQSQQQENGHLPTLCSLATPNIWDLSMLFAFISLLVMLPTWWIVSSWLVWGVILFVYLVIRALRLWRTAKLQVTLKKYSVHLEDMATNSRAFTNLVRKALRLIQETEVISRGFTLVSAACPFNKAGQHPSQHLIGLRKAVYRTLRANFQAARLATLYMLKNYPLNSESDNVTNYICVVPFKELGLGLSEEQISEEEAHNFTDGFSLPALKVLFQLWVAQSSEFFRRLALLLSTANSPPGPLLTPALLPHRILSDVTQGLPHAHSACLEELKRSYEFYRYFETQHQSVPQCLSKTQQKSRELNNVHTAVRSLQLHLKALLNEVIILEDELEKLVCTKETQELVSEAYPILEQKLKLIQPHVQASNNCWEEAISQVDKLLRRNTDKKGKPEIACENPHCTVVPLKQPTLHIADKDPIPEEQELEAYVDDIDIDSDFRKDDFYYLSQEDKERQKREHEESKRVLQELKSVLGFKASEAERQKWKQLLFSDHGKH

SEQ ID NO: 909665 - protein, 731 aa, Homo sapiens
MLKEWAIKQGILLKVAETIKSWIFFSQCNKKDDLLHKLDIGFRLDSLHTILQQEVLLQEDVELIELLDPSILSAGQSQQQENGHLPTLCSLATPNIWDLSMLFAFISLLVMLPTWWIVSSWLVWGVILFVYLVIRALRLWRTAKLQVTLKKYSVHLEDMATNSRAFTNLVRKALRLIQETEVISRGFTLVSAACPFNKAGQHPSQHLIGLRKAVYRTLRANFQAARLATLYMLKNYPLNSESDNVTNYICVVPFKELGLGLSEEQISEEEAHNFTDGFSLPALKVLFQLWVAQSSEFFRRLALLLSTANSPPGPLLTPALLPHRILSDVTQGLPHAHSACLEELKRSYEFYRYFETQHQSVPQCLSKTQQKSRELNNVHTAVRSLQLHLKALLNEVIILEDELEKLVCTKETQELVSEAYPILEQKLKLIQPHVQASNNCWEEAISQVDKLLRRNTDKKGKPEIACENPHCTVVPLKQPTLHIADKDPIPEEQELEAYVDDIDIDSDFRKDDFYYLSQEDKERQKREHEESKRVLQELKSVLGFKASEAERQKWKQLLFSDHAVLKSLSPVDPVEPISNSEPSMNSDMGKVSKNDTEEESNKSATTDNEISRTEYLCENSLEGKNKDNSSNEVFPQGAEERMCYQCESEDEPQADGSGLTTAPPTPRDSLQPSIKQRLARLQLSPDFTFTAGLAAEVAARSLSFTTMQEQTFGDEEEEQIIEENKNEIEEK

SEQ ID NO: 909666 - protein, 731 aa, Homo sapiens; identical to SEQ ID NO: 909665

SEQ ID NO: 909667 - protein, 573 aa, Homo sapiens
MLKEWAIKQGILLKVAETIKSWIFFSQCNKKDDLLHKLDIGFRLDSLHTILQQEVLLQEDVELIELLDPSILSAGQSQQQENGHLPTLCSLATPNIWDLSMLFAFISLLVMLPTWWIVSSWLVWGVILFVYLVIRALRLWRTAKLQVTLKKYSVHLEDMATNSRAFTNLVRKALRLIQETEVISRGFTLVSAACPFNKAGQHPSQHLIGLRKAVYRTLRANFQAARLATLYMLKNYPLNSESDNVTNYICVVPFKELGLGLSEEQISEEEAHNFTDGFSLPALKVLFQLWVAQSSEFFRRLALLLSTANSPPGPLLTPALLPHRILSDVTQGLPHAHSACLEELKRSYEFYRYFETQHQSVPQCLSKTQQKSRELNNVHTAVRSLQLHLKALLNEVIILEDELEKLVCTKETQELVSEAYPILEQKLKLIQPHVQASNNCWEEAISQVDKLLRRNTDKKGKPEIACENPHCTVVPLKQPTLHIADKDPIPEEQELEAYVDDIDIDSDFRKDDFYYLSQEDKERQKREHEESKRVLQELKSVLGFKASEAERQKWKQLLFSDHVFLHIALKLCY

SEQ ID NO: 909668 - protein, 621 aa, Homo sapiens
MLPTWWIVSSWLVWGVILFVYLVIRALRLWRTAKLQVTLKKYSVHLEDMATNSRAFTNLVRKALRLIQETEVISRGFTLVSAACPFNKAGQHPSQHLIGLRKAVYRTLRANFQAARLATLYMLKNYPLNSESDNVTNYICVVPFKELGLGLSEEQISEEEAHNFTDGFSLPALKVLFQLWVAQSSEFFRRLALLLSTANSPPGPLLTPALLPHRILSDVTQGLPHAHSACLEELKRSYEFYRYFETQHQSVPQCLSKTQQKSRELNNVHTAVRSLQLHLKALLNEVIILEDELEKLVCTKETQELVSEAYPILEQKLKLIQPHVQASNNCWEEAISQVDKLLRRNTDKKGKPEIACENPHCTVVPLKQPTLHIADKDPIPEEQELEAYVDDIDIDSDFRKDDFYYLSQEDKERQKREHEESKRVLQELKSVLGFKASEAERQKWKQLLFSDHAVLKSLSPVDPVEPISNSEPSMNSDMGKVSKNDTEEESNKSATTDNEISRTEYLCENSLEGKNKDNSSNEVFPQGAEERMCYQCESEDEPQADGSGLTTAPPTPRDSLQPSIKQRLARLQLSPDFTFTAGLAAEVAARSLSFTTMQEQTFGDEEEEQIIEENKNEIEEK

SEQ ID NO: 909669 - protein, 779 aa, Homo sapiens [sequence omitted]

SEQ ID NO: 909670 - protein, 189 aa, Homo sapiens
MLKEWAIKQGILLKVAETIKSWIFFSQCNKKDDLLHKLDIGFRLDSLHTILQQEVLLQEDVELIELLDPSILSAGQSQQQENGHLPTLCSLATPNIWDLSMLFAFISLLVMLPTWWIVSSWLVWGVILFVYLVIRALRLWRTAKLQVTLKKYSVHLEDMATNSRAFTNLVRKALPPCRNRLLVMRRKNK

SEQ ID NO: 909671 - protein, 692 aa, Homo sapiens
MLKEWAIKQGILLKVAETIKSWIFFSQCNKKDDLLHKLDIGFRLDSLHTILQQEVLLQEDVELIELLDPSILSAGQSQQQENGHLPTLCSLATPNIWDLSMLFAFISLLVMLPTWWIVSSWLVWGVILFVYLVIRALRLWRTAKLQVTLKKYSVHLEDMATNSRAFTNLVRKALRLIQETEVISRGFTLVSAACPFNKAGQHPSQHLIGLRKAVYRTLRANFQAARLATLYMLKNYPLNSESDNVTNYICVVPFKELGLGLSEEQISEEEAHNFTDGFSLPALKVLFQLWVAQSSEFFRRLALLLSTANSPPGPLLTPALLPHRILSDVTQGLPHAHSACLEELKRSYEFYRYFETQHQSVPQCLSKTQQKSRELNNVHTAVRSLQLHLKALLNEVIILEDELEKLVCTKETQELVSEAYPILEQKLKLIQPHVQASNNCWEEAISQVDKLLRRNTDKKGKPEIACENPHCTVVPLKQPTLHIADKDPIPEEQELEAYVDDIDIDSDFRKDDFYYLSQEDKERQKREHEESKRVLQELKSVLGFKASEAERQKWKQLLFSDHAVLKSLSPVDPVEPISNSEPSMNSDMGKVSKNDTEEESNKSATTDNEISRTEYLCENSLEGKNKDNSSNEVFPQGAEERMCYQCESEDEPQADGSGLTTAPPTPRDSLQPSIKQRLARLQLSPDFTFTAG

SEQ ID NO: 909672 - protein, 287 aa, Homo sapiens
MTPEFDEEVVFENSPLYQYLQDLGHTDFEICSSLSPKTEKCTTEGQQKPPTRVLPKQGILLKVAETIKSWIFFSQCNKKDDLLHKLDIGFRLDSLHTILQQEVLLQEDVELIELLDPSILSAGQSQQQENGHLPTLCSLATPNIWDLSMLFAFISLLVMLPTWWIVSSWLVWGVILFVYLVIRALRLWRTAKLQVTLKKYSVHLEDMATNSRAFTNLVRKALRLIQETEVISRGFTLVSAACPFNKAGQHPSQHLIGLRKAVYRTLRANFQAARLATLYMLKNTPEL

SEQ ID NO: 909673 - protein, 463 aa, Homo sapiens
AQLRYGKPRFPQALWLVWGVILFVYLVIRALRLWRTAKLQVTLKKYSVHLEDMATNSRAFTNLVRKALRLIQETEVISRGFTLVSAACPFNKAGQHPSQHLIGLRKAVYRTLRANFQAARLATLYMLKNYPLNSESDNVTNYICVVPFKELGLGLSEEQISEEEAHNFTDGFSLPALKVLFQLWVAQSSEFFRRLALLLSTANSPPGPLLTPALLPHRILSDVTQGLPHAHSACLEELKRSYEFYRYFETQHQSVPQCLSKTQQKSRELNNVHTAVRSLQLHLKALLNEVIILEDELEKLVCTKETQELVSEAYPILEQKLKLIQPHVQASNNCWEEAISQVDKLLRRNTDKKGKPEIACENPHCTVVPLKQPTLHIADKDPIPEEQELEAYVDDIDIDSDFRKDDFYYLSQEDKERQKREHEESKRVLQELKSVLGFKASEAERQKWKQLLFSDHGVKSAWN

SEQ ID NO: 909674 - protein, 104 aa, Homo sapiens
MTPEFDEEVVFENSPLYQYLQDLGHTDFEICSSLSPKTEKCTTEGQQKPPTRVLPKVRTHAHSFWPNLLHFTLLAIQILLKHFHILPHTGKTIYFINSTKLSVR

SEQ ID NO: 909675 - protein, 779 aa, Homo sapiens [sequence omitted]

SEQ ID NO: 909676 - protein, 621 aa, Homo sapiens; identical to SEQ ID NO: 909668

SEQ ID NO: 909677 - protein, 500 aa, Homo sapiens
MLKNYPLNSESDNVTNYICVVPFKELGLGLSEEQISEEEAHNFTDGFSLPALKVLFQLWVAQSSEFFRRLALLLSTANSPPGPLLTPALLPHRILSDVTQGLPHAHSACLEELKRSYEFYRYFETQHQSVPQCLSKTQQKSRELNNVHTAVRSLQLHLKALLNEVIILEDELEKLVCTKETQELVSEAYPILEQKLKLIQPHVQASNNCWEEAISQVDKLLRRNTDKKGKPEIACENPHCTVVPLKQPTLHIADKDPIPEEQELEAYVDDIDIDSDFRKDDFYYLSQEDKERQKREHEESKRVLQELKSVLGFKASEAERQKWKQLLFSDHAVLKSLSPVDPVEPISNSEPSMNSDMGKVSKNDTEEESNKSATTDNEISRTEYLCENSLEGKNKDNSSNEVFPQGAEERMCYQCESEDEPQADGSGLTTAPPTPRDSLQPSIKQRLARLQLSPDFTFTAGLAAEVAARSLSFTTMQEQTFGDEEEEQIIEENKNEIEEK

SEQ ID NO: 909678 - protein, 569 aa, Homo sapiens
MLKEWAIKQGILLKVAETIKSWIFFSQCNKKDDLLHKLDIGFRLDSLHTILQQEVLLQEDVELIELLDPSILSAGQSQQQENGHLPTLCSLATPNIWDLSMLFAFISLLVMLPTWWIVSSWLVWGVILFVYLVIRALRLWRTAKLQVTLKKYSVHLEDMATNSRAFTNLVRKALRLIQETEVISRGFTLVSAACPFNKAGQHPSQHLIGLRKAVYRTLRANFQAARLATLYMLKNYPLNSESDNVTNYICVVPFKELGLGLSEEQISEEEAHNFTDGFSLPALKVLFQLWVAQSSEFFRRLALLLSTANSPPGPLLTPALLPHRILSDVTQGLPHAHSACLEELKRSYEFYRYFETQHQSVPQCLSKTQQKSRELNNVHTAVRSLQLHLKALLNEVIILEDELEKLVCTKETQELVSEAYPILEQKLKLIQPHVQASNNCWEEAISQVDKLLRRNTDKKGKPEIACENPHCTVVPLKQPTLHIADKDPIPEEQELEAYVDDIDIDSDFRKDDFYYLSQEDKERQKREHEESKRVLQELKSVLGFKASEAERQKWKQLLFSDHGVKSAWN

SEQ ID NO: 909679 - protein, 580 aa, Homo sapiens
MLKEWAIKQGILLKVAETIKSWIFFSQCNKKDDLLHKLDIGFRLDSLHTILQQEVLLQEDVELIELLDPSILSAGQSQQQENGHLPTLCSLATPNIWDLSMLFAFISLLVMLPTWWIVSSWLVWGVILFVYLVIRALRLWRTAKLQVTLKKYSVHLEDMATNSRAFTNLVRKALRLIQETEVISRGFTLVSAACPFNKAGQHPSQHLIGLRKAVYRTLRANFQAARLATLYMLKNYPLNSESDNVTNYICVVPFKELGLGLSEEQISEEEAHNFTDGFSLPALKVLFQLWVAQSSEFFRRLALLLSTANSPPGPLLTPALLPHRILSDVTQGLPHAHSACLEELKRSYEFYRYFETQHQSVPQCLSKTQQKSRELNNVHTAVRSLQLHLKALLNEVIILEDELEKLVCTKETQELVSEAYPILEQKLKLIQPHVQASNNCWEEAISQVDKLLRRNTDKKGKPEIACENPHCTVVPLKQPTLHIADKDPIPEEQELEAYVDDIDIDSDFRKDDFYYLSQEDKERQKREHEESKRVLQELKSVLGFKASEAERQKWKQLLFSDHAVLKSLSPVEPCGIFTLG

SEQ ID NO: 909680 - protein, 462 aa, Homo sapiens
MARVLGAPVALGLWSLCWSLAIATPLPPTSAHGNVAEGETKPDPDVTERCSDGWSFDATTLDDNGTMLFFKGEFVWKSHKWDRELISERWKNFPSPVDAAFRQGHNSVFLIKGDKVWVYPPEKKEKGYPKLLQDEFPGIPSPLDAAVECHRGECQAEGVLFFQGDREWFWDLATGTMKERSWPAVGNCSSALRWLGRYYCFQGNQFLRFDPVRGEVPPRYPRDVRDYFMPCPGRGHGHRNGTGHGNSTHHGPEYMRCSPHLVLSALTSDNHGATYAFSGTHYWRLDTSRDGWHSWPIAHQWPQGPSAVDAAFSWEEKLYLVQGTQVYVFLTKGGYTLVSGYPKRLEKEVGTPHGIILDSVDAAFICPGSSRLHIMAGRRLWWLDLKSGAQATWTELPWPHEKVDGALCMEKSLGPNSCSANGPGLYLIHGPNLYCYSDVEKLNAAKALPQPQNVTSLLGCTH

SEQ ID NO: 909681 - protein, 444 aa, Homo sapiens
MARVLGAPVALGLWSLCWSLAIATPLPPTSAHGNVAEGETKPDPDVTERCSDGWSFDATTLDDNGTMLFFKGEFVWKSHKWDRELISERWKNFPSPVDAAFRQGHNSVFLIKGDKVWVYPPASPLDAAVECHRGECQAEGVLFFQGDREWFWDLATGTMKERSWPAVGNCSSALRWLGRYYCFQGNQFLRFDPVRGEVPPRYPRDVRDYFMPCPGRGHGHRNGTGHGNSTHHGPEYMRCSPHLVLSALTSDNHGATYAFSGTHYWRLDTSRDGWHSWPIAHQWPQGPSAVDAAFSWEEKLYLVQGTQVYVFLTKGGYTLVSGYPKRLEKEVGTPHGIILDSVDAAFICPGSSRLHIMAGRRLWWLDLKSGAQATWTELPWPHEKVDGALCMEKSLGPNSCSANGPGLYLIHGPNLYCYSDVEKLNAAKALPQPQNVTSLLGCTH

SEQ ID NO: 909682 - protein, 462 aa, Homo sapiens
MLVSGHCHPSSSVSKAGTRSEGLSSGLGTSAHGNVAEGETKPDPDVTERCSDGWSFDATTLDDNGTMLFFKGEFVWKSHKWDRELISERWKNFPSPVDAAFRQGHNSVFLIKGDKVWVYPPEKKEKGYPKLLQDEFPGIPSPLDAAVECHRGECQAEGVLFFQGDREWFWDLATGTMKERSWPAVGNCSSALRWLGRYYCFQGNQFLRFDPVRGEVPPRYPRDVRDYFMPCPGRGHGHRNGTGHGNSTHHGPEYMRCSPHLVLSALTSDNHGATYAFSGTHYWRLDTSRDGWHSWPIAHQWPQGPSAVDAAFSWEEKLYLVQGTQVYVFLTKGGYTLVSGYPKRLEKEVGTPHGIILDSVDAAFICPGSSRLHIMAGRRLWWLDLKSGAQATWTELPWPHEKVDGALCMEKSLGPNSCSANGPGLYLIHGPNLYCYSDVEKLNAAKALPQPQNVTSLLGCTH

SEQ ID NO: 909683 - protein, 462 aa, Homo sapiens; identical to SEQ ID NO: 909680

SEQ ID NO: 909684 - protein, 366 aa, Homo sapiens
MARVLGAPVALGLWSLCWSLAIATPLPPTSAHGNVAEGETKPDPDVTERCSDGWSFDATTLDDNGTMLFFKGEFVWKSHKWDRELISERWKNFPSPVDAAFRQGHNSVFLIKGDKVWVYPPEKKEKGYPKLLQDEFPGIPSPLDAAVECHRGECQAEGVLFFQGQSRLESKNLEKWWVGSDARTHYWRLDTSRDGWHSWPIAHQWPQGPSAVDAAFSWEEKLYLVQGTQVYVFLTKGGYTLVSGYPKRLEKEVGTPHGIILDSVDAAFICPGSSRLHIMAGRRLWWLDLKSGAQATWTELPWPHEKVDGALCMEKSLGPNSCSANGPGLYLIHGPNLYCYSDVEKLNAAKALPQPQNVTSLLGCTH

SEQ ID NO: 909685 - protein, 409 aa, Homo sapiens
MARVLGAPVALGLWSLCWSLAIATPLPPTSAHGNVAEGETKPDPDVTERCSDGWSFDATTLDDNGTMLFFKGEFVWKSHKWDRELISERWKNFPSPVDAAFRQGHNSVFLIKGDKVWVYPPEKKEKGYPKLLQDEFPGIPSPLDAAVECHRGECQAEGVLFFQGDREWFWDLATGTMKERSWPAVGNCSSALRWLGRYYCFQGNQFLRFDPVRGEVPPRYPRDVRDYFMPCPGRGHGHRNGTGHGNSTHHGPEYMRCSPHLVLSALTSDNHGATYAFSGTHYWRLDTSRDGWHSWPIAHQWPQGPSAVDAAFSWEEKLYLVQGTQVYVFLTKGGYTLVSGYPKRLEKEVGTPHGIILDSVDAAFICPGSSRLHIMAGRRLWWLDLKSGAQATWTELPWPHEKVDVMWRN

SEQ ID NO: 909686 - protein, 387 aa, Homo sapiens
MARVLGAPVALGLWSLCWSLAIATPLPPTSAHGNVAEGETKPDPDVTERCSDGWSFDATTLDDNGTMLFFKGEFVWKSHKWDRELISERWKNFPSPVDAAFRQGHNSVFLIKGDKVWVYPPEKKEKGYPKLLQDEFPGIPSPLDAAVECHRGECQAEGVLFFQGDREWFWDLATGTMKERSWPAVGNCSSALRWLGRYYCFQGNQFLRFDPVRGEVPPRYPRDVRDYFMPCPGRGHGHRNGTGHGNSTHHGPEYMRCSPHLVLSALTSDNHGATYAFSGTHYWRLDTSRDGWHSWPIAHQWPQGPSAVDAAFSWEEKLYLVQYPSKRLSEAAGEGSRDPSWDYPGLCGCGLYLPWVFSAPYHGRTAAVVAGPEVRSPSHVDRASLAP

SEQ ID NO: 909687 - protein, 174 aa, Homo sapiens
MARVLGAPVALGLWSLCWSLAIATPLPPTSAHGNVAEGETKPDPDVTERCSDGWSFDATTLDDNGTMLFFKGEFVWKSHKWDRELISERWKNFPSPVDAAFRQGHNSVFLIKGDKVWVYPPEKKEKGYPKLLQDEFPGIPSPLDAAVECHRGECQAEGVLFFQGQSRLESKNLE

SEQ ID NO: 909688 - protein, 250 aa, Homo sapiens
MARVLGAPVALGLWSLCWSLAIATPLPPTSAHGNVAEGETKPDPDVTERCSDGWSFDATTLDDNGTMLFFKGEFVWKSHKWDRELISERWKNFPSPVDAAFRQGHNSVFLIKGDKVWVYPPEKKEKGYPKLLQDEFPGIPSPLDAAVECHRGECQAEGVLFFQGDREWFWDLATGTMKERSWPAVGNCSSALRWLGRYYCFQGNQFLRFDPVRGEVPPRYPRDVRDYFMPCPGRGHGHRNGTGHGNIYAL

SEQ ID NO: 909689 - protein, 387 aa, Homo sapiens; identical to SEQ ID NO: 909686

SEQ ID NO: 909690 - protein, 549 aa, Homo sapiens
MARVLGAPVALGLWSLCWSLAIATPLPPTSAHGNVAEGETKPDPDVTERCSDGWSFDATTLDDNGTMLFFKGEFVWKSHKWDRELISERWKNFPSPVDAAFRQGHNSVFLIKGDKVWVYPPEKKEKGYPKLLQDEFPGIPSPLDAAVECHRGECQAEGVLFFQGDREWFWDLATGTMKERSWPAVGNCSSALRWLGRYYCFQGNQFLRFDPVRGEVPPRYPRDVRDYFMPCPGRGEKALALETCQNSSTFPELVDLTCPSSHFNSVLRHLALNLAPFPFWIFPLPSYGETHTPLTPAISSTLDLTLTSGLLLCSPHPFLSPGHGHRNGTGHGNSTHHGPEYMRCSPHLVLSALTSDNHGATYAFSGTHYWRLDTSRDGWHSWPIAHQWPQGPSAVDAAFSWEEKLYLVQGTQVYVFLTKGGYTLVSGYPKRLEKEVGTPHGIILDSVDAAFICPGSSRLHIMAGRRLWWLDLKSGAQATWTELPWPHEKVDGALCMEKSLGPNSCSANGPGLYLIHGPNLYCYSDVEKLNAAKALPQPQNVTSLLGCTH

SEQ ID NO: 909691 - protein, 444 aa, Homo sapiens
MLFQRFRNVCFPVGRKLRRVEKGSETFGTSAHGNVAEGETKPDPDVTERCSDGWSFDATTLDDNGTMLFFKGEFVWKSHKWDRELISERWKNFPSPVDAAFRQGHNSVFLIKGDKVWVYPPASPLDAAVECHRGECQAEGVLFFQGDREWFWDLATGTMKERSWPAVGNCSSALRWLGRYYCFQGNQFLRFDPVRGEVPPRYPRDVRDYFMPCPGRGHGHRNGTGHGNSTHHGPEYMRCSPHLVLSALTSDNHGATYAFSGTHYWRLDTSRDGWHSWPIAHQWPQGPSAVDAAFSWEEKLYLVQGTQVYVFLTKGGYTLVSGYPKRLEKEVGTPHGIILDSVDAAFICPGSSRLHIMAGRRLWWLDLKSGAQATWTELPWPHEKVDGALCMEKSLGPNSCSANGPGLYLIHGPNLYCYSDVEKLNAAKALPQPQNVTSLLGCTH

SEQ ID NO: 909692 - protein, 439 aa, Homo sapiens
MARVLGAPVALGLWSLCWSLAIATPLPPTSAHGNVAEGETKPDPDVTERCSDGWSFDATTLDDNGTMLFFKGEFVWKSHKWDRELISERWKNFPSPVDAAFRQGHNSVFLIKGDKVWVYPPEKKEKGYPKLLQDEFPGIPSPLDAAVECHRGECQAEGVLFFQGDREWFWDLATGTMKERSWPAVGNCSSALRWLGRYYCFQGNQFLRFDPVRGEVPPRYPRDVRDYFMPCPGRGHGHRNGTGHGNSTHHGPEYMRCSPHLVLSALTSDNHGATYAFSGTHYWRLDTSRDGWHSWPIAHQWPQGPSAVDAAFSWEEKLYLVQGTQVYVFLTKGGYTLVSGYPKRLEKEVGTPHGIILDSVDAAFICPGSSRLHIMAGRRLWWLDLKSGAQATWTELPWPHEKVDVHGPNLYCYSDVEKLNAAKALPQPQNVTSLLGCTH

SEQ ID NO: 909693 - protein, 373 aa, Homo sapiens
MKERSWPAVGNCSSALRWLGRYYCFQGNQFLRFDPVRGEVPPRYPRDVRDYFMPCPGRGEKALALETCQNSSTFPELVDLTCPSSHFNSVLRHLALNLAPFPFWIFPLPSYGETHTPLTPAISSTLDLTLTSGLLLCSPHPFLSPGHGHRNGTGHGNSTHHGPEYMRCSPHLVLSALTSDNHGATYAFSGTHYWRLDTSRDGWHSWPIAHQWPQGPSAVDAAFSWEEKLYLVQGTQVYVFLTKGGYTLVSGYPKRLEKEVGTPHGIILDSVDAAFICPGSSRLHIMAGRRLWWLDLKSGAQATWTELPWPHEKVDGALCMEKSLGPNSCSANGPGLYLIHGPNLYCYSDVEKLNAAKALPQPQNVTSLLGCTH

SEQ ID NO: 909694 - protein, 121 aa, Homo sapiens
TLYREFNWSPRAVLWPLQLSMARVLGAPVALGLWSLCWSLAIATPLPPTSAHGNVAEGETKPDPDVTERCSDGWSFDATTLDDNEPCVWKSPLALTHVPPMVPACTSSMVPICTATVMWRN

SEQ ID NO: 909695 - protein, 255 aa, Homo sapiens
GPKRGAAPCRRGGAGAGRATPAGAVRGREPAPPWWRRPLAVQRQTHRVGSGLQPGREEGPGLRSGDSGPRRGAHTQAGRPGVRGLCAADQAPRASAPPMAEPLQPDPGAAEDAAAQAVETPGWKAPEDAGPQPGSYEIRHYGPAKWVSTSVESMDWDSAIQTGFTKLNSYIQGKNEKELSHDCILPARAAKQGSCLLSGGRCSREAERPQNIAQVSSLHPNPPQFQALWPSRSRVGPGPVTRSKCNLENTVTCLH

SEQ ID NO: 909696 - protein, 303 aa, Homo sapiens
GPKRGAAPCRRGGAGAGRATPAGAVRGREPAPPWWRRPLAVQRQTHRVGSGLQPGREEGPGLRSGDSGPRRGAHTQAGRPGVRGLCAADQAPRASAPPMAEPLQPDPGAAEDAAAQAVETPGWKAPEDAGPQPGSYEIRHYGPAKWVSTSVESMDWDSAIQTGFTKLNSYIQGKNEKEMKIKMTAPVTSYVEPGSGPFSESTITISLYIPSEQQFDPPRPLESDVFIEDRAEMTVFVRSFDGFSSAQKNQEQLLTLASILREDGKVFDEKVYYTAGYNSPVKLLNRNNEVWLIQKNEPTKENE

SEQ ID NO: 909697 - protein, 303 aa, Homo sapiens; identical to SEQ ID NO: 909696

SEQ ID NO: 909698 - protein, 214 aa, Homo sapiens
GPKRGAAPCRRGGAGAGRATPAGAVRGREPAPPWWRRPLAVQRQTHRVGSGLQPGREEGPGLRSGDSGPRRGAHTQAGRPGVRGLCAADQAPRASAPPMAEPLQPDPGAAEDAAAQAVETPGWKAPEDAGPQPGSYEIRHYGPAKWVSTSVESMDWDSAIQTGFTKLNSYIQGKNEKEMKIKMTAPVTSYVEPGSGPFSLSMDFLVPKRIKNNF

SEQ ID NO: 909699 - protein, 214 aa, Homo sapiens; identical to SEQ ID NO: 909698

SEQ ID NO: 909700 - protein, 303 aa, Homo sapiens; identical to SEQ ID NO: 909696

SEQ ID NO: 909701 - protein, 303 aa, Homo sapiens; identical to SEQ ID NO: 909696

SEQ ID NO: 909702 - protein, 280 aa, Homo sapiens
GPKRGAAPCRRGGAGAGRATPAGAVRGREPAPPWWRRPLAVQRQTHRVGSGLQPGREEGPGLRSGDSGPRRGAHTQAGRPGVRGLCAADQAPRASAPPMAEPLQPDPGAPGSYEIRHYGPAKWVSTSVESMDWDSAIQTGFTKLNSYIQGKNEKEMKIKMTAPVTSYVEPGSGPFSESTITISLYIPSEQQFDPPRPLESDVFIEDRAEMTVFVRSFDGFSSAQKNQEQLLTLASILREDGKVFDEKVYYTAGYNSPVKLLNRNNEVWLIQKNEPTKENE

SEQ ID NO: 909703 - protein, 222 aa, Homo sapiens
GPKRGAAPCRRGGAGAGRATPAGAVRGREPAPPWWRRPLAVQRQTHRVGSGLQPGREEGPGLRSGDSGPRRGAHTQAGRPGVRGLCAADQAPRASAPPMAEPLQPDPGAAEDAAAQAVETPGWKAPEDAGPQPGSYEIRHYGPAKWVSTSVESMDWDSAIQTGFTKLNSYIQGKNEKEMKIKMTAPVTSYVEPGSGPFREGKRGNVQVKIESGKGASTGVLV

SEQ ID NO: 909704 - protein, 158 aa, Homo sapiens
ERAQPRDPRAGQRVRRDLGDKARPRAQLRRESGGAESVTRPLRAASPAPPPRAARAAMSEEKPKEGVKTENDHINLKVAGQDGSVVQFKIKRHTPLSKLMKAYCERQVRHLAPPQSLPVCALVLCVPGIPRARASRGWTQMQLPEVPSSWMGRRGLVL

SEQ ID NO: 909705 - protein, 147 aa, Homo sapiens
SLWCLLQEGVKTENDHINLKVAGQDGSVVQFKIKRHTPLSKLMKAYCERQGLSMRQIRFRFDGQPINETDTPAQGIILSWKELWTWKQTFFFETESRFVAQARMQWRSLSSLCKLCLLSSRHSPASASQVAGTIGAHHHSRLIFLYF

SEQ ID NO: 909706 - protein, 178 aa, Homo sapiens
ERAQPRDPRAGQRVRRDLGDKARPRAQLRRESGGAESVTRPLRAASPAPPPRAARAAMSEEKPKEGVKTENDHINLKVAGQDGSVVQFKIKRHTPLSKLMKAYCERQGLSMRQIRFRFDGQPINETDTPAQLENGGRGHHRRVPAADGRCAGEQPGRAQFLEGPSPARAVHPRIAVEW

SEQ ID NO: 909707 - protein, 178 aa, Homo sapiens; identical to SEQ ID NO: 909706

SEQ ID NO: 909708 - protein, 121 aa, Homo sapiens
MSEEKPKEGVKTENDHINLKVAGQDGSVVQFKIKRHTPLSKLMKAYCERQGLSMRQIRFRFDGQPINETDTPAQLENGGRGHHRRVPAADGRCAGEQPGRAQFLEGPSPARAVHPRIAVEW

SEQ ID NO: 909709 - protein, 178 aa, Homo sapiens; identical to SEQ ID NO: 909706

SEQ ID NO: 909710 - protein, 177 aa, Homo sapiens
ERAQPRDPRAGQRVRRDLGDKARPRAQLRRESGGAESVTRPLRAASPAPPPRAARAAMSEEKPKEGVKTENDHINLKVAGQDGSVVQFKIKRHTPLSKLMKAYCERQGLSMRQIRFRFDGQPINETDTPAQVRSWLRVVPGRLPICAGWRMEDEDTIDVFQQQTGGVPESSLAGHSF

SEQ ID NO: 909711 - protein, 159 aa, Homo sapiens
ERAQPRDPRAGQRVRRDLGDKARPRAQLRRESGGAESVTRPLRAASPAPPPRAARAAMSEEKPKEGVKTENDHINLKVAGQDGSVVQFKIKRHTPLSKLMKAYCERQGLSMRQIRFRFDGQPINETDTPAQWGCSCWTGIGGKVGREDRLSLAVTGTGD

SEQ ID NO: 909712 - protein, 178 aa, Homo sapiens; identical to SEQ ID NO: 909706

SEQ ID NO: 909713 - protein, 178 aa, Homo sapiens; identical to SEQ ID NO: 909706

SEQ ID NO: 909714 - protein, 178 aa, Homo sapiens; identical to SEQ ID NO: 909706

SEQ ID NO: 909715 - protein, 185 aa, Homo sapiens
HPRNGARKSGEAVLPAQRVSRVHEVPVPPALAASSLGLPALADVAAWPSSAPLTSADLGVVGPPSASVSSQEGVKTENDHINLKVAGQDGSVVQFKIKRHTPLSKLMKAYCERQGLSMRQIRFRFDGQPINETDTPAQLENGGRGHHRRVPAADGRCAGEQPGRAQFLEGPSPARAVHPRIAVEW

SEQ ID NO: 909716 - protein, 93 aa, Homo sapiens
YTNRARVPSGTSKLMKAYSERQGLSMRQIRFRFDGQPINETDTPAQLENGGRGHHRRVPAADGRCAGEQPGRAQFLEGPSPARAVHPRIAVEW

SEQ ID NO: 909717 - protein, 166 aa, Homo sapiens
ERAQPRDPRAGQRVRRDLGDKARPRAQLRRESGGAESVTRPLRAASPAPPPRAARAAMSEEKPKEGVKTENDHINLKVAGQDGSVVQFKIKRHTPLSKLMKAYCERQGLSMRQIRFRFDGQPINETDTPAQLENGGRGHHRLLLNGEHVTMPTTKVSAETRGHSPR

SEQ ID NO: 909718 - protein, 178 aa, Homo sapiens; identical to SEQ ID NO: 909706

SEQ ID NO: 909719 - protein, 1592 aa, Homo sapiens [sequence omitted]

SEQ ID NO: 909720 - protein, 1411 aa, Homo sapiens
RRLLLLNSRPPDHVRIKQMGKNASGQTHYLSLSGFELYGTVNGVCEDQLGKAAKEAEANLRRQRRLVRSQVLKYMVPGARVIRGLDWKWRDQDGSPQGEGTVTGELHNGWIDVTWDAGGSNSYRMGAEGKFDLKLAPGYDPDTVASPKPVSSTVSGTTQSWSSLVKNNCPDKTSAAAGSSSRKGSSSSVCSVASSSDISLGSTKTERRSEIVMEHSIVSGADVHEPIVVLSSAENVPQTEVGSSSSASTSTLTAETGSENAERKLGPDSSVRTPGESSAISMGIVSVSSPDVSSVSELTNKEAASQRPLSSSASNRLSVSSLLAAGAPMSSSASVPNLSSRETSSLESFVRRVANIARTNATNNMNLSRSSSDNNTNTLGRNVMSTATSPLMGAQSFPNLTTPGTTSTVTMSTSSVTSSSNVATATTVLSVGQSLSNTLTTSLTSTSSESDTGQEAEYSLYDFLDSCRASTLLAELDDDEDLPEPDEEDDENEDDNQEDQEYEEVMILRRPSLQRRAGSRSDVTHHAVTSQLPQVPAGAGSRPIGEQEEEEYETKGGRRRTWDDDYVLKRQFSALVPAFDPRPGRTNVQQTTDLEIPPPGTPHSELLEEVECTPSPRLALTLKVTGLGTTREVELPLTNFRSTIFYYVQKLLQLSCNGNVKSDKLRRIWEPTYTIMYREMKDSDKEKENGKMGCWSIEHVEQYLGTDELPKNDLITYLQKNADAAFLRHWKLTGTNKSIRKNRNCSQLIAAYKDFCEHGTKSGLNQGAISTLQSSDILNLTKEQPQAKAGNGQNSCGVEDVLQLLRILYIVASDPYSRISQEDGDEQPQFTFPPDEFTSKKITTKILQQIEEPLALASGALPDWCEQLTSKCPFLIPFETRQLYFTCTAFGASRAIVWLQNRREATVERTRTTSSVRRDDPGEFRVGRLKHERVKVPRGESLMEWAENVMQIHADRKSVLEVEFLGEEGTGLGPTLEFYALVAAEFQRTDLGAWLCDDNFPDDESRHVDLGGGLKPPGYYVQRSCGLFTAPFPQDSDELERITKLFHFLGIFLAKCIQDNRLVDLPISKPFFKLMCMGDIKSNMSKLIYESRGDRDLHCTESQSEASTEEGHDSLSVGSFEEDSKSEFILDPPKPKPPAWFNGILTWEDFELVNPHRARFLKEIKDLAIKRRQILSNKGLSEDEKNTKLQELVLKNPSGSGPPLSIEDLGLNFQFCPSSRIYGFTAVDLKPSGEDEMITMDNAEEYVDLMFDFCMHTGIQKQMEAFRDGFNKVFPMEKLSSFSHEEVQMILCGNQSPSWAAEDIINYTEPKLGYTRDSPGFLRFVRVLCGMSSDERKAFLQFTTGCSTLPPGGLANLHPRLTVVRKVDATDASYPSVNTCVHYLKLPEYSSEEIMRERLLAATMEKGFHLN

SEQ ID NO: 909721 - protein, 1416 aa, Homo sapiens
MLKMEPLATVESLEQYLLKMVAKQWYDFDRSSFVFVRKLREGQNFIFRHQHDFDENGIIYWIGTNAKTAYEWVNPAAYGLVVVTSSEGRNLPYGRLEDILSRDNSALNCHSNDDKNAWFAIDLGLWVIPSAYTLRHARGYGRSALRNWVFQVSKDGQNWTSLYTHVDDCSLNEPGSTATWPLDPPKDEKQGWRHVRIKQMGKNASGQTHYLSLSGFELYGTVNGVCEDQLGKAAKEAEANLRRQRRLVRSQVLKYMVPGARVIRGLDWKWRDQDGSPQGEGTVTGELHNGTTQSWSSLVKNNCPDKTSAAAGSSSRKGSSSSVCSVASSSDISLGSTKTERRSEIVMEHSIVSGADVHEPIVVLSSAENVPQTEVGSSSSASTSTLTAETGSENAERKLGPDSSVRTPGESSAISMGIVSVSSPDVSSVSELTNKEAASQRPLSSSASHQLPVRVTQVRKQNIPYMISLIAAVPVLYWLSSMDDEDLPEPDEEDDENEDDNQEDQEYEEVMILRRPSLQRRAGSRSDVTHHAVTSQLPQVPAGAGSRPIGEQEEEEYETKGGRRRTWDDDYVLKRQFSALVPAFDPRPGRTNVQQTTDLEIPPPGTPHSELLEEVECTPSPRLALTLKVTGLGTTREVELPLTNFRSTIFYYVQKLLQLSCNGNVKSDKLRRIWEPTYTIMYREMKDSDKEKENGKMGCWSIEHVEQYLGTDELPKNDLITYLQKNADAAFLRHWKLTGTNKSIRKNRNCSQLIAAYKDFCEHGTKSGLNQGAISTLQSSDILNLTKEQPQAKAGNGQNSCGVEDVLQLLRILYIVASDPYSRISQEDGDEQPQFTFPPDEFTSKKITTKILQQIEEPLALASGALPDWCEQLTSKCPFLIPFETRQLYFTCTAFGASRAIVWLQNRREATVERTRTTSSVRRDDPGEFRVGRLKHERVKVPRGESLMEWAENVMQIHADRKSVLEVEFLGEEGTGLGPTLEFYALVAAEFQRTDLGAWLCDDNFPDDESRHVDLGGGLKPPGYYVQRSCGLFTAPFPQDSDELERITKLFHFLGIFLAKCIQDNRLVDLPISKPFFKLMCMGDIKSNMSKLIYESRGDRDLHCTESQSEASTEEGHDSLSVGSFEEDSKSEFILDPPKPKPPAWFNGILTWEDFELVNPHRARFLKEIKDLAIKRRQILSNKGLSEDEKNTKLQELVLKNPSGSGPPLSIEDLGLNFQFCPSSRIYGFTAVDLKPSGEDEMITMDNAEEYVDLMFDFCMHTGIQKQMEAFRDGFNKVFPMEKLSSFSHEEVQMILCGNQSPSWAAEDIINYTEPKLGYTRDSPGFLRFVRVLCGMSSDERKAFLQFTTGCSTLPPGGLANLHPRLTVVRKVDATDASYPSVNTCVHYLKLPEYSSEEIMRERLLAATMEKGFHLN

SEQ ID NO: 909722 - protein, 1536 aa, Homo sapiens
MLKMEPLATVESLEQYLLKMVAKQWYDFDRSSFVFVRKLREGQNFIFRHQHDFDENGIIYWIGTNAKTAYEWVNPAAYGLVVVTSSEGRNLPYGRLEDILSRDNSALNCHSNDDKNAWFAIDLGLWVIPSAYTLRHARGYGRSALRNWVFQVSKDGQNWTSLYTHVDDCSLNEPGSTATWPLDPPKDEKQGWRHVRIKQMGKNASGQTHYLSLSGFELYGTVNGVCEDQLGKAAKEAEANLRRQRRLVRSQVLKYMVPGARVIRGLDWKWRDQDGSPQGEGTVTGELHNGTTQSWSSLVKNNCPDKTSAAAGSSSRKGSSSSVCSVASSSDISLGSTKTERRSEIVMEHSIVSGADVHEPIVVLSSAENVPQTEVGSSSSASTSTLTAETGSENAERKLGPDSSVRTPGESSAISMGIVSVSSPDVSSVSELTNKEAASQRPLSSSASNRLSVSSLLAAGAPMSSSASVPNLSSRETSSLESFVRRVANIARTNATNNMNLSRSSSDNNTNTLGRNVMSTATSPLMGAQSFPNLTTPGTTSTVTMSTSSVTSSSNVATATTVLSVGQSLSNTLTTSLTSTSSESDTDFLDSCRASTLLAELDDDEDLPEPDEEDDENEDDNQEDQEYEEVMILRRPSLQRRAGSRSDVTHHAVTSQLPQVPAGAGSRPIGEQEEEEYETKGGRRRTWDDDYVLKRQFSALVPAFDPRPGRTNVQQTTDLEIPPPGTPHSELLEEVECTPSPRLALTLKVTGLGTTREVELPLTNFRSTIFYYVQKLLQLSCNGNVKSDKLRRIWEPTYTIMYREMKDSDKEKENGKMGCWSIEHVEQYLGTDELPKNDLITYLQKNADAAFLRHWKLTGTNKSIRKNRNCSQLIAAYKDFCEHGTKSGLNQGAISTLQSSDILNLTKEQPQAKAGNGQNSCGVEDVLQLLRILYIVASDPYSRISQEDGDEQPQFTFPPDEFTSKKITTKILQQIEEPLALASGALPDWCEQLTSKCPFLIPFETRQLYFTCTAFGASRAIVWLQNRREATVERTRTTSSVRRDDPGEFRVGRLKHERVKVPRGESLMEWAENVMQIHADRKSVLEVEFLGEEGTGLGPTLEFYALVAAEFQRTDLGAWLCDDNFPDDESRHVDLGGGLKPPGYYVQRSCGLFTAPFPQDSDELERITKLFHFLGIFLAKCIQDNRLVDLPISKPFFKLMCMGDIKSNMSKLIYESRGDRDLHCTESQSEASTEEGHDSLSVGSFEEDSKSEFILDPPKPKPPAWFNGILTWEDFELVNPHRARFLKEIKDLAIKRRQILSNKGLSEDEKNTKLQELVLKNPSGSGPPLSIEDLGLNFQFCPSSRIYGFTAVDLKPSGEDEMITMDNAEEYVDLMFDFCMHTGIQKQMEAFRDGFNKVFPMEKLSSFSHEEVQMILCGNQSPSWAAEDIINYTEPKLGYTRDSPGFLRFVRVLCGMSSDERKAFLQFTTGCSTLPPGGLANLHPRLTVVRKVDATDASYPSVNTCVHYLKLPEYSSEEIMRERLLAATMEKGFHLN

SEQ ID NO: 909723 - protein, 1545 aa, Homo sapiens
MLKMEPLATVESLEQYLLKMVAKQWYDFDRSSFVFVRKLREGQNFIFRHQHDFDENGIIYWIGTNAKTAYEWVNPAAYGLVVVTSSEGRNLPYGRLEDILSRDNSALNCHSNDDKNAWFAIDLGLWVIPSAYTLRHARGYGRSALRNWVFQVSKDGQNWTSLYTHVDDCSLNEPGSTATWPLDPPKDEKQGWRHVRIKQMGKNASGQTHYLSLSGFELYGTVNGVCEDQLGKAAKEAEANLRRQRRLVRSQVLKYMVPGARVIRGLDWKWRDQDGSPQGEGTVTGELHNGTTQSWSSLVKNNCPDKTSAAAGSSSRKGSSSSVCSVASSSDISLGSTKTERRSEIVMEHSIVSGADVHEPIVVLSSAENVPQTEVGSSSSASTSTLTAETGSENAERKLGPDSSVRTPGESSAISMGIVSVSSPDVSSVSELTNKEAASQRPLSSSASNRLSVSSLLAAGAPMSSSASVPNLSSRETSSLESFVRRVANIARTNATNNMNLSRSSSDNNTNTLGRNVMSTATSPLMGAQSFPNLTTPGTTSTVTMSTSSVTSSSNVATATTVLSVGQSLSNTLTTSLTSTSSESDTGQEAEYSLYDFLDSCRASTLLAELDDDEDLPEPDEEDDENEDDNQEDQEYEEVMILRRPSLQRRAGSRSDVTHHAVTSQLPQVPAGAGSRPIGEQEEEEYETKGGRRRTWDDDYVLKRQFSALVPAFDPRPGRTNVQQTTDLEIPPPGTPHSELLEEVECTPSPRLALTLKVTGLGTTREVELPLTNFRSTIFYYVQKLLQLSCNGNVKSDKLRRIWEPTYTIMYREMKDSDKEKENGKMGCWSIEHVEQYLGTDELPKNDLITYLQKNADAAFLRHWKLTGTNKSIRKNRNCSQLIAAYKDFCEHGTKSGLNQGAISTLQSSDILNLTKEQPQAKAGNGQNSCGVEDVLQLLRILYIVASDPYSRISQEDGDEQPQFTFPPDEFTSKKITTKILQQIEEPLALASGALPDWCEQLTSKCPFLIPFETRQLYFTCTAFGASRAIVWLQNRREATVERTRTTSSVRRDDPGEFRVGRLKHERVKVPRGESLMEWAENVMQIHADRKSVLEVEFLGEEGTGLGPTLEFYALVAAEFQRTDLGAWLCDDNFPDDESRHVDLGGGLKPPGYYVQRSCGLFTAPFPQDSDELERITKLFHFLGIFLAKCIQDNRLVDLPISKPFFKLMCMGDIKSNMSKLIYESRGDRDLHCTESQSEASTEEGHDSLSVGSFEEDSKSEFILDPPKPKPPAWFNGILTWEDFELVNPHRARFLKEIKDLAIKRRQILSNKGLSEDEKNTKLQELVLKNPSGSGPPLSIEDLGLNFQFCPSSRIYGFTAVDLKPSGEDEMITMDNAEEYVDLMFDFCMHTGIQKQMEAFRDGFNKVFPMEKLSSFSHEEVQMILCGNQSPSWAAEDIINYTEPKLGYTRDSPGFLRFVRVLCGMSSDERKAFLQFTTGCSTLPPGGLANLHPRLTVVRKVDATDASYPSVNTCVHYLKLPEYSSEEIMRERLLAATMEKGFHLN

SEQ ID NO: 909724 - protein, 1545 aa, Homo sapiens; identical to SEQ ID NO: 909723

SEQ ID NO: 909725 - protein, 1545 aa, Homo sapiens; identical to SEQ ID NO: 909723

SEQ ID NO: 909726 - protein, 153 aa, Homo sapiens
MQKQMEAFRDGFNKVFPMEKLSSFSHEEVQMILCGNQSPSWAAEDIINYTEPKLGYTRDSPGFLRFVRVLCGMSSDERKAFLQFTTGCSTLPPGGLANLHPRLTVVRKVDATDASYPSVNTCVHYLKLPEYSSEEIMRERLLAATMEKGFHLN

SEQ ID NO: 909727 - protein, 1107 aa, Homo sapiens
MLKMEPLATVESLEQYLLKMVAKQWYDFDRSSFVFVRKLREGQNFIFRHQHDFDENGIIYWIGTNAKTAYEWVNPAAYGLVVVTSSEGRNLPYGRLEDILSRDNSALNCHSNDDKNAWFAIDLGLWVIPSAYTLRHARGYGRSALRNWVFQVSKDGQNWTSLYTHVDDCSLNEPGSTATWPLDPPKDEKQGWRHVRIKQMGKNASGQTHYLSLSGFELYGTVNGVCEDQLGKAAKEAEANLRRQRRLVRSQVLKYMVPGARVIRGLDWKWRDQDGSPQGEGTVTGELHNGTTQSWSSLVKNNCPDKTSAAAGSSSRKGSSSSVCSVASSSDISLGSTKTERRSEIVMEHSIVSGADVHEPIVVLSSAENVPQTEVGSSSSASTSTLTAETGSENAERKLGPDSSVRTPGESSAISMGIVSVSSPDVSSVSELTNKEAASQRPLSSSASNRLSVSSLLAAGAPMSSSASVPNLSSRETSSLESFVRRVANIARTNATNNMNLSRSSSDNNTNTLGRNVMSTATSPLMGAQSFPNLTTPGTTSTVTMSTSSVTSSSNVATATTVLSVGQSLSNTLTTSLTSTSSESDTGQEAEYSLYDFLDSCRASTLLAELDDDEDLPEPDEEDDENEDDNQEDQEYEEVMILRRPSLQRRAGSRSDVTHHAVTSQLPQVPAGAGSRPIGEQEEEEYETKGGRRRTWDDDYVLKRQFSALVPAFDPRPGRTNVQQTTDLEIPPPGTPHSELLEEVECTPSPRLALTLKVTGLGTTREVELPLTNFRSTIFYYVQKLLQLSCNGNVKSDKLRRIWEPTYTIMYREMKDSDKEKENGKMGCWSIEHVEQYLGTDELPKNDLITYLQKNADAAFLRHWKLTGTNKSIRKNRNCSQLIAAYKDFCEHGTKSGLNQGAISTLQSSDILNLTKEQPQAKAGNGQNSCGVEDVLQLLRILYIVASDPYSRISQEDGDEQPQFTFPPDEFTSKKITTKILQQIEEPLALASGALPDWCEQLTSKCPFLIPFETRQLYFTCTAFGASRAIVWLQNRREATVERTRTTSSVRRDDPGEFRVGRLKHERVKVPRGESLMEWAENVMQIHADRKSVLEVISYKIRFREQE

SEQ ID NO: 909728 - protein, 721 aa, Homo sapiens
MLKMEPLATVESLEQYLLKMVAKQWYDFDRSSFVFVRKLREGQNFIFRHQHDFDENGIIYWIGTNAKTAYEWVNPAAYGLVVVTSSEGRNLPYGRLEDILSRDNSALNCHSNDDKNAWFAIDLGLWVIPSAYTLRHARGYGRSALRNWVFQVSKDGQNWTSLYTHVDDCSLNEPGSTATWPLDPPKDEKQGWRHVRIKQMGKNASGQTHYLSLSGFELYGTVNGVCEDQLGKAAKEAEANLRRQRRLVRSQVLKYMVPGARVIRGLDWKWRDQDGSPQGEGTVTGELHNGTTQSWSSLVKNNCPDKTSAAAGSSSRKGSSSSVCSVASSSDISLGSTKTERRSEIVMEHSIVSGADVHEPIVVLSSAENVPQTEVGSSSSASTSTLTAETGSENAERKLGPDSSVRTPGESSAISMGIVSVSSPDVSSVSELTNKEAASQRPLSSSASNRLSVSSLLAAGAPMSSSASVPNLSSRETSSLESFVRRVANIARTNATNNMNLSRSSSDNNTNTLGRNVMSTATSPLMGAQSFPNLTTPGTTSTVTMSTSSVTSSSNVATATTVLSVGQSLSNTLTTSLTSTSSESDTDFLDSCRASTLLAELDDDEDLPEPDEEDDENEDDNQEDQEYEEVMILRRPSLQRRAGSRSDVTHHAVTSQLPQVPAGAGSRPIGEQEEEEYETNEDIMERINRLASLFYVFSNAVWNLFMTTLSSHLSAPLVNSP

SEQ ID NO: 909729 - protein, 145 aa, Homo sapiens
MLKMEPLATVESLEQYLLKMVAKQWYDFDRSSFVFVRKLREGQNFIFRHQHDFDENGIIYWIGTNAKTAYEWVNPAAYGLVVVTSSEGRNLPYGRLEDILSRDNSALNCHSNDDKNAWFAIDLGLWVIPSAYTLRHARGYGRVHF

SEQ ID NO: 909730 - protein, 124 aa, Homo sapiens
ARGSGNQGCHVYNLRFVTCITSGNQGCHVYNPGFLRFVRVLCGMSSDERKAFLQFTTGCSTLPPGGLANLHPRLTVVRKVDATDASYPSVNTCVHYLKLPEYSSEEIMRERLLAATMEKGFHLN

SEQ ID NO: 909731 - protein, 1545 aa, Homo sapiens; identical to SEQ ID NO: 909723

SEQ ID NO: 909732 - protein, 1545 aa, Homo sapiens; identical to SEQ ID NO: 909723

SEQ ID NO: 909733 - protein, 1545 aa, Homo sapiens; identical to SEQ ID NO: 909723

SEQ ID NO: 909734 - protein, 1545 aa, Homo sapiens; identical to SEQ ID NO: 909723

SEQ ID NO: 909735 - protein, 1381 aa, Homo sapiens
MLKMEPLATVESLEQYLLKMVAKQWYDFDRSSFVFVRKLREGQNFIFRHQHDFDENGIIYWIGTNAKTAYEWVNPAAYGLVVVTSSEGRNLPYGRLEDILSRDNSALNCHSNDDKNAWFAIDLGLWVIPSAYTLRHARGYGRSALRNWVFQVSKDGQNWTSLYTHVDDCSLNEPGSTATWPLDPPKDEKQGWRHVRIKQMGKNASGQTHYLSLSGFELYGTVNGVCEDQLGKAAKEAEANLRRQRRLVRSQVLKYMVPGARVIRGLDWKWRDQDGSPQGEGTVTGELHNGTTQSWSSLVKNNCPDKTSAAAGSSSRKGSSSSVCSVASSSDISLGSTKTERRSEIVMEHSIVSGADVHEPIVVLSSAENVPQTEVGSSSSASTSTLTAETGSENAERKLGPDSSVRTPGESSAISMGIVSVSSPDVSSVSELTNKEAASQRPLSSSASNRLSVSSLLAAGAPMSSSASVPNLSSRETSSLESFVRRVANIARTNATNNMNLSRSSSDNNTNTLGRNVMSTATSPLMGAQSFPNLTTPGTTSTVTMSTSSVTSSSNVATATTVLSVGQSLSNTLTTSLTSTSSESDTGQEAEYSLYDFLDSCRASTLLAELDDDEDLPEPDEEDDENEDDNQEDQEYEEVMILRRPSLQRRAGSRSDVTHHAVTSQLPQVPAGAGSRPIGEQEEEEYETKGGRRRTWDDDYVLKRQFSALVPAFDPRPGRTNVQQTTDLEIPPPGTPHSELLEEVECTPSPRLALTLKVTGLGTTREVELPLTNFRSTIFYYVQKLLQLSCNGNVKSDKLRRIWEPTYTIMYREMKDSDKEKENGKMGCWSIEHVEQYLGTDELPKNDLITYLQKNADAAFLRHWKLTGTNKSIRKNRNCSQLIAAYKDFCEHGTKSGLNQGAISTLQSSDILNLTKEQPQAKAGNGQNSCGVEDVLQLLRILYIVASDPYSRISQEDGDEQPQFTFPPDEFTSKKITTKILQQIEEPLALASGALPDWCEQLTSKCPFLIPFETRQLYFTCTAFGASRAIVWLQNRREATVERTRTTSSVRRDDPGEFRVGRLKHERVKVPRGESLMEWAENVMQIHADRKSVLEVEFLGEEGTGLGPTLEFYALVAAEFQRTDLGAWLCDDNFPDDESRHVDLGGGLKPPGYYVQRSCGLFTAPFPQDSDELERITKLFHFLGIFLAKCIQDNRLVDLPISKPFFKLMCMGDIKSNMSKLIYESRGDRDLHCTESQSEASTEEGHDSLSVGSFEEDSKSEFILDPPKPKPPAWFNGILTWEDFELVNPHRARFLKEIKDLAIKRRQILSNKGLSEDEKNTKLQELVLKNPSGSGPPLSIEDLGLNFQFCPSSRIYGFTAVDLKPSGEDELLGQKSCFLKT

SEQ ID NO: 909736 - protein, 808 aa, Homo sapiens
MLKMEPLATVESLEQYLLKMVAKQWYDFDRSSFVFVRKLREGQNFIFRHQHDFDENGIIYWIGTNAKTAYEWVNPAAYGLVVVTSSEGRNLPYGRLEDILSRDNSALNCHSNDDKNAWFAIDLGLWVIPSAYTLRHARGYGRSALRNWVFQVSKDGQNWTSLYTHVDDCSLNEPGSTATWPLDPPKDEKQGWRHVRIKQMGKNASGQTHYLSLSGFELYGTVNGVCEDQLGKAAKEAEANLRRQRRLVRSQVLKYMVPGARVIRGLDWKWRDQDGSPQGEGTVTGELHNGTTQSWSSLVKNNCPDKTSAAAGSSSRKGSSSSVCSVASSSDISLGSTKTERRSEIVMEHSIVSGADVHEPIVVLSSAENVPQTEVGSSSSASTSTLTAETGSENAERKLGPDSSVRTPGESSAISMGIVSVSSPDVSSVSELTNKEAASQRPLSSSASNRLSVSSLLAAGAPMSSSASVPNLSSRETSSLESFVRRVANIARTNATNNMNLSRSSSDNNTNTLGRNVMSTATSPLMGAQSFPNLTTPGTTSTVTMSTSSVTSSSNVATATTVLSVGQSLSNTLTTSLTSTSSESDTGQEAEYSLYDFLDSCRASTLLAELDDDEDLPEPDEEDDENEDDNQEDQEYEEVMILRRPSLQRRAGSRSDVTHHAVTSQLPQVPAGAGSRPIGEQEEEEYETKGGRRRTWDDDYVLKRQFSALVPAFDPRPGRTNVQQTTDLEIPPPGTPHSELLEEVECTPSPRLALTLKVTGLGTTREVELPLTNFRSTIFYYVQKLLQLSCNGNVKSDKLRRIWEPTYT

SEQ ID NO: 909737 - protein, 598 aa, Homo sapiens
MLKMEPLATVESLEQYLLKMVAKQWYDFDRSSFVFVRKLREGQNFIFRHQHDFDENGIIYWIGTNAKTAYEWVNPAAYGLVVVTSSEGRNLPYGRLEDILSRDNSALNCHSNDDKNAWFAIDLGLWVIPSAYTLRHARGYGRSALRNWVFQVSKDGQNWTSLYTHVDDCSLNEPGSTATWPLDPPKDEKQGWRHVRIKQMGKNASGQTHYLSLSGFELYGTVNGVCEDQLGKAAKEAEANLRRQRRLVRSQVLKYMVPGARVIRGLDWKWRDQDGSPQGEGTVTGELHNGTTQSWSSLVKNNCPDKTSAAAGSSSRKGSSSSVCSVASSSDISLGSTKTERRSEIVMEHSIVSGADVHEPIVVLSSAENVPQTEVGSSSSASTSTLTAETGSENAERKLGPDSSVRTPGESSAISMGIVSVSSPDVSSVSELTNKEAASQRPLSSSASNRLSVSSLLAAGAPMSSSASVPNLSSRETSSLESFVRRVANIARTNATNNMNLSRSSSDNNTNTLGRNVMSTATSPLMGAQSFPNLTTPGTTSTVTMSTSSVTSSSNVATATTVLSVGQSLSNTLTTSLTSTSSESDTGQEAEYSLYGKL

SEQ ID NO: 909738 - protein, 726 aa, Homo sapiens
MNHSPLKTALAYECFQDQDNSTLALPSDQKMKTGTSGRQRVQEQVMMTVKRQKSKSSQSSTLSHSNRGSMYDGLADNYNYGTTSRSSYYSKFQAGNGSWGYPIYNGTLKREPDNRRFSSYSQMENWSRHYPRGSCNTTGAGSDICFMQKIKASRSEPDLYCDPRGTLRKGTLGSKGQKTTQNRYSFYSTCSGQKAIKKCPVRPPSCASKQDPVYIPPISCNKDLSFGHSRASSKICSEDIECSGLTIPKAVQYLSSQDEKYQAIGAYYIQHTCFQDESAKQQVYQLGGICKLVDLLRSPNQNVQQAAAGALRNLVFRSTTNKLETRRQNGIREAVSLLRRTGNAEIQKQLTGLLWNLSSTDELKEELIADALPVLADRVIIPFSGWCDGNSNMSREVVDPEVFFNATGCLRNLSSADAGRQTMRNYSGLIDSLMAYVQNCVAASRCDDKSVENCMCVLHNLSYRLDAEVPTRYRQLEYNARNAYTEKSSTGCFSNKSDKMMNNNYDCPLPEEETNPKGSGWLYHSDAIRTYLNLMGKSKKDATLEACAGALQNLTASKGLMSSGMSQLIGLKEKGLPQIARLLQSGNSDVVRSGASLLSNMSRHPLLHRVMGNQVFPEVTRLLTSHTGNTSNSEDILSSACYTVRNLMASQPQLAKQYFSSSMLNNIINLCRSSASPKAAEAARLLLSDMWSSKELQGVLRQQGFDRNMLGTLAGANSLRNFTSRF

SEQ ID NO: 909739 - protein, 726 aa, Homo sapiens; identical to SEQ ID NO: 909738

SEQ ID NO: 909740 - protein, 726 aa, Homo sapiens; identical to SEQ ID NO: 909738

SEQ ID NO: 909741 - protein, 726 aa, Homo sapiens; identical to SEQ ID NO: 909738

SEQ ID NO: 909742 - protein, 191 aa, Homo sapiens
GRLLLLNSRPRRPGALQNLTASKGLMSSGMSQLIGLKEKGLPQIARLLQSGNSDVVRSGASLLSNMSRHPLLHRVMGNQVFPEVTRLLTSHTGNTSNSEDILSSACYTVRNLMASQPQLAKQYFSSSMLNNIINLCRSSASPKAAEAARLLLSDMWSSKELQGVLRQQGFDRNMLGTLAGANSLRNFTSRF

SEQ ID NO: 909743 - protein, 323 aa, Homo sapiens
MDSKQQCVKLNDGHFMPVLGFGTYAPPEVPRSKALEVTKLAIEAGFRHIDSAHLYNNEEQVGLAIRSKIADGSVKREDIFYTSKLWSTFHRPELVRPALENSLKKAQLDYVDLYLIHSPMSLKPGEELSPTDENGKVIFDIVDLCTTWEAMEKCKDAGLAKSIGVSNFNRRQLEMILNKPGLKYKPVCNQVECHPYFNRSKLLDFCKSKDIVLVAYSALGSQRDKRWVDPNSPVLLEDPVLCALAKKHKRTPALIALRYQLQRGVVVLAKSYNEQRIRQNVQVFEFQLTAEDMKAIDGLDRNLHYFNSDSFASHPNYPYSDEY

SEQ ID NO: 909744 - protein, 321 aa, Homo sapiens
MDSKQQCVKLNDGHFMPVLGFGTYAPPEVPRSKALEVTKLAIEAGFRHIDSAHLYNNEEQVGLAIRSKIADGSVKREDIFYTSKLWSTFHRPELVRPALENSLKKAQLDYVDLYLIHSPMSLKPGEELSPTDENGKVIFDIVDLCTTWEAMEKCKDAGLAKSIGVSNFNRRQLEMILNKPGLKYKPVCNQVECHPYFNRSKLLDFCKSKDIVLVAYSALGSQRDKRWVDPNSPVLLEDPVLCALAKKHKRTPALIALRYQLQRGVVVLAKVKRGLKNGVGHVRVNKVRILRIGPIKKKRALHTWGEPGQRHQQKRAWWSAR

SEQ ID NO: 909745 - protein, 204 aa, Homo sapiens
MSLKPGEELSPTDENGKVIFDIVDLCTTWEAMEKCKDAGLAKSIGVSNFNRRQLEMILNKPGLKYKPVCNQVECHPYFNRSKLLDFCKSKDIVLVAYSALGSQRDKRWVDPNSPVLLEDPVLCALAKKHKRTPALIALRYQLQRGVVVLAKSYNEQRIRQNVQVFEFQLTAEDMKAIDGLDRNLHYFNSDSFASHPNYPYSDEY

SEQ ID NO: 909746 - protein, 204 aa, Homo sapiens; identical to SEQ ID NO: 909745

SEQ ID NO: 909747 - protein, 272 aa, Homo sapiens
MDSKQQCVKLNDGHFMPVLGFGTYAPPEVPRSKALEVTKLAIEAGFRHIDSAHLYNNEEQVGLAIRSKIADGSVKREDIFYTSKLWSTFHRPELVRPALENSLKKAQLDYVDLYLIHSPMSLKPGEELSPTDENGKVIFDIVDLCTTWEAMEKCKDAGLAKSIGVSNFNRRQLEMILNKPGLKYKPVCNQVECHPYFNRSKLLDFCKSKDIVLVAYSALGSQRDKRWVDPNSPVLLEDPVLCALASSVGLWSWPRATMSSASDRTCRFLSSS

SEQ ID NO: 909748 - protein, 134 aa, Homo sapiens
VALTVLSCIYRDLQPTAQIIPHNPFLHRAMEKCKDAGLAKSIGVSNFNRRQLEMILNKPGLKYKPVCNQVSSLGLLSFRFFMPPLPVLLPNICLFCPSYLCEVEDYLESKASVKKGVKISCLYPAWKSIREKLE

SEQ ID NO: 909749 - protein, 251 aa, Homo sapiens
MDSKQQCVKLNDGHFMPVLGFGTYAPPEVPRSKALEVTKLAIEAGFRHIDSAHLYNNEEQVGLAIRSKIADGSVKREDIFYTSKLWSTFHRPELVRPALENSLKKAQLDYVDLYLIHSPMSLKPGEELSPTDENGKVIFDIVDLCTTWEAMEKCKDAGLAKSIGVSNFNRRQLEMILNKPGLKYKPVCNQVECHPYFNRSKLLDFCKSKDIVLVAYSALGSQRDKRWDPTSRGLLEDPSFWPWEHKGPPGC

SEQ ID NO: 909750 - protein, 323 aa, Homo sapiens; identical to SEQ ID NO: 909743

SEQ ID NO: 909751 - protein, 204 aa, Homo sapiens; identical to SEQ ID NO: 909745

SEQ ID NO: 909752 - protein, 310 aa, Homo sapiens
SATVITRYYLWLLLQVPRSKALEVTKLAIEAGFRHIDSAHLYNNEEQVGLAIRSKIADGSVKREDIFYTSKLWSTFHRPELVRPALENSLKKAQLDYVDLYLIHSPMSLKPGEELSPTDENGKVIFDIVDLCTTWEAMEKCKDAGLAKSIGVSNFNRRQLEMILNKPGLKYKPVCNQVECHPYFNRSKLLDFCKSKDIVLVAYSALGSQRDKRWVDPNSPVLLEDPVLCALAKKHKRTPALIALRYQLQRGVVVLAKSYNEQRIRQNVQVFEFQLTAEDMKAIDGLDRNLHYFNSDSFASHPNYPYSDEY

SEQ ID NO: 909753 - protein, 309 aa, Homo sapiens
MDSKQQCVKLNDGHFMPVLGFGTYAPPEVPRSKALEVTKLAIEAGFRHIDSAHLYNNEEQVGLAIRSKIADGSVKREDIFYTSKLWSTFHRPELVRPALENSLKKAQLDYVDLYLIHSPMSLKPGEELSPTDENGAMEKCKDAGLAKSIGVSNFNRRQLEMILNKPGLKYKPVCNQVECHPYFNRSKLLDFCKSKDIVLVAYSALGSQRDKRWVDPNSPVLLEDPVLCALAKKHKRTPALIALRYQLQRGVVVLAKSYNEQRIRQNVQVFEFQLTAEDMKAIDGLDRNLHYFNSDSFASHPNYPYSDEY

SEQ ID NO: 909754 - protein, 226 aa, Homo sapiens
MPGGPGVLQALPATIFLLFLLSAVYLGPGCQALWMHKVPASLMVSLGEDAHFQCPHNSSNNANVTWWRVLHGNYTWPPEFLGPGEDPNGTLIIQNVNKSHGGIYVCRVQEGNESYQQSCGTYLRVRQPPPRPFLDMGEGTKNRIITAEGIILLFCAVVPGTLLLFRKRWQNEKLGLDAGDEYEDENLYEGLNLDDCSMYEDISRGLQGTYQDVGSLNIGDVQLEKP

SEQ ID NO: 909755 - protein, 193 aa, Homo sapiens
KTRLGTRLGGVVLQALPATIFLLFLLSAVYLGPGCQALWMHKVPASLMVSLGEDAHFQCPHNSSNNANVTWWRVLHGNYTWPPEFLGPGEDPNEPPPRPFLDMGEGTKNRIITAEGIILLFCAVVPGTLLLFRKRWQNEKLGLDAGDEYEDENLYEGLNLDDCSMYEDISRGLQGTYQDVGSLNIGDVQLEKP

SEQ ID NO: 909756 - protein, 226 aa, Homo sapiens; identical to SEQ ID NO: 909754

SEQ ID NO: 909757 - protein, 226 aa, Homo sapiens; identical to SEQ ID NO: 909754

SEQ ID NO: 909758 - protein, 309 aa, Homo sapiens
MPGGPGVLQALPATIFLLFLLSAVYLGPGCQALWMHKVPASLMVSLGEDAHFQCPHNSSNNANVTWWRVLHGNYTWPPEFLGPGEDPNGTLIIQNVNKSHGGIYVCRVQEGNESYQQSCGTYLRVRRREWPSPGPYSHCPAGDTRFIFEVGIEPVPSMWVSNRLGQRDGHSPLQSGVSGGSGALQEVGGARRLEEGKRGQGSEPYYLLAEPPPRPFLDMGEGTKNRIITAEGIILLFCAVVPGTLLLFRKRWQNEKLGLDAGDEYEDENLYEGLNLDDCSMYEDISRGLQGTYQDVGSLNIGDVQLEKP

SEQ ID NO: 909759 - protein, 203 aa, Homo sapiens
MPGGPGVLQALPATIFLLFLLSAVYLGPGCQALWMHKVPASLMVSLGEDAHFQCPHNSSNNANVTWWRVLHGNYTWPPEFLGPGEDPNGTLIIQNVNKSHGGIYVCRVQEGNESYQQSCGTYLRVRQPPPRPFLDMGEGTKNRIITAEGIILLFCAVVPGTLLLFRKRWQNEKLGLDAGDEYEDENLYEGLNLDDCSMYEDIG

SEQ ID NO: 909760 - protein, 181 aa, Homo sapiens
MPGGPGVLQALPATIFLLFLLSAVYLGPGCQALWMHKVPASLMVSLGEDAHFQCPHNSSNNANVTWWRVLHGNYTWPPEFLGPGEDPNGTLIIQNVNKSHGGIYVCRVQEGNESYQQSCGTYLRVRQPPPRPFLGHGGGAPKTRIFTPRGGQYPLIWGVEAWEALWFPLKTMGEIGRLWVG

SEQ ID NO: 909761 - protein, 188 aa, Homo sapiens
MPGGPGVLQALPATIFLLFLLSAVYLGPGCQALWMHKVPASLMVSLGEDAHFQCPHNSSNNANVTWWRVLHGNYTWPPEFLGPGEDPNEPPPRPFLDMGEGTKNRIITAEGIILLFCAVVPGTLLLFRKRWQNEKLGLDAGDEYEDENLYEGLNLDDCSMYEDISRGLQGTYQDVGSLNIGDVQLEKP

SEQ ID NO: 909762 - protein, 226 aa, Homo sapiens; identical to SEQ ID NO: 909754

SEQ ID NO: 909763 - protein, 193 aa, Homo sapiens; identical to SEQ ID NO: 909755

SEQ ID NO: 909764 - protein, 188 aa, Homo sapiens; identical to SEQ ID NO: 909761

SEQ ID NO: 909765 - protein, 299 aa, Homo sapiens
MEHFDASLSTYFKALLGPRDTRVKGWFLLDNYIPTFICSVIYLLIVWLGPKYMRNKQPFSCRGILVVYNLGLTLLSLYMFCELVTGVWEGKYNFFCQGTRTAGESDMKIIRVLWWYYFSKLIEFMDTFFFILRKNNHQITVLHVYHHASMLNIWWFVMNWVPCGHSYFGATLNSFIHVLMYSYYGLSSVPSMRPYLWWKKYITQGQLLQFVLTIIQTSCGVIWPCTFPLGWLYFQIGYMISLIALFTNFYIQTYNKKGASRRKDHLKDHQNGSMAAVNGHTNSFSPLENNVKPRKLRKD

SEQ ID NO: 909766 - protein, 221 aa, Homo sapiens
MNYHLVTGVWEGKYNFFCQGTRTAGESDMKIIRVLWWYYFSKLIEFMDTFFFILRKNNHQITVLHVYHHASMLNIWWFVMNWVPCGHSYFGATLNSFIHVLMYSYYGLSSVPSMRPYLWWKKYITQGQLLQFVLTIIQTSCGVIWPCTFPLGWLYFQIGYMISLIALFTNFYIQTYNKKGASRRKDHLKDHQNGSMAAVNGHTNSFSPLENNVKPRKLRKD

SEQ ID NO: 909767 - protein, 193 aa, Homo sapiens
MKIIRVLWWYYFSKLIEFMDTFFFILRKNNHQITVLHVYHHASMLNIWWFVMNWVPCGHSYFGATLNSFIHVLMYSYYGLSSVPSMRPYLWWKKYITQGQLLQFVLTIIQTSCGVIWPCTFPLGWLYFQIGYMISLIALFTNFYIQTYNKKGASRRKDHLKDHQNGSMAAVNGHTNSFSPLENNVKPRKLRKD

SEQ ID NO: 909768 - protein, 262 aa, Homo sapiens
MEHFDASLSTYFKALLGPRDTRVKGWFLLDNYIPTFICSVIYLLIVWLGPKYMRNKQPFSCRGILVVYNLGLTLLSLYMFCELVTGVWEGKYNFFCQGTRTAGESDMKIIRVLWWYYFSKLIEFMDTFFFILRKNNHQITVLHVYHHASMLNIWWFVMNWVPCGHSSVCADNHPDQLRGHLAVHIPSWLVVFPDWIHDFPDCSLHKLLHSDLQQERGLPKERPPEGPPEWVHGCCEWTHQQLFTPGKQCEAKEAAEGLKSKN

SEQ ID NO: 909769 - protein, 299 aa, Homo sapiens; identical to SEQ ID NO: 909765

SEQ ID NO: 909770 - protein, 299 aa, Homo sapiens; identical to SEQ ID NO: 909765

SEQ ID NO: 909771 - protein, 275 aa, Homo sapiens
MEHFDASLSTYFKALLGPRDTRVKGWFLLDNYIPTFICSVIYLLIVWLGPKYMRNKQPFSCRGILVVYNLGLTLLSLYMFCELVTGVWEGKYNFFCQGTRTAGESDMKIIRVLWWYYFSKLIEFMDTFFFILRKNNHQITVLHVYHHASMLNIWWFVMNWVPCGHSYFGATLNSFIHVLMYSYYGLSSVPSMRPYLWWKKYITQGQLLQFVLTIIQTSCGVIWPCTFPLGWLYFQIGYMISLIALFTNFYIQVNLTLLWDLESGAFTNKGPHLFT

SEQ ID NO: 909772 - protein, 121 aa, Homo sapiens
MEHFDASLSTYFKALLGPRDTRVKGWFLLDNYIPTFICSVIYLLIVWLGPKYMRNKQPFSCRGILVVYNLGLTLLSLYMFCELVTGVWEGKYNFFCQGTRTAGESDMKALSSVVPFVGVGG

SEQ ID NO: 909773 - protein, 299 aa, Homo sapiens; identical to SEQ ID NO: 909765

SEQ ID NO: 909774 - protein, 193 aa, Homo sapiens; identical to SEQ ID NO: 909767

SEQ ID NO: 909775 - protein, 143 aa, Homo sapiens
SDLEDPERPPYFGATLNSFIHVLMYSYYGLSSVPSMRPYLWWKKYITQGQLLQFVLTIIQTSCGVIWPCTFPLGWLYFQIGYMISLIALFTNFYIQTYNKKGASRRKDHLKDHQNGSMAAVNGHTNSFSPLENNVKPRKLRKD

SEQ ID NO: 909776 - protein, 299 aa, Homo sapiens; identical to SEQ ID NO: 909765

SEQ ID NO: 909777 - protein, 299 aa, Homo sapiens; identical to SEQ ID NO: 909765

SEQ ID NO: 909778 - protein, 275 aa, Homo sapiens; identical to SEQ ID NO: 909771

SEQ ID NO: 909779 - protein, 418 aa, Homo sapiens
RWVGGASGRGGSSLFCLAAAAPFCAVTPSQRLGLEPGRSPPSFAHHLPTMDPRKVNELRAFVKMCKQDPSVLHTEEMRFLREWVESMGGKVPPATQKAKSEENTKEEKPDSKKVEEDLKADEPSSEESDLEIDKEGVIEPDTDAPQEMGDENAEITEEMMDQANDKKVAAIEALNDGELQKAIDLFTDAIKLNPRLAILYAKRASVFVKLQKPNAAIRDCDRAIEINPDSAQPYKWRGKAHRLLGHWEEAAHDLALACKLDYDEDASAMLKEVQPRAQKIAEHRRKYERKREEREIKERIERVKKAREEHERAQREEEARRQSGAQYGSFPGGFPGGMPGNFPGGMPGMGGGMPGMAGMPGLNEILSDPEVLAAMQDPEVMVAFQDVAQNPANMSKYQSNPKVMNLISKLSAKFGGQA

SEQ ID NO: 909780 - protein, 418 aa, Homo sapiens; identical to SEQ ID NO: 909779

SEQ ID NO: 909781 - protein, 418 aa, Homo sapiens; identical to SEQ ID NO: 909779

SEQ ID NO: 909782 - protein, 388 aa, Homo sapiens
RWVGGASGRGGSSLFCLAAAAPFCAVTPSQRLGLEPGRSPPSFAHHLPTMDPRKVNELRAFVKMCKQDPSVLHTEEEKPDSKKVEEDLKADEPSSEESDLEIDKEGVIEPDTDAPQEMGDENAEITEEMMDQANDKKVAAIEALNDGELQKAIDLFTDAIKLNPRLAILYAKRASVFVKLQKPNAAIRDCDRAIEINPDSAQPYKWRGKAHRLLGHWEEAAHDLALACKLDYDEDASAMLKEVQPRAQKIAEHRRKYERKREEREIKERIERVKKAREEHERAQREEEARRQSGAQYGSFPGGFPGGMPGNFPGGMPGMGGGMPGMAGMPGLNEILSDPEVLAAMQDPEVMVAFQDVAQNPANMSKYQSNPKVMNLISKLSAKFGGQA

SEQ ID NO: 909783 - protein, 418 aa, Homo sapiens; identical to SEQ ID NO: 909779

SEQ ID NO: 909784 - protein, 418 aa, Homo sapiens; identical to SEQ ID NO: 909779

SEQ ID NO: 909785 - protein, 418 aa, Homo sapiens; identical to SEQ ID NO: 909779

SEQ ID NO: 909786 - protein, 418 aa, Homo sapiens; identical to SEQ ID NO: 909779

SEQ ID NO: 909787 - protein, 332 aa, Homo sapiens
RWVGGASGRGGSSLFCLAAAAPFCAVTPSQRLGLEPGRSPPSFAHHLPTMDPRKVNELRAFVKMCKQDPSVLHTEEMRFLREWVESMGGKVPPATQKAKSEENTKEEKPDSKKVEEDLKADEPSSEESDLEIDKEGVIEPDTDAPQEMGDENAEITEEMMDQANDKKVAAIEALNDGELQKAIDLFTDAIKLNPRLAILYAKRASVFVKLQKPNAAIRDCDRAIEINPDSAQPYKWRGKAHRLLGHWEEAAHDLALACKLDYDEDASAMLKEVQPRAQKIAEHRRKYERKREEREIKERIAHEIVGRPSNISLLYYLPTSDTDNSTPAYQRA

SEQ ID NO: 909788 - protein, 78 aa, Homo sapiens
AAAYYYYYCSEFKLLTMYGDMLFKSFKNTHHINLHLSLCVLLLMCRVLLSRNCQCVLGLTQEQFLLDSLFDLFNLIIF

SEQ ID NO: 909789 - protein, 418 aa, Homo sapiens; identical to SEQ ID NO: 909779

SEQ ID NO: 909790 - protein, 418 aa, Homo sapiens; identical to SEQ ID NO: 909779

SEQ ID NO: 909791 - protein, 418 aa, Homo sapiens; identical to SEQ ID NO: 909779

SEQ ID NO: 909792 - protein, 265 aa, Homo sapiens
RWVGGASGRGGSSLFCLAAAAPFCAVTPSQRLGLEPGRSPPSFAHHLPTMDPRKVNELRAFVKMCKQDPSVLHTEEMRFLREWVESMGGKVPPATQKAKSEENTKEEKPDSKKVEEDLKADEPSSEESDLEIDKEGVIEPDTDAPQEMGDENAEITEEMMDQANDKKVAAIEALNDGELQKAIDLFTDAIKLNPRLAILYAKRASVFVKLQKPNAAIRDCDRAIEINPDSAQPYKWRGKAHRHRKLQNIGESMSENVKSERSKKE

SEQ ID NO: 909793 - protein, 418 aa, Homo sapiens; identical to SEQ ID NO: 909779

SEQ ID NO: 909794 - protein, 418 aa, Homo sapiens; identical to SEQ ID NO: 909779

SEQ ID NO: 909795 - protein, 58 aa, Homo sapiens
MLFKSFKNTHHINLHLSLCVLLLMCRVLLSRNCQCVLGLTQEQFLLDSLFDLFNLIIF

SEQ ID NO: 909796 - protein, 611 aa, Homo sapiens
MNNSSSETRGHPHSASSPSERVFPMPLPRKAPLNIPGTPVLEDFPQNDDEKERLQRRRSRVFDLQFSTDSPRLLASPSSRSIDISATIPKFTNTQITEHYSTCIKLSTENIDPMFQKTAASFDECSTAGVFLSTLHCQDYRSELLFPSDVQTLSTGEPLELPELGCVEMTDLKAPLQQCAEDRQICPSLAGFQFTQWDSETHNESVSALVDKFKKNDQVFDINAEVDESDCGDFPDGSLGDDFDANDEPDHTAVGDHEEFRSWKEPCQVQSCQEEMISLGDGDIRTMCPLLSMKPGEYSYFSPRTMSMWAGPDHWRFRPRRKQDAPSQSENKKKSTKKDFEIDFEDDIDFDVYFRKTKAATILTKSTLENQNWRATTLPTDFNYNVDTLVQLHLKPGTRLLKMAQGHRVETEHYEEIEDYDYNNPNDTSNFCPGLQAADSDDEDLDDLFVGPVGNSDLSPYPCHPPKTAQQNGDTPEAQGLDITTYGESNLVAEPQKVNKIEIHYAKTAKKMDMKKLKQSMWSLLTALSGKEADAEANHREAGKEAALAEVADEKMLSGLTKDLQRSLPPVMAQNLSIPLAFACLLHLANEKNLKLEGTEDLSDVLVRQGD

SEQ ID NO: 909797 - protein, 730 aa, Homo sapiens
MGPPGPETRGHPHSASSPSERVFPMPLPRKAPLNIPGTPVLEDFPQNDDEKERLQRRRSRVFDLQFSTDSPRLLASPSSRSIDISATIPKFTNTQITEHYSTCIKLSTENKITTKNAFGLHLIDFMSEILKQKDTEPTNFKVAAGTLDASTKIYAVRVDAVHADVYRVLGGLGKDAPSLEEVEGHVADGSATEMGTTKKAVKPKKKHLHRTIEQNINNLNVSEADRKCEIDPMFQKTAASFDECSTAGVFLSTLHCQDYRSELLFPSDVQTLSTGEPLELPELGCVEMTDLKAPLQQCAEDRQICPSLAGFQFTQWDSETHNESVSALVDKFKKNDQVFDINAEVDESDCGDFPDGSLGDDFDANDEPDHTAVGDHEEFRSWKEPCQVQSCQEEMISLGDGDIRTMCPLLSMKPGEYSYFSPRTMSMWAGPDHWRFRPRRKQDAPSQSENKKKSTKKDFEIDFEDDIDFDVYFRKTKAATILTKSTLENQNWRATTLPTDFNYNVDTLVQLHLKPGTRLLKMAQGHRVETEHYEEIEDYDYNNPNDTSNFCPGLQAADSDDEDLDDLFVGPVGNSDLSPYPCHPPKTAQQNGDTPEAQGLDITTYGESNLVAEPQKVNKIEIHYAKTAKKMDMKKLKQSMWSLLTALSGKEADAEANHREAGKEAALAEVADEKMLSGLTKDLQRSLPPVMAQNLSIPLAFACLLHLANEKNLKLEGTEDLSDVLVRQGD

SEQ ID NO: 909798 - protein, 742 aa, Homo sapiens
GRVGGRRGSTHASGPPGPETRGHPHSASSPSERVFPMPLPRKAPLNIPGTPVLEDFPQNDDEKERLQRRRSRVFDLQFSTDSPRLLASPSSRSIDISATIPKFTNTQITEHYSTCIKLSTENKITTKNAFGLHLIDFMSEILKQKDTEPTNFKVAAGTLDASTKIYAVRVDAVHADVYRVLGGLGKDAPSLEEVEGHVADGSATEMGTTKKAVKPKKKHLHRTIEQNINNLNVSEADRKCEIDPMFQKTAASFDECSTAGVFLSTLHCQDYRSELLFPSDVQTLSTGEPLELPELGCVEMTDLKAPLQQCAEDRQICPSLAGFQFTQWDSETHNESVSALVDKFKKNDQVFDINAEVDESDCGDFPDGSLGDDFDANDEPDHTAVGDHEEFRSWKEPCQVQSCQEEMISLGDGDIRTMCPLLSMKPGEYSYFSPRTMSMWAGPDHWRFRPRRKQDAPSQSENKKKSTKKDFEIDFEDDIDFDVYFRKTKAATILTKSTLENQNWRATTLPTDFNYNVDTLVQLHLKPGTRLLKMAQGHRVETEHYEEIEDYDYNNPNDTSNFCPGLQAADSDDEDLDDLFVGPVGNSDLSPYPCHPPKTAQQNGDTPEAQGLDITTYGESNLVAEPQKVNKIEIHYAKTAKKMDMKKLKQSMWSLLTALSGKEADAEANHREAGKEAALAEVADEKMLSGLTKDLQRSLPPVMAQNLSIPLAFACLLHLANEKNLKLEGTEDLSDVLVRQGD

SEQ ID NO: 909799 - protein, 717 aa, Homo sapiens
MGPPGPERVFPMPLPRKAPLNIPGTPVLEDFPQNDDEKERLQRRRSRVFDLQFSTDSPRLLASPSSRSIDISATIPKFTNTQITEHYSTCIKLSTENKITTKNAFGLHLIDFMSEILKQKDTEPTNFKVAAGTLDASTKIYAVRVDAVHADVYRVLGGLGKDAPSLEEVEGHVADGSATEMGTTKKAVKPKKKHLHRTIEQNINNLNVSEADRKCEIDPMFQKTAASFDECSTAGVFLSTLHCQDYRSELLFPSDVQTLSTGEPLELPELGCVEMTDLKAPLQQCAEDRQICPSLAGFQFTQWDSETHNESVSALVDKFKKNDQVFDINAEVDESDCGDFPDGSLGDDFDANDEPDHTAVGDHEEFRSWKEPCQVQSCQEEMISLGDGDIRTMCPLLSMKPGEYSYFSPRTMSMWAGPDHWRFRPRRKQDAPSQSENKKKSTKKDFEIDFEDDIDFDVYFRKTKAATILTKSTLENQNWRATTLPTDFNYNVDTLVQLHLKPGTRLLKMAQGHRVETEHYEEIEDYDYNNPNDTSNFCPGLQAADSDDEDLDDLFVGPVGNSDLSPYPCHPPKTAQQNGDTPEAQGLDITTYGESNLVAEPQKVNKIEIHYAKTAKKMDMKKLKQSMWSLLTALSGKEADAEANHREAGKEAALAEVADEKMLSGLTKDLQRSLPPVMAQNLSIPLAFACLLHLANEKNLKLEGTEDLSDVLVRQGD

SEQ ID NO: 909800 - protein, 453 aa, Homo sapiens
MGPPGPETRGHPHSASSPSERVFPMPICPSLAGFQFTQWDSETHNESVSALVDKFKKNDQVFDINAEVDESDCGDFPDGSLGDDFDANDEPDHTAVGDHEEFRSWKEPCQVQSCQEEMISLGDGDIRTMCPLLSMKPGEYSYFSPRTMSMWAGPDHWRFRPRRKQDAPSQSENKKKSTKKDFEIDFEDDIDFDVYFRKTKAATILTKSTLENQNWRATTLPTDFNYNVDTLVQLHLKPGTRLLKMAQGHRVETEHYEEIEDYDYNNPNDTSNFCPGLQAADSDDEDLDDLFVGPVGNSDLSPYPCHPPKTAQQNGDTPEAQGLDITTYGESNLVAEPQKVNKIEIHYAKTAKKMDMKKLKQSMWSLLTALSGKEADAEANHREAGKEAALAEVADEKMLSGLTKDLQRSLPPVMAQNLSIPLAFACLLHLANEKNLKLEGTEDLSDVLVRQGD

SEQ ID NO: 909801 - protein, 666 aa, Homo sapiens
MNNSSSETRGHPHSASSPSERVFPMPLPRKAPLNIPGTPVLEDFPQNDDEKERLQRRRSRVFDLQFSTDSPRLLASPSSRSIDISATIPKFTNTQITEHYSTCIKLSTENKITTKNAFGLHLIDFMSEILKQKDTEPTNFKVAAGTLDASTKIYAVRVDAVHADVYRVLGGLGKDAPSLEEVEGHVADGSATEMGTTKKAVKPKKKHLHRTIEQNINNLNVSEADRKCEIDPMFQKTAASFDECSTAGVFLSTLHCQDYRSELLFPSDVQTLSTGEPLELPELGCVEMTDLKAPLQQCAEDRQICPSLAGFQFTQWDSETHNESVSALVDKFKKNDQVFDINAEVDESDCGDFPDGSLGDDFDANDEPDHTAVGDHEEFRSWKEPCQVQSCQEEMISLGDGDIRTMCPLLSMKPGEYSYFSPRTMSMWAGPDHWRFRPRRKQDAPSQSENKKKSTKKDFEIDFEDDIDFDVYFRKTKAATILTKSTLENQNWRATTLPTDFNYNVDTLVQLHLKPGTRLLKMAQGHRVETEHYEEIEDYDYNNPNDTSNFCPGLQAADSDDEDLDDLFVGPVGNSDLSPYPCHPPKTAQQNGDTPEAQGLDITTYGESNLVAEPQKVNKIEIHYAKTAKKMDMKKLKQSMWSLLTALSGKEADAEVRCSCLFSRCP

SEQ ID NO: 909802 - protein, 358 aa, Homo sapiens
LKFKVCVGPGLDKFKNEVTTEEMISLGDGDIRTMCPLLSMKPGEYSYFSPRTMSMWAGPDHWRFRPRRKQDAPSQSENKKKSTKKDFEIDFEDDIDFDVYFRKTKAATILTKSTLENQNWRATTLPTDFNYNVDTLVQLHLKPGTRLLKMAQGHRVETEHYEEIEDYDYNNPNDTSNFCPGLQAADSDDEDLDDLFVGPVGNSDLSPYPCHPPKTAQQNGDTPEAQGLDITTYGESNLVAEPQKVNKIEIHYAKTAKKMDMKKLKQSMWSLLTALSGKEADAEANHREAGKEAALAEVADEKMLSGLTKDLQRSLPPVMAQNLSIPLAFACLLHLANEKNLKLEGTEDLSDVLVRQGD

SEQ ID NO: 909803 - protein, 730 aa, Homo sapiens
MNNSSSETRGHPHSASSPSERVFPMPLPRKAPLNIPGTPVLEDFPQNDDEKERLQRRRSRVFDLQFSTDSPRLLASPSSRSIDISATIPKFTNTQITEHYSTCIKLSTENKITTKNAFGLHLIDFMSEILKQKDTEPTNFKVAAGTLDASTKIYAVRVDAVHADVYRVLGGLGKDAPSLEEVEGHVADGSATEMGTTKKAVKPKKKHLHRTIEQNINNLNVSEADRKCEIDPMFQKTAASFDECSTAGVFLSTLHCQDYRSELLFPSDVQTLSTGEPLELPELGCVEMTDLKAPLQQCAEDRQICPSLAGFQFTQWDSETHNESVSALVDKFKKNDQVFDINAEVDESDCGDFPDGSLGDDFDANDEPDHTAVGDHEEFRSWKEPCQVQSCQEEMISLGDGDIRTMCPLLSMKPGEYSYFSPRTMSMWAGPDHWRFRPRRKQDAPSQSENKKKSTKKDFEIDFEDDIDFDVYFRKTKAATILTKSTLENQNWRATTLPTDFNYNVDTLVQLHLKPGTRLLKMAQGHRVETEHYEEIEDYDYNNPNDTSNFCPGLQAADSDDEDLDDLFVGPVGNSDLSPYPCHPPKTAQQNGDTPEAQGLDITTYGESNLVAEPQKVNKIEIHYAKTAKKMDMKKLKQSMWSLLTALSGKEADAEANHREAGKEAALAEVADEKMLSGLTKDLQRSLPPVMAQNLSIPLAFACLLHLANEKNLKLEGTEDLSDVLVRQGD

SEQ ID NO: 909804 - protein, 730 aa, Homo sapiens; identical to SEQ ID NO: 909803

SEQ ID NO: 909805 - protein, 730 aa, Homo sapiens; identical to SEQ ID NO: 909803

SEQ ID NO: 909806 - protein, 498 aa, Homo sapiens [sequence omitted]

SEQ ID NO: 909807 - protein, 454 aa, Homo sapiens
DFEIDFEDDIDFDVYFRKTKAATILTKSTLENQNVESYHPSYRFQLQSVSALVDKFKKNDQVFDINAEVDESDCGDFPDGSLGDDFDANDEPDHTAVGDHEEFRSWKEPCQVQSCQEEMISLGDGDIRTMCPLLSMKPGEYSYFSPRTMSMWAGPDHWRFRPRRKQDAPSQSENKKKSTKKDFEIDFEDDIDFDVYFRKTKAATILTKSTLENQNWRATTLPTDFNYNVDTLVQLHLKPGTRLLKMAQGHRVETEHYEEIEDYDYNNPNDTSNFCPGLQAADSDDEDLDDLFVGPVGNSDLSPYPCHPPKTAQQNGDTPEAQGLDITTYGESNLVAEPQKVNKIEIHYAKTAKKMDMKKLKQSMWSLLTALSGKEADAEANHREAGKEAALAEVADEKMLSGLTKDLQRSLPPVMAQNLSIPLAFACLLHLANEKNLKLEGTEDLSDVLVRQGD

SEQ ID NO: 909808 - protein, 342 aa, Homo sapiens
MNNSSSETRGHPHSASSPSERVFPMPLPRKAPLNIPGTPVLEDFPQNDDEKERLQRRRSRVFDLQFSTDSPRLLASPSSRSIDISATIPKFTNTQITEHYSTCIKLSTENKITTKNAFGLHLIDFMSEILKQKDTEPTNFKVAAGTLDASTKIYAVRVDAVHADVYRVLGGLGKDAPSLEEVEGHVADGSATEMGTTKKAVKPKKKHLHRTIEQNINNLNVSEADRKCEIDPMFQKTAASFDECSTAGVFLSTLHCQDYRSELLFPSDVQTLSTGEPLELPELGCVEMTDLKAPLQQCAEDRQICPSLAGFQFTQWDSETHNESVSLLLDTAQEALTLLASW

SEQ ID NO: 909809 - protein, 576 aa, Homo sapiens
MKCHYEALGVRRDASEEELKKAYRKLALKWHPDKNLDNAAEAAEQFKLIQAAYDVLSDPQERAWYDNHREALLKGGFDGEYQDDSLDLLRYFTVTCYSGYGDDEKGFYTVYRNVFEMIAKEELESVLEEEVDDFPTFGDSQSDYDTVVHPFYAYWQSFCTQKNFAWKEEYDTRQASNRWEKRAMEKENKKIRDKARKEKNELVRQLVAFIRKRDKRVQAHRKLVEEQNAEKARKAEEMRRQQKLKQAKLVEQYREQSWMTMANLEKELQEMEARYEKEFGDGSDENEMEEHELKDEEDGKDSDEAEDAELYDDLYCPACDKSFKTEKAMKNHEKSKKHREMVALLKQQLEEEEENFSRPQIDENPLDDNSEEEMEDAPKQKLSKKQKKKKQKPAQDVPGKDSYLPAAHFQMAWGKKCVLGERRDGESEHKCAKMLLENRQNYDDNFNVNGPGEGVKVDPEDTNLNQDSAKELEDSPQENVSVTEIIKPCDDPKSEAKSVPKPKGKKTKDMKKPVRVPAEPQTMSVLISCTTCHSEFPSRNKLFDHLKATGHARAPSSSSLNSATSSQSKKEKRKNR

SEQ ID NO: 909810 - protein, 453 aa, Homo sapiens
MKCHYEALGVRRDASEEELKKAYRKLALKWHPDKNLDNAAEAAEQFKLIQAAYDVLSDPQERAWYDNHREALLKGGFDGEYQDDSLDLLRYFTVTCYSGYGDDEKGFYTVYRNVFEMIAKEELESVLEEEVDDFPTFGDSQSDYDTVVHPFYAYWQSFCTQKNFAWKEEYDTRQASNRWEKRAMEKENKKIRDKARKEKNELVRQLVAFIRKRDKRVQAHRKLVEEQNAEKARKAEEMRRQQKLKQAKLVEQYREQSWMTMANLEKELQEMEARYEKEFGDGSDENEMEEHELKDEEDGKDSDEAEDAELYDDLYCPACDKSFKTEKAMKNHEKSKKHREMVALLKQQLEEEEENFSRPQIDENPLDDNSEEEMEDAPKQKLSKKQKKKKQKPAQNYDDNFNVNGPGEGVKVDPEDTNLNQDSAKELEDSPQENVSVTEIIKPCDDPKSEAKR

SEQ ID NO: 909811 - protein, 531 aa, Homo sapiens
MKCHYEALGVRRDASEEELKKAYRKLALKWHPDKNLDNAAEAAEQFKLIQAAYDVLSDPQERAWYDNHREALLKGGFDGEYQDDSLDLLRYFTVTCYSGYGDDEKGFYTVYRNVFEMIAKEELESVLEEEVDDFPTFGDSQSDYDTVVHPFYAYWQSFCTQKNFAWKEEYDTRQASNRWEKRAMEKENKKIRDKARKEKNELVRQLVAFIRKRDKRVQAHRKLVEEQNAEKARKAEEMRRQQKLKQAKLVEQYREQSWMTMANLEKELQEMEARYEKEFGDGSDENEMEEHELKDEEDGKDSDEAEDAELYDDLYCPACDKSFKTEKAMKNHEKSKKHREMVALLKQQLEEEEENFSRPQIDENPLDDNSEEEMEDAPKQKLSKKQKKKKQKPAQNYDDNFNVNGPGEGVKVDPEDTNLNQDSAKELEDSPQENVSVTEIIKPCDDPKSEAKSVPKPKGKKTKDMKKPVRVPAEPQTMSVLISCTTCHSEFPSRNKLFDHLKATGHARAPSSSSLNSATSSQSKKEKRKNR

SEQ ID NO: 909812 - protein, 531 aa, Homo sapiens; identical to SEQ ID NO: 909811

SEQ ID NO: 909813 - protein, 220 aa, Homo sapiens
YENELTLHQNVEADINGLRRVLDELTLCRTDQELQYESLSEEMTYLKKNHEEEMKALQCAAGGNVNVEMNAAPGVDLAVLLNNMRAEYEALAEQNRKDAEAWFNEKSASLQQQISHDSGAATFARSQLTEMRRTLQTLEIQLQSLMATKHSLECSLTETESNYCTQLAQIQAQIGALEEQLHQVRTETEGQKLEYEHLLDVKVHLEKEIETYCRLIDGDG

SEQ ID NO: 909814 - protein, 766 aa, Homo sapiens
MYPQGRHPAPHQPGQPGFKFTVAESCDRIKDEFQFLQAQYHSLKVEYDKLANEKTEMQRHYVMYYEMSYGLNIEMHKQTEIAKRLNTILAQIMPFLSQEHQQQVAQAVERAKQVTMTELNAIIGQQQLQAQHLSHATHGPPVQLPPHPSGLQPPGIPPVTGSSSGLLALGALGSQAHLTVKDEKNHHELDHREENMNNSVSPSESLRASEKHRGSADYSMEAKKRKAEEKDSLSRYDSDGDKSDDLVVDVSNEDPATPRVSPAHSPPENGLDKARSLKKDAPTSPASVASSSSTPSSKTKDLGHNDKSSTPGLKSNTPTPRNDAPTPGTSTTPGLRSMPGKPPGMDPIASALRTPISITSSYAAPFAMMSHHEMNGSLTSPGAYAGLHNIPPQMSAAAAAAAAAYGRSPSELGAVGFDPHPPMRATGLPSSLASIPGGKPAYSFHVSADGQMQPVPFPHDALAGPGIPRHARQINTLSHGEVVCAVTISNPTRHVYTGGKGCVKIWDISQPGSKSPISQLDCLNRDNYIRSCKLLPDGRTLIVGGEASTLTIWDLASPTPRIKAELTSSAPACYALAISPDAKVCFSCCSDGNIAVWDLHNQTLVRQFQGHTDGASCIDISHDGTKLWTGGLDNTVRSWDLREGRQLQQHDFTSQIFSLGYCPTGEWLAVGMESSNVEVLHHTKPDKYQLHLHESCVLSLKFAYCGKWFVSTGKDNLLNAWRTPYGASIFQSKESSSVLSCDISADDKYIVTGSGDKKATVYEVIY

SEQ ID NO: 909815 - protein, 766 aa, Homo sapiens; identical to SEQ ID NO: 909814

SEQ ID NO: 909816 - protein, 652 aa, Homo sapiens
MTELNAIIGQQQLQAQHLSHATHGPPVQLPPHPSGLQPPGIPPVTGSSSGLLALGALGSQAHLTVKDEKNHHELDHREEIQWNNSVSPSESLRASEKHRGSADYSMEAKKRKAEEKDSLSRYDSDGDKSDDLVVDVSNEDPATPRVSPAHSPPENGLDKARSLKKDAPTSPASVASSSSTPSSKTKDLGHNDKSSTPGLKSNTPTPRNDAPTPGTSTTPGLRSMPGKPPGMDPIASALRTPISITSSYAAPFAMMSHHEMNGSLTSPGAYAGLHNIPPQMSAAAAAAAAAYGRSPSELGAVGFDPHPPMRATGLPSSLASIPGGKPAYSFHVSADGQMQPVPFPHDALAGPGIPRHARQINTLSHGEVVCAVTISNPTRHVYTGGKGCVKIWDISQPGSKSPISQLDCLNRDNYIRSCKLLPDGRTLIVGGEASTLTIWDLASPTPRIKAELTSSAPACYALAISPDAKVCFSCCSDGNIAVWDLHNQTLVRQFQGHTDGASCIDISHDGTKLWTGGLDNTVRSWDLREGRQLQQHDFTSQIFSLGYCPTGEWLAVGMESSNVEVLHHTKPDKYQLHLHESCVLSLKFAYCGKWFVSTGKDNLLNAWRTPYGASIFQSKESSSVLSCDISADDKYIVTGSGDKKATVYEVIY

SEQ ID NO: 909817 - protein, 532 aa, Homo sapiens
AARGYVRQYVTLVVDVSNEDPATPRVSPAHSPPENGLDKARSLKKDAPTSPASVASSSSTPSSKTKDLGHNDKSSTPGLKSNTPTPRNDAPTPGTSTTPGLRSMPGKPPGMDPIASALRTPISITSSYAAPFAMMSHHEMNGSLTSPGAYAGLHNIPPQMSAAAAAAAAAYGRSPSELGAVGFDPHPPMRATGLPSSLASIPGGKPAYSFHVSADGQMQPVPFPHDALAGPGIPRHARQINTLSHGEVVCAVTISNPTRHVYTGGKGCVKIWDISQPGSKSPISQLDCLNRDNYIRSCKLLPDGRTLIVGGEASTLTIWDLASPTPRIKAELTSSAPACYALAISPDAKVCFSCCSDGNIAVWDLHNQTLVRQFQGHTDGASCIDISHDGTKLWTGGLDNTVRSWDLREGRQLQQHDFTSQIFSLGYCPTGEWLAVGMESSNVEVLHHTKPDKYQLHLHESCVLSLKFAYCGKWFVSTGKDNLLNAWRTPYGASIFQSKESSSVLSCDISADDKYIVTGSGDKKATVYEVIY

SEQ ID NO: 909818 - protein, 344 aa, Homo sapiens
MRATGLPSSLASIPGGKPAYSFHVSADGQMQPVPFPHDALAGPGIPRHARQINTLSHGEVVCAVTISNPTRHVYTGGKGCVKIWDISQPGSKSPISQLDCLNRDNYIRSCKLLPDGRTLIVGGEASTLTIWDLASPTPRIKAELTSSAPACYALAISPDAKVCFSCCSDGNIAVWDLHNQTLVRQFQGHTDGASCIDISHDGTKLWTGGLDNTVRSWDLREGRQLQQHDFTSQIFSLGYCPTGEWLAVGMESSNVEVLHHTKPDKYQLHLHESCVLSLKFAYCGKWFVSTGKDNLLNAWRTPYGASIFQSKESSSVLSCDISADDKYIVTGSGDKKATVYEVIY

SEQ ID NO: 909819 - protein, 766 aa, Homo sapiens; identical to SEQ ID NO: 909814

SEQ ID NO: 909820 - protein, 147 aa, Homo sapiens
HLESSPVFVCILLIFLCPGRSLAYGRNRHALLNLKNSESSFQTSLSFLFTSLKSILSWLAVEKPADIGSIAELFYLPISLLKFAYCGKWFVSTGKDNLLNAWRTPYGASIFQSKESSSVLSCDISADDKYIVTGSGDKKATVYEVIY

SEQ ID NO: 909821 - protein, 311 aa, Homo sapiens
MYPQGRHPAPHQPGQPGFKFTVAESCDRIKDEFQFLQAQYHSLKVEYDKLANEKTEMQRHYVMYYEMSYGLNIEMHKQTEIAKRLNTILAQIMPFLSQEHQQQVAQAVERAKQVTMTELNAIIGQQQLQAQHLSHATHGPPVQLPPHPSGLQPPGIPPVTGSSSGLLALGALGSQAHLTVKDEKNHHELDHREENMNNSVSPSESLRASEKHRGSADYSMEAKKRKAEEKDSLSRYDSDGDKSDDLVVDVSNEDPATPRVSPAHSPPENGLDKARSLKKDAPTSPASVASSSSTPSSKTKDLGHFCSSSSP

SEQ ID NO: 909822 - protein, 531 aa, Homo sapiens
MYPQGRHPAPHQPGQPGFKFTVAESCDRIKDEFQFLQAQYHSLKVEYDKLANEKTEMQRHYVMYYEMSYGLNIEMHKQTEIAKRLNTILAQIMPFLSQEHQQQVAQAVERAKQVTMTELNAIIGQQQLQAQHLSHATHGPPVQLPPHPSGLQPPGIPPVTGSSSGLLALGALGSQAHLTVKDEKNHHELDHREENMNNSVSPSESLRASEKHRGSADYSMEAKKRKAEEKDSLSRYDSDGDKSDDLVVDVSNEDPATPRVSPAHSPPENGLDKARSLKKDAPTSPASVASSSSTPSSKTKDLGHNDKSSTPGLKSNTPTPRNDAPTPGTSTTPGLRSMPGKPPGMDPIASALRTPISITSSYAAPFAMMSHHEMNGSLTSPGAYAGLHNIPPQMSAAAAAAAAAYGRSPSELGAVGFDPHPPMRATGLPSSLASIPGGKPAYSFHVSADGQMQPVPFPHDALAGPGIPRHARQINTLSHGEVVCAVTISNPTRHVYTGGKGCVKIWDISQPGSVQSLSGSQMSICHLLLRL

SEQ ID NO: 909823 - protein, 497 aa, Homo sapiens
MYPQGRHPAPHQPGQPGFKFTVAESCDRIKDEFQFLQAQYHSLKVEYDKLANEKTEMQRHYVMYYEMSYGLNIEMHKQTEIAKRLNTILAQIMPFLSQEHQQQVAQAVERAKQVTMTELNAIIGQQQLQAQHLSHATHGPPVQLPPHPSGLQPPGIPPVTGSSSGLLALGALGSQAHLTVKDEKNHHELDHREENMNNSVSPSESLRASEKHRGSADYSMEAKKRKAEEKDSLSRYDSDGDKSDDLVVDVSNEDPATPRVSPAHSPPENGLDKARSLKKDAPTSPASVASSSSTPSSKTKDLGHNDKSSTPGLKSNTPTPRNDAPTPGTSTTPGLRSMPGKPPGMDPIASALRTPISITSSYAAPFAMMSHHEMNGSLTSPGAYAGLHNIPPQMSAAAAAAAAAYGRSPSELELFGAVGFDPHPPMRATGLPSSLASIPGGKPKKSNLELLRISLLIESWLDAFLKVLEEVIVIAVRGVIHQVVGEHTPEEPHGLQP

SEQ ID NO: 909824 - protein, 349 aa, Homo sapiens
MYPQGRHPAPHQPGQPGFKFTVAESCDRIKDEFQFLQAQYHSLKVEYDKLANEKTEMQRHYVMYYEMSYGLNIEMHKQTEIAKRLNTILAQIMPFLSQEHQQQVAQAVERAKQVTMTELNAIIGQQQLQAQHLSHATHGPPVQLPPHPSGLQPPGIPPVTGSSSGLLALGALGSQAHLTVKDEKNHHELDHREENMNNSVSPSESLRASEKHRGSADYSMEAKKRKAEEKDSLSRYDSDGDKSDDLVVDVSNEDPATPRVSPAHSPPENGLDKARSLKKDAPTSPASVASSSSTPSSKTKDLGHNDKSSTPGLKSNTPTPRNDAPTPGTSTTPGLRSMPGKPPGMDPIV

SEQ ID NO: 909825 - protein, 269 aa, Homo sapiens
MYPQGRHPAPHQPGQPGFKFTVAESCDRIKDEFQFLQAQYHSLKVEYDKLANEKTEMQRHYVMYYEMSYGLNIEMHKQTEIAKRLNTILAQIMPFLSQEHQQQVAQAVERAKQVTMTELNAIIGVRGLPNLPLTQQQLQAQHLSHATHGPPVQLPPHPSGLQPPGIPPVTGSSSGLLALGALGSQAHLTVKDEKNHHELDHREKNMNNSVSPSESLRASEKHRGSADYSMEAKKRKAEEKDSLSRYDSDGEGKGRKKRRKGRKRKRERE

SEQ ID NO: 909826 - protein, 149 aa, Homo sapiens [sequence omitted]

SEQ ID NO: 909827 - protein, 757 aa, Homo sapiens
MYPQGRHPAPHQPGQPGFKFTVAESCDRIKDEFQFLQAQYHSLKVEYDKLANEKTEMQRHYVMYYEMSYGLNIEMHKQTEIAKRLNTILAQIMPFLSQEHQQQVAQAVERAKQVTMTELNAIIGQQQLQAQHLSHATHGPPVQLPPHPSGLQPPGIPPVTGSSSGLLALGALGSQAHLTVKDEKNHHELDHREENMNNSVSPSESLRASEKHRGSADYSMEAKKRKAEEKDSLSRYDSDGDKSDDLVVDVSNEDPATPRVSPAHSPPENGLDKARSLKKDAPTSPASVASSSSTPSSKTKDLGHNDKSSTPGLKSNTPTPRNDAPTPGTSTTPGLRSMPASALRTPISITSSYAAPFAMMSHHEMNGSLTSPGAYAGLHNIPPQMSAAAAAAAAAYGRSPSELGAVGFDPHPPMRATGLPSSLASIPGGKPAYSFHVSADGQMQPVPFPHDALAGPGIPRHARQINTLSHGEVVCAVTISNPTRHVYTGGKGCVKIWDISQPGSKSPISQLDCLNRDNYIRSCKLLPDGRTLIVGGEASTLTIWDLASPTPRIKAELTSSAPACYALAISPDAKVCFSCCSDGNIAVWDLHNQTLVRQFQGHTDGASCIDISHDGTKLWTGGLDNTVRSWDLREGRQLQQHDFTSQIFSLGYCPTGEWLAVGMESSNVEVLHHTKPDKYQLHLHESCVLSLKFAYCGKWFVSTGKDNLLNAWRTPYGASIFQSKESSSVLSCDISADDKYIVTGSGDKKATVYEVIY

SEQ ID NO: 909828 - protein, 766 aa, Homo sapiens; identical to SEQ ID NO: 909814

SEQ ID NO: 909829 - protein, 722 aa, Homo sapiens
EDGISAYVMYYEMSYGLNIEMHKQTEIAKRLNTILAQIMPFLSQEHQQQVAQAVERAKQVTMTELNAIIGVRGLPNLPLTQQQLQAQHLSHATHGPPVQLPPHPSGLQPPGIPPVTGSSSGLLALGALGSQAHLTVKDEKNHHELDHREKNMNNSVSPSESLRASEKHRGSADYSMEAKKRKAEEKDSLSRYDSDGDKSDDLVVDVSNEDPATPRVSPAHSPPENGLDKARSLKKDAPTSPASVASSSSTPSSKTKDLGHNDKSSTPGLKSNTPTPRNDAPTPGTSTTPGLRSMPGKPPGMDPIASALRTPISITSSYAAPFAMMSHHEMNGSLTSPGAYAGLHNIPPQMSAAAAAAAAAYGRSPSELGAVGFDPHPPMRATGLPSSLASIPGGKPAYSFHVSADGQMQPVPFPHDALAGPGIPRHARQINTLSHGEVVCAVTISNPTRHVYTGGKGCVKIWDISQPGSKSPISQLDCLNRDNYIRSCKLLPDGRTLIVGGEASTLTIWDLASPTPRIKAELTSSAPACYALAISPDAKVCFSCCSDGNIAVWDLHNQTLVRQFQGHTDGASCIDISHDGTKLWTGGLDNTVRSWDLREGRQLQQHDFTSQIFSLGYCPTGEWLAVGMESSNVEVLHHTKPDKYQLHLHESCVLSLKFAYCGKWFVSTGKDNLLNAWRTPYGASIFQSKESSSVLSCDISADDKYIVTGSGDKKATVYEVIY

SEQ ID NO: 909830 - protein, 429 aa, Homo sapiens
MPGKPPGMDPIASALRTPISITSSYAAPFAMMSHHEMNGSLTSPGAYAGLHNIPPQMSAAAAAAAAAYGRSPSELGAVGFDPHPPMRATGLPSSLASIPGGKPAYSFHVSADGQMQPVPFPHDALAGPGIPRHARQINTLSHGEVVCAVTISNPTRHVYTGGKGCVKIWDISQPGSKSPISQLDCLNRDNYIRSCKLLPDGRTLIVGGEASTLTIWDLASPTPRIKAELTSSAPACYALAISPDAKVCFSCCSDGNIAVWDLHNQTLVRQFQGHTDGASCIDISHDGTKLWTGGLDNTVRSWDLREGRQLQQHDFTSQIFSLGYCPTGEWLAVGMESSNVEVLHHTKPDKYQLHLHESCVLSLKFAYCGKWFVSTGKDNLLNAWRTPYGASIFQSKESSSVLSCDISADDKYIVTGSGDKKATVYEVIY

SEQ ID NO: 909831 - protein, 335 aa, Homo sapiens
AVTVSHLFRAYSFHVSADGQMQPVPFPHDALAGPGIPRHARQINTLSHGEVVCAVTISNPTRHVYTGGKGCVKIWDISQPGSKSPISQLDCLNRDNYIRSCKLLPDGRTLIVGGEASTLTIWDLASPTPRIKAELTSSAPACYALAISPDAKVCFSCCSDGNIAVWDLHNQTLVRQFQGHTDGASCIDISHDGTKLWTGGLDNTVRSWDLREGRQLQQHDFTSQIFSLGYCPTGEWLAVGMESSNVEVLHHTKPDKYQLHLHESCVLSLKFAYCGKWFVSTGKDNLLNAWRTPYGASIFQSKESSSVLSCDISADDKYIVTGSGDKKATVYEVIY

SEQ ID NO: 909832 - protein, 639 aa, Homo sapiens
MYPQGRHPAPHQPGQPGFKFTVAESCDRIKDEFQFLQAQYHSLKVEYDKLANEKTEMQRHYVMYYEMSYGLNIEMHKQTEIAKRLNTILAQIMPFLSQEHQQQVAQAVERAKQVTMTELNAIIGQQQLQAQHLSHATHGPPVQLPPHPSGLQPPGIPPVTGSSSGLLALGALGSQAHLTVKDEKNHHELDHREENMNNSVSPSESLRASEKHRGSADYSMEAKKRKAEEKDSLSRYDSDGDKSDDLVVDVSNEDPATPRVSPAHSPPENGLDKARSLKKDAPTSPASVASSSSTPSSKTKDLGHNDKSSTPGLKSNTPTPRNDAPTPGTSTTPGLRSMPGKPPGMDPIASALRTPISITSSYAAPFAMMSHHEMNGSLTSPGAYAGLHNIPPQMSAAAAAAAAAYGRSPSELGAVGFDPHPPMRATGLPSSLASIPGGKPAYSFHVSADGQMQPVPFPHDALAGPGIPRHARQINTLSHGEVVCAVTISNPTRHVYTGGKGCVKIWDISQPGSKSPISQLDCLNRDNYIRSCKLLPDGRTLIVGGEASTLTIWDLASPTPRIKAELTSSAPACYALAISPDAKVCFSCCSDGNIAVWDLHNQTLVRQFQGHTDGASCIDISHDVLLLLLPLNNAGSCYK

SEQ ID NO: 909833 - protein, 606 aa, Homo sapiens
MYPQGRHPAPHQPGQPGFKFTVAESCDRIKDEFQFLQAQYHSLKVEYDKLANEKTEMQRHYVMYYEMSYGLNIEMHKQTEIAKRLNTILAQIMPFLSQEHQQQVAQAVERAKQVTMTELNAIIGQQQLQAQHLSHATHGPPVQLPPHPSGLQPPGIPPVTGSSSGLLALGALGSQAHLTVKDEKNHHELDHREENMNNSVSPSESLRASEKHRGSADYSMEAKKRKAEEKDSLSRYDSDGDKSDDLVVDVSNEDPATPRVSPAHSPPENGLDKARSLKKDAPTSPASVASSSSTPSSKTKDLGHNDKSSTPGLKSNTPTPRNDAPTPGTSTTPGLRSMPGKPPGMDPIASALRTPISITSSYAAPFAMMSHHEMNGSLTSPGAYAGLHNIPPQMSAAAAAAAAAYGRSPSELGAVGFDPHPPMRATGLPSSLASIPGGKPAYSFHVSADGQMQPVPFPHDALAGPGIPRHARQINTLSHGEVVCAVTISNPTRHVYTGGKGCVKIWDISQPGSKSPISQLDCLNRDNYIRSCKLLPDGRTLIVGGEASTLTIWDLASPTPRIKAELTSSAPACYALAISPDAKVCFSCCSDGNIAVWDLHNQTLVR

SEQ ID NO: 909834 - protein, 368 aa, Homo sapiens
MYPQGRHPAPHQPGQPGFKFTVAESCDRIKDEFQFLQAQYHSLKVEYDKLANEKTEMQRHYVMYYEMSYGLNIEMHKQTEIAKRLNTILAQIMPFLSQEHQQQVAQAVERAKQVTMTELNAIIGQQQLQAQHLSHATHGPPVQLPPHPSGLQPPGIPPVTGSSSGLLALGALGSQAHLTVKDEKNHHELDHREENMNNSVSPSESLRASEKHRGSADYSMEAKKRKAEEKDSLSRYDSDGDKSDDLVVDVSNEDPATPRVSPAHSPPENGLDKARSLKKDAPTSPASVASSSSTPSSKTKDLGHNDKSSTPGLKSNTPTPRNDAPTPGTSTTPGLRSMPGKPPGMDPIASLSHAHLQFQLRSKDPARV

SEQ ID NO: 909835 - protein, 259 aa, Homo sapiens
MYPQGRHPAPHQPGQPGFKFTVAESCDRIKDEFQFLQAQYHSLKVEYDKLANEKTEMQRHYVMYYEMSYGLNIEMHKQTEIAKRLNTILAQIMPFLSQEHQQQVAQAVERAKQVTMTELNAIIGQQQLQAQHLSHATHGPPVQLPPHPSGLQPPGIPPVTGSSSGLLALGALGSQAHLTVKDEKNHHELDHREENMNNSVSPSESLRASEKHRGSADYSMEAKKRKAEEKDSLSRYDSDGEGKGRKKRRKGRKRKRERE

SEQ ID NO: 909836 - protein, 2540 aa, Homo sapiens
EPSRAALTSGSRSVSTSAFALAARPRPGRGPQQSRAVSLAPAAQSGPGAMGAAAGRSPHLGPAPARRPQRSLLLLQLLLLVAAPGSTQAQAAPFPELCSYTWEAVDTKNNVLYKINICGSVDIVQCGPSSAVCMHDLKTRTYHSVGDSVLRSATRSLLEFNTTVSCDQQGTNHRVQSSIAFLCGKTLGTPEFVTATECVHYFEWRTTAACKKDIFKANKEVPCYVFDEELRKHDLNPLIKLSGAYLVDDSDPDTSLFINVCRDIDTLRDPGSQLRACPPGTAACLVRGHQAFDVGQPRDGLKLVRKDRLVLSYVREEAGKLDFCDGHSPAVTITFVCPSERREGTIPKLTAKSNCRYEIEWITEYACHRDYLESKTCSLSGEQQDVSIDLTPLAQSGGSSYISDGKEYLFYLNVCGETEIQFCNKKQAAVCQVKKSDTSQVKAAGRYHNQTLRYSDGDLTLIYFGGDECSSGFQRMSVINFECNKTAGNDGKGTPVFTGEVDCTYFFTWDTEYACVKEKEDLLCGATDGKKRYDLSALVRHAEPEQNWEAVDGSQTETEKKHFFINICHRVLQEGKARGCPEDAAVCAVDKNGSKNLGKFISSPMKEKGNIQLSYSDGDDCGHGKKIKTNITLVCKPGDLESAPVLRTSGEGGCFYEFEWHTAAACVLSKTEGENCTVFDSQAGFSFDLSPLTKKNGAYKVETKKYDFYINVCGPVSVSPCQPDSGACQVAKSDEKTWNLGLSNAKLSYYDGMIQLNYRGGTPYNNERHTPRATLITFLCDRDAGVGFPEYQEEDNSTYNFRWYTSYACPEEPLECVVTDPSTLEQYDLSSLAKSEGGLGGNWYAMDNSGEHVTWRKYYINVCRPLNPVPGCNRYASACQMKYEKDQGSFTEVVSISNLGMAKTGPVVEDSGSLLLEYVNGSACTTSDGRQTTYTTRIHLVCSRGRLNSHPIFSLNWECVVSFLWNTEAACPIQTTTDTDQACSIRDPNSGFVFNLNPLNSSQGYNVSGIGKIFMFNVCGTMPVCGTILGKPASGCEAETQTEELKNWKPARPVGIEKSLQLSTEGFITLTYKGPLSAKGTADAFIVRFVCNDDVYSGPLKFLHQDIDSGQGIRNTYFEFETALACVPSPVDCQVTDLAGNEYDLTGLSTVRKPWTAVDTSVDGRKRTFYLSVCNPLPYIPGCQGSAVGSCLVSEGNSWNLGVVQMSPQAAANGSLSIMYVNGDKCGNQRFSTRITFECAQISGSPAFQLQDGCEYVFIWRTVEACPVVRVEGDNCEVKDPRHGNLYDLKPLGLNDTIVSAGEYTYYFRVCGKLSSDVCPTSDKSKVVSSCQEKREPQGFHKVAGLLTQKLTYENGLLKMNFTGGDTCHKVYQRSTAIFFYCDRGTQRPVFLKETSDCSYLFEWRTQYACPPFDLTECSFKDGAGNSFDLSSLSRYSDNWEAITGTGDPEHYLINVCKSLAPQAGTEPCPPEAAACLLGGSKPVNLGRVRDGPQWRDGIIVLKYVDGDLCPDGIRKKSTTIRFTCSESQVNSRPMFISAVEDCEYTFAWPTATACPMKSNEHDDCQVTNPSTGHLFDLSSLSGRAGFTAAYSEKGLVYMSICGENENCPPGVGACFGQTRISVGKANKRLRYVDQVLQLVYKDGSPCPSKSGLSYKSVISFVCRPEAGPTNRPMLISLDKQTCTLFFSWHTPLACEQATECSVRNGSSIVDLSPLIHRTGGYEAYDESEDDASDTNPDFYINICQPLNPMHGVPCPAGAAVCKVPIDGPPIDIGRVAGPPILNPIANEIYLNFESSTPCLADKHFNYTSLIAFHCKRGVSMGTPKLLRTSECDFVFEWETPVVCPDEVRMDGCTLTDEQLLYSFNLSSLSTSTFKVTRDSRTYSVGVCTFAVGPEQGGCKDGGVCLLSGTKGASFGRLQSMKLDYRHQDEAVVLSYVNGDRCPPETDDGVPCVFPFIFNGKSYEECIIESRAKLWCSTTADYDRDHEWGFCRHSNSYRTSSIIFKCDEDEDIGRPQVFSEVRGCDVTFEWKTKVVCPPKKLECKFVQKHKTYDLRLLSSLTGSWSLVHNGVSYYINLCQKIYKGPLGCSERASICRRTTTGDVQVLGLVHTQKLGVIGDKVVVTYSKGYPCGGNKTASSVIELTCTKTVGRPAFKRFDIDSCTYYFSWDSRAACAVKPQEVQMVNGTITNPINGKSFSLGDIYFKLFRASGDMRTNGDNYLYEIQLSSITSSRNPACSGANICQVKPNDQHFSRKVGTSDKTKYYLQDGDLDVVFASSSKCGKDKTKSVSSTIFFHCDPLVEDGIPEFSHETADCQYLFSWYTSAVCPLGVGFDSENPGDDGQMHKGLSERSQAVGAVLSLLLVALTCCLLALLLYKKERRETVISKLTTCCRRSSNVSYKYSKVNKEEETDENETEWLMEEIQLPPPRQGKEGQENGHITTKSVKALSSLHGDDQDSEDEVLTIPEVKVHSGRGAGAESSHPVRNAQSNALQEREDDRVGLVRGEKARKGKSSSAQQKTVSSTKLVSFHDDSDEDLLHI

SEQ ID NO: 909837 - protein, 1149 aa, Homo sapiens
FGQTRISVGKANKRLRYVDQVLQLVYKDGSPCPSKSGLSYKSVISFVCRPERAQPIGPCSSPWTSRHALSSSPGTEPCPPEAAACLLGGSKPVNLGRVRDGPQWRDGIIVLKYVDGDLCPDGIRKKSTTIRFTCSESQVNSRPMFISAVEDCEYTFAWPTATACPMKSNEHDDCQVTNPSTGHLFDLSSLSGRAGFTAAYSEKGLVYMSICGENENCPPGVGACFGQTRISVGKANKRLRYVDQVLQLVYKDGSPCPSKSGLSYKSVISFVCRPEAGPTNRPMLISLDKQTCTLFFSWHTPLACEQATECSVRNGSSIVDLSPLIHRTGGYEAYDESEDDASDTNPDFYINICQPLNPMHGVPCPAGAAVCKVPIDGPPIDIGRVAGPPILNPIANEIYLNFESSTPCLADKHFNYTSLIAFHCKRGVSMGTPKLLRTSECDFVFEWETPVVCPDEVRMDGCTLTDEQLLYSFNLSSLSTSTFKVTRDSRTYSVGVCTFAVGPEQGGCKDGGVCLLSGTKGASFGRLQSMKLDYRHQDEAVVLSYVNGDRCPPETDDGVPCVFPFIFNGKSYEECIIESRAKLWCSTTADYDRDHEWGFCRHSNSYRTSSIIFKCDEDEDIGRPQVFSEVRGCDVTFEWKTKVVCPPKKLECKFVQKHKTYDLRLLSSLTGSWSLVHNGVSYYINLCQKIYKGPLGCSERASICRRTTTGDVQVLGLVHTQKLGVIGDKVVVTYSKGYPCGGNKTASSVIELTCTKTVGRPAFKRFDIDSCTYYFSWDSRAACAVKPQEVQMVNGTITNPINGKSFSLGDIYFKLFRASGDMRTNGDNYLYEIQLSSITSSRNPACSGANICQVKPNDQHFSRKVGTSDKTKYYLQDGDLDVVFASSSKCGKDKTKSVSSTIFFHCDPLVEDGIPEFSHETADCQYLFSWYTSAVCPLGVGFDSENPGDDGQMHKGLSERSQAVGAVLSLLLVALTCCLLALLLYKKERRETVISKLTTCCRRSSNVSYKYSKVNKEEETDENETEWLMEEIQLPPPRQGKEGQENGHITTKSVKALSSLHGDDQDSEDEVLTIPEVKVHSGRGAGAESSHPVRNAQSNALQEREDDRVGLVRGEKARKGKSSSAQQKTVSSTKLVSFHDDSDEDLLHI

SEQ ID NO: 909838 - protein, 2540 aa, Homo sapiens; identical to SEQ ID NO: 909836

SEQ ID NO: 909839 - protein, 2124 aa, Homo sapiens
EPSRAALTSGSRSVSTSAFALAARPRPGRGPQQSRAVSLAPAAQSGPGAMGAAAGRSPHLGPAPARRPQRSLLLLQLLLLVAAPGSTQAQAAPFPELCSYTWEAVDTKNNVLYKINICGSVDIVQCGPSSAVCMHDLKTRTYHSVGDSVLRSATRSLLEFNTTVSCDQQGTNHRVQSSIAFLCGKTLGTPEFVTATECVHYFEWRTTAACKKDIFKANKEVPCYVFDEELRKHDLNPLIKLSGAYLVDDSDPDTSLFINVCRDIDTLRDPGSQLRACPPGTAACLVRGHQAFDVGQPRDGLKLVRKDRLVLSYVREEAGKLDFCDGHSPAVTITFVCPSERREGTIPKLTAKSNCRYEIEWITEYACHRDYLESKTCSLSGEQQDVSIDLTPLAQSGGSSYISDGKEYLFYLNVCGETEIQFCNKKQAAVCQVKKSDTSQVKAAGRYHNQTLRYSDGDLTLIYFGGDECSSGFQRMSVINFECNKTAGNDGKGTPVFTGEVDCTYFFTWDTEYACVKEKEDLLCGATDGKKRYDLSALVRHAEPEQNWEAVDGSQTETEKKHFFINICHRVLQEGKARGCPEDAAVCAVDKNGSKNLGKFISSPMKEKGNIQLSYSDGDDCGHGKKIKTNITLVCKPGDLESAPVLRTSGEGGCFYEFEWHTAAACVLSKTEGENCTVFDSQAGFSFDLSPLTKKNGAYKVETKKYDFYINVCGPVSVSPCQPDSGACQVAKSDEKTWNLGLSNAKLSYYDGMIQLNYRGGTPYNNERHTPRATLITFLCDRDAGVGFPEYQEEDNSTYNFRWYTSYACPEEPLECVVTDPSTLEQYDLSSLAKSEGGLGGNWYAMDNSGEHVTWRKYYINVCRPLNPVPGCNRYASACQMKYEKDQGSFTEVVSISNLGMAKTGPVVEDSGSLLLEYVNGSACTTSDGRQTTYTTRIHLVCSRGRLNSHPIFSLNWECVVSFLWNTEAACPIQTTTDTDQACSIRDPNSGFVFNLNPLNSSQGYNVSGIGKIFMFNVCGTMPVCGTILGKPASGCEAETQTEELKNWKPARPVGIEKSLQLSTEGFITLTYKGPLSAKGTADAFIVRFVCNDDVYSGPLKFLHQDIDSGQGIRNTYFEFETALACVPSPVDCQVTDLAGNEYDLTGLSTVRKPWTAVDTSVDGRKRTFYLSVCNPLPYIPGCQGSAVGSCLVSEGNSWNLGVVQMSPQAAANGSLSIMYVNGDKCGNQRFSTRITFECAQISGSPAFQLQDGCEYVFIWRTVEACPVVRVEGDNCEVKDPRHGNLYDLKPLGLNDTIVSAGEYTYYFRVCGKLSSDVCPTSDKSKVVSSCQEKREPQGFHKVAGLLTQKLTYENGLLKMNFTGGDTCHKVYQRSTAIFFYCDRGTQRPVFLKETSDCSYLFEWRTQYACPPFDLTECSFKDGAGNSFDLSSLSRYSDNWEAITGTGDPEHYLINVCKSLAPQAGTEPCPPEAAACLLGGSKPVNLGRVRDGPQWRDGIIVLKYVDGDLCPDGIRKKSTTIRFTCSESQVNSRPMFISAVEDCEYTFAWPTATACPMKSNEHDDCQVTNPSTGHLFDLSSLSGRAGFTAAYSEKGLVYMSICGENENCPPGVGACFGQTRISVGKANKRLRYVDQVLQLVYKDGSPCPSKSGLSYKSVISFVCRPEAGPTNRPMLISLDKQTCTLFFSWHTPLACEQATECSVRNGSSIVDLSPLIHRTGGYEAYDESEDDASDTNPDFYINICQPLNPMHGVPCPAGAAVCKVPIDGPPIDIGRVAGPPILNPIANEIYLNFESSTPCLADKHFNYTSLIAFHCKRGVSMGTPKLLRTSECDFVFEWETPVVCPDEVRMDGCTLTDEQLLYSFNLSSLSTSTFKVTRDSRTYSVGVCTFAVGPEQGGCKDGGVCLLSGTKGASFGRLQSMKLDYRHQDEAVVLSYVNGDRCPPETDDGVPCVFPFIFNGKSYEECIIESRAKLWCSTTADYDRDHEWGFCRHSNSYRTSSIIFKCDEDEDIGRPQVFSEVRGCDVTFEWKTKVVCPPKKLECKFVQKHKTYDLRLLSSLTGSWSWCPSMTTATRTSYTSDSAVPAGEHGAAGQPSTSNQIRLPLDDASIILPLTETFKREEFL

SEQ ID NO: 909840 - protein, 2278 aa, Homo sapiens
EPSRAALTSGSRSVSTSAFALAARPRPGRGPQQSRAVSLAPAAQSGPGAMGAAAGRSPHLGPAPARRPQRSLLLLQLLLLVAAPGSTQAQAAPFPELCSYTWEAVDTKNNVLYKINICGSVDIVQCGPSSAVCMHDLKTRTYHSVGDSVLRSATRSLLEFNTTVSCDQQGTNHRVQSSIAFLCGKTLGTPEFVTATECVHYFEWRTTAACKKDIFKANKEVPCYVFDEELRKHDLNPLIKLSGAYLVDDSDPDTSLFINVCRDIDTLRDPGSQLRACPPGTAACLVRGHQAFDVGQPRDGLKLVRKDRLVLSYVREEAGKLDFCDGHSPAVTITFVCPSERREGTIPKLTAKSNCRYEIEWITEYACHRDYLESKTCSLSGEQQDVSIDLTPLAQSGGSSYISDGKEYLFYLNVCGETEIQFCNKKQAAVCQVKKSDTSQVKAAGRYHNQTLRYSDGDLTLIYFGGDECSSGFQRMSVINFECNKTAGNDGKGTPVFTGEVDCTYFFTWDTEYACVKEKEDLLCGATDGKKRYDLSALVRHAEPEQNWEAVDGSQTETEKKHFFINICHRVLQEGKARGCPEDAAVCAVDKNGSKNLGKFISSPMKEKGNIQLSYSDGDDCGHGKKIKTNITLVCKPGDLESAPVLRTSGEGGCFYEFEWHTAAACVLSKTEGENCTVFDSQAGFSFDLSPLTKKNGAYKVETKKYDFYINVCGPVSVSPCQPDSGACQVAKSDEKTWNLGLSNAKLSYYDGMIQLNYRGGTPYNNERHTPRATLITFLCDRDAGVGFPEYQEEDNSTYNFRWYTSYACPEEPLECVVTDPSTLEQYDLSSLAKSEGGLGGNWYAMDNSGEHVTWRKYYINVCRPLNPVPGCNRYASACQMKYEKDQGSFTEVVSISNLGMAKTGPVVEDSGSLLLEYVNGSACTTSDGRQTTYTTRIHLVCSRGRLNSHPIFSLNWECVVSFLWNTEAACPIQTTTDTDQACSIRDPNSGFVFNLNPLNSSQGYNVSGIGKIFMFNVCGTMPVCGTILGKPASGCEAETQTEELKNWKPARPVGIEKSLQLSTEGFITLTYKGPLSAKGTADAFIVRFVCNDDVYSGPLKFLHQDIDSGQGIRNTYFEFETALACVPSPVDCQVTDLAGNEYDLTGLSTVRKPWTAVDTSVDGRKRTFYLSVCNPLPYIPGCQGSAVGSCLVSEGNSWNLGVVQMSPQAAANGSLSIMYVNGDKCGNQRFSTRITFECAQISGSPAFQLQDGCEYVFIWRTVEACPVVRVEGDNCEVKDPRHGNLYDLKPLGLNDTIVSAGEYTYYFRVCGKLSSDVCPTSDKSKVVSSCQEKREPQGFHKVAGLLTQKLTYENGLLKMNFTGGDTCHKVYQRSTAIFFYCDRGTQRPVFLKETSDCSYLFEWRTQYACPPFDLTECSFKDGAGNSFDLSSLSRYSDNWEAITGTGDPEHYLINVCKSLAPQAGTEPCPPEAAACLLGGSKPVNLGRVRDGPQWRDGIIVLKYVDGDLCPDGIRKKSTTIRFTCSESQVNSRPMFISAVEDCEYTFAWPTATACPMKSNEHDDCQVTNPSTGHLFDLSSLSGRAGFTAAYSEKGLVYMSICGENENCPPGVGACFGQTRISVGKANKRLRYVDQVLQLVYKDGSPCPSKSGLSYKSVISFVCRPEAGPTNRPMLISLDKQTCTLFFSWHTPLACEQATECSVRNGSSIVDLSPLIHRTGGYEAYDESEDDASDTNPDFYINICQPLNPMHGVPCPAGAAVCKVPIDGPPIDIGRVAGPPILNPIANEIYLNFESSTPCLADKHFNYTSLIAFHCKRGVSMGTPKLLRTSECDFVFEWETPVVCPDEVRMDGCTLTDEQLLYSFNLSSLSTSTFKVTRDSRTYSVGVCTFAVGPEQGGCKDGGVCLLSGTKGASFGRLQSMKLDYRHQDEAVVLSYVNGDRCPPETDDGVPCVFPFIFNGKSYEECIIESRAKLWCSTTADYDRDHEWGFCRHSNSYRTSSIIFKCDEDEDIGRPQVFSEVRGCDVTFEWKTKVVCPPKKLECKFVQKHKTYDLRLLSSLTGSWSLVHNGVSYYINLCQKIYKGPLGCSERASICRRTTTGDVQVLGLVHTQKLGVIGDKVVVTYSKGYPCGGNKTASSVIELTCTKTVGRPAFKRFDIDSCTYYFSWDSRAACAVKPQEVQMVNGTITNPINGKSFSLGDIYFKLFRASGDMRTNGDNYLYEIQLSSITSSRNPACSGANICQVKPNDQHFSRKVGTSDKTKYYLQGNPWLPTKFHI

SEQ ID NO: 909841 - protein, 2072 aa, Homo sapiens
EPSRAALTSGSRSVSTSAFALAARPRPGRGPQQSRAVSLAPAAQSGPGAMGAAAGRSPHLGPAPARRPQRSLLLLQLLLLVAAPGSTQAQAAPFPELCSYTWEAVDTKNNVLYKINICGSVDIVQCGPSSAVCMHDLKTRTYHSVGDSVLRSATRSLLEFNTTVSCDQQGTNHRVQSSIAFLCGKTLGTPEFVTATECVHYFEWRTTAACKKDIFKANKEVPCYVFDEELRKHDLNPLIKLSGAYLVDDSDPDTSLFINVCRDIDTLRDPGSQLRACPPGTAACLVRGHQAFDVGQPRDGLKLVRKDRLVLSYVREEAGKLDFCDGHSPAVTITFVCPSERREGTIPKLTAKSNCRYEIEWITEYACHRDYLESKTCSLSGEQQDVSIDLTPLAQSGGSSYISDGKEYLFYLNVCGETEIQFCNKKQAAVCQVKKSDTSQVKAAGRYHNQTLRYSDGDLTLIYFGGDECSSGFQRMSVINFECNKTAGNDGKGTPVFTGEVDCTYFFTWDTEYACVKEKEDLLCGATDGKKRYDLSALVRHAEPEQNWEAVDGSQTETEKKHFFINICHRVLQEGKARGCPEDAAVCAVDKNGSKNLGKFISSPMKEKGNIQLSYSDGDDCGHGKKIKTNITLVCKPGDLESAPVLRTSGEGGCFYEFEWHTAAACVLSKTEGENCTVFDSQAGFSFDLSPLTKKNGAYKVETKKYDFYINVCGPVSVSPCQPDSGACQVAKSDEKTWNLGLSNAKLSYYDGMIQLNYRGGTPYNNERHTPRATLITFLCDRDAGVGFPEYQEEDNSTYNFRWYTSYACPEEPLECVVTDPSTLEQYDLSSLAKSEGGLGGNWYAMDNSGEHVTWRKYYINVCRPLNPVPGCNRYASACQMKYEKDQGSFTEVVSISNLGMAKTGPVVEDSGSLLLEYVNGSACTTSDGRQTTYTTRIHLVCSRGRLNSHPIFSLNWECVVSFLWNTEAACPIQTTTDTDQACSIRDPNSGFVFNLNPLNSSQGYNVSGIGKIFMFNVCGTMPVCGTILGKPASGCEAETQTEELKNWKPARPVGIEKSLQLSTEGFITLTYKGPLSAKGTADAFIVRFVCNDDVYSGPLKFLHQDIDSGQGIRNTYFEFETALACVPSPVDCQVTDLAGNEYDLTGLSTVRKPWTAVDTSVDGRKRTFYLSVCNPLPYIPGCQGSAVGSCLVSEGNSWNLGVVQMSPQAAANGSLSIMYVNGDKCGNQRFSTRITFECAQISGSPAFQLQDGCEYVFIWRTVEACPVVRVEGDNCEVKDPRHGNLYDLKPLGLNDTIVSAGEYTYYFRVCGKLSSDVCPTSDKSKVVSSCQEKREPQGFHKVAGLLTQKLTYENGLLKMNFTGGDTCHKVYQRSTAIFFYCDRGTQRPVFLKETSDCSYLFEWRTQYACPPFDLTECSFKDGAGNSFDLSSLSRYSDNWEAITGTGDPEHYLINVCKSLAPQAGTEPCPPEAAACLLGGSKPVNLGRVRDGPQWRDGIIVLKYVDGDLCPDGIRKKSTTIRFTCSESQVNSRPMFISAVEDCEYTFAWPTATACPMKSNEHDDCQVTNPSTGHLFDLSSLSGRAGFTAAYSEKGLVYMSICGENENCPPGVGACFGQTRISVGKANKRLRYVDQVLQLVYKDGSPCPSKSGLSYKSVISFVCRPEAGPTNRPMLISLDKQTCTLFFSWHTPLACEQATECSVRNGSSIVDLSPLIHRTGGYEAYDESEDDASDTNPDFYINICQPLNPMHGVPCPAGAAVCKVPIDGPPIDIGRVAGPPILNPIANEIYLNFESSTPCLADKHFNYTSLIAFHCKRGVSMGTPKLLRTSECDFVFEWETPVVCPDEVRMDGCTLTDEQLLYSFNLSSLSTSTFKVTRDSRTYSVGVCTFAVGPEQGGCKDGGVCLLSGTKGASFGRLQSMKLDYRHQDEAVVLSYVNGDRCPPETDDGVPCVFPFIFNGKSYEECIIESRAKLWCSTTADYDRDHEWGFCRHSNSYRTSSIIFKCDEDEDIGRPQVFSEVRGCDVTFEWKTKVVCPPKKLECKFVQKHKTYDLRLLSSLTGSWSLVHNGVS

SEQ ID NO: 909842 - protein, 1803 aa, Homo sapiens
EPSRAALTSGSRSVSTSAFALAARPRPGRGPQQSRAVSLAPAAQSGPGAMGAAAGRSPHLGPAPARRPQRSLLLLQLLLLVAAPGSTQAQAAPFPELCSYTWEAVDTKNNVLYKINICGSVDIVQCGPSSAVCMHDLKTRTYHSVGDSVLRSATRSLLEFNTTVSCDQQGTNHRVQSSIAFLCGKTLGTPEFVTATECVHYFEWRTTAACKKDIFKANKEVPCYVFDEELRKHDLNPLIKLSGAYLVDDSDPDTSLFINVCRDIDTLRDPGSQLRACPPGTAACLVRGHQAFDVGQPRDGLKLVRKDRLVLSYVREEAGKLDFCDGHSPAVTITFVCPSERREGTIPKLTAKSNCRYEIEWITEYACHRDYLESKTCSLSGEQQDVSIDLTPLAQSGGSSYISDGKEYLFYLNVCGETEIQFCNKKQAAVCQVKKSDTSQVKAAGRYHNQTLRYSDGDLTLIYFGGDECSSGFQRMSVINFECNKTAGNDGKGTPVFTGEVDCTYFFTWDTEYACVKEKEDLLCGATDGKKRYDLSALVRHAEPEQNWEAVDGSQTETEKKHFFINICHRVLQEGKARGCPEDAAVCAVDKNGSKNLGKFISSPMKEKGNIQLSYSDGDDCGHGKKIKTNITLVCKPGDLESAPVLRTSGEGGCFYEFEWHTAAACVLSKTEGENCTVFDSQAGFSFDLSPLTKKNGAYKVETKKYDFYINVCGPVSVSPCQPDSGACQVAKSDEKTWNLGLSNAKLSYYDGMIQLNYRGGTPYNNERHTPRATLITFLCDRDAGVGFPEYQEEDNSTYNFRWYTSYACPEEPLECVVTDPSTLEQYDLSSLAKSEGGLGGNWYAMDNSGEHVTWRKYYINVCRPLNPVPGCNRYASACQMKYEKDQGSFTEVVSISNLGMAKTGPVVEDSGSLLLEYVNGSACTTSDGRQTTYTTRIHLVCSRGRLNSHPIFSLNWECVVSFLWNTEAACPIQTTTDTDQACSIRDPNSGFVFNLNPLNSSQGYNVSGIGKIFMFNVCGTMPVCGTILGKPASGCEAETQTEELKNWKPARPVGIEKSLQLSTEGFITLTYKGPLSAKGTADAFIVRFVCNDDVYSGPLKFLHQDIDSGQGIRNTYFEFETALACVPSPVDCQVTDLAGNEYDLTGLSTVRKPWTAVDTSVDGRKRTFYLSVCNPLPYIPGCQGSAVGSCLVSEGNSWNLGVVQMSPQAAANGSLSIMYVNGDKCGNQRFSTRITFECAQISGSPAFQLQDGCEYVFIWRTVEACPVVRVEGDNCEVKDPRHGNLYDLKPLGLNDTIVSAGEYTYYFRVCGKLSSDVCPTSDKSKVVSSCQEKREPQGFHKVAGLLTQKLTYENGLLKMNFTGGDTCHKVYQRSTAIFFYCDRGTQRPVFLKETSDCSYLFEWRTQYACPPFDLTECSFKDGAGNSFDLSSLSRYSDNWEAITGTGDPEHYLINVCKSLAPQAGTEPCPPEAAACLLGGSKPVNLGRVRDGPQWRDGIIVLKYVDGDLCPDGIRKKSTTIRFTCSESQVNSRPMFISAVEDCEYTFAWPTATACPMKSNEHDDCQVTNPSTGHLFDLSSLSGRAGFTAAYSEKGLVYMSICGENENCPPGVGACFGQTRISVGKANKRLRYVDQVLQLVYKDGSPCPSKSGLSYKSVISFVCRPEAGPTNRPMLISLDKQTCTLFFSWHTPLACEQATECSVRNGSSIVDLSPLIHRTGGYEAYDESEDDASDTNPDFYINICQPLNPMHGVPCPAGAAVCKVPIDGPPIVSMTNPRVEIIFARLLVITFALFLAFSGELLK

SEQ ID NO: 909843 - protein, 827 aa, Homo sapiens
EPSRAALTSGSRSVSTSAFALAARPRPGRGPQQSRAVSLAPAAQSGPGAMGAAAGRSPHLGPAPARRPQRSLLLLQLLLLVAAPGSTQAQAAPFPELCSYTWEAVDTKNNVLYKINICGSVDIVQCGPSSAVCMHDLKTRTYHSVGDSVLRSATRSLLEFNTTVSCDQQGTNHRVQSSIAFLCGKTLGTPEFVTATECVHYFEWRTTAACKKDIFKANKEVPCYVFDEELRKHDLNPLIKLSGAYLVDDSDPDTSLFINVCRDIDTLRDPGSQLRACPPGTAACLVRGHQAFDVGQPRDGLKLVRKDRLVLSYVREEAGKLDFCDGHSPAVTITFVCPSERREGTIPKLTAKSNCRYEIEWITEYACHRDYLESKTCSLSGEQQDVSIDLTPLAQSGGSSYISDGKEYLFYLNVCGETEIQFCNKKQAAVCQVKKSDTSQVKAAGRYHNQTLRYSDGDLTLIYFGGDECSSGFQRMSVINFECNKTAGNDGKGTPVFTGEVDCTYFFTWDTEYACVKEKEDLLCGATDGKKRYDLSALVRHAEPEQNWEAVDGSQTETEKKHFFINICHRVLQEGKARGCPEDAAVCAVDKNGSKNLGKFISSPMKEKGNIQLSYSDGDDCGHGKKIKTNITLVCKPGDLESAPVLRTSGEGGCFYEFEWHTAAACVLSKTEGENCTVFDSQAGFSFDLSPLTKKNGAYKVETKKYDFYINVCGPVSVSPCQPDSGACQVAKSDEKTWNLGLSNAKLSYYDGMIQLNYRGGTPYNNERHTPRATLITFLCDRDAGVGFPEYQEEDNSTYNFRWYTSYACPEEPLECVVTDPSQPYSG

SEQ ID NO: 909844 - protein, 255 aa, Homo sapiens
FGQTRISVGKANKRLRYVDQVLQLVYKDGSPCPSKSGLSYKSVISFVCRPERAQPIGPCSSPWTSRHALSSSPGTEPCPPEAAACLLGGSKPVNLGRVRDGPQWRDGIIVLKYVDGDLCPDGIRKKSTTIRFTCSESQVNSRPMFISAVEDCEYTFAWPTATACPMKSNEHDDCQVTNPSTGHLFDLSSLSGRAGFTAAYSEKGLVYMSICGEEGGQAGMAWRRREAGRSQHGGGGRRCWCSYSGGSAFPAMFSE

SEQ ID NO: 909845 - protein, 2540 aa, Homo sapiens; identical to SEQ ID NO: 909836

SEQ ID NO: 909846 - protein, 2540 aa, Homo sapiens; identical to SEQ ID NO: 909836

SEQ ID NO: 909847 - protein, 2453 aa, Homo sapiens
EPSRAALTSGSRSVSTSAFALAARPRPGRGPQQSRAVSLAPAAQSGPGAMGAAAGRSPHLGPAPARRPQRSLLLLQLLLLVAAPGSTQAQAAPFPELCSYTWEAVDTKNNVLYKINICGSVDIVQCGPSSAVCMHDLKTRTYHSVGDSVLRSATRSLLEFNTTVSCDQQGTNHRVQSSIAFLCGKTLGTPEFVTATECVHYFEWRTTAACKKDIFKANKEVPCYVFDEELRKHDLNPLIKLSGAYLVDDSDPDTSLFINVCRDIDTLRDPGSQLRACPPGTAACLVRGHQAFDVGQPRDGLKLVRKDRLVLSYVREEAGKLDFCDGHSPAVTITFVCPSERREGTIPKLTAKSNCRYEIEWITEYACHRDYLESKTCSLSGEQQDVSIDLTPLAQSGGSSYISDGKEYLFYLNVCGETEIQFCNKKQAAVCQVKKSDTSQVKAAGRYHNQTLRYSDGDLTLIYFGGDECSSGFQRMSVINFECNKTAGNDGKGTPVFTGEVDCTYFFTWDTEYACVKEKEDLLCGATDGKKRYDLSALVRHAEPEQNWEAVDGSQTETEKKHFFINICHRVLQEGKARGCPEDAAVCAVDKNGSKNLGKFISSPMKEKGNIQLSYSDGDDCGHGKKIKTNITLVCKPGDLESAPVLRTSGEGGCFYEFEWHTAAACVLSKTEGENCTVFDSQAGFSFDLSPLTKKNGAYKVETKKYDFYINVCGPVSVSPCQPDSGACQVAKSDEKTWNLGLSNAKLSYYDGMIQLNYRGGTPYNNERHTPRATLITFLCDRDAGVGFPEYQEEDNSTYNFRWYTSYACPEEPLECVVTDPSTLEQYDLSSLAKSEGGLGGNWYAMDNSGEHVTWRKYYINVCRPLNPVPGCNRYASACQMKYEKDQGSFTEVVSISNLGMAKTGPVVEDSGSLLLEYVNGSACTTSDGRQTTYTTRIHLVCSRGRLNSHPIFSLNWECVVSFLWNTEAACPIQTTTDTDQACSIRDPNSGFVFNLNPLNSSQGYNVSGIGKIFMFNVCGTMPVCGTILGKPASGCEAETQTEELKNWKPARPVGIEKSLQLSTEGFITLTYKGPLSAKGTADAFIVRFVCNDDVYSGPLKFLHQDIDSGQGIRNTYFEFETALACVPSPVDCQVTDLAGNEYDLTGLSTVRKPWTAVDTSVDGRKRTFYLSVCNPLPYIPGCQGSAVGSCLVSEGNSWNLGVVQMSPQAAANGSLSIMYVNGDKCGNQRFSTRITFECAQISGSPAFQLQDGCEYVFIWRTVEACPVVRVEGDNCEVKDPRHGNLYDLKPLGLNDTIVSAGEYTYYFRVCGKLSSDVCPTSDKSKVVSSCQEKREPQGFHKVAGLLTQKLTYENGLLKMNFTGGDTCHKVYQRSTAIFFYCDRGTQRPVFLKETSDCSYLFEWRTQYACPPFDLTECSFKDGAGNSFDLSSLSRYSDNWEAITGTGDPEHYLINVCKSLAPQAGTEPCPPEAAACLLGGSKPVNLGRVRDGPQWRDGIIVLKYVDGDLCPDGIRKKSTTIRFTCSESQVNSRPMFISAVEDCEYTFAWPTATACPMKSNEHDDCQVTNPSTGHLFDLSSLSGRAGFTAAYSEKGLVYMSICGENENCPPGVGACFGQTRISVGKANKRLRYVDQVLQLVYKDGSPCPSKSGLSYKSVISFVCRPEAGPTNRPMLISLDKQTCTLFFSWHTPLACEQATECSVRNGSSIVDLSPLIHRTGGYEAYDESEDDASDTNPDFYINICQPLNPMHGVPCPAGAAVCKVPIDGPPIDIGRVAGPPILNPIANEIYLNFESSTPCLADKHFNYTSLIAFHCKRGVSMGTPKLLRTSECDFVFEWETPVVCPDEVRMDGCTLTDEQLLYSFNLSSLSTSTFKVTRDSRTYSVGVCTFAVGPEQGGCKDGGVCLLSGTKGASFGRLQSMKLDYRHQDEAVVLSYVNGDRCPPETDDGVPCVFPFIFNGKSYEECIIESRAKLWCSTTADYDRDHEWGFCRHSNSYRTSSIIFKCDEDEDIGRPQVFSEVRGCDVTFEWKTKVVCPPKKLECKFVQKHKTYDLRLLSSLTGSWSLVHNGVSYYINLCQKIYKGPLGCSERASICRRTTTGDVQVLGLVHTQKLGVIGDKVVVTYSKGYPCGGNKTASSVIELTCTKTVGRPAFKRFDIDSCTYYFSWDSRAACAVKPQEVQMVNGTITNPINGKSFSLGDIYFKLFRASGDMRTNGDNYLYEIQLSSITSSRNPACSGANICQVKPNDQHFSRKVGTSDKTKYYLQDGDLDVVFASSSKCGKDKTKSVSSTIFFHCDPLVEDGIPEFSHETADCQYLFSWYTSAVCPLGVGFDSENPGDDGQMHKGLSERSQAVGAVLSLLLVALTCCLLALLLYKKERRETVISKLTTCCRRSSNVSYKYSKVNKEEETDENETEWLMEEREAGRSQHGGGGRRCWCSYSGGSAFPAMFSE

SEQ ID NO: 909848 - protein, 1646 aa, Homo sapiens
EPSRAALTSGSRSVSTSAFALAARPRPGRGPQQSRAVSLAPAAQSGPGAMGAAAGRSPHLGPAPARRPQRSLLLLQLLLLVAAPGSTQAQAAPFPELCSYTWEAVDTKNNVLYKINICGSVDIVQCGPSSAVCMHDLKTRTYHSVGDSVLRSATRSLLEFNTTVSCDQQGTNHRVQSSIAFLCGKTLGTPEFVTATECVHYFEWRTTAACKKDIFKANKEVPCYVFDEELRKHDLNPLIKLSGAYLVDDSDPDTSLFINVCRDIDTLRDPGSQLRACPPGTAACLVRGHQAFDVGQPRDGLKLVRKDRLVLSYVREEAGKLDFCDGHSPAVTITFVCPSERREGTIPKLTAKSNCRYEIEWITEYACHRDYLESKTCSLSGEQQDVSIDLTPLAQSGGSSYISDGKEYLFYLNVCGETEIQFCNKKQAAVCQVKKSDTSQVKAAGRYHNQTLRYSDGDLTLIYFGGDECSSGFQRMSVINFECNKTAGNDGKGTPVFTGEVDCTYFFTWDTEYACVKEKEDLLCGATDGKKRYDLSALVRHAEPEQNWEAVDGSQTETEKKHFFINICHRVLQEGKARGCPEDAAVCAVDKNGSKNLGKFISSPMKEKGNIQLSYSDGDDCGHGKKIKTNITLVCKPGDLESAPVLRTSGEGGCFYEFEWHTAAACVLSKTEGENCTVFDSQAGFSFDLSPLTKKNGAYKVETKKYDFYINVCGPVSVSPCQPDSGACQVAKSDEKTWNLGLSNAKLSYYDGMIQLNYRGGTPYNNERHTPRATLITFLCDRDAGVGFPEYQEEDNSTYNFRWYTSYACPEEPLECVVTDPSTLEQYDLSSLAKSEGGLGGNWYAMDNSGEHVTWRKYYINVCRPLNPVPGCNRYASACQMKYEKDQGSFTEVVSISNLGMAKTGPVVEDSGSLLLEYVNGSACTTSDGRQTTYTTRIHLVCSRGRLNSHPIFSLNWECVVSFLWNTEAACPIQTTTDTDQACSIRDPNSGFVFNLNPLNSSQGYNVSGIGKIFMFNVCGTMPVCGTILGKPASGCEAETQTEELKNWKPARPVGIEKSLQLSTEGFITLTYKGPLSAKGTADAFIVRFVCNDDVYSGPLKFLHQDIDSGQGIRNTYFEFETALACVPSPVDCQVTDLAGNEYDLTGLSTVRKPWTAVDTSVDGRKRTFYLSVCNPLPYIPGCQGSAVGSCLVSEGNSWNLGVVQMSPQAAANGSLSIMYVNGDKCGNQRFSTRITFECAQISGSPAFQLQDGCEYVFIWRTVEACPVVRVEGDNCEVKDPRHGNLYDLKPLGLNDTIVSAGEYTYYFRVCGKLSSDVCPTSDKSKVVSSCQEKREPQGFHKVAGLLTQKLTYENGLLKMNFTGGDTCHKVYQRSTAIFFYCDRGTQRPVFLKETSDCSYLFEWRTQYACPPFDLTECSFKDGAGNSFDLSSLSRYSDNWEAITGTGDPEHYLINVCKSLAPQAGTEPCPPEAAACLLGGSKPVNLGRVRDGPQWRDGIIVLKYVDGDLCPDGIRKKSTTIRFTCSESQVNSRPMFISAVEDCEYTFAWPTATACPMKSNEHDDCQVTNPSTGHLFDLSSLSGRAGFTAAYSEKGLVYMSICGEEGGQAGMAWRRREAGRSQHGGGGRRCWCSYSGGSAFPAMFSE

SEQ ID NO: 909849 - protein, 1282 aa, Homo sapiens
EPSRAALTSGSRSVSTSAFALAARPRPGRGPQQSRAVSLAPAAQSGPGAMGAAAGRSPHLGPAPARRPQRSLLLLQLLLLVAAPGSTQAQAAPFPELCSYTWEAVDTKNNVLYKINICGSVDIVQCGPSSAVCMHDLKTRTYHSVGDSVLRSATRSLLEFNTTVSCDQQGTNHRVQSSIAFLCGKTLGTPEFVTATECVHYFEWRTTAACKKDIFKANKEVPCYVFDEELRKHDLNPLIKLSGAYLVDDSDPDTSLFINVCRDIDTLRDPGSQLRACPPGTAACLVRGHQAFDVGQPRDGLKLVRKDRLVLSYVREEAGKLDFCDGHSPAVTITFVCPSERREGTIPKLTAKSNCRYEIEWITEYACHRDYLESKTCSLSGEQQDVSIDLTPLAQSGGSSYISDGKEYLFYLNVCGETEIQFCNKKQAAVCQVKKSDTSQVKAAGRYHNQTLRYSDGDLTLIYFGGDECSSGFQRMSVINFECNKTAGNDGKGTPVFTGEVDCTYFFTWDTEYACVKEKEDLLCGATDGKKRYDLSALVRHAEPEQNWEAVDGSQTETEKKHFFINICHRVLQEGKARGCPEDAAVCAVDKNGSKNLGKFISSPMKEKGNIQLSYSDGDDCGHGKKIKTNITLVCKPGDLESAPVLRTSGEGGCFYEFEWHTAAACVLSKTEGENCTVFDSQAGFSFDLSPLTKKNGAYKVETKKYDFYINVCGPVSVSPCQPDSGACQVAKSDEKTWNLGLSNAKLSYYDGMIQLNYRGGTPYNNERHTPRATLITFLCDRDAGVGFPEYQEEDNSTYNFRWYTSYACPEEPLECVVTDPSTLEQYDLSSLAKSEGGLGGNWYAMDNSGEHVTWRKYYINVCRPLNPVPGCNRYASACQMKYEKDQGSFTEVVSISNLGMAKTGPVVEDSGSLLLEYVNGSACTTSDGRQTTYTTRIHLVCSRGRLNSHPIFSLNWECVVSFLWNTEAACPIQTTTDTDQACSIRDPNSGFVFNLNPLNSSQGYNVSGIGKIFMFNVCGTMPVCGTILGKPASGCEAETQTEELKNWKPARPVGIEKSLQLSTEGFITLTYKGPLSAKGTADAFIVRFVCNDDVYSGPLKFLHQDIDSGQGIRNTYFEFETALACVPSPVDCQVTDLAGNEYDLTGLSTVRKPWTAVDTSVDGRKRTFYLSVCNPLPYIPGCQGSAVGSCLVSEGNSWNLGVVQMSPQAAANGSLSIMYVNGDKCGNQRFSTRITFECAQISGSPAFQLQDGCEYVFIWRTVEACPVVRVEGRTGPVPTSH

SEQ ID NO: 909850 - protein, 32 aa, Homo sapiens
MFISAVEDCEYTFAWPTATACPMKSNEHDDCQ

SEQ ID NO: 909851 - protein, 889 aa, Homo sapiens
MSIVIPLGVDTAETSYLEMAAGSEPESVEASPVVVEKSNSYPHQLYTSSSHHSHSYIGLPYADHNYGARPPPTPPASPPPSVLISKNEVGIFTTPNFDETSSATTISTSEDGSYGTDVTRCICGFTHDDGYMICCDKCSVWQHIDCMGIDRQHIPDTYLCERCQPRNLDKERAVLLQRRKRENMSDGDTSATESGDEVPVELYTAFQHTPTSITLTASRVSKVNDKRRKKSGEKEQHISKCKKAFREGSRKSSRVKGSAPEIDPSSDGSNFGWETKIKAWMDRYEEANNNQYSEGVQREAQRIALRLGNGNDKKEMNKSDLNTNNLLFKPPVESHIQKNKKILKSAKDLPPDALIIEYRGKFMLREQFEANGYFFKRPYPFVLFYSKFHGLEMCVDARTFGNEARFIRRSCTPNAEVRHEIQDGTIHLYIYSIHSIPKGTEITIAFDFDYGNCKYKVDCACLKENPECPVLKRSSESMENINSGYETRRKKGKKDKDISKEKDTQNQNITLDCEGTTNKMKSPETKQRKLSPLRLSVSNNQEPDFIDDIEEKTPISNEVEMESEEQIAERKRKMTREERKMEAILQAFARLEKREKRREQALERISTAKTEVKTECKDTQIVSDAEVIQEQAKEENASKPTPAKVNRTKQRKSFSRSRTHIGQQRRRHRTVSMCSDIQPSSPDIEVTSQQNDIENTVLTIEPETETALAEIITETEVPALNKCPTKYPKTKKHLVNEWLSEKNEKTGKPSDGLSERPLRITTDPEVLATQLNSLPGLTYSPHVYSTPKHYIRFTSPFLSEKRRRKEPTENISGSCKKRWLKQALEEENSAILHRFNSPCQERSRSPAVNGENKSPLLLNDSCSLPDLTTPLKKRRFYQLLDSVYSETST

SEQ ID NO: 909852 - protein, 639 aa, Homo sapiens
MSIVIPLGVDTAETSYLEMAAGSEPESVEASPVVVEKSNSYPHQLYTSSSHHSHSYIGLPYADHNYGARPPPTPPASPPPSVLISKNEVGIFTTPNFDETSSATTISTSEDGSYGTDVTRCICGFTHDDGYMICCDKCSVWQHIDCMGIDRQHIPDTYLCERCQPRNLDKERAVLLQRRKRENMSDGDTSATESGDEVPVELYTAFQHTPTSITLTASRVSKVNDKRRKKSGEKEQHISKCKKAFREGSRKSSRVKGSAPEIDPSSDGSNFGWETKIKAWMDRYEEANNNQYSEGVQREAQRIALRLGNGNDKKEMNKSDLNTNNLLFKPPVESHIQKNKKILKSAKDLPPDALIIEYRGKFMLREQFEANGYFFKRPYPFVLFYSKFHGLEMCVDARTFGNEARFIRRSCTPNAEVRHEIQDGTIHLYIYSIHSIPKGTEITIAFDFDYGNCKYKVDCACLKENPECPVLKRSSESMENINSGYETRRKKGKKDKDISKEKDTQNQNITLDCEGTTNKMKSPETKQRKLSPLRLSVSNNQEPDFIDDIEEKTPISNEVEMESEEQIAERKRKMTREERKMEAILQAFARLEKREKRREQALERISTAKTEVKTECKDTQIVSDAEVIQVLFIQVVLFS

SEQ ID NO: 909853 - protein, 639 aa, Homo sapiens; identical to SEQ ID NO: 909852

SEQ ID NO: 909854 - protein, 889 aa, Homo sapiens; identical to SEQ ID NO: 909851

SEQ ID NO: 909855 - protein, 600 aa, Homo sapiens
MSIVIPLGVDTAETSYLEMAAGSEPESVEASPVVVEKSNSYPHQLYTSSSHHSHSYIGLPYADHNYGARPPPTPPASPPPSVLISKNEVGIFTTPNFDETSSATTISTSEDGSYGTDVTRCICGFTHDDGYMICCDKCSVWQHIDCMGIDRQHIPDTYLCERCQPRNLDKERAVLLQRRKRENMSDGDTSATESGDEVPVELYTAFQHTPTSITLTASRVSKVNDKRRKKSGEKEQHISKCKKAFREGSRKSSRVKGSAPEIDPSSDGSNFGWETKIKAWMDRYEEANNNQYSEGVQREAQRIALRLGNGNDKKEMNKSDLNTNNLLFKPPVESHIQKNKKILKSAKDLPPDALIIEYRGKFMLREQFEANGYFFKRPYPFVLFYSKFHGLEMCVDARTFGNEARFIRRSCTPNAEVRHEIQDGTIHLYIYSIHSIPKGTEITIAFDFDYGNCKYKVDCACLKENPECPVLKRSSESMENINSGYETRRKKGKKDKDISKEKDTQNQNITLDCEGTTNKMKSPETKQRKLSPLRLSVSNNQEPDFIDDIEEKTPISNEVEMESEEQIAERKRKMTREERKMEAILQAFAKLAQILGSNIF

SEQ ID NO: 909856 - protein, 872 aa, Homo sapiens
MQLFPPRPESVEASPVVVEKSNSYPHQLYTSSSHHSHSYIGLPYADHNYGARPPPTPPASPPPSVLISKNEVGIFTTPNFDETSSATTISTSEDGSYGTDVTRCICGFTHDDGYMICCDKCSVWQHIDCMGIDRQHIPDTYLCERCQPRNLDKERAVLLQRRKRENMSDGDTSATESGDEVPVELYTAFQHTPTSITLTASRVSKVNDKRRKKSGEKEQHISKCKKAFREGSRKSSRVKGSAPEIDPSSDGSNFGWETKIKAWMDRYEEANNNQYSEGVQREAQRIALRLGNGNDKKEMNKSDLNTNNLLFKPPVESHIQKNKKILKSAKDLPPDALIIEYRGKFMLREQFEANGYFFKRPYPFVLFYSKFHGLEMCVDARTFGNEARFIRRSCTPNAEVRHEIQDGTIHLYIYSIHSIPKGTEITIAFDFDYGNCKYKVDCACLKENPECPVLKRSSESMENINSGYETRRKKGKKDKDISKEKDTQNQNITLDCEGTTNKMKSPETKQRKLSPLRLSVSNNQEPDFIDDIEEKTPISNEVEMESEEQIAERKRKMTREERKMEAILQAFARLEKREKRREQALERISTAKTEVKTECKDTQIVSDAEVIQEQAKEENASKPTPAKVNRTKQRKSFSRSRTHIGQQRRRHRTVSMCSDIQPSSPDIEVTSQQNDIENTVLTIEPETETALAEIITETEVPALNKCPTKYPKTKKHLVNEWLSEKNEKTGKPSDGLSERPLRITTDPEVLATQLNSLPGLTYSPHVYSTPKHYIRFTSPFLSEKRRRKEPTENISGSCKKRWLKQALEEENSAILHRFNSPCQERSRSPAVNGENKSPLLLNDSCSLPDLTTPLKKRRFYQLLDSVYSETST

SEQ ID NO: 909857 - protein, 840 aa, Homo sapiens
PWLQLSTVHVVLADHNYGARPPPTPPASPPPSVLISKNEVGIFTTPNFDETSSATTISTSEDGSYGTDVTRCICGFTHDDGYMICCDKCSVWQHIDCMGIDRQHIPDTYLCERCQPRNLDKERAVLLQRRKRENMSDGDTSATESGDEVPVELYTAFQHTPTSITLTASRVSKVNDKRRKKSGEKEQHISKCKKAFREGSRKSSRVKGSAPEIDPSSDGSNFGWETKIKAWMDRYEEANNNQYSEGVQREAQRIALRLGNGNDKKEMNKSDLNTNNLLFKPPVESHIQKNKKILKSAKDLPPDALIIEYRGKFMLREQFEANGYFFKRPYPFVLFYSKFHGLEMCVDARTFGNEARFIRRSCTPNAEVRHEIQDGTIHLYIYSIHSIPKGTEITIAFDFDYGNCKYKVDCACLKENPECPVLKRSSESMENINSGYETRRKKGKKDKDISKEKDTQNQNITLDCEGTTNKMKSPETKQRKLSPLRLSVSNNQEPDFIDDIEEKTPISNEVEMESEEQIAERKRKMTREERKMEAILQAFARLEKREKRREQALERISTAKTEVKTECKDTQIVSDAEVIQEQAKEENASKPTPAKVNRTKQRKSFSRSRTHIGQQRRRHRTVSMCSDIQPSSPDIEVTSQQNDIENTVLTIEPETETALAEIITETEVPALNKCPTKYPKTKKHLVNEWLSEKNEKTGKPSDGLSERPLRITTDPEVLATQLNSLPGLTYSPHVYSTPKHYIRFTSPFLSEKRRRKEPTENISGSCKKRWLKQALEEENSAILHRFNSPCQERSRSPAVNGENKSPLLLNDSCSLPDLTTPLKKRRFYQLLDSVYSETST

SEQ ID NO: 909858 - protein, 231 aa, Homo sapiens
MSIVIPLGVDTAETSYLEMAAGSEPESVEASPVVVEKSNSYPHQLYTSSSHHSHSYIGLPYADHNYGARPPPTPPASPPPSVLISKNEVGIFTTPNFDETSSATTISTSEDGSYGTDVTRCICGFTHDDGYMICCDKCSVWQHIDCMGIDRQHIPDTYLCERCQPRNLDKERAVLLQRRKRENMSDGDTSATESGDEVPVELYTAFQHTPTSITLTASRVSKVNDKRSIKR

SEQ ID NO: 909859 - protein, 527 aa, Homo sapiens
MLREQFEANGYFFKRPYPFVLFYSKFHGLEMCVDARTFGNEARFIRRSCTPNAEVRHEIQDGTIHLYIYSIHSIPKGTEITIAFDFDYGNCKYKVDCACLKENPECPVLKRSSESMENINSGYETRRKKGKKDKDISKEKDTQNQNITLDCEGTTNKMKSPETKQRKLSPLRLSVSNNQEPDFIDDIEEKTPISNEVEMESEEQIAERKRKMTREERKMEAILQAFARLEKREKRREQALERISTAKTEVKTECKDTQIVSDAEVIQEQAKEENASKPTPAKVNRTKQRKSFSRSRTHIGQQRRRHRTVSMCSDIQPSSPDIEVTSQQNDIENTVLTIEPETETALAEIITETEVPALNKCPTKYPKTKKHLVNEWLSEKNEKTGKPSDGLSERPLRITTDPEVLATQLNSLPGLTYSPHVYSTPKHYIRFTSPFLSEKRRRKEPTENISGSCKKRWLKQALEEENSAILHRFNSPCQERSRSPAVNGENKSPLLLNDSCSLPDLTTPLKKRRFYQLLDSVYSETST

SEQ ID NO: 909860 - protein, 166 aa, Homo sapiens
MSIVIPLGVDTAETSYLEMAAGSEPESVEASPVVVEKSNSYPHQLYTSSSHHSHSYIGLPYADHNYGARPPPTPPASPPPSVLISKNEVGIFTTPNFDETSSATTISTSEDGSYGTDVTRCICGFTHDDGYMICCDKCSVWQHIDCMGIDRQHIPDTYLCERCQPR

SEQ ID NO: 909861 - protein, 412 aa, Homo sapiens
MENINSGYETRRKKGKKDKDISKEKDTQNQNITLDCEGTTNKMKSPETKQRKLSPLRLSVSNNQEPDFIDDIEEKTPISNEVEMESEEQIAERKRKMTREERKMEAILQAFARLEKREKRREQALERISTAKTEVKTECKDTQIVSDAEVIQEQAKEENASKPTPAKVNRTKQRKSFSRSRTHIGQQRRRHRTVSMCSDIQPSSPDIEVTSQQNDIENTVLTIEPETETALAEIITETEVPALNKCPTKYPKTKKHLVNEWLSEKNEKTGKPSDGLSERPLRITTDPEVLATQLNSLPGLTYSPHVYSTPKHYIRFTSPFLSEKRRRKEPTENISGSCKKRWLKQALEEENSAILHRFNSPCQERSRSPAVNGENKSPLLLNDSCSLPDLTTPLKKRRFYQLLDSVYSETST

SEQ ID NO: 909862 - protein, 69 aa, Homo sapiens
SGRAAPRRRRHFPRARGSDTERAQGAESETVPEFGSGNRVGIDTPSSLAVVSAFLLTAWLPPPLLLGSW

SEQ ID NO: 909863 - protein, 609 aa, Homo sapiens
MSIVIPLGVDTAETSYLEMAAGSEPESVEASPVVVEKSNSYPHQLYTSSSHHSHSYIGLPYADHNYGARPPPTPPASPPPSVLISKNEVGIFTTPNFDETSSATTISTSEDGSYGTDVTRCICGFTHDDGYMICCDKCSVWQHIDCMGIDRQHIPDTYLCERCQPRNLDKERAVLLQRRKRENMSDGDTSATESGDEVPVELYTAFQHTPTSITLTASRVSKVNDKRRKKSGEKEQHISKCKKAFREGSRKSSRVKGSAPEIDPSSDGSNFGWETKIKAWMDRYEEANNNQYSEGVQREAQRIALRLGNGNDKKEMNKSDLNTNNLLFKPPVESHIQKNKKILKSAKDLPPDALIIEYRGKFMLREQFEANGYFFKRPYPFVLFYSKFHGLEMCVDARTFGNEARFIRRSCTPNAEVRHEIQDGTIHLYIYSIHSIPKGTEITIAFDFDYGNCKYKVDCACLKENPECPVLKRSSESMENINSGYETRRKKGKKDKDISKEKDTQNQNITLDCEGTTNKMKSPETKQRKLSPLRLSVSNNQEPDFIDDIEEKTPISNEVEMESEEQIAERKRKMVSWEASSLGLVTAALHMVIVAAFTWAFTLFFEVSE

SEQ ID NO: 909864 - protein, 603 aa, Homo sapiens
MSIVIPLGVDTAETSYLEMAAGSEPESVEASPVVVEKSNSYPHQLYTSSSHHSHSYIGLPYADHNYGARPPPTPPASPPPSVLISKNEVGIFTTPNFDETSSATTISTSEDGSYGTDVTRCICGFTHDDGYMICCDKCSVWQHIDCMGIDRQHIPDTYLCERCQPRNLDKERAVLLQRRKRENMSDGDTSATESGDEVPVELYTAFQHTPTSITLTASRVSKVNDKRRKKSGEKEQHISKCKKAFREGSRKSSRVKGSAPEIDPSSDGSNFGWETKIKAWMDRYEEANNNQYSEGVQREAQRIALRLGNGNDKKEMNKSDLNTNNLLFKPPVESHIQKNKKILKSAKDLPPDALIIEYRGKFMLREQFEANGYFFKRPYPFVLFYSKFHGLEMCVDARTFGNEARFIRRSCTPNAEVRHEIQDGTIHLYIYSIHSIPKGTEITIAFDFDYGNCKYKVDCACLKENPECPVLKRSSESMENINSGYETRRKKGKKDKDISKEKDTQNQNITLDCEGTTNKMKSPETKQRKLSPLRLSVSNNQEPDFIDDIEEKTPISNEVEMESEEQIAERKRKMTREERKMEAILQAFARLEKRNLEKELGIL

SEQ ID NO: 909865 - protein, 889 aa, Homo sapiens; identical to SEQ ID NO: 909851

SEQ ID NO: 909866 - protein, 872 aa, Homo sapiens; identical to SEQ ID NO: 909856

SEQ ID NO: 909867 - protein, 889 aa, Homo sapiens; identical to SEQ ID NO: 909851

SEQ ID NO: 909868 - protein, 706 aa, Homo sapiens
MSDGDTSATESGDEVPVELYTAFQHTPTSITLTASRVSKVNDKRRKKSGEKEQHISKCKKAFREGSRKSSRVKGSAPEIDPSSDGSNFGWETKIKAWMDRYEEANNNQYSEGVQREAQRIALRLGNGNDKKEMNKSDLNTNNLLFKPPVESHIQKNKKILKSAKDLPPDALIIEYRGKFMLREQFEANGYFFKRPYPFVLFYSKFHGLEMCVDARTFGNEARFIRRSCTPNAEVRHEIQDGTIHLYIYSIHSIPKGTEITIAFDFDYGNCKYKVDCACLKENPECPVLKRSSESMENINSGYETRRKKGKKDKDISKEKDTQNQNITLDCEGTTNKMKSPETKQRKLSPLRLSVSNNQEPDFIDDIEEKTPISNEVEMESEEQIAERKRKMTREERKMEAILQAFARLEKREKRREQALERISTAKTEVKTECKDTQIVSDAEVIQEQAKEENASKPTPAKVNRTKQRKSFSRSRTHIGQQRRRHRTVSMCSDIQPSSPDIEVTSQQNDIENTVLTIEPETETALAEIITETEVPALNKCPTKYPKTKKHLVNEWLSEKNEKTGKPSDGLSERPLRITTDPEVLATQLNSLPGLTYSPHVYSTPKHYIRFTSPFLSEKRRRKEPTENISGSCKKRWLKQALEEENSAILHRFNSPCQERSRSPAVNGENKSPLLLNDSCSLPDLTTPLKKRRFYQLLDSVYSETST

SEQ ID NO: 909869 - protein, 139 aa, Homo sapiens
MSIVIPLGVDTAETSYLEMAAGSEPESVEASPVVVEKSNSYPHQLYTSSSHHSHSYIGLPYADHNYGARPPPTPPASPPPSVLISKNEVGIFTTPNFDETSSATTISTSEDGSYGTDVTRCICGFTHDDGYMICCDKCR

SEQ ID NO: 909870 - protein, 416 aa, Homo sapiens
MSIVIPLGVDTAETRRKKGKKDKDISKEKDTQNQNITLDCEGTTNKMKSPETKQRKLSPLRLSVSNNQEPDFIDDIEEKTPISNEVEMESEEQIAERKRKMTREERKMEAILQAFARLEKREKRREQALERISTAKTEVKTECKDTQIVSDAEVIQEQAKEENASKPTPAKVNRTKQRKSFSRSRTHIGQQRRRHRTVSMCSDIQPSSPDIEVTSQQNDIENTVLTIEPETETALAEIITETEVPALNKCPTKYPKTKKHLVNEWLSEKNEKTGKPSDGLSERPLRITTDPEVLATQLNSLPGLTYSPHVYSTPKHYIRFTSPFLSEKRRRKEPTENISGSCKKRWLKQALEEENSAILHRFNSPCQERSRSPAVNGENKSPLLLNDSCSLPDLTTPLKKRRFYQLLDSVYSETST

SEQ ID NO: 909871 - protein, 326 aa, Homo sapiens
MDLTAIYESLLSLSPDVPVPSDHGGTESSPGWGSSGPWSLSPSDSSPSGVTSRLPGRSTSLVEGRSCGWVPPPPGFAPLAPRLGPELSPSPTSPTATSTTPSRYKTELCRTFSESGRCRYGAKCQFAHGLGELRQANRHPKYKTELCHKFYLQGRCPYGSRCHFIHNPSEDLAAPGHPPVLRQSISFSGLPSGRRTSPPPPGLAGPSLSSSSFSPSSSPPPPGDLPLSPSAFSAAPGTPLARRDPTPVCCPSCRRATPISVWGPLGGLVRTPSVQSLGSDPDEYASSGSSLGGSDSPVFEAGVFAPPQPVAAPRRLPIFNRISVSE

SEQ ID NO: 909872 - protein, 237 aa, Homo sapiens [sequence omitted]

SEQ ID NO: 909873 - protein, 306 aa, Homo sapiens
HTELLQPWAIRATPAWANKSYSSLGNKSCHPHPLRPLQPPPPPRATRLSYVGPSQRVGAAATGPSASLPMAWASCARPIATPNTRRNSVTSSTSRAAAPTALAATSSTTLAKTWRPRATLLCFARASASPACPLAAGPHHHHQAWPALPCPPAPSRPPAPHHHLGTFHCHPLPSLLPLAPPWLEETPPQSVAPPAEGPLLSASGGPWVAWFGPPLYSPWDPTLMNMPAAAAAWGALTLPSSRREFLHHPSPWQPPGDSPSSIASLFLSDKVTARSDQLDLSGEPRLLHCGLCMDPRAVGTWGTVIK

SEQ ID NO: 909874 - protein, 326 aa, Homo sapiens; identical to SEQ ID NO: 909871

SEQ ID NO: 909875 - protein, 326 aa, Homo sapiens; identical to SEQ ID NO: 909871

SEQ ID NO: 909876 - protein, 326 aa, Homo sapiens; identical to SEQ ID NO: 909871

SEQ ID NO: 909877 - protein, 326 aa, Homo sapiens; identical to SEQ ID NO: 909871

SEQ ID NO: 909878 - protein, 326 aa, Homo sapiens; identical to SEQ ID NO: 909871

SEQ ID NO: 909879 - protein, 326 aa, Homo sapiens; identical to SEQ ID NO: 909871

SEQ ID NO: 909880 - protein, 326 aa, Homo sapiens; identical to SEQ ID NO: 909871

SEQ ID NO: 909881 - protein, 220 aa, Homo sapiens
MDLTAIYESLLSLSPDVPVPSDHGGTESSPGWGSSGPWSLSPSDSSPSGVTSRLPGRSTSLVEGRSCGWVPPPPGFAPLAPRLGPELSPSPTSPTATSTTPSRYKTELCRTFSESGRCRYGAKCQFAHGLGELRQANRHPKYKTELCHKFYLQGRCPYGSRCHFIHNPSEDLAAPGHPPVLRQSISFSGLPSGRRTSPPPPGLAGPSLSSSSFSPSSSPQ

SEQ ID NO: 909882 - protein, 139 aa, Homo sapiens
YTVTQGAHKERLKKVKGTRQILPRLFTKNITSSITSIRGTACPVTHVYRPRYPNHSWIASWQSTHHSRPTPLMANRYTMDLTAIYEVSPRRTASPVPACLSPSPHLSSAANSSPGRLPPFSNCIAPPLFHRSPAMRGLP

SEQ ID NO: 909883 - protein, 326 aa, Homo sapiens; identical to SEQ ID NO: 909871

SEQ ID NO: 909884 - protein, 147 aa, Homo sapiens
MDLTAIYESLLSLSPDVPVPPPWLEETPPQSVAPPAEGPLLSASGGPWVAWFGPPLYSPWDPTLMNMPAAAAAWGALTLPSSRREFLHHPSPWQPPGDSPSSIASLFLSDKVTARSDQLDLSGEPRLLHCGLCMDPRAVGTWGTVIK

SEQ ID NO: 909885 - protein, 326 aa, Homo sapiens; identical to SEQ ID NO: 909871

SEQ ID NO: 909886 - protein, 326 aa, Homo sapiens; identical to SEQ ID NO: 909871

SEQ ID NO: 909887 - protein, 326 aa, Homo sapiens; identical to SEQ ID NO: 909871

SEQ ID NO: 909888 - protein, 326 aa, Homo sapiens; identical to SEQ ID NO: 909871

SEQ ID NO: 909889 - protein, 285 aa, Homo sapiens
MDLTAIYESLLSLSPDVPVPSDHGGTESSPGWGSSGPWSLSPSDSSPSGVTSRLPGRSTSLVEGRSCGWVPPPPGFAPLAPRLGPELSPSPTSPTATSTTPSRYKTELCRTFSESGRCRYGAKCQFAHGLGELRQANRHPKYKTELCHKFYLQGRCPYGSRCHFIHNPSEDLAAPGHPPVLRQSISFSGLPSGRRTSPPPPGLAGPSLSSSSFSPSSSPPPPGDLPLSPSAFSAAPGTPLARRDPTPVCCPSCRRATPISVWGPLGGLVRTPSVHQICLLESYVL

SEQ ID NO: 909890 - protein, 141 aa, Homo sapiens
MDLTAIYESLLSLSPDVPVPSDHGGTESSPGWGSSGPWSLSPSDSSPSGVTSRLPGRSTSLVEGRSCGWVPPPPGFAPLAPRLGPELSPSPTSPTATSTTPSRYKTELCRTFSESGRCRYGAKCQFAHGLGELRQANRHPK

SEQ ID NO: 909891 - protein, 469 aa, Homo sapiens
MSALTPPTDMPTPTTDKITQAAMETIYLCKFRVSMDGEWLCLRELDDISLTPDPEPTHEDPNYLMANERMNLMNMAKLSIKGLIESALNLGRTLDSDYAPLQQFFVVMEHCLKHGLKAKKTFLGQNKSFWGPLELVEKLVPEAAEITASVKDLPGLKTPVGRGRAWLRLALMQKKLSEYMKALINKKELLSEFYEPNALMMEEEGAIIAGLLVGLNVIDANFCMKGEDLDSQVGVIDFSMYLKDGNSSKGTEGDGQITAILDQKNYVEELNRHLNATVNNLQAKVDALEKSNTKLTEELAVANNRIITLQEEMERVKEESSYILESNRKGPKQDRTAEGQALSEARKHLKEETQLRLDVEKELEMQISMRQEMELAMKMLEKDVCEKQDALVSLRQQLDDLRALKHELAFKLQSSDLGVKQKSELNSRLEEKTNQMAATIKQLEQSEKDLVKQAKTLNSAANKLIPKHH

SEQ ID NO: 909892 - protein, 216 aa, Homo sapiens
MANERMNLMNMAKLSIKGLIESALNLGRTLDSDYAPLQQFFVVMEHCLKHGLKAKKTFLGQNKSFWGPLELVEKLVPEAAEITASVKDLPGLKTPVGRGRAWLRLALMQKKLSEYMKALINKKELLSEFYEPNALMMEEEGAIIAGLLVGLNVIDANFCMKGEDLDSQVGVIDFSMYLKDGNSSKGTEGDGSELPAISGPRKTMLEETGPNFECFW

SEQ ID NO: 909893 - protein, 469 aa, Homo sapiens; identical to SEQ ID NO: 909891

SEQ ID NO: 909894 - protein, 469 aa, Homo sapiens; identical to SEQ ID NO: 909891

SEQ ID NO: 909895 - protein, 469 aa, Homo sapiens; identical to SEQ ID NO: 909891

SEQ ID NO: 909896 - protein, 469 aa, Homo sapiens; identical to SEQ ID NO: 909891

SEQ ID NO: 909897 - protein, 471 aa, Homo sapiens
GGTDREGEAGPPPASPAGQSEPDSPVAAPFFLLYPGDGGAGFGVRPPPQQQRSWRTPPSPGSPLPFLLLSYPSGGGGSSGSGKHHPNYLMANERMNLMNMAKLSIKGLIESALNLGRTLDSDYAPLQQFFVVMEHCLKHGLKAKKTFLGQNKSFWGPLELVEKLVPEAAEITASVKDLPGLKTPVGRGRAWLRLALMQKKLSEYMKALINKKELLSEFYEPNALMMEEEGAIIAGLLVGLNVIDANFCMKGEDLDSQVGVIDFSMYLKDGNSSKGTEGDGQITAILDQKNYVEELNRHLNATVNNLQAKVDALEKSNTKLTEELAVANNRIITLQEEMERVKEESSYILESNRKGPKQDRTAEGQALSEARKHLKEETQLRLDVEKELEMQISMRQEMELAMKMLEKDVCEKQDALVSLRQQLDDLRALKHELAFKLQSSDLGVKQKSELNSRLEEKTNQMAATIKQLEQR

SEQ ID NO: 909898 - protein, 469 aa, Homo sapiens; identical to SEQ ID NO: 909891

SEQ ID NO: 909899 - protein, 620 aa, Homo sapiens
MSALTPPTDMPTPTTDKITQAAMETIYLCKFRVSMDGEWLCLRELDDISLTPDPEPTHEDPNYLMANERMNLMNMAKLSIKGLIESALNLGRTLDSDYAPLQQFFVVMEHCLKHGLKAKKTFLGQNKSFWGPLELVEKLVPEAAEITASVKDLPGLKTPVGRGRAWLRLALMQKKLSEYMKALINKKELLSEFYEPNALMMEEEGAIIAGLLVGLNVIDANFCMKGEDLDSQVGVIDFSMYLKDGNSSKGTEGDGQITAILDQKNYVEELNRHLNATVNNLQAKVDALEKSNTKLTEELAVANNRIITLQEEMERVKEESSYILESNRKGPKQDRTAEGQALSEARKHLKEETQLRLDVEKELEMQISMRQEMELAMKMLEKDVCEKQDALVSLRQQLDDLRALKHELAFKLQSSDLGVKQKSELNSRLEEKTNQMAATIKQLEQRLRQAERSRQSAELDNRLFKQDFGDKINSLQLEVEELTRQRNQLELELKQEKERRLQNDRSIPGRGSQKSESKMDGKHKMQEENVKLKKPLEESHRLQPHPMDEQDQLLLSEKPQLCQLCQEDGSLTKNVCKNCSGTFCDACSTNELPLPSSIKLERVCNPCHKHLMKQYSTSPS

SEQ ID NO: 909900 - protein, 469 aa, Homo sapiens; identical to SEQ ID NO: 909891

SEQ ID NO: 909901 - protein, 182 aa, Homo sapiens
MAEGEDVGWWRSWLQQSYQAVKEKSSEALEFMKRDLTEFTQVVQHDTACTIAATASVVKEKLATEGSSGATEKMKKGLSDFLGVISDTFAPSPDKTIDCDVITLMGTPSGTAEPYDGTKARLYSLQSDPATYCNEPDGPPELFDASPLPTRALGTDSGGSLLALLGLCSHLGRGSLNPGQKL

SEQ ID NO: 909902 - protein, 103 aa, Homo sapiens
GQSGTGGVQRKKESLDICGASLRRQASYRRVGSSTDISEDWEKDFDLDMTEEEVQMALSKVDASGEVSGPGGSEGSEPNGPGCESSPQPAQLSPQEGPCSCLR

SEQ ID NO: 909903 - protein, 433 aa, Homo sapiens
DVSVFHREDVGWWRSWLQQSYQAVKEKSSEALEFMKRDLTEFTQVVQHDTACTIAATASVVKEKLATEGSSGATEKMKKGLSDFLGVISDTFAPSPDKTIDCDVITLMGTPSGTAEPYDGTKARLYSLQSDPATYCNEPDGPPELFDAWLSQFCLEEKKGEISELLVGSPSIRALYTKMVPAAVSHSEFWHRYFYKVHQLEQEQARRDALKQRAEQSISEEPGWEEEEEELMGISPISPKEAKVPVAKISTFPEGEPGPQSPCEENLVTSVEPPAEVTPSESSESISLVTQIANPATAPEARVLPKDLSQKLLEASLEEQGLAVDVGETGPSPPIHSKPLTPAGHTGGPEPRPPARVETLREEAPTDLRVFELNSDSGKSTPSNNGKKGSSTDISEDWEKDFDLDMTEEEVQMALSKVDASGELEDVEWEDWE

SEQ ID NO: 909904 - protein, 447 aa, Homo sapiens
MAEGEDVGWWRSWLQQSYQAVKEKSSEALEFMKRDLTEFTQVVQHDTACTIAATASVVKEKLAIAACSRGACFLCPFSIQTEGSSGATEKMKKGLSDFLGVISDTFAPSPDKTIDCDVITLMGTPSGTAEPYDGTKARLYSLQSDPATYCNEPDGPPELFDAWLSQFCLEEKKGEISELLVGSPSIRALYTKMVPAAVSHSEFWHRYFYKVHQLEQEQARRDALKQRAEQSISEEPGWEEEEEELMGISPISPKEAKVPVAKISTFPEGEPGPQSPCEENLVTSVEPPAEVTPSESSESISLVTQIANPATAPEARVLPKDLSQKLLEASLEEQGLAVDVGETGPSPPIHSKPLTPAGHTGGPEPRPPARVETLREEAPTDLRVFELNSDSGKSTPSNNGKKGSSTDISEDWEKDFDLDMTEEEVQMALSKVDASGELEDVEWEDWE

SEQ ID NO: 909905 - protein, 430 aa, Homo sapiens
MAEGEDVGWWRSWLQQSYQAVKEKSSEALEFMKRDLTEFTQVVQHDTACTIAATASVVKEKLATEGSSGATEKMKKGLSDFLGVISDTFAPSPDKTIDCDVITLMGTPSGTAEPYDGTKARLYSLQSDPATYCNEPDGPPELFDAWLSQFCLEEKKGEISELLVGSPSIRALYTKMVPAAVSHSEFWHRYFYKVHQLEQEQARRDALKQRAEQSISEEPGWEEEEEELMGISPISPKEAKVPVAKISTFPEGEPGPQSPCEENLVTSVEPPAEVTPSESSESISLVTQIANPATAPEARVLPKDLSQKLLEASLEEQGLAVDVGETGPSPPIHSKPLTPAGHTGGPEPRPPARVETLREEAPTDLRVFELNSDSGKSTPSNNGKKGSSTDISEDWEKDFDLDMTEEEVQMALSKVDASGELEDVEWEDWE

SEQ ID NO: 909906 - protein, 409 aa, Homo sapiens
DFDLDMTEEEMQDKMAEGEDVGWWRSWLQQSYQAVKEKSSEALEFMKRDLTEFTQVVQHDTACTIAATASVVKEKLACDVITLMGTPSGTAEPYDGTKARLYSLQSDPATYCNEPDGPPELFDAWLSQFCLEEKKGEISELLVGSPSIRALYTKMVPAAVSHSEFWHRYFYKVHQLEQEQARRDALKQRAEQSISEEPGWEEEEEELMGISPISPKEAKVPVAKISTFPEGEPGPQSPCEENLVTSVEPPAEVTPSESSESISLVTQIANPATAPEARVLPKDLSQKLLEASLEEQGLAVDVGETGPSPPIHSKPLTPAGHTGGPEPRPPARVETLREEAPTDLRVFELNSDSGKSTPSNNGKKGSSTDISEDWEKDFDLDMTEEEVQMALSKVDASGELEDVEWEDWE

SEQ ID NO: 909907 - protein, 182 aa, Homo sapiens; identical to SEQ ID NO: 909901

SEQ ID NO: 909908 - protein, 430 aa, Homo sapiens; identical to SEQ ID NO: 909905

SEQ ID NO: 909909 - protein, 430 aa, Homo sapiens; identical to SEQ ID NO: 909905

SEQ ID NO: 909910 - protein, 457 aa, Homo sapiens
MAEGEDVGWWRSWLQQSYQAVKEKSSEALEFMKRDLTEFTQVVQHDTACTIAATASVVKEKLATEGSSGATEKMKKGLSDFLGVISDTFAPSPDKTIDCDVITLMGTPSGTAEPYDGTKARLYSLQSDPATYCNEPDGPPELFDAWLSQFCLEEKKGEISELLVGSPSIRALYTKMVPAAVSHSEFWHRYFYKVHQLEQEQARRDALKQRAEQSISEEPGWEEEEEELMGISPISPKEAKVPVAKISTFPEGEPGPQSPCEENLVTSVEPPAEVTPSESSESISLVTQIANPATAPEARVLPKDLSQKLLEASLEEQGLAVDVGETGPSPPIHSKPLTPAGHTGGPEPRPPARVETLREEAPTDLRVFELNSDSGKSTPSNNGKKGSSTDISEDWEKDFDLDMTEEEVQMALSKVDASGEVSGPGGSEGSEPNGPGCESSPQPAQLSPQEGPCSCLR

SEQ ID NO: 909911 - protein, 286 aa, Homo sapiens
MAEGEDVGWWRSWLQQSYQAVKEKSSEALEFMKRDLTEFTQVVQHDTACTIAATASVVKEKLATEGSSGATEKMKKGLSDFLGVISDTFAPSPDKTIDCDVITLMGTPSGTAEPYDGTKARLYSLQSDPATYCNEPDGPPELFDAWLSQFCLEEKKGEISELLVGSPSIRALYTKMVPAAVSHSEFWHRYFYKVHQLEQEQARRDALKQRAEQSISEEPGWEEEEEELMGISPISPKEAKVPVAKISTFPEGEPGPQSPCEENLVTSVEPPEHLPRDTDRQPGHCT

SEQ ID NO: 909912 - protein, 207 aa, Homo sapiens
MAEGEDVGWWRSWLQQSYQAVKEKSSEALEFMKRDLTEFTQVVQHDTACTIAATASVVKEKLATEGSSGATEKMKKGLSDFLGVISDTFAPSPDKTIDCDVITLMGTPSGTAEPYDGTKARLYSLQSDPATYCNEPDGPPELFDAWLSQFCLEEKKGEISELLVGSPSIRALYTKMVPAAVSHSEFWHRYFYKVHQLEPSTTRWFQQ

SEQ ID NO: 909913 - protein, 430 aa, Homo sapiens; identical to SEQ ID NO: 909905

SEQ ID NO: 909914 - protein, 430 aa, Homo sapiens; identical to SEQ ID NO: 909905

SEQ ID NO: 909915 - protein, 444 aa, Homo sapiens
DFDLDMTEEEMQDKMAEGEDVGWWRSWLQQSYQAVKEKSSEALEFMKRDLTEFTQVVQHDTACTIAATASVVKEKLATEGSSGATEKMKKGLSDFLGVISDTFAPSPDKTIDCDVITLMGTPSGTAEPYDGTKARLYSLQSDPATYCNEPDGPPELFDAWLSQFCLEEKKGEISELLVGSPSIRALYTKMVPAAVSHSEFWHRYFYKVHQLEQEQARRDALKQRAEQSISEEPGWEEEEEELMGISPISPKEAKVPVAKISTFPEGEPGPQSPCEENLVTSVEPPAEVTPSESSESISLVTQIANPATAPEARVLPKDLSQKLLEASLEEQGLAVDVGETGPSPPIHSKPLTPAGHTGGPEPRPPARVETLREEAPTDLRVFELNSDSGKSTPSNNGKKGSSTDISEDWEKDFDLDMTEEEVQMALSKVDASGELEDVEWEDWE

SEQ ID NO: 909916 - protein, 433 aa, Homo sapiens
RIGRLGREDVGWWRSWLQQSYQAVKEKSSEALEFMKRDLTEFTQVVQHDTACTIAATASVVKEKLATEGSSGATEKMKKGLSDFLGVISDTFAPSPDKTIDCDVITLMGTPSGTAEPYDGTKARLYSLQSDPATYCNEPDGPPELFDAWLSQFCLEEKKGEISELLVGSPSIRALYTKMVPAAVSHSEFWHRYFYKVHQLEQEQARRDALKQRAEQSISEEPGWEEEEEELMGISPISPKEAKVPVAKISTFPEGEPGPQSPCEENLVTSVEPPAEVTPSESSESISLVTQIANPATAPEARVLPKDLSQKLLEASLEEQGLAVDVGETGPSPPIHSKPLTPAGHTGGPEPRPPARVETLREEAPTDLRVFELNSDSGKSTPSNNGKKGSSTDISEDWEKDFDLDMTEEEVQMALSKVDASGELEDVEWEDWE

SEQ ID NO: 909917 - protein, 322 aa, Homo sapiens
MHEEMGSWRYGMQQSYQAVKEKSYCNEPDGPPELFDAWLSQFCLEEKKGEISELLVGSPSIRALYTKMVPAAVSHSEFWHRYFYKVHQLEQEQARRDALKQRAEQSISEEPGWEEEEEELMGISPISPKEAKVPVAKISTFPEGEPGPQSPCEENLVTSVEPPAEVTPSESSESISLVTQIANPATAPEARVLPKDLSQKLLEASLEEQGLAVDVGETGPSPPIHSKPLTPAGHTGGPEPRPPARVETLREEAPTDLRVFELNSDSGKSTPSNNGKKGSSTDISEDWEKDFDLDMTEEEVQMALSKVDASGELEDVEWEDWE

SEQ ID NO: 909918 - protein, 145 aa, Homo sapiens
PATAPEARVLPKDLSQKLLEASLEEQGLAVDVGETGPSPPIHSKPLTPAGHTGVFELEEEELMGISPISPKEAKVPVAKISTFPEGEPGPQSPCEENLVTSVEPPAEVTPSESSDLLCQPELWAQILVAPCWPSWASAHTWEGAL

SEQ ID NO: 909919 - protein, 430 aa, Homo sapiens; identical to SEQ ID NO: 909905

SEQ ID NO: 909920 - protein, 423 aa, Homo sapiens
MAEGEDVGWWRSWLQQSYQAVKEKSSEALEFMKRDLTEFTQVVQHDTACTIAATASVVKEKLATEGSSGATEKMKKGLSDFLGVISDTFAPSPDKTIDCDVITLMGTPSGTAEPYDGTKARLYSLQSDPATYCNEPDGPPELFDAWLSQFCLEEKKGEISELLVGSPSIRALYTKMVPAAVSHSEFWHRYFYKVHQLEQEQARRDALKQRAEQSISEEPGWEEEEEELMGISPISPKEAKVPVAKISTFPEGEPGPQSPCEENLVTSVEPPAEVTPSESSESISLVTQIANPATAPEARVLPKDLSQKLLEASLEEQGLAVDVGETGPSPPIHSKPLTPAGHTGGPEPRPPARVETLREEAPTDLRVFELNSDSGKSTPSNNGKKGRSGGPSPEGCVRSGPPPEADLSPCPLLGYYEQIFFRF

SEQ ID NO: 909921 - protein, 102 aa, Homo sapiens
DVSVFHREDVGWWRSWLQQSYQAVKEKSSEALEFMKRDLTEFTQVVQHDTACTIAATASVVKEKLATEGSSGATEKMKKGLSDFLGVISDTFAPSPDKTIDQ

SEQ ID NO: 909922 - protein, 103 aa, Homo sapiens
DVSVFHREDVGWWRSWLQQSYQAVKEKSSEALEFMKRDLTEFTQVVQHDTACTIAATASVVKEKLATEGSSGATEKMKKGLSDFLGVISDTFAPSPDKTIDRE

SEQ ID NO: 909923 - protein, 790 aa, Homo sapiens
MKAFGPPHEGPLQGLVASRIETYGGRHRASAQSTAGRLYPRGYPVLDPSRRRLQQYVPFARGSGQARGLSPMRLRDPEPEKRHGGHVGAGLLHSPKLKELTKAHELEVRLHTFSMFGMPRLPPEDRRHWEIGEGGDSGLTIEKSWRELVPGHKEMSQELCHQQEALWELLTTELIYVRKLKIMTDLLAAGLLNLQRVGLLMEVSAETLFGNVPSLIRTHRSFWDEVLGPTLEETRASGQPLDPIGLQSGFLTFGQRFHPYVQYCLRVKQTMAYAREQQETNPLFHAFVQWCEKHKRSGRQMLCDLLIKPHQRITKYPLLLHAVLKRSPEARAQEALNAMIEAVESFLRHINGQVRQGEEQESLAAAAQRIGPYEVLEPPSDEVEKNLRPFSTLDLTSPMLGVASEHTRQLLLEGPVRVKEGREGKLDVYLFLFSDVLLVTKPQRKADKAKVIRPPLMLEKLVCQPLRDPNSFLLIHLTEFQCVSSALLVHCPSPTDRAQWLEKTQQAQAALQKLKAEEYVQQKRELLTLYRDQDRESPSTRPSTPSLEGSQSSAEGRTPEFSTIIPHLVVTEDTDEDAPLVPDDTSDSGYGTLIPGTPTGSRSPLSRLRQRALRRDPRLTFSTLELRDIPLRPHPPDPQAPQRRSAPELPEGILKGGSLPQEDPPTWSEEEDGASERGNVVVETLHRARLRGQLPSSPTHADSAGESPWESSGEEEEEGPLFLKAGHTSLRPMRAEDMLREIREELASQRIEGAEEPRDSRPRKLTRAQLQRMRGPHIIQLDTPLSASEV

SEQ ID NO: 909924 - protein, 790 aa, Homo sapiens; identical to SEQ ID NO: 909923

SEQ ID NO: 909925 - protein, 790 aa, Homo sapiens; identical to SEQ ID NO: 909923

SEQ ID NO: 909926 - protein, 69 aa, Homo sapiens
PIPSGTSTTVPGVGVLRATRDGLPLADSSLFVCKPRRVSWSALLLKDHISQRKPGPGTLPPALFGDQEL

SEQ ID NO: 909927 - protein, 540 aa, Homo sapiens
MKAFGPPHEGPLQGLVASRIETYGGRHRASAQSTAGRLYPRGYPVLDPSRRRLQQYVPFARGSGQARGLSPMRLRDPEPEKRHGGHVGAGLLHSPKLKELTKAHELEVRLHTFSMFGMPRLPPEDRRHWEIGEGGDSGLTIEKSWRELVPGHKEMSQELCHQQEALWELLTTELIYVRKLKIMTDLLAAGLLNLQRVGLLMEVSAETLFGNVPSLIRTHRSFWDEVLGPTLEETRASGQPLDPIGLQSGFLTFGQRFHPYVQYCLRVKQTMAYAREQQETNPLFHAFVQWCEKHKRSGRQMLCDLLIKPHQRITKYPLLLHAVLKRSPEARAQEALNAMIEAVESFLRHINGQVRQGEEQESLAAAAQRIGPYEVLEPPSDEVEKNLRPFSTLDLTSPMLGVASEHTRQLLLEGPVRVKEGREGKLDVYLFLFSDVLLVTKPQRKADKAKVIRPPLMLEKLVCQPLRDPNSFLLIHLTEFQCVSSALLVHCPSPTDRAQWLEKTQQAQVWESQQRGGMGRGPRSSEMGAQWWITPVISAL

SEQ ID NO: 909928 - protein, 236 aa, Homo sapiens
PKSLSCAEPRLRFPGQARHVWPAARMQAPHKEHLYKLLVIGDLGVGKTSIIKRYVHQNFSSHYRATIGVDFALKVLHWDPETVVRLQLWDIAGQERFGNMTRVYYREAMGAFIVFDVTRPATFEAVAKWKNDLDSKLSLPNGKPVSVVLLANKCDQGKDVLMNNGLKMDQFCKEHGFVGWFETSAKENINIDEASRCLVKHILANECDLMESIEPDVVKPHLTSTKVASCSGCAKS

SEQ ID NO: 909929 - protein, 97 aa, Homo sapiens
PKSLSCAEPRLRFPGQARHVWPAARMQAPHKEHLYKLLVIGDLGVGKTSIIKRYVHQNFSSHYRATIGVDFALKVLHWDPETVVRLQLWDIAGKYKH

SEQ ID NO: 909930 - protein, 236 aa, Homo sapiens; identical to SEQ ID NO: 909928

SEQ ID NO: 909931 - protein, 137 aa, Homo sapiens
MTRVYYREAMGAFIVFDVTRPATFEAVAKWKNDLDSKLSLPNGKPVSVVLLANKCDQGKDVLMNNGLKMDQFCKEHGFVGWFETSAKENINIDEASRCLVKHILANECDLMESIEPDVVKPHLTSTKVASCSGCAKS

SEQ ID NO: 909932 - protein, 133 aa, Homo sapiens
GVLKIRDGSKEPRSRWDIVRLIPPQTYLQAEGEDGQNLEKRRNLLNCLIVRILKAHGDEGLHIDQLVCLVLEAWQKGPCPPRGLVSSLGKGSACSSTDVLSCIPPLTFHTLQIRSRGVPYASCTATQSFSTFR

SEQ ID NO: 909933 - protein, 1798 aa, Homo sapiens
MVGELRYREFRVPLGPGLHAYPDELIRQRVGHDGHPEYQIRWLILRRGDEGDGGSGQVDCKAEHILLWMSKDEIYANCHKMLGEDGQVIGPSQESAGEVGALDKSVLEEMETDVKSLIQRALRQLEECVGTIPPAPLLHTVHVLSAYASIEPLTGVFKDPRVLDLLMHMLSSPDYQIRWSAGRMIQALSSHDAGTRTQILLSLSQQEAIEKHLDFDSRCALLALFAQATLSEHPMSFEGIQLPQVPGRVLFSLVKRYLHVTSLLDQLNDSAAEPGAQNTSAPEELSGERGQLELEFSMAMGTLISELVQAMRWDQASDRPRSSARSPGSIFQPQLADVSPGLPAAQAQPSFRRSRRFRPRSEFASGNTYALYVRDTLQPGMRVRMLDDYEEISAGDEGEFRQSNNGVPPVQVFWESTGRTYWVHWHMLEILGFEEDIEDMVEADEYQGAVASRVLGRALPAWRWRPMTELYAVPYVLPEDEDTEECEHLTLAEWWELLFFIKKLDGPDHQEVLQILQENLDGEVEPAWRHSEVGGLYCKGWTVQSIWKAQDEKWRSESGRGCRGGVWNFQRWEGELFGRSQLPAVRGSGWRVCVQRDPHPYQVLPGASGSAGLSAVRASPGWQILDDEILAELAVPIELAQDLLLTLPQRLNDSALRDLINCHVYKKYGPEALAGNQAYPSLLEAQEDVLLLDAQAQAKDSEDAAKVEAKEPPSQSPNTPLQRLVEGYGPAGKILLDLEQALSSEGTQENKVKPLLLQLQRQPQPFLALMQSLDTPETNRTLHLTVLRILKQLVDFPEALLLPWHEAVDACMACLRSPNTDREVLQELIFFLHRLTSVSRDYAVVLNQLGARDAISKALEKHLGKLELAQELRDMVFKCEKHAHLYRKLITNILGGCIQMVLGQIEDHRRTHRPINIPFFDVFLRYLCQGSSVEVKEDKCWEKVEVSSNPHRASKLTDHNPKTYWESNGSAGSHYITLHMRRGILIRQLTLLVASEDSSYMPARVVVCGGDSTSSLHTELNSVNVMPSASRVILLENLTRFWPIIQIRIKRCQQGGIDTRIRGLEILGPKPTFWPVFREQLCRHTRLFYMVRAQAWSQDMAEDRRSLLHLSSRLNGALRQEQNFADRFLPDDEAAQALGKTCWEALVSPVVQNITSPDEDGISPLGWLLDQYLECQEAVFNPQSRGPAFFSRVRRLTHLLVHVEPCEAPPPVVATPRPKGRNRSHDWSSLATRGLPSSIMRNLTRCWRAVVEKQVNNFLTSSWRDDDFVPRYCEHFNILQNSSSELFGPRAAFLLALQNGCAGALLKLPFLKAAHVSEQFARHIDQQIQGSRIGGAQEMERLAQLQQCLQAVLIFSGLEIATTFEHYYQHYMADRLLGVVSSWLEGAVLEQIGPCFPNRLPQQMLQSLSTSKELQRQFHVYQLQQLDQELLKLEDTEKKIQVGLGASGKEHKSEKEEEAGAAAVVDVAEGEEEEEENEDLYYEGAMPEVSVLVLSRHSWPVASICHTLNPRTCLPSYLRGTLNRYSNFYNKSQSHPALERGSQRRLQWTWLGWAELQFGNQTLHVSTVQMWLLLYLNDLKAVSVESLLAFSGLSADMLNQAIGPLTSSRGPLDLHEQKDIPGGVLKIRDGSKEPRSRWDIVRLIPPQTYLQAEGEDGQNLEKRRNLLNCLIVRILKAHGDEGLHIDQLVCLVLEAWQKGPCPPRGLVSSLGKGSACSSTDVLSCILHLLGKGTLRRHDDRPQVLSYAVPVTVMEPHTESLNPGSSGPNPPLTFHTLQIRSRGVPYASCTATQSFSTFR

SEQ ID NO: 909934 - protein, 1791 aa, Homo sapiens
MVGELRYREFRVPLGPGLHAYPDELIRQRVGHDGHPEYQIRWLILRRGDEGDGGSGQVDCKAEHILLWMSKDEIYANCHKMLGEDGQVIGPSQESAGEVGALDKSVLEEMETDVKSLIQRALRQLEECVGTIPPAPLLHTVHVLSAYASIEPLTGVFKDPRVLDLLMHMLSSPDYQIRWSAGRMIQALSSHDAGTRTQILLSLSQQEAIEKHLDFDSRCALLALFAQATLSEHPMSFEGIQLPQVPGRVLFSLVKRYLHVTSLLDQLNDSAAEPGAQNTSAPEELSGERGQLELEFSMAMGTLISELVQAMRWDQASDRPRSSARSPGSIFQPQLADVSPGLPAAQAQPSFRRSRRFRPRSEFASGNTYALYVRDTLQPGMRVRMLDDYEEISAGDEGEFRQSNNGVPPVQVFWESTGRTYWVHWHMLEILGFEEDIEDMVEADEYQGAVASRVLGRALPAWRWRPMTELYAVPYVLPEDEDTEECEHLTLAEWWELLFFIKKLDGPDHQEVLQILQENLDGEILDDEILAELAVPIELAQDLLLTLPQRLNDSALRDLINCHVYKKYGPEALAGNQAYPSLLEAQEDVLLLDAQAQAKDSEDAAKVEAKEPPSQSPNTPLQRLVEGYGPAGKILLDLEQALSSEGTQENKVKPLLLQLQRQPQPFLALMQSLDTPETNRTLHLTVLRILKQLVDFPEALLLPWHEAVDACMACLRSPNTDREVLQELIFFLHRLTSVSRDYAVVLNQLGARDAISKALEKHLGKLELAQELRDMVFKCEKHAHLYRKLITNILGGCIQVQEEGELVGLEWHQNMKPKQWRVRAVFPWLGTAGDSSEPGAFVPLPLCPIWACSAGAVEEVPLLHGLSFIRVSVCVSVFLLPLCPFSLMFWLQMVLGQIEDHRRTHRPINIPFFDVFLRYLCQGSSVEVKEDKCWEKVEVSSNPHRASKLTDHNPKTYWESNGSAGSHYITLHMRRGILIRQLTLLVASEDSSYMPARVVVCGGDSTSSLHTELNSVNVMPSASRVILLENLTRFWPIIQIRIKRCQQGGIDTRIRGLEILGPKPTFWPVFREQLCRHTRLFYMVRAQAWSQDMAEDRRSLLHLSSRLNGALRQEQNFADRFLPDDEAAQALGKTCWEALVSPVVQNITSPDEDGISPLGWLLDQYLECQEAVFNPQSRGPAFFSRVRRLTHLLVHVEPCEAPPPVVATPRPKGRNRSHDWSSLATRGLPSSIMRNLTRCWRAVVEKQVNNFLTSSWRDDDFVPRYCEHFNILQNSSSELFGPRAAFLLALQNGCAGALLKLPFLKAAHVSEQFARHIDQQIQGSRIGGAQEMERLAQLQQCLQAVLIFSGLEIATTFEHYYQHYMADRLLGVVSSWLEGAVLEQIGPCFPNRLPQQMLQSLSTSKELQRQFHVYQLQQLDQELLKLEDTEKKIQVGLGASGKEHKSEKEEEAGAAAVVDVAEGEEEEEENEDLYYEGAMPEVSVLVLSRHSWPVASICHTLNPRTCLPSYLRGTLNRYSNFYNKSQSHPALERGSQRRLQWTWLGWAELQFGNQTLHVSTVQMWLLLYLNDLKAVSVESLLAFSGLSADMLNQAIGPLTSSRGPLDLHEQKDIPGGVLKIRDGSKEPRSRWDIVRLIPPQTYLQAEGEDGQNLEKRRNLLNCLIVRILKAHGDEGLHIDQLVCLVLEAWQKGPCPPRGLVSSLGKGSACSSTDVLSCILHLLGKGTLRRHDDRPQVLSYAVPVTVMEPHTESLNPGSSGPNPPLTFHTLQIRSRGVPYASCTATQSFSTFR

SEQ ID NO: 909935 - protein, 985 aa, Homo sapiens
MVHKSKRSNKVLQELIFFLHRLTSVSRDYAVVLNQLGARDAISKALEKHLGKLELAQELRDMVFKCEKHAHLYRKLITNILGGCIQMVLGQIEDHRRTHRPINIPFFDVFLRYLCQGSSVEVKEDKCWEKVEVSSNPHRASKLTDHNPKTYWESNGSAGSHYITLHMRRGILIRQLTLLVASEDSSYMPARVVVCGGDSTSSLHTELNSVNVMPSASRVILLENLTRFWPIIQIRIKRCQQGGIDTRIRGLEILGPKPTFWPVFREQLCRHTRLFYMVRAQAWSQDMAEDRRSLLHLSSRLNGALRQEQNFADRFLPDDEAAQALGKTCWEALVSPVVQNITSPDEDGISPLGWLLDQYLECQEAVFNPQSRGPAFFSRVRRLTHLLVHVEPCEAPPPVVATPRPKGRNRSHDWSSLATRGLPSSIMRNLTRCWRAVVEKQVNNFLTSSWRDDDFVPRYCEHFNILQNSSSELFGPRAAFLLALQNGCAGALLKLPFLKAAHVSEQFARHIDQQIQGSRIGGAQEMERLAQLQQCLQAVLIFSGLEIATTFEHYYQHYMADRLLGVVSSWLEGAVLEQIGPCFPNRLPQQMLQSLSTSKELQRQFHVYQLQQLDQELLKLEDTEKKIQVGLGASGKEHKSEKEEEAGAAAVVDVAEGEEEEEENEDLYYEGAMPEVSVLVLSRHSWPVASICHTLNPRTCLPSYLRGTLNRYSNFYNKSQSHPALERGSQRRLQWTWLGWAELQFGNQTLHVSTVQMWLLLYLNDLKAVSVESLLAFSGLSADMLNQAIGPLTSSRGPLDLHEQKDIPGGVLKIRDGSKEPRSRWDIVRLIPPQTYLQAEGEDGQNLEKRRNLLNCLIVRILKAHGDEGLHIDQLVCLVLEAWQKGPCPPRGLVSSLGKGSACSSTDVLSCILHLLGKGTLRRHDDRPQVLSYAVPVTVMEPHTESLNPGSSGPNPPLTFHTLQIRSRGVPYASCTATQSFSTFR

SEQ ID NO: 909936 - protein, 1232 aa, Homo sapiens
MVGELRYREFRVPLGPGLHAYPDELIRQRVGHDGHPEYQIRWLILRRGDEGDGGSGQVDCKAEHILLWMSKDEIYANCHKMLGEDGQVIGPSQESAGEVGALDKSVLEEMETDVKSLIQRALRQLEECVGTIPPAPLLHTVHVLSAYASIEPLTGVFKDPRVLDLLMHMLSSPDYQIRWSAGRMIQALSSHDAGTRTQILLSLSQQEAIEKHLDFDSRCALLALFAQATLSEHPMSFEGIQLPQVPGRVLFSLVKRYLHVTSLLDQLNDSAAEPGAQNTSAPEELSGERGQLELEFSMAMGTLISELVQAMRWDQASDRPRSSARSPGSIFQPQLADVSPGLPAAQAQPSFRRSRRFRPRSEFASGNTYALYVRDTLQPGMRVRMLDDYEEISAGDEGEFRQSNNGVPPVQVFWESTGRTYWVHWHMLEILGFEEDIEDMVEADEYQGAVASRVLGRALPAWRWRPMTELYAVPYVLPEDEDTEECEHLTLAEWWELLFFIKKLDGPDHQEVLQILQENLDGEILDDEILAELAVPIELAQDLLLTLLNGALRQEQNFADRFLPDDEAAQALGKTCWEALVSPVVQNITSPDEDGISPLGWLLDQYLECQEAVFNPQSRGPAFFSRVRRLTHLLVHVEPCEAPPPVVATPRPKGRNRSHDWSSLATRGLPSSIMRNLTRCWRAVVEKQVNNFLTSSWRDDDFVPRYCEHFNILQNSSSELFGPRAAFLLALQNGCAGALLKLPFLKAAHVSEQFARHIDQQIQGSRIGGAQEMERLAQLQQCLQAVLIFSGLEIATTFEHYYQHYMADRLLGVVSSWLEGAVLEQIGPCFPNRLPQQMLQSLSTSKELQRQFHVYQLQQLDQELLKLEDTEKKIQVGLGASGKEHKSEKEEEAGAAAVVDVAEGEEEEEENEDLYYEGAMPEVSVLVLSRHSWPVASICHTLNPRTCLPSYLRGTLNRYSNFYNKSQSHPALERGSQRRLQWTWLGWAELQFGNQTLHVSTVQMWLLLYLNDLKAVSVESLLAFSGLSADMLNQAIGPLTSSRGPLDLHEQKDIPGGVLKIRDGSKEPRSRWDIVRLIPPQTYLQAEGEDGQNLEKRRNLLNCLIVRILKAHGDEGLHIDQLVCLVLEAWQKGPCPPRGLVSSLGKGSACSSTDVLSCILHLLGKGTLRRHDDRPQVLSYAVPVTVMEPHTESLNPGSSGPNPPLTFHTLQIRSRGVPYASCTATQSFSTFR

SEQ ID NO: 909937 - protein, 828 aa, Homo sapiens
MVGELRYREFRVPLGPGLHAYPDELIRQRVGHDGHPEYQIRWLILRRGDEGDGGSGQVDCKAEHILLWMSKDEIYANCHKMLGEDGQVIGPSQESAGEVGALDKSVLEEMETDVKSLIQRALRQLEECVGTIPPAPLLHTVHVLSAYASIEPLTGVFKDPRVLDLLMHMLSSPDYQIRWSAGRMIQALSSHDAGTRTQILLSLSQQEAIEKHLDFDSRCALLALFAQATLSEHPMSFEGIQLPQVPGRVLFSLVKRYLHVTSLLDQLNDSAAEPGAQNTSAPEELSGERGQLELEFSMAMGTLISELVQAMRWDQASDRPRSSARSPGSIFQPQLADVSPGLPAAQAQPSFRRSRRFRPRSEFASGNTYALYVRDTLQPGMRVRMLDDYEEISAGDEGEFRQSNNGVPPVQVFWESTGRTYWVHWHMLEILGFEEDIEDMVEADEYQGAVASRVLGRALPAWRWRPMTELYAVPYVLPEDEDTEECEHLTLAEWWELLFFIKKLDGPDHQEVLQILQENLDGEILDDEILAELAVPIELAQDLLLTLPQRLNDSALRDLINCHVYKKYGPEALAGNQAYPSLLEAQEDVLLLDAQAQAKDSEDAAKVEAKEPPSQSPNTPLQRLVEGYGPAGKILLDLEQALSSEGTQENKVKPLLLQLQRQPQPFLALMQSLDTPETNRTLHLTVLRILKQLVDFPEALLLPWHEAVDACMACLRSPNTDREVLQELIFFLHRLTSVSRDYAVVLNQLGARDAISKALEKHLGKLELAQELRDMVFKCEKHAHLYRKLITNILGGCIQMVLGQIEDHRRTHRPINIPFFDVFLTLSP

SEQ ID NO: 909938 - protein, 543 aa, Homo sapiens
MVGELRYREFRVPLGPGLHAYPDELIRQRVGHDGHPEYQIRWLILRRGDEGDGGSGQVDCKAEHILLWMSKDEIYANCHKMLGEDGQVIGPSQESAGEVGALDKSVLEEMETDVKSLIQRALRQLEECVGTIPPAPLLHTVHVLSAYASIEPLTGVFKDPRVLDLLMHMLSSPDYQIRWSAGRMIQALSSHDAGTRTQILLSLSQQEAIEKHLDFDSRCALLALFAQATLSEHPMSFEGIQLPQVPGRVLFSLVKRYLHVTSLLDQLNDSAAEPGAQNTSAPEELSGERGQLELEFSMAMGTLISELVQAMRWDQASDRPRSSARSPGSIFQPQLADVSPGLPAAQAQPSFRRSRRFRPRSEFASGNTYALYVRDTLQPGMRVRMLDDYEEISAGDEGEFRQSNNGVPPVQVFWESTGRTYWVHWHMLEILGFEEDIEDMVEADEYQGAVASRVLGRALPAWRWRPMTELYAVPYVLPEDEDTEECEHLTLAEWWELLFFIKKLDGPDHQEVLQILQENLDGEVEPAWRHSEVGGLYCKGWTV

SEQ ID NO: 909939 - protein, 543 aa, Homo sapiens; identical to SEQ ID NO: 909938

SEQ ID NO: 909940 - protein, 117 aa, Homo sapiens
LSRHSWPVASICHTLNPRTCLPSYLRGTLNRYSNFYNKSEQPGRGTGDWGEGGLLGKDLGLGADPDVGRLDVKRDSLWLGTVLTPVIPALWEAEAGRSLEVRSSRPALANMVKPRLC

SEQ ID NO: 909941 - protein, 63 aa, Homo sapiens
MAFLCSAIAQVSEQFARHIDQQIQGSRIGGAQEMERLAQLQQCLQAVLIFSGLEIATTFEHYY

SEQ ID NO: 909942 - protein, 100 aa, Homo sapiens
KIVLCVFQGGIDTRIRGLEILGPKPTFWPVFREQLCRHTRLFYMVRAQAWSQDMAEDRRSLLHLSSRCVRVCVYACVCGKGKAIANSWQAGVHRSCEMEV

SEQ ID NO: 909943 - protein, 1698 aa, Homo sapiens
MVGELRYREFRVPLGPGLHAYPDELIRQRVGHDGHPEYQIRWLILRRGDEGDGGSGQVDCKAEHILLWMSKDEIYANCHKMLGEDGQVIGPSQESAGEVGALDKSVLEEMETDVKSLIQRALRQLEECVGTIPPAPLLHTVHVLSAYASIEPLTGVFKDPRVLDLLMHMLSSPDYQIRWSAGRMIQALSSHDAGTRTQILLSLSQQEAIEKHLDFDSRCALLALFAQATLSEHPMSFEGIQLPQVPGRVLFSLVKRYLHVTSLLDQLNDSAAEPGAQNTSAPEELSGERGQLELEFSMAMGTLISELVQAMRWDQASDRPRSSARSPGSIFQPQLADVSPGLPAAQAQPSFRRSRRFRPRSEFASGNTYALYVRDTLQPGMRVRMLDDYEEISAGDEGEFRQSNNGVPPVQVFWESTGRTYWVHWHMLEILGFEEDIEDMVEADEYQGAVASRVLGRALPAWRWRPMTELYAVPYVLPEDEDTEECEHLTLAEWWELLFFIKKLDGPDHQEVLQILQENLDGEILDDEILAELAVPIELAQDLLLTLPQRLNDSALRDLINCHVYKKYGPEALAGNQAYPSLLEAQEDVLLLDAQAQAKDSEDAAKVEAKEPPSQSPNTPLQRLVEGYGPAGKILLDLEQALSSEGTQENKVKPLLLQLQRQPQPFLALMQSLDTPETNRTLHLTVLRILKQLVDFPEALLLPWHEAVDACMACLRSPNTDREVLQELIFFLHRLTSVSRDYAVVLNQLGARDAISKALEKHLGKLELAQELRDMVFKCEKHAHLYRKLITNILGGCIQMVLGQIEDHRRTHRPINIPFFDVFLRYLCQGSSVEVKEDKCWEKVEVSSNPHRASKLTDHNPKTYWESNGSAGSHYITLHMRRGILIRQLTLLVASEDSSYMPARVVVCGGDSTSSLHTELNSVNVMPSASRVILLENLTRFWPIIQIRIKRCQQGGIDTRIRGLEILGPKPTFWPVFREQLCRHTRLFYMVRAQAWSQDMAEDRRSLLHLSSRLNGALRQEQNFADRFLPDDEAAQALGKTCWEALVSPVVQNITSPDEDGISPLGWLLDQYLECQEAVFNPQSRGPAFFSRVRRLTHLLVHVEPCEAPPPVVATPRPKGRNRSHDWSSLATRGLPSSIMRNLTRCWRAVVEKQVNNFLTSSWRDDDFVPRYCEHFNILQNSSSELFGPRAAFLLALQNGCAGALLKLPFLKAAHVSEQFARHIDQQIQGSRIGGAQEMERLAQLQQCLQAVLIFSGLEIATTFEHYYQHYMADRLLGVVSSWLEGAVLEQIGPCFPNRLPQQMLQSLSTSKELQRQFHVYQLQQLDQELLKLEDTEKKIQVGLGASGKEHKSEKEEEAGAAAVVDVAEGEEEEEENEDLYYEGAMPEVSVLVLSRHSWPVASICHTLNPRTCLPSYLRGTLNRYSNFYNKSQSHPALERGSQRRLQWTWLGWAELQFGNQTLHVSTVQMWLLLYLNDLKAVSVESLLAFSGLSADMLNQAIGPLTSSRGPLDLHEQKDIPGGVLKIRDGSKEPRSRWDIVRLIPPQTYLQAEGEDGQNLEKRRNLLNCLIVRILKAHGDEGLHIDQLVCLVLEAWQKGPCPPRGLVSSLGKGSACSSTDVLSCILHLLGKGTLRRHDDRPQVLSYAVPVTVMEPHTESLNPGSSGPNPPLTFHTLQIRSRGVPYASCTATQSFSTFR

SEQ ID NO: 909944 - protein, 1730 aa, Homo sapiens [sequence omitted]

SEQ ID NO: 909945 - protein, 1716 aa, Homo sapiens
RLGDVRQSNNGVLLCRYFGSQQAAPIGCTGTCVEILGFEEDIEDMVEAEHILLWMSKDEIYANCHKMLGEDGQVIGPSQESAGEVGALDKSVLEEMETDVKSLIQRALRQLEECVGTIPPAPLLHTVHVLSAYASIEPLTGVFKDPRVLDLLMHMLSSPDYQIRWSAGRMIQALSSHDAGEGQCGEEGKAGEGLGRLRDSQDTVAGASDLIRTRTQILLSLSQQEAIEKHLDFDSRCALLALFAQATLSEHPMSFEGIQLPQVPGRVLFSLVKRYLHVTSLLDQLNDSAAEPGAQNTSAPEELSGERGQLELEFSMAMGTLISELVQAMRWDQASDRPRSSARSPGSIFQPQLADVSPGLPAAQAQPSFRRSRRFRPRSEFASGNTYALYVRDTLQPGMRVRMLDDYEEISAGDEGEFRQSNNGVPPVQVFWESTGRTYWVHWHMLEILGFEEDIEDMVEADEYQGAVASRVLGRALPAWRWRPMTELYAVPYVLPEDEDTEECEHLTLAEWWELLFFIKKLDGPDHQEVLQILQENLDGEILDDEILAELAVPIELAQDLLLTLPQRLNDSALRDLINCHVYKKYGPEALAGNQAYPSLLEAQEDVLLLDAQAQAKDSEDAAKVEAKEPPSQSPNTPLQRLVEGYGPAGKILLDLEQALSSEGTQENKVKPLLLQLQRQPQPFLALMQSLDTPETNRTLHLTVLRILKQLVDFPEALLLPWHEAVDACMACLRSPNTDREVLQELIFFLHRLTSVSRDYAVVLNQLGARDAISKALEKHLGKLELAQELRDMVFKCEKHAHLYRKLITNILGGCIQMVLGQIEDHRRTHRPINIPFFDVFLRYLCQGSSVEVKEDKCWEKVEVSSNPHRASKLTDHNPKTYWESNGSAGSHYITLHMRRGILIRQLTLLVASEDSSYMPARVVVCGGDSTSSLHTELNSVNVMPSASRVILLENLTRFWPIIQIRIKRCQQGGIDTRIRGLEILGPKPTFWPVFREQLCRHTRLFYMVRAQAWSQDMAEDRRSLLHLSSRLNGALRQEQNFADRFLPDDEAAQALGKTCWEALVSPVVQNITSPDEDGISPLGWLLDQYLECQEAVFNPQSRGPAFFSRVRRLTHLLVHVEPCEAPPPVVATPRPKGRNRSHDWSSLATRGLPSSIMRNLTRCWRAVVEKQVNNFLTSSWRDDDFVPRYCEHFNILQNSSSELFGPRAAFLLALQNGCAGALLKLPFLKAAHVSEQFARHIDQQIQGSRIGGAQEMERLAQLQQCLQAVLIFSGLEIATTFEHYYQHYMADRLLGVVSSWLEGAVLEQIGPCFPNRLPQQMLQSLSTSKELQRQFHVYQLQQLDQELLKLEDTEKKIQVGLGASGKEHKSEKEEEAGAAAVVDVAEGEEEEEENEDLYYEGAMPEVSVLVLSRHSWPVASICHTLNPRTCLPSYLRGTLNRYSNFYNKSQSHPALERGSQRRLQWTWLGWAELQFGNQTLHVSTVQMWLLLYLNDLKAVSVESLLAFSGLSADMLNQAIGPLTSSRGPLDLHEQKDIPGGVLKIRDGSKEPRSRWDIVRLIPPQTYLQAEGEDGQNLEKRRNLLNCLIVRILKAHGDEGLHIDQLVCLVLEAWQKGPCPPRGLVSSLGKGSACSSTDVLSCILHLLGKGTLRRHDDRPQVLSYAVPVTVMEPHTESLNPGSSGPNPPLTFHTLQIRSRGVPYASCTATQSFSTFR

SEQ ID NO: 909946 - protein, 912 aa, Homo sapiens
GNEPWLLAGGAAGRDRAPPCPSGCRLTRVQLCSAEARPPRSEFASGNTYALYVRDTLQPGMRVRMLDDYEEISAGDEGEFRQSNNGVPPVQVFWESTGRTYWVHWHMLEILGFEEDIEDMVEADEYQGAVASRVLGRALPAWRWRPMTELYAVPYVLPEDEDTEECEHLTLAEWWELLFFIKKLDGPDHQEVLQILQENLDGEILDDEILAELAVPIELAQDLLLTLLNGALRQEQNFADRFLPDDEAAQALGKTCWEALVSPVVQNITSPDEDGISPLGWLLDQYLECQEAVFNPQSRGPAFFSRVRRLTHLLVHVEPCEAPPPVVATPRPKGRNRSHDWSSLATRGLPSSIMRNLTRCWRAVVEKQVNNFLTSSWRDDDFVPRYCEHFNILQNSSSELFGPRAAFLLALQNGCAGALLKLPFLKAAHVSEQFARHIDQQIQGSRIGGAQEMERLAQLQQCLQAVLIFSGLEIATTFEHYYQHYMADRLLGVVSSWLEGAVLEQIGPCFPNRLPQQMLQSLSTSKELQRQFHVYQLQQLDQELLKLEDTEKKIQVGLGASGKEHKSEKEEEAGAAAVVDVAEGEEEEEENEDLYYEGAMPEVSVLVLSRHSWPVASICHTLNPRTCLPSYLRGTLNRYSNFYNKSQSHPALERGSQRRLQWTWLGWAELQFGNQTLHVSTVQMWLLLYLNDLKAVSVESLLAFSGLSADMLNQAIGPLTSSRGPLDLHEQKDIPGGVLKIRDGSKEPRSRWDIVRLIPPQTYLQAEGEDGQNLEKRRNLLNCLIVRILKAHGDEGLHIDQLVCLVLEAWQKGPCPPRGLVSSLGKGSACSSTDVLSCILHLLGKGTLRRHDDRPQVLSYAVPVTVMEPHTESLNPGSSGPNPPLTFHTLQIRSRGVPYASCTATQSFSTFR

SEQ ID NO: 909947 - protein, 543 aa, Homo sapiens; identical to SEQ ID NO: 909938

SEQ ID NO: 909948 - protein, 543 aa, Homo sapiens; identical to SEQ ID NO: 909938

SEQ ID NO: 909949 - protein, 45 aa, Homo sapiens
MPSASRVILLENLTRFWPIIQIRIKRCQQVGPGMWGVALGRGSEP

SEQ ID NO: 909950 - protein, 119 aa, Homo sapiens [sequence omitted]

SEQ ID NO: 909951 - protein, 126 aa, Homo sapiens
MAGRGKLIAVIGDEDTVTGFLLGGIGELNKNRHPNFLVVEKDTTINEIEDTFRSLGSLPGSVVEANPNQRDPPLWDEIDSRQFLNRDDIGIILINQYIAEMVRHALDAHQQSIPAVLGDPLQGAPI

SEQ ID NO: 909952 - protein, 119 aa, Homo sapiens [sequence omitted]

SEQ ID NO: 909953 - protein, 119 aa, Homo sapiens [sequence omitted]

SEQ ID NO: 909954 - protein, 119 aa, Homo sapiens [sequence omitted]

SEQ ID NO: 909955 - protein, 261 aa, Homo sapiens
MNPEWGQAFVHVAVAGGLCAVAVFTGIFDSVSVQVGYEHYAEAPVAGLPAFLAMPFNSLVNMAYTLLGLSWLHRGGAMGLGPRYLKDVFAAMALLYGPVQWLRLWTQWRRAAVLDQWLTLPIFAWPVAWCLYLDRGWRPWLFLSLECVSLASYGLALLHPQGFEVALGAHVVAAVGQALRTHRHYGSTTSATYLALGVLSCLGFVVLKLCDHQLARWRLFQCLTGHFWSKVCDVLQFHFAFLFLTHFNTHPRFHPSGGKTR

SEQ ID NO: 909956 - protein, 208 aa, Homo sapiens
MPFNSLVNMAYTLLGLSWLHRGGAMGLGPRYLKDVFAAMALLYGPVQWLRLWTQWRRAAVLDQWLTLPIFAWPVAWCLYLDRGWRPWLFLSLECVSLASYGLALLHPQGFEVALGAHVVAAVGQALRTHRHYGSTTSATYLALGVLSCLGFVVLKLCDHQLARWRLFQCLTGHFWSKVCDVLQFHFAFLFLTHFNTHPRFHPSGGKTR

SEQ ID NO: 909957 - protein, 261 aa, Homo sapiens; identical to SEQ ID NO: 909955

SEQ ID NO: 909958 - protein, 261 aa, Homo sapiens; identical to SEQ ID NO: 909955

SEQ ID NO: 909959 - protein, 246 aa, Homo sapiens
RTATAAAPAAGKRAFSRPAHPAAAGGGPRRAAGEPGAGRQWEATQPSAGARGWSLRPLPGSQAAGPALGRHRLRPRRSKMSRAARPRPPRARPPPLPRGPQSGRWRTSRAGDRGRRPRHLASPRPARFPGFESRPARRRTGAARILPFRRFEFPPARRVRRNTRMVIAGLFAPILKKAERSSAGASQSAGLLPSFGARSQHLPRKSRNHGASFCWLSREAQSVLQRLRIEGCSLKLPAPGHAAGSR

SEQ ID NO: 909960 - protein, 261 aa, Homo sapiens; identical to SEQ ID NO: 909955

SEQ ID NO: 909961 - protein, 379 aa, Homo sapiens
MEQLSSANTRFALDLFLALSENNPAGNIFISPFSISSAMAMVFLGTRGNTAAQLSKTFHFNTVEEVHSRFQSLNADINKRGASYILKLANRLYGEKTYNFLPEFLVSTQKTYGADLASVDFQHASEDARKTINQWVKGQTEGKIPELLASGMVDNMTKLVLVNAIYFKGNWKDKFMKEATTNAPFRLNKKDRKTVKMMYQKKKFAYGYIEDLKCRVLELPYQGEELSMVILLPDDIEDESTGLKKIEEQLTLEKLHEWTKPENLDFIEVNVSLPRFKLEESYTLNSDLARLGVQDLFNSSKADLSGMSGARDIFISKIVHKSFVEVNEEGTEAAAATAGIATFCMLMPEENFTADHPFLFFIRHNSSGSILFLGRFSSP

SEQ ID NO: 909962 - protein, 156 aa, Homo sapiens
ANSLVIEYLVLVWNKKAGRKYKIQDASGRLAEIEEASGEIVLPNLLAWAVGTMRTLFCVAVFTMEQLSSANTRFALDLFLALSENNPAGNIFISPFSISSAMAMVFLGTRGNTAAQLSKVSRNKKKGLLSSHLPTNGQSAWKGCAFELLPCVFRTV

SEQ ID NO: 909963 - protein, 167 aa, Homo sapiens
RSLLLALRRPRELGLLRSHREGPPPRPRLLARVTLPPAIRAAALGASFLTSHPARSPERASAACRVRPGLGAVARGRARGEARLPRSASSPAPPTPQAQAPQTRSSLRSPSPPASRPHPFRAPRRRQTTSDPPPPPGYRPGQPAREGGREDDRCRRKARLKPEIRML

SEQ ID NO: 909964 - protein, 379 aa, Homo sapiens; identical to SEQ ID NO: 909961

SEQ ID NO: 909965 - protein, 379 aa, Homo sapiens; identical to SEQ ID NO: 909961

SEQ ID NO: 909966 - protein, 390 aa, Homo sapiens [sequence omitted]

SEQ ID NO: 909967 - protein, 390 aa, Homo sapiens [sequence omitted]

SEQ ID NO: 909968 - protein, 339 aa, Homo sapiens
MVFLGTRGNTAAQLSKTFHFNTVEEVHSRFQSLNADINKRGASYILKLANRLYGEKTYNFLPEFLVSTQKTYGADLASVDFQHASEDARKTINQWVKGQTEGKIPELLASGMVDNMTKLVLVNAIYFKGNWKDKFMKEATTNAPFRLNKKDRKTVKMMYQKKKFAYGYIEDLKCRVLELPYQGEELSMVILLPDDIEDESTGLKKIEEQLTLEKLHEWTKPENLDFIEVNVSLPRFKLEESYTLNSDLARLGVQDLFNSSKADLSGMSGARDIFISKIVHKSFVEVNEEGTEAAAATAGIATFCMLMPEENFTADHPFLFFIRHNSSGSILFLGRFSSP

SEQ ID NO: 909969 - protein, 402 aa, Homo sapiens
MEQLSSANTRFALDLFLALSENNPAGNIFISPFSISSAMAMVFLGTRGNTAAQLSKVSRNKKRVCFPPISLRMDSLHGKTFHFNTVEEVHSRFQSLNADINKRGASYILKLANRLYGEKTYNFLPEFLVSTQKTYGADLASVDFQHASEDARKTINQWVKGQTEGKIPELLASGMVDNMTKLVLVNAIYFKGNWKDKFMKEATTNAPFRLNKKDRKTVKMMYQKKKFAYGYIEDLKCRVLELPYQGEELSMVILLPDDIEDESTGLKKIEEQLTLEKLHEWTKPENLDFIEVNVSLPRFKLEESYTLNSDLARLGVQDLFNSSKADLSGMSGARDIFISKIVHKSFVEVNEEGTEAAAATAGIATFCMLMPEENFTADHPFLFFIRHNSSGSILFLGRFSSP

SEQ ID NO: 909970 - protein, 252 aa, Homo sapiens
NSRPRRHGCEKTTEGKIPELLASGMVDNMTKLVLVNAIYFKGNWKDKFMKEATTNAPFRLNKKDRKTVKMMYQKKKFAYGYIEDLKCRVLELPYQGEELSMVILLPDDIEDESTGLKKIEEQLTLEKLHEWTKPENLDFIEVNVSLPRFKLEESYTLNSDLARLGVQDLFNSSKADLSGMSGARDIFISKIVHKSFVEVNEEGTEAAAATAGIATFCMLMPEENFTADHPFLFFIRHNSSGSILFLGRFSSP

SEQ ID NO: 909971 - protein, 224 aa, Homo sapiens
MEQLSSANTRFALDLFLALSENNPAGNIFISPFSISSAMAMVFLGTRGNTAAQLSKTFHFNTVEEVHSRFQSLNADINKRGASYILKLANRLYGEKTYNFLPEFLVSTQKTYGADLASVDFQHASEDARKTINQWVKGQTEGKIPELLASGMVDNMTKLVLVNAIYFKGNWKDKFMKEATTNAPFRLNKKISLPTIHSFSLFGIIPQVASYSWGDFLPLRRKRL

SEQ ID NO: 909972 - protein, 207 aa, Homo sapiens
MEQLSSANTRFALDLFLALSENNPAGNIFISPFSISSAMAMVFLGTRGNTAAQLSKTFHFNTVEEVHSRFQSLNADINKRGASYILKLANRLYGEKTYNFLPEFLVSTQKTYGADLASVDFQHASEDARKTINQWVKGQTEGKIPELLASGMVDNMTKLVLVNAIYFKGNWKDKFMKEATTNAPFRLNKSDLITNDRQDSKGPFLLQ

SEQ ID NO: 909973 - protein, 68 aa, Homo sapiens
RSLLLALRRPRELGLLRSHREGPPPRPRLLARVTLPPAIRAAALGASFLTSHPARSPERASAACRSCL

SEQ ID NO: 909974 - protein, 117 aa, Homo sapiens
YYYYIPPRRRLPRFKLEESYTLNSDLARLGVQDLFNSSKADLSGMSGARDIFISKIVHKSFVEVNEEGTEAAAATAGIATFCMLMPEENFTADHPFLFFIRHNSSGSILFLGRFSSP

SEQ ID NO: 909975 - protein, 379 aa, Homo sapiens; identical to SEQ ID NO: 909961

SEQ ID NO: 909976 - protein, 379 aa, Homo sapiens; identical to SEQ ID NO: 909961

SEQ ID NO: 909977 - protein, 379 aa, Homo sapiens; identical to SEQ ID NO: 909961

SEQ ID NO: 909978 - protein, 410 aa, Homo sapiens
PPPPHLRSTARGTRPRQLGAGACLGGLSVFTMEQLSSANTRFALDLFLALSENNPAGNIFISPFSISSAMAMVFLGTRGNTAAQLSKTFHFNTVEEVHSRFQSLNADINKRGASYILKLANRLYGEKTYNFLPEFLVSTQKTYGADLASVDFQHASEDARKTINQWVKGQTEGKIPELLASGMVDNMTKLVLVNAIYFKGNWKDKFMKEATTNAPFRLNKKDRKTVKMMYQKKKFAYGYIEDLKCRVLELPYQGEELSMVILLPDDIEDESTGLKKIEEQLTLEKLHEWTKPENLDFIEVNVSLPRFKLEESYTLNSDLARLGVQDLFNSSKADLSGMSGARDIFISKIVHKSFVEVNEEGTEAAAATAGIATFCMLMPEENFTADHPFLFFIRHNSSGSILFLGRFSSP

SEQ ID NO: 909979 - protein, 228 aa, Homo sapiens
MVDNMTKLVLVNAIYFKGNWKDKFMKEATTNAPFRLNKKDRKTVKMMYQKKKFAYGYIEDLKCRVLELPYQGEELSMVILLPDDIEDESTGLKKIEEQLTLEKLHEWTKPENLDFIEVNVSLPRFKLEESYTLNSDLARLGVQDLFNSSKADLSGMSGARDIFISKIVHKSFVEVNEEGTEAAAATAGIATFCMLMPEENFTADHPFLFFIRHNSSGSILFLGRFSSP

SEQ ID NO: 909980 - protein, 361 aa, Homo sapiens
MEQLSSANTRFALDLFLALSENNPAGNIFISPFSISSAMAMVFLGTRGNTAAQLSKTFHFNTVEEVHSRFQSLNADINKRGASYILKLANRLYGEKTYNFLPEFLVSTQKTYGADLASVDFQHASEDARKTINQWVKGQTEGKIPELLASGMVDNMTKLVLVNAIYFKGNWKDKFMKEATTNAPFRLNKKDRKTVKMMYQKNYQGEELSMVILLPDDIEDESTGLKKIEEQLTLEKLHEWTKPENLDFIEVNVSLPRFKLEESYTLNSDLARLGVQDLFNSSKADLSGMSGARDIFISKIVHKSFVEVNEEGTEAAAATAGIATFCMLMPEENFTADHPFLFFIRHNSSGSILFLGRFSSP

SEQ ID NO: 909981 - protein, 204 aa, Homo sapiens
MEQLSSANTRFALDLFLALSENNPAGNIFISPFSISSAMAMVFLGTRGNTAAQLSKTFHFNTVEEVHSRFQSLNADINKRGASYILKLANRLYGEKTYNFLPEFLVSTQKTYGADLASVDFQHASEDARKTINQWVKGQTEGKIPELLASGMVDNMTKLVLVNAIYFKGNWKDKFMKEATTNAPFRLNKKDRKTVKMMYQKKKL

SEQ ID NO: 909982 - protein, 88 aa, Homo sapiens
LVLARDLELVADLSGMSGARDIFISKIVHKSFVEVNEEGTEAAAATAGIATFCMLMPEENFTADHPFLFFIRHNSSGSILFLGRFSSP

SEQ ID NO: 909983 - protein, 103 aa, Homo sapiens
MESLCAGHVIRFLSPPSLPAVIPSPAPTVLAHIVVTVRGRCRCVKSALHVAGQLSHVRSSPEWKLKHDLTQAAKSFFLISSPKLLKLHFKVKTNIGRRGGSCL

SEQ ID NO: 909984 - protein, 565 aa, Homo sapiens
MIEPFGNQYIVARPVYSTNAFEENHKKTGRHHKTFLDHLKVCCSCSPQKAKRIVLSLFPIASWLPAYRLKEWLLSDIVSGISTGIVAVLQGLAFALLVDIPPVYGLYASFFPAIIYLFFGTSRHISVGPFPILSMMVGLAVSGAVSKAVPDRNATTLGLPNNSNNSSLLDDERVRVAAAASVTVLSGIIQLAFGILRIGFVVIYLSESLISGFTTAAAVHVLVSQLKFIFQLTVPSHTDPVSIFKVLYSVFSQIEKTNIADLVTALIVLLVVSIVKEINQRFKDKLPVPIPIEFIMTVIAAGVSYGCDFKNRFKVAVVGDMNPGFQPPITPDVETFQNTVGDCFGIAMVAFAVAFSVASVYSLKYDYPLDGNQELIALGLGNIVCGVFRGFAGSTALSRSAVQESTGGKTQIAGLIGAIIVLIVVLAIGFLLAPLQKSVLAALALGNLKGMLMQFAEIGRLWRKDKYDCLIWIMTFIFTIVLGLGLGLAASVAFQLLTIVFRTQFPKCSTLANIGRTNIYKNKKDYYDMYEPEGVKIFRCPSPIYFANIGFFRRKLIDAVRFGVI

SEQ ID NO: 909985 - protein, 764 aa, Homo sapiens
MIEPFGNQYIVARPVYSTNAFEENHKKTGRHHKTFLDHLKVCCSCSPQKAKRIVLSLFPIASWLPAYRLKEWLLSDIVSGISTGIVAVLQGLAFALLVDIPPVYGLYASFFPAIIYLFFGTSRHISVGPFPILSMMVGLAVSGAVSKAVPDRNATTLGLPNNSNNSSLLDDERVRVAAAASVTVLSGIIQLAFGILRIGFVVIYLSESLISGFTTAAAVHVLVSQLKFIFQLTVPSHTDPVSIFKVLYSVFSQIEKTNIADLVTALIVLLVVSIVKEINQRFKDKLPVPIPIEFIMTVIAAGVSYGCDFKNRFKVAVVGDMNPGFQPPITPDVETFQNTVGDCFGIAMVAFAVAFSVASVYSLKYDYPLDGNQELIALGLGNIVCGVFRGFAGSTALSRSAVQESTGGKTQIAGLIGAIIVLIVVLAIGFLLAPLQKSVLAALALGNLKGMLMQFAEIGRLWRKDKYDCLIWIMTFIFTIVLGLGLGLAASVAFQLLTIVFRTQFPKCSTLANIGRTNIYKNKKDYYDMYEPEGVKIFRCPSPIYFANIGFFRRKLIDAVGFSPLRILRKRNKALRKIRKLQKQGLLQVTPKGFICTVDTIKDSDEELDNNQIEVLDQPINTTDLPFHIDWNDDLPLNIEVPKISLHSLILDFSAVSFLDVSSVRGLKSILQEFIRIKVDVYIVGTDDDFIEKLNRYEFFDGEVKSSIFFLTIHDAVLHILMKKDYSTSKFNPSQEKDGKIDFTINTNGGLRNRVYEVPVETKF

SEQ ID NO: 909986 - protein, 174 aa, Homo sapiens
MIEPFGNQYIVARPVYSTNAFEENHKKTGRHHKTFLDHLKVCCSCSPQKAKRIVLSLFPIASWLPAYRLKEWLLSDIVSGISTGIVAVLQGLAFALLVDIPPVYGLYASFFPAIIYLFFGTSRHISVGPFPILSMMVGLAVSGAVSKAVPDRNATRKPQAATRKPQAASRKPQA

SEQ ID NO: 909987 - protein, 197 aa, Homo sapiens
RRAAGCCLLPPRAPAAMFNRAVSRLSRKRPPSDIHDSDGSSSSSHQSLKSTAKWAASLENLLEDPEGVKRFREFLKKEFSEENVLFWLACEDFKKMQDKTQMQEKAKEIYMTFLSSKASSQVNVEGQSRLNEKILEEPHPLMFQKLQDQIFNLMKYDSYSRFLKSDLFLKHKRTEEEEEDLPDAQTAAKRASRIYNT

SEQ ID NO: 909988 - protein, 192 aa, Homo sapiens
HYRARAAARAVDCWSAWNFSGGHQSMEHIHDSDGSSSSSHQSLKSTAKWAASLENLLEDPEGVKRFREFLKKEFSEENVLFWLACEDFKKMQDKTQMQEKAKEIYMTFLSSKASSQVNVEGQSRLNEKILEEPHPLMFQKLQDQIFNLMKYDSYSRFLKSDLFLKHKRTEEEEEDLPDAQTAAKRASRIYNT

SEQ ID NO: 909989 - protein, 212 aa, Homo sapiens
MLRLVFSSDPRVLGSPPVSAFLTQGVSGKAVDCWSAWNFSGGHQSMEHIHDSDGSSSSSHQSLKSTAKWAASLENLLEDPEGVKRFREFLKKEFSEENVLFWLACEDFKKMQDKTQMQEKAKEIYMTFLSSKASSQVNVEGQSRLNEKILEEPHPLMFQKLQDQIFNLMKYDSYSRFLKSDLFLKHKRTEEEEEDLPDAQTAAKRASRIYNT

SEQ ID NO: 909990 - protein, 173 aa, Homo sapiens
MQSELCFADIHDSDGSSSSSHQSLKSTAKWAASLENLLEDPEGVKRFREFLKKEFSEENVLFWLACEDFKKMQDKTQMQEKAKEIYMTFLSSKASSQVNVEGQSRLNEKILEEPHPLMFQKLQDQIFNLMKYDSYSRFLKSDLFLKHKRTEEEEEDLPDAQTAAKRASRIYNT

SEQ ID NO: 909991 - protein, 147 aa, Homo sapiens
LEPNSPKAPGSSQISHATSPDLCVLMGKVGLTENALCCMSRGLRKWDPSKQMQEKAKEIYMTFLSSKASSQVNVEGQSRLNEKILEEPHPLMFQKLQDQIFNLMKYDSYSRFLKSDLFLKHKRTEEEEEDLPDAQTAAKRASRIYNT

SEQ ID NO: 909992 - protein, 218 aa, Homo sapiens
RRAAGCCLLPPRAPAAMFNRAVSRLSRKRPPSDIHDSDGSSSSSHQSLKSTAKWAASLENLLEDPEGVKRFREFLKKEFSEENVLFWLACEDFKKMQDKTQMQEKAKEIYMTFLSSKASSQVNVEGQSRLNEKILEEPHPLMFQKLQDQIFNLMKYDSYSRFLKSDLFLKKRKKICLMLKLQLKELPEFITHEPPKSRDWNFLSGPCRVYHCFVICKD

SEQ ID NO: 909993 - protein, 197 aa, Homo sapiens; identical to SEQ ID NO: 909987

SEQ ID NO: 909994 - protein, 197 aa, Homo sapiens; identical to SEQ ID NO: 909987

SEQ ID NO: 909995 - protein, 212 aa, Homo sapiens; identical to SEQ ID NO: 909989

SEQ ID NO: 909996 - protein, 170 aa, Homo sapiens
RRAAGCCLLPPRAPAAMFNRAVSRLSRKRPPSDIHDSDGSSSSSHQSLKSTAKWAASLENLLEDPEGVKRFREFLKKEFSEENVLFWLACEDFKKMQDKTQKEAKPKKAAAKDKSSDKKVQTKGKRGAKGKQAEVANQETKEDLPAENGETKTEESPASDEAGEKEAKSD

SEQ ID NO: 909997 - protein, 326 aa, Homo sapiens
QCHPSYSSNQSKHSTWEKGIWHLLPPGSSSSTTSGSFHLERRPLPSSMQLAVIRGDTLRGFDSTDLSQRKLRTRGNGKTVRPSSVYRNGTDIIYNYHGIVSLKLEDDSFPTHKRKAKVSIISQPQKTIKVAELPQADKVESTTDSHFPRQDQLPSFPKNCTLELKGLFHFEEGIQKLYQCNGIAWKAWSPQTKDVEDKSCPAGWHQHSGYCHILITEQKGTWNAAAQACREQYLGNLVTVFSRQHMRWLWDIGGRKSFWIGLNDQVHAGHWEWIGGEPVAFTNGRRGPSPRSKLGKSCVLVQRQGKWQTKDCRRAKPHNYVCSRKL

SEQ ID NO: 909998 - protein, 326 aa, Homo sapiens; identical to SEQ ID NO: 909997

SEQ ID NO: 909999 - protein, 279 aa, Homo sapiens
MQLAVIRGDTLRGFDSTDLSQRKLRTRGNGKTVRPSSVYRNGTDIIYNYHGIVSLKLEDDSFPTHKRKAKVSIISQPQKTIKVAELPQADKVESTTDSHFPRQDQLPSFPKNCTLELKGLFHFEEGIQKLYQCNGIAWKAWSPQTKDVEDKSCPAGWHQHSGYCHILITEQKGTWNAAAQACREQYLGNLVTVFSRQHMRWLWDIGGRKSFWIGLNDQVHAGHWEWIGGEPVAFTNGRRGPSPRSKLGKSCVLVQRQGKWQTKDCRRAKPHNYVCSRKL

SEQ ID NO: 910000 - protein, 348 aa, Homo sapiens [sequence omitted]

SEQ ID NO: 910001 - protein, 120 aa, Homo sapiens
MSNIRSQHAEEQSNNGRYDDCKEFKDLHCSKDSTLAEEESEFPSTSISAVLSDLADLRSCDGQALPSQDPEVALSLSCGHSRGLFSHMQQHDILDTLCRTIESTIHVVTRISGKGNQAAS

SEQ ID NO: 910002 - protein, 679 aa, Homo sapiens
MATLITSTTAATAASGPLVDYLWMLILGFIIAFVLAFSVGANDVANSFGTAVGSGVVTLKQACILASIFETVGSVLLGAKVSETIRKGLIDVEMYNSTQGLLMAGSVSAMFGSAVWQLVASFLKLPISGTHCIVGATIGFSLVAKGQEGVKWSELIKIVMSWFVSPLLSGIMSGILFFLVRAFILHKADPVPNGLRALPVFYACTVGINLFSIMYTGAPLLGFDKLPLWGTILISVGCAVFCALIVWFFVCPRMKRKIEREIKCSPSESPLMEKKNSLKEDHEETKLSVGDIENKHPVSEVGPATVPLQAVVEERTVSFKLGDLEEAPERERLPSVDLKEETSIDSTVNGAVQLPNGNLVQFSQAVSNQINSSGHYQYHTVHKDSGLYKELLHKLHLAKVGDCMGDSGDKPLRRNNSYTSYTMAICGMPLDSFRAKEGEQKGEEMEKLTWPNADSKKRIRMDSYTSYCNAVSDLHSASEIDMSVKAEMGLGDRKGSNGSLEEWYDQDKPEVSLLFQFLQILTACFGSFAHGGNDVSNAIGPLVALYLVYDTGDVSSKVATPIWLLLYGGVGICVGLWVWGRRVIQTMGKDLTPITPSSGFSIELASALTVVIASNIGLPISTTHCKVGSVVSVGWLRSKKAVDWRLFRNIFMAWFVTVPISGVISAAIMAIFRYVILRM

SEQ ID NO: 910003 - protein, 637 aa, Homo sapiens
MATLITSTTAATAASGPLVDYLWMLILGFIIAFVLAFSVGANDVANSFGTAVGSGVVTLKQACILASIFETVGSVLLGAKVSETIRKGLIDVEMYNSTQGLLMAGSVSAMFGSAVWQLVASFLKLPISGTHCIVGATIGFSLVAKGQEGVKWSELIKIVMSWFVSPLLSGIMSGILFFLVRAFILHKADPVPNGLRALPVFYACTVGINLFSIMYTGAPLLGFDKLPLWGTILISVGCAVFCALIVWFFVCPRMKRKIERPATVPLQAVVEERTVSFKLGDLEEAPERERLPSVDLKEETSIDSTVNGAVQLPNGNLVQFSQAVSNQINSSGHYQYHTVHKDSGLYKELLHKLHLAKVGDCMGDSGDKPLRRNNSYTSYTMAICGMPLDSFRAKEGEQKGEEMEKLTWPNADSKKRIRMDSYTSYCNAVSDLHSASEIDMSVKAEMGLGDRKGSNGSLEEWYDQDKPEVSLLFQFLQILTACFGSFAHGGNDVSNAIGPLVALYLVYDTGDVSSKVATPIWLLLYGGVGICVGLWVWGRRVIQTMGKDLTPITPSSGFSIELASALTVVIASNIGLPISTTHCKVGSVVSVGWLRSKKAVDWRLFRNIFMAWFVTVPISGVISAAIMAIFRYVILRM

SEQ ID NO: 910004 - protein, 679 aa, Homo sapiens; identical to SEQ ID NO: 910002

SEQ ID NO: 910005 - protein, 467 aa, Homo sapiens
DAPFYLLVLGFDKLPLWGTILISVGCAVFCALIVWFFVCPRMKRKIEREIKCSPSESPLMEKKNSLKEDHEETKLSVGDIENKHPVSEVGPATVPLQAVVEERTVSFKLGDLEEAPERERLPSVDLKEETSIDSTVNGAVQLPNGNLVQFSQAVSNQINSSGHYQYHTVHKDSGLYKELLHKLHLAKVGDCMGDSGDKPLRRNNSYTSYTMAICGMPLDSFRAKEGEQKGEEMEKLTWPNADSKKRIRMDSYTSYCNAVSDLHSASEIDMSVKAEMGLGDRKGSNGSLEEWYDQDKPEVSLLFQFLQILTACFGSFAHGGNDVSNAIGPLVALYLVYDTGDVSSKVATPIWLLLYGGVGICVGLWVWGRRVIQTMGKDLTPITPSSGFSIELASALTVVIASNIGLPISTTHCKVGSVVSVGWLRSKKAVDWRLFRNIFMAWFVTVPISGVISAAIMAIFRYVILRM

SEQ ID NO: 910006 - protein, 408 aa, Homo sapiens [sequence omitted]

SEQ ID NO: 910007 - protein, 679 aa, Homo sapiens; identical to SEQ ID NO: 910002

SEQ ID NO: 910008 - protein, 114 aa, Homo sapiens
MEKKNSLKEDHEETKLSVGDIENKHPVSEVGPATVPLQAVVEERTVSFKLGDLEEAPERERLPSVDLKEETSIDSTVNGELEFLVSLLLPAVVRRLIVLDLMLFVLNVTLVILT

SEQ ID NO: 910009 - protein, 679 aa, Homo sapiens; identical to SEQ ID NO: 910002

SEQ ID NO: 910010 - protein, 466 aa, Homo sapiens
MYTGAPLLGFDKLPLWGTILISVGCAVFCALIVWFFVCPRMKRKIEREIKCSPSESPLMEKKNSLKEDHEETKLSVGDIENKHPVSEVGPATVPLQAVVEERTVSFKLGDLEEAPERERLPSVDLKEETSIDSTVNGAVQLPNGNLVQFSQAVSNQINSSGHYQYHTVHKDSGLYKELLHKLHLAKVGDCMGDSGDKPLRRNNSYTSYTMAICGMPLDSFRAKEGEQKGEEMEKLTWPNADSKKRIRMDSYTSYCNAVSDLHSASEIDMSVKAEMGLGDRKGSNGSLEEWYDQDKPEVSLLFQFLQILTACFGSFAHGGNDVSNAIGPLVALYLVYDTGDVSSKVATPIWLLLYGGVGICVGLWVWGRRVIQTMGKDLTPITPSSGFSIELASALTVVIASNIGLPISTTHCKVGSVVSVGWLRSKKAVDWRLFRNIFMAWFVTVPISGVISAAIMAIFRYVILRM

SEQ ID NO: 910011 - protein, 530 aa, Homo sapiens
YFFLMCSIPVMSWFVSPLLSGIMSGILFFLVRAFILHKADPVPNGLRALPVFYACTVGINLFSIMYTGAPLLGFDKLPLWGTILISVGCAVFCALIVWFFVCPRMKRKIEREIKCSPSESPLMEKKNSLKEDHEETKLSVGDIENKHPVSEVGPATVPLQAVVEERTVSFKLGDLEEAPERERLPSVDLKEETSIDSTVNGAVQLPNGNLVQFSQAVSNQINSSGHYQYHTVHKDSGLYKELLHKLHLAKVGDCMGDSGDKPLRRNNSYTSYTMAICGMPLDSFRAKEGEQKGEEMEKLTWPNADSKKRIRMDSYTSYCNAVSDLHSASEIDMSVKAEMGLGDRKGSNGSLEEWYDQDKPEVSLLFQFLQILTACFGSFAHGGNDVSNAIGPLVALYLVYDTGDVSSKVATPIWLLLYGGVGICVGLWVWGRRVIQTMGKDLTPITPSSGFSIELASALTVVIASNIGLPISTTHCKVGSVVSVGWLRSKKAVDWRLFRNIFMAWFVTVPISGVISAAIMAIFRYVILRM

SEQ ID NO: 910012 - protein, 679 aa, Homo sapiens; identical to SEQ ID NO: 910002

SEQ ID NO: 910013 - protein, 90 aa, Homo sapiens
ALTTITPSSGIHAELSLSLTGVIALNIGLSINTTHHTVRIYEGYALLRSKKAVDWRLFRNIFMAWFVTVPISGVISAAIMAIFRYVILRM

SEQ ID NO: 910014 - protein, 386 aa, Homo sapiens
MDKEDALICFEEHIRALEKEEEEEKQKSLLRERRRQRKNRESFQIFLDELHEHGQLHSMSSWMELYPTISSDIRFTNMLGQPGSTALDLFKFYVEDLKARYHDEKKIIKDILKDKGFVVEVNTTFEDFVAIISSTKRSTTLDAGNIKLAFNSLLEKAEAREREREKEEARKMKRKESAFKSMLKQAAPPIELDAVWEDIRERFVKEPAFEDITLESERKRIFKDFMHVLEHECQHHHSKNKKHSKKSKKHHRKRSRSRSGSDSDDDDSHSKKKRQRSESRSASEHSSSAESERSYKKSKKHKKKSKKRRHKSDSPESDAEREKDKKEKDRESEKDRTRQRSESKHKSPKKKTGKDSGNWDTSGSELSEGELEKRRRTLLEQLDDDQ

SEQ ID NO: 910015 - protein, 422 aa, Homo sapiens
NILDNMANVTYSTTWSEAQQYLMDNPTFAEDEELQNMDKEDALICFEEHIRALEKEEEEEKQKSLLRERRRQRKNRESFQIFLDELHEHGQLHSMSSWMELYPTISSDIRFTNMLGQPGSTALDLFKFYVEDLKARYHDEKKIIKDILKDKGFVVEVNTTFEDFVAIISSTKRSTTLDAGNIKLAFNSLLEKAEAREREREKEEARKMKRKESAFKSMLKQAAPPIELDAVWEDIRERFVKEPAFEDITLESERKRIFKDFMHVLEHECQHHHSKNKKHSKKSKKHHRKRSRSRSGSDSDDDDSHSKKKRQRSESRSASEHSSSAESERSYKKSKKHKKKSKKRRHKSDSPESDAEREKDKKEKDRESEKDRTRQRSESKHKSPKKKTGKDSGNWDTSGSELSEGELEKRRRTLLEQLDDDQ

SEQ ID NO: 910016 - protein, 386 aa, Homo sapiens; identical to SEQ ID NO: 910014

SEQ ID NO: 910017 - protein, 213 aa, Homo sapiens
NILDNMANVTYSTTWSEAQQYLMDNPTFAEDEELQNMDKEDALICFEEHIRALEKEEEEEKQKSLLRERRRQRKNRESFQIFLDELHEHGQLHSMSSWMELYPTISSDIRFTNMLGQPGSTALDLFKFYVEDLKARYHDEKKIIKDILKDKGFVVEVNTTFEDFVAIISSTKRSTTLDAGNIKLAFNSLLEKAEAREREREKEEARKYVVGSM

SEQ ID NO: 910018 - protein, 386 aa, Homo sapiens; identical to SEQ ID NO: 910014

SEQ ID NO: 910019 - protein, 230 aa, Homo sapiens
MIAREREREKEEARKMKRKESAFKSMLKQAAPPIELDAVWEDIRERFVKEPAFEDITLESERKRIFKDFMHVLEHECQHHHSKNKKHSKKSKKHHRKRSRSRSGSDSDDDDSHSKKKRQRSESRSASEHSSSAESERSYKKSKKHKKKSKKRRHKSDSPESDAEREKDKKEKDRESEKDRTRQRSESKHKSPKKKTGKDSGNWDTSGSELSEGELEKRRRTLLEQLDDDQ

SEQ ID NO: 910020 - protein, 175 aa, Homo sapiens
MEKIPVSAFLLLVALSYTLARDTTVKPGAKKDTKDSRPKLPQTLSRGWGDQLIWTQTYEEALYKSKTSNKPLMIIHHLDECPHSQALKKVFAENKEIQKLAEQFVLLNLVYETTDKHLSPDGQYVPRIMFVDPSLTVRADITGRYSNRLYAYEPADTALLLDNMKKALKLLKTEL

SEQ ID NO: 910021 - protein, 188 aa, Homo sapiens
MEKIPVSAFLLLVALSYTLARDTTVKPGAKKDTKDSRPKLPQTLSRGWGDQLIWTQTYEEALYKSKTSNKPLMIIHHLDECPHSQALKKVFAENKEIQKLAEQFVLLNLVYETTDKHLSPDGQYVPRIMFVDPSLTVRADITGRYSNRLYAYEPADTALCKCDLQFGCCPRVEHLYCCSDGTRGCMVR

SEQ ID NO: 910022 - protein, 175 aa, Homo sapiens; identical to SEQ ID NO: 910020

SEQ ID NO: 910023 - protein, 175 aa, Homo sapiens; identical to SEQ ID NO: 910020

SEQ ID NO: 910024 - protein, 200 aa, Homo sapiens
WQDEAWVNRTRRLTQGRWVRKSRVAMEKIPVSAFLLLVALSYTLARDTTVKPGAKKDTKDSRPKLPQTLSRGWGDQLIWTQTYEEALYKSKTSNKPLMIIHHLDECPHSQALKKVFAENKEIQKLAEQFVLLNLVYETTDKHLSPDGQYVPRIMFVDPSLTVRADITGRYSNRLYAYEPADTALLLDNMKKALKLLKTEL

SEQ ID NO: 910025 - protein, 138 aa, Homo sapiens
MQVSQTLSRGWGDQLIWTQTYEEALYKSKTSNKPLMIIHHLDECPHSQALKKVFAENKEIQKLAEQFVLLNLVYETTDKHLSPDGQYVPRIMFVDPSLTVRADITGRYSNRLYAYEPADTALLLDNMKKALKLLKTEL

SEQ ID NO: 910026 - protein, 138 aa, Homo sapiens
SERSRNYLPSWGDQLIWTQTYEEALYKSKTSNKPLMIIHHLDECPHSQALKKVFAENKEIQKLAEQFVLLNLVYETTDKHLSPDGQYVPRIMFVDPSLTVRADITGRYSNRLYAYEPADTALLLDNMKKALKLLKTEL

SEQ ID NO: 910027 - protein, 189 aa, Homo sapiens
MEKIPVSAFLLLVALSYTLARDTTVKPGAKKDTKDSRPKLPQTLSRGWGDQLIWTQTYEEALYKSKTSNKPLMIIHHLDECPHSQALKKVFAENKEIQKLAEQFVLLNLVYETTDKHLSPDGQYVPRIMFVDPSLTVRADITGRYSNRLYAYEPADTALCKCDLQFGCCPRVEHLYCCSDGTRGCMVSA

SEQ ID NO: 910028 - protein, 175 aa, Homo sapiens; identical to SEQ ID NO: 910020

SEQ ID NO: 910029 - protein, 175 aa, Homo sapiens; identical to SEQ ID NO: 910020

SEQ ID NO: 910030 - protein, 175 aa, Homo sapiens; identical to SEQ ID NO: 910020

SEQ ID NO: 910031 - protein, 175 aa, Homo sapiens; identical to SEQ ID NO: 910020

SEQ ID NO: 910032 - protein, 175 aa, Homo sapiens; identical to SEQ ID NO: 910020

SEQ ID NO: 910033 - protein, 176 aa, Homo sapiens
MEKIPVSAFLLLVALSYTLARDTTVKPGAKKDTKDSRPKLPQTLSRGWGDQLIWTQTYEEALYKSKTSNKPLMIIHHLDECPHSQALKKVFAENKEIQKLAEQFVLLNLVYETTDKHLSPDGQYVPRIMFVDPSLTVRADITGRYSNRLYAYEPADTALLLDNMKKAQLWQELCQG

SEQ ID NO: 910034 - protein, 374 aa, Homo sapiens
MKALIFAAAGLLLLLPTFCQSGMENDTNNLAKPTLPIKTFRGAPPNSFEEFPFSALEGWTGATITVKIKCPEESASHLHVKNATMGYLTSSLSTKLIPAIYLLVFVVGVPANAVTLWMLFFRTRSICTTVFYTNLAIADFLFCVTLPFKIAYHLNGNNWVFGEVLCRATTVIFYGNMYCSILLLACISINRYLAIVHPFTYRGLPKHTYALVTCGLVWATVFLYMLPFFILKQEYYLVQPDITTCHDVHNTCESSSPFQLYYFISLAFFGFLIPFVLIIYCYAAIIRTLNAYDHRWLWYVKASLLILVIFTICFAPSNIILIIHHANYYYNNTDGLYFIYLIALCLGSLNSCLDPFLYFLMSKTRNHSTAYLTK

SEQ ID NO: 910035 - protein, 181 aa, Homo sapiens [sequence omitted]

SEQ ID NO: 910036 - protein, 483 aa, Homo sapiens [sequence omitted]

SEQ ID NO: 910037 - protein, 483 aa, Homo sapiens [sequence omitted]

SEQ ID NO: 910038 - protein, 484 aa, Homo sapiens
ICYTLLKTPLGVLIYKQCRSKSDSSPAVLRASRLYQWSLKSSAQFLGSPQLRQVGQIIRVPARMAATLILEPAGRCCWDEPVRIAVRGLAPEQPVTLRASLRDEKGALFQAHARYRADTLGELDLERAPALGGSFAGLEPMGLLWALEPEKPLVRLVKRDVRTPLAVELEVLDGHDPDPGRLLCQTRHERYFLPPGVRREPVRVGRVRGTLFLPPEPGPFPGIVDMFGTGGGLLEYRASLLAGKGFAVMALAYYNYEDLPKTMETLHLEYFEEAMNYLLSHPEVKGPGVGLLGISKGGELCLSMASFLKGITAAVVINGSVANVGGTLRYKGETLPPVGVNRNRIKVTKDGYADIVDVLNSPLEGPDQKSFIPVERAESTFLFLVGQDDHNWKSEFYANEACKRLQAHGRRKPQIICYPETGHYIEPPYFPLCRASLHALVGSPIIWGGEPRAHAMAQVDAWKQLQTFFHKHLGGHEGTIPSKV

SEQ ID NO: 910039 - protein, 286 aa, Homo sapiens [sequence omitted]

SEQ ID NO: 910040 - protein, 301 aa, Homo sapiens
MSNKLLSPHPHSVVLRSEFKMASSPAVLRASRLYQWSLKSSAQFLGSPQLRQYRASLLAGKGFAVMALAYYNYEDLPKTMETLHLEYFEEAMNYLLSHPEVKGPGVGLLGISKGGELCLSMASFLKGITAAVVINGSVANVGGTLRYKGETLPPVGVNRNRIKVTKDGYADIVDVLNSPLEGPDQKSFIPVERAESTFLFLVGQDDHNWKSEFYANEACKRLQAHGRRKPQIICYPETGHYIEPPYFPLCRASLHALVGSPIIWGGEPRAHAMAQVDAWKQLQTFFHKHLGGHEGTIPSKV

SEQ ID NO: 910041 - protein, 255 aa, Homo sapiens
MSNKLLSPHPHSVVLRSEFKMASSPAVLRASRLYQWSLKSSAQFLGSPQLRQVGQIIRVPARMAATLILEPAGRCCWDEPVRIAVRGLAPEQPVTLRASLRDEKGALFQAHARYRADTLGELDLERAPALGGSFAGLEPMGLLWALEPEKPLVRLVKRDVRTPLAVELEVLDGHDPDPGRLLCQTRHERYFLPPGVRREPVRVGRVRGTLFLPPGDSPPLIVPCSFAFHFVCLPRPTLFAYVYAPPPRPRAILPR

SEQ ID NO: 910042 - protein, 295 aa, Homo sapiens
MAATLILEPAGRCCWDEPVRIAVRGLAPEQPVTLRASLRDEKGALFQAHARYRADTLGELDLERAPALGGSFAGLEPMGLLWALEPEKPLVRLVKRDVRTPLAVELEVLDGHDPDPGRLLCRVRHERYFLPPGVRREPVRAGRVRGTLFLPPEPGPFPGIVDMFGTGGGLLEYRASLLAGKEFAVMALAYYNYEDLPKTMETLHLEYFEEAVNYLLSHPEVKGPGVGLLGISKGGELCLSMASFLKGITAAVVINGSVANVGGTLRYKGETLPPVGVNRNRIKVTKDGYADIVDV

SEQ ID NO: 910043 - protein, 483 aa, Homo sapiens [sequence omitted]

SEQ ID NO: 910044 - protein, 485 aa, Homo sapiens
MSNKLLSPHPHSVVLRSEFKMASSPAVLRASRLYQWSLKSSAQFLGSPQLRQVGQIIRVPARMAATLILEPAGRCCWDEPVRIAVRGLAPEQPVTLRASLRDEKGALFQAHARYRADTLGELDLERAPALGGSFAGLEPMGLLWALEPEKPLVRLVKRDVRTPLAVELEVLDGHDPDPGRLLCQTRHERYFLPPGVRREPVRVGRVRGTLFLPPEPGPFPGIVDMFGTGGGLLEYRASLLAGKGFAVMALAYYNYEDLPKTMETLHLEYFEDSYNKPEAQSNPEVKGPGVGLLGISKGGELCLSMASFLKGITAAVVINGSVANVGGTLRYKGETLPPVGVNRNRIKVTKDGYADIVDVLNSPLEGPDQKSFIPVERAESTFLFLVGQDDHNWKSEFYANEACKRLQAHGRRKPQIICYPETGHYIEPPYFPLCRASLHALVGSPIIWGGEPRAHAMAQVDAWKQLQTFFHKHLGGHEGTIPSKV

SEQ ID NO: 910045 - protein, 286 aa, Homo sapiens [sequence omitted]

SEQ ID NO: 910046 - protein, 181 aa, Homo sapiens [sequence omitted]

SEQ ID NO: 910047 - protein, 94 aa, Homo sapiens
GGAFGPQAEPTWIPQALGERHSGCNSPCLARPEAPLSSSVVVLAGLFVMVLILFLGASMVYLIRVARRNQERALRTVWSSGDDKEQLVKNTYVL

SEQ ID NO: 910048 - protein, 254 aa, Homo sapiens
MAQLCGLRRSRAFLALLGSLLLSGVLAADRERSIHDFCLVSKVVGRCRASMPRWWYNVTDGSCQLFVYGGCDGNSNNYLTKEECLKKCATVTENATGDLATSRNAADSSVPSAPRRQDSEDHSSDMFNYERILAPPTQSLGALPVHSFPRWYFDVERNSCNNFIYGGCRGNKNSYRSEEACMLRCFRQQENPPLPLGSKVVVLAGLFVMVLILFLGASMVYLIRVARRNQERALRTVWSSGDDKEQLVKNTYVL

SEQ ID NO: 910049 - protein, 254 aa, Homo sapiens; identical to SEQ ID NO: 910048

SEQ ID NO: 910050 - protein, 254 aa, Homo sapiens; identical to SEQ ID NO: 910048

SEQ ID NO: 910051 - protein, 254 aa, Homo sapiens; identical to SEQ ID NO: 910048

SEQ ID NO: 910052 - protein, 254 aa, Homo sapiens; identical to SEQ ID NO: 910048

SEQ ID NO: 910053 - protein, 261 aa, Homo sapiens
MAQLCGLRRSRAFLALLGSLLLSGVLAADRERSIHDFCLVSKVVGRCRASMPRWWYNVTDGSCQLFVYGGCDGNSNNYLTKEECLKKCATVTENATGDLATSRNAADSSVPSAPRRQDSEDHSSDMFNYERENSKEARILAPPTQSLGALPVHSFPRWYFDVERNSCNNFIYGGCRGNKNSYRSEEACMLRCFRQQENPPLPLGSKVVVLAGLFVMVLILFLGASMVYLIRVARRNQERALRTVWSSGDDKEQLVKNTYVL

SEQ ID NO: 910054 - protein, 271 aa, Homo sapiens
MAQLCGLRRSRAFLALLGSLLLSGVLAADRERSIHDFCLVSKVVGRCRASMPRWWYNVTDGSCQLYGVLGGGLCTRKTRQRNFYPLNTKGDGTGGPVKREHWFANLVKEENATGDLATSRNAADSSVPSAPRRQDSEDHSSDMFNYERILAPPTQSLGALPVHSFPRWYFDVERNSCNNFIYGGCRGNKNSYRSEEACMLRCFRQQENPPLPLGSKVVVLAGLFVMVLILFLGASMVYLIRVARRNQERALRTVWSSGDDKEQLVKNTYVL

SEQ ID NO: 910055 - protein, 234 aa, Homo sapiens
MAQLCGLRRSRAFLALLGSLLLSGVLAADRERSIHDFCLVSKVVGRCRASMPRWWYNVTDGSCQLFVYGGCDGNSNNYLTKEECLKKCATVTAPRRQDSEDHSSDMFNYERILAPPTQSLGALPVHSFPRWYFDVERNSCNNFIYGGCRGNKNSYRSEEACMLRCFRQQENPPLPLGSKVVVLAGLFVMVLILFLGASMVYLIRVARRNQERALRTVWSSGDDKEQLVKNTYVL

SEQ ID NO: 910056 - protein, 199 aa, Homo sapiens
MAQLCGLRRSRAFLALLGSLLLSGVLAADRERSIHDFCLVSKVVGRCRASMPRWWYNVTDGSCQLFVYGGCDGNSNNYLTKEECLKKCATVTENATGDLATSRNAADSSVPSAPRRQDSEDHSSDMFNYERILAPPTQSLGALPVHSFPRWYFDVERNSCNNSMVYLIRVARRNQERALRTVWSSGDDKEQLVKNTYVL

SEQ ID NO: 910057 - protein, 216 aa, Homo sapiens
MAQLCGLRRSRAFLALLGSLLLSGVLAADRERSIHDFCLVSKVVGRCRASMPRWWYNVTDGSCQLFVYGGCDGNSNNYLTKEECLKKCATVTENATGDLATSRNAADSSVPSAPRRQDSEDHSSDMFNYERILAPPTQSLGALPVHSFPRWYFDVERNSCNNFIYGGCRGNKNSYRSEEACMLRCFRRGNLPGPWPRGAGGRPAGGPLGAPRGQNR

SEQ ID NO: 910058 - protein, 256 aa, Homo sapiens
MAQLCGLRRSRAFLALLGSLLLSGVLAADRERSIHDFCLVSKVVGRCRASMPRWWYNVTDGSCQLFVYGGCDGNSNNYLTKEECLKKCATVTENATGDLATSRNAADSSVPSAPRRQDSEDHSSDMFNYERILSRQRSHLGHGRAVLSQRVLDVGKELRENSHKEGPGRKQTRIRWMSGFARRNARRVAKGGHVGRHEGVNHTGPGHLQRGGTHSRASRANDGRNQRSHTRERETHSQPSTRGSERYSSSRECVVH

SEQ ID NO: 910059 - protein, 183 aa, Homo sapiens
MAQLCGLRRSRAFLALLGSLLLSGVLAADRERSIHDFCLVSKVVGRCRASMPRWWYNVTDGSCQLFVYGGCDGNSNNYLTKEECLKKCATVTDATAMRYHRAEHKELGYTFYQVQCRSAEIEKTKGKVRFDIDSPVQSKAPQVVIRSVPTCPLWVPLLDIRNRGSIEGSPATPVNVGGGRPYY

SEQ ID NO: 910060 - protein, 113 aa, Homo sapiens
HRWVPSIKPWSMSPVNFEIQEGIHRKAAARRAENHRLPRNACLPPPPPTLRPVLERRPSSDVVTKPKGRVAGAQRADAPPRPARFCWGRGPRKPRLFPGTRGGPRCAQGRGAA

SEQ ID NO: 910061 - protein, 216 aa, Homo sapiens; identical to SEQ ID NO: 910057

SEQ ID NO: 910062 - protein, 254 aa, Homo sapiens; identical to SEQ ID NO: 910048

SEQ ID NO: 910063 - protein, 254 aa, Homo sapiens; identical to SEQ ID NO: 910048

SEQ ID NO: 910064 - protein, 254 aa, Homo sapiens; identical to SEQ ID NO: 910048

SEQ ID NO: 910065 - protein, 260 aa, Homo sapiens
MAQLCGLRRSRAFLALLGSLLLSGVLAADRERSIHDFCLVSKVVGRCRASMPRWWYNVTDGSCQLFVYGGCDGNSNNYLTKEECLKKCATVTENATGDLATSRNAADSSVPSAPRRQDSEDHSSDMFNYERILAPPTQSLGALPVHSFPRWYFDVERNSCNNFIYGGCRGNKNSYRSEEACMLRCFRCVFSPGQQENPPLPLGSKVVVLAGLFVMVLILFLGASMVYLIRVARRNQERALRTVWSSGDDKEQLVKNTYVL

SEQ ID NO: 910066 - protein, 197 aa, Homo sapiens
MAQLCGLRRSRAFLALLGSLLLSGVLAADRERSIHENATGDLATSRNAADSSVPSAPRRQDSEDHSSDMFNYERILAPPTQSLGALPVHSFPRWYFDVERNSCNNFIYGGCRGNKNSYRSEEACMLRCFRQQENPPLPLGSKVVVLAGLFVMVLILFLGASMVYLIRVARRNQERALRTVWSSGDDKEQLVKNTYVL

SEQ ID NO: 910067 - protein, 244 aa, Homo sapiens
MAQLCGLRRSRAFLALLGSLLLSGVLAADRERSIHDFCLVSKVVGRCRASMPRWWYNVTDGSCQLFVYGGCDGNSNNYLTKEECLKKCATVTENATGDLATSRNAADSSVPSAPRRQDSEDHSSDMFNYERILAPPTQSLGALPVHSFPRWYFDVERNSCNNFIYGGCRGNKNSYRSEEACMLRCFRQQENPPLPLGSKGKWPLTLLLPSACLLPSLTELSPAQLWFTLSFTVNIILAESHVSA

SEQ ID NO: 910068 - protein, 261 aa, Homo sapiens; identical to SEQ ID NO: 910053

SEQ ID NO: 910069 - protein, 94 aa, Homo sapiens; identical to SEQ ID NO: 910047

SEQ ID NO: 910070 - protein, 175 aa, Homo sapiens
MAQLCGLRRSRAFLALLGSLLLSGVLAADRERSIHDFCLVSKVVGRCRASMPRWWYNVTDGSCQLFVYGGCDGNSNNYLTKEECLKKCATVTVGLLWKSSRRLLLAWPAVWQQPRVVSSLIDFFPPGRVFFAYVEFHCLFSHHRSDVGIVSFVCLIYGFFKYKQKFFISILKEGK

SEQ ID NO: 910071 - protein, 699 aa, Homo sapiens
MAEPVSPLKHFVLAKKAITAVFDQLLEFVTEGSHFVEATYKNPELDRIATEDDLVEMQGYKDKLSIIGEVLSRRHMKVAFFGRTSSGKSSVINAMLWDKVLPSGIGHITNCFLSVEGTDGDKAYLMTEGSDEKKSVKTVNQLAHALHMDKDLKAGCLVRVFWPKAKCALLRDDLVLVDSPGTDVTTELDSWIDKFCLDADVFVLVANSESTLMNTEKHFFHKVNERLSKPNIFILNNRWDASASEPEYMEDVRRQHMERCLHFLVEELKVVNALEAQNRIFFVSAKEVLSARKQKAQGMPESGVALAEGFHARLQEFQNFEQIFEECISQSAVKTKFEQHTIRAKQILATVKNIMDSVNLAAEDKEVSCAMTDEICRLSVLVDEFCSEFHPNPDVLKIYKSELNKHIEDGMGRNLADRCTDEVNALVLQTQQEIIENLKPLLPAGIQDKLHTLIPCKKFDLSYNLNYHKLCSDFQEDIVFRFSLGWSSLVHRFLGPRNAQRVLLGLSEPIFQLPRSLASTPTAPTTPATPDNASQEELMITLVTGLASVTSRTSMGIIIVGGVIWKTIGWKLLSVSLTMYGALYLYERLSWTTHAKERAFKQQFVNYATEKLRMIVSSTSANCSHQVKQQIATTFARLCQQVDITQKQLEEEIARLPKEIDQLEKIQNNSKLLRNKAVQLENELENFTKQFLPSSNEES

SEQ ID NO: 910072 - protein, 741 aa, Homo sapiens
MAEPVSPLKHFVLAKKAITAVFDQLLEFVTEGSHFVEATYKNPELDRIATEDDLVEMQGYKDKLSIIGEVLSRRHMKVAFFGRTSSGKSSVINAMLWDKVLPSGIGHITNCFLSVEGTDGDKAYLMTEGSDEKKSVKTVNQLAHALHMDKDLKAGCLVRVFWPKAKCALLRDDLVLVDSPGTDVTTELDSWIDKFCLDADVFVLVANSESTLMNTEKHFFHKVNERLSKPNIFILNNRWDASASEPEYMEDVRRQHMERCLHFLVEELKVVNALEAQNRIFFVSAKEVLSARKQKAQGMPESGVALAEGFHARLQEFQNFEQIFEECISQSAVKTKFEQHTIRAKQILATVKNIMDSVNLAAEDKRHYSVEEREDQIDRLDFIRNQMNLLTLDVKKKIKEVTEEVANKVSCAMTDEICRLSVLVDEFCSEFHPNPDVLKIYKSELNKHIEDGMGRNLADRCTDEVNALVLQTQQEIIENLKPLLPAGIQDKLHTLIPCKKFDLSYNLNYHKLCSDFQEDIVFRFSLGWSSLVHRFLGPRNAQRVLLGLSEPIFQLPRSLASTPTAPTTPATPDNASQEELMITLVTGLASVTSRTSMGIIIVGGVIWKTIGWKLLSVSLTMYGALYLYERLSWTTHAKERAFKQQFVNYATEKLRMIVSSTSANCSHQVKQQIATTFARLCQQVDITQKQLEEEIARLPKEIDQLEKIQNNSKLLRNKAVQLENELENFTKQFLPSSNEES

SEQ ID NO: 910073 - protein, 741 aa, Homo sapiens; identical to SEQ ID NO: 910072

SEQ ID NO: 910074 - protein, 746 aa, Homo sapiens
MAEPVSPLKHFVLAKKAITAVFDQLLEFVTEGSHFVEATYKNPELDRIATEDDLVEMQGYKDKLSIIGEVLSRRHMKVAFFGRTSSGKSSVINAMLWDKVLPSGIGHITNCFLSVEGTDGDKAYLMTEGSDEKKSVKTVNQLAHALHMDKDLKAGCLVRVFWPKAKCALLRDDLVLVDSPGTDVTTELDSWIDKFCLDADVFVLVANSESTLMNTEKHFFHKVNERLSKPNIFILNNRWDASASEPEYMEDVRRQHMERCLHFLVEELKVVNALEAQNRIFFVSAKEVLSARKQKAQGMPESGVALAEGFHARLQEFQNFEQIFEECISQSAVKTKFEQHTIRAKQILATVKNIMDSVNLAAEDKRHYSVEEREDQIDRLDFIRNQMNLLTLDVKKKIKEVTEEVANKVSCAMTDEICRLSVLVDEFCSEFHPNPDVLKIYKSELNKHIEDGMGRNLADRCTDEVNALVLQTQQEIIENLKPLLPAGIQDKLHTLIPCKKFDLSYNLNYHKLCSDFQEDIVFRFSLGWSSLVHRFLGPRNAQRVLLGLSEPIFQLPRSLASTPTAPTTPATPDNASQEELMITLVTGLASVTSRTSMGIIIVGGVIWKTIGWKLLSVSLTMYGALYLYERLSWTTHAKERAFKQQFVNYATEKLRMIVSSTSANCSHQVKQQIATTFARLCQQVDITQKQLEEEIARLPKEIDQLEKIQNNSKLLRILTIEIALVTMIGGNETCKIGTVVIFMKLL

SEQ ID NO: 910075 - protein, 386 aa, Homo sapiens
MAEPVSPLKHFVLAKKAITAVFDQLLEFVTEGSHFVEATYKNPELDRIATEDDLVEMQGYKDKLSIIGEVLSRRHMKVAFFGRTSSGKSSVINAMLWDKVLPSGIGHITNCFLSVEGTDGDKAYLMTEGSDEKKSVKTVNQLAHALHMDKDLKAGCLVRVFWPKAKCALLRDDLVLVDSPGTDVTTELDSWIDKFCLDADVFVLVANSESTLMNTEKHFFHKVNERLSKPNIFILNNRWDASASEPEYMEDVRRQHMERCLHFLVEELKVVNALEAQNRIFFVSAKEVLSARKQKAQGMPESGVALAEGFHARLQEFQNFEQIFEECISQSAVKTKFEQHTIRAKQILATVKNIMDSVNLAAEDKRYEFILLQHKNVSFFVRLLLR

SEQ ID NO: 910076 - protein, 741 aa, Homo sapiens; identical to SEQ ID NO: 910072

SEQ ID NO: 910077 - protein, 355 aa, Homo sapiens
MNLLTLDVKKKIKEVTEEVANKVSCAMTDEICRLSVLVDEFCSEFHPNPDVLKIYKSELNKHIEDGMGRNLADRCTDEVNALVLQTQQEIIENLKPLLPAGIQDKLHTLIPCKKFDLSYNLNYHKLCSDFQEDIVFRFSLGWSSLVHRFLGPRNAQRVLLGLSEPIFQLPRSLASTPTAPTTPATPDNASQEELMITLVTGLASVTSRTSMGIIIVGGVIWKTIGWKLLSVSLTMYGALYLYERLSWTTHAKERAFKQQFVNYATEKLRMIVSSTSANCSHQVKQQIATTFARLCQQVDITQKQLEEEIARLPKEIDQLEKIQNNSKLLRNKAVQLENELENFTKQFLPSSNEES

SEQ ID NO: 910078 - protein, 741 aa, Homo sapiens; identical to SEQ ID NO: 910072

SEQ ID NO: 910079 - protein, 281 aa, Homo sapiens [sequence omitted]

SEQ ID NO: 910080 - protein, 187 aa, Homo sapiens
MAMMEVQGGPSLGQTCVLIVIFTVLLQSLCVAVTYVYFTNELKQMQDKYSKSGIACFLKEDDSYWDPNDEESMNSPCWQVKWQLRQLVRKMILRTSEETISTVQEKQQNISPLVRERGPQRVAAHITGTRGRSNTLSSPTGESFEPGRQRLQCGEIMPLHSSLATERDLVSKKKKKKTSVSTCYFFQ

SEQ ID NO: 910081 - protein, 281 aa, Homo sapiens [sequence omitted]

SEQ ID NO: 910082 - protein, 281 aa, Homo sapiens [sequence omitted]

SEQ ID NO: 910083 - protein, 185 aa, Homo sapiens
TRGSGALCQAAAVRGGRAAPSASRTPEARVAAMARNVVYPLYRLGGPQLRVFRTNFFIQLVRPGVAQPEDTVQFRIPMEMTRVDLRNYLEGIYNVPVAAVRTRVQHGSNKRRDHRNVRIKKPDYKVAYVQLAHGQTFTFPDLFPEKDESPEGSAADDLYSMLEEERQQRQSSDPRRGGVPSWFGL

SEQ ID NO: 910084 - protein, 167 aa, Homo sapiens
VTRGRPRVRTTRPGGSAGVGYPLYRLGGPQLRVFRTNFFIQLVRPGVAQPEDTVQFRIPMEMTRVDLRNYLEGIYNVPVAAVRTRVQHGSNKRRDHRNVRIKKPDYKVAYVQLAHGQTFTFPDLFPEKDESPEGSAADDLYSMLEEERQQRQSSDPRRGGVPSWFGL

SEQ ID NO: 910085 - protein, 155 aa, Homo sapiens
TRGSGALCQAAAVRGGRAAPSASRTPEARVAAMARNVVYPLYRLGGPQLRVFRTNFFIQLVRPGVAQPEDTVQFRIPMEMTRVDLRNYLEGIYNVPVAAVRTRVQHGSNKRRDHRNVRIKKPDYKVAYVQLVPKEQYPLLLVNPSHMLWPGLGLG

SEQ ID NO: 910086 - protein, 155 aa, Homo sapiens; identical to SEQ ID NO: 910085

SEQ ID NO: 910087 - protein, 215 aa, Homo sapiens
TRGSGALCQAAAVRGGRAAPSASRTPEARVAAMARNVVYPLYRLGGPQLRVFRTNFFIQLVRPGVAQPEDTVQFRIPMEMTRVDLRNYLEGIYNVPVAAVRTRVQHGSNKRRDHRNVRIKKPDYKVAYVQLAHGQTFTFPDLFPEKDESPEGSAAVRTRVQHGSNKRRDHRNVRIKKPDYKVAYVQLAHGQTFTFPDLFPSSDPRRGGVPSWFGL

SEQ ID NO: 910088 - protein, 185 aa, Homo sapiens; identical to SEQ ID NO: 910083

SEQ ID NO: 910089 - protein, 185 aa, Homo sapiens; identical to SEQ ID NO: 910083

SEQ ID NO: 910090 - protein, 155 aa, Homo sapiens
VAEEPPARYPLYRLGGPQLRVFRTNFFIQLVRPGVAQPEDTVQFRIPMEMTRVDLRNYLEGIYNVPVAAVRTRVQHGSNKRRDHRNVRIKKPDYKVAYVQLAHGQTFTFPDLFPEKDESPEGSAADDLYSMLEEERQQRQSSDPRRGGVPSWFGL

SEQ ID NO: 910091 - protein, 134 aa, Homo sapiens
PDSGAILTPPPSSLPSPLVCSFCLLALEHLVIISKFKMASCICLGPQGAVSPPSREPEPHAVAWAGAWLTRTYSELSAEDAHGQTFTFPDLFPEKDESPEGSAADDLYSMLEEERQQRQSSDPRRGGVPSWFGL

SEQ ID NO: 910092 - protein, 95 aa, Homo sapiens
PPTTVGSGHSGIRSVSYPLFCPPCCEWTLGGLQGWCVGLPWPKCVTWTQSLLYRYPLYRLGGPQLRVFRTNFFIQLVRPGVAQPEDTVQFRIPME

SEQ ID NO: 910093 - protein, 531 aa, Homo sapiens
MVDVGKWPIFTLLSPQEIASIRKVCVFGTSASEALYVTDNDEVFVFGLNYSNCLGTGDNQSTLVPKKLEGLCGKKIKSLSYGSGPHVLLSTEDGVVYAWGHNGYSQLGNGTTNQGIAPVQVCTNLLIKQVVEVACGSHHSMALAADGEVFAWGYNNCGQVGSGSTANQPTPRKVTNCLHIKRVVGIACGQTSSMAVLDNGEVYGWGYNGNGQLGLGNNGNQLTPVRVAALHSVCVNQIVCGYAHTLALTDEGLLYAWGANTYGQLGTGNKNNLLSPAHIMVEKERVVEIAACHSAHTSAAKTQGGHVYMWGQCRGQSVILPHLTHFSCTDDVFACFATPAVSWRLLSVEHEDFLTVAESLKKEFDSPETADLKFRIDGKYIHVHKAVLKIRCEHFRSMFQSYWNEDMKEVIEIDQFSYPVYRAFLQYLYTDTVDLPPEDAIGLLDLATSYCENRLKKLCQHIIKRGITVENAFSLFSAAVRYDAEDLEEFCFKFCINHLTEVTQTAAFWQMDGPLLKEFIAKASKCGAFKN

SEQ ID NO: 910094 - protein, 118 aa, Homo sapiens
MAIPLCAGAVIIGFRSKIKKCPSPLLTTRHTYTPFIPILVIIETISLLIQPIALAVTPNRYITAGHLLMHLIGSASLAVSTINLPSTLIIFTILILLTILEIAVALIQAYVFTLLVSL

SEQ ID NO: 910095 - protein, 223 aa, Homo sapiens
MWGQCRGQSVILPHLTHFSCTDDVFACFATPAVSWRLLSVEHEDFLTVAESLKKEFDSPETADLKFRIDGKYIHVHKAVLKIRCEHFRSMFQSYWNEDMKEVIEIDQFSYPVYRAFLQYLYTDTVDLPPEDAIGLLDLATSYCENRLKKLCQHIIKRGITVENAFSLFSAAVRYDAEDLEEFCFKFCINHLTEVTQTAAFWQMDGPLLKEFIAKASKCGAFKN

SEQ ID NO: 910096 - protein, 487 aa, Homo sapiens
MVDVGKWPIFTLLSPQEIASIRKVCVFGTSASEALYVTDNDEVFVFGLNYSNCLGTGDNQSTLVPKKLEGLCGKKIKSLSYGSGPHVLLSTEDGVVYAWGHNGYSQLGNGTTNQGIAPVQVCTNLLIKQVVEVACGSHHSMALAADGEVFAWGYNNCGQVGSGSTANQPTPRKVTNCLHIKRVVGIACGQTSSMAVLDNGEVYGWGYNGNGQLGLGNNGNQLTPVRVAALHSVCVNQIVCGYAHTLALTDEGLLYAWGANTYGQLGTGNKNNLLSPAHIMVEKERVVEIAACHSAHTSAAKTQGGHVYMWGQCRGQSVILPHLTHFSCTDDVFACFATPAVSWRLLSVEHEDFLTVAESLKKEFDSPETADLKFRIDGKYIHVHKAVLKIRCEHFRSMFQSYWNEDMKEVIEIDQFSYPVYRAFLQYLYTDTVDLPPEDAIGLLDLATSYCENRLKKLCQHIIKRGITVENAFSLFSAAVRYDAEVT

SEQ ID NO: 910097 - protein, 104 aa, Homo sapiens
PWNLDCFLRYCKHELLNCLVWCAVGFCDHEVTCIFLKTFQGGRDCSLSLCPHVCSQDAGWARVHVGPVPGSVRDPPAPHPLLLHRRRVCLLCHSRRLVAPPVCG

SEQ ID NO: 910098 - protein, 531 aa, Homo sapiens; identical to SEQ ID NO: 910093

SEQ ID NO: 910099 - protein, 526 aa, Homo sapiens
MVDVGKWPIFTLLSPQEIASIRKVCVFGTSASEALYVTDNDEVFVFGLNYSNCLGTGDNQSTLVPKKLEGLCGKKIKSLSYGSGPHVLLSTEDGVVYAWGHNGYSQLGNGTTNQGIAPVQVCTNLLIKQVVEVACGSHHSMALAADGEVFAWGYNNCGQVGSGSTANQPTPRKVTNCLHIKRVVGIACGQTSSMAVLDNGEVLPPCPGVLTSDYETLPKKHTTEKYIFLGGLCDLILTHSELRMRSGHLGKENSALALICCFCCCDLAAECPWNLDCFLRVVEIAACHSAHTSAAKTQGGHVYMWGQCRGQSVILPHLTHFSCTDDVFACFATPAVSWRLLSVEHEDFLTVAESLKKEFDSPETADLKFRIDGKYIHVHKAVLKIRCEHFRSMFQSYWNEDMKEVIEIDQFSYPVYRAFLQYLYTDTVDLPPEDAIGLLDLATSYCENRLKKLCQHIIKRGITVENAFSLFSAAVRYDAEDLEEFCFKFCINHLTEVTQTAAFWQMDGPLLKEFIAKASKCGAFKN

SEQ ID NO: 910100 - protein, 531 aa, Homo sapiens; identical to SEQ ID NO: 910093

SEQ ID NO: 910101 - protein, 285 aa, Homo sapiens [sequence omitted]

SEQ ID NO: 910102 - protein, 286 aa, Homo sapiens
MAAHTASVAAVVRFLRPGPGSISGRQLSRAQTPPANEGGHVEPPSGLAAPGPMGKWHVGGRRGAPRQWGATARGRDLEAVRRGGCGSVGRRRQRRRRRRRRMRRMRRMWATQGLAVALALSVLPGSRALRPGDCEVCISYLGRFYQDLKDRDVTFSPATIENELIKFCREARGKENRLCYYIGATDDAATKIINEVSKPLAHHIPVEKICEKLKKKDSQICELKYDKQIDLSTVDLKKLRVKELKKILDDWGETCKGCAEKSDYIRKINELMPKYAPKAASARTDL

SEQ ID NO: 910103 - protein, 286 aa, Homo sapiens; identical to SEQ ID NO: 910102

SEQ ID NO: 910104 - protein, 286 aa, Homo sapiens; identical to SEQ ID NO: 910102

SEQ ID NO: 910105 - protein, 187 aa, Homo sapiens
EGTKLRLGTKPGGGLAVALALSVLPGSRALRPGDCEVCISYLGRFYQDLKDRDVTFSPATIENELIKFCREARGKENRLCYYIGATDDAATKIINEVSKPLAHHIPVEKICEKLKKKDSQICELKYDKQIDLSTVDLKKLRVKELKKILDDWGETCKGCAEKSDYIRKINELMPKYAPKAASARTDL

SEQ ID NO: 910106 - protein, 160 aa, Homo sapiens
MAAHTASVAAVVRFLRPGPGSISGRQLSRAQTPPANEGGHVEPPVWARGSWTNGEVACGRAPGCPPPMGSYGARPGLGGGAARRVRFSRSAAAAEEEEEEEDEEDEEDVGHAGAGGGAGSERAAGQPGAAAGRLRSLYFLSGKILPGPQRQRCHILTSHY

SEQ ID NO: 910107 - protein, 198 aa, Homo sapiens
MAAHTASVAAVVRFLRPGPGSISGRQLSRAQTPPANEGGHVEPPVWARGSWTNGEVACGRAPGCPPPMGSYGARPGLGGGAARRVRFSRSAAAAEEEEEEEDEEDEEDVGHAGAGGGAGSERAAGQPGAAAGRLRRCGIGGRGPRSVTVLAAALNPTTSPDGRGQEGEGGGGGGGDSRSPRGLHEEAPAPALVNLSWA

SEQ ID NO: 910108 - protein, 50 aa, Homo sapiens
GGSPPNRLKLQGAVIMPLHSSLGDREPYLKTQVRPYREMMFQGVSMFGGD

SEQ ID NO: 910109 - protein, 286 aa, Homo sapiens; identical to SEQ ID NO: 910102

SEQ ID NO: 910110 - protein, 191 aa, Homo sapiens
MVRYEAGVNRQRMWATQGLAVALALSVLPGSRALRPGDCEVCISYLGRFYQDLKDRDVTFSPATIENELIKFCREARGKENRLCYYIGATDDAATKIINEVSKPLAHHIPVEKICEKLKKKDSQICELKYDKQIDLSTVDLKKLRVKELKKILDDWGETCKGCAEKSDYIRKINELMPKYAPKAASARTDL

SEQ ID NO: 910111 - protein, 332 aa, Homo sapiens
MAAHTASVAAVVRFLRPGPGSISGRQLSRAQTPPANEGGHVEPPSGLAAPGPMGKWHVGGRRGAPRQWGATARGRDLEAVRRGGCGSVGRRRQRRRRRRRRMRRMRRMWATQGLAVALALSVLPGSRALRPGDCEVCISYLGRFYQDLKDRDVTFSPATIENELIKFCREARGKENRLVGTLVTLKFIWWLSAWTEHVLRVQGLHWLNLTTSTGRAPKNAAVGQCYYIGATDDAATKIINEVSKPLAHHIPVEKICEKLKKKDSQICELKYDKQIDLSTVDLKKLRVKELKKILDDWGETCKGCAEKSDYIRKINELMPKYAPKAASARTDL

SEQ ID NO: 910112 - protein, 286 aa, Homo sapiens; identical to SEQ ID NO: 910102

SEQ ID NO: 910113 - protein, 474 aa, Homo sapiens
MEAEDIQEELTCPICLDYFQDPVSIECGHNFCRGCLHRNWAPGGGPFPCPECRHPSAPAALRPNWALARLTEKTQRRRLGPVPPGLCGRHWEPLRLFCEDDQRPVCLVCRESQEHQTHAMAPIDEAFESYREKLLKSQRNLVAKMKKVMHLQDVEVKNATQWKDKIKSQRMRISTEFSKLHNFLVEEEDLFLQRLNKEEEETKKKLNENTLKLNQTIASLKKLILEVGEKSQAPTLELLQNPKEVLTRSEIQDVNYSLEAVKVKTVCQIPLMKEMLKRFQVAVNLAEDTAHPKLVFSQEGRYVKNTASASSWPVFSSAWNYFAGWRNPQKTAFVERFQHLPCVLGKNVFTSGKHYWEVESRDSLEVAVGVCREDVMGITDRSKMSPDVGIWAIYWSAAGYWPLIGFPGTPTQQEPALHRVGVYLDRGTGNVSFYSAVDGVHLHTFSCSSVSRLRPFFWLSPLASLVIPPVTDRK

SEQ ID NO: 910114 - protein, 137 aa, Homo sapiens [sequence omitted]

SEQ ID NO: 910115 - protein, 294 aa, Homo sapiens
MEAEDIQEELTCPICLDYFQDPVSIECGHNFCRGCLHRNWAPGGGPFPCPECRHPSAPAALRPNWALARLTEKTQRRRLGPVPPGLCGRHWEPLRLFCEDDQRPVCLVCRESQEHQTHAMAPIDEAFESYREKLLKSQRNLVAKMKKVMHLQDVEVKNATQWKDKIKSQRMRISTEFSKLHNFLVEEEDLFLQRLNKEEEETKKKLNENTLKLNQTIASLKKLILEVGEKSQAPTLELLQNPKEVLTRSEIQDVNYSLEAVKVKTVCQIPLMKEMLKRFQATKIKTQKQNRHNM

SEQ ID NO: 910116 - protein, 267 aa, Homo sapiens
MEAEDIQEELTCPICLDYFQDPVSIECGHNFCRGCLHRNWAPGGGPFPCPECRHPSAPAALRPNWALARLTEKTQRRRLGPVPPGLCGRHWEPLRLFCEDDQRPVCLVCRESQEHQTHAMAPIDEAFESYREKLLKSQRNLVAKMKKVMHLQDVEVKNATQWKDKIKSQRMRISTEFSKLHNFLVEEEDLFLQRLNKEEEETKKKLNENTLKLNQTIASLKKLILEVGEKSQAPTLELLQVRQLRVGVISSSLTELSLVFRAECPSW

SEQ ID NO: 910117 - protein, 500 aa, Homo sapiens
MEAEDIQEELTCPICLDYFQDPVSIECGHNFCRGCLHRNWAPGGGPFPCPECRHPSAPAALRPNWALARLTEKTQRRRLGPVPPGLCGRHWEPLRLFCEDDQRPVCLVCRESQEHQTHAMAPIDEAFESYRTGNFDIHVDEWKRRLIRLLLYHSKQEEKLLKSQRNLVAKMKKVMHLQDVEVKNATQWKDKIKSQRMRISTEFSKLHNFLVEEEDLFLQRLNKEEEETKKKLNENTLKLNQTIASLKKLILEVGEKSQAPTLELLQNPKEVLTRSEIQDVNYSLEAVKVKTVCQIPLMKEMLKRFQVAVNLAEDTAHPKLVFSQEGRYVKNTASASSWPVFSSAWNYFAGWRNPQKTAFVERFQHLPCVLGKNVFTSGKHYWEVESRDSLEVAVGVCREDVMGITDRSKMSPDVGIWAIYWSAAGYWPLIGFPGTPTQQEPALHRVGVYLDRGTGNVSFYSAVDGVHLHTFSCSSVSRLRPFFWLSPLASLVIPPVTDRK

SEQ ID NO: 910118 - protein, 294 aa, Homo sapiens; identical to SEQ ID NO: 910115

SEQ ID NO: 910119 - protein, 474 aa, Homo sapiens; identical to SEQ ID NO: 910113

SEQ ID NO: 910120 - protein, 226 aa, Homo sapiens
MVWKVAVFLSVALGIGAVPIDDPEDGGKHWVVIVAGSNGWYNYRHQADACHAYQIIHRNGIPDEQIVVMMYDDIAYSEDNPTPGIVINRPNGTDVYQGVPKDYTGEDVTPQNFLAVLRGDAEAVKGIGSGKVLKSGPQDHVFIYFTDHGSTGILVFPNEDLHVKDLNETIHYMYKHKMYRKMVFYIEACESGSMMNHLPDNINGYATTGCQPQNKFLQKPRLTGHK

SEQ ID NO: 910121 - protein, 433 aa, Homo sapiens
MVWKVAVFLSVALGIGAVPIDDPEDGGKHWVVIVAGSNGWYNYRHQADACHAYQIIHRNGIPDEQIVVMMYDDIAYSEDNPTPGIVINRPNGTDVYQGVPKDYTGEDVTPQNFLAVLRGDAEAVKGIGSGKVLKSGPQDHVFIYFTDHGSTGILVFPNEDLHVKDLNETIHYMYKHKMYRKMVFYIEACESGSMMNHLPDNINVYATTAANPRESSYACYYDEKRSTYLGDWYSVNWMEDSDVEDLTKETLHKQYHLVKSHTNTSHVMQYGNKTISTMKVMQFQGMKRKASSPVPLPPVTHLDLTPSPDVPLTIMKRKLMNTNDLEESRQLTEEIQRHLDARHLIEKSVRKIVSLLAASEAEVEQLLSERAPLTGHSCYPEALLHFRTHCFNWHSPTYEYALRHLYVLVNLCEKPYPLHRIKLSMDHVCLGHY

SEQ ID NO: 910122 - protein, 321 aa, Homo sapiens
MVWKVAVFLSVALGIGAVPIDDPEDGGKHWVVIVAGSNGWYNYRHQADACHAYQIIHRNGIPDEQIVVMMYDDIAYSEDNPTPGIVINRPNGTDVYQGVPKDYTGEDVTPQNFLAVLRGDAEAVKGIGSGKVLKSGPQDHVFIYFTDHGSTGILVFPNEDLHVKDLNETIHYMYKHKMYRKMVFYIEACESGSMMNHLPDNINVYATTAANPRESSYACYYDEKRSTYLGDWYSVNWMEDSDVEDLTKETLHKQYHLVKSHTNTSHVMQYGNKTISTMKVMQFQGMKRKASSPVPLPPVTHLDLTPSPDVPLTIMGCQAPH

SEQ ID NO: 910123 - protein, 433 aa, Homo sapiens; identical to SEQ ID NO: 910121

SEQ ID NO: 910124 - protein, 433 aa, Homo sapiens; identical to SEQ ID NO: 910121

SEQ ID NO: 910125 - protein, 376 aa, Homo sapiens
MVWKVAVFLSVALGIGAVPIDDPEDGGKHWVVIVAGSNGWYNYRHQADACHAYQIIHRNGIPDEQIVVMMYDDIAYSEDNPTPGIVINRPNGTDVYQGVPKDYTGEDVTPQNFLAVLRGDAEAVKGIGSGKVLKSGPQDHVFIYFTDHGSTGILVFPNEDLHVKDLNETIHYMYKHKMYRKMVFYIEACESGSMMNHLPDNINVYATTAANPRESSYACYYDEKRSTYLGDWYSVNWMEDSDVEDLTKETLHKQYHLVKSHTNTSHVMQYGNKTISTMKVMQFQGMKRKASSPVPLPPVTHLDLTPSPDVPLTIMKRKLMNTNDLEESRQLTEEIQRHLDYEYALRHLYVLVNLCEKPYPLHRIKLSMDHVCLGHY

SEQ ID NO: 910126 - protein, 346 aa, Homo sapiens
MVWKVAVFLSVALGIGAVPIDDPEDGGKHWVVIVAGSNGWYNYRHQADACHAYQIIHRNGIPDEQIVVMMYDDIAYSEDNPTPGIVINRPNGTDVYQGVPKDYTGEDVTPQNFLAVLRGDAEAVKGIGSGKVLKSGPQDHVFIYFTDHGSTGILVFPNEDLHVKDLNETIHYMYKHKMYRKMVFYIEACESGSMMNHLPDNINVYATTAANPRESSYACYYDEKRSTYLGDWYSVNWMEDSDVEDLTKETLHKQYHLVKSHTNTSHVMQYGNKTISTMKVMQFQGMKRKASSPVPLPPVTHLDLTPSPDVPLTIMKRKLMNTNDLEESRQLTEEIQRHLDGCQAPH

SEQ ID NO: 910127 - protein, 373 aa, Homo sapiens
MPTRADACHAYQIIHRNGIPDEQIVVMMYDDIAYSEDNPTPGIVINRPNGTDVYQGVPKDYTGEEMIDPRRLLGSGPQDHVFIYFTDHGSTGILVFPNEDLHVKDLNETIHYMYKHKMYRKMVFYIEACESGSMMNHLPDNINVYATTAANPRESSYACYYDEKRSTYLGDWYSVNWMEDSDVEDLTKETLHKQYHLVKSHTNTSHVMQYGNKTISTMKVMQFQGMKRKASSPVPLPPVTHLDLTPSPDVPLTIMKRKLMNTNDLEESRQLTEEIQRHLDARHLIEKSVRKIVSLLAASEAEVEQLLSERAPLTGHSCYPEALLHFRTHCFNWHSPTYEYALRHLYVLVNLCEKPYPLHRIKLSMDHVCLGHY

SEQ ID NO: 910128 - protein, 433 aa, Homo sapiens; identical to SEQ ID NO: 910121

SEQ ID NO: 910129 - protein, 119 aa, Homo sapiens [sequence omitted]

SEQ ID NO: 910130 - protein, 101 aa, Homo sapiens
ILFLLVEDSDVEDLTKETLHKQYHLVKSHTNTSHVMQYGNKTISTMKVMQFQGMKRKASSPVPDVPLTIMKRKLMNTNDLEESRQLTEEIQRHLDGCQAPH

SEQ ID NO: 910131 - protein, 112 aa, Homo sapiens
MIWRSPGSSRRRSSGIWMDARHLIEKSVRKIVSLLAASEAEVEQLLSERAPLTGHSCYPEALLHFRTHCFNWHSPTYEYALRHLYVLVNLCEKPYPLHRIKLSMDHVCLGHY

SEQ ID NO: 910132 - protein, 160 aa, Homo sapiens
MVWKVAVFLSVALGIGAVPIDDPEDGGKHWVVIVAGSNGWYNYRHQADACHAYQIIHRNGIPDEQIVVMMYDDIAYSEDNPTPGIVINRPNGTDVYQGVPKDYTGEDVTPQNFLAVLRGDAWSEKSPLLGPSWGAPAPGLAPGPSSQDDLLAVTCFPSLF

SEQ ID NO: 910133 - protein, 153 aa, Homo sapiens
RGTVALKRGAAAPAAITAVPTSWVFGVRLRAAASSHGPAGATTAVTHRRRLLLGDETQWLEVHHVYSQDHAREIFDSRGNPLVEVDPQKVSELLCQWCNWLGGLLRDNDKTRYMGKGVKAVEHINKTIAAALVSKKLNVTEQKIDKLMIEMDG

SEQ ID NO: 910134 - protein, 433 aa, Homo sapiens; identical to SEQ ID NO: 910121

SEQ ID NO: 910135 - protein, 433 aa, Homo sapiens; identical to SEQ ID NO: 910121

SEQ ID NO: 910136 - protein, 346 aa, Homo sapiens; identical to SEQ ID NO: 910126

SEQ ID NO: 910137 - protein, 433 aa, Homo sapiens; identical to SEQ ID NO: 910121

SEQ ID NO: 910138 - protein, 365 aa, Homo sapiens [sequence omitted]

SEQ ID NO: 910139 - protein, 420 aa, Homo sapiens [sequence omitted]

SEQ ID NO: 910140 - protein, 341 aa, Homo sapiens
MVWKVAVFLSVALGIGAVPIDDPEDGGKHWVVIVAGSNGWYNYRHQADACHAYQIIHRNGIPDEQIVVMMYDDIAYSEDNPTPGIVINRPNGTDVYQGVPKDYTGEDVTPQNFLAVLRGDAEAVKGIGSGKVLKSGPQDHVFIYFTDHGSTGILVFPNEDLHVKDLNETIHYMYKHKMYRKMVFYIEACESGSMMNHLPDNINVYATTAANPRESSYACYYDEKRSTYLGDWYSVNWMEDSDVEDLTKETLHKQYHLVKSHTNTSHVMQYGNKTISTMKVMQFQGMKRKASSPVPLPPVTHLDLTPSPDVPLTIMKRKLMNTNDLEESRQLTEEIQRHLDG

SEQ ID NO: 910141 - protein, 433 aa, Homo sapiens; identical to SEQ ID NO: 910121

SEQ ID NO: 910142 - protein, 126 aa, Homo sapiens
ACLVKSPVLDNVQQSTAYRHTEEEDLTKETLHKQYHLVKSHTNTSHVMQYGNKTISTMKVMQFQGMKRKASSPVPLPPVTHLDLTPSPDVPLTIMKRKLMNTNDLEESRQLTEEIQRHLDGCQAPH

SEQ ID NO: 910143 - protein, 344 aa, Homo sapiens
MVWKVAVFLSVALGIGAVPIDDPEDGGKHWVVIVAGSNGWYNYRHQADACHAYQIIHRNGIPDEQIVVMMYDDIAYSEDNPTPGIVINRPNGTDVYQGVPKDYTGEDVTPQNFLAVLRGDAEAVKGIGSGKVLKSGPQDHVFIYFTDHGSTGILVFPNEDLHVKDLNETIHYMYKHKMYRKMVFYIEACESGSMMNHLPDNINVYATTAANPRESSYACYYDEKRSTYLGDWYSVNWMEDSDVEDLTKETLHKQYHLVKSHTNTSHVMQYGNKTISTMKVMQFQGMKRKASSPVPLPPVTHLDLTPSPDVPLTIMKRKLMNTNDLEESRQLTEEIQRHLDMTDI

SEQ ID NO: 910144 - protein, 228 aa, Homo sapiens
MVWKVAVFLSVALGIGAVPIDDPEDGGKHWVVIVAGSNGWYNYRHQADACHAYQIIHRNGIPDEQIVVMMYDDIAYSEDNPTPGIVINRPNGTDVYQGVPKDYTGEDVTPQNFLAVLRGDAEAVKGIGSGKVLKSGPQDHVFIYFTDHGSTGILVFPNEDLHVKDLNETIHYMYKHKMYRKMVFYIEACESGSMMNHLPDNINVYATTAANPRESSYACYYDEKREGI

SEQ ID NO: 910145 - protein, 197 aa, Homo sapiens
MQRASRLKRELHMLATEPPPGITCWQDKDQMDDLRAQILGGANTPYEKGVFKLEVIIPERYPFEPPQIRFLTPIYHPNIDSAGRICLDVLKLPPKGAWRPSLNIATVLTSIQLLMSEPNPDDPLMADISSEFKYNKPAFLKNARQWTEKHARQKQKADEEEMLDNLPEAGDSRVHNSTQKRKASQLVGIEKKFHPDV

SEQ ID NO: 910146 - protein, 132 aa, Homo sapiens
MQRASRLKRELHMLATEPPPGITCWQDKDQMDDLRAQILGGANTPYEKGVFKLEVIIPERYPFEPPQIRFLTPIYHPNIDSAGRICLDVLKLPPKSSEFKYNKPAFLKNARQWTEKHARQKQKRLMREMLDL

SEQ ID NO: 910147 - protein, 197 aa, Homo sapiens; identical to SEQ ID NO: 910145

SEQ ID NO: 910148 - protein, 150 aa, Homo sapiens [sequence omitted]

SEQ ID NO: 910149 - protein, 92 aa, Homo sapiens
MQRASRLKRELHMLATEPPPGITCWQDKDQMDDLRAQILGGANTPYEKGVFKLEVIIPERYPFEPPQIRFLTPIYHPNKSFQQNQCWADQLE

SEQ ID NO: 910150 - protein, 197 aa, Homo sapiens; identical to SEQ ID NO: 910145

SEQ ID NO: 910151 - protein, 197 aa, Homo sapiens; identical to SEQ ID NO: 910145

SEQ ID NO: 910152 - protein, 166 aa, Homo sapiens
MQRASRLKRELHMLATEPPPGITCWQDKDQMDDLRAQILGGANTPYEKGVFKLEVIIPERYPFEPPQIRFLTPIYHPNIDSAGRICLDVLKLPPKGAWRPSLNIATVLTSIQLLMSEPNPDDPLMADISSEFKYNKPAFLKNARQWTEKHARQKQKTGSKQGGTEL

SEQ ID NO: 910153 - protein, 192 aa, Homo sapiens
MDGSGEQPRGGGPTSSEQIMKTGALLLQGFIQDRAGRMGGEAPELALDPVPQDASTKKLSECLKRIGDELDSNMELQRMIAAVDTDSPREVFFRVAADMFSDGNFNWGRVVALFYFASKLVLKALCTKVPELIRTIMGWTLDFLRERLLGWIQDQGGWDGLLSYFGTPTWQTVTIFVAGVLTASLTIWKKMG

SEQ ID NO: 910154 - protein, 166 aa, Homo sapiens
MDGFIQDRAGRMGGEAPELALDPVPQDASTKKLSECLKRIGDELDSNMELQRMIAAVDTDSPREVFFRVAADMFSDGNFNWGRVVALFYFASKLVLKALCTKVPELIRTIMGWTLDFLRERLLGWIQDQGGWDGLLSYFGTPTWQTVTIFVAGVLTASLTIWKKMG

SEQ ID NO: 910155 - protein, 173 aa, Homo sapiens
MKTGALLLQGFIQDRAGRMGGEAPELALDPVPQDASTKKLSECLKRIGDELDSNMELQRMIAAVDTDSPREVFFRVAADMFSDGNFNWGRVVALFYFASKLVLKALCTKVPELIRTIMGWTLDFLRERLLGWIQDQGGWDGLLSYFGTPTWQTVTIFVAGVLTASLTIWKKMG

SEQ ID NO: 910156 - protein, 173 aa, Homo sapiens; identical to SEQ ID NO: 910155

SEQ ID NO: 910157 - protein, 173 aa, Homo sapiens; identical to SEQ ID NO: 910155

SEQ ID NO: 910158 - protein, 179 aa, Homo sapiens
MDGSGEQPRGGGPTSSEQIMKTGALLLQGFIQDRAGRMGGEAPELALDPVPQDASTKKLSECLKRIGDELDSNMELQRMIAAVDTDSPREVFFRVAADMFSDGNFNWGRVVALFYFASKLVLKALCTKVPELIRTIMGWTLDFLRERLLGWIQDQGGWTVTIFVAGVLTASLTIWKKMG

SEQ ID NO: 910159 - protein, 105 aa, Homo sapiens
MGGEAPELALDPVPQDASTKKLSECLKRIGDELDSNMELQRMIAAVDTDSPREVFFRVAADMFSDGNFNWGRVVALFYFASKLVLKPVHQGAGTDQYTIGTELDL

SEQ ID NO: 910160 - protein, 155 aa, Homo sapiens
MGGEAPELALDPVPQDASTKKLSECLKRIGDELDSNMELQRMIAAVDTDSPREVFFRVAADMFSDGNFNWGRVVALFYFASKLVLKALCTKVPELIRTIMGWTLDFLRERLLGWIQDQGGWDGLLSYFGTPTWQTVTIFVAGVLTASLTIWKKMG

SEQ ID NO: 910161 - protein, 155 aa, Homo sapiens
MGGEAPELALDPVPQDASTKKLSECLKRIGDELDSNMELQRMIAAVDTDSPREVFFRVAADMFSDGNFNWGRVVALFYFASKLVLKALCTKVPELIRTIMGWTLDFLRERLLGWIQDQGGWVRLLKPPHPHHRALTTAPAPPPLPAILPSGLLRP

SEQ ID NO: 910162 - protein, 237 aa, Homo sapiens
MGGEAPELALDPVPQDASTKKLSECLKRIGDELDSNMELQSMIAASGRHPHLPPVPSPPHYTAHQPLQGSHGLSGEQFSPGLSSQLPPPTHAYTHALLDKANIPLSRTLHLLRPHSLGGGDIALWAFGLGAPSLLLHCSLWLPIVGPGRVPLALKGAQAPSHPGTPYSTALAAAGVANGGGCWAPGFPQPNCLCHHVGLTFHPSPSSLGPRTRLDSPLRLQEGRRGESPIPLHCGTG

SEQ ID NO: 910163 - protein, 114 aa, Homo sapiens
MIAAVDTDSPREVFFRVAADMFSDGNFNWGRVVALFYFASKLVLKALCTKVPELIRTIMGWTLDFLRERLLGWIQDQGGWDGLLSYFGTPTWQTVTIFVAGVLTASLTIWKKMG

SEQ ID NO: 910164 - protein, 192 aa, Homo sapiens; identical to SEQ ID NO: 910153

SEQ ID NO: 910165 - protein, 218 aa, Homo sapiens
MDGSGEQPRGGGPTSSEQIMKTGALLLQGFIQDRAGRMGGEAPELALDPVPQDASTKKLSECLKRIGDELDSNMELQRMIAAVDTDSPREVFFRVAADMFSDGNFNWGRVVALFYFASKLVLKALCTKVPELIRTIMGWTLDFLRERLLGWIQDQGGWVRLLKPPHPHHRALTTAPAPPSLPPATPLGPWAFWSRSQWCPLPIFRSSDVVYNAFSLRV

SEQ ID NO: 910166 - protein, 173 aa, Homo sapiens; identical to SEQ ID NO: 910155

SEQ ID NO: 910167 - protein, 173 aa, Homo sapiens
MKTGALLLQGFIQDRAGRMGGEAPELALDPVPQDASTKKLSECLKRIGDELDSNMELQRMIAAVDTDSPREVFFRVAADMFSDGNFNWGRVVALFYFASKLVLKALCTKVPELIRTIMGWTLDFLRERLLGWIQDQGGWVRLLKPPHPHHRALTTAPAPPPLPAILPSGLLRP

SEQ ID NO: 910168 - protein, 155 aa, Homo sapiens; identical to SEQ ID NO: 910160

SEQ ID NO: 910169 - protein, 225 aa, Homo sapiens
MDGSGEQPRGGGPTSSEQIMKTGALLLQGFIQDRAGRMGGEAPELALDPVPQDASTKKLSECLKRIGDELDSNMELQRMIAAVDTDSPREVFFRVAADMFSDGNFNWGRVVALFYFASKLVLKAGVKWRDLGSLQPLPPGFKRFTCLSITKELGLQALCTKVPELIRTIMGWTLDFLRERLLGWIQDQGGWDGLLSYFGTPTWQTVTIFVAGVLTASLTIWKKMG

SEQ ID NO: 910170 - protein, 155 aa, Homo sapiens; identical to SEQ ID NO: 910160

SEQ ID NO: 910171 - protein, 143 aa, Homo sapiens
MDGSGEQPRGGGPTSSEQIMKTGALLLQGMIAAVDTDSPREVFFRVAADMFSDGNFNWGRVVALFYFASKLVLKALCTKVPELIRTIMGWTLDFLRERLLGWIQDQGGWDGLLSYFGTPTWQTVTIFVAGVLTASLTIWKKMG

SEQ ID NO: 910172 - protein, 326 aa, Homo sapiens
VDFRGKMAAVRMLRTWSRNAGKLICVRYFQTCGNVHVLKPNYVCFFGYPSFKYSHPHHFLKTTAALRGQVVQFKLSDIGEGIREVTVKEWYVKEGDTVSQFDSICEVQSDKASVTITSRYDGVIKKLYYNLDDIAYVGKPLVDIETEALKDSEEDVVETPAVSHDEHTHQEIKGRKTLATPAVRRLAMENNIKLSEVVGSGKDGRILKEDILNYLEKQTGAILPPSPKVEIMPPPPKPKDMTVPILVSKPPVFTGKDKTEPIKGFQKAMVKTMSAALKIPHFGYCDEIDLTELVKLREELKPIAFARGIKLSFMPFFLKYYFSWKS

SEQ ID NO: 910173 - protein, 135 aa, Homo sapiens [sequence omitted]

SEQ ID NO: 910174 - protein, 488 aa, Homo sapiens
VDFRGKMAAVRMLRTWSRNAGKLICVRYFQTCGNVHVLKPNYVCFFGYPSFKYSHPHHFLKTTAALRGQVVQFKLSDIGEGIREVTVKEWYVKEGDTVSQFDSICEVQSDKASVTITSRYDGVIKKLYYNLDDIAYVGKPLVDIETEALKDSEEDVVETPAVSHDEHTHQEIKGRKTLATPAVRRLAMENNIKLSEVVGSGKDGRILKEDILNYLEKQTGAILPPSPKVEIMPPPPKPKDMTVPILVSKPPVFTGKDKTEPIKGFQKAMVKTMSAALKIPHFGYCDEIDLTELVKLREELKPIAFARGIKLSFMPFFLKAASLGLLQFPILNASVDENCQNITYKASHNIGIAMDTEQGLIVPNVKNVQICSIFDIATELNRLQKLGSVGQLSTTDLTGGTFTLSNIGSIGGTFAKPVIMPPEVAIGALGSIKAIPRFNQKGEVYKAQIMNVSWSADHRVIDGATMSRFSNLWKSYLENPAFMLLDLK

SEQ ID NO: 910175 - protein, 301 aa, Homo sapiens
MENNIKLSEVVGSGKDGRILKEDILNYLEKQTGAILPPSPKVEIMPPPPKPKDMTVPILVSKPPVFTGKDKTEPIKGFQKAMVKTMSAALKIPHFGYCDEIDLTELVKLREELKPIAFARGIKLSFMPFFLKAASLGLLQFPILNASVDENCQNITYKASHNIGIAMDTEQGLIVPNVKNVQICSIFDIATELNRLQKLGSVGQLSTTDLTGGTFTLSNIGSIGGTFAKPVIMPPEVAIGALGSIKAIPRFNQKGEVYKAQIMNVSWSADHRVIDGATMSRFSNLWKSYLENPAFMLLDLK

SEQ ID NO: 910176 - protein, 483 aa, Homo sapiens
VDFRGKMAAVRMLRTWSRNAGKLICVRYFQTCGNVHVLKPNYVCFFGYPSFKYSHPHHFLKTTAALRGQVVQFKLSDIGEGIREVTVKEWYVKEGDTVSQFDSICEVQSDKASVTITSRYDGVIKKLYYNLDDIAYVGKPLVDIETEALKDSEEDVVETPAVSHDEHTHQEIKGRKTLATPAVRRLAMENNIKLSEVVGSGKDGRILKEDILNYLEKQTGAILPPSPKVEIMPPPPKPKDMTVPILVSKPPVFTGKDKTEPIKGFQKAMVKTMSAALKIPHFGYCDEIDLTELVKLREELKPIAFARGIKLSFMPFFLKAASLGLLQFPILNASVDENCQNITYKASHNIGIAMDTEQGLIVPNVKNVQICSIFDIATELNRLQKLGSVGQLSTTDLTGGTFTLSNIGSIGGTFAKPVIMPPEVAIGALGSIKAIPRFNQKGEVYKAQIMNVSWSADHRVIDGATMSRFSNLWKSYLPDYAHN

SEQ ID NO: 910177 - protein, 883 aa, Homo sapiens
PAEPQCRAPEQRRQSSCTIPAFACAAAFLLHLFSSASAGAMAKPLTDSEKRKQISVRGLAGLGDVAEVRKSFNRHLHFTLVKDRNVATPRDYFFALAHTVRDHLVGRWIRTQQHYYERDPKRIYYLSLEFYMGRTLQNTMVNLGLQNACDEAIYQLGLDLEELEEIEEDAGLGNGGLGRLAACFLDSMATLGLAAYGYGIRYEFGIFNQKIVNGWQVEEADDWLRYGNPWEKARPEYMLPVHFYGRVEHTPDGVKWLDTQVVLAMPYDTPVPGYKNNTVNTMRLWSAKAPNDFKLQDFNVGDYIEAVLDRNLAENISRVLYPNDNFFEGKELRLKQEYFVVAATLQDIIRRFKSSKFGCRDPVRTCFETFPDKVAIQLNDTHPALSIPELMRILVDVEKVDWDKAWEITKKTCAYTNHTVLPEALERWPVSMFEKLLPRHLEIIYAINQRHLDHVAALFPGDVDRLRRMSVIEEGDCKRINMAHLCVIGSHAVNGVARIHSEIVKQSVFKDFYELEPEKFQNKTNGITPRRWLLLCNPGLADTIVEKIGEEFLTDLSQLKKLLPLVSDEVFIRDVAKVKQENKLKFSAFLEKEYKVKINPSSMFDVHVKRIHEYKRQLLNCLHVVTLYNRIKRDPAKAFVPRTVMIGGKAAPGYHMAKLIIKLVTSIGDVVNHDPVVGDRLKVIFLENYRVSLAEKVIPAADLSQQISTAGTEASGTGNMKFMLNGALTIGTMDGANVEMAEEAGAENLFIFGLRVEDVEALDRKGYNAREYYDHLPELKQAVDQISSGFFSPKEPDCFKDIVNMLMHHDRFKVFADYEAYMQCQAQVDQLYRNPKEWTKKVIRNIACSGKFSSDRTITEYAREIWGVEPSDLQIPPPNIPRD

SEQ ID NO: 910178 - protein, 261 aa, Homo sapiens
KHHHTVPPSVTPKALDRSPPCPEMFTRAAPGYHMAKLIIKLVTSIGDVVNHDPVVGDRLKVIFLENYRVSLAEKVIPAADLSQQISTAGTEASGTGNMKFMLNGALTIGTMDGANVEMAEEAGAENLFIFGLRVEDVEALDRKGYNAREYYDHLPELKQAVDQISSGFFSPKEPDCFKDIVNMLMHHDRFKVFADYEAYMQCQAQVDQLYRNPKEWTKKVIRNIACSGKFSSDRTITEYAREIWGVEPSDLQIPPPNIPRD

SEQ ID NO: 910179 - protein, 883 aa, Homo sapiens; identical to SEQ ID NO: 910177

SEQ ID NO: 910180 - protein, 775 aa, Homo sapiens
PAEPQCRAPEQRRQSSCTIPAFACAAAFLLHLFSSASAGAMAKPLTDSEKRKQISVRGLAGLGDVAEVRKSFNRHLHFTLVKDRNVATPRDYFFALAHTVRDHLVGRWIRTQQHYYERDPKRIYYLSLEFYMGRTLQNTMVNLGLQNACDEAIYQLGLDLEELEEIEEDAGLGNGGLGRLAACFLDSMATLGLAAYGYGIRYEFGIFNQKIVNGWQVEEADDWLRYGNPWEKARPEYMLPVHFYGRVEHTPDGVKWLDTQVVLAMPYDTPVPGYKNNTVNTMRLWSAKAPNDFKLQDFNVGDYIEAVLDRNLAENISRVLYPNDNFFEGKELRLKQEYFVVAATLQDIIRRFKSSKFGCRDPVRTCFETFPDKVAIQLNDTHPALSIPELMRILVDVEKVDWDKAWEITKKTCAYTNHTVLPEALERWPVSMFEKLLPRHLEIIYAINQRHLDHVAALFPGDVDRLRRMSVIEEGDCKRINMAHLCVIGSHAVNGVARIHSEIVKQSVFKDFYELEPEKFQNKTNGITPRRWLLLCNPGLADTIVEKIGEEFLTDLSQLKKLLPLVSDEVFIRDVAKVKQENKLKFSAFLEKEYKVKINPSSMFDVHVKRIHEYKRQLLNCLHVVTLYNRIKRDPAKAFVPRTVMIGGKDVEALDRKGYNAREYYDHLPELKQAVDQISSGFFSPKEPDCFKDIVNMLMHHDRFKVFADYEAYMQCQAQVDQLYRNPKEWTKKVIRNIACSGKFSSDRTITEYAREIWGVEPSDLQIPPPNIPRD

SEQ ID NO: 910181 - protein, 202 aa, Homo sapiens
PAEPQCRAPEQRRQSSCTIPAFACAAAFLLHLFSSASAGAMAKPLTDSEKRKQISVRGLAGLGDVAEVRKSFNRHLHFTLVKDRNVATPRDYFFALAHTVRDHLVGRWIRTQQHYYERDPKRIYYLSLEFYMGRTLQNTMVNLGLQNACDEAIYQLGLDLEELEEIEEDAGLGNGGLGRLAGKLPHPGGALSDPLAWLEATW

SEQ ID NO: 910182 - protein, 173 aa, Homo sapiens
HLRGPSQGAPFHFLPLRPSVFQKLCPGFHSEPSSEWPSPLGMWHQPLCPSRSASDDISLTVKGAGGIGFRLTSHLCSSRSLLKGLVTTHGHWLLPWTVQALSSQGHPGAGAVPGTNMAVFSKVAHLGRWLLTPGPSPHRYNAREYYDHLPELKQAVDQISSGFFSPKEPDCFK

SEQ ID NO: 910183 - protein, 883 aa, Homo sapiens; identical to SEQ ID NO: 910177

SEQ ID NO: 910184 - protein, 883 aa, Homo sapiens; identical to SEQ ID NO: 910177

SEQ ID NO: 910185 - protein, 883 aa, Homo sapiens; identical to SEQ ID NO: 910177

SEQ ID NO: 910186 - protein, 298 aa, Homo sapiens
PAEPQCRAPEQRRQSSCTIPAFACAAAFLLHLFSSASAGAMAKPLTDSEKRKQISVRGLAGLGDVAEVRKSFNRHLHFTLVKDRNVATPRDYFFALAHTVRDHLVGRWIRTQQHYYERDPKRIYYLSLEFYMGRTLQNTMVNLGLQNACDEAIYQLGLDLEELEEIEEDAGLGNGGLGRLAACFLDSMATLGLAAYGYGIRYEFGIFNQKIVNGWQVEEADDWLRYGNPWEKARPEYMLPVHFYGRVEHTPDGVKWLDTQVVLAMPYDTPVPGYKNNTVNTMRLWSAKAPNDFKLQDW

SEQ ID NO: 910187 - protein, 72 aa, Homo sapiens
LKTFTLSFQAAPGYHMAKLIIKLVTSIGDVVNHDPVVGDRLKVIFLENYRVSLAEKGNPGSLCWTENSLLPG

SEQ ID NO: 910188 - protein, 181 aa, Homo sapiens
MALSDADVQKQIKHMMAFIEQEANEKAEEIDAKAEEEFNIEKGRLVQTQRLKIMEYYEKKEKQIEQQKKIQMSNLMNQARLKVLRARDDLITDLLNEAKQRLSKVVKDTTRYQVLLDGLVLQGLYQLLEPRMIVRCRKQDFPLVKAAVQKAIPMYKIATKNDVDVQIDQESYLPEDIAGGS

SEQ ID NO: 910189 - protein, 116 aa, Homo sapiens
GCAVYTPRQGHSSAGVKGTMYLSQVFENDYFLCFFFAELVGVEIYNGDRKIKVSNTLEKPAGSHSPADDARSPGSLVWCKCQQEVFGLSLQEVELVVSSPAVMWKLLIFEETRMSL

SEQ ID NO: 910190 - protein, 116 aa, Homo sapiens; identical to SEQ ID NO: 910189

SEQ ID NO: 910191 - protein, 181 aa, Homo sapiens; identical to SEQ ID NO: 910188

SEQ ID NO: 910192 - protein, 181 aa, Homo sapiens; identical to SEQ ID NO: 910188

SEQ ID NO: 910193 - protein, 209 aa, Homo sapiens
IVIQHIPLTTSFKPKLEPTVHRPSIALAMALSDADVQKQIKHMMAFIEQEANEKAEEIDAKAEEEFNIEKGRLVQTQRLKIMEYYEKKEKQIEQQKKIQMSNLMNQARLKVLRARDDLITDLLNEAKQRLSKVVKDTTRYQVLLDGLVLQGLYQLLEPRMIVRCRKQDFPLVKAAVQKAIPMYKIATKNDVDVQIDQESYLPEDIAGGS

SEQ ID NO: 910194 - protein, 159 aa, Homo sapiens
MALSDADVQKQAEEEFNIEKGRLVQTQRLKIMEYYEKKEKQIEQQKKIQMSNLMNQARLKVLRARDDLITDLLNEAKQRLSKVVKDTTRYQVLLDGLVLQGLYQLLEPRMIVRCRKQDFPLVKAAVQKAIPMYKIATKNDVDVQIDQESYLPEDIAGGS

SEQ ID NO: 910195 - protein, 151 aa, Homo sapiens
MALSDADVQKQIKHMMAFIEQEANEKAEEIDAKAEEEFNIEKGRLVQTQRLKIMEYYEKKEKQIEQQKKIQMSNLMNQARLKVLRARDDLITGLYQLLEPRMIVRCRKQDFPLVKAAVQKAIPMYKIATKNDVDVQIDQESYLPEDIAGGS

SEQ ID NO: 910196 - protein, 123 aa, Homo sapiens
MALSDADVQKQIKHMMAFIEQEANEKAEEIDAKAEEEFNIEKGRLVQTQRLKIMEYYEKKEKQIEQQKKIQMSNLMNQARLKVLRARDDLITGGCMGFLGLHSPSGLKVMYLVFGPAVPTLEA

SEQ ID NO: 910197 - protein, 112 aa, Homo sapiens
MALSDADVQKQIKHMMAFIEQEANEKAEEIDAKAEEEFNIEKGRLVQTQRLKIMEYYEKKEKQIEQQKKIQMSNLMNQARLKVLRARDDLITVDLSRVAIQISQSTTDLHVR

SEQ ID NO: 910198 - protein, 215 aa, Homo sapiens
MALSDADVQKQIKHMMAFIEQEANEKAEEIDAKAEEEFNIEKGRLVQTQRLKIMEYYEKKEKQIEQQKKIQMSNLMNQARLKVLRARDDLITDLLNEAKQRLSKVVKDTTRYQVLLDGLVLQGLYQLLEPRMIVRCRKQDFPLVKAAVQKAIPMYKIATKNDVDVQIDQESYLPEDIAVGLNLYGDPHFRVPNLEPVGFSEDEAKSDLLGIHGVG

SEQ ID NO: 910199 - protein, 181 aa, Homo sapiens; identical to SEQ ID NO: 910188

SEQ ID NO: 910200 - protein, 181 aa, Homo sapiens; identical to SEQ ID NO: 910188

SEQ ID NO: 910201 - protein, 182 aa, Homo sapiens
MQSRDGVSPCWPGWSQSLDLVIRLPRPPQVLGLQAEEEFNIEKGRLVQTQRLKIMEYYEKKEKQIEQQKKIQMSNLMNQARLKVLRARDDLITDLLNEAKQRLSKVVKDTTRYQVLLDGLVLQGLYQLLEPRMIVRCRKQDFPLVKAAVQKAIPMYKIATKNDVDVQIDQESYLPEDIAGGS

SEQ ID NO: 910202 - protein, 151 aa, Homo sapiens; identical to SEQ ID NO: 910195

SEQ ID NO: 910203 - protein, 125 aa, Homo sapiens
MALSDADVQKQIKHMMAFIEQEANEKAEEIDAKAEEEFNIEKGRLVQTQRLKIMEYYEKKEKQIEQQKKIQMSNLMNQARLKVLRARDDLITDLLNEAKQRLSKVVKDTTRYQVLLDGLVLQVPS

SEQ ID NO: 910204 - protein, 112 aa, Homo sapiens
MALSDADVQKQIKHMMAFIEQEANEKAEEIDAKAEEEFNIEKGRLVQTQRLKIMEYYEKKEKQIEQQKKMKKRSRHRRLHFVLYEKILFALGIAVNPKPYPPGALNMCCVPK

SEQ ID NO: 910205 - protein, 321 aa, Homo sapiens
MEEGQYSEIEELPRRRCCRRGTQIVLLGLVTAALWAGLLTLLLLWHWDTTQSLKQLEERAARNVSQVSKNLESHHGDQMAQKSQSTQISQELEELRAEQQRLKSQDLELSWNLNGLQADLSSFKSQELNERNEASDLLERLREEVTKLRMELQVSSGFVCNTCPEKWINFQRKCYYFGKGTKQWVHARYACDDMEGQLVSIHSPEEQDFLTKHASHTGSWIGLRNLDLKGEFIWVDGSHVDYSNWAPGEPTSRSQGEDCVMMRGSGRWNDAFCDRKLGAWVCDRLATCTPPASEGSAESMGPDSRPDPDGRLPTPSAPLHS

SEQ ID NO: 910206 - protein, 153 aa, Homo sapiens
MEEGQYSEIEELPRRRCCRRGTQIVLLGLVTAALWAGLLTLLLLWREDTPSSMWSPQLMGPFCVPSFTPISELGEPNASSQNPIFPSCLPSCHCQPFPIPHPPEPLTPHPASLSSTLSAPPWLIPKTSIPSWEVGCRQVGALTIPPLHSSSLP

SEQ ID NO: 910207 - protein, 300 aa, Homo sapiens
MEEGQYSEIEELPRRRCCRRGTQIVLLGLVTAALWAGLLTLLLLWHWDTTQSLKQLEERAARNVSQVSKNLESHHGDQMAQKSQSTQISQELEELRAEQQRLKSQELNERNEASDLLERLREEVTKLRMELQVSSGFVCNTCPEKWINFQRKCYYFGKGTKQWVHARYACDDMEGQLVSIHSPEEQDFLTKHASHTGSWIGLRNLDLKGEFIWVDGSHVDYSNWAPGEPTSRSQGEDCVMMRGSGRWNDAFCDRKLGAWVCDRLATCTPPASEGSAESMGPDSRPDPDGRLPTPSAPLHS

SEQ ID NO: 910208 - protein, 321 aa, Homo sapiens; identical to SEQ ID NO: 910205

SEQ ID NO: 910209 - protein, 289 aa, Homo sapiens
MASGTSDLVHAWVLVTSSALILIGLSRLWITPDEHWDTTQSLKQLEERAARNVSQVSKNLESHHGDQMAQKSQSTQISQELEELRAEQQRLKSQELNERNEASDLLERLREEVTKLRMELQVSSGFVCNTCPEKWINFQRKCYYFGKGTKQWVHARYACDDMEGQLVSIHSPEEQDFLTKHASHTGSWIGLRNLDLKGEFIWVDGSHVDYSNWAPGEPTSRSQGEDCVMMRGSGRWNDAFCDRKLGAWVCDRLATCTPPASEGSAESMGPDSRPDPDGRLPTPSAPLHS

SEQ ID NO: 910210 - protein, 202 aa, Homo sapiens
SGRGELRVAAVDMFQVPDSEGGRAGSRAMKPPGGESSNLFGSPEEATPSSRPNRMASNIFGPTEEPQNIPKRTNPPGGKGSGIFDESTPVQTRQHLNPPGGKTSDIFGSPVTATSRLAHPNKPKDHVFLCEGEEPKSDLKAARSIPAGAEPGEKGSARKAGPAKEQEPMPTVDSHEPRLGPRPRSHNKVLNPPGGKSSISFY

SEQ ID NO: 910211 - protein, 202 aa, Homo sapiens; identical to SEQ ID NO: 910210

SEQ ID NO: 910212 - protein, 201 aa, Homo sapiens
RESRSQKQEMAEKMVPDSEGGRAGSRAMKPPGGESSNLFGSPEEATPSSRPNRMASNIFGPTEEPQNIPKRTNPPGGKGSGIFDESTPVQTRQHLNPPGGKTSDIFGSPVTATSRLAHPNKPKDHVFLCEGEEPKSDLKAARSIPAGAEPGEKGSARKAGPAKEQEPMPTVDSHEPRLGPRPRSHNKVLNPPGGKSSISFY

SEQ ID NO: 910213 - protein, 202 aa, Homo sapiens; identical to SEQ ID NO: 910210

SEQ ID NO: 910214 - protein, 82 aa, Homo sapiens
SGRGELRVAAVDMFQVPDSEGGRAGSRAMKPPGGESSNLFGSPEEATPSSRPNRMASNIFGPTEEPQNIPKRTNPPGSCFLM

SEQ ID NO: 910215 - protein, 202 aa, Homo sapiens; identical to SEQ ID NO: 910210

SEQ ID NO: 910216 - protein, 79 aa, Homo sapiens
RESRSQKQEMAEKMVPDSEGGRAGSRAMKPPGGESSNLFGSPEEATPSSRLIGCLGMTERNQNSLSTAAVGWRRRKQKH

SEQ ID NO: 910217 - protein, 202 aa, Homo sapiens; identical to SEQ ID NO: 910210

SEQ ID NO: 910218 - protein, 254 aa, Homo sapiens
SGRGELRVAAVDMFQVPDSEGGRAGSRAMKPPGGESSNLFGSPEEATPSSRPNRMASNIFGPTEEPQNIPKRTNPPGGKGSGIFDESTPVQTRQHLNPPGGKTSDIFGSPVTATSRLAHPNKPKVWTAFRRDSAAAGMPGALSKKAPRQMRHVFRENHGGCRRLSWMQALVIEFGSSPESPRKQSSLVLTEAVGEALLCWWRTPTADGLWRLLTAVLRGAEKRWGAERAADELGPCPSSTLPVSPCRGKVTVLF

SEQ ID NO: 910219 - protein, 209 aa, Homo sapiens
GRAGSRKWQLLTGSLASTSPSLLSGQGPWAPLQRAMKPPGGESSNLFGSPEEATPSSRPNRMASNIFGPTEEPQNIPKRTNPPGGKGSGIFDESTPVQTRQHLNPPGGKTSDIFGSPVTATSRLAHPNKPKDHVFLCEGEEPKSDLKAARSIPAGAEPGEKGSARKAGPAKEQEPMPTVDSHEPRLGPRPRSHNKVLNPPGGKSSISFY

SEQ ID NO: 910220 - protein, 202 aa, Homo sapiens; identical to SEQ ID NO: 910210

SEQ ID NO: 910221 - protein, 202 aa, Homo sapiens; identical to SEQ ID NO: 910210

SEQ ID NO: 910222 - protein, 145 aa, Homo sapiens
SGRGELRVAAVDMFQVPDSEGGRAGSRAMKPPGGESSNLFGSPEEATPSSRPNRMASNIFGPTEEPQNIPKRTNPPGGKGSGIFDESTPVQTRQHLNPPGGKTSDIFGSPVTATSRLAHPNKPKGSHVFISFCPNERGGKRVSLM

SEQ ID NO: 910223 - protein, 202 aa, Homo sapiens; identical to SEQ ID NO: 910210

SEQ ID NO: 910224 - protein, 95 aa, Homo sapiens
SGRGELRVAAVDMFQVPDSEGGRAGSRAMKPPGGESSNLFGSPEEATPSSRPNRMASNIFGPTEEPQNIPKRTNPPVGSAQGFVNQRQLPPFDCL

SEQ ID NO: 910225 - protein, 754 aa, Homo sapiens
MGIKVQRPRCFFDIAINNQPAGRVVFELFSDVCPKTCENFRCLCTGEKGTGKSTQKPLHYKSCLFHRVVKDFMVQGGDFSEGNGRGGESIYGGFFEDESFAVKHNKEFLLSMANRGKDTNGSQFFITTKPTPHLDGHHVVFGQVISGQEVVREIENQKTDAASKPFAEVRILSCGELIPKSKVKKEEKKRHKSSSSSSSSSSDSDSSSDSQSSSDSSDSESATEEKSKKRKKKHRKNSRKHKKEKKKRKKSKKSASSESEAENLEAQPQSTVRPEEIPPIPENRFLMRKSPPKADEKERKNRERERERECNPPNSQPASYQRRLLVTRSGRKIKGRGPRRYRTPSRSRSRDRFRRSETPPHWRQEMQRAQRMRVSSGERWIKGDKSELNEIKENQRSPVRVKERKITDHRNVSESPNRKNEKEKKVKDHKSNSKERDIRRNSEKDDKYKNKVKKRAKSKSRSKSKEKSKSKERDSKHNRNEEKRMRSRSKGRDHENVKEKEKQSDSKGKDQERSRSKEKSKQLESKSNEHDHSKSKEKDRRAQSRSRECDITKGKHSYNSRTRERSRSRDRSRRVRSRTHDRDRSRSKEYHRYREQEYRRRGRSRSRERRTPPGRSRSKDRRRRRRDSRSSEREESQSRNKDKYRNQESKSSHRKENSESEKRMYSKSRDHNSSNNSREKKADRDQSPFSKIKQSSQDNELKSSMLKNKEDEKIRSSVEKENQKSKGQENDHVHEKNKKFDHESSPGTDEDKSG

SEQ ID NO: 910226 - protein, 754 aa, Homo sapiens; identical to SEQ ID NO: 910225

SEQ ID NO: 910227 - protein, 754 aa, Homo sapiens; identical to SEQ ID NO: 910225

SEQ ID NO: 910228 - protein, 540 aa, Homo sapiens
MGIKVQRPRCFFDIAINNQPAGRVVFELFSDVCPKTCENFRCLCTGEKGTGKSTQKPLHYKSCLFHRVVKDFMVQGGDFSEGNGRGGESIYGGFFEDESFAVKHNKEFLLSMANRGKDTNGSQFFITTKPTPHLDGHHVVFGQVISGQEVVREIENQKTDAASKPFAEVRILSCGELIPKSKVKKEEKKRHKSSSSSSSSSSDSDSSSDSQSSSDSSDSESATEEKSKKRKKKHRKNSRKHKKEKKKRKKSKKSASSESEAENLEAQPQSTVRPEEIPPIPENRFLMRKSPPKADEKERKNRERERERECNPPNSQPASYQRRLLVTRSGRKIKGRGPRRYRTPSRSRSRDRFRRSETPPHWRQEMQRAQRMRVSSGERWIKGDKSELNEIKENQRSPVRVKERKITDHRNVSESPNRKNEKEKKVKDHKSNSKERDIRRNSEKDDKYKNKVKKRAKSKSRSKSKEKSKSKERDSKHNRNEEKRMRSRSKGRDHENVKEKEKQSDSKGKDQERSRSKEKSKQLESKSNEHDHSKSKETQL

SEQ ID NO: 910229 - protein, 519 aa, Homo sapiens
MGIKVQRPRCFFDIAINNQPAGRVVFELFSDVCPKTCENFRCLCTGEKGTGKSTQKPLHYKSCLFHRVVKDFMVQGGDFSEGNGRGGESIYGGFFEDESFAVKHNKEFLLSMANRGKDTNGSQFFITTKPTPHLDGHHVVFGQVISGQEVVREIENQKTDAASKPFAEVRILSCGELIPKSKVKKEEKKRHKSSSSSSSSSSDSDSSSDSQSSSDSSDSESATEEKSKKRKKKHRKNSRKHKKEKKKRKKSKKSASSESEAENLEAQPQSTVRPEEIPPIPENRFLMRKSPPKADEKERKNRERERERECNPPNSQPASYQRRLLVTRSGRKIKGRGPRRYRTPSRSRSRDRFRRSETPPHWRQEMQRAQRMRVSSGERWIKGDKSELNEIKENQRSPVRVKERKITDHRNVSESPNRKNEKEKKVKDHKSNSKERDIRRNSEKDDKYKNKVKKRAKSKSRSKSKEKSKSKERDSKHNRNEEKRMRSRSKGRDHENVKEKEKQSDSKGKDQERSRSKEK

SEQ ID NO: 910230 - protein, 699 aa, Homo sapiens
MRELSLSLYSHRVVKDFMVQGGDFSEGNGRGGESIYGGFFEDESFAVKHNKEFLLSMANRGKDTNGSQFFITTKPTPHLDGHHVVFGQVISGQEVVREIENQKTDAASKPFAEVRILSCGELIPKSKVKKEEKKRHKSSSSSSSSSSDSDSSSDSQSSSDSSDSESATEEKSKKRKKKHRKNSRKHKKEKKKRKKSKKSASSESEAENLEAQPQSTVRPEEIPPIPENRFLMRKSPPKADEKERKNRERERERECNPPNSQPASYQRRLLVTRSGRKIKGRGPRRYRTPSRSRSRDRFRRSETPPHWRQEMQRAQRMRVSSGERWIKGDKSELNEIKENQRSPVRVKERKITDHRNVSESPNRKNEKEKKVKDHKSNSKERDIRRNSEKDDKYKNKVKKRAKSKSRSKSKEKSKSKERDSKHNRNEEKRMRSRSKGRDHENVKEKEKQSDSKGKDQERSRSKEKSKQLESKSNEHDHSKSKEKDRRAQSRSRECDITKGKHSYNSRTRERSRSRDRSRRVRSRTHDRDRSRSKEYHRYREQEYRRRGRSRSRERRTPPGRSRSKDRRRRRRDSRSSEREESQSRNKDKYRNQESKSSHRKENSESEKRMYSKSRDHNSSNNSREKKADRDQSPFSKIKQSSQDNELKSSMLKNKEDEKIRSSVEKENQKSKGQENDHVHEKNKKFDHESSPGTDEDKSG

SEQ ID NO: 910231 - protein, 632 aa, Homo sapiens
NALYFRKHNSSLDGHHVVFGQVISGQEVVREIENQKTDAASKPFAEVRILSCGELIPKSKVKKEEKKRHKSSSSSSSSSSDSDSSSDSQSSSDSSDSESATEEKSKKRKKKHRKNSRKHKKEKKKRKKSKKSASSESEAENLEAQPQSTVRPEEIPPIPENRFLMRKSPPKADEKERKNRERERERECNPPNSQPASYQRRLLVTRSGRKIKGRGPRRYRTPSRSRSRDRFRRSETPPHWRQEMQRAQRMRVSSGERWIKGDKSELNEIKENQRSPVRVKERKITDHRNVSESPNRKNEKEKKVKDHKSNSKERDIRRNSEKDDKYKNKVKKRAKSKSRSKSKEKSKSKERDSKHNRNEEKRMRSRSKGRDHENVKEKEKQSDSKGKDQERSRSKEKSKQLESKSNEHDHSKSKEKDRRAQSRSRECDITKGKHSYNSRTRERSRSRDRSRRVRSRTHDRDRSRSKEYHRYREQEYRRRGRSRSRERRTPPGRSRSKDRRRRRRDSRSSEREESQSRNKDKYRNQESKSSHRKENSESEKRMYSKSRDHNSSNNSREKKADRDQSPFSKIKQSSQDNELKSSMLKNKEDEKIRSSVEKENQKSKGQENDHVHEKNKKFDHESSPGTDEDKSG

SEQ ID NO: 910232 - protein, 468 aa, Homo sapiens [sequence omitted]

SEQ ID NO: 910233 - protein, 309 aa, Homo sapiens
MGIKVQRPRCFFDIAINNQPAGRVVFELFSDVCPKTCENFRCLCTGEKGTGKSTQKPLHYKSCLFHRVVKDFMVQGGDFSEGNGRGGESIYGGFFEDESFAVKHNKEFLLSMANRGKDTNGSQFFITTKPTPHLDGHHVVFGQVISGQEVVREIENQKTDAASKPFAEVRILSCGELIPKSKVKKEEKKRHKSSSSSSSSSSDSDSSSDSQSSSDSSDSESATEEKSKKRKKKHRKNSRKHKKEKKKRKKSKKSASSESEAENLEAQPQSTVRPEEIPPIPENRFLMRKSPPKADEKERKNRERERERE

SEQ ID NO: 910234 - protein, 383 aa, Homo sapiens [sequence omitted]

SEQ ID NO: 910235 - protein, 754 aa, Homo sapiens; identical to SEQ ID NO: 910225

SEQ ID NO: 910236 - protein, 754 aa, Homo sapiens; identical to SEQ ID NO: 910225

SEQ ID NO: 910237 - protein, 255 aa, Homo sapiens [sequence omitted]

SEQ ID NO: 910238 - protein, 736 aa, Homo sapiens
MGIKVQRPRCFFDIAINNQPAGRVVFELFSDVCPKTCENFRCLCTGEKGTGKSTQKPLHYKSCLFHRVVKDFMVQGGDFSEGNGRGGESIYGGFFEDESFAVKHNKEFLLSMANRGKDTNGSQFFITTKPTPHLDGHHVVFGQVISGQEVVREIENQKTDAASKPFAEVRILSCGELIPKSKVKKEEKKRHKSSSSSSSSSSDSDSSSDSQSSSDSSDSESATEEKSKKRKKKHRKNSRKHKKEKKKRKKSKKSASSESEAENLEAQPQSTVRPEEIPPIPENRFLMRKSPPKADEKERKNRERERERECNPPNSQPASYQRRLLVTRSGRKDRFRRSETPPHWRQEMQRAQRMRVSSGERWIKGDKSELNEIKENQRSPVRVKERKITDHRNVSESPNRKNEKEKKVKDHKSNSKERDIRRNSEKDDKYKNKVKKRAKSKSRSKSKEKSKSKERDSKHNRNEEKRMRSRSKGRDHENVKEKEKQSDSKGKDQERSRSKEKSKQLESKSNEHDHSKSKEKDRRAQSRSRECDITKGKHSYNSRTRERSRSRDRSRRVRSRTHDRDRSRSKEYHRYREQEYRRRGRSRSRERRTPPGRSRSKDRRRRRRDSRSSEREESQSRNKDKYRNQESKSSHRKENSESEKRMYSKSRDHNSSNNSREKKADRDQSPFSKIKQSSQDNELKSSMLKNKEDEKIRSSVEKENQKSKGQENDHVHEKNKKFDHESSPGTDEDKSG

SEQ ID NO: 910239 - protein, 512 aa, Homo sapiens
MGIKVQRPRCFFDIAINNQPAGRVVFELFSDVCPKTCENFRCLCTGEKGTGKSTQKPLHYKSCLFHRVVKDFMVQGGDFSEGNGRGGESIYGGFFEDESFAVKHNKEFLLSMANRGKDTNGSQFFITTKPTPHLDGHHVVFGQVISGQEVVREIENQKTDAASKPFAEVRILSCGELIPKSKVKKEEKKRHKSSSSSSSSSSDSDSSSDSQSSSDSSDSESATEEKSKKRKKKHRKNSRKHKKEKKKRKKSKKSASSESEAENLEAQPQSTVRPEEIPPIPENRFLMRKSPPKADEKERKNRERERERECNPPNSQPASYQRRLLVTRSGRKIKGRGPRRYRTPSRSRSRDRFRRSETPPHWRQEMQRAQRMRVSSGERWIKGDKSELNEIKENQRSPVRVKERKITDHRNVSESPNRKNEKEKKVKDHKSNSKERDIRRNSEKDDKYKNKVKKRAKSKSRSKSKEKSKSKERDSKHNRNEEKRMRSRSKGRDHENVKEKEKQSDSKGKDQE

SEQ ID NO: 910240 - protein, 357 aa, Homo sapiens
MGIKVQRPRCFFDIAINNQPAGRVVFELFSDVCPKTCENFRCLCTGEKGTGKSTQKPLHYKSCLFHRVVKDFMVQGGDFSEGNGRGGESIYGGFFEDESFAVKHNKEFLLSMANRGKDTNGSQFFITTKPTPHLDGHHVVFGQVISGQEVVREIENQKTDAASKPFAEVRILSCGELIPKSKVKKEEKKRHKSSSSSSSSSSDSDSSSDSQSSSDSSDSESATEEKSKKRKKKHRKNSRKHKKEKKKRKKSKKSASSESEAENLEAQPQSTVRPEEIPPIPENRFLMRKSPPKADEKERKNRERERERECNPPNSQPASYQRRLLVTRSGRKIKGRGPRVGDSFPRDLHNIAFVFLK

SEQ ID NO: 910241 - protein, 438 aa, Homo sapiens
MVRSIENSYFTKVGRSVHRRGPRRYRTPSRSRSRDRFRRSETPPHWRQEMQRAQRMRVSSGERWIKGDKSELNEIKENQRSPVRVKERKITDHRNVSESPNRKNEKEKKVKDHKSNSKERDIRRNSEKDDKYKNKVKKRAKSKSRSKSKEKSKSKERDSKHNRNEEKRMRSRSKGRDHENVKEKEKQSDSKGKDQERSRSKEKSKQLESKSNEHDHSKSKEKDRRAQSRSRECDITKGKHSYNSRTRERSRSRDRSRRVRSRTHDRDRSRSKEYHRYREQEYRRRGRSRSRERRTPPGRSRSKDRRRRRRDSRSSEREESQSRNKDKYRNQESKSSHRKENSESEKRMYSKSRDHNSSNNSREKKADRDQSPFSKIKQSSQDNELKSSMLKNKEDEKIRSSVEKENQKSKGQENDHVHEKNKKFDHESSPGTDEDKSG

SEQ ID NO: 910242 - protein, 371 aa, Homo sapiens
MASELNEIKENQRSPVRVKERKITDHRNVSESPNRKNEKEKKVKDHKSNSKERDIRRNSEKDDKYKNKVKKRAKSKSRSKSKEKSKSKERDSKHNRNEEKRMRSRSKGRDHENVKEKEKQSDSKGKDQERSRSKEKSKQLESKSNEHDHSKSKEKDRRAQSRSRECDITKGKHSYNSRTRERSRSRDRSRRVRSRTHDRDRSRSKEYHRYREQEYRRRGRSRSRERRTPPGRSRSKDRRRRRRDSRSSEREESQSRNKDKYRNQESKSSHRKENSESEKRMYSKSRDHNSSNNSREKKADRDQSPFSKIKQSSQDNELKSSMLKNKEDEKIRSSVEKENQKSKGQENDHVHEKNKKFDHESSPGTDEDKSG

SEQ ID NO: 910243 - protein, 109 aa, Homo sapiens [sequence omitted]

SEQ ID NO: 910244 - protein, 139 aa, Homo sapiens
MNSGHSFSQTPSASFHGAGGGWGRPRSFPRAPTVHGGAGGARISLSFTTRSCPPPGGSWGSGRSSPLLGGNGKATMQNLNDRLASYLEKVRALEEANMKLESRILKWHQSLQKTFPIRNSTGDNGDNPRYFLQGGVPIL

SEQ ID NO: 910245 - protein, 224 aa, Homo sapiens [sequence omitted]

SEQ ID NO: 910246 - protein, 209 aa, Homo sapiens
MEKHHVPSDFNVNVKVDTGPREDLIKVLEDMRQEYELIIKKKHRDLDTWYKEQSAAMSQEAASPATVQSRQGDIHELKRTFQALEIDLQAQYSTKSALENMLSETQSRYSCKLQDMQEIISHYEEELTQLRHELERQNNEYQVLLGIKTHLEKEITTYRRLLEGESEGTREESKSSMKVSATPKIKAITQETINGRLVLCQVNEIQKHA

SEQ ID NO: 910247 - protein, 224 aa, Homo sapiens [sequence omitted]

SEQ ID NO: 910248 - protein, 224 aa, Homo sapiens [sequence omitted]

SEQ ID NO: 910249 - protein, 232 aa, Homo sapiens
LRAGWGSAGCPGPSPPSFYPQGRGERAYDIYSRLLRERIVCVMGPIDDSVASLVIAQLLFLQSESNKKPIHMYINSPGGVVTAGLAIYDTMQYILNPICTWCVGQAASMGSLLLAAGTPGMRHSLPNSRIMIHQPSGGARGQATDIAIQAEEIMKLKKQLYNIYAKHTKQSLQVIESAMERDRYMSPMEAQEFGILDKVLVHPPQDGEDEPTLVQKEPVEAAPAAEPVPAST

SEQ ID NO: 910250 - protein, 68 aa, Homo sapiens
RPPTTTTARIQASNDVRASPESCGGARGLPDPQLGPAHPLLLGLEGPLEELLICRGARYGRGIPAETL

SEQ ID NO: 910251 - protein, 277 aa, Homo sapiens
MWPGILVGGARVASCRYPALGPRLAAHFPAQRPPQRTLQNGLALQRCLHATATRALPLIPIVVEQTGRGERAYDIYSRLLRERIVCVMGPIDDSVASLVIAQLLFLQSESNKKPIHMYINSPGGVVTAGLAIYDTMQYILNPICTWCVGQAASMGSLLLAAGTPGMRHSLPNSRIMIHQPSGGARGQATDIAIQAEEIMKLKKQLYNIYAKHTKQSLQVIESAMERDRYMSPMEAQEFGILDKVLVHPPQDGEDEPTLVQKEPVEAAPAAEPVPAST

SEQ ID NO: 910252 - protein, 248 aa, Homo sapiens
NRLGTRLRVESAEADGSRRGVRRDVALPLIPIVVEQTGRGERAYDIYSRLLRERIVCVMGPIDDSVASLVIAQLLFLQSESNKKPIHMYINSPGGVVTAGLAIYDTMQYILNPICTWCVGQAASMGSLLLAAGTPGMRHSLPNSRIMIHQPSGGARGQATDIAIQAEEIMKLKKQLYNIYAKHTKQSLQVIESAMERDRYMSPMEAQEFGILDKVLVHPPQDGEDEPTLVQKEPVEAAPAAEPVPAST

SEQ ID NO: 910253 - protein, 136 aa, Homo sapiens
MTALPALLSHSSSSCNPRATRSPSTCTSTALSRIMIHQPSGGARGQATDIAIQAEEIMKLKKQLYNIYAKHTKQSLQVIESAMERDRYMSPMEAQEFGILDKVLVHPPQDGEDEPTLVQKEPVEAAPAAEPVPAST

SEQ ID NO: 910254 - protein, 242 aa, Homo sapiens
MWPGILVGGARVASCRYPALGPRLAAHFPAQRPPQRTLQNGLALQRCLHATATRALPLIPIVVEQTGRGERAYDIYSRLLRERIVCVMGPIDDSVASLVIAQLLFLQSESNKKPIHMYINSPGGVVTAGLAIYDTMQYILNPICTWCVGQAASMGSLLLAAGTPGMRHSLPNSRIMIHQPSGGARGQATDIAIQAEEIMKLKKQLYNIYAKHTKQSLQVIESAMERCRMTRADGSNSRHLQT

SEQ ID NO: 910255 - protein, 136 aa, Homo sapiens; identical to SEQ ID NO: 910253

SEQ ID NO: 910256 - protein, 193 aa, Homo sapiens
MWPGILVGGARVASCRYPALGPRLAAHFPAQRPPQRTLQNGLALQRCLHATATRALPLIPIVVEQTGRGERAYDIYSRLLRERIVCVMGPIDDSVASLVIAQLLFLQSESNKKPIHMYINSPGGVVTAGLAIYDTMQYILNPGFPNAQRSTKDWPGRMWRRLLLPLMIRHRYVELCRSQSRAPLNLNVGPALS

SEQ ID NO: 910257 - protein, 277 aa, Homo sapiens; identical to SEQ ID NO: 910251

SEQ ID NO: 910258 - protein, 277 aa, Homo sapiens; identical to SEQ ID NO: 910251

SEQ ID NO: 910259 - protein, 161 aa, Homo sapiens [sequence omitted]

SEQ ID NO: 910260 - protein, 143 aa, Homo sapiens
MWPGILVGGARVASCRYPALGPRLAAHFPAQRPPQRTLQNGLALQRCLHATATRALPLIPIVVEQTGRGERAYDIYSRLLRERIVCVMGPIDDSVASLVIAQLLFLQSESNKKPIHMYINSPGPSHRHCHPGRGDHEAQEAAL

SEQ ID NO: 910261 - protein, 171 aa, Homo sapiens
MWPGILVGGARVASCRYPALGPRLAAHFPAQRPPQRTLQNGLALQRCLHATATRALPLIPIVVEQTGRGERAYDIYSRLLRERIVCVMGPIDDSVASLVIAQLLFLQSESNKKPIHMYINSPGGVVTAGLAIYDTMQYILNPPQDGEDEPTLVQKEPVEAAPAAEPVPAST

SEQ ID NO: 910262 - protein, 127 aa, Homo sapiens
MWPGILVGGARVASCRYPALGPRLAAHFPAQRPPQRTLQNGLALQRCLHATATRALPLIPIVVEQTGRGERAYDIYSRLLRERIVCVMGPVSAPRRDPPQDSPKRLPTLPAPLLPWPQTFPQAPLPF

SEQ ID NO: 910263 - protein, 503 aa, Homo sapiens
VSASALPWSSPPWRGRRVGMAAGGDHGSPDSYRSPLASRYASPEMCFVFSDRYKFRTWRQLWLWLAEAEQTLGLPITDEQIQEMKSNLENIDFKMAAEEEKRLRHDVMAHVHTFGHCCPKAAGIIHLGATSCYVGDNTDLIILRNALDLLLPKLARVISRLADFAKERASLPTLGFTHFQPAQLTTVGKRCCLWIQDLCMDLQNLKRVRDDLRFRGVKGTTGTQASFLQLFEGDDHKVEQLDKMVTEKAGFKRAFIITGQTYTRKVDIEVLSVLASLGASVHKICTDIRLLANLKEMEEPFEKQQIGSSAMPYKRNPMRSERCCSLARHLMTLVMDPLQTASVQWFERTLDDSANRRICLAEAFLTADTILNTLQNISEGLVVYPKVIERRIRQELPFMATENIIMAMVKAGGSRQDCHEKIRVLSQQAASVVKQEGGDNDLIERIQVDAYFSPIHSQLDHLLDPSSFTGRASQQVQRFLEEEVYPLLKPYESVMKVKAELCL

SEQ ID NO: 910264 - protein, 503 aa, Homo sapiens; identical to SEQ ID NO: 910263

SEQ ID NO: 910265 - protein, 496 aa, Homo sapiens
VSASALPWSSPPWRGRRVGMAAGGDHGSPDSYRSPLASRYASPEMCFVFSDRYKFRTWRQLWLWLAEAEQTLGLPITDEQIQEMKSNLENIDFKMAAEEEKRLRHDVMAHVHTFGHCCPKAAGIIHLGATSCYVGDNTDLIILRNALDLLLPKLARVISRLADFAKERASLPTLGFTHFQPAQLTTVGKRCCLWIQDLCMDLQNLKRVRDDLRFRGVKGTTGTQASFLQLFEGDDHKVEQLDKMVTEKAGFKRAFIITGQTYTRKVDIEVLSVLASLGASVHKICTDIRLLANLKEMEEPFEKQQIGSSAMPYKRNPMRSERCCSLARHLMTLVMDPLQTASVQWFERTLDDSANRRICLAEAFLTADTILNTLQNISEGLVVYPKVIERRIRQELPFMATENIIMAMVKAGGSRQDCHEKIRVLSQQAASVVKQEGGDNDLIERIQVDAYFSPIHSQLDHLLDPSSFTGRASQQLQRFLEEVLWSPPTPSCKRVS

SEQ ID NO: 910266 - protein, 444 aa, Homo sapiens
VSASALPWSSPPWRGRRVGMAAGGDHGSPDSYRSPLASRYASPEMCFVFSDRYKFRTWRQLWLWLAEAEQTLGLPITDEQIQEMKSNLENIDFKMAAEEEKRLRHDVMAHVHTFGHCCPKAAGIIHLGATSCYVGDNTDLIILRNALDLLLPKLARVISRLADFAKERASLPTLGFTHFQPAQLTTVGKRCCLWIQDLCMDLQNLKRVRDDLRFRGVKGTTGTQASFLQLFEGDDHKVEQLDKMVTEKAGFKRAFIITGQTYTRKVDIEVLSVLASLGASVHKICTDIRLLANLKEMEEPFEKQQIGSSAMPYKRNPMRSERCCSLARHLMTLVMDPLQTASVQWFERTLDDSANRRICLAEAFLTADTILNTLQNISEGLVVYPKVIERRIRQELPFMATENIIMAMVKAGGSRQVQRFLEEEVYPLLKPYESVMKVKAELCL

SEQ ID NO: 910267 - protein, 488 aa, Homo sapiens
VSASALPWSSPPWRGRRVGMAAGGDHGSPDSYRSPLASRYASPEMCFVFSDRYKFRTWRQLWLWLAEAEQTLGLPITDEQIQEMKSNLENIDFKMAAEEEKRLRHDVMAHVHTFGHCCPKAAGIIHLGATSCYVGDNTLARVISRLADFAKERASLPTLGFTHFQPAQLTTVGKRCCLWIQDLCMDLQNLKRVRDDLRFRGVKGTTGTQASFLQLFEGDDHKVEQLDKMVTEKAGFKRAFIITGQTYTRKVDIEVLSVLASLGASVHKICTDIRLLANLKEMEEPFEKQQIGSSAMPYKRNPMRSERCCSLARHLMTLVMDPLQTASVQWFERTLDDSANRRICLAEAFLTADTILNTLQNISEGLVVYPKVIERRIRQELPFMATENIIMAMVKAGGSRQDCHEKIRVLSQQAASVVKQEGGDNDLIERIQVDAYFSPIHSQLDHLLDPSSFTGRASQQVQRFLEEEVYPLLKPYESVMKVKAELCL

SEQ ID NO: 910268 - protein, 304 aa, Homo sapiens
MDLQNLKRVRDDLRFRGVKGTTGTQASFLQLFEGDDHKVEQLDKMVTEKAGFKRAFIITGQTYTRKVDIEVLSVLASLGASVHKICTDIRLLANLKEMEEPFEKQQIGSSAMPYKRNPMRSERCCSLARHLMTLVMDPLQTASVQWFERTLDDSANRRICLAEAFLTADTILNTLQNISEGLVVYPKVIERRIRQELPFMATENIIMAMVKAGGSRQDCHEKIRVLSQQAASVVKQEGGDNDLIERIQVDAYFSPIHSQLDHLLDPSSFTGRASQQVQRFLEEEVYPLLKPYESVMKVKAELCL

SEQ ID NO: 910269 - protein, 329 aa, Homo sapiens
MLETILPAQLTTVGKRCCLWIQDLCMDLQNLKRVRDDLRFRGVKGTTGTQASFLQLFEGDDHKVEQLDKMVTEKAGFKRAFIITGQTYTRKVDIEVLSVLASLGASVHKICTDIRLLANLKEMEEPFEKQQIGSSAMPYKRNPMRSERCCSLARHLMTLVMDPLQTASVQWFERTLDDSANRRICLAEAFLTADTILNTLQNISEGLVVYPKVIERRIRQELPFMATENIIMAMVKAGGSRQDCHEKIRVLSQQAASVVKQEGGDNDLIERIQVDAYFSPIHSQLDHLLDPSSFTGRASQQVQRFLEEEVYPLLKPYESVMKVKAELCL

SEQ ID NO: 910270 - protein, 292 aa, Homo sapiens
VSASALPWSSPPWRGRRVGMAAGGDHGSPDSYRSPLASRYASPEMCFVFSDRYKFRTWRQLWLWLAEAEQTLGLPITDEQIQEMKSNLENIDFKMAAEEEKRLRHDVMAHVHTFGHCCPKAAGIIHLGATSCYVGDNTDLIILRNALDLLLPKLARVISRLADFAKERASLPTLGFTHFQPAQLTTVGKRCCLWIQDLCMDLQNLKRVRDDLRFRGVKGTTGTQASFLQLFEGDDHKVEQLDKMVTEKAGFKRAFIITGQTYTRKVDIEVLSVLASLGASVHKNCTATLLAT

SEQ ID NO: 910271 - protein, 157 aa, Homo sapiens
PTWLLVMEILNVTLVPYGNAQEQNVSGRWEFKCQHGEEECKFNKVDIEESKVHSSISTIMAMVKAGGSRQDCHEKIRVLSQQAASVVKQEGGDNDLIERIQVDAYFSPIHSQLDHLLDPSSFTGRASQQVQRFLEEEVYPLLKPYESVMKVKAELCL

SEQ ID NO: 910272 - protein, 444 aa, Homo sapiens; identical to SEQ ID NO: 910266

SEQ ID NO: 910273 - protein, 375 aa, Homo sapiens
VSASALPWSSPPWRGRRVGMAAGGDHGSPDSYRSPLASRYASPEMCFVFSDRYKFRTWRQLWLWLAEAEQTLGLPITDEQIQEMKSNLENIDFKMAAEEEKRLRHDVMAHVHTFGHCCPKAAGIIHLGATSCYVGDNTDLIILRNALDLLLPKLARVISRLADFAKERASLPTLGFTHFQPAQLTTVGKRCCLWIQDLCMDLQNLKRVRDDLRFRGVKGTTGTQASFLQLFEGDDHKVEQLDKMVTEKAGFKRAFIITGQTYTRKVDIEVLSVLASLGASVHKICTDIRLLANLKEMEEPFEKQQIGSSAMPYKRNPMRSERCCSLARHLMTLVMDPLQTASVQWFERTLDDSANRSVAQGHHIHQVEWRSEGGT

SEQ ID NO: 910274 - protein, 497 aa, Homo sapiens
VSASALPWSSPPWRGRRVGMAAGGDHGSPDSYRSPLASRYASPEMCFVFSDRYKFRTWRQLWLWLAEAEQTLGLPITDEQIQEMKSNLENIDFKMAAEEEKRLRHDVMAHVHTFGHCCPKAAGIIHLGATSCYVGDNTDLIILRNALDLLLPKLARVISRLADFAKERASLPTLGFTHFQPAQLTTVGKRCCLWIQDLCMDLQNLKRVRDDLRFRGVKGTTGTQASFLQLFEGDDHKVEQLDKMVTEKAGFKRAFIITGQTYTRKVDIEVLSVLASLGASVHKICRIASGNSGMGTLKTECSSAMPYKRNPMRSERCCSLARHLMTLVMDPLQTASVQWFERTLDDSANRRICLAEAFLTADTILNTLQNISEGLVVYPKVIERRIRQELPFMATENIIMAMVKAGGSRQDCHEKIRVLSQQAASVVKQEGGDNDLIERIQVDAYFSPIHSQLDHLLDPSSFTGRASQQVQRFLEEEVYPLLKPYESVMKVKAELCL

SEQ ID NO: 910275 - protein, 332 aa, Homo sapiens
MHLTCFCQRPAQLTTVGKRCCLWIQDLCMDLQNLKRVRDDLRFRGVKGTTGTQASFLQLFEGDDHKVEQLDKMVTEKAGFKRAFIITGQTYTRKVDIEVLSVLASLGASVHKICTDIRLLANLKEMEEPFEKQQIGSSAMPYKRNPMRSERCCSLARHLMTLVMDPLQTASVQWFERTLDDSANRRICLAEAFLTADTILNTLQNISEGLVVYPKVIERRIRQELPFMATENIIMAMVKAGGSRQDCHEKIRVLSQQAASVVKQEGGDNDLIERIQVDAYFSPIHSQLDHLLDPSSFTGRASQQVQRFLEEEVYPLLKPYESVMKVKAELCL

SEQ ID NO: 910276 - protein, 335 aa, Homo sapiens
VSASALPWSSPPWRGRRVGMAAGGDHGSPDSYRSPLASRYASPEMCFVFSDRYKFRTWRQLWLWLAEAEQTLGLPITDEQIQEMKSNLENIDFKMAAEEEKRLRHDVMAHVHTFGHCCPKAAGIIHLGATSCYVGDNTDLIILRNALDLLLPKLARVISRLADFAKERASLPTLGFTHFQPAQLTTVGKRCCLWIQDLCMDLQNLKRVRDDLRFRGVKGTTGTQASFLQLFEGDDHKVEQLDKMVTEKAGFKRAFIITGQTYTRKVDIEVLSVLASLGASVHKICRIASGNSGMGDLENRMVRGAKKEPVSNVGCPGTLAQNFSVGRVCPAGEPH

SEQ ID NO: 910277 - protein, 283 aa, Homo sapiens
VSASALPWSSPPWRGRRVGMAAGGDHGSPDSYRSPLASRYASPEMCFVFSDRYKFRTWRQLWLWLAEAEQTLGLPITDEQIQEMKSNLENIDFKMAAEEEKRLRHDVMAHVHTFGHCCPKAAGIIHLGATSCYVGDNTDLIILRNALDLLLPKLARVISRLADFAKERASLPTLGFTHFQPAQLTTVGKRCCLWIQDCHEKIRVLSQQAASVVKQEGGDNDLIERIQVDAYFSPIHSQLDHLLDPSSFTGRASQQVQRFLEEEVYPLLKPYESVMKVKAELCL

SEQ ID NO: 910278 - protein, 197 aa, Homo sapiens
GGAAGVSRRCNLLRRRPREPADPGLVAKSDVVTRIKTEEGEEAGGQKRQWQQRPEQPQPSGSSRRSFCRASVPAPILPAPSVVVWADLNSQVKSSWVIMAEGGFDPCECVCSHEHAMRRLINLLRQSQSYCTDTECLQELPGPSGDNGISVTMILVAWMVIALILFLLRPPNLRGSSLPGKPTSPHNGQDPPAPPVD

SEQ ID NO: 910279 - protein, 197 aa, Homo sapiens; identical to SEQ ID NO: 910278

SEQ ID NO: 910280 - protein, 197 aa, Homo sapiens; identical to SEQ ID NO: 910278

SEQ ID NO: 910281 - protein, 197 aa, Homo sapiens; identical to SEQ ID NO: 910278

SEQ ID NO: 910282 - protein, 197 aa, Homo sapiens; identical to SEQ ID NO: 910278

SEQ ID NO: 910283 - protein, 197 aa, Homo sapiens; identical to SEQ ID NO: 910278

SEQ ID NO: 910284 - protein, 197 aa, Homo sapiens; identical to SEQ ID NO: 910278

SEQ ID NO: 910285 - protein, 136 aa, Homo sapiens
GGAAGVSRRCNLLRRRPREPADPGLVAKSDVVTRIKTEEGEEAGGQKRQWQQRPEQPQPSGSSRRSFCRASVPAPILPAPSVVVWADLNSQVKSSWVIMAEGGFDPCECVCSHEHAMRRLINLYRDPLVIMASVLQ

SEQ ID NO: 910286 - protein, 133 aa, Homo sapiens
GGAAGVSRRCNLLRRRPREPADPGLVAKSDVVTRIKTEEGEEAGGQKRQWQQRPEQPQPSGSSRRSFCRASVPAPILPAPSVVVWADLNSQVKSSWVIMAEGGFDPCECVCSHEHAMRRLINLGQDPPAPPVD

SEQ ID NO: 910287 - protein, 197 aa, Homo sapiens; identical to SEQ ID NO: 910278

SEQ ID NO: 910288 - protein, 63 aa, Homo sapiens
MGSPRSIGETPLLGNWDRRRCTSRGREEAVSTKRAGFDRDRNATLNGEHNNRSTAGDTFLFAL

SEQ ID NO: 910289 - protein, 197 aa, Homo sapiens; identical to SEQ ID NO: 910278

SEQ ID NO: 910290 - protein, 197 aa, Homo sapiens; identical to SEQ ID NO: 910278

SEQ ID NO: 910291 - protein, 197 aa, Homo sapiens; identical to SEQ ID NO: 910278

SEQ ID NO: 910292 - protein, 148 aa, Homo sapiens
GGAAGVSRRCNLLRRRPREPADPGLVAKSDVVTRIKTDLNSQVKSSWVIMAEGGFDPCECVCSHEHAMRRLINLLRQSQSYCTDTECLQELPGPSGDNGISVTMILVAWMVIALILFLLRPPNLRGSSLPGKPTSPHNGQDPPAPPVD

SEQ ID NO: 910293 - protein, 152 aa, Homo sapiens
GGAAGVSRRCNLLRRRPREPADPGLVAKSDVVTRIKTEEGEEAGGQKRQWQQRPEQPQPSGSSRRSFCRASVPAPILPAPSVVVWADLNSQVKSSWVIMAEGGFDPCECVCSHEHAMRRLINLLRQSQSYCTDTECLQEWTRSTSSSCGLTL

SEQ ID NO: 910294 - protein, 197 aa, Homo sapiens; identical to SEQ ID NO: 910278

SEQ ID NO: 910295 - protein, 243 aa, Homo sapiens
TIGRYEAAVKETPCRGLGSPCPLPVSHLAAVCNPPAPPAGLDVLSLSLAPGACFRNSPHLCVLCFAVIRAKAVSEKEVDSGNDIYGNPIKRIQYEIKQIKMFKGPEKDIEFIYTAPSSAVCGVSLDVGGKKEYLIAGKAEGDGKMHITLCDFIVPWDTLSTTQKKSLNHRYQMGCECKITRCPMIPCYISSPDECLWMDWVTEKNINGHQAKFFACIKRSDGSCAWYRGAAPPKQEFLDIEDP

SEQ ID NO: 910296 - protein, 143 aa, Homo sapiens
MFKGPEKDIEFIYTAPSSAVCGVSLDVGGKKEYLIAGKAEGDGKMHITLCDFIVPWDTLSTTQKKSLNHRYQMGCECKITRCPMIPCYISSPDECLWMDWVTEKNINGHQAKFFACIKRSDGSCAWYRGAAPPKQEFLDIEDP

SEQ ID NO: 910297 - protein, 117 aa, Homo sapiens
SSVIPVYLIAGKAEGDGKMHITLCDFIVPWDTLSTTQKKSLNHRYQMGCECKITRCPMIPCYISSPDECLWMDWVTEKNINGHQAKFFACIKRSDGSCAWYRGAAPPKQEFLDIEDP

SEQ ID NO: 910298 - protein, 127 aa, Homo sapiens
KQLGPHRSQDVGGKKEYLIAGKAEGDGKMHITLCDFIVPWDTLSTTQKKSLNHRYQMGCECKITRCPMIPCYISSPDECLWMDWVTEKNINGHQAKFFACIKRSDGSCAWYRGAAPPKQEFLDIEDP

SEQ ID NO: 910299 - protein, 220 aa, Homo sapiens
MGAAARTLRLALGLLLLATLLRPADACSCSPVHPQQAFCNADVVIRAKAVSEKEVDSGNDIYGNPIKRIQYEIKQIKMFKGPEKDIEFIYTAPSSAVCGVSLDVGGKKEYLIAGKAEGDGKMHITLCDFIVPWDTLSTTQKKSLNHRYQMGCECKITRCPMIPCYISSPDECLWMDWVTEKNINGHQAKFFACIKRSDGSCAWYRGAAPPKQEFLDIEDP

SEQ ID NO: 910300 - protein, 220 aa, Homo sapiens; identical to SEQ ID NO: 910299

SEQ ID NO: 910301 - protein, 220 aa, Homo sapiens; identical to SEQ ID NO: 910299

SEQ ID NO: 910302 - protein, 220 aa, Homo sapiens; identical to SEQ ID NO: 910299

SEQ ID NO: 910303 - protein, 220 aa, Homo sapiens; identical to SEQ ID NO: 910299

SEQ ID NO: 910304 - protein, 220 aa, Homo sapiens; identical to SEQ ID NO: 910299

SEQ ID NO: 910305 - protein, 220 aa, Homo sapiens; identical to SEQ ID NO: 910299

SEQ ID NO: 910306 - protein, 220 aa, Homo sapiens; identical to SEQ ID NO: 910299

SEQ ID NO: 910307 - protein, 220 aa, Homo sapiens; identical to SEQ ID NO: 910299

SEQ ID NO: 910308 - protein, 243 aa, Homo sapiens
GWASSLSLEEETPCRGLGSPCPLPVSHLAAVCNPPAPPAGLDVLSLSLAPGACFRNSPHLCVLCFAVIRAKAVSEKEVDSGNDIYGNPIKRIQYEIKQIKMFKGPEKDIEFIYTAPSSAVCGVSLDVGGKKEYLIAGKAEGDGKMHITLCDFIVPWDTLSTTQKKSLNHRYQMGCECKITRCPMIPCYISSPDECLWMDWVTEKNINGHQAKFFACIKRSDGSCAWYRGAAPPKQEFLDIEDP

SEQ ID NO: 910309 - protein, 177 aa, Homo sapiens
MIRAKAVSEKEVDSGNDIYGNPIKRIQYEIKQIKMFKGPEKDIEFIYTAPSSAVCGVSLDVGGKKEYLIAGKAEGDGKMHITLCDFIVPWDTLSTTQKKSLNHRYQMGCECKITRCPMIPCYISSPDECLWMDWVTEKNINGHQAKFFACIKRSDGSCAWYRGAAPPKQEFLDIEDP

SEQ ID NO: 910310 - protein, 115 aa, Homo sapiens
MLWRPAGWERAVPVDVALLPAGVLGTTALPLAHCLLAWPVIRAKAVSEKEVDSGNDIYGNPIKRIQYEIKQIKMFKGPEKDIEFIYTAPSSAVCGVSLDVGGKKEYLIADAHHPL

SEQ ID NO: 910311 - protein, 220 aa, Homo sapiens; identical to SEQ ID NO: 910299

SEQ ID NO: 910312 - protein, 220 aa, Homo sapiens; identical to SEQ ID NO: 910299

SEQ ID NO: 910313 - protein, 220 aa, Homo sapiens; identical to SEQ ID NO: 910299

SEQ ID NO: 910314 - protein, 220 aa, Homo sapiens; identical to SEQ ID NO: 910299

SEQ ID NO: 910315 - protein, 220 aa, Homo sapiens; identical to SEQ ID NO: 910299

SEQ ID NO: 910316 - protein, 85 aa, Homo sapiens
SLQRQGSLQRQGSLQRQGSLQRQGSLQRQGSVEHWSCLDSPALWSYPGIPWRLQNLDAAVFYSTYFCQIGKETLSHRILKNWRLQ

SEQ ID NO: 910317 - protein, 135 aa, Homo sapiens [sequence omitted]

SEQ ID NO: 910318 - protein, 457 aa, Homo sapiens [sequence omitted]

SEQ ID NO: 910319 - protein, 439 aa, Homo sapiens
MQTVKKEQASLDASSNVDKMMVLNSALTEVSEDSTTGEELLLSEGSVGKNKSSACRRKREFIPDEKKDAMYWEKRRKNNEAAKRSREKRRLNDLVLENKLIALGEENATLKAELLSLKLKFGLISSTAYAQEIQKLSNSTAVYFQDYQTSKSNVSSFVDEHEPSMVSSSCISVIKHSPQSSLSDVSEVSSVEHTQESSVQGSCRSPENKFQIIKQEPMELESYTREPRDDRGSYTASIYQNYMGNSFSGYSHSPPLLQVNRSSSNSPRTSETDDGVVGKSSDGEDEQQVPKGPIHSPVELKHVHATVVKVPEVNSSALPHKLRIKAKAMQIKVEAFDNEFEATQKLSSPIDMTSKRHFELEKHSAPSMVHSSLTPFSVQVTNIQDWSLKSEHWHQKELSGKTQNSFNLYLKQGIANLSAEVVSLKRLIATQPISASDSG

SEQ ID NO: 910320 - protein, 457 aa, Homo sapiens [sequence omitted]

SEQ ID NO: 910321 - protein, 439 aa, Homo sapiens; identical to SEQ ID NO: 910319

SEQ ID NO: 910322 - protein, 1395 aa, Homo sapiens
MDTKLMCLLFFFSLPPLLVSNHTGRIKVVFTPSICKVTCTKGSCQNSCEKGNTTTLISENGHAADTLTATNFRVVICHLPCMNGGQCSSRDKCQCPPNFTGKLCQIPVHGASVPKLYQHSQQPGKALGTHVIHSTHTLPLTVTSQQGVKVKFPPNIVNIHVKHPPEASVQIHQVSRIDGPTGQKTKEAQPGQSQVSYQGLPVQKTQTIHSTYSHQQVIPHVYPVAAKTQLGRCFQETIGSQCGKALPGLSKQEDCCGTVGTSWGFNKCQKCPKKPSYHGYNQMMECLPGYKRVNNTFCQDINECQLQGVCPNGECLNTMGSYRCTCKIGFGPDPTFSSCVPDPPVISEEKGPCYRLVSSGRQCMHPLSVHLTKQLCCCSVGKAWGPHCEKCPLPGTAAFKEICPGGMGYTVSGVHRRRPIHHHVGKGPVFVKPKNTQPVAKSTHPPPLPAKEEPVEALTFSREHGPGVAEPEVATAPPEKEIPSLDQEKTKLEPGQPQLSPGISTIHLHPQFPVVIEKTSPPVPVEVAPEASTSSASQVIAPTQVTEINECTVNPDICGAGHCINLPVRYTCICYEGYRFSEQQRKCVDIDECTQVQHLCSQGRCENTEGSFLCICPAGFMASEEGTNCIDVDECLRPDVCGEGHCVNTVGAFRCEYCDSGYRMTQRGRCEDIDECLNPSTCPDEQCVNSPGSYQCVPCTEGFRGWNGQCLDVDECLEPNVCANGDCSNLEGSYMCSCHKGYTRTPDHKHCRDIDECQQGNLCVNGQCKNTEGSFRCTCGQGYQLSAAKDQCEDIDECQHRHLCAHGQCRNTEGSFQCVCDQGYRASGLGDHCEDINECLEDKSVCQRGDCINTAGSYDCTCPDGFQLDDNKTCQDINECEHPGLCGPQGECLNTEGSFHCVCQQGFSISADGRTCEDIDECVNNTVCDSHGFCDNTAGSFRCLCYQGFQAPQDGQGCVDVNECELLSGVCGEAFCENVEGSFLCVCADENQEYSPMTGQCRSRTSTDLDVDVDQPKEEKKECYYNLNDASLCDNVLAPNVTKQECCCTSGAGWGDNCEIFPCPVLGTAEFTEMCPKGKGFVPAGESSSEAGGENYKDADECLLFGQEICKNGFCLNTRPGYECYCKQGTYYDPVKLQCFDMDECQDPSSCIDGQCVNTEGSYNCFCTHPMVLDASEKRCIRPAESNEQIEETDVYQDLCWEHLSDEYVCSRPLVGKQTTYTECCCLYGEAWGMQCALCPLKDSDDYAQLCNIPVTGRRQPYGRDALVDFSEQYTPEADPYFIQDRFLNSFEELQAEECGILNGCENGRCVRVQEGYTCDCFDGYHLDTAKMTCVDVNECDELNNRMSLCKNAKCINTDGSYKCLCLPGYVPSDKPNYCTPLNTALNLEKDSDLE

SEQ ID NO: 910323 - protein, 656 aa, Homo sapiens
SRGSRMRQDKHCRDIDECQQGNLCVNGQCKNTEGSFRCTCGQGYQLSAAKDQCEDIDECQHRHLCAHGQCRNTEGSFQCVCDQGYRASGLGDHCEDINECLEDKSVCQRGDCINTAGSYDCTCPDGFQLDDNKTCQDINECEHPGLCGPQGECLNTEGSFHCVCQQGFSISADGRTCEDIDECVNNTVCDSHGFCDNTAGSFRCLCYQGFQAPQDGQGCVDVNECELLSGVCGEAFCENVEGSFLCVCADENQEYSPMTGQCRSRTSTDLDVDVDQPKEEKKECYYNLNDASLCDNVLAPNVTKQECCCTSGAGWGDNCEIFPCPVLGTAEFTEMCPKGKGFVPAGESSSEAGGENYKDADECLLFGQEICKNGFCLNTRPGYECYCKQGTYYDPVKLQCFDMDECQDPSSCIDGQCVNTEGSYNCFCTHPMVLDASEKRCIRPAESNEQIEETDVYQDLCWEHLSDEYVCSRPLVGKQTTYTECCCLYGEAWGMQCALCPLKDSDDYAQLCNIPVTGRRQPYGRDALVDFSEQYTPEADPYFIQDRFLNSFEELQAEECGILNGCENGRCVRVQEGYTCDCFDGYHLDTAKMTCVDVNECDELNNRMSLCKNAKCINTDGSYKCLCLPGYVPSDKPNYCTPLNTALNLEKDSDLE

SEQ ID NO: 910324 - protein, 1353 aa, Homo sapiens
MDTKLMCLLFFFSLPPLLVSNHTGRIKVVFTPSICKVTCTKGSCQNSCEKGNTTTLISENGHAADTLTATNFRVVICHLPCMNGGQCSSRDKCQCPPNFTGKLCQIPVHGASVPKLYQHSQQPGKALGTHVIHSTHTLPLTVTSQQGVKVKFPPNIVNIHVKHPPEASVQIHQVSRIDGPTGQKTKEAQPGQSQVSYQGLPVQKTQTIHSTYSHQQVIPHVYPVAAKTQLGRCFQETIGSQCGKALPGLSKQEDCCGTVGTSWGFNKCQKCPKKPSYHGYNQMMECLPGYKRVNNTFCQDINECQLQGVCPNGECLNTMGSYRCTCKIGFGPDPTFSSCVPDPPVISEEKGPCYRLVSSGRQCMHPLSVHLTKQLCCCSVGKAWGPHCEKCPLPGTAAFKEICPGGMGYTVSGVHRRRPIHHHVGKGPVFVKPKNTQPVAKSTHPPPLPAKEEPVEALTFSREHGPGVAEPEVATAPPEKEIPSLDQEKTKLEPGQPQLSPGISTIHLHPQFPVVIEKTSPPVPVEVAPEASTSSASQVIAPTQVTEINECTVNPDICGAGHCINLPVRYTCICYEGYRFSEQQRKCVDIDECTQVQHLCSQGRCENTEGSFLCICPAGFMASEEGTNCIDVDECLRPDVCGEGHCVNTVGAFRCEYCDSGYRMTQRGRCEDIDECLNPSTCPDEQCVNSPGSYQCVPCTEGFRGWNGQCLDVDECLEPNVCANGDCSNLEGSYMCSCHKGYTRTPDHKHCRDIDECQQGNLCVNGQCKNTEGSFRCTCGQGYQLSAAKDQCEDIDECQHRHLCAHGQCRNTEGSFQCVCDQGYRASGLGDHCEDINECLEDKSVCQRGDCINTAGSYDCTCPDGFQLDDNKTCQDINECEHPGLCGPQGECLNTEGSFHCVCQQGFSISADGRTCEDVNECELLSGVCGEAFCENVEGSFLCVCADENQEYSPMTGQCRSRTSTDLDVDVDQPKEEKKECYYNLNDASLCDNVLAPNVTKQECCCTSGAGWGDNCEIFPCPVLGTAEFTEMCPKGKGFVPAGESSSEAGGENYKDADECLLFGQEICKNGFCLNTRPGYECYCKQGTYYDPVKLQCFDMDECQDPSSCIDGQCVNTEGSYNCFCTHPMVLDASEKRCIRPAESNEQIEETDVYQDLCWEHLSDEYVCSRPLVGKQTTYTECCCLYGEAWGMQCALCPLKDSDDYAQLCNIPVTGRRQPYGRDALVDFSEQYTPEADPYFIQDRFLNSFEELQAEECGILNGCENGRCVRVQEGYTCDCFDGYHLDTAKMTCVDVNECDELNNRMSLCKNAKCINTDGSYKCLCLPGYVPSDKPNYCTPLNTALNLEKDSDLE

SEQ ID NO: 910325 - protein, 1395 aa, Homo sapiens; identical to SEQ ID NO: 910322

SEQ ID NO: 910326 - protein, 431 aa, Homo sapiens
FFGLIYIYIYICENVEGSFLCVCADENQEYSPMTGQCRSRTSTDLDVDVDQPKEEKKECYYNLNDASLCDNVLAPNVTKQECCCTSGAGWGDNCEIFPCPVLGTAEFTEMCPKGKGFVPAGESSSEAGGENYKDADECLLFGQEICKNGFCLNTRPGYECYCKQGTYYDPVKLQCFDMDECQDPSSCIDGQCVNTEGSYNCFCTHPMVLDASEKRCIRPAESNEQIEETDVYQDLCWEHLSDEYVCSRPLVGKQTTYTECCCLYGEAWGMQCALCPLKDSDDYAQLCNIPVTGRRQPYGRDALVDFSEQYTPEADPYFIQDRFLNSFEELQAEECGILNGCENGRCVRVQEGYTCDCFDGYHLDTAKMTCVDVNECDELNNRMSLCKNAKCINTDGSYKCLCLPGYVPSDKPNYCTPLNTALNLEKDSDLE

SEQ ID NO: 910327 - protein, 1276 aa, Homo sapiens
MDTKLMCLLFFFSLPPLLVSNHTGRIKVVFTPSICKVTCTKGSCQNSCEKGNTTTLISENGHAADTLTATNFRVVICHLPCMNGGQCSSRDKCQCPPNFTGKLCQIPVHGASVPKLYQHSQQPGKALGTHVIHSTHTLPLTVTSQQGVKVKFPPNIVNIHVKHPPEASVQIHQVSRIDGPTGQKTKEAQPGQSQVSYQGLPVQKTQTIHSTYSHQQVIPHVYPVAAKTQLGRCFQETIGSQCGKALPGLSKQEDCCGTVGTSWGFNKCQKCPKKPSYHGYNQMMECLPGYKRVNNTFCQDINECQLQGVCPNGECLNTMGSYRCTCKIGFGPDPTFSSCVPDPPVISEEKGPCYRLVSSGRQCMHPLSVHLTKQLCCCSVGKAWGPHCEKCPLPGTAAFKEICPGGMGYTVSGVHRRRPIHHHVGKGPVFVKPKNTQPVAKSTHPPPLPAKEEPVEALTFSREHGPGVAEPEVATAPPEKEIPSLDQEKTKLEPGQPQLSPGISTIHLHPQFPVVIEKTSPPVPVEVAPEASTSSASQVIAPTQVTEINECTVNPDICGAGHCINLPVRYTCICYEGYRFSEQQRKCVDIDECTQVQHLCSQGRCENTEGSFLCICPAGFMASEEGTNCIDVDECLRPDVCGEGHCVNTVGAFRCEYCDSGYRMTQRGRCEDIDECLNPSTCPDEQCVNSPGSYQCVPCTEGFRGWNGQCLDVDECLEPNVCANGDCSNLEGSYMCSCHKGYTRTPDHKHCRDIDECQQGNLCVNGQCKNTEGSFRCTCGQGYQLSAAKDQCEDIDECQHRHLCAHGQCRNTEGSFQCVCDQGYRASGLGDHCEDINECLEDKSVCQRGDCINTAGSYDCTCPDGFQLDDNKTCQDINECEHPGLCGPQGECLNTEGSFHCVCQQGFSISADGRTCEDIDECVNNTVCDSHGFCDNTAGSFRCLCYQGFQAPQDGQGCVDVNECELLSGVCGEAFCENVEGSFLCVCADENQEYSPMTGQCRSRTSTDLDVDVDQPKEEKKECYYNLNDASLCDNVLAPNVTKQECCCTSGAGWGDNCEIFPCPVLGTAEFTEMCPKGKGFVPAGESSSEAGGENYKDADECLLFGQEICKNGFCLNTRPGYECYCKQGTYYDPVKLQCFDMDECQDPSSCIDGQCVNTEGSYNCFCTHPMVLDASEKRCIRPAESNEQIEETDVYQDLCWEHLSDEYVCSRPLVGKQTTYTECCCLYGEAWGMQCALCPLKDSDDYAQLCNIPVTGQSSSPGGRRGREFSSSRRP

SEQ ID NO: 910328 - protein, 1092 aa, Homo sapiens
MDTKLMCLLFFFSLPPLLVSNHTGRIKVVFTPSICKVTCTKGSCQNSCEKGNTTTLISENGHAADTLTATNFRVVICHLPCMNGGQCSSRDKCQCPPNFTGKLCQIPVHGASVPKLYQHSQQPGKALGTHVIHSTHTLPLTVTSQQGVKVKFPPNIVNIHVKHPPEASVQIHQVSRIDGPTGQKTKEAQPGQSQVSYQGLPVQKTQTIHSTYSHQQVIPHVYPVAAKTQLGRCFQETIGSQCGKALPGLSKQEDCCGTVGTSWGFNKCQKCPKKPSYHGYNQMMECLPGYKRVNNTFCQDINECQLQGVCPNGECLNTMGSYRCTCKIGFGPDPTFSSCVPDPPVISEEKGPCYRLVSSGRQCMHPLSVHLTKQLCCCSVGKAWGPHCEKCPLPGTAAFKEICPGGMGYTVSGVHRRRPIHHHVGKGPVFVKPKNTQPVAKSTHPPPLPAKEEPVEALTFSREHGPGVAEPEVATAPPEKEIPSLDQEKTKLEPGQPQLSPGISTIHLHPQFPVVIEKTSPPVPVEVAPEASTSSASQVIAPTQVTEINECTVNPDICGAGHCINLPVRYTCICYEGYRFSEQQRKCVDIDECTQVQHLCSQGRCENTEGSFLCICPAGFMASEEGTNCIDVDECLRPDVCGEGHCVNTVGAFRCEYCDSGYRMTQRGRCEDIDECLNPSTCPDEQCVNSPGSYQCVPCTEGFRGWNGQCLDVDECLEPNVCANGDCSNLEGSYMCSCHKGYTRTPDHKHCRDIDECQQGNLCVNGQCKNTEGSFRCTCGQGYQLSAAKDQCEDIDECQHRHLCAHGQCRNTEGSFQCVCDQGYRASGLGDHCEDINECLEDKSVCQRGDCINTAGSYDCTCPDGFQLDDNKTCQDINECEHPGLCGPQGECLNTEGSFHCVCQQGFSISADGRTCEDIDECVNNTVCDSHGFCDNTAGSFRCLCYQGFQAPQDGQGCVDVNECELLSGVCGEAFCENVEGSFLCVCADENQEYSPMTGQCRSRTSTDLDVDVDQPKEEKKECYYNLNDASLCDNVLAPNVTKQECCCTSGAGWGDNCEIFPCPVLGTAEFTEMCPKGKGFVPAFDVPSVAK

SEQ ID NO: 910329 - protein, 300 aa, Homo sapiens
MDTKLMCLLFFFSLPPLLVSNHTGRIKVVFTPSICKVTCTKGSCQNSCEKGNTTTLISENGHAADTLTATNFRVVICHLPCMNGGQCSSRDKCQCPPNFTGKLCQIPVHGASVPKLYQHSQQPGKALGTHVIHSTHTLPLTVTSQQGVKVKFPPNIVNIHVKHPPEASVQIHQVSRIDGPTGQKTKEAQPGQSQVSYQGLPVQKTQTIHSTYSHQQVIPHVYPVAAKTQLGRCFQETIGSQCGKALPGLSKQEDCCGTVGTSHPFASVSQLAGSTGMSHHARVINKFFFVEMGVSLCCSG

SEQ ID NO: 910330 - protein, 91 aa, Homo sapiens
TGQKTKEAQPGQSQVSYQGLPVQKTQTIHSTYSHQQVIPHVYPVAAKTQLGRCFQETIGSQVNIITEPALAVSYRYGIILTRKPDLIKMLF

SEQ ID NO: 910331 - protein, 1395 aa, Homo sapiens; identical to SEQ ID NO: 910322

SEQ ID NO: 910332 - protein, 1400 aa, Homo sapiens
GEQSTEGSFPLRYVQDQVAAPFQLSNHTGRIKVVFTPSICKVTCTKGSCQNSCEKGNTTTLISENGHAADTLTATNFRVVICHLPCMNGGQCSSRDKCQCPPNFTGKLCQIPVHGASVPKLYQHSQQPGKALGTHVIHSTHTLPLTVTSQQGVKVKFPPNIVNIHVKHPPEASVQIHQVSRIDGPTGQKTKEAQPGQSQVSYQGLPVQKTQTIHSTYSHQQVIPHVYPVAAKTQLGRCFQETIGSQCGKALPGLSKQEDCCGTVGTSWGFNKCQKCPKKPSYHGYNQMMECLPGYKRVNNTFCQDINECQLQGVCPNGECLNTMGSYRCTCKIGFGPDPTFSSCVPDPPVISEEKGPCYRLVSSGRQCMHPLSVHLTKQLCCCSVGKAWGPHCEKCPLPGTAAFKEICPGGMGYTVSGVHRRRPIHHHVGKGPVFVKPKNTQPVAKSTHPPPLPAKEEPVEALTFSREHGPGVAEPEVATAPPEKEIPSLDQEKTKLEPGQPQLSPGISTIHLHPQFPVVIEKTSPPVPVEVAPEASTSSASQVIAPTQVTEINECTVNPDICGAGHCINLPVRYTCICYEGYRFSEQQRKCVDIDECTQVQHLCSQGRCENTEGSFLCICPAGFMASEEGTNCIDVDECLRPDVCGEGHCVNTVGAFRCEYCDSGYRMTQRGRCEDIDECLNPSTCPDEQCVNSPGSYQCVPCTEGFRGWNGQCLDVDECLEPNVCANGDCSNLEGSYMCSCHKGYTRTPDHKHCRDIDECQQGNLCVNGQCKNTEGSFRCTCGQGYQLSAAKDQCEDIDECQHRHLCAHGQCRNTEGSFQCVCDQGYRASGLGDHCEDINECLEDKSVCQRGDCINTAGSYDCTCPDGFQLDDNKTCQDINECEHPGLCGPQGECLNTEGSFHCVCQQGFSISADGRTCEDIDECVNNTVCDSHGFCDNTAGSFRCLCYQGFQAPQDGQGCVDVNECELLSGVCGEAFCENVEGSFLCVCADENQEYSPMTGQCRSRTSTDLDVDVDQPKEEKKECYYNLNDASLCDNVLAPNVTKQECCCTSGAGWGDNCEIFPCPVLGTAEFTEMCPKGKGFVPAGESSSEAGGENYKDADECLLFGQEICKNGFCLNTRPGYECYCKQGTYYDPVKLQCFDMDECQDPSSCIDGQCVNTEGSYNCFCTHPMVLDASEKRCIRPAESNEQIEETDVYQDLCWEHLSDEYVCSRPLVGKQTTYTECCCLYGEAWGMQCALCPLKDSDDYAQLCNIPVTGRRQPYGRDALVDFSEQYTPEADPYFIQDRFLNSFEELQAEECGILNGCENGRCVRVQEGYTCDCFDGYHLDTAKMTCVDVNECDELNNRMSLCKNAKCINTDGSYKCLCLPGYVPSDKPNYCTPLNTALNLEKDSDLE

SEQ ID NO: 910333 - protein, 517 aa, Homo sapiens
TRGYPYHSKSQGECLNTEGSFHCVCQQGFSISADGRTCEDIDECVNNTVCDSHGFCDNTAGSFRCLCYQGFQAPQDGQGCVDVNECELLSGVCGEAFCENVEGSFLCVCADENQEYSPMTGQCRSRTSTDLDVDVDQPKEEKKECYYNLNDASLCDNVLAPNVTKQECCCTSGAGWGDNCEIFPCPVLGTAEFTEMCPKGKGFVPAGESSSEAGGENYKDADECLLFGQEICKNGFCLNTRPGYECYCKQGTYYDPVKLQCFDMDECQDPSSCIDGQCVNTEGSYNCFCTHPMVLDASEKRCIRPAESNEQIEETDVYQDLCWEHLSDEYVCSRPLVGKQTTYTECCCLYGEAWGMQCALCPLKDSDDYAQLCNIPVTGRRQPYGRDALVDFSEQYTPEADPYFIQDRFLNSFEELQAEECGILNGCENGRCVRVQEGYTCDCFDGYHLDTAKMTCVDVNECDELNNRMSLCKNAKCINTDGSYKCLCLPGYVPSDKPNYCTPLNTALNLEKDSDLE

SEQ ID NO: 910334 - protein, 254 aa, Homo sapiens [sequence omitted]

SEQ ID NO: 910335 - protein, 119 aa, Homo sapiens
PVLSLGIRRRFLNSFEELQAEECGILNGCENGRCVRVQEGYTCDCFDGYHLDTAKMTCVDVNECDELNNRMSLCKNAKCINTDGSYKCLCLPGYVPSDKPNYCTPLNTALNLEKDSDLE

SEQ ID NO: 910336 - protein, 920 aa, Homo sapiens
MDTKLMCLLFFFSLPPLLVSNHTGRIKVVFTPSICKVTCTKGSCQNSCEKGNTTTLISENGHAADTLTATNFRVVICHLPCMNGGQCSSRDKCQCPPNFTGKLCQIPVHGASVPKLYQHSQQPGKALGTHVIHSTHTLPLTVTSQQGVKVKFPPNIVNIHVKHPPEASVQIHQVSRIDGPTGQKTKEAQPGQSQVSYQGLPVQKTQTIHSTYSHQQVIPHVYPVAAKTQLGRCFQETIGSQCGKALPGLSKQEDCCGTVGTSWGFNKCQKCPKKPSYHGYNQMMECLPGYKRVNNTFCQDINECQLQGVCPNGECLNTMGSYRCTCKIGFGPDPTFSSCVPDPPVISEEKGPCYRLVSSGRQCMHPLSVHLTKQLCCCSVGKAWGPHCEKCPLPGTAAFKEICPGGMGYTVSGVHRRRPIHHHVGKGPVFVKPKNTQPVAKSTHPPPLPAKEEPVEALTFSREHGPGVAEPEVATAPPEKEIPSLDQEKTKLEPGQPQLSPGISTIHLHPQFPVVIEKTSPPVPVEVAPEASTSSASQVIAPTQVTEINECTVNPDICGAGHCINLPVRYTCICYEGYRFSEQQRKCVDIDECTQVQHLCSQGRCENTEGSFLCICPAGFMASEEGTNCIDVDECLRPDVCGEGHCVNTVGAFRCEYCDSGYRMTQRGRCEDIDECLNPSTCPDEQCVNSPGSYQCVPCTEGFRGWNGQCLDVDECLEPNVCANGDCSNLEGSYMCSCHKGYTRTPDHKHCRDIDECQQGNLCVNGQCKNTEGSFRCTCGQGYQLSAAKDQCEDIDECQHRHLCAHGQCRNTEGSFQCVCDQGYRASGLGDHCEDINECLEDKSVCQRGDCINTAGSYDCTCPDGFQLDDNKTCQDINECEHPGLCGPQGECLNTEGSFHCVCQQGFSISADGRTCEASV

SEQ ID NO: 910337 - protein, 105 aa, Homo sapiens
NGGQCSSRDKCQCPPNFTGKLCQIPVHGASVPKLYQHSQQPGKALGTHVIHSTHTLPLTVTSQQGVKGKLFSFRPFARPLLTCQTHIEVKDLRVARAGIETERST

SEQ ID NO: 910338 - protein, 923 aa, Homo sapiens
RGGGLVCERMCEGREASRRSVVLRPARAGGGGGMRRGGGGAGAGVGVWRRQSSGSRSRRSSSAGVVHRLKTAVPFYPPTFFFFFLNNLEPMNAAGIRAPEAAGADGTRLAPGGSPCLRRRGRPEESPAAVVAPRGAGELQAAGAPLRFHPASPRRLHPASTPGPAWGWLLRRRRWAALLVLGLLVAGAADGCELVPRHLRGRRATGSAATAASSPAAAAGDSPALMTDPCMSLSPPCFTEEDRFSLEALQTIHKQMDDDKDGGIEVEESDEFIREDMKYKDATNKHSHLHREDKHITIEDLWKRWKTSEVHNWTLEDTLQWLIEFVELPQYEKNFRDNNVKGTTLPRIAVHEPSFMISQLKISDRSHRQKLQLKALDVVLFGPLTRPPHNWMKDFILTVSIVIGVGGCWFAYTQNKTSKEHVAKMMKDLESLQTAEQSLMDLQERLEKAQEENRNVAVEKQNLERKMMDEINYAKEEACRLRELREGAECELSRRQYAEQELEQVRMALKKAEKEFELRSSWSVPDALQKWLQLTHEVEVQYYNIKRQNAEMQLAIAKDEAEKIKKKRSTVFGTLHVAHSSSLDEVDHKILEAKKALSELTTCLRERLFRWQQIEKICGFQIAHNSGLPSLTSSLYSDHSWVVMPRVSIPPYPIAGGVDDLDEDTPPIVSQFPGTMAKPPGSLARSSSLCRSRRSIVPSSPQPQRAQLAPHAPHPSHPRHPHHPQHTPHSLPSPDPDILSVSSCPALYRNEEEEEAIYFSAEKQWEVPDTASECDSLNSSIGRKQSPPLSLEIYQTLSPRKISRDEVSLEDSSRGDSPVTVDVSWGSPDCVGLTETKSMIFSPASKVYNGILEKSCSMNQLSSGIPVPKPRHTSCSSAGNDSKPVQEAPSVARISSIPHDLCHNGEKSKKPSKIKSLFKKKSK

SEQ ID NO: 910339 - protein, 923 aa, Homo sapiens; identical to SEQ ID NO: 910338

SEQ ID NO: 910340 - protein, 816 aa, Homo sapiens
RGGGLVCERMCEGREASRRSVVLRPARAGGGGGMRRGGGGAGAGVGVWRRQSSGSRSRRSSSAGVVHRLKTAVPFYPPTFFFFFLNNLEPMNAAGIRAPEAAGADGTRLAPGGSPCLRRRGRPEESPAAVVAPRGAGELQAAGAPLRFHPASPRRLHPASTPGPAWGWLLRRRRWAALLVLGLLVAGAADGCELVPRHLRGRRATGSAATAASSPAAAAGDSPALMTDPCMSLSPPCFTEEDRFSLEALQTIHKQMDDDKDGGIEVEESDEFIREDMKYKDATNKHSHLHREDKHITIEDLWKRWKTSEVHNWTLEDTLQWLIEFVELPQYEKNFRDNNVKGTTLPRIAVHEPSFMISQLKISDRSHRQKLQLKALDVVLFGPLTRPPHNWMKDFILTVSIVIGVGGCWFAYTQNKTSKEHVAKMMKDLESLQTAEQSLMDLQERLEKAQEENRNVAVEKQNLERKMMDEINYAKEEACRLRELREGAECELSRRQYAEQELEQVRMALKKAEKEFELRSSWSVPDALQKWLQLTHEVEVQYYNIKRQNAEMQLAIAKDEAEKIKKKRSTVFGTLHVAHSSSLDEVDHKILEAKKALSELTTCLRERLFRWQQIEKICGFQIAHNSGLPSLTSSLYSDHSWVVMPRVSIPPYPIAGGVDDLDEDTPPIVSQFPGTMAKPPGSLARSSSLCRSRRSIVPSSPQPQRAQLAPHAPHPSHPRHPHHPQHTPHSLPSPDPDILSVSSCPALYRNEEEEEAIYFSAEKQWNTRECAVGDSQGPHVHGLVRFDKDFGSYSEYERKHWEVSRKCQTQLQNVTP

SEQ ID NO: 910341 - protein, 923 aa, Homo sapiens; identical to SEQ ID NO: 910338

SEQ ID NO: 910342 - protein, 337 aa, Homo sapiens
NFFIGFSRKALSELTTCLRERLFRWQQIEKICGFQIAHNSGLPSLTSSLYSDHSWVVMPRVSIPPYPIAGGVDDLDEDTPPIVSQFPGTMAKPPGSLARSSSLCRSRRSIVPSSPQPQRAQLAPHAPHPSHPRHPHHPQHTPHSLPSPDPDILSVSSCPALYRNEEEEEAIYFSAEKQWEVPDTASECDSLNSSIGRKQSPPLSLEIYQTLSPRKISRDEVSLEDSSRGDSPVTVDVSWGSPDCVGLTETKSMIFSPASKVYNGILEKSCSMNQLSSGIPVPKPRHTSCSSAGNDSKPVQEAPSVARISSIPHDLCHNGEKSKKPSKIKSLFKKKSK

SEQ ID NO: 910343 - protein, 796 aa, Homo sapiens
RGGGLVCERMCEGREASRRSVVLRPARAGGGGGMRRGGGGAGAGVGVWRRQSSGSRSRRSSSAGVVHRLKTAVPFYPPTFFFFFLNNLEPMNAAGIRAPEAAGADGTRLAPGGSPCLRRRGRPEESPAAVVAPRGAGELQAAGAPLRFHPASPRRLHPASTPGPAWGWLLRRRRWAALLVLGLLVAGAADGCELVPRHLRGRRATGSAATAASSPAAAAGDSPALMTDPCMSLSPPCFTEEDRFSLEALQTIHKQMDDDKDGGIEVEESDEFIREDMKYKDATNKHSHLHREDKHITIEDLWKRWKTSEVHNWTLEDTLQWLIEFVELPQYEKNFRDNNVKGTTLPRIAVHEPSFMISQLKISDRSHRQKLQLKALDVVLFGPLTRPPHNWMKDFILTVSIVIGVGGCWFAYTQNKTSKEHVAKMMKDLESLQTAEQSLMDLQERLEKAQEENRNVAVEKQNLERKMMDEINYAKEEACRLRELREGAECELSRRQYAEQELEQVRMALKKAEKEFELRSSWSVPDALQKWLQLTHEVEVQYYNIKRQNAEMQLAIAKDEAEKIKKKRSTVFGTLHVAHSSSLDEVDHKILEAKKALSELTTCLRERLFRWQQIEKICGFQIAHNSGLPSLTSSLYSDHSWVVMPRVSIPPYPIAGGVDDLDEDTPPIVSQFPGTMAKPPGSLARSSSLCRSRRSIVPSSPQPQRAQLAPHAPHPSHPRHPHHPQHTPHSLPSPDPDILSVSSCPALYRNEEEEEAIYFSAEKQCMIIVTSKMPLLTELVLCGFWKSEGKLESCTV

SEQ ID NO: 910344 - protein, 2035 aa, Homo sapiens
MASAVSPANLPAVLLQPRWKRVVGWSGPVPRPRHGHRAVAIKELIVVFGGGNEGIVDELHVYNTATNQWFIPAVRGDIPPGCAAYGFVCDGTRLLVFGGMVEYGKYSNDLYELQASRWEWKRLKAKTPKNGPPPCPRLGHSFSLVGNKCYLFGGLANDSEDPKNNIPRYLNDLYILELRPGSGVVAWDIPITYGVLPPPRESHTAVVYTEKDNKKSKLVIYGGMSGCRLGDLWTLDIDTLTWNKPSLSGVAPLPRSLHSATTIGNKMYVFGGWVPLVMDDVKVATHEKEWKCTNTLACLNLDTMAWETILMDTLEDNIPRARAGHCAVAINTRLYIWSGRDGYRKAWNNQVCCKDLWYLETEKPPPPARVQLVRANTNSLEVSWGAVATADSYLLQLQKYDIPATAATATSPTPNPVPSVPANPPKSPAPAAAAPAVQPLTQVGITLLPQAAPAPPTTTTIQVLPTVPGSSISVPTAARTQGVPAVLKVTGPQATTGTPLVTMRPASQAGKAPVTVTSLPAGVRMVVPTQSAQGTVIGSSPQMSGMAALAAAAAATQKIPPSSAPTVLSVPAGTTIVKTMAVTPGTTTLPATVKVASSPVMVSNPATRMLKTAAAQVGTSVSSATNTSTRPIITVHKSGTVTVAQQAQVVTTVVGGVTKTITLVKSPISVPGGSALISNLGKVMSVVQTKPVQTSAVTGQASTGPVTQIIQTKGPLPAGTILKLVTSADGKPTTIITTTQASGAGTKPTILGISSVSPSTTKPGTTTIIKTIPMSAIITQAGATGVTSSPGIKSPITIITTKVMTSGTGAPAKIITAVPKIATGHGQQGVTQVVLKGAPGQPGTILRTVPMGGVRLVTPVTVSAVKPAVTTLVVKGTTGVTTLGTVTGTVSTSLAGAGGHSTSASLATPITTLGTIATLSSQVINPTAITVSAAQTTLTAAGGLTTPTITMQPVSQPTQVTLITAPSGVEAQPVHDLPVSILASPTTEQPTATVTIADSGQGDVQPGTVTLVCSNPPCETHETGTTNTATTTVVANLGGHPQPTQVQFVCDRQEAAASLVTSTVGQQNGSVVRVCSNPPCETHETGTTNTATTATSNMAGQHGCSNPPCETHETGTTNTATTAMSSVGANHQRDARRACAAGTPAVIRISVATGALEAAQGSKSQCQTRQTSATSTTMTVMATGAPCSAGPLLGPSMAREPGGRSPAFVQLAPLSSKVRLSSPSIKDLPAGRHSHAVSTAAMTRSSVGAGEPRMAPVCESLQGGSPSTTVTVTALEALLCPSATVTQVCSNPPCETHETGTTNTATTSNAGSAQRVCSNPPCETHETGTTHTATTATSNGGTGQPEGGQQPPAGRPCETHQTTSTGTTMSVSVGALLPDATSSHRTVESGLEVAAAPSVTPQAGTALLAPFPTQRVCSNPPCETHETGTTHTATTVTSNMSSNQDPPPAASDQGEVESTQGDSVNITSSSAITTTVSSTLTRAVTTVTQSTPVPGPSVPPPEELQVSPGPRQQLPPRQLLQSASTALMGESAEVLSASQTPELPAAVDLSSTGEPSSGQESAGSAVVATVVVQPPPPTQSEVDQLSLPQELMAEAQAGTTTLMVTGLTPEELAVTAAAEAAAQAAATEEAQALAIQAVLQAAQQAVMGTGEPMDTSEAAATVTQAELGHLSAEGQEGQATTIPIVLTQQELAALVQQQQLQEAQAQQQHHHLPTEALAPADSLNDPAIESNCLNELAGTVPSTVALLPSTATESLAPSNTFVAPQPVVVASPAKLQAAATLTEVANGIESLGVKPDLPPPPSKAPMKKENQWFDVGVIKGTNVMVTHYFLPPDDAVPSDDDLGTVPDYNQLKKQELQPGTAYKFRVAGINACGRGPFSEISAFKTCLPGFPGAPCAIKISKSPDGAHLTWEPPSVTSGKIIEYSVYLAIQSSQAGGELKSSTPAQLAFMRVYCGPSPSCLVQSSSLSNAHIDYTTKPAIIFRIAARNEKGYGPATQVRWLQETSKDSSGTKPANKRPMSSPEMKSAPKKSKADGQ

SEQ ID NO: 910345 - protein, 1992 aa, Homo sapiens
GYTPLWDGGNEGIVYNCTLHTATNQWFIPAVRGDIPPGCAAYGFVCDGTRLLVFGGMVEYGKYSNDLYELQASRWEWKRLKAKTPKNGPPPCPRLGHSFSLVGNKCYLFGGLANDSEDPKNNIPRYLNDLYILELRPGSGVVAWDIPITYGVLPPPRESHTAVVYTEKDNKKSKLVIYGGMSGCRLGDLWTLDIDTLTWNKPSLSGVAPLPRSLHSATTIGNKMYVFGGWVPLVMDDVKVATHEKEWKCTNTLACLNLDTMAWETILMDTLEDNIPRARAGHCAVAINTRLYIWSGRDGYRKAWNNQVCCKDLWYLETEKPPPPARVQLVRANTNSLEVSWGAVATADSYLLQLQKYDIPATAATATSPTPNPVPSVPANPPKSPAPAAAAPAVQPLTQVGITLLPQAAPAPPTTTTIQVLPTVPGSSISVPTAARTQGVPAVLKVTGPQATTGTPLVTMRPASQAGKAPVTVTSLPAGVRMVVPTQSAQGTVIGSSPQMSGMAALAAAAAATQKIPPSSAPTVLSVPAGTTIVKTMAVTPGTTTLPATVKVASSPVMVSNPATRMLKTAAAQVGTSVSSATNTSTRPIITVHKSGTVTVAQQAQVVTTVVGGVTKTITLVKSPISVPGGSALISNLGKVMSVVQTKPVQTSAVTGQASTGPVTQIIQTKGPLPAGTILKLVTSADGKPTTIITTTQASGAGTKPTILGISSVSPSTTKPGTTTIIKTIPMSAIITQAGATGVTSSPGIKSPITIITTKVMTSGTGAPAKIITAVPKIATGHGQQGVTQVVLKGAPGQPGTILRTVPMGGVRLVTPVTVSAVKPAVTTLVVKGTTGVTTLGTVTGTVSTSLAGAGGHSTSASLATPITTLGTIATLSSQVINPTAITVSAAQTTLTAAGGLTTPTITMQPVSQPTQVTLITAPSGVEAQPVHDLPVSILASPTTEQPTATVTIADSGQGDVQPGTVTLVCSNPPCETHETGTTNTATTTVVANLGGHPQPTQVQFVCDRQEAAASLVTSTVGQQNGSVVRVCSNPPCETHETGTTNTATTATSNMAGQHGCSNPPCETHETGTTNTATTAMSSVGANHQRDARRACAAGTPAVIRISVATGALEAAQGSKSQCQTRQTSATSTTMTVMATGAPCSAGPLLGPSMAREPGGRSPAFVQLAPLSSKVRLSSPSIKDLPAGRHSHAVSTAAMTRSSVGAGEPRMAPVCESLQGGSPSTTVTVTALEALLCPSATVTQVCSNPPCETHETGTTNTATTSNAGSAQRVCSNPPCETHETGTTHTATTATSNGGTGQPEGGQQPPAGRPCETHQTTSTGTTMSVSVGALLPDATSSHRTVESGLEVAAAPSVTPQAGTALLAPFPTQRVCSNPPCETHETGTTHTATTVTSNMSSNQDPPPAASDQGEVESTQGDSVNITSSSAITTTVSSTLTRAVTTVTQSTPVPGPSVPPPEELQVSPGPRQQLPPRQLLQSASTALMGESAEVLSASQTPELPAAVDLSSTGEPSSGQESAGSAVVATVVVQPPPPTQSEVDQLSLPQELMAEAQAGTTTLMVTGLTPEELAVTAAAEAAAQAAATEEAQALAIQAVLQAAQQAVMGTGEPMDTSEAAATVTQAELGHLSAEGQEGQATTIPIVLTQQELAALVQQQQLQEAQAQQQHHHLPTEALAPADSLNDPAIESNCLNELAGTVPSTVALLPSTATESLAPSNTFVAPQPVVVASPAKLQAAATLTEVANGIESLGVKPDLPPPPSKAPMKKENQWFDVGVIKGTNVMVTHYFLPPDDAVPSDDDLGTVPDYNQLKKQELQPGTAYKFRVAGINACGRGPFSEISAFKTCLPGFPGAPCAIKISKSPDGAHLTWEPPSVTSGKIIEYSVYLAIQSSQAGGELKSSTPAQLAFMRVYCGPSPSCLVQSSSLSNAHIDYTTKPAIIFRIAARNEKGYGPATQVRWLQETSKDSSGTKPANKRPMSSPEMKSAPKKSKADGQ

SEQ ID NO: 910346 - protein, 2079 aa, Homo sapiens
MASAVSPANLPAVLLQPRWKRVVGWSGPVPRPRHGHRAVAIKELIVVFGGGNEGIVDELHVYNTATNQWFIPAVRGDIPPGCAAYGFVCDGTRLLVFGGMVEYGKYSNDLYELQASRWEWKRLKAKTPKNGPPPCPRLGHSFSLVGNKCYLFGGLANDSEDPKNNIPRYLNDLYILELRPGSGVVAWDIPITYGVLPPPRESHTAVVYTEKDNKKSKLVIYGGMSGCRLGDLWTLDIDTLTWNKPSLSGVAPLPRSLHSATTIGNKMYVFGGWVPLVMDDVKVATHEKEWKCTNTLACLNLDTMAWETILMDTLEDNIPRARAGHCAVAINTRLYIWSGRDGYRKAWNNQVCCKDLWYLETEKPPPPARVQLVRANTNSLEVSWGAVATADSYLLQLQKYDIPATAATATSPTPNPVPSVPANPPKSPAPAAAAPAVQPLTQVGITLLPQAAPAPPTTTTIQVLPTVPGSSISVPTAARTQGVPAVLKVTGPQATTGTPLVTMRPASQAGKAPVTVTSLPAGVRMVVPTQSAQGTVIGSSPQMSGMAALAAAAAATQKIPPSSAPTVLSVPAGTTIVKTMAVTPGTTTLPATVKVASSPVMVSNPATRMLKTAAAQVGTSVSSATNTSTRPIITVHKSGTVTVAQQAQVVTTVVGGVTKTITLVKSPISVPGGSALISNLGKVMSVVQTKPVQTSAVTGQASTGPVTQIIQTKGPLPAGTILKLVTSADGKPTTIITTTQASGAGTKPTILGISSVSPSTTKPGTTTIIKTIPMSAIITQAGATGVTSSPGIKSPITIITTKVMTSGTGAPAKIITAVPKIATGHGQQGVTQVVLKGAPGQPGTILRTVPMGGVRLVTPVTVSAVKPAVTTLVVKGTTGVTTLGTVTGTVSTSLAGAGGHSTSASLATPITTLGTIATLSSQVINPTAITVSAAQTTLTAAGGLTTPTITMQPVSQPTQVTLITAPSGVEAQPVHDLPVSILASPTTEQPTATVTIADSGQGDVQPGTVTLVCSNPPCETHETGTTNTATTTVVANLGGHPQPTQVQFVCDRQEAAASLVTSTVGQQNGSVVRVCSNPPCETHETGTTNTATTATSNMAGQHGCSNPPCETHETGTTNTATTAMSSVGANHQRDARRACAAGTPAVIRISVATGALEAAQGSKSQCQTRQTSATSTTMTVMATGAPCSAGPLLGPSMAREPGGRSPAFVQLAPLSSKVRLSSPSIKDLPAGRHSHAVSTAAMTRSSVGAGEPRMAPVCESLQGGSPSTTVTVTALEALLCPSATVTQVCSNPPCETHETGTTNTATTSNAGSAQRVCSNPPCETHETGTTHTATTATSNGGTGQPEGGQQPPAGRPCETHQTTSTGTTMSVSVGALLPDATSSHRTVESGLEVAAAPSVTPQAGTALLAPFPTQRVCSNPPCETHETGTTHTATTVTSNMSSNQDPPPAASDQGEVESTQGDSVNITSSSAITTTVSSTLTRAVTTVTQSTPVPGPSVPKISSMTETAPRALTTEVPIPAKITVTIANTETSDMPFSAVDILQPPEELQVSPGPRQQLPPRQLLQSASTALMGESAEVLSASQTPELPAAVDLSSTGEPSSGQESAGSAVVATVVVQPPPPTQSEVDQLSLPQELMAEAQAGTTTLMVTGLTPEELAVTAAAEAAAQAAATEEAQALAIQAVLQAAQQAVMGTGEPMDTSEAAATVTQAELGHLSAEGQEGQATTIPIVLTQQELAALVQQQQLQEAQAQQQHHHLPTEALAPADSLNDPAIESNCLNELAGTVPSTVALLPSTATESLAPSNTFVAPQPVVVASPAKLQAAATLTEVANGIESLGVKPDLPPPPSKAPMKKENQWFDVGVIKGTNVMVTHYFLPPDDAVPSDDDLGTVPDYNQLKKQELQPGTAYKFRVAGINACGRGPFSEISAFKTCLPGFPGAPCAIKISKSPDGAHLTWEPPSVTSGKIIEYSVYLAIQSSQAGGELKSSTPAQLAFMRVYCGPSPSCLVQSSSLSNAHIDYTTKPAIIFRIAARNEKGYGPATQVRWLQETSKDSSGTKPANKRPMSSPEMKSAPKKSKADGQ

SEQ ID NO: 910347 - protein, 1732 aa, Homo sapiens
MAWETILMDTLEDNIPRARAGHCAVAINTRLYIWSGRDGYRKAWNNQVCCKDLWYLETEKPPPPARVQLVRANTNSLEVSWGAVATADSYLLQLQKYDIPATAATATSPTPNPVPSVPANPPKSPAPAAAAPAVQPLTQVGITLLPQAAPAPPTTTTIQVLPTVPGSSISVPTAARTQGVPAVLKVTGPQATTGTPLVTMRPASQAGKAPVTVTSLPAGVRMVVPTQSAQGTVIGSSPQMSGMAALAAAAAATQKIPPSSAPTVLSVPAGTTIVKTMAVTPGTTTLPATVKVASSPVMVSNPATRMLKTAAAQVGTSVSSATNTSTRPIITVHKSGTVTVAQQAQVVTTVVGGVTKTITLVKSPISVPGGSALISNLGKVMSVVQTKPVQTSAVTGQASTGPVTQIIQTKGPLPAGTILKLVTSADGKPTTIITTTQASGAGTKPTILGISSVSPSTTKPGTTTIIKTIPMSAIITQAGATGVTSSPGIKSPITIITTKVMTSGTGAPAKIITAVPKIATGHGQQGVTQVVLKGAPGQPGTILRTVPMGGVRLVTPVTVSAVKPAVTTLVVKGTTGVTTLGTVTGTVSTSLAGAGGHSTSASLATPITTLGTIATLSSQVINPTAITVSAAQTTLTAAGGLTTPTITMQPVSQPTQVTLITAPSGVEAQPVHDLPVSILASPTTEQPTATVTIADSGQGDVQPGTVTLVCSNPPCETHETGTTNTATTTVVANLGGHPQPTQVQFVCDRQEAAASLVTSTVGQQNGSVVRVCSNPPCETHETGTTNTATTATSNMAGQHGCSNPPCETHETGTTNTATTAMSSVGANHQRDARRACAAGTPAVIRISVATGALEAAQGSKSQCQTRQTSATSTTMTVMATGAPCSAGPLLGPSMAREPGGRSPAFVQLAPLSSKVRLSSPSIKDLPAGRHSHAVSTAAMTRSSVGAGEPRMAPVCESLQGGSPSTTVTVTALEALLCPSATVTQVCSNPPCETHETGTTNTATTSNAGSAQRVCSNPPCETHETGTTHTATTATSNGGTGQPEGGQQPPAGRPCETHQTTSTGTTMSVSVGALLPDATSSHRTVESGLEVAAAPSVTPQAGTALLAPFPTQRVCSNPPCETHETGTTHTATTVTSNMSSNQDPPPAASDQGEVESTQGDSVNITSSSAITTTVSSTLTRAVTTVTQSTPVPGPSVPPPEELQVSPGPRQQLPPRQLLQSASTALMGESAEVLSASQTPELPAAVDLSSTGEPSSGQESAGSAVVATVVVQPPPPTQSEVDQLSLPQELMAEAQAGTTTLMVTGLTPEELAVTAAAEAAAQAAATEEAQALAIQAVLQAAQQAVMGTGEPMDTSEAAATVTQAELGHLSAEGQEGQATTIPIVLTQQELAALVQQQQLQEAQAQQQHHHLPTEALAPADSLNDPAIESNCLNELAGTVPSTVALLPSTATESLAPSNTFVAPQPVVVASPAKLQAAATLTEVANGIESLGVKPDLPPPPSKAPMKKENQWFDVGVIKGTNVMVTHYFLPPDDAVPSDDDLGTVPDYNQLKKQELQPGTAYKFRVAGINACGRGPFSEISAFKTCLPGFPGAPCAIKISKSPDGAHLTWEPPSVTSGKIIEYSVYLAIQSSQAGGELKSSTPAQLAFMRVYCGPSPSCLVQSSSLSNAHIDYTTKPAIIFRIAARNEKGYGPATQVRWLQETSKDSSGTKPANKRPMSSPEMKSAPKKSKADGQ

SEQ ID NO: 910348 - protein, 1422 aa, Homo sapiens
ENGAPGPPISRFPLSAPPLSGLCKSGTVTVAQQAQVVTTVVGGVTKTITLVKSPISVPGGSALISNLGKVMSVVQTKPVQTSAVTGQASTGPVTQIIQTKGPLPAGTILKLVTSADGKPTTIITTTQASGAGTKPTILGISSVSPSTTKPGTTTIIKTIPMSAIITQAGATGVTSSPGIKSPITIITTKVMTSGTGAPAKIITAVPKIATGHGQQGVTQVVLKGAPGQPGTILRTVPMGGVRLVTPVTVSAVKPAVTTLVVKGTTGVTTLGTVTGTVSTSLAGAGGHSTSASLATPITTLGTIATLSSQVINPTAITVSAAQTTLTAAGGLTTPTITMQPVSQPTQVTLITAPSGVEAQPVHDLPVSILASPTTEQPTATVTIADSGQGDVQPGTVTLVCSNPPCETHETGTTNTATTTVVANLGGHPQPTQVQFVCDRQEAAASLVTSTVGQQNGSVVRVCSNPPCETHETGTTNTATTATSNMAGQHGCSNPPCETHETGTTNTATTAMSSVGANHQRDARRACAAGTPAVIRISVATGALEAAQGSKSQCQTRQTSATSTTMTVMATGAPCSAGPLLGPSMAREPGGRSPAFVQLAPLSSKVRLSSPSIKDLPAGRHSHAVSTAAMTRSSVGAGEPRMAPVCESLQGGSPSTTVTVTALEALLCPSATVTQVCSNPPCETHETGTTNTATTSNAGSAQRVCSNPPCETHETGTTHTATTATSNGGTGQPEGGQQPPAGRPCETHQTTSTGTTMSVSVGALLPDATSSHRTVESGLEVAAAPSVTPQAGTALLAPFPTQRVCSNPPCETHETGTTHTATTVTSNMSSNQDPPPAASDQGEVESTQGDSVNITSSSAITTTVSSTLTRAVTTVTQSTPVPGPSVPPPEELQVSPGPRQQLPPRQLLQSASTALMGESAEVLSASQTPELPAAVDLSSTGEPSSGQESAGSAVVATVVVQPPPPTQSEVDQLSLPQELMAEAQAGTTTLMVTGLTPEELAVTAAAEAAAQAAATEEAQALAIQAVLQAAQQAVMGTGEPMDTSEAAATVTQAELGHLSAEGQEGQATTIPIVLTQQELAALVQQQQLQEAQAQQQHHHLPTEALAPADSLNDPAIESNCLNELAGTVPSTVALLPSTATESLAPSNTFVAPQPVVVASPAKLQAAATLTEVANGIESLGVKPDLPPPPSKAPMKKENQWFDVGVIKGTNVMVTHYFLPPDDAVPSDDDLGTVPDYNQLKKQELQPGTAYKFRVAGINACGRGPFSEISAFKTCLPGFPGAPCAIKISKSPDGAHLTWEPPSVTSGKIIEYSVYLAIQSSQAGGELKSSTPAQLAFMRVYCGPSPSCLVQSSSLSNAHIDYTTKPAIIFRIAARNEKGYGPATQVRWLQETSKDSSGTKPANKRPMSSPEMKSAPKKSKADGQ

SEQ ID NO: 910349 - protein, 1064 aa, Homo sapiens
SCTAWASTPLGAVIRVTWVGWYTGCMVMFGVVSPPGTVTLVCSNPPCETHETGTTNTATTTVVANLGGHPQPTQVQFVCDRQEAAASLVTSTVGQQNGSVVRVCSNPPCETHETGTTNTATTATSNMAGQHGCSNPPCETHETGTTNTATTAMSSVGANHQRDARRACAAGTPAVIRISVATGALEAAQGSKSQCQTRQTSATSTTMTVMATGAPCSAGPLLGPSMAREPGGRSPAFVQLAPLSSKVRLSSPSIKDLPAGRHSHAVSTAAMTRSSVGAGEPRMAPVCESLQGGSPSTTVTVTALEALLCPSATVTQVCSNPPCETHETGTTNTATTSNAGSAQRVCSNPPCETHETGTTHTATTATSNGGTGQPEGGQQPPAGRPCETHQTTSTGTTMSVSVGALLPDATSSHRTVESGLEVAAAPSVTPQAGTALLAPFPTQRVCSNPPCETHETGTTHTATTVTSNMSSNQDPPPAASDQGEVESTQGDSVNITSSSAITTTVSSTLTRAVTTVTQSTPVPGPSVPPPEELQVSPGPRQQLPPRQLLQSASTALMGESAEVLSASQTPELPAAVDLSSTGEPSSGQESAGSAVVATVVVQPPPPTQSEVDQLSLPQELMAEAQAGTTTLMVTGLTPEELAVTAAAEAAAQAAATEEAQALAIQAVLQAAQQAVMGTGEPMDTSEAAATVTQAELGHLSAEGQEGQATTIPIVLTQQELAALVQQQQLQEAQAQQQHHHLPTEALAPADSLNDPAIESNCLNELAGTVPSTVALLPSTATESLAPSNTFVAPQPVVVASPAKLQAAATLTEVANGIESLGVKPDLPPPPSKAPMKKENQWFDVGVIKGTNVMVTHYFLPPDDAVPSDDDLGTVPDYNQLKKQELQPGTAYKFRVAGINACGRGPFSEISAFKTCLPGFPGAPCAIKISKSPDGAHLTWEPPSVTSGKIIEYSVYLAIQSSQAGGELKSSTPAQLAFMRVYCGPSPSCLVQSSSLSNAHIDYTTKPAIIFRIAARNEKGYGPATQVRWLQETSKDSSGTKPANKRPMSSPEMKSAPKKSKADGQ

SEQ ID NO: 910350 - protein, 2035 aa, Homo sapiens; identical to SEQ ID NO: 910344

SEQ ID NO: 910351 - protein, 2035 aa, Homo sapiens; identical to SEQ ID NO: 910344

SEQ ID NO: 910352 - protein, 491 aa, Homo sapiens
MASAVSPANLPAVLLQPRWKRVVGWSGPVPRPRHGHRAVAIKELIVVFGGGNEGIVDELHVYNTATNQWFIPAVRGDIPPGCAAYGFVCDGTRLLVFGGMVEYGKYSNDLYELQASRWEWKRLKAKTPKNGPPPCPRLGHSFSLVGNKCYLFGGLANDSEDPKNNIPRYLNDLYILELRPGSGVVAWDIPITYGVLPPPRESHTAVVYTEKDNKKSKLVIYGGMSGCRLGDLWTLDIDTLTWNKPSLSGVAPLPRSLHSATTIGNKMYVFGGWVPLVMDDVKVATHEKEWKCTNTLACLNLDTMAWETILMDTLEDNIPRARAGHCAVAINTRLYIWSGRDGYRKAWNNQVCCKDLWYLETEKPPPPARVQLVRANTNSLEVSWGAVATADSYLLQLQKYDIPATAATATSPTPNPVPSVPANPPKSPAPAAAAPAVQPLTQVGITLLPQAAPAPPTTTTIQVLPTVPGSSISVPTAARTQGEPGDQGRLK

SEQ ID NO: 910353 - protein, 103 aa, Homo sapiens
MPCLLQVIGSSPQMSGMAALAAAAAATQKIPPSSAPTVLSVPAGTTIVKTMAVTPGTTTLPATVKVASSPVMVSVFRGLSLWSNKHSHSLRALELAVGPWAAE

SEQ ID NO: 910354 - protein, 1936 aa, Homo sapiens
MVEYGKYSNDLYELQASRWEWKRLKAKTPKNGPPPCPRLGHSFSLVGNKCYLFGGLANDSEDPKNNIPRYLNDLYILELRPGSGVVAWDIPITYGVLPPPRESHTAVVYTEKDNKKSKLVIYGGMSGCRLGDLWTLDIDTLTWNKPSLSGVAPLPRSLHSATTIGNKMYVFGGWVPLVMDDVKVATHEKEWKCTNTLACLNLDTMAWETILMDTLEDNIPRARAGHCAVAINTRLYIWSGRDGYRKAWNNQVCCKDLWYLETEKPPPPARVQLVRANTNSLEVSWGAVATADSYLLQLQKYDIPATAATATSPTPNPVPSVPANPPKSPAPAAAAPAVQPLTQVGITLLPQAAPAPPTTTTIQVLPTVPGSSISVPTAARTQGVPAVLKVTGPQATTGTPLVTMRPASQAGKAPVTVTSLPAGVRMVVPTQSAQGTVIGSSPQMSGMAALAAAAAATQKIPPSSAPTVLSVPAGTTIVKTMAVTPGTTTLPATVKVASSPVMVSNPATRMLKTAAAQVGTSVSSATNTSTRPIITVHKSGTVTVAQQAQVVTTVVGGVTKTITLVKSPISVPGGSALISNLGKVMSVVQTKPVQTSAVTGQASTGPVTQIIQTKGPLPAGTILKLVTSADGKPTTIITTTQASGAGTKPTILGISSVSPSTTKPGTTTIIKTIPMSAIITQAGATGVTSSPGIKSPITIITTKVMTSGTGAPAKIITAVPKIATGHGQQGVTQVVLKGAPGQPGTILRTVPMGGVRLVTPVTVSAVKPAVTTLVVKGTTGVTTLGTVTGTVSTSLAGAGGHSTSASLATPITTLGTIATLSSQVINPTAITVSAAQTTLTAAGGLTTPTITMQPVSQPTQVTLITAPSGVEAQPVHDLPVSILASPTTEQPTATVTIADSGQGDVQPGTVTLVCSNPPCETHETGTTNTATTTVVANLGGHPQPTQVQFVCDRQEAAASLVTSTVGQQNGSVVRVCSNPPCETHETGTTNTATTATSNMAGQHGCSNPPCETHETGTTNTATTAMSSVGANHQRDARRACAAGTPAVIRISVATGALEAAQGSKSQCQTRQTSATSTTMTVMATGAPCSAGPLLGPSMAREPGGRSPAFVQLAPLSSKVRLSSPSIKDLPAGRHSHAVSTAAMTRSSVGAGEPRMAPVCESLQGGSPSTTVTVTALEALLCPSATVTQVCSNPPCETHETGTTNTATTSNAGSAQRVCSNPPCETHETGTTHTATTATSNGGTGQPEGGQQPPAGRPCETHQTTSTGTTMSVSVGALLPDATSSHRTVESGLEVAAAPSVTPQAGTALLAPFPTQRVCSNPPCETHETGTTHTATTVTSNMSSNQDPPPAASDQGEVESTQGDSVNITSSSAITTTVSSTLTRAVTTVTQSTPVPGPSVPPPEELQVSPGPRQQLPPRQLLQSASTALMGESAEVLSASQTPELPAAVDLSSTGEPSSGQESAGSAVVATVVVQPPPPTQSEVDQLSLPQELMAEAQAGTTTLMVTGLTPEELAVTAAAEAAAQAAATEEAQALAIQAVLQAAQQAVMGTGEPMDTSEAAATVTQAELGHLSAEGQEGQATTIPIVLTQQELAALVQQQQLQEAQAQQQHHHLPTEALAPADSLNDPAIESNCLNELAGTVPSTVALLPSTATESLAPSNTFVAPQPVVVASPAKLQAAATLTEVANGIESLGVKPDLPPPPSKAPMKKENQWFDVGVIKGTNVMVTHYFLPPDDAVPSDDDLGTVPDYNQLKKQELQPGTAYKFRVAGINACGRGPFSEISAFKTCLPGFPGAPCAIKISKSPDGAHLTWEPPSVTSGKIIEYSVYLAIQSSQAGGELKSSTPAQLAFMRVYCGPSPSCLVQSSSLSNAHIDYTTKPAIIFRIAARNEKGYGPATQVRWLQETSKDSSGTKPANKRPMSSPEMKSAPKKSKADGQ

SEQ ID NO: 910355 - protein, 2035 aa, Homo sapiens; identical to SEQ ID NO: 910344

SEQ ID NO: 910356 - protein, 1533 aa, Homo sapiens
MRPASQAGKAPVTVTSLPAGVRMVVPTQSAQGTVIGSSPQMSGMAALAAAAAATQKIPPSSAPTVLSVPAGTTIVKTMAVTPGTTTLPATVKVASSPVMVSNPATRMLKTAAAQVGTSVSSATNTSTRPIITVHKSGTVTVAQQAQVVTTVVGGVTKTITLVKSPISVPGGSALISNLGKVMSVVQTKPVQTSAVTGQASTGPVTQIIQTKGPLPAGTILKLVTSADGKPTTIITTTQASGAGTKPTILGISSVSPSTTKPGTTTIIKTIPMSAIITQAGATGVTSSPGIKSPITIITTKVMTSGTGAPAKIITAVPKIATGHGQQGVTQVVLKGAPGQPGTILRTVPMGGVRLVTPVTVSAVKPAVTTLVVKGTTGVTTLGTVTGTVSTSLAGAGGHSTSASLATPITTLGTIATLSSQVINPTAITVSAAQTTLTAAGGLTTPTITMQPVSQPTQVTLITAPSGVEAQPVHDLPVSILASPTTEQPTATVTIADSGQGDVQPGTVTLVCSNPPCETHETGTTNTATTTVVANLGGHPQPTQVQFVCDRQEAAASLVTSTVGQQNGSVVRVCSNPPCETHETGTTNTATTATSNMAGQHGCSNPPCETHETGTTNTATTAMSSVGANHQRDARRACAAGTPAVIRISVATGALEAAQGSKSQCQTRQTSATSTTMTVMATGAPCSAGPLLGPSMAREPGGRSPAFVQLAPLSSKVRLSSPSIKDLPAGRHSHAVSTAAMTRSSVGAGEPRMAPVCESLQGGSPSTTVTVTALEALLCPSATVTQVCSNPPCETHETGTTNTATTSNAGSAQRVCSNPPCETHETGTTHTATTATSNGGTGQPEGGQQPPAGRPCETHQTTSTGTTMSVSVGALLPDATSSHRTVESGLEVAAAPSVTPQAGTALLAPFPTQRVCSNPPCETHETGTTHTATTVTSNMSSNQDPPPAASDQGEVESTQGDSVNITSSSAITTTVSSTLTRAVTTVTQSTPVPGPSVPPPEELQVSPGPRQQLPPRQLLQSASTALMGESAEVLSASQTPELPAAVDLSSTGEPSSGQESAGSAVVATVVVQPPPPTQSEVDQLSLPQELMAEAQAGTTTLMVTGLTPEELAVTAAAEAAAQAAATEEAQALAIQAVLQAAQQAVMGTGEPMDTSEAAATVTQAELGHLSAEGQEGQATTIPIVLTQQELAALVQQQQLQEAQAQQQHHHLPTEALAPADSLNDPAIESNCLNELAGTVPSTVALLPSTATESLAPSNTFVAPQPVVVASPAKLQAAATLTEVANGIESLGVKPDLPPPPSKAPMKKENQWFDVGVIKGTNVMVTHYFLPPDDAVPSDDDLGTVPDYNQLKKQELQPGTAYKFRVAGINACGRGPFSEISAFKTCLPGFPGAPCAIKISKSPDGAHLTWEPPSVTSGKIIEYSVYLAIQSSQAGGELKSSTPAQLAFMRVYCGPSPSCLVQSSSLSNAHIDYTTKPAIIFRIAARNEKGYGPATQVRWLQETSKDSSGTKPANKRPMSSPEMKSAPKKSKADGQ

SEQ ID NO: 910357 - protein, 1115 aa, Homo sapiens
MVPACVVTVQDSGRDRQTASCSTNSPPRVSPQPVSQPTQVTLITAPSGVEAQPVHDLPVSILASPTTEQPTATVTIADSGQGDVQPGTVTLVCSNPPCETHETGTTNTATTTVVANLGGHPQPTQVQFVCDRQEAAASLVTSTVGQQNGSVVRVCSNPPCETHETGTTNTATTATSNMAGQHGCSNPPCETHETGTTNTATTAMSSVGANHQRDARRACAAGTPAVIRISVATGALEAAQGSKSQCQTRQTSATSTTMTVMATGAPCSAGPLLGPSMAREPGGRSPAFVQLAPLSSKVRLSSPSIKDLPAGRHSHAVSTAAMTRSSVGAGEPRMAPVCESLQGGSPSTTVTVTALEALLCPSATVTQVCSNPPCETHETGTTNTATTSNAGSAQRVCSNPPCETHETGTTHTATTATSNGGTGQPEGGQQPPAGRPCETHQTTSTGTTMSVSVGALLPDATSSHRTVESGLEVAAAPSVTPQAGTALLAPFPTQRVCSNPPCETHETGTTHTATTVTSNMSSNQDPPPAASDQGEVESTQGDSVNITSSSAITTTVSSTLTRAVTTVTQSTPVPGPSVPPPEELQVSPGPRQQLPPRQLLQSASTALMGESAEVLSASQTPELPAAVDLSSTGEPSSGQESAGSAVVATVVVQPPPPTQSEVDQLSLPQELMAEAQAGTTTLMVTGLTPEELAVTAAAEAAAQAAATEEAQALAIQAVLQAAQQAVMGTGEPMDTSEAAATVTQAELGHLSAEGQEGQATTIPIVLTQQELAALVQQQQLQEAQAQQQHHHLPTEALAPADSLNDPAIESNCLNELAGTVPSTVALLPSTATESLAPSNTFVAPQPVVVASPAKLQAAATLTEVANGIESLGVKPDLPPPPSKAPMKKENQWFDVGVIKGTNVMVTHYFLPPDDAVPSDDDLGTVPDYNQLKKQELQPGTAYKFRVAGINACGRGPFSEISAFKTCLPGFPGAPCAIKISKSPDGAHLTWEPPSVTSGKIIEYSVYLAIQSSQAGGELKSSTPAQLAFMRVYCGPSPSCLVQSSSLSNAHIDYTTKPAIIFRIAARNEKGYGPATQVRWLQETSKDSSGTKPANKRPMSSPEMKSAPKKSKADGQ

SEQ ID NO: 910358 - protein, 1723 aa, Homo sapiens
MASAVSPANLPAVLLQPRWKRVVGWSGPVPRPRHGHRAVAIKELIVVFGGGNEGIVDELHVYNTATNQWFIPAVRGDIPPGCAAYGFVCDGTRLLVFGGMVEYGKYSNDLYELQASRWEWKRLKAKTPKNGPPPCPRLGHSFSLVGNKCYLFGGLANDSEDPKNNIPRYLNDLYILELRPGSGVVAWDIPITYGVLPPPRESHTAVVYTEKDNKKSKLVIYGGMSGCRLGDLWTLDIDTLTWNKPSLSGVAPLPRSLHSATTIGNKMYVFGGWVPLVMDDVKVATHEKEWKCTNTLACLNLDTMAWETILMDTLEDNIPRARAGHCAVAINTRLYIWSGRDGYRKAWNNQVCCKDLWYLETEKPPPPARVQLVRANTNSLEVSWGAVATADSYLLQLQKYDIPATAATATSPTPNPVPSVPANPPKSPAPAAAAPAVQPLTQVGITLLPQAAPAPPTTTTIQVLPTVPGSSISVPTAARTQGVPAVLKVTGPQATTGTPLVTMRPASQAGKAPVTVTSLPAGVRMVVPTQSAQGTVIGSSPQMSGMAALAAAAAATQKIPPSSAPTVLSVPAGTTIVKTMAVTPGTTTLPATVKVASSPVMVSNPATRMLKTAAAQVGTSVSSATNTSTRPIITVHKSGTVTVAQQAQVVTTVVGGVTKTITLVKSPISVPGGSALISNLGKVMSVVQTKPVQTSAVTGQASTGPVTQIIQTKGPLPAGTILKLVTSADGKPTTIITTTQASGAGTKPTILGISSVSPSTTKPGTTTIIKTIPMSAIITQAGATGVTSSPGIKSPITIITTKVMTSGTGAPAKIITAVPKIATGHGQQGVTQVVLKGAPGQPGTILRTVPMGGVRLVTPVTVSAVKPAVTTLVVKGTTGVTTLGTVTGTVSTSLAGAGGHSTSASLATPITTLGTIATLSSQVINPTAITVSAAQTTLTAAGGLTTPTITMQPVSQPTQVTLITAPSGVEAQPVHDLPVSILASPTTEQPTATVTIADSGQGDVQPGTVTLVCSNPPCETHETGTTNTATTTVVANLGGHPQPTQVQFVCDRQEAAASLVTSTVGQQNGSVVRVCSNPPCETHETGTTNTATTATSNMAGQHGCSNPPCETHETGTTNTATTAMSSVGANHQRDARRACAAGTPAVIRISVATGALEAAQGSKSQCQTRQTSATSTTMTVMATGAPCSAGPLLGPSMAREPGGRSPAFVQLAPLSSKVRLSSPSIKDLPAGRHSHAVSTAAMTRSSVGAGEPRMAPVCESLQGGSPSTTVTVTALEALLCPSATVTQVCSNPPCETHETGTTNTATTSNAGSAQRVCSNPPCETHETGTTHTATTATSNGGTGQPEGGQQPPAGRPCETHQTTSTGTTMSVSVGALLPDATSSHRTVESGLEVAAAPSVTPQAGTALLAPFPTQRVCSNPPCETHETGTTHTATTVTSNMSSNQDPPPAASDQGEVESTQGDSVNITSSSAITTTVSSTLTRAVTTVTQSTPVPGPSVPPPEELQVSPGPRQQLPPRQLLQSASTALMGESAEVLSASQTPELPAAVDLSSTGEPSSGQESAGSAVVATVVVQPPPPTQSEVDQLSLPQELMAEAQAGTTTLMVTGLTPEELAVTAAAEAAAQAAATEEAQALAIQAVLQAAQQAVMGTGEPMDTSEAAATVTQAELGHLSAEGQEGQATTIPIVLTQQELAALVQQQQLQEAQAQQQHHPLPFLFLSVFKII

SEQ ID NO: 910359 - protein, 632 aa, Homo sapiens
MASAVSPANLPAVLLQPRWKRVVGWSGPVPRPRHGHRAVAIKELIVVFGGGNEGIVDELHVYNTATNQWFIPAVRGDIPPGCAAYGFVCDGTRLLVFGGMVEYGKYSNDLYELQASRWEWKRLKAKTPKNGPPPCPRLGHSFSLVGNKCYLFGGLANDSEDPKNNIPRYLNDLYILELRPGSGVVAWDIPITYGVLPPPRESHTAVVYTEKDNKKSKLVIYGGMSGCRLGDLWTLDIDTLTWNKPSLSGVAPLPRSLHSATTIGNKMYVFGGWVPLVMDDVKVATHEKEWKCTNTLACLNLDTMAWETILMDTLEDNIPRARAGHCAVAINTRLYIWSGRDGYRKAWNNQVCCKDLWYLETEKPPPPARVQLVRANTNSLEVSWGAVATADSYLLQLQKYDIPATAATATSPTPNPVPSVPANPPKSPAPAAAAPAVQPLTQVGITLLPQAAPAPPTTTTIQVLPTVPGSSISVPTAARTQGVPAVLKVTGPQATTGTPLVTMRPASQAGKAPVTVTSLPAGVRMVVPTQSAQGTVIGSSPQMSGMAALAAAAAATQKIPPSSAPTVLSVPAGTTIVKTMAVTPGTTTLPATVKVASSPVMVSVFRGLSLWSNKHSHSLRALELAVGPWAAE

SEQ ID NO: 910360 - protein, 341 aa, Homo sapiens
MASAVSPANLPAVLLQPRWKRVVGWSGPVPRPRHGHRAVAIKELIVVFGGGNEGIVDELHVYNTATNQWFIPAVRGDIPPGCAAYGFVCDGTRLLVFGGMVEYGKYSNDLYELQASRWEWKRLKAKTPKNGPPPCPRLGHSFSLVGNKCYLFGGLANDSEDPKNNIPRYLNDLYILELRPGSGVVAWDIPITYGVLPPPRESHTAVVYTEKDNKKSKLVIYGGMSGCRLGDLWTLDIDTLTWNKPSLSGVAPLPRSLHSATTIGNKMYVFGGWVPLVMDDVKVATHEKEWKCTNTLACLNLGMASSGSEWPVGGCRRLALLSLRAVWGVRGASWAPGSLWN

SEQ ID NO: 910361 - protein, 98 aa, Homo sapiens
TPRTFLLQQGTSLTPGHFLLHHKLPRVPSGGLLIPRFSLQVLILQASRWEWKRLKAKTPKNGPPPCPRLGHSFSLVGNKCYLFGGLANDSEDPKNNIP

SEQ ID NO: 910362 - protein, 522 aa, Homo sapiens
MPRKKAAAAAWEEPSSGNGTARAGPRKRGGPAGRKRERPERCSSSSGGGSSGDEDGLELDGAPGGGKRAARPATAGKAGGAAVVITEPEHTKERVKLEGSKCKGQLLIFGATNWDLIGRKEVPKQQAAYRNLGQNLWGPHRYGCLAGVRVRTVVSGSCAAHSLLITTEGKLWSWGRNEKGQLGHGDTKRVEAPRLIEGLSHEVIVSAACGRNHTLALTETGSVFAFGENKMGQLGLGNQTDAVPSPAQIMYNGQPITKMACGAEFSMIMDCKGNLYSFGCPEYGQLGHNSDGKFIARAQRIEYDCELVPRRVAIFIEKTKDGQILPVPNVVVRDVACGANHTLVLDSQKRVFSWGFGGYGRLGHAEQKDEMVPRLVKLFDFPGRGASQIYAGYTCSFAVSEVGGLFFWGATNTSRESTMYPKAVQDLCGWRIRSLACGKSSIIVAADESTISWGPSPTFGELGYGDHKPKSSTAAQEVKTLDGIFSEQVAMGYSHSLVIARDESETEKEKIKKLPEYNPRTL

SEQ ID NO: 910363 - protein, 109 aa, Homo sapiens
SPCEHTDTSLVLVLLLMAGSVVSTGHNSDGKFIARAQRIEYDCELVPRRVAIFIEKTKDGQILPVPNVVVRDVACGANHTVRLGFSHFLRVAPGWKGCLCSSFLTLGFG

SEQ ID NO: 910364 - protein, 522 aa, Homo sapiens; identical to SEQ ID NO: 910362

SEQ ID NO: 910365 - protein, 522 aa, Homo sapiens; identical to SEQ ID NO: 910362

SEQ ID NO: 910366 - protein, 112 aa, Homo sapiens
LGVIGRGYMYPKAVQDLCGWRIRSLACGKSSIIVAADESTISWGPSPTFGELGYGDHKPKSSTAAQEVKTLDGIFSEQVAMGYSHSLVIARDESETEKEKIKKLPEYNPRTL

SEQ ID NO: 910367 - protein, 115 aa, Homo sapiens
KWQLTLMPLSIAAWVQVWGCWPCSDSLPVCRKSSIIVAADESTISWGPSPTFGELGYGDHKPKSSTAAQEVKTLDGIFSEQVAMGYSHSLVIARDESETEKEKIKKLPEYNPRTL

SEQ ID NO: 910368 - protein, 109 aa, Homo sapiens
GTEGLKVQASWQKMVTAVASALSSKIPLSLLPMIQRYLEDKVTGPPPSKITLACFGSIRVTPSPLFLADGPRPVSVLFLPLAACTPTAFWLRHYRIGRVPPGGGLGICV

SEQ ID NO: 910369 - protein, 522 aa, Homo sapiens; identical to SEQ ID NO: 910362

SEQ ID NO: 910370 - protein, 522 aa, Homo sapiens; identical to SEQ ID NO: 910362

SEQ ID NO: 910371 - protein, 522 aa, Homo sapiens; identical to SEQ ID NO: 910362

SEQ ID NO: 910372 - protein, 90 aa, Homo sapiens
RLGTRLGVDRPRLWSLFLPPAWILPRAGRPVAETRGTVLLTQLPLVTFAWLWYQIVGITEESPSLRVSTDAVTATCVLVKCPSSPPCVLR

SEQ ID NO: 910373 - protein, 89 aa, Homo sapiens
NRRDECVIRTRLWSLFLPPAWILPRAGRPVAETRGTVLLTQLPLVTFAWLWYQIVGITEESPSLRVSTDAVTATCVLVKCPSSPPCVLR

SEQ ID NO: 910374 - protein, 522 aa, Homo sapiens; identical to SEQ ID NO: 910362

SEQ ID NO: 910375 - protein, 509 aa, Homo sapiens
MPRKKAAAAAWEEPSSGNGTARAGPRKRGGPAGRKRERPERCSSSSGGGSSGDEDGLELDGAPGGGKRAARPATAGKAGGAAVVITEPEHTKERVKLEGSKCKGQLLIFGATNWDLIGRKEVPKQQAAYRNLGQNLWGPHRYGCLAGVRVRTVVSGSCAAHSLLITTEGKLWSWGRNEKGQLGHGDTKRVEAPRLIEGLSHEVIVSAACGRNHTLALTETGSVFAFGENKMGQLGLGNQTDAVPSPAQIMYNGQPITKMACGAEFSMIMDCKGNLYSFGCPEYGQLGHNSDGKFIARAQRIEYDCELVPRRVAIFIEKTKDGQILPVPNVVVRDVACGANHTLVLDSQKRVFSWGFGGYGRLGHAEQKDEMVPRLVKLFDFPGRGASQIYAGYTCSFAVSEVGGLFFWGATNTSRESTMYPKAVQDLCGWRIRSLACGKSSIIVAADESTISWGPSPTFGELGYGDHKPKSSTAAQEVKTLDGIFSEQVSGGSCASSGTCPYPVVCHSS

SEQ ID NO: 910376 - protein, 128 aa, Homo sapiens
MNSNFGAEYGSRHNSDGKFIARAQRIEYDCELVPRRVAIFIEKTKDGQILPVPNVVVRDVACGANHTLVLDSQKRVFSWGFGGYGRLGHAEQKDEMVPRLVKLFDFPGRGASQIYAGYTCSFAVSEVG

SEQ ID NO: 910377 - protein, 522 aa, Homo sapiens; identical to SEQ ID NO: 910362

SEQ ID NO: 910378 - protein, 133 aa, Homo sapiens [sequence omitted]

SEQ ID NO: 910379 - protein, 522 aa, Homo sapiens; identical to SEQ ID NO: 910362

SEQ ID NO: 910380 - protein, 522 aa, Homo sapiens; identical to SEQ ID NO: 910362

SEQ ID NO: 910381 - protein, 522 aa, Homo sapiens; identical to SEQ ID NO: 910362

SEQ ID NO: 910382 - protein, 119 aa, Homo sapiens
KARYEAGCWIGRGDGPASSQVHSPVLARRISPFCASLDRLVLWSLFLPPAWILPRAGRPVAETRGTVLLTQLPLVTFAWLWYQIVGITEESPSLRVSTDAVTATCVLVKCPSSPPCVLR

SEQ ID NO: 910383 - protein, 91 aa, Homo sapiens
EKTRLGGPVVMAELWSLFLPPAWILPRAGRPVAETRGTVLLTQLPLVTFAWLWYQIVGITEESPSLRVSTDAVTATCVLVKCPSSPPCVLR

SEQ ID NO: 910384 - protein, 522 aa, Homo sapiens; identical to SEQ ID NO: 910362

SEQ ID NO: 910385 - protein, 371 aa, Homo sapiens
MPRKKAAAAAWEEPSSGNGTARAGPRKRGGPAGRKRERPERCSSSSGGGSSGDEDGLELDGAPGGGKRAARPATAGKAGGAAVVITEPEHTKERVKLEGSKCKGQLLIFGATNWDLIGRKEVPKQQAAYRNLGQNLWGPHRYGCLAGVRVRTVVSGSCAAHSLLITTEGKLWSWGRNEKGQLGHGDTKRVEAPRLIEGLSHEVIVSAACGRNHTLALTETGSVFAFGENKMGQLGLGNQTDAVPSPAQIMYNGQPITKMACGAEFSMIMDCKGNLYSFGCPEYGQLGHNSDGKFIARAQRIEYDCELVPRRVAIFIEKTKDGQILPVPNVVVRDVACGANHTVRLGFSHFLRVAPGWKGCLCSSFLTLGFG

SEQ ID NO: 910386 - protein, 297 aa, Homo sapiens; identical to SEQ ID NO: 755456

SEQ ID NO: 910387 - protein, 297 aa, Homo sapiens; identical to SEQ ID NO: 755456

SEQ ID NO: 910388 - protein, 297 aa, Homo sapiens; identical to SEQ ID NO: 755456

SEQ ID NO: 910389 - protein, 240 aa, Homo sapiens
MEDYTKIEKIGEGTYGVVYKGRHKTTGQVVAMKKIRLESEEEGVPSTAIREISLLKELRHPNIVSLQDVLMQDSRLYLIFEFLSMDLKKYLDSIPPGQYMDSSLVKVVTLWYRSPEVLLGSARYSTPVDIWSIGTIFAELATKKPLFHGDSEIDQLFRIFRALGTPNNEVWPEVESLQDYKNTFPKWKPGSLASHVKNLDENGLDLLSKMLIYDPAKRISGKMALNHPYFNDLDNQIKKM

SEQ ID NO: 910390 - protein, 144 aa, Homo sapiens
MEDYTKIEKIGEGTYGVVYKGRHKTTGQVVAMKKIRLESEEEGVPSTAIREISLLKELRHPNIVSLQDVLMQDSRLYLIFEFLSMDLKKYLDSIPPGQYMDSSLVKSYLYQILQGIVFCHSRRVLHRDLKPCQSFWNTYQSIYT

SEQ ID NO: 910391 - protein, 109 aa, Homo sapiens
MEDYTKIEKIGEGTYGVVYKGRHKTTGQVVAMKKIRLESEEEGVPSTAIREISLLKELRHPNIVSLQDVLMQDSRLYLIFEFLSMDLKKYLDSIPPGQYMDSSLVKVKA

SEQ ID NO: 910392 - protein, 297 aa, Homo sapiens; identical to SEQ ID NO: 755456

SEQ ID NO: 910393 - protein, 297 aa, Homo sapiens; identical to SEQ ID NO: 755456

SEQ ID NO: 910394 - protein, 246 aa, Homo sapiens
GSEEILGKKLKDEIKPGILHKHILKTAIFEFLSMDLKKYLDSIPPGQYMDSSLVKSYLYQILQGIVFCHSRRVLHRDLKPQNLLIDDKGTIKLADFGLARAFGIPIRVYTHEVVTLWYRSPEVLLGSARYSTPVDIWSIGTIFAELATKKPLFHGDSEIDQLFRIFRALGTPNNEVWPEVESLQDYKNTFPKWKPGSLASHVKNLDENGLDLLSKMLIYDPAKRISGKMALNHPYFNDLDNQIKKM

SEQ ID NO: 910395 - protein, 144 aa, Homo sapiens; identical to SEQ ID NO: 910390

SEQ ID NO: 910396 - protein, 584 aa, Homo sapiens
PSHPPGEAAGDPLSAPWEKAPAMSNQYQEEGCSERPECKSKSPTLLSSYCIDSILGRRSPCKMRLLGAAQSLPAPLTSRADPEKAVQGSPKSSSAPFEAELHLPPKLRRLYGPGGGRLLQGAAAAAAAAAAAAAAAATATAGPRGEAPPPPPPTARPGERPDGAGAAAAAAAAAAAAWDTLKISQAPQVSISRSKSYRENGAPFVPPPPALDELGGPGGVTHPEERLGVAGGPGSAPAAGGGTGTEDDEEELLEDEEDEDEEEELLEDDEEELLEDDARALLKEPRRCPVAATGAVAAAAAAAVATEGGELSPKEELLLHPEDAEGKDGEDSVCLSAGSDSEEGLLKRKQRRYRTTFTSYQLEELERAFQKTHYPDVFTREELAMRLDLTEARVQVWFQNRRAKWRKREKAGAQTHPPGLPFPGPLSATHPLSPYLDASPFPPHHPALDSAWTAAAAAAAAAFPSLPPPPGSASLPPSGAPLGLSTFLGAAVFRHPAFISPAFGRLFSTMAPLTSASTAAALLRQPTPAVEGAVASGALADPATAAADRRASSIAALRLKAKEHAAQLTQLNILPGTSTGKEVC

SEQ ID NO: 910397 - protein, 220 aa, Homo sapiens
PPSLLLLSSPFLLPHSLLGDSVIAAPGLGINRPFKRNHRIHATGPWGLRSPRRPVDPGPARPLGEYLDSVFSPQSVPCPRKALSAGSSFRPRPLPTSPPRPIRVPWVPRPSAAPATSGGRRCPGAAHSSRGHDRAVCSPCRLFSTMAPLTSASTAAALLRQPTPAVEGAVASGALADPATAAADRRASSIAALRLKAKEHAAQLTQLNILPGTSTGKEVC

SEQ ID NO: 910398 - protein, 229 aa, Homo sapiens
PSHPPGEAAGDPLSAPWEKAPAMSNQYQEEGCSERPECKSKSPTLLSSYCIDSILGRRSPCKMRLLGAAQSLPAPLTSRADPEKAVQGSPKSSSAPFEAELHRRRRRLPEPTSASGLGQPAAQRGAAGPEHFPRSGSVPTPSFHQPGIRQALFHNGPPDQRVDRGRALRQPTPAVEGAVASGALADPATAAADRRASSIAALRLKAKEHAAQLTQLNILPGTSTGKEVC

SEQ ID NO: 910399 - protein, 110 aa, Homo sapiens
LTQEGRREKPWPVSLLLSQKQAPGRKKLWKALALLEAIIIGKGLQHAKFASHTFVKKTVTWQGRWDSQQVQHIWKSPYYTRFSNSTSFLGNAVFKERAFFEPWLPVTLML

SEQ ID NO: 910400 - protein, 228 aa, Homo sapiens
LTQEGRREKPWPVSLLLSQKQAPGRKKLWKALALLEAIIIGKGLQHAKFASHTFVKKTVTWQGRWDSQQVQHIWKSPYYTRFSNSTSFLGNDYRVGGIFSAPRAQGLWSHGIREGICGKKYSEQVPDVLQLNEIFKTLNSKNCPSLKDKPKVIIIQACHVGEANVFENTRHSNTVLICIHHEFSVYVCFLVSKNIHCQHSRCGFCELYDWLVDICFIFKSETLMFGGF

SEQ ID NO: 910401 - protein, 140 aa, Homo sapiens
LTQEGRREKPWPVSLLLSQKQAPGRKKLWKALALLEAIIIGKGLQHAKFASHTFVKKTVTWQGRWDSQQVQHIWKSPYYTRFSNSTSFLAVSPLFCRSAAIRWGSTTDTVHLGIIDGGCRTAKIAACSFLWKLRPREALT

SEQ ID NO: 910402 - protein, 228 aa, Homo sapiens; identical to SEQ ID NO: 910400

SEQ ID NO: 910403 - protein, 142 aa, Homo sapiens
LTQEGRREKPWPVSLLLSQKQAPGRKKLWKALALLEAIIIGKGLQHAKFASHTFVKKTVTWQGRWDSQQVQHIWKSPYYTRFSNSTSFLENHGVVLVKDSVPASENISLPTPGDFEDDAINQVHIEKDFIAFCSSTLGSTFI

SEQ ID NO: 910404 - protein, 854 aa, Homo sapiens
MLAKQEAQMNLMKQAVEIYVHHEIYNLIFKYVGTMEASEDAAFNKITRSLQDLQQKDIGVKPEFSFNIPRAKRELAQLNKCTSPQQKLVCLRKVVQLITQSPSQRVNLETMCADDLLSVLLYLLVKTEIPNWMANLSYIKNFRFSSLAKDELGYCLTSFEAAIEYIRQGSLSAKPPESEGFGDRLFLKQRMSLLSQMTSSPTDCLFKHIASGNQKEVERLLSQEDHDKDTVQKMCHPLCFCDDCEKLVSGRLNDPSVVTPFSRDDRGHTPLHVAAVCGQASLIDLLVSKGAMVNATDYHGATPLHLACQKGYQSVTLLLLHYKASAEVQDNNGNTPLHLACTYGHEDCVKALVYYDVESCRLDIGNEKGDTPLHIAARWGYQGVIETLLQNGASTEIQNRLKETPLKCALNSKILSVMEAYHLSFERRQKSSEAPVQSPQRSVDSISQESSTSSFSSMSAGSRQEETKKDYREVEKLLRAVADGDLEMVRYLLEWTEEDLEDAEDTVSAADPEFCHPLCQCPKCAPAQKRLAKVPASGLGVNVTSQDGSSPLHVAALHGRADLIRLLLKHGANAGARNADQAVPLHLACQQGHFQVVKCLLDSNAKPNKKDLSGNTPLIYACSGGHHELVALLLQHGASINASNNKGNTALHEAVIEKHVFVVELLLLHGASVQVLNKRQRTAVDCAEQNSKIMELLQVVPSCVASLDDVAETDRKEYVTVKIRKKWNSKLYDLPDEPFTRQFYFVHSAGQFKGKTSREIMARDRSVPNLTEGSLHEPGRQSVTLRQNNLPAQSGSHAAEKGNSDWPERPGLTQTGPGHRRMLRRHTVEDAVVSQGPEAAGPLSTPQEVSASRS

SEQ ID NO: 910405 - protein, 1050 aa, Homo sapiens
MALYDEDLLKNPFYLALQKCRPDLCSKVAQIHGIVLVPCKGSLSSSIQSTCQFESYILIPVEEHFQTLNGKDVFIQGNRIKLGAGFACLLSVPILFEETFYNEKEESFSILCIAHPLEKRESSEEPLAPSDPFSLKTIEDVREFLGRHSERFDRNIASFHRTFRECERKSLRHHIDSANALYTKCLQQLLRDSHLKMLAKQEAQMNLMKQAVEIYVHHEIYNLIFKYVGTMEASEDAAFNKITRSLQDLQQKDIGVKPEFSFNIPRAKRELAQLNKCTSPQQKLVCLRKVVQLITQSPSQRVNLETMCADDLLSVLLYLLVKTEIPNWMANLSYIKNFRFSSLAKDELGYCLTSFEAAIEYIRQGSLSAKPPESEGFGDRLFLKQRMSLLSQMTSSPTDCLFKHIASGNQKEVERLLSQEDHDKDTVQKMCHPLCFCDDCEKLVSGRLNDPSVVTPFSRDDRGHTPLHVAAVCGQASLIDLLVSKGAMVNATDYHGATPLHLACQKGYQSVTLLLLHYKASAEVQDNNGNTPLHLACTYGHEDCVKALVYYDVESCRLDIGNEKGDTPLHIAARWGYQGVIETLLQNGASTEIQNRLKETPLKCALNSKILSVMEAYHLSFERRQKSSEAPVQSPQRSVDSISQESSTSSFSSMSAGSRQEETKKDYREVEKLLRAVADGDLEMVRYLLEWTEEDLEDAEDTVSAADPEFCHPLCQCPKCAPAQKRLAKVPASGLGVNVTSQDGSSPLHVAALHGRADLIRLLLKHGANAGARNADQAVPLHLACQQGHFQVVKCLLDSNAKPNKKDLSGNTPLIYACSGGHHELVALLLQHGASINASNNKGNTALHEAVIEKHVFVVELLLLHGASVQVLNKRQRTAVDCAEQNSKIMELLQVVPSCVASLDDVAETDRKEYVTVKIRKKWNSKLYDLPDEPFTRQFYFVHSAGQFKGKTSREIMARDRSVPNLTEGSLHEPGRQSVTLRQNNLPAQSGSHAAEKGNSDWPERPGLTQTGPGHRRMLRRHTVEDAVVSQGPEAAGPLSTPQEVSASRS

SEQ ID NO: 910406 - protein, 744 aa, Homo sapiens
MCADDLLSVLLYLLVKTEIPNWMANLSYIKNFRFSSLAKDELGYCLTSFEAAIEYIRQGSLSAKPPESEGFGDRLFLKQRMSLLSQMTSSPTDCLFKHIASGNQKEVERLLSQEDHDKDTVQKMCHPLCFCDDCEKLVSGRLNDPSVVTPFSRDDRGHTPLHVAAVCGQASLIDLLVSKGAMVNATDYHGATPLHLACQKGYQSVTLLLLHYKASAEVQDNNGNTPLHLACTYGHEDCVKALVYYDVESCRLDIGNEKGDTPLHIAARWGYQGVIETLLQNGASTEIQNRLKETPLKCALNSKILSVMEAYHLSFERRQKSSEAPVQSPQRSVDSISQESSTSSFSSMSAGSRQEETKKDYREVEKLLRAVADGDLEMVRYLLEWTEEDLEDAEDTVSAADPEFCHPLCQCPKCAPAQKRLAKVPASGLGVNVTSQDGSSPLHVAALHGRADLIRLLLKHGANAGARNADQAVPLHLACQQGHFQVVKCLLDSNAKPNKKDLSGNTPLIYACSGGHHELVALLLQHGASINASNNKGNTALHEAVIEKHVFVVELLLLHGASVQVLNKRQRTAVDCAEQNSKIMELLQVVPSCVASLDDVAETDRKEYVTVKIRKKWNSKLYDLPDEPFTRQFYFVHSAGQFKGKTSREIMARDRSVPNLTEGSLHEPGRQSVTLRQNNLPAQSGSHAAEKGNSDWPERPGLTQTGPGHRRMLRRHTVEDAVVSQGPEAAGPLSTPQEVSASRS

SEQ ID NO: 910407 - protein, 220 aa, Homo sapiens
MHGASINASNNKGNTALHEAVIEKHVFVVELLLLHGASVQVLNKRQRTAVDCAEQNSKIMELLQVVPSCVASLDDVAETDRKEYVTVKIRKKWNSKLYDLPDEPFTRQFYFVHSAGQFKGKTSREIMARDRSVPNLTEGSLHEPGRQSVTLRQNNLPAQSGSHAAEKGNSDWPERPGLTQTGPGHRRMLRRHTVEDAVVSQGPEAAGPLSTPQEVSASRS

SEQ ID NO: 910408 - protein, 1050 aa, Homo sapiens; identical to SEQ ID NO: 910405

SEQ ID NO: 910409 - protein, 135 aa, Homo sapiens [sequence omitted]

SEQ ID NO: 910410 - protein, 252 aa, Homo sapiens
MALYDEDLLKNPFYLALQKCRPDLCSKVAQIHGIVLVPCKGSLSSSIQSTCQFESYILIPVEEHFQTLNGKDVFIQGNRIKLGAGFACLLSVPILFEETFYNEKEESFSILCIAHPLEKRESSEEPLAPSDPFSLKTIEDVREFLGRHSERFDRNIASFHRTFRECERKSLRHHIDSANALYTKCLQQLLRDSHLKMLAKQEAQMNLMKQAVEIYVHHEIYNLIFKYVGTMEASEVGSQLLSPKMEAFFCAF

SEQ ID NO: 910411 - protein, 1050 aa, Homo sapiens; identical to SEQ ID NO: 910405

SEQ ID NO: 910412 - protein, 1017 aa, Homo sapiens
REFIILLFEFIILPREFMILLREFIILLEEHFQTLNGKDVFIQGNRIKLGAGFACLLSVPILFEETFYNEKEESFSILCIAHPLEKRESSEEPLAPSDPFSLKTIEDVREFLGRHSERFDRNIASFHRTFRECERKSLRHHIDSANALYTKCLQQLLRDSHLKMLAKQEAQMNLMKQAVEIYVHHEIYNLIFKYVGTMEASEDAAFNKITRSLQDLQQKDIGVKPEFSFNIPRAKRELAQLNKCTSPQQKLVCLRKVVQLITQSPSQRVNLETMCADDLLSVLLYLLVKTEIPNWMANLSYIKNFRFSSLAKDELGYCLTSFEAAIEYIRQGSLSAKPPESEGFGDRLFLKQRMSLLSQMTSSPTDCLFKHIASGNQKEVERLLSQEDHDKDTVQKMCHPLCFCDDCEKLVSGRLNDPSVVTPFSRDDRGHTPLHVAAVCGQASLIDLLVSKGAMVNATDYHGATPLHLACQKGYQSVTLLLLHYKASAEVQDNNGNTPLHLACTYGHEDCVKALVYYDVESCRLDIGNEKGDTPLHIAARWGYQGVIETLLQNGASTEIQNRLKETPLKCALNSKILSVMEAYHLSFERRQKSSEAPVQSPQRSVDSISQESSTSSFSSMSAGSRQEETKKDYREVEKLLRAVADGDLEMVRYLLEWTEEDLEDAEDTVSAADPEFCHPLCQCPKCAPAQKRLAKVPASGLGVNVTSQDGSSPLHVAALHGRADLIRLLLKHGANAGARNADQAVPLHLACQQGHFQVVKCLLDSNAKPNKKDLSGNTPLIYACSGGHHELVALLLQHGASINASNNKGNTALHEAVIEKHVFVVELLLLHGASVQVLNKRQRTAVDCAEQNSKIMELLQVVPSCVASLDDVAETDRKEYVTVKIRKKWNSKLYDLPDEPFTRQFYFVHSAGQFKGKTSREIMARDRSVPNLTEGSLHEPGRQSVTLRQNNLPAQSGSHAAEKGNSDWPERPGLTQTGPGHRRMLRRHTVEDAVVSQGPEAAGPLSTPQEVSASRS

SEQ ID NO: 910413 - protein, 304 aa, Homo sapiens
LYDALVAPAGSNVYRGVSFLIAARWGYQGVIETLLHLACQQGHFQVVKCLLDSNAKPNKKDLSGNTPLIYACSGGHHELVALLLQHGASINASNNKGNTALHEAVIEKHVFVVELLLLHGASVQVLNKRQRTAVDCAEQNSKIMELLQVVPSCVASLDDVAETDRKEYVTVKIRKKWNSKLYDLPDEPFTRQFYFVHSAGQFKGKTSREIMARDRSVPNLTEGSLHEPGRQSVTLRQNNLPAQSGSHAAEKGNSDWPERPGLTQTGPGHRRMLRRHTVEDAVVSQGPEAAGPLSTPQEVSASRS

SEQ ID NO: 910414 - protein, 161 aa, Homo sapiens
MELLQVVPSCVASLDDVAETDRKEYVTVKIRKKWNSKLYDLPDEPFTRQFYFVHSAGQFKGKTSREIMARDRSVPNLTEGSLHEPGRQSVTLRQNNLPAQSGSHAAEKGNSDWPERPGLTQTGPGHRRMLRRHTVEDAVVSQGPEAAGPLSTPQEVSASRS

SEQ ID NO: 910415 - protein, 1050 aa, Homo sapiens; identical to SEQ ID NO: 910405

SEQ ID NO: 910416 - protein, 81 aa, Homo sapiens
MSAGSRQEETKKDYREVRLPEEGLGRGGLGGPGQWCPAEEPWPDKGRPLSLLAHAEAAAALWWPRLVPSSWAQQHLAVLYI

SEQ ID NO: 910417 - protein, 432 aa, Homo sapiens
MISAAQLLDELMGRDRNLAPDEKRSNVRWDHESVCKYYLCGFCPAELFTNTRSDLGPCEKIHDENLRKQYEKSSRFMKVGYERDFLRYLQSLLAEVERRIRRGHARLALSQNQQSSGAAGPTGKNEEKIQVLTDKIDVLLQQIEELGSEGKVEEAQGMMKLVEQLKEERELLRSTTSTIESFAAQEKQMEVCEVCGAFLIVGDAQSRVDDHLMGKQHMGYAKIKATVEELKEKLRKRTEEPDRDERLKKEKQEREEREKEREREREERERKRRREEEEREKERARDRERRKRSRSRSRHSSRTSDRRCSRSRDHKRSRSRERRRSRSRDRRRSRSHDRSERKHRSRSRDRRRSKSRDRKSYKHRSKSRDREQDRKSKEKEKRGSDDKKSSVKSGSREKQSEDTNTESKESDTKNEVNGTSEDIKSEGDTQSN

SEQ ID NO: 910418 - protein, 356 aa, Homo sapiens [sequence omitted]

SEQ ID NO: 910419 - protein, 356 aa, Homo sapiens [sequence omitted]

SEQ ID NO: 910420 - protein, 432 aa, Homo sapiens; identical to SEQ ID NO: 910417

SEQ ID NO: 910421 - protein, 432 aa, Homo sapiens; identical to SEQ ID NO: 910417

SEQ ID NO: 910422 - protein, 432 aa, Homo sapiens; identical to SEQ ID NO: 910417

SEQ ID NO: 910423 - protein, 415 aa, Homo sapiens
LNALYFLILPGAAKNIWEDYHECVIMSDTGLESCKQPFTTIPSKIVTNGFSHHPPARILSISLILTKSPRFTICIEQLSILSHELVFFPTCPVLALTPTGKYKAVELKAVYFQVLAEKIDVLLQQIEELGSEGKVEEAQGMMKLVEQLKEERELLRSTTSTIESFAAQEKQMEVCEVCGAFLIVGDAQSRVDDHLMGKQHMGYAKIKATVEELKEKLRKRTEEPDRDERLKKEKQEREEREKEREREREERERKRRREEEEREKERARDRERRKRSRSRSRHSSRTSDRRCSRSRDHKRSRSRERRRSRSRDRRRSRSHDRSERKHRSRSRDRRRSKSRDRKSYKHRSKSRDREQDRKSKEKEKRGSDDKKSSVKSGSREKQSEDTNTESKESDTKNEVNGTSEDIKSEGDTQSN

SEQ ID NO: 910424 - protein, 432 aa, Homo sapiens; identical to SEQ ID NO: 910417

SEQ ID NO: 910425 - protein, 432 aa, Homo sapiens; identical to SEQ ID NO: 910417

SEQ ID NO: 910426 - protein, 185 aa, Homo sapiens
MNERQEREEREKEREREREERERKRRREEEEREKERARDRERRKRSRSRSRHSSRTSDRRCSRSRDHKRSRSRERRRSRSRDRRRSRSHDRSERKHRSRSRDRRRSKSRDRKSYKHRSKSRDREQDRKSKEKEKRGSDDKKSSVKSGSREKQSEDTNTESKESDTKNEVNGTSEDIKSEGDTQSN

SEQ ID NO: 910427 - protein, 159 aa, Homo sapiens
MVGGGLYTCPELVGRGPILDRSRSRHSSRTSDRRCSRSRDHKRSRSRERRRSRSRDRRRSRSHDRSERKHRSRSRDRRRSKSRDRKSYKHRSKSRDREQDRKSKEKEKRGSDDKKSSVKSGSREKQSEDTNTESKESDTKNEVNGTSEDIKSEGDTQSN

SEQ ID NO: 910428 - protein, 432 aa, Homo sapiens; identical to SEQ ID NO: 910417

SEQ ID NO: 910429 - protein, 93 aa, Homo sapiens
CSLLLLVDSEVSPTRDTFGHEVEKEGGAEVEIDEEAEAMIDQKENTDLEVGIEEDQKAGIESHISTGAKVGTENKIENPRRKKRGDLMIKKVV

SEQ ID NO: 910430 - protein, 432 aa, Homo sapiens; identical to SEQ ID NO: 910417

SEQ ID NO: 910431 - protein, 346 aa, Homo sapiens
MISAAQLLDELMGRDRNLAPDEKRSNVRWDHESVCKYYLCGFCPAELFTNTRSDLGPCEKIHDENLRKQYEKSSRFMKVGYERDFLRYLQSLLAEVERRIRRGHARLALSQNQQSSGAAGPTGKNEEKIQVLTDKIDVLLQQIEELGSEGKVEEAQGMMKLVEQLKEERELLRSTTSTIESFAAQEKQMEVCEVCGAFLIVGDAQSRVDDHLMGKQHMGYAKIKATVEELKEKLRKRTEEPDRDERLKKEKQEREEREKEREREREERERKRRREEEEREKERARDRERRKRSRSRSRHSSRTSDRRCSRSRDHKRSRSRERRRSRERKRRREEEEREKERARDKK

SEQ ID NO: 910432 - protein, 487 aa, Homo sapiens
MISAAQLLDELMGRDRNLAPDEKRSNVRWDHESVCKYYLCGFCPAELFTNTRSDLGPCEKIHDENLRKQYEKSSRFMKVGYERDFLRYLQSLLAEVERRIRRGHARLALSQNQQSSGAAGPTGKNEEKIQVLTDKIDVLLQQIEELGSEGKVEEAQGMMKLVEQLKEERELLRSTTSTIESFAAQEKQMEVCEVCGAFLIVGDAQSRVDDHLMGKQHMGYAKIKATVEELKEKLRKRTEEPDRDERLKKEKQEREEREKEREREREERERKRRREEEEREKERARDRERRKRSRSRSRHSSRTSDRRCSRSRDHKRSRSRERRRSRSRDRRRSRSHDRSERKHRSRSRDRRRSKSRDRKSYKHRSKSRDREQDRKSKEKEKRGSDDKKSSVKSGSREKQSEDTNTESKESDTKNEVNGTSEDIKSQRKYAQMKMELSRVRRHTKASSEGKDSVVLQNILRYIVLSQLFCSRLVPPLVCLFGNYRPHL

SEQ ID NO: 910433 - protein, 401 aa, Homo sapiens
MISAAQLLDELMGRDRNLAPDEKRSNVRWDHESVCKYYLCGFCPAELFTNTRSDLGPCEKIHDENLRKQYEKSSRFMKVGYERDFLRYLQSLLAEVERRIRRGHARLALSQNQQSSGAAGPTGKNEEKIQVLTDKIDVLLQQIEELGSEGKVEEAQGMMKLVEQLKEERELLRSTTSTIESFAAQEKQMEVCEVCGAFLIVGDAQSRVDDHLMGKQHMGYAKIKATVEELKEKLRKRTEEPDRDERLKKEKQEREEREKEREREREERERKRRREEEEREKERARDRERRKRSRSRSRHSSRTSDRRCSRSRDHKRSRSRERRRSRSRDRRRSRSHDRSERKHRSRSRDRRRSKSRDRKSYKHRSKSRDREQDRKSKEKAEDKIIGLTTSPLRDNKTTLPH

SEQ ID NO: 910434 - protein, 432 aa, Homo sapiens; identical to SEQ ID NO: 910417

SEQ ID NO: 910435 - protein, 432 aa, Homo sapiens; identical to SEQ ID NO: 910417

SEQ ID NO: 910436 - protein, 432 aa, Homo sapiens; identical to SEQ ID NO: 910417

SEQ ID NO: 910437 - protein, 381 aa, Homo sapiens
MISAAQLLDELMGRDRNLAPDEKRSNVRWDHESVCKYYLCGFCPAELFTNTRSDLGPCEKIHDENLRKQYEKSSRFMKVGYERDFLRYLQSLLAEVERRIRRGHARLALSQNQQSSGAAGPTGKNEEKIQVLTDKIDVLLQQIEELGSEGKVEEAQGMMKLVEQLKEERELLRSTTSTIESFAAQEKQMEVCEVCGAFLIVGDAQSRVDDHLMGKQHMGYAKIKATVEELKEKLRKRTEEPDRDERLKKEKQEREEREKEREREREERERKRRREEEEREKERARDRERRKRSRSRSRHSSRTSDRRCSRSRDHKRSRSRERRRSRSRDRRRSRSHDRSERKHRSRSRDRRRSKSRDRKSYKHRSKSRDREQDRKSKEKAA

SEQ ID NO: 910438 - protein, 432 aa, Homo sapiens; identical to SEQ ID NO: 910417

SEQ ID NO: 910439 - protein, 432 aa, Homo sapiens; identical to SEQ ID NO: 910417

SEQ ID NO: 910440 - protein, 432 aa, Homo sapiens; identical to SEQ ID NO: 910417

SEQ ID NO: 910441 - protein, 432 aa, Homo sapiens; identical to SEQ ID NO: 910417

SEQ ID NO: 910442 - protein, 141 aa, Homo sapiens
CSLLLLVDSEVSPTRDTFGHEVEKEGGAEVEIDEEAEAMIDQKENTDLEVGIEEDQKAGIESHISTGAKVGTENKIENPRRKQTQNKEGTLTDYPQTRTCELSWYVDEQRYDVTRPANHLNFDTDTRDYLHDTDWSIGDPG

SEQ ID NO: 910443 - protein, 557 aa, Homo sapiens
AALGAGSRRAARSAEPELDAAAATATCAAVIKMSWHPQYRSSKFRHVFGKPASKENCYDSVPITRSVHDNHFCAVNPHFIAVVTECAGGGAFLVIPLHQTGKLDPHYPKVCGHRGNVLDVKWNPFDDFEIASCSEDATIKIWSIPKQLLTRNLTAYRKELVGHARRVGLVEWHPTAANILFSAGYDYKVMIWNLDTKESVITSPMSTISCHQDVILSMSFNTNGSLLATTCKDRKIRVIDPRAGTVLQEASYKGHRASKVLFLGNLKKLMSTGTSRWNNRQVALWDQDNLSVPLMEEDLDGSSGVLFPFYDADTSMLYVVGKGDGNIRYYEVSADKPHLSYLTEYRSYNPQKGIGVMPKRGLDVSSCEIFRFYKLITTKSLIEPISMIVPRRSESYQEDIYPPTAGAQPSLTAQEWLSGMNRDPILVSLRPGSELLRPHPLPAERPIFNSMAPASPRLLNQTEKLAAEDGWRSSSLLEEKMPRWAAEHRLEEKKTWLTNGFDVFECPPPKTENELLQMFYRQQEEIRRLRELLTQREVQAKQLELEIKNLRMGSEQL

SEQ ID NO: 910444 - protein, 557 aa, Homo sapiens; identical to SEQ ID NO: 910443

SEQ ID NO: 910445 - protein, 501 aa, Homo sapiens
AALGAGSRRAARSAEPELDAAAATATCAAVIKMSWHPQYRSSKFRHVFGKPASKENCYDSVPITRSVHDNHFCAVNPHFIAVVTECAGGGAFLVIPLHQTGKLDPHYPKVCGHRGNVLDVKWNPFDDFEIASCSEDATIKIWSIPKQLLTRNLTAYRKELVGHARRVGLVEWHPTAANILFSAGYDYKVMIWNLDTKESVITSPMSTISCHQDVILSMSFNTNGSLLATTCKDRKIRVIDPRAGTVLQEASYKGHRASKVLFLGNLKKLMSTGTSRWNNRQVALWDQDNLSVPLMEEDLDGSSGVLFPFYDADTSMLYVVGKGDGNIRYYEVSADKPHLSYLTEYRSYNPQKGIGVMPKRGLDVSSCEIFRFYKLITTKSLIEPISMIVPRRSESYQEDIYPPTAGAQPSLTAQEWLSGMNRDPILVSLRPGSELLRPHPLPAERPIFNSMAPASPRLLNQTEKLAAEDGWRSSSLLEEKMPSCCRCSTGNRRRSEGSGSC

SEQ ID NO: 910446 - protein, 525 aa, Homo sapiens
MSWHPQYRSSKFRHVFGKPASKENCYDSVPITRSVHDNHFCAVNPHFIAVVTECAGGGAFLVIPLHQTGKLDPHYPKVCGHRGNVLDVKWNPFDDFEIASCSEDATIKIWSIPKQLLTRNLTAYRKELVGHARRVGLVEWHPTAANILFSAGYDYKVMIWNLDTKESVITSPMSTISCHQDVILSMSFNTNGSLLATTCKDRKIRVIDPRAGTVLQEASYKGHRASKVLFLGNLKKLMSTGTSRWNNRQVALWDQDNLSVPLMEEDLDGSSGVLFPFYDADTSMLYVVGKGDGNIRYYEVSADKPHLSYLTEYRSYNPQKGIGVMPKRGLDVSSCEIFRFYKLITTKSLIEPISMIVPRRSESYQEDIYPPTAGAQPSLTAQEWLSGMNRDPILVSLRPGSELLRPHPLPAERPIFNSMAPASPRLLNQTEKLAAEDGWRSSSLLEEKMPRWAAEHRLEEKKTWLTNGFDVFECPPPKTENELLQMFYRQQEEIRRLRELLTQREVQAKQLELEIKNLRMGSEQL

SEQ ID NO: 910447 - protein, 557 aa, Homo sapiens; identical to SEQ ID NO: 910443

SEQ ID NO: 910448 - protein, 153 aa, Homo sapiens
MSTTDEEDGRPSNPESSVEIDTIDIALRACQDITRLVRAAVCAVSLGKGTRTKSTDTHAVGVTPSRATRDVWMAPQEKRLSVERDGRSDWYFAHNAPRTEEHHVEMQFACPYVCKRVTGQEIRRLRELLTQREVQAKQLELEIKNLRMGSEQL

SEQ ID NO: 910449 - protein, 653 aa, Homo sapiens
LGFVSSAASERGCSSCVPTPGSAMAELCPLAEELSCSICLEPFKEPVTTPCGHNFCGSCLNETWAVQGSPYLCPQCRAVYQARPQLHKNTVLCNVVEQFLQADLAREPPADVWTPPARASAPSPNAQVACDHCLKEAAVKTCLVCMASFCQEHLQPHFDSPAFQDHPLQPPVRDLLRRKCSQHNRLREFFCPEHSECICHICLVEHKTCSPASLSQASADLEATLRHKLTVMYSQINGASRALDDVRNRQQDVRMTANRKVEQLQQEYTEMKALLDASETTSTRKIKEEEKRVNSKFDTIYQILLKKKSEIQTLKEEIEQSLTKRDEFEFLEKASKLRGISTKPVYIPEVELNHKLIKGIHQSTIDLKNELKQCIGRLQELTPSSGDPGEHDPASTHKSTRPVKKVSKEEKKSKKPPPVPALPSKLPTFGAPEQLVDLKQAGLEAAAKATSSHPNSTSLKAKVLETFLAKSRPELLEYYIKVILDYNTAHNKVALSECYTVASVAEMPQNYRPHPQRFTYCSQVLGLHCYKKGIHYWEVELQKNNFCGVGICYGSMNRQGPESRLGRNSASWCVEWFNTKISAWHNNVEKTLPSTKATRVGVLLNCDHGFVIFFAVADKVHLMYKFRVDFTEALYPAFWVFSAGATLSICSPK

SEQ ID NO: 910450 - protein, 653 aa, Homo sapiens; identical to SEQ ID NO: 910449

SEQ ID NO: 910451 - protein, 759 aa, Homo sapiens
LGFVSSAASERGCSSCVPTPGSAMAELCPLAEELSCSICLEPFKEPVTTPCGHNFCGSCLNETWAVQGSPYLCPQCRAVYQARPQLHKNTVLCNVVEQFLQADLAREPPADVWTPPARASAPSPNAQVACDHCLKEAAVKTCLVCMASFCQEHLQPHFDSPAFQDHPLQPPVRDLLRRKCSQHNRLREFFCPEHSECICHICLVEHKTCSPASLSQASADLEATLRHKLTVMYSQINGASRALDDVRNRQQDVRMTANRKVEQLQQEYTEMKALLDASETTSTRKIKEEEKRVNSKFDTIYQILLKKKSEIQTLKEEIEQSLTKRDEFEFLEKASKLRGISTKPVYIPEVELNHKLIKGIHQSTIDLKNELKQCIGRLQELTPSSGDPGEHDPASTHKSTRPVKKVSKEEKKSKKPRKLCISATVRFLRLPEHRTNAGSESRPLSSGFCDGFYMIPFCNGSRPEAGGETSISEMNKVTLALSVFPCVVLLFRRVFVEVALNQCEGSRGHPVALYHISLSLPPAPVPALPSKLPTFGAPEQLVDLKQAGLEAAAKATSSHPNSTSLKAKVLETFLAKSRPELLEYYIKVILDYNTAHNKVALSECYTVASVAEMPQNYRPHPQRFTYCSQVLGLHCYKKGIHYWEVELQKNNFCGVGICYGSMNRQGPESRLGRNSASWCVEWFNTKISAWHNNVEKTLPSTKATRVGVLLNCDHGFVIFFAVADKVHLMYKFRVDFTEALYPAFWVFSAGATLSICSPK

SEQ ID NO: 910452 - protein, 422 aa, Homo sapiens
MYSQINGASRALDDVRNRQQDVRMTANRKVEQLQQEYTEMKALLDASETTSTRKIKEEEKRVNSKFDTIYQILLKKKSEIQTLKEEIEQSLTKRDEFEFLEKASKLRGISTKPVYIPEVELNHKLIKGIHQSTIDLKNELKQCIGRLQELTPSSGDPGEHDPASTHKSTRPVKKVSKEEKKSKKPPPVPALPSKLPTFGAPEQLVDLKQAGLEAAAKATSSHPNSTSLKAKVLETFLAKSRPELLEYYIKVILDYNTAHNKVALSECYTVASVAEMPQNYRPHPQRFTYCSQVLGLHCYKKGIHYWEVELQKNNFCGVGICYGSMNRQGPESRLGRNSASWCVEWFNTKISAWHNNVEKTLPSTKATRVGVLLNCDHGFVIFFAVADKVHLMYKFRVDFTEALYPAFWVFSAGATLSICSPK

SEQ ID NO: 910453 - protein, 479 aa, Homo sapiens
LGFVSSAASERGCSSCVPTPGSAMAELCPLAEELSCSICLEPFKEPVTTPCGHNFCGSCLNETWAVQGSPYLCPQCRAVYQARPQLHKNTVLCNVVEQFLQADLAREPPADVWTPPARASAPSPNAQVACDHCLKEAAVKTCLVCMASFCQEHLQPHFDSPAFQDHPLQPPVRDLLRRKCSQHNRLREFFCPEHSECICHICLVEHKTCSPASLSQASADLEATLRHKLTVMYSQINGASRALDDVRNRQQDVRMTANRKVEQLQQEYTEMKALLDASETTSTRKIKEEEKRVNSKFDTIYQILLKKKSEIQTLKEEIEQSLTKRDEFEFLEKASKLRGISTKPVYIPEVELNHKLIKGIHQSTIDLKNELKQCIGRLQELTPSSGDPGEHDPASTHKSTRPVKKVSKEEKKSKKPPPVPALPSKLPTFGAPEQLVDLKQAGLEAAAKATSSHPNSTSLKAKVLETFLAKSRPELLECE

SEQ ID NO: 910454 - protein, 479 aa, Homo sapiens; identical to SEQ ID NO: 910453

SEQ ID NO: 910455 - protein, 409 aa, Homo sapiens
LGFVSSAASERGCSSCVPTPGSAMAELCPLAEELSCSICLEPFKEPVTTPCGHNFCGSCLNETWAVQGSPYLCPQCRAVYQARPQLHKNTVLCNVVEQFLQADLAREPPADVWTPPARASAPSPNAQVACDHCLKEAAVKTCLVCMASFCQEHLQPHFDSPAFQDHPLQPPVRDLLRRKCSQHNRLREFFCPEHSECICHICLVEHKTCSPASLSQASADLEATLRHKLTVMYSQINGASRALDDVRNRQQDVRMTANRKVEQLQQEYTEMKALLDASETTSTRKIKEEEKRVNSKFDTIYQILLKKKSEIQTLKEEIEQSLTKRDEFEFLEKASKLRGISTKPVYIPEVELNHKLIKGIHQSTIDLKNELKQCIGRLQELTPSSGDPGEHDPASTHKSTRPVKKVSSK

SEQ ID NO: 910456 - protein, 93 aa, Homo sapiens
MGKELWGVHSEFVLQITLCFLSQLQPKPPAHIRTQHLSRPRCWRPSWPSPDLSSWSVSSFGAGARFHWFCLSCAALCSSLWGQLAGYISHSPS

SEQ ID NO: 910457 - protein, 653 aa, Homo sapiens; identical to SEQ ID NO: 910449

SEQ ID NO: 910458 - protein, 422 aa, Homo sapiens; identical to SEQ ID NO: 910452

SEQ ID NO: 910459 - protein, 147 aa, Homo sapiens [sequence omitted]

SEQ ID NO: 910460 - protein, 438 aa, Homo sapiens
LGFVSSAASERGCSSCVPTPGSAMAELCPLAEELSCSICLEPFKEPVTTPCGHNFCGSCLNETWAVQGSPYLCPQCRAVYQARPQLHKNTVLCNVVEQFLQADLAREPPADVWTPPARASAPSPNAQVACDHCLKEAAVKTCLVCMASFCQEHLQPHFDSPAFQDHPLQPPVRDLLRRKCSQHNRLREFFCPEHSECICHICLVEHKTCSPASLSQASADLEATLRHKLTVMYSQINGASRALDDVRNRQQDVRMTANRKVEQLQQEYTEMKALLDASETTSTRKIKEEEKRVNSKFDTIYQILLKKKSEIQTLKEEIEQSLTKRDEFEFLEKASKLRGISTKPVYIPEVELNHKLIKGIHQSTIDLKNELKQCIGRLQELTPSSGDPGEHDPASTHKSTRPVKKVSKEEKKSKKPRKLCISATVRFLRLPEHRTKCW

SEQ ID NO: 910461 - protein, 137 aa, Homo sapiens
MLSSDVSWWLWLQLGEETESDLQNKLRVDTPKLLAHDNLPSKPACFKSTNSSWPSPDLSSWSVSSFGAGARFHWFCLSCAALCSSLWGQLAGYISHSPSLVLYFVAPLFSPSHQCLSLLFLTSSDFTIGPLTLPLAV

SEQ ID NO: 910462 - protein, 112 aa, Homo sapiens
MCFNCPVFGFYLLIAPFVPGAAFKDVGPCDQVIKLSEVRSWPGDVSVPVLSSPRKSCFGIVVYLDSYKEQGSNLGKLSEAYKNLKGFGGGTVTKGCLYVFGHKAHRCMFCKD

SEQ ID NO: 910463 - protein, 314 aa, Homo sapiens
MAPPQVLAFGLLLAAATATFAAAQEECVCENYKLAVNCFVNNNRQCQCTSVGAQNTVICSKLAAKCLVMKAEMNGSKLGRRAKPEGALQNNDGLYDPDCDESGLFKAKQCNGTSTCWCVNTAGVRRTDKDTEITCSERVRTYWIIIELKHKAREKPYDSKSLRTALQKEITTRYQLDPKFITSILYENNVITIDLVQNSSQKTQNDVDIADVAYYFEKDVKGESLFHSKKMDLTVNGEQLDLDPGQTLIYYVDEKAPEFSMQGLKAGVIAVIVVVVIAVVAGIVVLVISRKKRMAKYEKAEIKEMGEMHRELNA

SEQ ID NO: 910464 - protein, 390 aa, Homo sapiens
MAPPQVLAFGLLLAAATATFAAAQEGEARIGAKLWSWAGLGGNGPRPSAPETGIIGRGPRGRAFQRGDRTVRPCSGSGPPRGRKRRGPSRGAASLRSFARLECVCENYKLAVNCFVNNNRQCQCTSVGAQNTVICSKLAAKCLVMKAEMNGSKLGRRAKPEGALQNNDGLYDPDCDESGLFKAKQCNGTSTCWCVNTAGVRRTDKDTEITCSERVRTYWIIIELKHKAREKPYDSKSLRTALQKEITTRYQLDPKFITSILYENNVITIDLVQNSSQKTQNDVDIADVAYYFEKDVKGESLFHSKKMDLTVNGEQLDLDPGQTLIYYVDEKAPEFSMQGLKAGVIAVIVVVVIAVVAGIVVLVISRKKRMAKYEKAEIKEMGEMHRELNA

SEQ ID NO: 910465 - protein, 411 aa, Homo sapiens
QRARAVESSPGVRMPRLPGSSTFLYPVPAPFPPGPILQGFRAALLRLKGSLSTESSNLLGGHQRSLTPPWRRSTWGGAERGARAHTCGEGRAPTAAPGLGEGSLLISPNSRAVTHQRAPAARECVCENYKLAVNCFVNNNRQCQCTSVGAQNTVICSKLAAKCLVMKAEMNGSKLGRRAKPEGALQNNDGLYDPDCDESGLFKAKQCNGTSTCWCVNTAGVRRTDKDTEITCSERVRTYWIIIELKHKAREKPYDSKSLRTALQKEITTRYQLDPKFITSILYENNVITIDLVQNSSQKTQNDVDIADVAYYFEKDVKGESLFHSKKMDLTVNGEQLDLDPGQTLIYYVDEKAPEFSMQGLKAGVIAVIVVVVIAVVAGIVVLVISRKKRMAKYEKAEIKEMGEMHRELNA

SEQ ID NO: 910466 - protein, 185 aa, Homo sapiens
ICEFRILECSETYWIIIELKHKAREKPYDSKSLRTALQKEITTRYQLDPKFITSILYENNVITIDLVQNSSQKTQNDVDIADVAYYFEKDVKGESLFHSKKMDLTVNGEQLDLDPGQTLIYYVDEKAPEFSMQGLKAGVIAVIVVVVIAVVAGIVVLVISRKKRMAKYEKAEIKEMGEMHRELNA

SEQ ID NO: 910467 - protein, 128 aa, Homo sapiens
RVVLRLLIKAQIRLRDAENDVDIADVAYYFEKDVKGESLFHSKKMDLTVNGEQLDLDPGQTLIYYVDEKAPEFSMQGLKAGVIAVIVVVVIAVVAGIVVLVISRKKRMAKYEKAEIKEMGEMHRELNA

SEQ ID NO: 910468 - protein, 314 aa, Homo sapiens; identical to SEQ ID NO: 910463

SEQ ID NO: 910469 - protein, 314 aa, Homo sapiens; identical to SEQ ID NO: 910463

SEQ ID NO: 910470 - protein, 314 aa, Homo sapiens; identical to SEQ ID NO: 910463

SEQ ID NO: 910471 - protein, 225 aa, Homo sapiens
MAPPQVLAFGLLLAAATATFAAAQEECVCENYKLAVNCFVNNNRQCQCTSVGAQNTVICSKLAAKCLVMKAEMNGSKLGRRAKPEGALQNNDGLYDPDCDESGLFKAKQCNGTSTCWCVNTAGVRRTDKDTEITCSERVRTYWIIIELKHKAREKPYDSKSLRTALQKEITTRYQLDPKFITSILYENNVITIDLVQNSSQKTQNDVDIADVAYYFEKDNWSCCN

SEQ ID NO: 910472 - protein, 225 aa, Homo sapiens
MAPPQVLAFGLLLAAATATFAAAQEECVCENYKLAVNCFVNNNRQCQCTSVGAQNTVICSKLAAKCLVMKAEMNGSKLGRRAKPEGALQNNDGLYDPDCDESGLFKAKQCNGTSTCWCVNTAGVRRTDKDTEITCSERVRTYWIIIELKHKAREKPYDSKSLRTALQLETRMSTTSQLEEAEHKVQSLQTALEKNSPEFFDLKTKYDEETTAKADEIEMIMTDLD

SEQ ID NO: 910473 - protein, 314 aa, Homo sapiens; identical to SEQ ID NO: 910463

SEQ ID NO: 910474 - protein, 314 aa, Homo sapiens; identical to SEQ ID NO: 910463

SEQ ID NO: 910475 - protein, 272 aa, Homo sapiens
NRARYRISELCQNTVIWSKLAAKCLVMKAEMNGSKLGRRAKPEGALQNNDGLYDPDCDESGLFKAKQCNGTSTCWCVNTAGVRRTDKDTEITCSERVRTYWIIIELKHKAREKPYDSKSLRTALQKEITTRYQLDPKFITSILYENNVITIDLVQNSSQKTQNDVDIADVAYYFEKDVKGESLFHSKKMDLTVNGEQLDLDPGQTLIYYVDEKAPEFSMQGLKAGVIAVIVVVVIAVVAGIVVLVISRKKRMAKYEKAEIKEMGEMHRELNA

SEQ ID NO: 910476 - protein, 314 aa, Homo sapiens; identical to SEQ ID NO: 910463

SEQ ID NO: 910477 - protein, 144 aa, Homo sapiens
RSHAMSQHAPACAGFFMYSSFWFSPQLAWGPGSSPPRLLAAVAYYFEKDVKGESLFHSKKMDLTVNGEQLDLDPGQTLIYYVDEKAPEFSMQGLKAGVIAVIVVVVIAVVAGIVVLVISRKKRMAKYEKAEIKEMGEMHRELNA

SEQ ID NO: 910478 - protein, 297 aa, Homo sapiens
MAPPQVLAFGLLLAAATATFAAAQEECVCENYKLAVNCFVNNNRQCQCTSVGAQNTVICSKLAAKCLVMKAEMNGSKLGRRAKPEGALQNNDGLYDPDCDESGLFKAKQCNGTSTCWCVNTAGVRRTDKDTEITCSERVRTYWIIIELKHKAREKPYDSKSLRTALQKEITTRYQLDPKFITSILYENNVITIDLVQNSSQKTQNDVDIADVAYYFEKDVKGESLFHSKKMDLTVNGEQLDLDPGQTRHRLKKEEAQIVLKKLGTEDENGNWSSPEAALSAQVKDTEGETVMLTHRP

SEQ ID NO: 910479 - protein, 249 aa, Homo sapiens
MAPPQVLAFGLLLAAATATFAAAQEECVCENYKLAVNCFVNNNRQCQCTSVGAQNTVICSKLAAKCLVMKAEMNGSKLGRRAKPEGALQNNDGLYDPDCDESGLFKAKQCNGTSTCWCVNTAGVRRTDKDTEITCSERVRTYWIIIELKHKAREKPYDSKSLRTALQKEITTRYQLDPKFITSILYENNVITIDLVQNSSQKTQNDVDIADVAYYFEKDITKTSVQMHPSCLSNDIAPDRNSRVHTRSP

SEQ ID NO: 910480 - protein, 141 aa, Homo sapiens
MAPPQVLAFGLLLAAATATFAAAQEECVCENYKLAVNCFVNNNRQCQCTSVGAQNTVICSKLAAKCLVMKAEMNGSKLGRRAKPEGALQNNDGLYDPDCDESGLFKAKQCNGTSTCWCVNTAGVRRTDKDTLHPEDTLHPE

SEQ ID NO: 910481 - protein, 379 aa, Homo sapiens
LMLPATVLLYRKLGIILMMVKCVSCGFASFFFQSLCCFFGPEKNCGQILWPCAHLPWDAGTGDPGGEKAGRPRPGSVGGMPGSCSEQYELQPLARRRSPSFDTSTATSKLSHRPSALSEDLQLHDGPCCSRPPPAPASPRELLLDHQAVFSQCPALQTSSPYKQAGPSPKTRARQDSQGEEAEPLPASPEAPAHSPKAKAADPPDGFCSSASTLEGLSVSDETCLSTSEPSARVPDSVGVSPDDLDDTGQPVLERGQLNGKRDTLWLALRETVYDPSLPASHHSSLSWKGRGGPGDGSPVVLPNASQTCQMFGCAGPALTHQAIAAEGDPGRLDRARNPVMDDKARAAIGWSPKVFLQIHRERSHPPAVDVKPCQMSQP

SEQ ID NO: 910482 - protein, 202 aa, Homo sapiens
EARGPPGSGAVEAFGGERVSSTMSGLSGPPARRGPFPLALLLLFLLGPRLVLAISFHLPINSRKCLREEIHKDLLVTGAYEISDQSGGAGGLRSHLKITDSAGHILYSKEDATKGKFAFTTEDYDMFEVCFESKGTGRIPDQLVILDMKHGVEAKNYEEIAKVEKLKPLEVELRRLEDLSESIVNDFAYMKKREEEMRDTNE

SEQ ID NO: 910483 - protein, 241 aa, Homo sapiens
EARGPPGSGAVEAFGGERVSSTMSGLSGPPARRGPFPLALLLLFLLGPRLVLAISFHLPINSRKCLREEIHKDLLVTGAYEISDQSGGAGGLRSHLKITDSAGHILYSKEDATKGKFAFTTEDYDMFEVCFESKGTGRIPDQLVILDMKHGVEAKNYEEIAKVEKLKPLEVELRRLEDLSESIVNDFAYMKKREEEMRDTNESTNTRVLYFSIFSMFCLIGLATWQVFYLRRFFKAKKLIE

SEQ ID NO: 910484 - protein, 241 aa, Homo sapiens; identical to SEQ ID NO: 910483

SEQ ID NO: 910485 - protein, 241 aa, Homo sapiens; identical to SEQ ID NO: 910483

SEQ ID NO: 910486 - protein, 154 aa, Homo sapiens
MFFWWEKNFIITDSAGHILYSKEDATKGKFAFTTEDYDMFEVCFESKGTGRIPDQLVILDMKHGVEAKNYEEIAKVEKLKPLEVELRRLEDLSESIVNDFAYMKKREEEMRDTNESTNTRVLYFSIFSMFCLIGLATWQVFYLRRFFKAKKLIE

SEQ ID NO: 910487 - protein, 241 aa, Homo sapiens; identical to SEQ ID NO: 910483

SEQ ID NO: 910488 - protein, 134 aa, Homo sapiens
PLPPPLLLSSSPTLPLGTRLCVNSAEEGTGRIPDQLVILDMKHGVEAKNYEEIAKVEKLKPLEVELRRLEDLSESIVNDFAYMKKREEEMRDTNESTNTRVLYFSIFSMFCLIGLATWQVFYLRRFFKAKKLIE

SEQ ID NO: 910489 - protein, 116 aa, Homo sapiens
SPTSLGALAACAATSRCGIGRRGAGREDGRLRRGEARVRGSRAGGGLGVVLASRERKGRAVEPAPSPRWLPVAGRGGSPTPGNPKKGCEALADVVTPELGRLSTSYTSFGLRYIEP

SEQ ID NO: 910490 - protein, 241 aa, Homo sapiens; identical to SEQ ID NO: 910483

SEQ ID NO: 910491 - protein, 241 aa, Homo sapiens; identical to SEQ ID NO: 910483

SEQ ID NO: 910492 - protein, 241 aa, Homo sapiens; identical to SEQ ID NO: 910483

SEQ ID NO: 910493 - protein, 241 aa, Homo sapiens; identical to SEQ ID NO: 910483

SEQ ID NO: 910494 - protein, 222 aa, Homo sapiens
EARGPPGSGAVEAFGGERVSSTMSGLSGPPARRGPFPLALLLLFLLGPRLVLAISFHLPINSRKCLREEIHKDLLVTGAYEISDQSGGAGGLRSHLKITDSAGHILYSKEDATKGKFAFTTEDYDMFEVCFESKGTGRIPDQLVILDMKHGVEAKNYEELSESIVNDFAYMKKREEEMRDTNESTNTRVLYFSIFSMFCLIGLATWQVFYLRRFFKAKKLIE

SEQ ID NO: 910495 - protein, 120 aa, Homo sapiens
QGEELWLFPSIEEGTGRIPDQLVILDMKHGVEAKNYEEIAKVEKLKPLEVELRRLEDLSESIVNDFAYMKKREEEMRDTNESTNTRVLYFSIFSMFCLIGLATWQVFYLRRFFKAKKLIE

SEQ ID NO: 910496 - protein, 219 aa, Homo sapiens
SALLRVLYSRVFYLRVCSPRFLDGMAAGQRRSSLSRLGSQAEGLLISQTMGGQAETLLTSQTGWRPGRGCNLGSLGGQGRRLGGGCSEPRSRHCTPALAPIEHWVNETPSAIPAPREAEVVDHSRLGAGVEAKNYEEIAKVEKLKPLEVELRRLEDLSESIVNDFAYMKKREEEMRDTNESTNTRVLYFSIFSMFCLIGLATWQVFYLRRFFKAKKLIE

SEQ ID NO: 910497 - protein, 592 aa, Homo sapiens
PKSADVNPKYQCDLVSKNGNDVYRYPSPLHAVAVQSPMFLLCLTGNPLREEDRLGNHASDICGGSELDAVKTDSSLPSPSSLWSASHPSSSKKMDGYILSLVQKKTHPVRTNKPRTSVNADPTKGLLRNGSVCVRAPGGVSQGNSVNLKNSKQACLPSGGIPSLNNGTFSPPKQWSKESKAEQAESKRVPLPEGCPSGAASDLQSKHLPKTAKPASQEHVRCSAIGTGESPKESAQLSGASPKESPSRGPAPPQENKVVQPLKKMSQKNSLQGVPPATPPLLSTAFPVEERPALDFKSEGSSQSLEEAHLVKAQFIPGQQPSVRLHRGHRNMGVVKNSSLKHRGPALQGLENGLPTVREKTRAGSKKCRFPDDLDTNKKLKKASSKGRKSGGGPEAGVPGRPAGGGHRAGSRAHGHGREAVVAKPKHKRTDYRRWKSSAEISYEEALRRARRGRRENVGLYPAPVPLPYASPYAYVASDSEYSAECESLFHSTVVDTSEDEQSNYTTNCFGDSESSVSEGEFVGESTTTSDSEESGGLIWSQFVQTLPIQTVTAPDLHNHPAKTFVKIKASHNLKKKILRFRSGSLKLMTTV

SEQ ID NO: 910498 - protein, 592 aa, Homo sapiens; identical to SEQ ID NO: 910497

SEQ ID NO: 910499 - protein, 1195 aa, Homo sapiens
MGEEGPPSLEYIQAKDLFPPKELVKEEENLQVPFTVLQGEGVEFLGRAADALIAISNYRLHIKFKDSVINVPLRMIDSVESRDMFQLHISCKDSKVVRCHFSTFKQCQEWLSRLSRATARPAKPEDLFAFAYHAWCLGLTEEDQHTHLCQPGEHIRCRQEAELARMGFDLQNVWRVSHINSNYKLCPSYPQKLLVPVWITDKELENVASFRSWKRIPVVVYRHLRNGAAIARCSQPEISWWGWRNADDEYLVTSIAKACALDPGTRATGGSLSTGNNDTSEACDADFDSSLTACSGVESTAAPQKLLILDARSYTAAVANRAKGGGCECEEYYPNCEVVFMGMANIHAIRNSFQYLRAVCSQMPDPSNWLSALESTKWLQHLSVMLKAAVLVANTVDREGRPVLVHCSDGWDRTPQIVALAKILLDPYYRTLEGFQVLVESDWLDFGHKFGDRCGHQENVEDQNEQCPVFLQWLDSVHQLLKQFPCLFEFNEAFLVKLVQHTYSCLYGTFLANNPCEREKRNIYKRTCSVWALLRAGNKNFHNFLYTPSSDMVLHPVCHVRALHLWTAVYLPASSPCTLGEENMDLYLSPVAQSQEFSGRSLDRLPKTRSMDDLLSACDTSSPLTRTSSDPNLNNHCQEVRVGLEPWHSNPEGSETSFVDSGVGGPQQTVGEVGLPPPLPSSQKDYLSNKPFKSHKSCSPSYKLLNTAVPREMKSNTSDPEIKVLEETKGPAPDPSAQDELGRTLDGIGEPPEHCPETEAVSALSKVISNKCDGVCNFPESSQNSPTGTPQQAQPDSMLGVPSKCVLDHSLSTVCNPPSAACQTPLDPSTDFLNQDPSGSVASISHQEQLSSVPDLTHGEEDIGKRGNNRNGQLLENPRFGKMPLELVRKPISQSQISEFSFLGSNWDSFQGMVTSFPSGEATPRRLLSYGCCSKRPNSKQMRATGPCFGGQWAQREGVKSPVCSSHSNGHCTGPGGKNQMWLSSHPKQVSSTKPVPLNCPSPVPPLYLDDDGLPFPTDVIQHRLRQIEAGYKQEVEQLRRQVRELQMRLDIRHCCAPPAEPPMDYEDDFTCLKESDGSDTEDFGSDHSEDCLSEASWEPVDKKETEVTRWVPDHMASHCYNCDCEFWLAKRRHHCRNCGNVFCAGCCHLKLPIPDQQLYDPVLVCNSCYEHIQVSRARELMSQQLKKPIATASS

SEQ ID NO: 910500 - protein, 1030 aa, Homo sapiens [sequence omitted]

SEQ ID NO: 910501 - protein, 1195 aa, Homo sapiens; identical to SEQ ID NO: 910499

SEQ ID NO: 910502 - protein, 855 aa, Homo sapiens
MGMANIHAIRNSFQYLRAVCSQMPDPSNWLSALESTKWLQHLSVMLKAAVLVANTVDREGRPVLVHCSDGWDRTPQIVALAKILLDPYYRTLEGFQVLVESDWLDFGHKFGDRCGHQENVEDQNEQCPVFLQWLDSVHQLLKQFPCLFEFNEAFLVKLVQHTYSCLYGTFLANNPCEREKRNIYKRTCSVWALLRAGNKNFHNFLYTPSSDMVLHPVCHVRALHLWTAVYLPASSPCTLGEENMDLYLSPVAQSQEFSGRSLDRLPKTRSMDDLLSACDTSSPLTRTSSDPNLNNHCQEVRVGLEPWHSNPEGSETSFVDSGVGGPQQTVGEVGLPPPLPSSQKDYLSNKPFKSHKSCSPSYKLLNTAVPREMKSNTSDPEIKVLEETKGPAPDPSAQDELGRTLDGIGEPPEHCPETEAVSALSKVISNKCDGVCNFPESSQNSPTGTPQQAQPDSMLGVPSKCVLDHSLSTVCNPPSAACQTPLDPSTDFLNQDPSGSVASISHQEQLSSVPDLTHGEEDIGKRGNNRNGQLLENPRFGKMPLELVRKPISQSQISEFSFLGSNWDSFQGMVTSFPSGEATPRRLLSYGCCSKRPNSKQMRATGPCFGGQWAQREGVKSPVCSSHSNGHCTGPGGKNQMWLSSHPKQVSSTKPVPLNCPSPVPPLYLDDDGLPFPTDVIQHRLRQIEAGYKQEVEQLRRQVRELQMRLDIRHCCAPPAEPPMDYEDDFTCLKESDGSDTEDFGSDHSEDCLSEASWEPVDKKETEVTRWVPDHMASHCYNCDCEFWLAKRRHHCRNCGNVFCAGCCHLKLPIPDQQLYDPVLVCNSCYEHIQVSRARELMSQQLKKPIATASS

SEQ ID NO: 910503 - protein, 732 aa, Homo sapiens
APCPQGGCVGGGLPLRSSGTGCWTGCTSQLSPERLYSYRQTLCTHRAGANNPCEREKRNIYKRTCSVWALLRAGNKNFHNFLYTPSSDMVLHPVCHVRALHLWTAVYLPASSPCTLGEENMDLYLSPVAQSQEFSGRSLDRLPKTRSMDDLLSACDTSSPLTRTSSDPNLNNHCQEVRVGLEPWHSNPEGSETSFVDSGVGGPQQTVGEVGLPPPLPSSQKDYLSNKPFKSHKSCSPSYKLLNTAVPREMKSNTSDPEIKVLEETKGPAPDPSAQDELGRTLDGIGEPPEHCPETEAVSALSKVISNKCDGVCNFPESSQNSPTGTPQQAQPDSMLGVPSKCVLDHSLSTVCNPPSAACQTPLDPSTDFLNQDPSGSVASISHQEQLSSVPDLTHGEEDIGKRGNNRNGQLLENPRFGKMPLELVRKPISQSQISEFSFLGSNWDSFQGMVTSFPSGEATPRRLLSYGCCSKRPNSKQMRATGPCFGGQWAQREGVKSPVCSSHSNGHCTGPGGKNQMWLSSHPKQVSSTKPVPLNCPSPVPPLYLDDDGLPFPTDVIQHRLRQIEAGYKQEVEQLRRQVRELQMRLDIRHCCAPPAEPPMDYEDDFTCLKESDGSDTEDFGSDHSEDCLSEASWEPVDKKETEVTRWVPDHMASHCYNCDCEFWLAKRRHHCRNCGNVFCAGCCHLKLPIPDQQLYDPVLVCNSCYEHIQVSRARELMSQQLKKPIATASS

SEQ ID NO: 910504 - protein, 224 aa, Homo sapiens
MCIGAGWWYFSRGQASKQVSSTKPVPLNCPSPVPPLYLDDDGLPFPTDVIQHRLRQIEAGYKQEVEQLRRQVRELQMRLDIRHCCAPPAEPPMDYEDDFTCLKESDGSDTEDFGSDHSEDCLSEASWEPVDKKETEVTRWVPDHMASHCYNCDCEFWLAKRRHHCRNCGNVFCAGCCHLKLPIPDQQLYDPVLVCNSCYEHIQVSRARELMSQQLKKPIATASS

SEQ ID NO: 910505 - protein, 1195 aa, Homo sapiens; identical to SEQ ID NO: 910499

SEQ ID NO: 910506 - protein, 1195 aa, Homo sapiens; identical to SEQ ID NO: 910499

SEQ ID NO: 910507 - protein, 1195 aa, Homo sapiens
MGEEGPPSLEYIQAKDLFPPKELVKEEENLQVPFTVLQGEGVEFLGRAADALIAISNYRLHIKFKDSVINVPLRMIDSVESRDMFQLHISCKDSKVVRCHFSTFKQCQEWLSRLSRATARPAKPEDLFAFAYHAWCLGLTEEDQHTHLCQPGEHIRCRQEAELARMGFDLQNVWRVSHINSNYKLCPSYPQKLLVPVWITDKELENVASFRSWKRIPVVVYRHLRNGAAIARCSQPEISWWGWRNADDEYLVTSIAKACALDPGTRATGGSLSTGNNDTSEACDADFGKVWMMLTPQGAGPLLGFIGSQGVPSESLEKMTTHGVLGSLPCQKLWGMRGLQLHVLPSERECQRASKRLGGWLTQGLLPAVCLDSSLTACSGVESTAAPQKLLILDARSYTAAVANRAKGGGCECEEYYPNCEVVFMGMANIHAIRNSFQYLRAVCSQMPDPSNWLSALESTKWLQHLSVMLKAAVLVANTVDREGRPVLVHCSDGWDRTPQIVALAKILLDPYYRTLEGFQVLVESDWLDFGHKFGDRCGHQENVEDQNEQCPVFLQWLDSVHQLLKQFPCLFEFNEAFLVKLVQHTYSCLYGTFLANNPCEREKRNIYKRTCSVWALLRAGNKNFHNFLYTPSSDMVLHPVCHVRALHLWTAVYLPASSPCTLGEENMDLYLSPVAQSQEFSGRSLDRLPKTRSMDDLLSACDTSSPLTRTSSDPNLNNHCQEVRVGLEPWHSNPEGSETSFVDSGVGGPQQTVGEVGLPPPLPSSQKDYLSNKPFKSHKSCSPSYKLLNTAVPREMKSNTSDPEIKVLEETKGPAPDPSAQDELGRTLDGIGEPPEHCPETEAVSALSKVISNKCDGVCNFPESSQNSPTGTPQQAQPDSMLGVPSKCVLDHSLSTVCNPPSAACQTPLDPSTDFLNQDPSGSVASISHQEQLSSVPDLTHGEEDIGKRGNNRNGQLLENPRFGKMPLELVRKPISQSQISEFSFLGSNWDSFQGMVTSFPSGEATPRRLLSYGCCSKRPNSKQMRATGPCFGGQWAQREGVKSPVCSSHSNGHCTGPGGKNQMWLSSHPKQVSSTKPVPLNCPSPVPPLYLDDDGLPFPTDVIQHRLRQIEAGYKQEVEQLRRQVRELQMRLDIRHCCAPPAEPPMDYEDDFVSSHQLPYTHYLLCSSSLPSIQHLFVGYLLCATELGAWAIG

SEQ ID NO: 910508 - protein, 318 aa, Homo sapiens
MGEEGPPSLEYIQAKDLFPPKELVKEEENLQVPFTVLQGEGVEFLGRAADALIAISNYRLHIKFKDSVINVPLRMIDSVESRDMFQLHISCKDSKVVRCHFSTFKQCQEWLSRLSRATARPAKPEDLFAFAYHAWCLGLTEEDQHTHLCQPGEHIRCRQEAELARMGFDLQNVWRVSHINSNYKLCPSYPQKLLVPVWITDKELENVASFRSWKRIPVVVYRHLRNGAAIARCSQPEISWWGWRNADDEYLVTSIAKACALDPGTRATGGSLSTGNNDTSEACDADFGKVWMMLTPQGAGPLLGFIGSQGVPSESLGR

SEQ ID NO: 910509 - protein, 1272 aa, Homo sapiens
APLWRGGERRAGAARRPGHQRPSLLAAAAAPGEPRSRDAAGARGWRAAQRLRGHVRWPRPPATMSLTARVSCSMLSCFGEEGPPSLEYIQAKDLFPPKELVKEEENLQVPFTVLQGEGVEFLGRAADALIAISNYRLHIKFKDSVINVPLRMIDSVESRDMFQLHISCKDSKVVRCHFSTFKQCQEWLSRLSRATARPAKPEDLFAFAYHAWCLGLTEEDQHTHLCQPGEHIRCRQEAELARMGFDLQNVWRVSHINSNYKLCPSYPQKLLVPVWITDKELENVASFRSWKRIPVVVYRHLRNGAAIARCSQPEISWWGWRNADDEYLVTSIAKACALDPGTRATGGSLSTGNNDTSEACDADFDSSLTACSGVESTAAPQKLLILDARSYTAAVANRAKGGGCECEEYYPNCEVVFMGMANIHAIRNSFQYLRAVCSQMPDPSNWLSALESTKWLQHLSVMLKAAVLVANTVDREGRPVLVHCSDGWDRTPQIVALAKILLDPYYRTLEGFQVLVESDWLDFGHKFGDRCGHQENVEDQNEQCPVFLQWLDSVHQLLKQFPCLFEFNEAFLVKLVQHTYSCLYGTFLANNPCEREKRNIYKRTCSVWALLRAGNKNFHNFLYTPSSDMVLHPVCHVRALHLWTAVYLPASSPCTLGEENMDLYLSPVAQSQEFSGRSLDRLPKTRSMDDLLSACDTSSPLTRTSSDPNLNNHCQEVRVGLEPWHSNPEGSETSFVDSGVGGPQQTVGEVGLPPPLPSSQKDYLSNKPFKSHKSCSPSYKLLNTAVPREMKSNTSDPEIKVLEETKGPAPDPSAQDELGRTLDGIGEPPEHCPETEAVSALSKVISNKCDGVCNFPESSQNSPTGTPQQAQPDSMLGVPSKCVLDHSLSTVCNPPSAACQTPLDPSTDFLNQDPSGSVASISHQEQLSSVPDLTHGEEDIGKRGNNRNGQLLENPRFGKMPLELVRKPISQSQISEFSFLGSNWDSFQGMVTSFPSGEATPRRLLSYGCCSKRPNSKQMRATGPCFGGQWAQREGVKSPVCSSHSNGHCTGPGGKNQMWLSSHPKQVSSTKPVPLNCPSPVPPLYLDDDGLPFPTDVIQHRLRQIEAGYKQEVEQLRRQVRELQMRLDIRHCCAPPAEPPMDYEDDFTCLKESDGSDTEDFGSDHSEDCLSEASWEPVDKKETEVTRWVPDHMASHCYNCDCEFWLAKRRHHCRNCGNVFCAGCCHLKLPIPDQQLYDPVLVCNSCYEHIQVSRARELMSQQLKKPIATASS

SEQ ID NO: 910510 - protein, 1195 aa, Homo sapiens; identical to SEQ ID NO: 910499

SEQ ID NO: 910511 - protein, 1278 aa, Homo sapiens
MGEEGPPSLEYIQAKDLFPPKELVKEEENLQVPFTVLQGEGVEFLGRAADALIAISNYRLHIKFKDSVINVPLRMIDSVESRDMFQLHISCKDSKVVRCHFSTFKQCQEWLSRLSRATARPAKPEDLFAFAYHAWCLGLTEEDQHTHLCQPGEHIRCRQEAELARMGFDLQNVWRVSHINSNYKLCPSYPQKLLVPVWITDKELENVASFRSWKRIPVVVYRHLRNGAAIARCSQPEISWWGWRNADDEYLVTSIAKACALDPGTRATGGSLSTGNNDTSEACDADFGKVWMMLTPQGAGPLLGFIGSQGVPSESLEDDNTRGAGVPALSEAVGYEGSLLHVLPSERECQRASKRLGGWLTQGLLPAVCLDSSLTACSGVESTAAPQKLLILDARSYTAAVANRAKGGGCECEEYYPNCEVVFMGMANIHAIRNSFQYLRAVCSQMPDPSNWLSALESTKWLQHLSVMLKAAVLVANTVDREGRPVLVHCSDGWDRTPQIVALAKILLDPYYRTLEGFQVLVESDWLDFGHKFGDRCGHQENVEDQNEQCPVFLQWLDSVHQLLKQFPCLFEFNEAFLVKLVQHTYSCLYGTFLANNPCEREKRNIYKRTCSVWALLRAGNKNFHNFLYTPSSDMVLHPVCHVRALHLWTAVYLPASSPCTLGEENMDLYLSPVAQSQEFSGRSLDRLPKTRSMDDLLSACDTSSPLTRTSSDPNLNNHCQEVRVGLEPWHSNPEGSETSFVDSGVGGPQQTVGEVGLPPPLPSSQKDYLSNKPFKSHKSCSPSYKLLNTAVPREMKSNTSDPEIKVLEETKGPAPDPSAQDELGRTLDGIGEPPEHCPETEAVSALSKVISNKCDGVCNFPESSQNSPTGTPQQAQPDSMLGVPSKCVLDHSLSTVCNPPSAACQTPLDPSTDFLNQDPSGSVASISHQEQLSSVPDLTHGEEDIGKRGNNRNGQLLENPRFGKMPLELVRKPISQSQISEFSFLGSNWDSFQGMVTSFPSGEATPRRLLSYGCCSKRPNSKQMRATGPCFGGQWAQREGVKSPVCSSHSNGHCTGPGGKNQMWLSSHPKQVSSTKPVPLNCPSPVPPLYLDDDGLPFPTDVIQHRLRQIEAGYKQEVEQLRRQVRELQMRLDIRHCCAPPAEPPMDYEDDFTCLKESDGSDTEDFGSDHSEDCLSEASWEPVDKKETEVTRWVPDHMASHCYNCDCEFWLAKRRHHCRNCGNVFCAGCCHLKLPIPDQQLYDPVLVCNSCYEHIQVSRARELMSQQLKKPIATASS

SEQ ID NO: 910512 - protein, 585 aa, Homo sapiens
MDDLLSACDTSSPLTRTSSDPNLNNHCQEVRVGLEPWHSNPEGSETSFVDSGVGGPQQTVGEVGLPPPLPSSQKDYLSNKPFKSHKSCSPSYKLLNTAVPREMKSNTSDPEIKVLEETKGPAPDPSAQDELGRTLDGIGEPPEHCPETEAVSALSKVISNKCDGVCNFPESSQNSPTGTPQQAQPDSMLGVPSKCVLDHSLSTVCNPPSAACQTPLDPSTDFLNQDPSGSVASISHQEQLSSVPDLTHGEEDIGKRGNNRNGQLLENPRFGKMPLELVRKPISQSQISEFSFLGSNWDSFQGMVTSFPSGEATPRRLLSYGCCSKRPNSKQMRATGPCFGGQWAQREGVKSPVCSSHSNGHCTGPGGKNQMWLSSHPKQVSSTKPVPLNCPSPVPPLYLDDDGLPFPTDVIQHRLRQIEAGYKQEVEQLRRQVRELQMRLDIRHCCAPPAEPPMDYEDDFTCLKESDGSDTEDFGSDHSEDCLSEASWEPVDKKETEVTRWVPDHMASHCYNCDCEFWLAKRRHHCRNCGNVFCAGCCHLKLPIPDQQLYDPVLVCNSCYEHIQVSRARELMSQQLKKPIATASS

SEQ ID NO: 910513 - protein, 1195 aa, Homo sapiens; identical to SEQ ID NO: 910499

SEQ ID NO: 910514 - protein, 1195 aa, Homo sapiens; identical to SEQ ID NO: 910499

SEQ ID NO: 910515 - protein, 888 aa, Homo sapiens
MGEEGPPSLEYIQAKDLFPPKELVKEEENLQVPFTVLQGEGVEFLGRAADALIAISNYRLHIKFKDSVINVPLRMIDSVESRDMFQLHISCKDSKVVRCHFSTFKQCQEWLSRLSRATARPAKPEDLFAFAYHAWCLGLTEEDQHTHLCQPGEHIRCRQEAELARMGFDLQNVWRVSHINSNYKLCPSYPQKLLVPVWITDKELENVASFRSWKRIPVVVYRHLRNGAAIARCSQPEISWWGWRNADDEYLVTSIAKACALDPGTRATGGSLSTGNNDTSEACDADFGKVWMMLTPQGAGPLLGFIGSQGVPSESLEKMTTHGVLGSLPCQKLWGMRGLQLHVLPSERECQRASKRLGGWLTQGLLPAVCLDSSLTACSGVESTAAPQKLLILDARSYTAAVANRAKGGGCECEEYYPNCEVVFMGMANIHAIRNSFQYLRAVCSQMPDPSNWLSALESTKWLQHLSVMLKAAVLVANTVDREGRPVLVHCSDGWDRTPQIVALAKILLDPYYRTLEGFQVLVESDWLDFGHKFGDRCGHQENVEDQNEQCPVFLQWLDSVHQLLKQFPCLFEFNEAFLVKLVQHTYSCLYGTFLANNPCEREKRNIYKRTCSVWALLRAGNKNFHNFLYTPSSDMVLHPVCHVRALHLWTAVYLPASSPCTLGEENMDLYLSPVAQSQEFSGRSLDRLPKTRSMDDLLSACDTSSPLTRTSSDPNLNNHCQEVRVGLEPWHSNPEGSETSFVDSGVGGPQQTVGEVGLPPPLPSSQKDYLSNKPFKSHKSCSPSYKLLNTAVPREMKSNTSDPEIKVLEETKGPAPDPSAQDELGRTLDGIGEPPEHCPETEAICLLSVAVLRDCPISEQTAWPWRETLGSWLRCVHQILLSELLWV

SEQ ID NO: 910516 - protein, 126 aa, Homo sapiens
ASNGIARLRGSGGRRLVRRGSQYPCHGRMGEEGPPSLEYIQAKDLFPPKELVKEEENLQVPFTVLQGEGVEFLGRAADALIAISNYRLHIKFKDSVINVPLRMIDSVESRDMFQLHISCKDSKVVR

SEQ ID NO: 910517 - protein, 106 aa, Homo sapiens
MGLLSILRKLKSAPDQEVRILLLGLDNAGKTTLLKQLASEDISHITPTQGFNIKSVQSQGFKLNVWDIGGQRKIRPYWKNYFENTDILIYVIDSADRKRFEETGQN

SEQ ID NO: 910518 - protein, 182 aa, Homo sapiens
MGLLSILRKLKSAPDQEVRILLLGLDNAGKTTLLKQLASEDISHITPTQGFNIKSVQSQGFKLNVWDIGGQRKIRPYWKNYFENTDILIYVIDSADRKRFEETGQELAELLEEEKLSCVPVLIFANKQDLLTAAPASEIAEGLNLHTIRDRVWQIQSCSALTGEGVQDGMNWVCKNVNAKKK

SEQ ID NO: 910519 - protein, 103 aa, Homo sapiens
MCSEGRGESSQYQSPVQTDNIEETGQELAELLEEEKLSCVPVLIFANKQDLLTAAPASEIAEGLNLHTIRDRVWQIQSCSALTGEGVQDGMNWVCKNVNAKKK

SEQ ID NO: 910520 - protein, 165 aa, Homo sapiens
MGLLSILRKLKSAPDQEVRILLLGLDNAGKTTLLKQLASEDISHITPTQGFNIKSVQSQGFKLNVWDIGGQRKIRPYWKNYFENTDILELAELLEEEKLSCVPVLIFANKQDLLTAAPASEIAEGLNLHTIRDRVWQIQSCSALTGEGVQDGMNWVCKNVNAKKK

SEQ ID NO: 910521 - protein, 182 aa, Homo sapiens; identical to SEQ ID NO: 910518

SEQ ID NO: 910522 - protein, 44 aa, Homo sapiens
MESPKFPPGRFDEGELIYHKRDLTNLEKRYHRESEENSPNIRRP

SEQ ID NO: 910523 - protein, 190 aa, Homo sapiens
NLSPLWLLKGLLSILRKLKSAPDQEVRILLLGLDNAGKTTLLKQLASEDISHITPTQGFNIKSVQSQGFKLNVWDIGGQRKIRPYWKNYFENTDILIYVIDSADRKRFEETGQELAELLEEEKLSCVPVLIFANKQDLLTAAPASEIAEGLNLHTIRDRVWQIQSCSALTGEGVQDGMNWVCKNVNAKKK

SEQ ID NO: 910524 - protein, 52 aa, Homo sapiens
MEKVQYLTRSAIRRASTIEMPQQARQKLQNLFINFCLILICLLLICIIVMLL

SEQ ID NO: 910525 - protein, 52 aa, Homo sapiens; identical to SEQ ID NO: 910524

SEQ ID NO: 910526 - protein, 52 aa, Homo sapiens; identical to SEQ ID NO: 910524

SEQ ID NO: 910527 - protein, 506 aa, Homo sapiens
MVDQLFCKKFAEALGSTEAKAVPYQKFEAHPNDLYVEGLPENIPFRSPSWYGIPRLEKIIQVGNRIKFVIKRPELLTHSTTEVTQPRTNTPVKEDWNVRITKLRKQVEEIFNLKFAQALGLTEAVKVPYPVFESNPEFLYVEGLPEGIPFRSPTWFGIPRLERIVHGSNKIKFVVKKPELVISYLPPGMASKINTKALQSPKRPRSPGSNSKVPEIEVTVEGPNNNNPQTSAVRTPTQTNGSNVPFKPRGREFSFEAWNAKITDLKQKVENLFNEKCGEALGLKQAVKVPFALFESFPEDFYVEGLPEGVPFRRPSTFGIPRLEKILRNKAKIKFIIKKPEMFETAIKESTSSKSPPRKINSSPNVNTTASGVEDLNIIQVTIPDDDNERLSKVEKARQLREQVNDLFSRKFGEAIGMGFPVKVPYRKITINPGCVVVDGMPPGVSFKAPSYLEISSMRRILDSAEFIKFTVIRPFPGLVINNQLVDQSDHLAQPRLFYQDKGLCI

SEQ ID NO: 910528 - protein, 390 aa, Homo sapiens
MVDQLFCKKFAEALGSTEAKAVPYQKFEAHPNDLYVEGLPENIPFRSPSWYGIPRLEKIIQVGNRIKFVIKRPELLTHSTTEVTQPRTNTPVKEDWNVRITKLRKQVEEIFNLKFAQALGLTEAVKVPYPVFESNPEFLYVEGLPEGIPFRSPTWFGIPRLERIVHGSNKIKFVVKKPELVISYLPPGMASKINTKALQSPKRPRSPGSNSKVPEIEVTVEGPNNNNPQTSAVRTPTQTNGSNVPFKPRGREFSFEAWNAKITDLKQKVENLFNEKCGEALGLKQAVKVPFALFESFPEDFYVEGLPEGVPFRRPSTFGIPRLEKILRNKAKIKFIIKKPEMFETAIKESTSSKSPPRKINSSPNVNTTASGVEDLNIIQVTIPAWLCGG

SEQ ID NO: 910529 - protein, 506 aa, Homo sapiens; identical to SEQ ID NO: 910527

SEQ ID NO: 910530 - protein, 534 aa, Homo sapiens
MVDQLFCKKFAEALGSTEAKAVPYQKFEAHPNDLYVEGLPENIPFRSPSWYGIPRLEKIIQVGNRIKFVIKRPELLTHSTTEVTQPRTNTPVKEDWNVRITKLRKQVEEIFNLKFAQALGLTEAVKVPYPVFESNPEFLYVEGLPEGIPFRSPTWFGIPRLERIVHGSNKIKFVVKKPELVISYLPPGMASKINTKALQSPKRPRSPGSNSKVPEIEVTVEGPNNNNPQTSAVRTPTQTNGSNVPFKPRGREFSFEAWNAKITDLKQKVENLFNEKCGEALGLKQAVKVPFALFESFPEDFYVEGLPEGVPFRRPSTFGIPRLEKILRNKAKIKFIIKKPEMFETAIKESTSSKSPPRKINSSPNVNTTASGVEDLNIIQVTIPDDDNERLSKVEKARQLREQVNDLFSRKFGEAIGMGFPVKVPYRKITINPGCVVVDGMPPGVSFKAPSYLEISSMRRILDSAEFIKFTVIRPFPGLVINNQLVDQSESKGPVIQESAEPSQLEVPATEEGKSASVSGMLCGVHLNPLHTRS

SEQ ID NO: 910531 - protein, 456 aa, Homo sapiens
YNSSSYNSSFYWRDRIKFGIKRPELLTHSTTEVTQPRTNTPVKEDWNVRITKLRKQVEEIFNLKFAQALGLTEAVKVPYPVFESNPEFLYVEGLPEGIPFRSPTWFGIPRLERIVHGSNKIKFVVKKPELVISYLPPGMASKINTKALQSPKRPRSPGSNSKVPEIEVTVEGPNNNNPQTSAVRTPTQTNGSNVPFKPRGREFSFEAWNAKITDLKQKVENLFNEKCGEALGLKQAVKVPFALFESFPEDFYVEGLPEGVPFRRPSTFGIPRLEKILRNKAKIKFIIKKPEMFETAIKESTSSKSPPRKINSSPNVNTTASGVEDLNIIQVTIPDDDNERLSKVEKARQLREQVNDLFSRKFGEAIGMGFPVKVPYRKITINPGCVVVDGMPPGVSFKAPSYLEISSMRRILDSAEFIKFTVIRPFPGLVINNQLVDQSDHLAQPRLFYQDKGLCI

SEQ ID NO: 910532 - protein, 530 aa, Homo sapiens [sequence omitted]

SEQ ID NO: 910533 - protein, 178 aa, Homo sapiens
MVDQLFCKKFAEALGSTEAKAVPYQKFEAHPNDLYVEGLPENIPFRSPSWYGIPRLEKIIQVGNRIKFVIKRPELLTHSTTEVTQPRTNTPVKEDWNVRITKLRKQVEEIFNLKFAQALGLTEAVKVPYPVFESNPEFLYVEGLPEGIPFRSPTWFGIPRLERIVHGSNKIKFVVKKP

SEQ ID NO: 910534 - protein, 212 aa, Homo sapiens
MEGVEEKKKEVPAVPETLKKKRRNFAELKIKRLRKKFAQKMLRKARRKLIYEKAKHYHKEYRQMYRTEIRMARMARKAGNFYVPAEPKLAFVIRIRGINGVSPKVRKVLQLLRLRQIFNGTFVKLNKLRFNMLRICEKPYIGLGGYPILKSRYMNLSNKTWSWANSIEANWFDSKRLIGQLLGTTGSLLERSGTNFSGDTPQGENRCATIFP

SEQ ID NO: 910535 - protein, 530 aa, Homo sapiens [sequence omitted]

SEQ ID NO: 910536 - protein, 530 aa, Homo sapiens [sequence omitted]

SEQ ID NO: 910537 - protein, 506 aa, Homo sapiens; identical to SEQ ID NO: 910527

SEQ ID NO: 910538 - protein, 530 aa, Homo sapiens [sequence omitted]

SEQ ID NO: 910539 - protein, 506 aa, Homo sapiens; identical to SEQ ID NO: 910527

SEQ ID NO: 910540 - protein, 476 aa, Homo sapiens
MVDQLFCKKFAEALGSTEAKAVPYQKFEAHPNDLYVEGLPENIPFRSPSWYGIPRLEKIIQVGNRIKFVIKRPELLTHSTTEVTQPRTNTPVKEDWNVRITKLRKQVEEIFNLKFAQALGLTEAVKVPYPVFESNPEFLYVEGLPEGIPFRSPTWFGIPRLERIVHGSNKIKFVVKKPELVISYLPPGMASKINTKALQSPKRPRSPGSNSKVPEIEVTVEGPNNNNPQTSAVRTPTQTNGSNVPFKPRGREFSFEAWNAKITDLKQKVENLFNEKCGEALGLKQAVKVPFALFESFPEDFYVEGLPEGVPFRRPSTFGIPRLEKILRNKAKIKFIIKKPEMFETAIKESTSSKSPPRKINSSPNVNTTASGVEDLNIIQVTIPDDDNERLSKVEKARQLREQVNDLFSRKFGEAIGMGFPVKVPYRKITINPGCVVVDGMPPGVSFKAPSYLEISSMRRILDSAEFIKFTVIRIS

SEQ ID NO: 910541 - protein, 837 aa, Homo sapiens
MNHLEGSAEVEVTDEAAGGEVNESVEADLEHPEVEEEQQQPPQQQHYVGRHQRGRALEDLRAQLGQEEEERGECLARSASTESGFHNHTDTAEGDVIAAARDGYDAERAQDPEDESAYAVQYRPEAEEYTEQAEAEHAEATHRRALPNHLHFHSLEHEEAMNAAYSGYVYTHRLFHRGEDEPYSEPYADYGGLQEHVYEEIGDAPELDARDGLRLYEQERDEAAAYRQEALGARLHHYDERSDGESDSPEKEAEFAPYPRMDSYEQEEDIDQIVAEVKQSMSSQSLDKAAEDMPEAEQDLERPPTPAGGRPDSPGLQAPAGQQRAVGPAGGGEAGQRYSKEKRDAISLAIKDIKEAIEEVKTRTIRSPYTPDEPKEPIWVMRQDISPTRDCDDQRPMDGDSPSPGSSSPLGAESSSTSLHPSDPVEAPTNKESRKSLASFPTYVEVPGPCDPEDLIDGIIFAANYLGSTQLLSDKTPSKNVRMMQAQEAVSRIKMAQKLAKSRKKAPEGESQPMTEVDLFISTQRIKVLNADTQETMMDHPLRTISYIADIGNIVVLMARRRMPRSNSQENVEASHPSQDGKRQYKMICHVFESEDAQLIAQSIGQAFSVAYQEFLRANGINPEDLSQKEYSDLLNTQDMYNDDLIHFSKSENCKDVFIEKQKGEILGVVIVESGWGSILPTVIIANMMHGGPAEKSGKLNIGDQIMSINGTSLVGLPLSTCQSIIKGLENQSRVKLNIVRCPPVTTVLIRRPDLRYQLGFSVQNGIICSLMRGGIAERGGVRVGHRIIEINGQSVVATPHEKIVHILSNAVGEIHMKTMPAAMYRLLTAQEQPVYI

SEQ ID NO: 910542 - protein, 826 aa, Homo sapiens
MNHLEGSAEVEVTDEAAGGEVNESVEADLEHPEVEEEQQQPPQQQHYVGRHQRGRALEDLRAQLGQEEEERGECLARSASTESGFHNHTDTAEGDVIAAARDGYDAERAQDPEDESAYAVQYRPEAEEYTEQAEAEHAEATHRRALPNHLHFHSLEHEEAMNAAYSGYVYTHRLFHRGEDEPYSEPYADYGGLQEHVYEEIGDAPELDARDGLRLYEQERDEAAAYRQEALGARLHHYDERSDGESDSPEKEAEFAPYPRMDSYEQEEDIDQIVAEVKQSMSSQSLDKAAEDMPEAEQDLERPPTPAGGRPDSPGLQAPAGQQRAVGPAGGGEAGQRYSKEKRDAISLAIKDIKEAIEEVKTRTIRSPYTPDEPKEPIWVMRQDISPTRDCDDQRPMDGDSPSPGSSSPLGAESSSTSLHPSDPVEAPTNKESRKSLASFPTYVEVPGPCDPEDLIDGIIFAANYLGSTQLLSDKTPSKNVRMMQAQEAVSRIKAPEGESQPMTEVDLFISTQRIKVLNADTQETMMDHPLRTISYIADIGNIVVLMARRRMPRSNSQENVEASHPSQDGKRQYKMICHVFESEDAQLIAQSIGQAFSVAYQEFLRANGINPEDLSQKEYSDLLNTQDMYNDDLIHFSKSENCKDVFIEKQKGEILGVVIVESGWGSILPTVIIANMMHGGPAEKSGKLNIGDQIMSINGTSLVGLPLSTCQSIIKGLENQSRVKLNIVRCPPVTTVLIRRPDLRYQLGFSVQNGIICSLMRGGIAERGGVRVGHRIIEINGQSVVATPHEKIVHILSNAVGEIHMKTMPAAMYRLLTAQEQPVYI

SEQ ID NO: 910543 - protein, 837 aa, Homo sapiens; identical to SEQ ID NO: 910541

SEQ ID NO: 910544 - protein, 108 aa, Homo sapiens
AFSDDANNMAAESGSDFQQRRRRRRDPEEPEKTELSERELAVAVAVSQENDEENEERWVGPLPVEATLAKKRKVLEFERVYLDNLPSASMYERSYMHRDVITHVVCTK

SEQ ID NO: 910545 - protein, 90 aa, Homo sapiens
AFSDDANNMAAESGSDFQQRRRRRRDPEEPEKTELSERELAVAVAVSQENDEENEERWVGPLPVEATLAKKRKGSCRHSTGTNWSAASAE

SEQ ID NO: 910546 - protein, 470 aa, Homo sapiens
MKVFDVVNFDMINMLKLGYFPGQCEWIYCPGDAISSVAASEKSTGKIFIYDGRGDNQPLHIFDKLHTSPLTQIRLNPVYKAVVSSDKSGMIEYWTGPPHEYKFPKNVNWEYKTDTDLYEFAKCKAYPTSVCFSPDGKKIATIGSDRKVRIFRFVTGKLMRVFDESLSMFTELQQMRQQLPDMEFGRRMAVERELEKVDAVRLINIVFDETGHFVLYGTMLGIKVINVETNRGYAKKHRAATTIEMKASENPVLQNIQADPTIVCTSFKKNRFYMFTKREPEDTKSADSDRDVFNEKPSKEEVMAATQAEGPKRVSDSAIIHTSMGDIHTKLFPVECPKTVENFCVHSRNGYYNGHTFHRIIKGFMIQTGDPTGTGMGGESIWGGEFEDEFHSTLRHDRPYTLSMANAGSNTNGSQFFITVVPTPWLDNKHTVFGRVTKGMEVVQRISNVKVNPKTDKPYEDVSIINITVK

SEQ ID NO: 910547 - protein, 634 aa, Homo sapiens
AFSDDANNMAAESGSDFQQRRRRRRDPEEPEKTELSERELAVAVAVSQENDEENEERWVGPLPVEATLAKKRKVLEFERVYLDNLPSASMYERSYMHRDVITHVVCTKTDFIITASHDGHVKFWKKIEEGIEFVKHFRSHLGVIESIAVSSEGALFCSVGDDKAMKVFDVVNFDMINMLKLGYFPGQCEWIYCPGDAISSVAASEKSTGKIFIYDGRGDNQPLHIFDKLHTSPLTQIRLNPVYKAVVSSDKSGMIEYWTGPPHEYKFPKNVNWEYKTDTDLYEFAKCKAYPTSVCFSPDGKKIATIGSDRKVRIFRFVTGKLMRVFDESLSMFTELQQMRQQLPDMEFGRRMAVERELEKVDAVRLINIVFDETGHFVLYGTMLGIKVINVETNRGYAKKHRAATTIEMKASENPVLQNIQADPTIVCTSFKKNRFYMFTKREPEDTKSADSDRDVFNEKPSKEEVMAATQAEGPKRVSDSAIIHTSMGDIHTKLFPVECPKTVENFCVHSRNGYYNGHTFHRIIKGFMIQTGDPTGTGMGGESIWGGEFEDEFHSTLRHDRPYTLSMANAGSNTNGSQFFITVVPTPWLDNKHTVFGRVTKGMEVVQRISNVKVNPKTDKPYEDVSIINITVK

SEQ ID NO: 910548 - protein, 346 aa, Homo sapiens
MCLAPLIYSPQQPHEVGISNSYLVLEFERVYLDNLPSASMYERSYMHRDVITHVVCTKTDFIITASHDGHVKFWKKIEEGIEFVKHFRSHLGVIESIAVSSEGALFCSVGDDKAMKVFDVVNFDMINMLKLGYFPGQCEWIYCPGDAISSVAASEKSTGKIFIYDGRGDNQPLHIFDKLHTSPLTQIRLNPVYKAVVSSDKSGMIEYWTGPPHEYKFPKNVNWEYKTDTDLYEFAKCKAYPTSVCFSPDGKKIATIGSDRKVRIFRFVTGKLMRVFDESLSMFTELQQMRQQLPDMEFGRRMAVERELEKVDAVRLINIVFDETGHFVLYGTMLGIKVINVETNRG

SEQ ID NO: 910549 - protein, 475 aa, Homo sapiens
AFSDDANNMAAESGSDFQQRRRRRRDPEEPEKTELSERELAVAVAVSQENDEENEERWVGPLPVEATLAKKRKVLEFERVYLDNLPSASMYERSYMHRDVITHVVCTKTDFIITASHDGHVKFWKKIEEGIEFVKHFRSHLGVIESIAVSSEGALFCSVGDDKAMKVFDVVNFDMINMLKLGYFPGQCEWIYCPGDAISSVAASEKSTGKIFIYDGRGDNQPLHIFDKLHTSPLTQIRLNPVYKAVVSSDKSGMIEYWTGPPHEYKFPKNVNWEYKTDTDLYEFAKCKAYPTSVCFSPDGKKIATIGSDRKVRIFRFVTGKLMRVFDESLSMFTELQQMRQQLPDMEFGRRMAVERELEKVDAVRLINIVFDETGHFVLYGTMLGIKVINVETNRCVRILGKQENIRVMQLALFQGIAKKHRAATTIEMKASENPVLQNIQADPTIVCTSFKKNRFYMVCVSTRRLDGNVPSSLV

SEQ ID NO: 910550 - protein, 332 aa, Homo sapiens
AFSDDANNMAAESGSDFQQRRRRRRDPEEPEKTELSERELAVAVAVSQENDEENEERWVGPLPVEATLAKKRKVLEFERVYLDNLPSASMYERSYMHRDVITHVVCTKTDFIITASHDGHVKFWKKIEEGIEFVKHFRSHLGVIESIAVSSEGALFCSVGDDKAMKVFDVVNFDMINMLKLGYFPGQCEWIYCPGDAISSVAASEKSTGKIFIYDGRGDNQPLHIFDKLHTSPLTQIRLNPVYKAVVSSDKSGMIEYWTGPPHEYKFPKNVNWEYKTDTDLYEFAKCKAYPTSVCFSPDGKKIATIGSDRKVRIFRFVTGKLMRVFDESLSS

SEQ ID NO: 910551 - protein, 335 aa, Homo sapiens
AFSDDANNMAAESGSDFQQRRRRRRDPEEPEKTELSERELAVAVAVSQENDEENEERWVGPLPVEATLAKKRKVLEFERVYLDNLPSASMYERSYMHRDVITHVVCTKTDFIITASHDGHVKFWKKIEEGIEFVKHFRSHLGVIESIAVSSEGALFCSVGDDKAMKVFDVVNFDMINMLKLGYFPGQCEWIYCPGDAISSVAASEKSTGKIFIYDGRGDNQPLHIFDKLHTSPLTQIRLNPVYKAVVSSDKSGMIEYWTGPPHEYKFPKNVNWEYKTDTDLYEFAKCKAYPTSVCFSPDGKKIATIGSDRKVRIFRFVTGKLMRVFDESLSVSVI

SEQ ID NO: 910552 - protein, 654 aa, Homo sapiens
AFSDDANNMAAESGSDFQQRRRRRRDPEEPEKTELSERELAVAVAVSQENDEENEERWVGPLPVEATLAKKRKVLEFERVYLDNLPSASMYERSYMHRDVITHVVCTKTDFIITASHDGHVKFWKKIEEGIEFVKHFRSHLGVIESIAVSSEGALFCSVGDDKAMKVFDVVNFDMINMLKLGYFPGQCEWIYCPGDAISSVAASEKSTGKIFIYDGRGDNQPLHIFDKLHTSPLTQIRLNPVYKAVVSSDKSGMIEYWTGPPHEYKFPKNVNWEYKTDTDLYEFAKCKAYPTSVCFSPDGKKIATIGSDRKVRIFRFVTGKLMRVFDESLSMFTELQQMRQQLPDMEFGRRMAVERELEKVDAVRLINIVFDETGHFVLYGTMLGIKVINVETNRCVRILGKQENIRVMQLALFQGIAKKHRAATTIEMKASENPVLQNIQADPTIVCTSFKKNRFYMFTKREPEDTKSADSDRDVFNEKPSKEEVMAATQAEGPKRVSDSAIIHTSMGDIHTKLFPVECPKTVENFCVHSRNGYYNGHTFHRIIKGFMIQTGDPTGTGMGGESIWGGEFEDEFHSTLRHDRPYTLSMANAGSNTNGSQFFITVVPTPWLDNKHTVFGRVTKGMEVVQRISNVKVNPKTDKPYEDVSIINITVK

SEQ ID NO: 910553 - protein, 109 aa, Homo sapiens
MHAAITSCVGRENEVSDFQQRRRRRRDPEEPEKTELSERELAVAVAVSQENDEENEERWVGPLPVEATLAKKRKVLEFERVYLDNLPSASMYERSYMHRDVITHVVCTK

SEQ ID NO: 910554 - protein, 634 aa, Homo sapiens; identical to SEQ ID NO: 910547

SEQ ID NO: 910555 - protein, 545 aa, Homo sapiens
MYERSYMHRDVITHVVCTKTDFIITASHDGHVKFWKKIEEGIEFVKHFRSHLGVIESIAVSSEGALFCSVGDDKAMKVFDVVNFDMINMLKLGYFPGQCEWIYCPGDAISSVAASEKSTGKIFIYDGRGDNQPLHIFDKLHTSPLTQIRLNPVYKAVVSSDKSGMIEYWTGPPHEYKFPKNVNWEYKTDTDLYEFAKCKAYPTSVCFSPDGKKIATIGSDRKVRIFRFVTGKLMRVFDESLSMFTELQQMRQQLPDMEFGRRMAVERELEKVDAVRLINIVFDETGHFVLYGTMLGIKVINVETNRGYAKKHRAATTIEMKASENPVLQNIQADPTIVCTSFKKNRFYMFTKREPEDTKSADSDRDVFNEKPSKEEVMAATQAEGPKRVSDSAIIHTSMGDIHTKLFPVECPKTVENFCVHSRNGYYNGHTFHRIIKGFMIQTGDPTGTGMGGESIWGGEFEDEFHSTLRHDRPYTLSMANAGSNTNGSQFFITVVPTPWLDNKHTVFGRVTKGMEVVQRISNVKVNPKTDKPYEDVSIINITVK

SEQ ID NO: 910556 - protein, 168 aa, Homo sapiens [sequence omitted]

SEQ ID NO: 910557 - protein, 395 aa, Homo sapiens
AFSDDANNMAAESGSDFQQRRRRRRDPEEPEKTELSERELAVAVAVSQENDEENEERWVGPLPVEATLAKKRKVLEFERVYLDNLPSASMYERSYMHRDVITHVVCTKTDFIITASHDGHVKFWKKIEEGIEFVKHFRSHLGVIESIAVSSEGALFCSVGDDKAMKVFDVVNFDMINMLKLGYFPGQCEWIYCPGDAISSVAASEKSTGKIFIYDGRGDNQPLHIFDKLHTSPLTQIRLNPVYKAVVSSDKSGMIEYWTGPPHEYKFPKNVNWEYKTDTDLYEFAKCKAYPTSVCFSPDGKKIATIGSDRKVRIFRFVTGKLMRVFDESLSMFTELQQMRQQLPDMEFGRRMAVERELEKVDAVRLINIVFDETGHFVLYGTMLGIKVINVETNR

SEQ ID NO: 910558 - protein, 146 aa, Homo sapiens
MGSFSHRTILFLFSSLMHGIKFSSILLFFPTGEGMSQAATICKSNFKYMYWTMLQQLTHHSVNGCNLRPGDLLASGTISGPEPENFGSMLELSWKGTKPIDLGNGQTRKFLLDGDEVIITGYCQGDGYRIGFGQCAGKVLPALLPS

SEQ ID NO: 910559 - protein, 294 aa, Homo sapiens
MSFIPVAEDSDFPIHNLPYGVFSTRGDPRPRIGVAIGDQILDLSIIKHLFTGPVLSKHQDVFNQPTLNSFMGLGQAAWKEARVFLQNLLSVSQARLRDDTELRKCAFISQASATMHLPATIGDYTDFYSSRQHATNVGIMFRDKENALMPNWLHLPVGYHGRASSVVVSGTPIRRPMGQMKPDDSKPPVYGACKLLDMELEMAFFVGPGNRLGEPIPISKAHEHIFGMVLMNDWSGRDLPTVGKYVPSPGHPLGRGLGDHLLLGVGPLGCSLALGVPSRSSGPVLSRLSRASSI

SEQ ID NO: 910560 - protein, 174 aa, Homo sapiens
MSFIPVAEDSDFPIHNLPYGVFSTRGDPRPRIGVAIGDQILDLSIIKHLFTGPVLSKHQDVFNQPTLNSFMGLGQAAWKEARVFLQNLLSVSQARLRDDTELRKCAFISQASATMHLPATIGECSLFTKIRTEQLRGPRGLARRLHRLLFLSAACYQRRNHVQGQGECVDAKLV

SEQ ID NO: 910561 - protein, 442 aa, Homo sapiens
GRDCGGPGAGGGQGPQPCRVLFSMSFIPVAEDSDFPIHNLPYGVFSTRGDPRPRIGVAIGDQILDLSIIKHLFTGPVLSKHQDVFNQPTLNSFMGLGQAAWKEARVFLQNLLSVSQARLRDDTELRKCAFISQASATMHLPATIGDYTDFYSSRQHATNVGIMFRDKENALMPNWLHLPVGYHGRASSVVVSGTPIRRPMGQMKPDDSKPPVYGACKLLDMELEMAFFVGPGNRLGEPIPISKAHEHIFGMVLMNDWSARDIQKWEYVPLGPFLGKSFGTTVSPWVVPMDALMPFAVPNPKQDPRPLPYLCHDEPYTFDINLSVNLKGEGMSQAATICKSNFKYMYWTMLQQLTHHSVNGCNLRPGDLLASGTISGPEPENFGSMLELSWKGTKPIDLGNGQTRKFLLDGDEVIITGYCQGDGYRIGFGQCAGKVLPALLPS

SEQ ID NO: 910562 - protein, 419 aa, Homo sapiens
MSFIPVAEDSDFPIHNLPYGVFSTRGDPRPRIGVAIGDQILDLSIIKHLFTGPVLSKHQDVFNQPTLNSFMGLGQAAWKEARVFLQNLLSVSQARLRDDTELRKCAFISQASATMHLPATIGDYTDFYSSRQHATNVGIMFRDKENALMPNWLHLPVGYHGRASSVVVSGTPIRRPMGQMKPDDSKPPVYGACKLLDMELEMAFFVGPGNRLGEPIPISKAHEHIFGMVLMNDWSARDIQKWEYVPLGPFLGKSFGTTVSPWVVPMDALMPFAVPNPKQDPRPLPYLCHDEPYTFDINLSVNLKGEGMSQAATICKSNFKYMYWTMLQQLTHHSVNGCNLRPGDLLASGTISGPEPENFGSMLELSWKGTKPIDLGNGQTRKFLLDGDEVIITGYCQGDGYRIGFGQCAGKVLPALLPS

SEQ ID NO: 910563 - protein, 462 aa, Homo sapiens
TDSDFPIHNLPYGVFSDQRRPKTEDRCGHWDQILDLSIIKHLSMSFIPVAEDSDFPIHNLPYGVFSTRGDPRPRIGVAIGDQILDLSIIKHLFTGPVLSKHQDVFNQPTLNSFMGLGQAAWKEARVFLQNLLSVSQARLRDDTELRKCAFISQASATMHLPATIGDYTDFYSSRQHATNVGIMFRDKENALMPNWLHLPVGYHGRASSVVVSGTPIRRPMGQMKPDDSKPPVYGACKLLDMELEMAFFVGPGNRLGEPIPISKAHEHIFGMVLMNDWSARDIQKWEYVPLGPFLGKSFGTTVSPWVVPMDALMPFAVPNPKQDPRPLPYLCHDEPYTFDINLSVNLKGEGMSQAATICKSNFKYMYWTMLQQLTHHSVNGCNLRPGDLLASGTISGPEPENFGSMLELSWKGTKPIDLGNGQTRKFLLDGDEVIITGYCQGDGYRIGFGQCAGKVLPALLPS

SEQ ID NO: 910564 - protein, 401 aa, Homo sapiens
RGRGCRQRRPRPRIGVAIGDQILDLSIIKHLFTGPVLSKHQDVFNQPTLNSFMGLGQAAWKEARVFLQNLLSVSQARLRDDTELRKCAFISQASATMHLPATIGDYTDFYSSRQHATNVGIMFRDKENALMPNWLHLPVGYHGRASSVVVSGTPIRRPMGQMKPDDSKPPVYGACKLLDMELEMAFFVGPGNRLGEPIPISKAHEHIFGMVLMNDWSARDIQKWEYVPLGPFLGKSFGTTVSPWVVPMDALMPFAVPNPKQDPRPLPYLCHDEPYTFDINLSVNLKGEGMSQAATICKSNFKYMYWTMLQQLTHHSVNGCNLRPGDLLASGTISGPEPENFGSMLELSWKGTKPIDLGNGQTRKFLLDGDEVIITGYCQGDGYRIGFGQCAGKVLPALLPS

SEQ ID NO: 910565 - protein, 440 aa, Homo sapiens
KLKEECEAVARAFVYFIRMAADTEFDITLGETYGCILNQNRAKNDRYVVAHRVPNTDTEDDQPLLLKCVLSSTMDHVNVNSFTLHVYQLHWSLSVAVCWKEARVFLQNLLSVSQARLRDDTELRKCAFISQASATMHLPATIGDYTDFYSSRQHATNVGIMFRDKENALMPNWLHLPVGYHGRASSVVVSGTPIRRPMGQMKPDDSKPPVYGACKLLDMELEMAFFVGPGNRLGEPIPISKAHEHIFGMVLMNDWSARDIQKWEYVPLGPFLGKSFGTTVSPWVVPMDALMPFAVPNPKQDPRPLPYLCHDEPYTFDINLSVNLKGEGMSQAATICKSNFKYMYWTMLQQLTHHSVNGCNLRPGDLLASGTISGPEPENFGSMLELSWKGTKPIDLGNGQTRKFLLDGDEVIITGYCQGDGYRIGFGQCAGKVLPALLPS

SEQ ID NO: 910566 - protein, 419 aa, Homo sapiens; identical to SEQ ID NO: 910562

SEQ ID NO: 910567 - protein, 360 aa, Homo sapiens
MSFIPVAEDSDFPIHNLPYGVFSTRGDPRPRIGVAIGDQILDLSIIKHLFTGPVLSKHQDVFNQPTLNSFMGLGQAAWKEARVFLQNLLSVSQARLRDDTELRKCAFISQASATMHLPATIGDYTDFYSSRQHATNVGIMFRDKENALMPNWLHLPVGYHGRASSVVVSGTPIRRPMGQMKPDDSKPPVYGACKLLDMELEMAFFVGPGNRLGEPIPISKAHEHIFGMVLMNDWSARDIQKWEYVPLGPFLGKSFGTTVSPWVVPMDALMPFAVPNPKQDPRPLPYLCHDEPYTFDINLSVNLKGEGMSQAATICKSNFKYMYWTMLQQLTHHSVNGCNLRPGDLLASGTISGPVSIWLH

SEQ ID NO: 910568 - protein, 385 aa, Homo sapiens
MSFIPVAEDSDFPIHNLPYGVFSTRGDPRPRIGVAIGDQILDLSIIKHLFTGPVLSKHQDVFNQPTLNSFMGLGQAAWKEARVFLQNLLSVSQARLRDDTELRKCAFISQASATMHLPATIGDYTDFYSSRQHATNVGIMFRDKENALMPNWLHLPVGYHGRASSVVVSGTPIRRPMGQMKPDDSKPPVYGACKLLDMELEMAFFVGPGNRLGEPIPISKAHEHIFGMVLMNDWSARDIQKWEYVPLGPFLGKSFGTTVSPWVVPMDALMPFAVPNPKQDPRPLPYLCHDEPYTFDINLSVNLKGEGMSQAATICKSNFKEPENFGSMLELSWKGTKPIDLGNGQTRKFLLDGDEVIITGYCQGDGYRIGFGQCAGKVLPALLPS

SEQ ID NO: 910569 - protein, 154 aa, Homo sapiens [sequence omitted]

SEQ ID NO: 910570 - protein, 237 aa, Homo sapiens
MSFIPVAEDSDFPIHNLPYGVFSTRGDPRPRIGVAIGDQILDLSIIKHLFTGPVLSKHQDVFNQPTLNSFMGLGQAAWKEARVFLQNLLSVSQARLRDDTELRKCAFISQASATMHLPATIGDYTDFYSSRQHATNVGIMFRDKENALMPNWLHLPVGYHGRASSVVVSGTPIRRPMGQMKPDDSRLRYGLGALALRRNGLCGPEHVWAPPFRPGLCGLYDGARAKGGLGPGSGAPA

SEQ ID NO: 910571 - protein, 419 aa, Homo sapiens; identical to SEQ ID NO: 910562

SEQ ID NO: 910572 - protein, 419 aa, Homo sapiens; identical to SEQ ID NO: 910562

SEQ ID NO: 910573 - protein, 405 aa, Homo sapiens
GETVEDLELAGVRPRPRIGVAIGDQILDLSIIKHLFTGPVLSKHQDVFNQPTLNSFMGLGQAAWKEARVFLQNLLSVSQARLRDDTELRKCAFISQASATMHLPATIGDYTDFYSSRQHATNVGIMFRDKENALMPNWLHLPVGYHGRASSVVVSGTPIRRPMGQMKPDDSKPPVYGACKLLDMELEMAFFVGPGNRLGEPIPISKAHEHIFGMVLMNDWSARDIQKWEYVPLGPFLGKSFGTTVSPWVVPMDALMPFAVPNPKQDPRPLPYLCHDEPYTFDINLSVNLKGEGMSQAATICKSNFKYMYWTMLQQLTHHSVNGCNLRPGDLLASGTISGPEPENFGSMLELSWKGTKPIDLGNGQTRKFLLDGDEVIITGYCQGDGYRIGFGQCAGKVLPALLPS

SEQ ID NO: 910574 - protein, 408 aa, Homo sapiens
MSFIPVAEDSDFPIHNLPYGVFSTRGDQILDLSIIKHLFTGPVLSKHQDVFNQPTLNSFMGLGQAAWKEARVFLQNLLSVSQARLRDDTELRKCAFISQASATMHLPATIGDYTDFYSSRQHATNVGIMFRDKENALMPNWLHLPVGYHGRASSVVVSGTPIRRPMGQMKPDDSKPPVYGACKLLDMELEMAFFVGPGNRLGEPIPISKAHEHIFGMVLMNDWSARDIQKWEYVPLGPFLGKSFGTTVSPWVVPMDALMPFAVPNPKQDPRPLPYLCHDEPYTFDINLSVNLKGEGMSQAATICKSNFKYMYWTMLQQLTHHSVNGCNLRPGDLLASGTISGPEPENFGSMLELSWKGTKPIDLGNGQTRKFLLDGDEVIITGYCQGDGYRIGFGQCAGKVLPALLPS

SEQ ID NO: 910575 - protein, 419 aa, Homo sapiens
MSFIPVAEDSDFPIHNLPYGVFSTRGDPRPRIGVAIGDQILDLSIIKHLFTGPVLSKHQDVFNQPTLNSFMGLGQAAWKEARVFLQNLLSVSQARLRDDTELRKCAFISQASATMHLPATIGDYTDFYSSRQHATNVGIMFRDKENALMPNWLHLPVGYHGRASSVVVSGTPIRRPMGQMKPDDSKPPVYGACKLLDMELEMAFFVGPGNRLGEPIPISKAHEHIFGMVLMNDWSARDIQKWEYVPLGPFLGKSFGTTVSPWVVPMDALMPFAVPNPKQDPRPLPYLCHDEPYTFDINLSVNLKGEGMSQAATICKSNFKYMYWTMLQQLTHHSVNGCNLRPGDLLASGTISGPEPENFGSMLELSWKGTKPIDLGNGQTRKFLLDGDEVIITGYCQGDGYRIGFGQCAGASSTPFPVT

SEQ ID NO: 910576 - protein, 248 aa, Homo sapiens
WLSRGSLIGSQDDSKPPVYGACKLLDMELEMAFFVGPGNRLGEPIPISKAHEHIFGMVLMNDWSARDIQKWEYVPLGPFLGKSFGTTVSPWVVPMDALMPFAVPNPKQDPRPLPYLCHDEPYTFDINLSVNLKGEGMSQAATICKSNFKYMYWTMLQQLTHHSVNGCNLRPGDLLASGTISGPEPENFGSMLELSWKGTKPIDLGNGQTRKFLLDGDEVIITGYCQGDGYRIGFGQCAGKVLPALLPS

SEQ ID NO: 910577 - protein, 432 aa, Homo sapiens
MSFIPVAEDSDFPIHNLPYGVFSTRGDPRPRIGVAIGDQILDLSIIKHLFTGPVLSKHQDVFNQPTLNSFMGLGQAAWKEARVFLQNLLSVSQARLRDDTELRKCAFISQASATMHLPATIGDYTDFYSSRQHATNVGIMFRDKENALMPNWLHLPVGYHGRASSVVVSGTPIRRPMGQMKPDDSKPPVYGACKLLDMELEMAFFVGPGNRLGEPIPISKAHEHIFGMVLMNDWSARDIQKWEYVPLGPFLGKSFGTTVSPWVVPMDALMPFAVPNPKQVSTFSAGSSQTQPCCLRGCLPTEWTCQACRPSGGKLCAHGMPTAECLGVPGHDYFQAARASFSLVVSLALAQFLEKTQNFVTLRILQDPGDLASWQEESLQVPTLHNLPGGHQILFCANGATWTPTHRMQLGAQQQGVPAASGSRHRLVYHWV

SEQ ID NO: 910578 - protein, 798 aa, Homo sapiens
GHSADSSRQSGTRHTESSSRGQAASSHEQARSSAGERHGSHHQLQSADSSRHSGIGHGQASSAVRDSGHRGYSGSQASDSEGHSEDSDTQSVSAQGKAGPHQQSHKESARGQSGESSGRSGSFLYQVSTHEQSESTHGQSAPSTGGRQGSHYDQAQDSSRHSASQEGQDTIRGHPGPSRGGRQGSHQEQSVDRSGHSGSHHSHTTSQGRSDASRGQSGSRSASRKTYDKEQSGDGSRHSGSHHHEASTQADSSRHSQSGQGQSAGPRTSRNQGSSVSQDSDSQGHSEDSERWSGSASRNHRGSAQEQSRDGSRHPRSHHEDRAGHGHSAESSRQSGTHHAENSSGGQAASSHEQARSSAGERHGSHHQQSADSSRHSGIGHGQASSAVRDSGHRGSSGSQASDSEGHSEDSDTQSVSAHGQAGPHQQSHQESTRGRSAGRSGRSGSFLYQVSTHEQSESAHGRAGPSTGGRQGSRHEQARDSSRHSASQEGQDTIRGHPGSRRGGRQGSYHEQSVDRSGHSGSHHSHTTSQGRSDASHGQSGSRSASRETRNEEQSGDGSRHSGSRHHEASTQADSSRHSQSGQGESAGSRRSRRQGSSVSQDSDSEAYPEDSERRSESASRNHHGSSREQSRDGSRHPGSSHRDTASHVQSSPVQSDSSTAKEHGHFSSLSQDSAYHSGIQSRGSPHSSSSYHYQSEGTERQKGQSGLVWRHGSYGSADYDYGESGFRHSQHGSVSYNSNPVVFKERSDICKASAFGKDHPRYYATYINKDPGLCGHSSDISKQLGFSQSQRYYYYE

SEQ ID NO: 910579 - protein, 347 aa, Homo sapiens
MESPASSQPASMPQSKGKSKRKKDLRISCMSKPPAPNPTPPRNLDSRTFITIGDRNFEVEADDLVTISELGRGAYGVVEKVRHAQSGTIMAVKRIRATVNSQEQKRLLMDLDINMRTVDCFYTVTFYGALFREGDVWICMELMDTSLDKFYRKVLDKNMTIPEDILGEIAVSIVRALEHLHSKLSVIHRDVKPSNVLINKEGHVKMCDFGISGYLVDSVAKTMDAGCKPYMAPERINPELNQKGYNVKSDVWSLGITMIEMAILRFPYESWGTPFQQLKQVVEEPSPQLPADRFSPEFVDFTAQCLRKNPAERMSYLELMEHPFFTLHKTKKTDIAAFVKEILGEDS

SEQ ID NO: 910580 - protein, 430 aa, Homo sapiens
AGNGLADLEPGPRGDLWSTAYDPGARPVDAEASPYTTQACEERGPHPSSPYVQVPLTERLVISMVTIYGPQQVPICAVNPVLSTYADVILLRPAALCGAGKSKRKKDLRISCMSKPPAPNPTPPRNLDSRTFITIGDRNFEVEADDLVTISELGRGAYGVVEKVRHAQSGTIMAVKRIRATVNSQEQKRLLMDLDINMRTVDCFYTVTFYGALFREGDVWICMELMDTSLDKFYRKVLDKNMTIPEDILGEIAVSIVRALEHLHSKLSVIHRDVKPSNVLINKEGHVKMCDFGISGYLVDSVAKTMDAGCKPYMAPERINPELNQKGYNVKSDVWSLGITMIEMAILRFPYESWGTPFQQLKQVVEEPSPQLPADRFSPEFVDFTAQCLRKNPAERMSYLELMEHPFFTLHKTKKTDIAAFVKEILGEDS

SEQ ID NO: 910581 - protein, 413 aa, Homo sapiens
RPGQRRLPAAGGCRGQSIYHPGLRGAWSPPIQPICASALDREAGHIHGDHLWATTGPHLRSEPCAEHLADVILLRPAALCGAGKSKRKKDLRISCMSKPPAPNPTPPRNLDSRTFITIGDRNFEVEADDLVTISELGRGAYGVVEKVRHAQSGTIMAVKRIRATVNSQEQKRLLMDLDINMRTVDCFYTVTFYGALFREGDVWICMELMDTSLDKFYRKVLDKNMTIPEDILGEIAVSIVRALEHLHSKLSVIHRDVKPSNVLINKEGHVKMCDFGISGYLVDSVAKTMDAGCKPYMAPERINPELNQKGYNVKSDVWSLGITMIEMAILRFPYESWGTPFQQLKQVVEEPSPQLPADRFSPEFVDFTAQCLRKNPAERMSYLELMEHPFFTLHKTKKTDIAAFVKEILGEDS

SEQ ID NO: 910582 - protein, 108 aa, Homo sapiens
WRIRHEDVMSDVWSLGITMIEMAILRFPYESWGTPFQQLKQVVEEPSPQLPADRFSPEFVDFTAQCLRKNPAERMSYLELMEHPFFTLHKTKKTDIAAFVKEILGEDS

SEQ ID NO: 910583 - protein, 347 aa, Homo sapiens; identical to SEQ ID NO: 910579

SEQ ID NO: 910584 - protein, 347 aa, Homo sapiens; identical to SEQ ID NO: 910579

SEQ ID NO: 910585 - protein, 265 aa, Homo sapiens
MESPASSQPASMPQSKGKSKRKKDLRISCMSKPPAPNPTPPRNLDSRTFITIGDRNFEVEADDLVTISELGRGAYGVVEKVRHAQSGTIMAVKRIRATVNSQEQKRLLMDLDINMRTVDCFYTVTFYGALFREGDVWICMELMDTSLDKFYRKVLDKNMTIPEDILGEIAVSIVRALEHLHSKLSVIHRDVKPSNVLINKEGHVKMCDFGISGYLVDSVAKTMDAGCKPYMAPERINPELNQKGYNVKSDVWSLGITMPGGDGVS

SEQ ID NO: 910586 - protein, 347 aa, Homo sapiens; identical to SEQ ID NO: 910579

SEQ ID NO: 910587 - protein, 124 aa, Homo sapiens
MALVPGWVGAPNPRSWVQSVVVSGAGASDPLSPLQIEMAILRFPYESWGTPFQQLKQVVEEPSPQLPADRFSPEFVDFTAQCLRKNPAERMSYLELMEHPFFTLHKTKKTDIAAFVKEILGEDS

SEQ ID NO: 910588 - protein, 347 aa, Homo sapiens; identical to SEQ ID NO: 910579

SEQ ID NO: 910589 - protein, 388 aa, Homo sapiens
MESPASSQPASMPQSKGKSKRKKDLRISCMSKPPAPNPTPPRNLDSRTFITIGDRNFEVEADDLVTISELGRGAYGVVEKVRHAQSGTIMAVKRIRATVNSQEQKRLLMDLDINMRTVDCFYTVTFYGALFREGDVWICMELMDTSLDKFYRKVLDKNMTIPEDILGEIAVSIVRALEHLHSKLSVIHRDVKPSNVLINKEGHVKMCDFGISGYLVDSVAKTMDAGCKPYMAPERINPELNQKGYNVKSDVWSLGITMIEMAILRFPYESWGTPFQQLKQVVEEPSPQLPADRFSPEFVDFTAQCLRKNPAERMSYLELMLIASPPPPRVPAGRALPSAQAGVQWEGPKISAQRSAGGAFQLTLPEDWLDRGYGFALVLFLKKENIFF

SEQ ID NO: 910590 - protein, 114 aa, Homo sapiens
MTCKMSQLERNIETIINTFHQYSVKLGHPDTLNQGEFKELVRKDLQNFLKKENKNEKVIEHIMEDLDTNADKQLSFEEFIMLMARLTWASHEKMHEGDEGPGHHHKPGLGEGTP

SEQ ID NO: 910591 - protein, 108 aa, Homo sapiens
VSSSSFVNPNCGDAALRPATAPASPQFGLTREDGSMGYSNQGEDLSSWSPAPRRSECPVIQGRCSQLHRTTGSRNCSIEHLLFVGPCSGQRDVVVNGEPTIPVEGDTQ

SEQ ID NO: 910592 - protein, 114 aa, Homo sapiens; identical to SEQ ID NO: 910590

SEQ ID NO: 910593 - protein, 114 aa, Homo sapiens; identical to SEQ ID NO: 910590

SEQ ID NO: 910594 - protein, 144 aa, Homo sapiens
MSLLRGSSSCCGALGHPPLGIVLLLTHLHLHGRRFIINRLRFHELKVSADEDCLLNPMEVVPEQGEFKELVRKDLQNFLKKENKNEKVIEHIMEDLDTNADKQLSFEEFIMLMARLTWASHEKMHEGDEGPGHHHKPGLGEGTP

SEQ ID NO: 910595 - protein, 182 aa, Homo sapiens
MTCKMSQLERNIETIINTFHQYSVKLGHPDTLNQGEFKELVRKDLQNFLKKENKNEKVIEHIMEDLDTNADKQLSFEEFIMLMVTQLLYNFLNISSVPLVSEHLEPVIGVEQRTDPSCIVRRTMFVKPHFSRALRHTLVPVCVAAFVLSACGTQKATSQSTSMKVTRGTISQSISGSGQIEA

SEQ ID NO: 910596 - protein, 146 aa, Homo sapiens [sequence omitted]

SEQ ID NO: 910597 - protein, 93 aa, Homo sapiens
GRLLLLLLLEFKLLTMYGVMVATATATNQEARPPCLYPTRAPGPVMSNCLGCGARGWGQIKSLPPKKKKKKKKKGGGEKKSPGGPSLAAPGFL

SEQ ID NO: 910598 - protein, 114 aa, Homo sapiens; identical to SEQ ID NO: 910590

SEQ ID NO: 910599 - protein, 119 aa, Homo sapiens
REECYRQAIGNGERRIQRTIINTFHQYSVKLGHPDTLNQGEFKELVRKDLQNFLKKENKNEKVIEHIMEDLDTNADKQLSFEEFIMLMARLTWASHEKMHEGDEGPGHHHKPGLGEGTP

SEQ ID NO: 910600 - protein, 104 aa, Homo sapiens
MTCKMSQLERNIETIINTFHQYSVKLGHPDTLNQGEFKELKENKNEKVIEHIMEDLDTNADKQLSFEEFIMLMARLTWASHEKMHEGDEGPGHHHKPGLGEGTP

SEQ ID NO: 910601 - protein, 618 aa, Homo sapiens
PAPLWTPALGALRRPPSERACSRRRPEHPQLRRRGETETDRATGPRGRSISEENMLANSASVRILIKGGKVVNDDCTHEADVYIENGIIQQVGRELMIPGGAKVIDATGKLVIPGGIDTSTHFHQTFMNATCVDDFYHGTKAALVGGTTMIIGHVLPDKETSLVDAYEKCRGLADPKVCCDYALHVGITWWAPKVKAEMETLVREKGVNSFQMFMTYKDLYMLRDSELYQVLHACKDIGAIARVHAENGELVAEGAKEALDLGITGPEGIEISRPEELEAEATHRVITIANRTHCPIYLVNVSSISAGDVIAAAKMQGKVVLAETTTAHATLTGLHYYHQDWSHAAAYVTVPPLRLDTNTSTYLMSLLANDTLNIVASDHRPFTTKQKAMGKEDFTKIPHGVSGVQDRMSVIWERGVVGGKMDENRFVAVTSSNAAKLLNLYPRKGRIIPGADADVVVWDPEATKTISASTQVQGGDFNLYENMRCHGVPLVTISRGRVVYENGVFMCAEGTGKFCPLRSFPDTVYKKLVQREKTLKVRGVDRTPYLGDVAVVVHPGKKEMGTPLADTPTRPVTRHGGMRDLHESSFSLSGSQIDDHVPKRASARILAPPGGRSSGIW

SEQ ID NO: 910602 - protein, 564 aa, Homo sapiens
MLANSASVRILIKGGKVVNDDCTHEADVYIENGIIQQVGRELMIPGGAKVIDATGKLVIPGGIDTSTHFHQTFMNATCVDDFYHGTKAALVGGTTMIIGHVLPDKETSLVDAYEKCRGLADPKVCCDYALHVGITWWAPKVKAEMETLVREKGVNSFQMFMTYKDLYMLRDSELYQVLHACKDIGAIARVHAENGELVAEGAKEALDLGITGPEGIEISRPEELEAEATHRVITIANRTHCPIYLVNVSSISAGDVIAAAKMQGKVVLAETTTAHATLTGLHYYHQDWSHAAAYVTVPPLRLDTNTSTYLMSLLANDTLNIVASDHRPFTTKQKAMGKEDFTKIPHGVSGVQDRMSVIWERGVVGGKMDENRFVAVTSSNAAKLLNLYPRKGRIIPGADADVVVWDPEATKTISASTQVQGGDFNLYENMRCHGVPLVTISRGRVVYENGVFMCAEGTGKFCPLRSFPDTVYKKLVQREKTLKVRGVDRTPYLGDVAVVVHPGKKEMGTPLADTPTRPVTRHGGMRDLHESSFSLSGSQIDDHVPKRASARILAPPGGRSSGIW

SEQ ID NO: 910603 - protein, 618 aa, Homo sapiens; identical to SEQ ID NO: 910601

SEQ ID NO: 910604 - protein, 373 aa, Homo sapiens
PPPLWTPALGALRRPPSERACSRRRPEHPQLRRRGETETDRATGPRGRSISEENMLANSASVRILIKGGKVVNDDCTHEADVYIENGIIQQVGRELMIPGGAKVIDATGKLVIPGGIDTSTHFHQTFMNATCVDDFYHGTKAALVGGTTMIIGHVLPDKETSLVDAYEKCRGLADPKVCCDYALHVGITWWAPKVKAEMETLVREKGVNSFQMFMTYKDLYMLRDSELYQVLHACKDIGAIARVHAENGELVAEGAKEALDLGITGPEGIEISRPEELEAEATHRVITIANRTHCPIYLVNVSSISAGDVIAAAKMQVLGVHSRSLSSRCRDEGFSDTDPEATEPQGNPNPLQLLRRRHSLGSDGASSTPAPR

SEQ ID NO: 910605 - protein, 168 aa, Homo sapiens
PPPLWTPALGALRRPPSERACSRRRPEHPQLRRRGETETDRATGPRGRSISEENMLANSASVRILIKGGKVVNDDCTHEADVYIENGIIQQVGRELMIPGGAKVIDATGKLVIPGGIDTSTHFHQTFMNATCVDDFYHGTKVMLLFAKGGFLFGFFILLLGLLQTRLM

SEQ ID NO: 910606 - protein, 618 aa, Homo sapiens; identical to SEQ ID NO: 910601

SEQ ID NO: 910607 - protein, 564 aa, Homo sapiens; identical to SEQ ID NO: 910602

SEQ ID NO: 910608 - protein, 118 aa, Homo sapiens
MCDKEFMWALKNGDLDEVKDYVAKGEDVNRTLEGGRKPLHYAADCGQLEILEFLLLKGADINAPDKHHITPLLSAVYEGHVSCVKLLLSKGADKTVKGPDGLTAFEATDNQAIKALLQ

SEQ ID NO: 910609 - protein, 118 aa, Homo sapiens; identical to SEQ ID NO: 910608

SEQ ID NO: 910610 - protein, 118 aa, Homo sapiens; identical to SEQ ID NO: 910608

SEQ ID NO: 910611 - protein, 118 aa, Homo sapiens; identical to SEQ ID NO: 910608

SEQ ID NO: 910612 - protein, 118 aa, Homo sapiens; identical to SEQ ID NO: 910608

SEQ ID NO: 910613 - protein, 118 aa, Homo sapiens; identical to SEQ ID NO: 910608

SEQ ID NO: 910614 - protein, 118 aa, Homo sapiens; identical to SEQ ID NO: 910608

SEQ ID NO: 910615 - protein, 118 aa, Homo sapiens; identical to SEQ ID NO: 910608

SEQ ID NO: 910616 - protein, 118 aa, Homo sapiens; identical to SEQ ID NO: 910608

SEQ ID NO: 910617 - protein, 118 aa, Homo sapiens; identical to SEQ ID NO: 910608

SEQ ID NO: 910618 - protein, 166 aa, Homo sapiens
GRRWAFICGPAGREPDPSDLPRRQRFTQRLPAARSWVQLCVHASPEPGGQGVCPGRSERMVIRVFIASSSGFVAIKKKQQDVVRFLEANKIEFEEVDITMSEEQRQWMYKNVPPEKKPTQGNPLPPQIFNGDRYCGDYDSFFESKESNTVFSFLGLKPRLASKAEP

SEQ ID NO: 910619 - protein, 166 aa, Homo sapiens; identical to SEQ ID NO: 910618

SEQ ID NO: 910620 - protein, 184 aa, Homo sapiens
GRRWAFICGPAGREPDPSDLPRRQRFTQRLPAARSWVQLCVHASPEPGGQGVCPGRSERMVIRVFIASSSGFVAIKKKQQDVVRFLEANKIEFEEVDITMSEEQRQWMYKNVPPEKKPTQGNPLPPQIFNGDRYCGDYDSFFESKESNTVFSFLGLKPRLASKVGKSFLILVLEFISFEFFLEM

SEQ ID NO: 910621 - protein, 166 aa, Homo sapiens; identical to SEQ ID NO: 910618

SEQ ID NO: 910622 - protein, 166 aa, Homo sapiens; identical to SEQ ID NO: 910618

SEQ ID NO: 910623 - protein, 166 aa, Homo sapiens; identical to SEQ ID NO: 910618

SEQ ID NO: 910624 - protein, 177 aa, Homo sapiens
IRKGAQLHISCTIKVTHLPQEFPEIIFRKDKRFVAPPDMANKAVYSVMAMVEHSGNYTCKVESSRISKVSSIVVNITELFSKPELESSFTHLDQGERLNLSCSIPGAPPANFTIQKEDTIVSQTQDFLALWFCCIICDVLLFVSFCFFFKEKTKTKWDYVCRCVSVPKSYFLKSLNF

SEQ ID NO: 910625 - protein, 1100 aa, Homo sapiens
MFTLSQTSRAWFIDRARQAREERLVQKERERAAVVIQAHVRSFLCRSRLQRDIRREIDDFFKADDPESTKRSALCIFKIARKLLFLFRIKEDNERFEKLCRSILSSMDAENEPKVWYVSLACSKDLTLLWIQQIKNILWYCCDFLKQLKPEILQDSRLITLYLTMLVTFTDTSTWKILRGKGESLRPAMNHICANIMGHLNQHGFYSVLQILLTRGLARPRPCLSKGTLTAAFSLALRPVIAAQFSDNLIRPFLIHIMSVPALVTHLSTVTPERLTVLESHDMLRKFIIFLRDQDRCRDVCESLEGCHTLCLMGNLLHLGSLSPRVLEEETDGFVSLLTQTLCYCRKYVSQKKSNLTHWHPVLGWFSQSVDYGLNESMHLITKQLQFLWGVPLIRIFFCDILSKKLLESQEPAHAQPASPQNVLPVKSLLKRAFQKSASVRNILRPVGGKRVDSAEVQKVCNICVLYQTSLTTLTQIRLQILTGLTYLDDLLPKLWAFICELGPHGGLKLFLECLNNDTEESKQLLAMLMLFCDCSRHLITILDDIEVYEEQISFKLEELVTISSFLNSFVFKMIWDGIVENAKGETLELFQSVHGWLMVLYERDCRRRFTPEDHWLRKDLKPSVLFQELDRDRKRAQLILQYIPHVIPHKNRVLLFRTMVTKEKEKLGLVETSSASPHVTHITIRRSRMLESLFECPWPLVINAESCWKAVCAEQWMFLTFFKDGYEQLRQLSQHAMKGVIRVKFVNDLGVDEAGIDQDGVFKEFLEEIIKRVFDPALNLFKTTSGDERLYPSPTSYIHENYLQLFEFVGKMLGKAVYEGIVVDVPFASFFLSQLLGHHHSVFYSSVDELPSLDSEFYKNLTSIKRYDGDITDLGLTLSYDEDVMGQLVCHELIPGGKTIPVTNENKISYIHLMAHFRMHTQIKNQTAALISGFRSIIKPEWIRMFSTPELQRLISGDNAEIDLEDLKKHTVYYGGFHGSHRVIIWLWDILASDFTPDERAMFLKFVTSCSRPPLLGFAYLKPPFSIRCVEVSDDQDTGDTLGSVLRGFFTIRKREPGGRLPTSSTCFNLLKLPNYSKKSVLREKLRYAISMNTGFELS

SEQ ID NO: 910626 - protein, 1100 aa, Homo sapiens; identical to SEQ ID NO: 910625

SEQ ID NO: 910627 - protein, 1100 aa, Homo sapiens; identical to SEQ ID NO: 910625

SEQ ID NO: 910628 - protein, 1068 aa, Homo sapiens
MFTLSQTSRAWFIDRARQAREERLVQKERERAAVVIQAHVRSFLCRSRLQRDIRREIDDFFKADDPESTKRSALCIFKIARKLLFLFRIKEDNERFEKLCRSILSSMDAENEPKVWYVSLACSKDLTLLWIQQIKNILWYCCDFLKQLKPEILQDSRLITLYLTMLVTFTDTSTWKILRGKGESLRPAMNHICANIMGHLNQHGFYSVLQILLTRGLARPRPCLSKGTLTAAFSLALRPVIAAQFSDNLIRPFLIHIMSVPALVTHLSTVTPERLTVLESHDMLRKFIIFLRDQDRCRDVCESLEGCHTLCLMGNLLHLGSLSPRVLEEETDGFVSLLTQTLCYCRKYVSQKKSNLTHWHPVLGWFSQSVDYGLNESMHLITKQLQFLWGVPLIRIFFCDILSKKLLESQEPAHAQPASPQNVLPVKSLLKRAFQKSASVRNILRPVGGKRVDSAEVQKVCNICVLYQTSLTTLTQIRLQILTGLTYLDDLLPKLWAFICELGPHGGLKLFLECLNNDTEESKQLLAMLMLFCDCSRHLITILDDIEVYEEQISFKLEELVTISSFLNSFVFKMIWDGIVENAKGETLELFQSVHGWLMVLYERDCRRRFTPEDHWLRKDLKPSVLFQELDRDRKRAQLILQYIPHVIPHKNRVLLFRTMVTKEKEKLGLVETSSASPHVTHITIRRSRMLEDGYEQLRQLSQHAMKGVIRVKFVNDLGVDEAGIDQDGVFKEFLEEIIKRVFDPALNLFKTTSGDERLYPSPTSYIHENYLQLFEFVGKMLGKAVYEGIVVDVPFASFFLSQLLGHHHSVFYSSVDELPSLDSEFYKNLTSIKRYDGDITDLGLTLSYDEDVMGQLVCHELIPGGKTIPVTNENKISYIHLMAHFRMHTQIKNQTAALISGFRSIIKPEWIRMFSTPELQRLISGDNAEIDLEDLKKHTVYYGGFHGSHRVIIWLWDILASDFTPDERAMFLKFVTSCSRPPLLGFAYLKPPFSIRCVEVSDDQDTGDTLGSVLRGFFTIRKREPGGRLPTSSTCFNLLKLPNYSKKSVLREKLRYAISMNTGFELS

SEQ ID NO: 910629 - protein, 850 aa, Homo sapiens
MNIKLISSSDQLKHSFQILLTRGLARPRPCLSKGTLTAAFSLALRPVIAAQFSDNLIRPFLIHIMSVPALVTHLSTVTPERLTVLESHDMLRKFIIFLRDQDRCRDVCESLEGCHTLCLMGNLLHLGSLSPRVLEEETDGFVSLLTQTLCYCRKYVSQKKSNLTHWHPVLGWFSQSVDYGLNESMHLITKQLQFLWGVPLIRIFFCDILSKKLLESQEPAHAQPASPQNVLPVKSLLKRAFQKSASVRNILRPVGGKRVDSAEVQKVCNICVLYQTSLTTLTQIRLQILTGLTYLDDLLPKLWAFICELGPHGGLKLFLECLNNDTEESKQLLAMLMLFCDCSRHLITILDDIEVYEEQISFKLEELVTISSFLNSFVFKMIWDGIVENAKGETLELFQSVHGWLMVLYERDCRRRFTPEDHWLRKDLKPSVLFQELDRDRKRAQLILQYIPHVIPHKNRVLLFRTMVTKEKEKLGLVETSSASPHVTHITIRRSRMLEDGYEQLRQLSQHAMKGVIRVKFVNDLGVDEAGIDQDGVFKEFLEEIIKRVFDPALNLFKTTSGDERLYPSPTSYIHENYLQLFEFVGKMLGKAVYEGIVVDVPFASFFLSQLLGHHHSVFYSSVDELPSLDSEFYKNLTSIKRYDGDITDLGLTLSYDEDVMGQLVCHELIPGGKTIPVTNENKISYIHLMAHFRMHTQIKNQTAALISGFRSIIKPEWIRMFSTPELQRLISGDNAEIDLEDLKKHTVYYGGFHGSHRVIIWLWDILASDFTPDERAMFLKFVTSCSRPPLLGFAYLKPPFSIRCVEVSDDQAVHVQARCFISSLAKGEGKPSGLRSSVCLKPGPLWVLK

SEQ ID NO: 910630 - protein, 829 aa, Homo sapiens
MNIKLISSSDQLKHSFQILLTRGLARPRPCLSKGTLTAAFSLALRPVIAAQFSDNLIRPFLIHIMSVPALVTHLSTVTPERLTVLESHDMLRKFIIFLRDQDRCRDVCESLEGCHTLCLMGNLLHLGSLSPRVLEEETDGFVSLLTQTLCYCRKYVSQKKSNLTHWHPVLGWFSQSVDYGLNESMHLITKQLQFLWGVPLIRIFFCDILSKKLLESQEPAHAQPASPQNVLPVKSLLKRAFQKSASVRNILRPVGGKRVDSAEVQKVCNICVLYQTSLTTLTQIRLQILTGLTYLDDLLPKLWAFICELGPHGGLKLFLECLNNDTEESKQLLAMLMLFCDCSRHLITILDDIEVYEEQISFKLEELVTISSFLNSFVFKMIWDGIVENAKGETLELFQSVHGWLMVLYERDCRRRFTPEDHWLRKDLKPSVLFQELDRDRKRAQLILQYIPHVIPHKNRVLLFRTMVTKEKEKLGLVETSSASPHVTHITIRRSRMLEDGYEQLRQLSQHAMKGVIRVKFVNDLGVDEAGIDQDGVFKEFLEEIIKRVFDPALNLFKTTSGDERLYPSPTSYIHENYLQLFEFVGKMLGKAVYERYDGDITDLGLTLSYDEDVMGQLVCHELIPGGKTIPVTNENKISYIHLMAHFRMHTQIKNQTAALISGFRSIIKPEWIRMFSTPELQRLISGDNAEIDLEDLKKHTVYYGGFHGSHRVIIWLWDILASDFTPDERAMFLKFVTSCSRPPLLGFAYLKPPFSIRCVEVSDDQDTGDTLGSVLRGFFTIRKREPGGRLPTSSTCFNLLKLPNYSKKSVLREKLRYAISMNTGFELS

SEQ ID NO: 910631 - protein, 875 aa, Homo sapiens
MNIKLISSSDQLKHSFQILLTRGLARPRPCLSKGTLTAAFSLALRPVIAAQFSDNLIRPFLIHIMSVPALVTHLSTVTPERLTVLESHDMLRKFIIFLRDQDRCRDVCESLEGCHTLCLMGNLLHLGSLSPRVLEEETDGFVSLLTQTLCYCRKYVSQKKSNLTHWHPVLGWFSQSVDYGLNESMHLITKQLQFLWGVPLIRIFFCDILSKKLLESQEPAHAQPASPQNVLPVKSLLKRAFQKSASVRNILRPVGGKRVDSAEVQKVCNICVLYQTSLTTLTQIRLQILTGLTYLDDLLPKLWAFICELGPHGGLKLFLECLNNDTEESKQLLAMLMLFCDCSRHLITILDDIEVYEEQISFKLEELVTISSFLNSFVFKMIWDGIVENAKGETLELFQSVHGWLMVLYERDCRRRFTPEDHWLRKDLKPSVLFQELDRDRKRAQLILQYIPHVIPHKNRVLLFRTMVTKEKEKLGLVETSSASPHVTHITIRRSRMLEDGYEQLRQLSQHAMKGVIRVKFVNDLGVDEAGIDQDGVFKEFLEEIIKRVFDPALNLFKTTSGDERLYPSPTSYIHENYLQLFEFVGKMLGKAVYEGIVVDVPFASFFLSQLLGHHHSVFYSSVDELPSLDSEFYKNLTSIKRYDGDITDLGLTLSYDEDVMGQLVCHELIPGGKTIPVTNENKISYIHLMAHFRMHTQIKNQTAALISGFRSIIKPEWIRMFSTPELQRLISGDNAEIDLEDLKKHTVYYGGFHGSHRVIIWLWDILASDFTPDERAMFLKFVTSCSRPPLLGFAYLKPPFSIRCVEVSDDQDTGDTLGSVLRGFFTIRKREPGGRLPTSSTCFNLLKLPNYSKKSVLREKLRYAISMNTGFELS

SEQ ID NO: 910632 - protein, 731 aa, Homo sapiens
GGKRVDSAEVQKVCNICVLYQTSLTTLTQIRLQILTGLTYLDDLLPKLWAQLWRPLIRIFFCDILSKKLLESQEPAHAQPASPQNVLPVKSLLKRAFQKSASVRNILRPVGGKRVDSAEVQKVCNICVLYQTSLTTLTQIRLQILTGLTYLDDLLPKLWAFICELGPHGGLKLFLECLNNDTEESKQLLAMLMLFCDCSRHLITILDDIEVYEEQISFKLEELVTISSFLNSFVFKMIWDGIVENAKGETLELFQSVHGWLMVLYERDCRRRFTPEDHWLRKDLKPSVLFQELDRDRKRAQLILQYIPHVIPHKNRVLLFRTMVTKEKEKLGLVETSSASPHVTHITIRRSRMLEDGYEQLRQLSQHAMKGVIRVKFVNDLGVDEAGIDQDGVFKEFLEEIIKRVFDPALNLFKTTSGDERLYPSPTSYIHENYLQLFEFVGKMLGKAVYEGIVVDVPFASFFLSQLLGHHHSVFYSSVDELPSLDSEFYKNLTSIKRYDGDITDLGLTLSYDEDVMGQLVCHELIPGGKTIPVTNENKISYIHLMAHFRMHTQIKNQTAALISGFRSIIKPEWIRMFSTPELQRLISGDNAEIDLEDLKKHTVYYGGFHGSHRVIIWLWDILASDFTPDERAMFLKFVTSCSRPPLLGFAYLKPPFSIRCVEVSDDQDTGDTLGSVLRGFFTIRKREPGGRLPTSSTCFNLLKLPNYSKKSVLREKLRYAISMNTGFELS

SEQ ID NO: 910633 - protein, 691 aa, Homo sapiens
GGKRVDSAEVQKVCNICVLYQTSLTTLTQIRLQILTGLTYLDDLLPKLWAQLWRPLIRIFFCDILSKKLLESQEPAHAQPASPQNVLPVKSLLKRAFQKSASVRNILRPVGGKRVDSAEVQKVCNICVLYQTSLTTLTQIRLQILTGLTYLDDLLPKLWAFICELGPHGGLKLFLECLNNDTEESKQLLAMLMLFCDCSRTSSQNAKGETLELFQSVHGWLMVLYERDCRRRFTPEDHWLRKDLKPSVLFQELDRDRKRAQLILQYIPHVIPHKNRVLLFRTMVTKEKEKLGLVETSSASPHVTHITIRRSRMLEDGYEQLRQLSQHAMKGVIRVKFVNDLGVDEAGIDQDGVFKEFLEEIIKRVFDPALNLFKTTSGDERLYPSPTSYIHENYLQLFEFVGKMLGKAVYEGIVVDVPFASFFLSQLLGHHHSVFYSSVDELPSLDSEFYKNLTSIKRYDGDITDLGLTLSYDEDVMGQLVCHELIPGGKTIPVTNENKISYIHLMAHFRMHTQIKNQTAALISGFRSIIKPEWIRMFSTPELQRLISGDNAEIDLEDLKKHTVYYGGFHGSHRVIIWLWDILASDFTPDERAMFLKFVTSCSRPPLLGFAYLKPPFSIRCVEVSDDQDTGDTLGSVLRGFFTIRKREPGGRLPTSSTCFNLLKLPNYSKKSVLREKLRYAISMNTGFELS

SEQ ID NO: 910634 - protein, 288 aa, Homo sapiens
MLGKAVYEGIVVDVPFASFFLSQLLGHHHSVFYSSVDELPSLDSEFYKNLTSIKRYDGDITDLGLTLSYDEDVMGQLVCHELIPGGKTIPVTNENKISYIHLMAHFRMHTQIKNQTAALISGFRSIIKPEWIRMFSTPELQRLISGDNAEIDLEDLKKHTVYYGGFHGSHRVIIWLWDILASDFTPDERAMFLKFVTSCSRPPLLGFAYLKPPFSIRCVEVSDDQDTGDTLGSVLRGFFTIRKREPGGRLPTSSTCFNLLKLPNYSKKSVLREKLRYAISMNTGFELS

SEQ ID NO: 910635 - protein, 1100 aa, Homo sapiens; identical to SEQ ID NO: 910625

SEQ ID NO: 910636 - protein, 604 aa, Homo sapiens
MNIKLISSSDQLKHSFQILLTRGLARPRPCLSKGTLTAAFSLALRPVIAAQFSDNLIRPFLIHIMSVPALVTHLSTVTPERLTVLESHDMLRKFIIFLRDQDRCRDVCESLEGCHTLCLMGNLLHLGSLSPRVLEEETDGFVSLLTQTLCYCRKYVSQKKSNLTHWHPVLGWFSQSVDYGLNESMHLITKQLQFLWGVPLIRIFFCDILSKKLLESQEPAHAQPASPQNVLPVKSLLKRAFQKSASVRNILRPVGGKRVDSAEVQKVCNICVLYQTSLTTLTQIRLQILTGLTYLDDLLPKLWAFICELGPHGGLKLFLECLNNDTEESKQLLAMLMLFCDCSRHLITILDDIEVYEEQISFKLEELVTISSFLNSFVFKMIWDGIVENAKGETLELFQSVHGWLMVLYERDCRRRFTPEDHWLRKDLKPSVLFQELDRDRKRAQLILQYIPHVIPHKNRVLLFRTMVTKEKEKLGLVETSSASPHVTHITIRRSRMLEDGYEQLRQLSQHAMKGVIRVKFVNDLGVDEAGIDQDGVFKEFLEEIIKRVFDPALNLFKTTSGDERLYPSPTSYIHENYLQLFEFVGKMLGKAVYEVGTLRNREM

SEQ ID NO: 910637 - protein, 244 aa, Homo sapiens
MFTLSQTSRAWFIDRARQAREERLVQKERERAAVVIQAHVRSFLCRSRLQRDIRREIDDFFKADDPESTKRSALCIFKIARKLLFLFRIKEDNERFEKLCRSILSSMDAENEPKVWYVSLACSKDLTLLWIQQIKNILWYCCDFLKQLKPEILQDSRLITLYLTMLVTFTDTSTWKILRGKGESLRPAMNHICANIMGHLNQHGFYSVLQCCDGLFPDLVSYAPHNNPVRWSVGRSWYDWQLSR

SEQ ID NO: 910638 - protein, 296 aa, Homo sapiens
MFTLSQTSRAWFIDRARQAREERLVQKERERAAVVIQAHVRSFLCRSRLQRDIRREIDDFFKADDPESTKRSALCIFKIARKLLFLFRIKEDNERFEKLCRSILSSMDAENEPKVWYVSLACSKDLTLLWIQQIKNILWYCCDFLKQLKPEILQDSRLITLYLTMLVTFTDTSTWKILRGKGESLRPAMNHICANIMGHLNQHGFYSVLQRSVTPAPQCATSPLSNTCTWIFTFAFSIPGVLLRNTFHRKSLMPAVLFFLPLPCLTCGSGKGRTVVLGSLECSTFLAARVIQSFDI

SEQ ID NO: 910639 - protein, 1068 aa, Homo sapiens; identical to SEQ ID NO: 910628

SEQ ID NO: 910640 - protein, 1068 aa, Homo sapiens; identical to SEQ ID NO: 910628

SEQ ID NO: 910641 - protein, 875 aa, Homo sapiens; identical to SEQ ID NO: 910631

SEQ ID NO: 910642 - protein, 875 aa, Homo sapiens; identical to SEQ ID NO: 910631

SEQ ID NO: 910643 - protein, 1100 aa, Homo sapiens; identical to SEQ ID NO: 910625

SEQ ID NO: 910644 - protein, 745 aa, Homo sapiens
MNIKLISSSDQLKHSFQILLTRGLARPRPCLSKGTLTAAFSLALRPVIAAQFSDNLIRPFLIHIMSVPALVTHLSTVTPERLTVLESHDMLRKFIIFLRDQDRCRDVCESLEGCHTLCLMGNLLHLGSLSPRVLEEETDGFVSLLTQTLCYCRKYVSQKKSNLTHWHPVLGWFSQSVDYGLNESMHLITKQLQFLWGVPLIRIFFCDILSKKLLESQEPAHAQPASPQNVLPVKSLLKRAFQKSASVRNILRPVGGKRVDSAEVQKVCNICVLYQTSLTTLTQIRLQILTGLTYLDDLLPKLWAFICELGPHGGLKLFLECLNNDTEESKQLLAMLMLFCDCSRHLITILDDIEVYEEQISFKLEELVTISSFLNSFVFKMIWDGIVENAKGETLELFQSVHGWLMVLYERDCRRRFTPEDHWLRKDLKPSVLFQELDRDRKRAQLILQYIPHVIPHKNRVLLFRTMVTKEKEKLGLVETSSASPHVTHITIRRSRMLEDGYEQLRQLSQHAMKGVIRVKFVNDLGVDEAGIDQDGVFKEFLEEIIKRVFDPALNLFKTTSGDERLYPSPTSYIHENYLQLFEFVGKMLGKAVYEGIVVDVPFASFFLSQLLGHHHSVFYSSVDELPSLDSEFYKNLTSIKRYDGDITDLGLTLSYDEDVMGQLVCHELIPGGKTIPVTNENKISYIHLMAHFRMHTQIKNQTAALISGFRSIIKPEWIRMFSTPELQRLISGDNAEIDLEDLNS

SEQ ID NO: 910645 - protein, 397 aa, Homo sapiens
MPRAARKAVCAEQWMFLTFFKDGYEQLRQLSQHAMKGVIRVKFVNDLGVDEAGIDQDGVFKEFLEEIIKRVFDPALNLFKTTSGDERLYPSPTSYIHENYLQLFEFVGKMLGKAVYEGIVVDVPFASFFLSQLLGHHHSVFYSSVDELPSLDSEFYKNLTSIKRYDGDITDLGLTLSYDEDVMGQLVCHELIPGGKTIPVTNENKISYIHLMAHFRMHTQIKNQTAALISGFRSIIKPEWIRMFSTPELQRLISGDNAEIDLEDLKKHTVYYGGFHGSHRVIIWLWDILASDFTPDERAMFLKFVTSCSRPPLLGFAYLKPPFSIRCVEVSDDQDTGDTLGSVLRGFFTIRKREPGGRLPTSSTCFNLLKLPNYSKKSVLREKLRYAISMNTGFELS

SEQ ID NO: 910646 - protein, 157 aa, Homo sapiens
YLSKAGSWTPQSQVRRAPQFSRQENQPAPERLPTDSALSRQPLSLSFLREGYLEWGWVRAVFSGVWPHQGSRSEAAWEKVREWAQEAGRRRLECYSYPSRLCTSRLAASFPHWPKEKESLQGYGALCVSSLAHCGCSNESPTPHKNPVAASGCSCLS

SEQ ID NO: 910647 - protein, 296 aa, Homo sapiens; identical to SEQ ID NO: 910638

SEQ ID NO: 910648 - protein, 261 aa, Homo sapiens
MFTLSQTSRAWFIDRARQAREERLVQKERERAAVVIQAHVRSFLCRSRLQRDIRREIDDFFKADDPESTKRSALCIFKIARKLLFLFRIKEDNERFEKLCRSILSSMDAENEPKVWYVSLACSKDLTLLWIQQIKNILWYCCDFLKQLKPEILQDSRLITLYLTMLVTFTDTSTWKILRGKGESLRPAMNHICANIMGHLNQHGFYSVLQPATPPSLLPRLSRVNNPSTTPPPPRLPPASQTLATPHAPPAYDEPPPPHHN

SEQ ID NO: 910649 - protein, 191 aa, Homo sapiens
MFTLSQTSRAWFIDRARQAREERLVQKERERAAVVIQAHVRSFLCRSRLQRDIRREIDDFFKADDPESTKRSALCIFKIARKLLFLFRIKEDNERFEKLCRSILSSMDAENEPKVWYVSLACSKDLTLLWIQQIKNILWYCCDFLKQLKPEILQDSRLITLYLTMLVTFTDTSTWKILRGKGLWDLLQNVL

SEQ ID NO: 910650 - protein, 539 aa, Homo sapiens
MVAELAGQQDPGLGAFSCQEARRAWLDRHGNLDEAVEECVRTRRRKVQELQSLGFGPEEGSLQALFQHGGDVSRALTELQRQRLEPFRQRLWDSGPEPTPSWDGPDKQSLVRRLLAVYALPSWGRAELALSLLQETPRNYELGDVVEAVRHSQDRAFLRRLLAQECAVCGWALPHNRMQALTSCECTICPDCFRQHFTIALKEKHITDMVCPACGRPDLTDDTQLLSYFSTLDIQLRESLEPDAYALFHKKLTEGVLMRDPKFLWCAQCSFGFIYEREQLEATCPQCHQTFCVRCKRQWEEQHRGRSCEDFQNWKRMNDPEYQAQGLAMYLQENGIDCPKCKFSYALARGGCMHFHCTQCRHQFCSGCYNAFYAKNKCPEPNCRVKKSLHGHHPRDCLFYLRDWTALRLQKLLQDNNVMFNTEPPAGARAVPGGGCRVIEQKEVPNGLRDEACGKETPAGYAGLCQAHYKEYLVSLINAHSLDPATLYEVEELETATERYLHVRPQPLAGEDPPAYQARLLQKLTEEVPLGQSIPRRRK

SEQ ID NO: 910651 - protein, 1048 aa, Homo sapiens
MPGEEEERAFLVAREELASALRRDSGQAFSLEQLRPLLASSLPLAARYLQLDAARLVRCNAHGEPRNYLNTLSTALNILEKYGRNLLSPQRPRYWRGVKFNNPVFRSTVDAVQGGRDVLRLYGYTEEQPDGLSFPEGQEEPDEHQVATVTLEVLLLRTELSLLLQNTHPRQQALEQLLEDKVEDDMLQLSEFDPLLREIAPGPSPHPLSQALCPACDHLFHGHPSRAHHLRQTLPGVLQGTHLSPSLPASAQPRPQSTSLLALGDSSLSSPNPASAHLPWHCAACAMLNEPWAVLCVACDRPRGCKGLGLGTEGPQGTGGLEPDLARGRWACQSCTFENEAAAVLCSICERPRLAQPPSLVVDSRDAGICLQPLQQGDALLASAQSQVWYCIHCTFCNSSPGWVCVMCNRTSSPIPAQHAPRPYASSLEKGPPKPGPPRRLSAPLPSSCGDPEKQRQDKMREEGLQLVSMIREGEAAGACPEEIFSALQYSGTEVPLQWLRSELPYVLEMVAELAGQQDPGLGAFSCQEARRAWLDRHGNLDEAVEECVRTRRRKVQELQSLGFGPEEGSLQALFQHGGDVSRALTELQRQRLEPFRQRLWDSGPEPTPSWDGPDKQSLVRRLLAVYALPSWGRAELALSLLQETPRNYELGDVVEAVRHSQDRAFLRRLLAQECAVCGWALPHNRMQALTSCECTICPDCFRQHFTIALKEKHITDMVCPACGRPDLTDDTQLLSYFSTLDIQLRESLEPDAYALFHKKLTEGVLMRDPKFLWCAQCSFGFIYEREQLEATCPQCHQTFCVRCKRQWEEQHRGRSCEDFQNWKRMNDPEYQAQGLAMYLQENGIDCPKCKFSYALARGGCMHFHCTQCRHQFCSGCYNAFYAKNKCPEPNCRVKKSLHGHHPRDCLFYLRDWTALRLQKLLQDNNVMFNTEPPAGARAVPGGGCRVIEQKEVPNGLRDEACGKETPAGYAGLCQAHYKEYLVSLINAHSLDPATLYEVEELETATERYLHVRPQPLAGEDPPAYQARLLQKLTEEVPLGQSIPRRRK

SEQ ID NO: 910652 - protein, 762 aa, Homo sapiens [sequence omitted]

SEQ ID NO: 910653 - protein, 962 aa, Homo sapiens
MPGEEEERAFLVAREELASALRRDSGQAFSLEQLRPLLASSLPLAARYLQLDAARLVRCNAHGEPRNYLNTLSTALNILEKYGRNLLSPQRPRYWRGVKFNNPVFRSTVDAVQGGRDVLRLYGYTEEQPDGLSFPEGQEEPDEHQVATVTLEVLLLRTELSLLLQNTHPRQQALEQLLEDKVEDDMLQLSEFDPLLREIAPGPLTTPSVPGSTPGPCFLCGSAPGTLHCPSCKQALCPACDHLFHGHPSRAHHLRQTLPGVLQGTHLSPSLPASAQPRPQSTSLLALGDSSLSSPNPASAHLPWHCAACAMLNEPWAVLCVACDRPRGCKGLGLGTEGPQGTGGLEPDLARGRWACQSCTFENEAAAVLCSICERPRLAQPPSLVVDSRDAGICLQPLQQGDALLASAQSQVWYCIHCTFCNSSPGWVCVMCNRTSSPIPAQHAPRPYASSLEKGPPKPGPPRRLSAPLPSSCGDPEKQRQDKMREEGLQLVSMIREGEAAGACPEEIFSALQYSGTEVPLQWLRSELPYVLEMVAELAGQQDPGLGAFSCQEARRAWLDRHGNLDEAVEECVRTRRRKVQELQSLGFGPEEGSLQALFQHGGDVSRALTELQRQRLEPFRQRLWDSGPEPTPSWDGPDKQSLVRRLLAVYALPSWGRAELALSLLQETPRNYELGDVVEAVRHSQDRAFLRRLLAQECAVCGWALPHNRMQALTSCECTICPDCFRQHFTIALKEKHITDMVCPACGRPDLTDDTQLLSYFSTLDIQLRESLEPDAYALFHKKLTEGVLMRDPKFLWCAQCSFGFIYEREQLEATCPQCHQTFCVRCKRQWEEQHRGRSCEDFQNWKRMNDPEYQAQGLAMYLQENGIDCPKCKFSYALARGGCMHFHCTQCRHQFCSGCYNAFYAKNKCPEPNCRVKKSLHGHHPRDCLFYLRDWTALRLQKLLQSLQLGPGQSLEAAAE

SEQ ID NO: 910654 - protein, 362 aa, Homo sapiens [sequence omitted]

SEQ ID NO: 910655 - protein, 974 aa, Homo sapiens
MPGEEEERAFLVAREELASALRRDSGQAFSLEQLRPLLASSLPLAARYLQLDAARLVRCNAHGEPRNYLNTLSTALNILEKYGRNLLSPQRPRYWRGVKFNNPVFRSTVDAVQGGRDVLRLYGYTEEQPDGLSFPEGQEEPDEHQVATVTLEVLLLRTELSLLLQNTHPRQQALEQLLEDKVEDDMLQLSEFDPLLREIAPGPLTTPSVPGSTPGPCFLCGSAPGTLHCPSCKQALCPACDHLFHGHPSRAHHLRQTLPGVLQGTHLSPSLPASAQPRPQSTSLLALGDSSLSSPNPASAHLPWHCAACAMLNEPWAVLCVACDRPRGCKGLGLGTEGPQGTGGLEPDLARGRWACQSCTFENEAAAVLCSICERPRLAQPPSLVVDSRDAGICLQPLQQGDALLASAQSQVWYCIHCTFCNSSPGWVCVMCNRTSSPIPAQHAPRPYASSLEKGPPKPGPPRRLSAPLPSSCGDPEKQRQDKMREEGLQLVSMIREGEAAGACPEEIFSALQYSGTEVPLQWLRSELPYVLEMVAELAGQQDPGLGAFSCQEARRAWLDRHGNLDEAVEECVRTRRRKVQELQSLGFGPEEGSLQALFQHGGDVSRALTELQRQRLEPFRQRLWDSGPEPTPSWDGPDKQSLVRRLLAVYALPSWGRAELALSLLQETPRNYELGDVVEAVRHSQDRAFLRRLLAQECAVCGWALPHNRMQALTSCECTICPDCFRQHFTIALKEKHITDMVCPACGRPDLTDDTQLLSYFSTLDIQLRESLEPDAYALFHKKLTEGVLMRDPKFLWCAQCSFGFIYEREQLEATCPQCHQTFCVRCKRQWEEQHRGRSCEDFQNWKRMNDPEYQAQGLAMYLQENGIDCPKCKFSYALARGGCMHFHCTQCRHQFCSGCYNAFYAKNKCPEPNCRVKKSLHGHHPRDCLFYLRDWTALRLQKLLQDNNVMFNTEPPAGARAVPGGHTTKSIL

SEQ ID NO: 910656 - protein, 302 aa, Homo sapiens
NLRGLKRVRRPPRVGFNRQKLMPDPYLWCAQCSFGFIYEREQLEATCPQCHQTFCVRCKRQWEEQHRGRSCEDFQNWKRMNDPEYQAQGLAMYLQENGIDCPKCKFSYALARGGCMHFHCTQCRHQFCSGCYNAFYAKNKCPEPNCRVKKSLHGHHPRDCLFYLRDWTALRLQKLLQDNNVMFNTEPPAGARAVPGGGCRVIEQKEVPNGLRDEACGKETPAGYAGLCQAHYKEYLVSLINAHSLDPATLYEVEELETATERYLHVRPQPLAGEDPPAYQARLLQKLTEEVPLGQSIPRRRK

SEQ ID NO: 910657 - protein, 1034 aa, Homo sapiens
MPGEEEERAFLVAREELASALRRDSGQAFSLEQLRPLLASSLPLAARYLQLDAARLVRCNAHGEPRNYLNTLSTALNILEKYGRNLLSPQRPRYWRGVKFNNPVFRSTVDAVQGGRDVLRLYGYTEEQPDGLSFPEGQEEPDEHQVATVTLEVLLLRTELSLLLQNTHPRQQALEQLLEDKVEDDMLQLSEFDPLLREIAPGPLTTPSVPGSTPGPCFLCGSAPGTLHCPSCKQALCPACDHLFHGHPSRAHHLRQTLPGVLQGTHLSPSLPASAQPRPQSTSLLALGDSSLSSPNPASAHLPWHCAACAMLNEPWAVLCVACDRPRGCKGLGLGTEGPQGTGGLEPDLARGRWACQSCTFENEAAAVLCSICERPRLAQPPSLVVDSRDAGICLQPLQQGDALLASAQSQVWYCIHCTFCNSSPGWVCVMCNRTSSPIPAQHAPRPYASSLEKGPPKPGPPRRLSAPLPSSCGDPEKQRQDKMREEGLQLVSMIREGEAAGACPEEIFSALQYSGTEVPLQWLRSELPYVLEMVAELAGQQDPGLGAFSCQEARRAWLDRHGNLDEAVEECVRTRRRKVQELQSLGFGPEEGSLQALFQHGGDVSRALTELQRQRLEPFRQRLWDSGPEPTPSWDGPDKQSLVRRLLAVYALPSWGRAELALSLLQETPRNYELGDVVEAVRHSQDRAFLRRLLAQECAVCGWALPHNRMQALTSCECTICPDCFRQHFTIALKEKHITDMVCPACGRPDLTDDTQLLSYFSTLDIQLRESLEPDAYALFHKKLTEGVLMRDPKFLWCAQCSFGFIYEREQLEATCPQCHQTFCVRCKRQWEEQHRGRSCEDFQNWKRMNDPEYQAQGLAMYLQENGIDCPKCKFSYALARGGCMHFHCTQCRHQFCSGCYNAFYAKNDNNVMFNTEPPAGARAVPGGGCRVIEQKEVPNGLRDEACGKETPAGYAGLCQAHYKEYLVSLINAHSLDPATLYEVEELETATERYLHVRPQPLAGEDPPAYQARLLQKLTEEVPLGQSIPRRRK

SEQ ID NO: 910658 - protein, 116 aa, Homo sapiens
SRQCGHRWVVNLVRPGVSESSYVRHTQLILANTTNILLPFLPRAHYKEYLVSLINAHSLDPATLYEVEELETATERYLHVRPQPLAGEDPPAYQARLLQKLTEEVPLGQSIPRRRK

SEQ ID NO: 910659 - protein, 131 aa, Homo sapiens
GLGTEGPQGTGGLEPDLARGRWACQSCTFENEAAAVLCSICERPRLAQPPSLVVDSRDAGICLQPLQVTGLPSSLSCVTSGILFPIPCFPSVPPNSLYFCCELQPASQRDNSLCLPSRGMLCWPLPRVKSG

SEQ ID NO: 910660 - protein, 1072 aa, Homo sapiens
MPGEEEERAFLVAREELASALRRDSGQAFSLEQLRPLLASSLPLAARYLQLDAARLVRCNAHGEPRNYLNTLSTALNILEKYGRNLLSPQRPRYWRGVKFNNPVFRSTVDAVQGGRDVLRLYGYTEEQPDGLSFPEGQEEPDEHQVATVTLEVLLLRTELSLLLQNTHPRQQALEQLLEDKVEDDMLQLSEFDPLLREIAPGPLTTPSVPGSTPGPCFLCGSAPGTLHCPSCKQALCPACDHLFHGHPSRAHHLRQTLPGVLQGTHLSPSLPASAQPRPQSTSLLALGDSSLSSPNPASAHLPWHCAACAMLNEPWAVLCVACDRPRGCKGLGLGTEGPQGTGGLEPDLARGRWACQSCTFENEAAAVLCSICERPRLAQPPSLVVDSRDAGICLQPLQQGDALLASAQSQVWYCIHCTFCNSSPGWVCVMCNRTSSPIPAQHAPRPYASSLEKGPPKPGPPRRLSAPLPSSCGDPEKQRQDKMREEGLQLVSMIREGEAAGACPEEIFSALQYSGTEVPLQWLRSELPYVLEMVAELAGQQDPGLGAFSCQEARRAWLDRHGNLDEAVEECVRTRRRKVQELQSLGFGPEEGSLQALFQHGGDVSRALTELQRQRLEPFRQRLWDSGPEPTPSWDGPDKQSLVRRLLAVYALPSWGRAELALSLLQETPRNYELGDVVEAVRHSQDRAFLRRLLAQECAVCGWALPHNRMQALTSCECTICPDCFRQHFTIALKEKHITDMVCPACGRPDLTDDTQLLSYFSTLDIQLRESLEPDAYALFHKKLTEGVLMRDPKFLWCAQCSFGFIYEREQLEATCPQCHQTFCVRCKRQWEEQHRGRSCEDFQNWKRMNDPEYQAQGLAMYLQENGIDCPKCKFSYALARGGCMHFHCTQCRHQFCSGCYNAFYAKNKCPEPNCRVKKSLHGHHPRDCLFYLRDWTALRLQKLLQDNNVMFNTEPPAGARAVPGGGCRVIEQKEVPNGLRDEACGKETPAGYAGLCQAHYKEYLVSLINAHSLDPATLYEVEELETATERYLHVRPQPLAGEDPPAYQARLLQKLTEEVPLGQSIPRRRK

SEQ ID NO: 910661 - protein, 353 aa, Homo sapiens
MQALTSCECTICPDCFRQHFTIALKEKHITDMVCPACGRPDLTDDTQLLSYFSTLDIQLRESLEPDAYALFHKKLTEGVLMRDPKFLWCAQCSFGFIYEREQLEATCPQCHQTFCVRCKRQCEDFQNWKRMNDPEYQAQGLAMYLQENGIDCPKCKFSYALARGGCMHFHCTQCRHQFCSGCYNAFYAKNKCPEPNCRVKKSLHGHHPRDCLFYLRDWTALRLQKLLQDNNVMFNTEPPAGARAVPGGGCRVIEQKEVPNGLRDEACGKETPAGYAGLCQAHYKEYLVSLINAHSLDPATLYEVEELETATERYLHVRPQPLAGEDPPAYQARLLQKLTEEVPLGQSIPRRRK

SEQ ID NO: 910662 - protein, 518 aa, Homo sapiens
MAWIVMAALIVLLCHGVCEDQSKEAVQELQSLGFGPEEGSLQALFQHGGDVSRALTELQRQRLEPFRQRLWDSGPEPTPSWDGPDKQSLVRRLLAVYALPSWGRAELALSLLQETPRNYELGDVVEAVRHSQDRAFLRRLLAQECAVCGWALPHNRMQALTSCECTICPDCFRQHFTIALKEKHITDMVCPACGRPDLTDDTQLLSYFSTLDIQLRESLEPDAYALFHKKLTEGVLMRDPKFLWCAQCSFGFIYEREQLEATCPQCHQTFCVRCKRQWEEQHRGRSCEDFQNWKRMNDPEYQAQGLAMYLQENGIDCPKCKFSYALARGGCMHFHCTQCRHQFCSGCYNAFYAKNKCPEPNCRVKKSLHGHHPRDCLFYLRDWTALRLQKLLQDNNVMFNTEPPAGARAVPGGGCRVIEQKEVPNGLRDEACGKETPAGYAGLCQAHYKEYLVSLINAHSLDPATLYEVEELETATERYLHVRPQPLAGEDPPAYQARLLQKLTEEVPLGQSIPRRRK

SEQ ID NO: 910663 - protein, 376 aa, Homo sapiens
MPGEEEERAFLVAREELASALRRDSGQAFSLEQLRPLLASSLPLAARYPACGRPDLTDDTQLLSYFSTLDIQLRESLEPDAYALFHKKLTEGVLMRDPKFLWCAQCSFGFIYEREQLEATCPQCHQTFCVRCKRQWEEQHRGRSCEDFQNWKRMNDPEYQAQGLAMYLQENGIDCPKCKFSYALARGGCMHFHCTQCRHQFCSGCYNAFYAKNKCPEPNCRVKKSLHGHHPRDCLFYLRDWTALRLQKLLQDNNVMFNTEPPAGARAVPGGGCRVIEQKEVPNGLRDEACGKETPAGYAGLCQAHYKEYLVSLINAHSLDPATLYEVEELETATERYLHVRPQPLAGEDPPAYQARLLQKLTEEVPLGQSIPRRRK

SEQ ID NO: 910664 - protein, 181 aa, Homo sapiens
LQDLTIHQRCYNAFYAKNKCPEPNCRVKKSLHGHHPRDCLFYLRDWTALRLQKLLQDNNVMFNTEPPAGARAVPGGGCRVIEQKEVPNGLRDEACGKETPAGYAGLCQAHYKEYLVSLINAHSLDPATLYEVEELETATERYLHVRPQPLAGEDPPAYQARLLQKLTEEVPLGQSIPRRRK

SEQ ID NO: 910665 - protein, 98 aa, Homo sapiens
LSLGSRLRDEACGKETPAGYAGLCQAHYKEYLVSLINAHSLDPATLYEVEELETATERYLHVRPQPLAGEDPPAYQARLLQKLTEEVPLGQSIPRRRK

SEQ ID NO: 910666 - protein, 736 aa, Homo sapiens
MPGEEEERAFLVAREELASALRRDSGQAFSLEQLRPLLASSLPLAARYLQLDAARLVRCNAHGEPRNYLNTLSTALNILEKYGRNLLSPQRPRYWRGVKFNNPVFRSTVDAVQGGRDVLRLYGYTEEQPDGLSFPEGQEEPDEHQVATVTLEVLLLRTELSLLLQNTHPRQQALEQLLEDKVEDDMLQLSEFDPLLREIAPGPLTTPSVPGSTPGPCFLCGSAPGTLHCPSCKQALCPACDHLFHGHPSRAHHLRQTLPGVLQGTHLSPSLPASAQPRPQSTSLLALGDSSLSSPNPASAHLPWHCAACAMLNEPWAVLCVACDRPRGCKGLGLGTEGPQGTGGLEPDLARGRWACQSCTFENEAAAVLCSICERPRLAQPPSLVVDSRDAGICLQPLQQGDALLASAQSQVWYCIHCTFCNSSPGWVCVMCNRTSSPIPAQHAPRPYASSLEKGPPKPGPPRRLSAPLPSSCGDPEKQRQDKMREEGLQLVSMIREGEAAGACPEEIFSALQYSGTEVPLQWLRSELPYVLEMVAELAGQQDPGLGAFSCQEARRAWLDRHGNLDEAVEECVRTRRRKVQELQSLGFGPEEGSLQALFQHGGDVSRALTELQRQRLEPFRQRLWDSGPEPTPSWDGPDKQSLVRRLLAVYALPSWGRAELALSLLQETPRNYELGDVVEAVRHSQDRAFLRRLLAQECAVCGWALPHNRVSPSPRYLVQELLYSFGPPSYPSLHL

SEQ ID NO: 910667 - protein, 157 aa, Homo sapiens [sequence omitted]

SEQ ID NO: 910668 - protein, 157 aa, Homo sapiens [sequence omitted]

SEQ ID NO: 910669 - protein, 157 aa, Homo sapiens [sequence omitted]

SEQ ID NO: 910670 - protein, 157 aa, Homo sapiens [sequence omitted]

SEQ ID NO: 910671 - protein, 157 aa, Homo sapiens [sequence omitted]

SEQ ID NO: 910672 - protein, 137 aa, Homo sapiens
MQKLLKCSRLVLALALILVLESSVQGYPTQRARYQWVRCNPDSNSANCLEEKGPIKTRIQDLNRIFPLSEDYSGSGFGSGSGSGSGSGSGFLTEMEQDYQLVDESDAFHDNLRSLDRNLPSDSQDLGQHGLEEDFML

SEQ ID NO: 910673 - protein, 157 aa, Homo sapiens [sequence omitted]

SEQ ID NO: 910674 - protein, 139 aa, Homo sapiens
MHAPLLVLALALILVLESSVQGYPTQRARYQWVRCNPDSNSANCLEEKGPMFELLPGESNKIPRLRTDLFPKTRIQDLNRIFPLSEDYSGSGFGSGSGSGSGSGSGFLTSTHLPKNPPLHTTHLSATRLSNDTILPSSP

SEQ ID NO: 910675 - protein, 157 aa, Homo sapiens [sequence omitted]

SEQ ID NO: 910676 - protein, 157 aa, Homo sapiens [sequence omitted]

SEQ ID NO: 910677 - protein, 181 aa, Homo sapiens
RAIRWSRGTSYSSCRRHVRALAHILLQYCSGFTGHSTNTTTAGIPDAVADMPQSKIDNSRGDTLTWNQYKEPSAIRQTTCTSAELPTTRIRRLRTDLFPKTRIQDLNRIFPLSEDYSGSGFGSGSGSGSGSGSGFLTEMEQDYQLVDESDAFHDNLRSLDRNLPSDSQDLGQHGLEEDFML

SEQ ID NO: 910678 - protein, 157 aa, Homo sapiens [sequence omitted]

SEQ ID NO: 910679 - protein, 72 aa, Homo sapiens
PAFRELKRVPRSFISGLCMRSIVPCHSPLSSGQVEDWPEGLHMQTPVPAFRELKRVPRSFISGPGPQIHARE

SEQ ID NO: 910680 - protein, 456 aa, Homo sapiens
MTTTFLQTSSSTFGGGSTRGGSLLAGGGGFGGGSLSGGGGSRSISASSARFVSSGSGGGYGGGMRVCGFGGGAGSVFGGGFGGGVGGGFGGGFGGGDGGLLSGNEKITMQNLNDRLASYLDKVRALEEANADLEVKIHDWYQKQTPASPECDYSQYFKTIEELRDKIMATTIDNSRVILEIDNARLAADDFRLKYENELALRQGVEADINGLRRVLDELTLARTDLEMQIEGLNEELAYLKKNHEEEMKEFSSQLAGQVNVEMDAAPGVDLTRVLAEMREQYEAMAEKNRRDVEAWFFSKTEELNKEVASNTEMIQTSKTEITDLRRTMQELEIELQSQLSMKAGLENSLAETECRYATQLQQIQGLIGGLEAQLSELRCEMEAQNQEYKMLLDIKTRLEQEIATYRSLLEGQDAKMAGIGIREASSGGGGSSSNFHINVEESVDGQVVSSHKREI

SEQ ID NO: 910681 - protein, 289 aa, Homo sapiens [sequence omitted]

SEQ ID NO: 910682 - protein, 432 aa, Homo sapiens
MTTTFLQTSSSTFGGGSTRGGSLLAGGGGFGGGSLSGGGGSRSISASSARFVSSGSGGGYGGGMRVCGFGGGAGSVFGGGFGGGVGGGFGGGFGGGDGGLLSGNEKITMQNLNDRLASYLDKVRALEEANADLEVKIHDWYQKQTPASPECDYSQYFKTIEELRDKIMATTIDNSRVILEIDNARLAADDFRLKYENELALRQGVEADINGLRRVLDELTLARTDLEMQIEGLNEELAYLKKNHEEEMKEFSSQLAGQVNVEMDAAPGVDLTRVLAEMREQYEAMAEKNRRDVEAWFFSKTEELNKEVASNTEMIQTSKTEITDLRRTMQELEIELQSQLSMKAGLENSLAETECRYATQLQQIQGLIGGLEAQLSELRCEMEAQNQEYKMLLDIKTRLEQEIATYRSLLEGQDAKMAGIGIREGVMRAACG

SEQ ID NO: 910683 - protein, 456 aa, Homo sapiens; identical to SEQ ID NO: 910680

SEQ ID NO: 910684 - protein, 359 aa, Homo sapiens
MSCPQWGWWSVSERAIVRAGCTPLPHSPGQPIPTGNTASLVFRALEIRKAAPQVSQGGWMGQNKKWTLKIMATTIDNSRVILEIDNARLAADDFRLKYENELALRQGVEADINGLRRVLDELTLARTDLEMQIEGLNEELAYLKKNHEEEMKEFSSQLAGQVNVEMDAAPGVDLTRVLAEMREQYEAMAEKNRRDVEAWFFSKTEELNKEVASNTEMIQTSKTEITDLRRTMQELEIELQSQLSMKAGLENSLAETECRYATQLQQIQGLIGGLEAQLSELRCEMEAQNQEYKMLLDIKTRLEQEIATYRSLLEGQDAKMAGIGIREASSGGGGSSSNFHINVEESVDGQVVSSHKREI

SEQ ID NO: 910685 - protein, 432 aa, Homo sapiens; identical to SEQ ID NO: 910682

SEQ ID NO: 910686 - protein, 495 aa, Homo sapiens
MTTTFLQTSSSTFGGGSTRGGSLLAGGGGFGGGSLSGGGGSRSISASSARFVSSGSGGGYGGGMRVCGFGGGAGSVFGGGFGGGVGGGFGGGFGGGDGGLLSGNEKITMQNLNDRLASYLDKVRALEEANADLEVKIHDWYQKQTPASPECDYSQYFKTIEELRDKIMATTIDNSRVILEIDNARLAADDFRLKCAPPSLSSSCIAHFTWPSPGSDSGSQDPSHFLLWPPSLRYENELALRQGVEADINGLRRVLDELTLARTDLEMQIEGLNEELAYLKKNHEEEMKEFSSQLAGQVNVEMDAAPGVDLTRVLAEMREQYEAMAEKNRRDVEAWFFSKTEELNKEVASNTEMIQTSKTEITDLRRTMQELEIELQSQLSMKAGLENSLAETECRYATQLQQIQGLIGGLEAQLSELRCEMEAQNQEYKMLLDIKTRLEQEIATYRSLLEGQDAKMAGIGIREASSGGGGSSSNFHINVEESVDGQVVSSHKREI

SEQ ID NO: 910687 - protein, 270 aa, Homo sapiens
MTTTFLQTSSSTFGGGSTRGGSLLAGGGGFGGGSLSGGGGSRSISASSARFVSSGSGGGYGGGMRVCGFGGGAGSVFGGGFGGGVGGGFGGGFGGGDGGLLSGNEKITMQNLNDRLASYLDKVRALEEANADLEVKIHDWYQKQTPASPECDYSQYFKTIEELRDKIMATTIDNSRVILEIDNARLAADDFRLKYENELALRQGVEADINGLRRVLDELTLARTDLEMQIEGLNEELAYLKKNHEESHQAKWRTGQRACTCKLQSLPSES

SEQ ID NO: 910688 - protein, 281 aa, Homo sapiens
MTTTFLQTSSSTFGGGSTRGGSLLAGGGGFGGGSLSGGGGSRSISASSARFVSSGSGGGYGGGMRVCGFGGGAGSVFGGGFGGGVGGGFGGGFGGGDGGLLSGNEKITMQNLNDRLASYLDKVRALEEANADLEVKIHDWYQKQTPASPECDYSQYFKTIEELRDKIMATTIDNSRVILEIDNARLAADDFRLKYENELALRQGVEADINGLRRVLDELTLARTDLEMQIWPEGLHMQTPVPAFRELKRVPRSFISGLCMRSIPPLPLPTFFGARRCSCIV

SEQ ID NO: 910689 - protein, 66 aa, Homo sapiens
MATTIDNSRVILEIDNARLAADDFRLKCAPPSLSSSCIAHFTWPSPGSDSGSQDPSHFLLWPPSPQ

SEQ ID NO: 910690 - protein, 456 aa, Homo sapiens; identical to SEQ ID NO: 910680

SEQ ID NO: 910691 - protein, 289 aa, Homo sapiens [sequence omitted]

SEQ ID NO: 910692 - protein, 383 aa, Homo sapiens
MGANLALLSSDMPLLEKAGASWNLPQPYQRRFAPNIPETSKGSAPCSWQVRALEEANADLEVKIHDWYQKQTPASPECDYSQYFKTIEELRDKIMATTIDNSRVILEIDNARLAADDFRLKYENELALRQGVEADINGLRRVLDELTLARTDLEMQIEGLNEELAYLKKNHEEEMKEFSSQLAGQVNVEMDAAPGVDLTRVLAEMREQYEAMAEKNRRDVEAWFFSKTEELNKEVASNTEMIQTSKTEITDLRRTMQELEIELQSQLSMKAGLENSLAETECRYATQLQQIQGLIGGLEAQLSELRCEMEAQNQEYKMLLDIKTRLEQEIATYRSLLEGQDAKMAGIGIREASSGGGGSSSNFHINVEESVDGQVVSSHKREI

SEQ ID NO: 910693 - protein, 456 aa, Homo sapiens; identical to SEQ ID NO: 910680

SEQ ID NO: 910694 - protein, 299 aa, Homo sapiens
MKARADLATIMATTIDNSRVILEIDNARLAADDFRLKYENELALRQGVEADINGLRRVLDELTLARTDLEMQIEGLNEELAYLKKNHEEEMKEFSSQLAGQVNVEMDAAPGVDLTRVLAEMREQYEAMAEKNRRDVEAWFFSKTEELNKEVASNTEMIQTSKTEITDLRRTMQELEIELQSQLSMKAGLENSLAETECRYATQLQQIQGLIGGLEAQLSELRCEMEAQNQEYKMLLDIKTRLEQEIATYRSLLEGQDAKMAGIGIREASSGGGGSSSNFHINVEESVDGQVVSSHKREI

SEQ ID NO: 910695 - protein, 432 aa, Homo sapiens; identical to SEQ ID NO: 910682

SEQ ID NO: 910696 - protein, 291 aa, Homo sapiens [sequence omitted]

SEQ ID NO: 910697 - protein, 111 aa, Homo sapiens
MTTTFLQTSSSTFGGGSTRGGSLLAGGGGFGGGSLSGGGGSRSISASSARFVSSGSGGGYGGGMRVCGFGGGAGSVFGGASSGGGGSSSNFHINVEESVDGQVVSSHKREI

SEQ ID NO: 910698 - protein, 485 aa, Homo sapiens
MAAVWQQVLAVDARYNAYRTPTFPQFRTQYIRRRSQLLRENAKAGHPPALRRQYLRLRGQLLGQRYGPLSEPGSARAYSNSIVRSSRTTLDRMEDFEDDPRALGARGHRRSVSRGSYQLQAQMNRAVYEDRPPGSVVPTSAAEASRAMAGDTSLSENYAFAGMYHVFDQHVDEAVPRVRFANDDRHRLACCSLDGSISLCQLVPAPPTVLRVLRGHTRGVSDFAWSLSNDILVSTSLDATMRIWASEDGRCIREIPDPDSAELLCCTFQPVNNNLTVVGNAKHNVHVMNISTGKKVKGGSSKLTGRVLALSFDAPGRLLWAGDDRGSVFSFLFDMATGKLTKAKRLVVHEGSPVTSISARSWVSREARDPSLLINACLNKLLLYRVVDNEGTLQLKRSFPIEQSSHPVRSIFCPLMSFRQGACVVTGSEDMCVHFFDVERAAKAAVNKLQGHSAPVLDVSFNCDESLLASSDASGMVIVWRREQK

SEQ ID NO: 910699 - protein, 551 aa, Homo sapiens
GATNLETETFGFGKPTLQPSCLEPEKGRRDRRNRRQWSQGRSGGPQEPEAAPEAAAGGHARGGGRGMAAVWQQVLAVDARYNAYRTPTFPQFRTQYIRRRSQLLRENAKAGHPPALRRQYLRLRGQLLGQRYGPLSEPGSARAYSNSIVRSSRTTLDRMEDFEDDPRALGARGHRRSVSRGSYQLQAQMNRAVYEDRPPGSVVPTSAAEASRAMAGDTSLSENYAFAGMYHVFDQHVDEAVPRVRFANDDRHRLACCSLDGSISLCQLVPAPPTVLRVLRGHTRGVSDFAWSLSNDILVSTSLDATMRIWASEDGRCIREIPDPDSAELLCCTFQPVNNNLTVVGNAKHNVHVMNISTGKKVKGGSSKLTGRVLALSFDAPGRLLWAGDDRGSVFSFLFDMATGKLTKAKRLVVHEGSPVTSISARSWVSREARDPSLLINACLNKLLLYRVVDNEGTLQLKRSFPIEQSSHPVRSIFCPLMSFRQGACVVTGSEDMCVHFFDVERAAKAAVNKLQGHSAPVLDVSFNCDESLLASSDASGMVIVWRREQK

SEQ ID NO: 910700 - protein, 543 aa, Homo sapiens
GSAVLSDSRQPSCLEPEKGRRDRRNRRQWSQGRSGGPQEPEAAPEAAAGGHARGGGRGMAAVWQQVLAVDARYNAYRTPTFPQFRTQYIRRRSQLLRENAKAGHPPALRRQYLRLRGQLLGQRYGPLSEPGSARAYSNSIVRSSRTTLDRMEDFEDDPRALGARGHRRSVSRGSYQLQAQMNRAVYEDRPPGSVVPTSAAEASRAMAGDTSLSENYAFAGMYHVFDQHVDEAVPRVRFANDDRHRLACCSLDGSISLCQLVPAPPTVLRVLRGHTRGVSDFAWSLSNDILVSTSLDATMRIWASEDGRCIREIPDPDSAELLCCTFQPVNNNLTVVGNAKHNVHVMNISTGKKVKGGSSKLTGRVLALSFDAPGRLLWAGDDRGSVFSFLFDMATGKLTKAKRLVVHEGSPVTSISARSWVSREARDPSLLINACLNKLLLYRVVDNEGTLQLKRSFPIEQSSHPVRSIFCPLMSFRQGACVVTGSEDMCVHFFDVERAAKAAVNKLQGHSAPVLDVSFNCDESLLASSDASGMVIVWRREQK

SEQ ID NO: 910701 - protein, 565 aa, Homo sapiens
RRNKFPGDGNLRLRTHACSHLAWSLRKGGETEGTGDSGLRAAPGGLKNRRQPRRWSPIPGYALGSEKAAAGGHARGGGRGMAAVWQQVLAVDARYNAYRTPTFPQFRTQYIRRRSQLLRENAKAGHPPALRRQYLRLRGQLLGQRYGPLSEPGSARAYSNSIVRSSRTTLDRMEDFEDDPRALGARGHRRSVSRGSYQLQAQMNRAVYEDRPPGSVVPTSAAEASRAMAGDTSLSENYAFAGMYHVFDQHVDEAVPRVRFANDDRHRLACCSLDGSISLCQLVPAPPTVLRVLRGHTRGVSDFAWSLSNDILVSTSLDATMRIWASEDGRCIREIPDPDSAELLCCTFQPVNNNLTVVGNAKHNVHVMNISTGKKVKGGSSKLTGRVLALSFDAPGRLLWAGDDRGSVFSFLFDMATGKLTKAKRLVVHEGSPVTSISARSWVSREARDPSLLINACLNKLLLYRVVDNEGTLQLKRSFPIEQSSHPVRSIFCPLMSFRQGACVVTGSEDMCVHFFDVERAAKAAVNKLQGHSAPVLDVSFNCDESLLASSDASGMVIVWRREQK

SEQ ID NO: 910702 - protein, 393 aa, Homo sapiens
MEDFEDDPRALGARGHRRSVSRGSYQLQAQMNRAVYEDRPPGSVVPTSAAEASRAMAGDTSLSENYAFAGMYHVFDQHVDEAVPRVRFANDDRHRLACCSLDGSISLCQLVPAPPTVLRVLRGHTRGVSDFAWSLSNDILVSTSLDATMRIWASEDGRCIREIPDPDSAELLCCTFQPVNNNLTVVGNAKHNVHVMNISTGKKVKGGSSKLTGRVLALSFDAPGRLLWAGDDRGSVFSFLFDMATGKLTKAKRLVVHEGSPVTSISARSWVSREARDPSLLINACLNKLLLYRVVDNEGTLQLKRSFPIEQSSHPVRSIFCPLMSFRQGACVVTGSEDMCVHFFDVERAAKAAVNKLQGHSAPVLDVSFNCDESLLASSDASGMVIVWRREQK

SEQ ID NO: 910703 - protein, 393 aa, Homo sapiens; identical to SEQ ID NO: 910702

SEQ ID NO: 910704 - protein, 551 aa, Homo sapiens
GSAVLSDSRQPSCLEPEKGRRDRRNRRQWSQGRSGGPQEPEAAPEAAAGGHARGGGRGMAAVWQQVLAVDARYNAYRTPTFPQFRTQYIRRRSQLLRENAKAGHPPALRRQYLRLRGQLLGQRYGPLSEPGSARAYSNSIVRSSRTTLDRMEDFEDDPRALGARGHRRSVSRGSYQLQAQMNRAVYEDRPPGSVVPTSAAEASRAMAGDTSLSENYAFAGMYHVFDQHVDEAVPRVRFANDDRHRLACCSLDGSISLCQLVPAPPTVLRVLRGHTRGVSDFAWSLSNDILVSTSLDATMRIWASEDGRCIREIPDPDSAELLCCTFQPVNNNLTVVRLQDTHTVGNAKHNVHVMNISTGKKVKGGSSKLTGRVLALSFDAPGRLLWAGDDRGSVFSFLFDMATGKLTKAKRLVVHEGSPVTSISARSWVSREARDPSLLINACLNKLLLYRVVDNEGTLQLKRSFPIEQSSHPVRSIFCPLMSFRQGACVVTGSEDMCVHFFDVERAAKAAVNKLQGHSAPVLDVSFNCDESLLASSDASGMVIVWRREQK

SEQ ID NO: 910705 - protein, 393 aa, Homo sapiens; identical to SEQ ID NO: 910702

SEQ ID NO: 910706 - protein, 464 aa, Homo sapiens
GSAVLSDSRQPSCLEPEKGRRDRRNRRQWSQGRSGGPQEPEAAPEAAAGGHARGGGRGMAAVWQQVLAVDARYNAYRTPTFPQFRTQYIRRRSQLLRENAKAGHPPALRRQYLRLRGQLLGQRYGPLSEPGSARAYSNSIVRSSRTTLDRMEDFEDDPRALGARGHRRSVSRGSYQLQAQMNRAVYEDRPPGSVVPTSAAEASRAMAGDTSLSENYAFAGMYHVFDQHVDEAVPRVRFANDDRHRLACCSLDGSISLCQLVPAPPTVLRVLRGHTRGVSDFAWSLSNDILVSTSLDATMRIWASEDGRCIREIPDPDSAELLCCTFQPVNNNLTVVGNAKHNVHVMNISTGKKVKGGSSKLTGRVLALSFDAPGRLLWAGDDRGSVFSFLFDMATGKLTKAKRLVVHEGSPRGGRRGGAGSRAGEGGQGGGLDRGGDNGARQKRGRRGEGEQAGAEEGGGRQGR

SEQ ID NO: 910707 - protein, 433 aa, Homo sapiens
GSAVLSDSRQPSCLEPEKGRRDRRNRRQWSQGRSGGPQEPEAAPEAAAGGHARGGGRGMAAVWQQVLAVDARYNAYRTPTFPQFRTQYIRRRSQLLRENAKAGHPPALRRQYLRLRGQLLGQRYGPLSEPGSARAYSNSIVRSSRTTLDRMEDFEDDPRALGARGHRRSVSRGSYQLQAQMNRAVYEDRPPGSVVPTSAAEASRAMAGDTSLSENYAFAGMYHVFDQHVDEAVPRVRFANDDRHRLACCSLDGSISLCQLVPAPPTVLRVLRGHTRGVSDFAWSLSNDILVSTSLDATMRIWASEDGRCIREIPDPDSAELLCCTFQPVNNNLTVVGNAKHNVHVMNISTGKKVKGGSSKLTGRVLALSFDAPGRLLWAGDDRGSVFSFLFDMATGHACPSQPPARASADALRPSPQPASCPASHPRHPPAHS

SEQ ID NO: 910708 - protein, 404 aa, Homo sapiens
GSAVLSDSRQPSCLEPEKGRRDRRNRRQWSQGRSGGPQEPEAAPEAAAGGHARGGGRGMAAVWQQVLAVDARYNAYRTPTFPQFRTQYIRRRSQLLRENAKAGHPPALRRQYLRLRGQLLGQRYGPLSEPGSARAYSNSIVRSSRTTLDRMEDFEDDPRALGARGHRRSVSRGSYQLQAQMNRAVYEDRPPGSVVPTSAAEASRAMAGDTSLSENYAFAGMYHVFDQHVDEAVPRVRFANDDRHRLACCSLDGSISLCQLVPAPPTVLRVLRGHTRGVSDFAWSLSNDILVSTSLDATMRIWASEDGRCIREIPDPDSAELLCCTFQPVNNNLTVVRTPGHPHMTGSEDMCVHFFDVERAAKAAVNKLQGHSAPVLDVSFNCDESLLASSDASGMVIVWRREQK

SEQ ID NO: 910709 - protein, 217 aa, Homo sapiens
MMVCAFSPQVGNAKHNVHVMNISTGKKVKGGSSKLTGRVLALSFDAPGRLLWAGDDRGSVFSFLFDMATGKLTKAKRLVVHEGSPVTSISARSWVSREARDPSLLINACLNKLLLYRVVDNEGTLQLKRSFPIEQSSHPVRSIFCPLMSFRQGACVVTGSEDMCVHFFDVERAAKAAVNKLQGHSAPVLDVSFNCDESLLASSDASGMVIVWRREQK

SEQ ID NO: 910710 - protein, 58 aa, Homo sapiens
MEDFEDDPRALGARGHRRSVSRGSYQLQAQMNRAVYEDSTLQHVPTSAAAARKDPARS

SEQ ID NO: 910711 - protein, 85 aa, Homo sapiens
PRLVVEIVCCEAEGVGGGMWGGPGLAGTSQPPAPNGVNVVDCFAAVNKLQGHSAPVLDVSFNCDESLLASSDASGMVIVWRREQK

SEQ ID NO: 910712 - protein, 543 aa, Homo sapiens; identical to SEQ ID NO: 910700

SEQ ID NO: 910713 - protein, 393 aa, Homo sapiens; identical to SEQ ID NO: 910702

SEQ ID NO: 910714 - protein, 393 aa, Homo sapiens; identical to SEQ ID NO: 910702

SEQ ID NO: 910715 - protein, 580 aa, Homo sapiens
LSTKEPVVRQFSPHLLRFWWGLRLSTPHLWAIELLSCSMKLAPQQQGVLPPGVWSSRPFHFGVARHKGHEPESVDVLAFVVHAAAGGHARGGGRGMAAVWQQVLAVDARYNAYRTPTFPQFRTQYIRRRSQLLRENAKAGHPPALRRQYLRLRGQLLGQRYGPLSEPGSARAYSNSIVRSSRTTLDRMEDFEDDPRALGARGHRRSVSRGSYQLQAQMNRAVYEDRPPGSVVPTSAAEASRAMAGDTSLSENYAFAGMYHVFDQHVDEAVPRVRFANDDRHRLACCSLDGSISLCQLVPAPPTVLRVLRGHTRGVSDFAWSLSNDILVSTSLDATMRIWASEDGRCIREIPDPDSAELLCCTFQPVNNNLTVVGNAKHNVHVMNISTGKKVKGGSSKLTGRVLALSFDAPGRLLWAGDDRGSVFSFLFDMATGKLTKAKRLVVHEGSPVTSISARSWVSREARDPSLLINACLNKLLLYRVVDNEGTLQLKRSFPIEQSSHPVRSIFCPLMSFRQGACVVTGSEDMCVHFFDVERAAKAAVNKLQGHSAPVLDVSFNCDESLLASSDASGMVIVWRREQK

SEQ ID NO: 910716 - protein, 543 aa, Homo sapiens; identical to SEQ ID NO: 910700

SEQ ID NO: 910717 - protein, 609 aa, Homo sapiens
GSAVLSDSRQPSCLEPEKGRRDRRNRRQWSQGRSGGPQEPEAAPEAAAGGHARGGGRGMAAVWQQVLAVDARYNAYRTPTFPQFRTQYIRRRSQLLRENAKAGHPPALRRQYLRLRGQLLGQRYGPLSEPGSARAYSNSIVRSSRTTLDRMEDFEDDPRALGARGHRRSVSRGSYQLQAQMNRAVYEDRPPGSVVPTSAAEASRAMAGDTSLSENYAFAGMYHVFDQHVDEAVPRVRFANDDRHRLACCSLDGSISLCQLVPAPPTVLRVLRGHTRGVSDFAWSLSNDILVSTSLDATMRIWASEDGRCIREIPDPDSAELLCCTFQPVNNNLTVVGNAKHNVHVMNISTGKKVKGGSSKLTGRVLALSFDAPGRLLWAGDDRGSVFSFLFDMATGKLTKAKRLVVHEGSPVTSISARSWVSREARDPSLLINACLNKLLLYRVVDNEGTLQLKRSFPIEQSSHPVRSIFCPLMSFRQGACVVTGPCRTCAFTSLLWSGGKAAVNSCGPSALAGVAHWRELWPLSTGVSLAGDGTNIVRFAALCFIPTFITPVAKALARVQPRGATTSEATAPMFMHTEFTRRPGIHSYTCGVPLHPSLPLCSADRHAE

SEQ ID NO: 910718 - protein, 443 aa, Homo sapiens
GSAVLSDSRQPSCLEPEKGRRDRRNRRQWSQGRSGGPQEPEAAPEAAAGGHARGGGRGMAAVWQQVLAVDARYNAYRTPTFPQFRTQYIRRRSQLLRENAKAGHPPALRRQYLRLRGQLLGQRYGPLSEPGSARAYSNSIVRSSRTTLDRMEDFEDDPRALGARGHRRSVSRGSYQLQAQMNRAVYEDRPPGSVVPTSAAEASRAMAGDTSLSENYAFAGMYHVFDQHVDEAVPRVRFANDDRHRLACCSLDGSISLCQLVPAPPTVLRVLRGHTRGVSDFAWSLSNDILVSTSLDATMRIWASEDGRCIREIPDPDSAELLCCTFQPVNNNLTVVGNAKHNVHVMNISTGKKVKGGSSKLTGRVLALSFDAPGRLLWAGDDLTGSEDMCVHFFDVERAAKAAVNKLQGHSAPVLDVSFNCDESLLASSDASGMVIVWRREQK

SEQ ID NO: 910719 - protein, 362 aa, Homo sapiens
GSAVLSDSRQPSCLEPEKGRRDRRNRRQWSQGRSGGPQEPEAAPEAAAGGHARGGGRGMAAVWQQVLAVDARYNAYRTPTFPQFRTQYIRRRSQLLRENAKAGHPPALRRQYLRLRGQLLGQRYGPLSEPGSARAYSNSIVRSSRTTLDRMEDFEDDPRALGARGHRRSVSRGSYQLQAQMNRAVYEDRPPGSVVPTSAAEASRAMAGDTSLSENYAFAGMYHVFDQHVDEAVPRVRFANDDRHRLACCSLDGSISLCQLVPAPPTVLRVLRGHTRGVSDFAWSLSNDILVSTSLDATMRIWASEDGRCIREIPDPDSAELLCCTFQPVNNNLTVVGNAKHNVHVMNISLHPTPLTPASCCK

SEQ ID NO: 910720 - protein, 152 aa, Homo sapiens
RRNKFPGDGNLRLRTHACSHLAWSLRKGGETEGTGDSGLRAAPGGLKNRRQPRRWSPIPGYALGSEKGRRRAAGTRWVENVKQGMLGGGGALLWRLGRGGVCSESLCVTRALPRKGRAGVMTMVTPGWEFVTSPARRDSMSMAMVAWWKGRN

SEQ ID NO: 910721 - protein, 148 aa, Homo sapiens
GSAVLSDSRQPSCLEPEKGRRDRRNRRQWSQGRSGGPQEPEAAPEAAAGGHARGGGRGMAAVWQQVLAVDARYNAYRTPTFPQFRTQYIRRRSQLLRENAKAGHPPALRRQYLHHIYNIIPHLLLILLTSFFRFHLLTFNISNHRSFS

SEQ ID NO: 910722 - protein, 322 aa, Homo sapiens
RASSRPGNSRLPRVPHSPSVSPRKTRPLRGQRPGSASCAPTSSTSPLEKSYCSVPEGLCHKRVGDIPREFQHPFGLSQSEMAAVKASTSKATRPWYSHPVYARYWQHYHQAMAWMQSHHNAYRKAVESCFNLPWYLPSALLPQSSYDNEAAYPQSFYDHHVAWQDYPCSSSHFRRSGQHPRYSSRIQASTKEDQALSKEEEMETESDAEVECDLSNMEITEELRQYFAETERHREERRRQQQLDAERLDSYVNADHDLYCNTRRSVEAPTERPGERRQAEMKRLYGDSAAKIQAMEAAVQLSFDKHCDRKQPKYWPVIPLKF

SEQ ID NO: 910723 - protein, 242 aa, Homo sapiens
MAAVKASTSKATRPWYSHPVYARYWQHYHQAMAWMQSHHNAYRKAVESCFNLPWYLPSALLPQSSYDNEAAYPQSFYDHHVAWQDYPCSSSHFRRSGQHPRYSSRIQASTKEDQALSKEEEMETESDAEVECDLSNMEITEELRQYFAETERHREERRRQQQLDAERLDSYVNADHDLYCNTRRSVEAPTERPGERRQAEMKRLYGDSAAKIQAMEAAVQLSFDKHCDRKQPKYWPVIPLKF

SEQ ID NO: 910724 - protein, 202 aa, Homo sapiens
MAWMQSHHNAYRKAVESCFNLPWYLPSALLPQSSYDNEAAYPQSFYDHHVAWQDYPCSSSHFRRSGQHPRYSSRIQASTKEDQALSKEEEMETESDAEVECDLSNMEITEELRQYFAETERHREERHIHRCTKPISEMIRVNGCRKVERNMKMHFCCKSKNGGCPVTSGLHLSWGKGCATKREDQSEMAPVLLACTCVLGGC

SEQ ID NO: 910725 - protein, 242 aa, Homo sapiens; identical to SEQ ID NO: 910723

SEQ ID NO: 910726 - protein, 242 aa, Homo sapiens; identical to SEQ ID NO: 910723

SEQ ID NO: 910727 - protein, 229 aa, Homo sapiens
MASARGGTGSVGLAAAPVRGRRENKQGGAGPGMKLGRAVLGLLLLAPSVVQAVEPISLGLALAGVLTGYIYPRLYCLFAECCGQKRSLSREALQKDLDDNLFGQHLAKKIILNAVFGFINNPKPKKPLTLSLHGWTGTGKNFVSKIIAENIYEGGLNSDYVHLFVATLHFPHASNITLYKARMEVWNPFLDVIGFGVSLLWDEIWEFYVEMSEPGKRFMSQFPLERCRS

SEQ ID NO: 910728 - protein, 297 aa, Homo sapiens
MRPGSSAMTTDVPDLSGDLRSQAAALQKDLDDNLFGQHLAKKIILNAVFGFINNPKPKKPLTLSLHGWTGTGKNFVSKIIAENIYEGGLNSDYVHLFVATLHFPHASNITLYKDQLQLWIRGNVSACARSIFIFDEMDKMHAGLIDAIKPFLDYYDLVDGVSYQKAMFIFLSNAGAERITDVALDFWRSGKQREDIKLKDIEHALSVSVFNNKNSGFWHSSLIDRNLIDYFVPFLPLEYKHLKMCIRVEMQSRGYEIDEDIVSRVAEEMTFFPKEERVFSDKGCKTVFTKLDYYYDD

SEQ ID NO: 910729 - protein, 275 aa, Homo sapiens
FGFINTAFKMIFFARCCPKKIILNAVFGFINNPKPKKPLTLSLHGWTGTGKNFVSKIIAENIYEGGLNSDYVHLFVATLHFPHASNITLYKDQLQLWIRGNVSACARSIFIFDEMDKMHAGLIDAIKPFLDYYDLVDGVSYQKAMFIFLSNAGAERITDVALDFWRSGKQREDIKLKDIEHALSVSVFNNKNSGFWHSSLIDRNLIDYFVPFLPLEYKHLKMCIRVEMQSRGYEIDEDIVSRVAEEMTFFPKEERVFSDKGCKTVFTKLDYYYDD

SEQ ID NO: 910730 - protein, 213 aa, Homo sapiens
AGVKGVRMKTVWGGKWDFRHASKHRACYKDQLQLWIRGNVSACARSIFIFDEMDKMHAGLIDAIKPFLDYYDLVDGVSYQKAMFIFLSNAGAERITDVALDFWRSGKQREDIKLKDIEHALSVSVFNNKNSGFWHSSLIDRNLIDYFVPFLPLEYKHLKMCIRVEMQSRGYEIDEDIVSRVAEEMTFFPKEERVFSDKGCKTVFTKLDYYYDD

SEQ ID NO: 910731 - protein, 125 aa, Homo sapiens
MKSINPVNEEELGLGTEPQNYMADQKGISSVEDTHGLVGDAVCAVSSGAGRKCPGSGVPGAQEEWTGQCRASPHSGEKTRPRPGGAHMLCRVWALWQRQQASLLLVQLLKLQGESKSSQIQRRGW

SEQ ID NO: 910732 - protein, 283 aa, Homo sapiens
MASARGGTGSVGLAAAPVRGRRENKQGGAGPGMKLGRAVLGLLLLAPSVVQAVEPISLGLALAGVLTGYIYPRLYCLFAECCGQKRSLSREALQKDLDDNLFGQHLAKKIILNAVFGFINNPKPKKPLTLSLHGWTGTGKNFVSKIIAENIYEGGLNSDYVHLFVATLHFPHASNITLYKDQLQLWIRGNVSACARSIFIFDEMDKMHAGLIDAIKPFLDYYDLVDGVSYQKAMFIFLSNAGAERITDVALDFWRSGKQREDIKLKDIEHALSVSVFNNKNSE

SEQ ID NO: 910733 - protein, 364 aa, Homo sapiens
MASARGGTGSVGLAAAPVRGRRENKQGGAGPGMKLGRAVLGLLLLAPSVVQAVEPISLGLALAGVLTGYIYPRLYCLFAECCGQKRSLSREALQKDLDDNLFGQHLAKKIILNAVFGFINNPKPKKPLTLSLHGWTGTGKNFVSKIIAENIYEGGLNSDYVHLFVATLHFPHASNITLYKDQLQLWIRGNVSACARSIFIFDEMDKMHAGLIDAIKPFLDYYDLVDGVSYQKAMFIFLSNAGAERITDVALDFWRSGKQREDIKLKDIEHALSVSVFNNKNSGFWHSSLIDRNLIDYFVPFLPLEYKHLKMCIRVEMQSRGYEIDEDIVSRVAEEMTFFPKEERVFSDKGCKTVFTKLDYYYDD

SEQ ID NO: 910734 - protein, 364 aa, Homo sapiens; identical to SEQ ID NO: 910733

SEQ ID NO: 910735 - protein, 283 aa, Homo sapiens; identical to SEQ ID NO: 910732

SEQ ID NO: 910736 - protein, 122 aa, Homo sapiens
MKSINPVNEEELGLGTEPQNYMADQKGISSVEDTHGLVGDAVCAVSSGAGRKCPGSGVPGAQEEWTGQCRASPHSGEKTRPRPGLHGEPSVGCTSALSRLVLVPTCSAGSGHCGSGSRLPCC

SEQ ID NO: 910737 - protein, 73 aa, Homo sapiens
GRVRSSRSPEGVERVRSEPAVIQGRKHVPGPRGAHMLCRVWALWQRQQASLLLVQLLKLQGESKSSQIQRRGW

SEQ ID NO: 910738 - protein, 2224 aa, Homo sapiens
MFPGCPRLWVLVVLGTSWVGWGSQGTEAAQLRQFYVAAQGISWSYRPEPTNSSLNLSVTSFKKIVYREYEPYFKKEKPQSTISGLLGPTLYAEVGDIIKVHFKNKADKPLSIHPQGIRYSKLSEGASYLDHTFPAEKMDDAVAPGREYTYEWSISEDSGPTHDDPPCLTHIYYSHENLIEDFNSGLIGPLLICKKGTLTEGGTQKTFDKQIVLLFAVFDESKSWSQSSSLMYTVNGYVNGTMPDITVCAHDHISWHLLGMSSGPELFSIHFNGQVLEQNHHKVSAITLVSATSTTANMTVGPEGKWIISSLTPKHLQAGMQAYIDIKNCPKKTRNLKKITREQRRHMKRWEYFIAAEEVIWDYAPVIPANMDKKYRSQHLDNFSNQIGKHYKKVMYTQYEDESFTKHTVNPNMKEDGILGPIIRAQVRDTLKIVFKNMASRPYSIYPHGVTFSPYEDEVNSSFTSGRNNTMIRAVQPGETYTYKWNILEFDEPTENDAQCLTRPYYSDVDIMRDIASGLIGLLLICKSRSLDRRGIQRAADIEQQAVFAVFDENKSWYLEDNINKFCENPDEVKRDDPKFYESNIMSTINGYVPESITTLGFCFDDTVQWHFCSVGTQNEILTIHFTGHSFIYGKRHEDTLTLFPMRGESVTVTMDNVGTWMLTSMNSSPRSKKLRLKFRDVKCIPDDDEDSYEIFEPPESTVMATRKMHDRLEPEDEESDADYDYQNRLAAALGIRSFRNSSLNQEEEEFNLTALALENGTEFVSSNTDIIVGSNYSSPSNISKFTVNNLAEPQKAPSHQQATTAGSPLRHLIGKNSVLNSSTAEHSSPYSEDPIEDPLQPDVTGIRLLSLGAGEFKSQEHAKHKGPKVERDQAAKHRFSWMKLLAHKVGRHLSQDTGSPSGMRPWEDLPSQDTGSPSRMRPWKDPPSDLLLLKQSNSSKILVGRWHLASEKGSYEIIQDTDEDTAVNNWLISPQNASRAWGESTPLANKPGKQSGHPKFPRVRHKSLQVRQDGGKSRLKKSQFLIKTRKKKKEKHTHHAPLSPRTFHPLRSEAYNTFSERRLKHSLVLHKSNETSLPTDLNQTLPSMDFGWIASLPDHNQNSSNDTGQASCPPGLYQTVPPEEHYQTFPIQDPDQMHSTSDPSHRSSSPELSEMLEYDRSHKSFPTDISQMSPSSEHEVWQTVISPDLSQVTLSPELSQTNLSPDLSHTTLSPELIQRNLSPALGQMPISPDLSHTTLSPDLSHTTLSLDLSQTNLSPELSQTNLSPALGQMPLSPDLSHTTLSLDFSQTNLSPELSHMTLSPELSQTNLSPALGQMPISPDLSHTTLSLDFSQTNLSPELSQTNLSPALGQMPLSPDPSHTTLSLDLSQTNLSPELSQTNLSPDLSEMPLFADLSQIPLTPDLDQMTLSPDLGETDLSPNFGQMSLSPDLSQVTLSPDISDTTLLPDLSQISPPPDLDQIFYPSESSQSLLLQEFNESFPYPDLGQMPSPSSPTLNDTFLSKEFNPLVIVGLSKDGTDYIEIIPKEEVQSSEDDYAEIDYVPYDDPYKTDVRTNINSSRDPDNIAAWYLRSNNGNRRNYYIAAEEISWDYSEFVQRETDIEDSDDIPEDTTYKKVVFRKYLDSTFTKRDPRGEYEEHLGILGPIIRAEVDDVIQVRFKNLASRPYSLHAHGLSYEKSSEGKTYEDDSPEWFKEDNAVQPNSSYTYVWHATERSGPESPGSACRAWAYYSAVNPEKDIHSGLIGPLLICQKGILHKDSNMPVDMREFVLLFMTFDEKKSWYYEKKSRSSWRLTSSEMKKSHEFHAINGMIYSLPGLKMYEQEWVRLHLLNIGGSQDIHVVHFHGQTLLENGNKQHQLGVWPLLPGSFKTLEMKASKPGWWLLNTEVGENQRAGMQTPFLIMDRDCRMPMGLSTGIISDSQIKASEFLGYWEPRLARLNNGGSYNAWSVEKLAAEFASKPWIQVDMQKEVIITGIQTQGAKHYLKSCYTTEFYVAYSSNQINWQIFKGNSTRNVMYFNGNSDASTIKENQFDPPIVARYIRISPTRAYNRPTLRLELQGCEVNGCSTPLGMENGKIENKQITASSFKKSWWGDYWEPFRARLNAQGRVNAWQAKANNNKQWLEIDLLKIKKITAIITQGCKSLSSEMYVKSYTIHYSEQGVEWKPYRLKSSMVDKIFEGNTNTKGHVKNFFNPPIISRFIRVIPKTWNQSIALRLELFGCDIY

SEQ ID NO: 910739 - protein, 2207 aa, Homo sapiens
MFPGCPRLWVLVVLGTSWVGWGSQGTEAAQLRQFYVAAQGISWSYRPEPTNSSLNLSVTSFKKIVYREYEPYFKKEKPQSTISGLLGPTLYAEVGDIIKVHFKNKADKPLSIHPQGIRYSKLSEGASYLDHTFPAEKMDDAVAPGREYTYEWSISEDSGPTHDDPPCLTHIYYSHENLIEDFNSGLIGPLLICKKGTLTEGGTQKTFDKQIVLLFAVFDESKSWSQSSSLMYTVNGYVNGTMPDITVCAHDHISWHLLGMSSGPELFSIHFNGQVLEQNHHKVSAITLVSATSTTANMTVGPEGKWIISSLTPKHLQAGMQAYIDIKNCPKKTRNLKKITREQRRHMKRWEYFIAAEEVIWDYAPVIPANMDKKYRSQHLDNFSNQIGKHYKKVMYTQYEDESFTKHTVNPNMKEDGILGPIIRAQVRDTLKIVFKNMASRPYSIYPHGVTFSPYEDEVNSSFTSGRNNTMIRAVQPGETYTYKWNILEFDEPTENDAQCLTRPYYSDVDIMRDIASGLIGLLLICKSRSLDRRGIQRAADIEQQAVFAVFDENKSWYLEDNINKFCENPDEVKRDDPKFYESNIMSTINGYVPESITTLGFCFDDTVQWHFCSVGTQNEILTIHFTGHSFIYGKRHEDTLTLFPMRGESVTVTMDNVGTWMLTSMNSSPRSKKLRLKFRDVKCIPDDDEDSYEIFEPPESTVMATRKMHDRLEPEDEESDADYDYQNRLAAALGIRSFRNSSLNQEEEEFNLTALALENGTEFVSSNTDIIVGSNYSSPSNISKFTVNNLAEPQKAPSHQQATTAGSPLRHLIGKNSVLNSSTAEHSSPYSEDPIEDPLQPDVTGIRLLSLGAGEFKSQEHAKHKGPKVERDQAAKHRFSWMKLLAHKVGRHLSQDTGSPSGMRPWEDLPSQDTGSPSRMRPWKDPPSDLLLLKQSNSSKILVGRWHLASEKGSYEIIQDTDEDTAVNNWLISPQNASRAWGESTPLANKPGKQSGHPKFPRVRHKSLQVRQDGGKSRLKKSQFLIKTRKKKKEKHTHHAPLSPRTFHPLRSEAYNTFSERRLKHSLVLHKSNETSLPTDLNQTLPSMDFGWIASLPDHNQNSSNDTGQASCPPGLYQTVPPEEHYQTFPIQDPDQMHSTSDPSHRSSSPELSEMLEYDRSHKSFPTDISQMSPSSEHEVWQTVISPDLSQVTLSPELSQTNLSPDLSHTTLSPELIQRNLSPALGQMPISPDLSHTTLSPDLSHTTLSLDLSQTNLSPELSQTNLSPALGQMPLSPDLSHTTLSLDFSQTNLSPELSHMTLSPELSQTNLSPALGQMPISPDLSHTTLSLDFSQTNLSPELSQTNLSPALGQMPLSPDPSHTTLSLDLSQTNLSPELSQTNLSPDLSEMPLFADLSQIPLTPDLDQMTLSPDLGETDLSPNFGQMSLSPDLSQVTLSPDISDTTLLPDLSQISPPPDLDQIFYPSESSQSLLLQEFNESFPYPDLGQMPSPSSPTLNDTFLSKEFNPLVIVGLSKDGTDYIEIIPKEEVQSSEDDYAEIDYVPYDDPYKTDVRTNINSSRDPDNIAAWYLRSNNGNRRNYYIAAEEISWDYSEFVQRETDIEDSDDIPEDTTYKKGSMKSISEFLVLLSELKWMMLSKFVLENLASRPYSLHAHGLSYEKSSEGKTYEDDSPEWFKEDNAVQPNSSYTYVWHATERSGPESPGSACRAWAYYSAVNPEKDIHSGLIGPLLICQKGILHKDSNMPVDMREFVLLFMTFDEKKSWYYEKKSRSSWRLTSSEMKKSHEFHAINGMIYSLPGLKMYEQEWVRLHLLNIGGSQDIHVVHFHGQTLLENGNKQHQLGVWPLLPGSFKTLEMKASKPGWWLLNTEVGENQRAGMQTPFLIMDRDCRMPMGLSTGIISDSQIKASEFLGYWEPRLARLNNGGSYNAWSVEKLAAEFASKPWIQVDMQKEVIITGIQTQGAKHYLKSCYTTEFYVAYSSNQINWQIFKGNSTRNVMYFNGNSDASTIKENQFDPPIVARYIRISPTRAYNRPTLRLELQGCEVNGCSTPLGMENGKIENKQITASSFKKSWWGDYWEPFRARLNAQGRVNAWQAKANNNKQWLEIDLLKIKKITAIITQGCKSLSSEMYVKSYTIHYSEQGVEWKPYRLKSSMVDKIFEGNTNTKGHVKNFFNPPIISRFIRVIPKTWNQSIALRLELFGCDIY

SEQ ID NO: 910740 - protein, 2193 aa, Homo sapiens
MFPGCPRLWVLVVLGTSWVGWGSQGTEAAQLRQFYVAAQGISWSYRPEPTNSSLNLSVTSFKKIVYREYEPYFKKEKPQSTISGLLGPTLYAEVGDIIKVHFKNKADKPLSIHPQGIRYSKLSEGASYLDHTFPAEKMDDAVAPGREYTYEWSISEDSGPTHDDPPCLTHIYYSHENLIEDFNSGLIGPLLICKKGTLTEGGTQKTFDKQIVLLFAVFDESKSWSQSSSLMYTVNGYVNGTMPDITVCAHDHISWHLLGMSSGPELFSIHFNGQVLEQNHHKVSAITLVSATSTTANMTVGPEGKWIISSLTPKHLQAGMQAYIDIKNCPKKTRNLKKITREQRRHMKRWEYFIAAEEVIWDYAPVIPANMDKKYRSQHLDNFSNQIGKHYKKVMYTQYEDESFTKHTVNPNMKEDGILGPIIRAQVRDTLKIVFKNMASRPYSIYPHGVTFSPYEDEVNSSFTSGRNNTMIRAVQPGETYTYKWNILEFDEPTENDAQCLTRPYYSDVDIMRDIASGLIGLLLICKSRSLDRRGIQRAADIEQQAVFAVFDENKSWYLEDNINKFCENPDEVKRDDPKFYESNIMSTINGYVPESITTLGFCFDDTVQWHFCSVGTQNEILTIHFTGHSFIYGKRHEDTLTLFPMRGESVTVTMDNVGTWMLTSMNSSPRSKKLRLKFRDVKCIPDDDEDSYEIFEPPESTVMATRKMHDRLEPEDEESDADYDYQNRLAAALGIRSFRNSSLNQEEEEFNLTALALENGTEFVSSNTDIIVGSNYSSPSNISKFTVNNLAEPQKAPSHQQATTAGSPLRHLIGKNSVLNSSTAEHSSPYSEDPIEDPLQPDVTGIRLLSLGAGEFKSQEHAKHKGPKVERDQAAKHRFSWMKLLAHKVGRHLSQDTGSPSGMRPWEDLPSQDTGSPSRMRPWKDPPSDLLLLKQSNSSKILVGRWHLASEKGSYEIIQDTDEDTAVNNWLISPQNASRAWGESTPLANKPGKQSGHPKFPRVRHKSLQVRQDGGKSRLKKSQFLIKTRKKKKEKHTHHAPLSPRTFHPLRSEAYNTFSERRLKHSLVLHKSNETSLPTDLNQTLPSMDFGWIASLPDHNQNSSNDTGQASCPPGLYQTVPPEEHYQTFPIQDPDQMHSTSDPSHRSSSPELSEMLEYDRSHKSFPTDISQMSPSSEHEVWQTVISPDLSQVTLSPELSQTNLSPDLSHTTLSPELIQRNLSPALGQMPISPDLSHTTLSPDLSHTTLSLDLSQTNLSPELSQTNLSPALGQMPLSPDLSHTTLSLDFSQTNLSPELSHMTLSPELSQTNLSPALGQMPISPDLSHTTLSLDFSQTNLSPELSQTNLSPALGQMPLSPDPSHTTLSLDLSQTNLSPELSQTNLSPDLSEMPLFADLSQIPLTPDLDQMTLSPDLGETDLSPNFGQMSLSPDLSQVTLSPDISDTTLLPDLSQISPPPDLDQIFYPSESSQSLLLQEFNESFPYPDLGQMPSPSSPTLNDTFLSKEFNPLVIVGLSKDGTDYIEIIPKEEVQSSEDDYAEIDYVPYDDPYTWYLRSNNGNRRNYYIAAEEISWDYSEFVQRETDIEDSDDIPEDTTYKKVVFRKYLDSTFTKRDPRGEYEEHLGILGPIIRAEVDDVIQVRFKNLASRPYSLHAHGLSYEKSSEGKTYEDDSPEWFKEDNAVQPNSSYTYVWHATERSGPESPGSACRAWAYYSAVNPEKDIHSGLIGPLLICQKGILHKDSNMPVDMREFVLLFMTFDEKKSWYYEKKSRSSWRLTSSEMKKSHEFHAINGMIYSLPGLKMYEQEWVRLHLLNIGGSQDIHVVHFHGQTLLENGNKQHQLGVWPLLPGSFKTLEMKASKPGWWLLNTEVGENQRAGMQTPFLIMDRDCRMPMGLSTGIISDSQIKASEFLGYWEPRLARLNNGGSYNAWSVEVDMQKEVIITGIQTQGAKHYLKSCYTTEFYVAYSSNQINWQIFKGNSTRNVMYFNGNSDASTIKENQFDPPIVARYIRISPTRAYNRPTLRLELQGCEVNGCSTPLGMENGKIENKQITASSFKKSWWGDYWEPFRARLNAQGRVNAWQAKANNNKQWLEIDLLKIKKITAIITQGCKSLSSEMYVKSYTIHYSEQGVEWKPYRLKSSMVDKIFEGNTNTKGHVKNFFNPPIISRFIRVIPKTWNQSIALRLELFGCDIY

SEQ ID NO: 910741 - protein, 2189 aa, Homo sapiens
MFPGCPRLWVLVVLGTSWVGWGSQGTEAAQLRQFYVAAQGISWSYRPEPTNSSLNLSVTSFKKIVYREYEPYFKKEKPQSTISGLLGPTLYAEVGDIIKVHFKNKADKPLSIHPQGIRYSKLSEGASYLDHTFPAEKMDDAVAPGREYTYEWSISEDSGPTHDDPPCLTHIYYSHENLIEDFNSGLIGPLLICKKGTLTEGGTQKTFDKQIVLLFAVFDESKSWSQSSSLMYTVNGYVNGTMPDITVCAHDHISWHLLGMSSGPELFSIHFNGQVLEQNHHKVSAITLVSATSTTANMTVGPEGKWIISSLTPKHLQAGMQAYIDIKNCPKKTRNLKKITREQRRHMKRWEYFIAAEEVIWDYAPVIPANMDKKYRSQHLDNFSNQIGKHYKKVMYTQYEDESFTKHTVNPNMKEDGILGPIIRAQVRDTLKIVFKNMASRPYSIYPHGVTFSPYEDEVNSSFTSGRNNTMIRAVQPGETYTYKWNILEFDEPTENDAQCLTRPYYSDVDIMRDIASGLIGLLLICKSRSLDRRGIQRAADIEQQAVFAVFDENKSWYLEDNINKFCENPDEVKRDDPKFYESNIMSTINGYVPESITTLGFCFDDTVQWHFCSVGTQNEILTIHFTGHSFIYGKRHEDTLTLFPMRGESVTVTMDNVGTWMLTSMNSSPRSKKLRLKFRDVKCIPDDDEDSYEIFEPPESTVMATRKMHDRLEPEDEESDADYDYQNRLAAALGIRSFRNSSLNQEEEEFNLTALALENGTEFVSSNTDIIVGSNYSSPSNISKFTVNNLAEPQKAPSHQQATTAGSPLRHLIGKNSVLNSSTAEHSSPYSEDPIEDPLQPDVTGIRLLSLGAGEFKSQEHAKHKGPKVERDQAAKHRFSWMKLLAHKVGRHLSQDTGSPSGMRPWKDPPSDLLLLKQSNSSKILVGRWHLASEKGSYEIIQDTDEDTAVNNWLISPQNASRAWGESTPLANKPGKQSGHPKFPRVRHKSLQVRQDGGKSRLKKSQFLIKTRKKKKEKHTHHAPLSPRTFHPLRSEAYNTFSERRLKHSLVLHKSNETSLPTDLNQTLPSMDFGWIASLPDHNQNSSNDTGQASCPPGLYQTVPPEEHYQTFPIQDPDQMHSTSDPSHRSSSPELSEMLEYDRSHKSFPTDISQMSPSSEHEVWQTVISPDLSQVTLSPELSQTNLSPDLSHTTLSPELIQRNLSPALGQMPISPDLSHTTLSPDLSHTTLSLDLSQTNLSPELSQTNLSPALGQMPLSPDLSHTTLSLDFSQTNLSPELSHMTLSPELSQTNLSPALGQMPISPDLSHTTLSLDFSQTNLSPELSQTNLSPALGQMPLSPDPSHTTLSLDLSQTNLSPELSQTNLSPDLSEMPLFADLSQIPLTPDLDQMTLSPDLGETDLSPNFGQMSLSPDLSQVTLSPDISDTTLLPDLSQISPPPDLDQIFYPSESSQSLLLQEFNESFPYPDLGQMPSPSSPTLNDTFLSKEFNPLVIVGLSKDGTDYIEIIPKEEVQSSEDDYAEIDYVPYDDPYTWYLRSNNGNRRNYYIAAEEISWDYSEFVQRETDIEDSDDIPEDTTYKKVVFRKYLDSTFTKRDPRGEYEEHLGILGPIIRAEVDDVIQVRFKNLASRPYSLHAHGLSYEKSSEGKTYEDDSPEWFKEDNAVQPNSSYTYVWHATERSGPESPGSACRAWAYYSAVNPEKDIHSGLIGPLLICQKGILHKDSNMPVDMREFVLLFMTFDEKKSWYYEKKSRSSWRLTSSEMKKSHEFHAINGMIYSLPGLKMYEQEWVRLHLLNIGGSQDIHVVHFHGQTLLENGNKQHQLGVWPLLPGSFKTLEMKASKPGWWLLNTEVGENQRAGMQTPFLIMDRDCRMPMGLSTGIISDSQIKASEFLGYWEPRLARLNNGGSYNAWSVEKLAAEFASKPWIQVDMQKEVIITGIQTQGAKHYLKSCYTTEFYVAYSSNQINWQIFKGNSTRNVMYFNGNSDASTIKENQFDPPIVARYIRISPTRAYNRPTLRLELQGCEVNGCSTPLGMENGKIENKQITASSFKKSWWGDYWEPFRARLNAQGRVNAWQAKANNNKQWLEIDLLKIKKITAIITQGCKSLSSEMYVKSYTIHYSEQGVEWKPYRLKSSMVDKIFEGNTNTKGHVKNFFNPPIISRFIRVIPKTWNQSIALRLELFGCDIY

SEQ ID NO: 910742 - protein, 1046 aa, Homo sapiens
MFPGCPRLWVLVVLGTSWVGWGSQGTEAAQLRQFYVAAQGISWSYRPEPTNSSLNLSVTSFKKIVYREYEPYFKKEKPQSTISGLLGPTLYAEVGDIIKVHFKNKADKPLSIHPQGIRYSKLSEGASYLDHTFPAEKMDDAVAPGREYTYEWSISEDSGPTHDDPPCLTHIYYSHENLIEDFNQSNKPFPSPRSDALSPDPSHTTLSLDLSQTNLSPELSQTNLSPDLSEMPLFADLSQIPLTPDLDQMTLSPDLGETDLSPNFGQMSLSPDLSQVTLSPDISDTTLLPDLSQISPPPDLDQIFYPSESSQSLLLQEFNESFPYPDLGQMPSPSSPTLNDTFLSKEFNPLVIVGLSKDGTDYIEIIPKEEVQSSEDDYAEIDYVPYDDPYTWYLRSNNGNRRNYYIAAEEISWDYSEFVQRETDIEDSDDIPEDTTYKKVVFRKYLDSTFTKRDPRGEYEEHLGILGPIIRAEVDDVIQVRFKNLASRPYSLHAHGLSYEKSSEGKTYEDDSPEWFKEDNAVQPNSSYTYVWHATERSGPESPGSACRAWAYYSAVNPEKDIHSGLIGPLLICQKGILHKDSNMPVDMREFVLLFMTFDEKKSWYYEKKSRSSWRLTSSEMKKSHEFHAINGMIYSLPGLKMYEQEWVRLHLLNIGGSQDIHVVHFHGQTLLENGNKQHQLGVWPLLPGSFKTLEMKASKPGWWLLNTEVGENQRAGMQTPFLIMDRDCRMPMGLSTGIISDSQIKASEFLGYWEPRLARLNNGGSYNAWSVEKLAAEFASKPWIQVDMQKEVIITGIQTQGAKHYLKSCYTTEFYVAYSSNQINWQIFKGNSTRNVMYFNGNSDASTIKENQFDPPIVARYIRISPTRAYNRPTLRLELQGCEVNGCSTPLGMENGKIENKQITASSFKKSWWGDYWEPFRARLNAQGRVNAWQAKANNNKQWLEIDLLKIKKITAIITQGCKSLSSEMYVKSYTIHYSEQGVEWKPYRLKSSMVDKIFEGNTNTKGHVKNFFNPPIISRFIRVIPKTWNQSIALRLELFGCDIY

SEQ ID NO: 910743 - protein, 2206 aa, Homo sapiens
MFPGCPRLWVLVVLGTSWVGWGSQGTEAAQLRQFYVAAQGISWSYRPEPTNSSLNLSVTSFKKIVYREYEPYFKKEKPQSTISGLLGPTLYAEVGDIIKVHFKNKADKPLSIHPQGIRYSKLSEGASYLDHTFPAEKMDDAVAPGREYTYEWSISEDSGPTHDDPPCLTHIYYSHENLIEDFNSGLIGPLLICKKGTLTEGGTQKTFDKQIVLLFAVFDESKSWSQSSSLMYTVNGYVNGTMPDITVCAHDHISWHLLGMSSGPELFSIHFNGQVLEQNHHKVSAITLVSATSTTANMTVGPEGKWIISSLTPKHLQAGMQAYIDIKNCPKKTRNLKKITREQRRHMKRWEYFIAAEEVIWDYAPVIPANMDKKYRSQHLDNFSNQIGKHYKKVMYTQYEDESFTKHTVNPNMKEDGILGPIIRAQVRDTLKIVFKNMASRPYSIYPHGVTFSPYEDEVNSSFTSGRNNTMIRAVQPGETYTYKWNILEFDEPTENDAQCLTRPYYSDVDIMRDIASGLIGLLLICKSRSLDRRGIQRAADIEQQAVFAVFDENKSWYLEDNINKFCENPDEVKRDDPKFYESNIMSTINGYVPESITTLGFCFDDTVQWHFCSVGTQNEILTIHFTGHSFIYGKRHEDTLTLFPMRGESVTVTMDNVGTWMLTSMNSSPRSKKLRLKFRDVKCIPDDDEDSYEIFEPPESTVMATRKMHDRLEPEDEESDADYDYQNRLAAALGIRSFRNSSLNQEEEEFNLTALALENGTEFVSSNTDIIVGSNYSSPSNISKFTVNNLAEPQKAPSHQQATTAGSPLRHLIGKNSVLNSSTAEHSSPYSEDPIEDPLQPDVTGIRLLSLGAGEFKSQEHAKHKGPKVERDQAAKHRFSWMKLLAHKVGRHLSQDTGSPSGMRPWEDLPSQDTGSPSRMRPWKDPPSDLLLLKQSNSSKILVGRWHLASEKGSYEIIQDTDEDTAVNNWLISPQNASRAWGESTPLANKPGKQSGHPKFPRVRHKSLQVRQDGGKSRLKKSQFLIKTRKKKKEKHTHHAPLSPRTFHPLRSEAYNTFSERRLKHSLVLHKSNETSLPTDLNQTLPSMDFGWIASLPDHNQNSSNDTGQASCPPGLYQTVPPEEHYQTFPIQDPDQMHSTSDPSHRSSSPELSEMLEYDRSHKSFPTDISQMSPSSEHEVWQTVISPDLSQVTLSPELSQTNLSPDLSHTTLSPELIQRNLSPALGQMPISPDLSHTTLSPDLSHTTLSLDLSQTNLSPELSQTNLSPALGQMPLSPDLSHTTLSLDFSQTNLSPELSHMTLSPELSQTNLSPALGQMPISPDLSHTTLSLDFSQTNLSPELSQTNLSPALGQMPLSPDPSHTTLSLDLSQTNLSPELSQTNLSPDLSEMPLFADLSQIPLTPDLDQMTLSPDLGETDLSPNFGQMSLSPDLSQVTLSPDISDTTLLPDLSQISPPPDLDQIFYPSESSQSLLLQEFNESFPYPDLGQMPSPSSPTLNDTFLSKEFNPLVIVGLSKDGTDYIEIIPKEEVQSSEDDYAEIDYVPYDDPYTWYLRSNNGNRRNYYIAAEEISWDYSEFVQRETDIEDSDDIPEDTTYKKVVFRKYLDSTFTKRDPRGEYEEHLGILGPIIRAEVDDVIQVRFKNLASRPYSLHAHGLSYEKSSEGKTYEDDSPEWFKEDNAVQPNSSYTYVWHATERSGPESPGSACRAWAYYSAVNPEKDIHSGLIGPLLICQKGILHKDSNMPVDMREFVLLFMTFDEKKSWYYEKKSRSSWRLTSSEMKKSHEFHAINGMIYSLPGLKMYEQEWVRLHLLNIGGSQDIHVVHFHGQTLLENGNKQHQLGVWPLLPGSFKTLEMKASKPGWWLLNTEVGENQRAGMQTPFLIMDRDCRMPMGLSTGIISDSQIKASEFLGYWEPRLARLNNGGSYNAWSVEKLAAEFASKPWIQVDMQKEVIITGIQTQGAKHYLKSCYTTEFYVAYSSNQINWQIFKGNSTRNVMYFNGNSDASTIKENQFDPPIVARYIRISPTRAYNRPTLRLELQGCEVNGCSTPLGMENGKIENKQITASSFKKSWWGDYWEPFRARLNAQGRVNAWQAKANNNKQWLEIDLLKIKKITAIITQGCKSLSSEMYVKSYTIHYSEQGVEWKPYRLKSSMVDKIFEGNTNTKGHVKNFFNPPIISRFIRVIPKTWNQSIALRLELFGCDIY

SEQ ID NO: 910744 - protein, 2206 aa, Homo sapiens; identical to SEQ ID NO: 910743

SEQ ID NO: 910745 - protein, 2153 aa, Homo sapiens
MFPGCPRLWVLVVLGTSWVGWGSQGTEAAQLRQFYVAAQGISWSYRPEPTNSSLNLSVTSFKKIVYREYEPYFKKEKPQSTISGLLGPTLYAEVGDIIKVHFKNKADKPLSIHPQGIRYSKLSEGASYLDHTFPAEKMDDAVAPGREYTYEWSISEDSGPTHDDPPCLTHIYYSHENLIEDFNSGLIGPLLICKKGTLTEGGTQKTFDKQIVLLFAVFDESKSWSQSSSLMYTVNGYVNGTMPDITVCAHDHISWHLLGMSSGPELFSIHFNGQVLEQNHHKVSAITLVSATSTTANMTVGPEGKWIISSLTPKHLQAGMQAYIDIKNCPKKTRNLKKITREQRRHMKRWEYFIAAEEVIWDYAPVIPANMDKKYRSQHLDNFSNQIGKHYKKVMYTQYEDESFTKHTVNPNMKEDGILGPIIRAQVRDTLKIVFKNMASRPYSIYPHGVTFSPYEDEVNSSFTSGRNNTMIRAVQPGETYTYKWNILEFDEPTENDAQCLTRPYYSDVDIMRDIASGLIGLLLICKSRSLDRRGIQRAADIEQQAVFAVFDENKSWYLEDNINKFCENPDEVKRDDPKFYESNIMSTINGYVPESITTLGFCFDDTVQWHFCSVGTQNEILTIHFTGHSFIYGKRHEDTLTLFPMRGESVTVTMDNVGTWMLTSMNSSPRSKKLRLKFRDVKCIPDDDEDSYEIFEPPESTVMATRKMHDRLEPEDEESDADYDYQNRLAAALGIRSFRNSSLNQEEEEFNLTALALENGTEFVSSNTDIIVGSNYSSPSNISKFTVNNLAEPQKAPSHQQATTAGSPLRHLIGKNSVLNSSTAEHSSPYSEDPIEDPLQPDVTGIRLLSLGAGEFKSQEHAKHKGPKVERDQAAKHRFSWMKLLAHKVGRHLSQDTGSPSGMRPWEDLPSQDTGSPSRMRPWKDPPSDLLLLKQSNSSKILVGRWHLASEKGSYEIIQDTDEDTAVNNWLISPQNASRAWGESTPLANKPGKQSGHPKFPRVRHKSLQVRQDGGKSRLKKSQFLIKTRKKKKEKHTHHAPLSPRTFHPLRSEAYNTFSERRLKHSLVLHKSNETSLPTDLNQTLPSMDFGWIASLPDHNQNSSNDTGQASCPPGLYQTVPPEEHYQTFPIQDPDQMHSTSDPSHRSSSPELSEMLEYDRSHKSFPTDISQMSPSSEHEVWQTVISPDLSQVTLSPELSQTNLSPDLSHTTLSPELIQRNLSPALGQMPISPDLSHTTLSPDLSHTTLSLDLSQTNLSPELSQTNLSPALGQMPLSPDLSHTTLSLDFSQTNLSPELSHMTLSPELSQTNLSPALGQMPISPDLSHTTLSLDFSQTNLSPELSQTNLSPALGQMPLSPDPSHTTLSLDLSQTNLSPELSQTNLSPDLSEMPLFADLSQIPLTPDLDQMTLSPDLGETDLSPNFGQMSLSPDLSQVTLSPDISDTTLLPDLSQISPPPDLDQIFYPSESSQSLLLQEFNESFPYPDLGQMPSPSSPTLNDTFLSKEFNPLVIVGLSKDGTDYIEIIPKEEVQSSEDDYAEIDYVPYDDPYTWYLRSNNGNRRNYYIAAEEISWDYSEFVQRETDIEDSDDIPEDTTYKKVVFRKYLDSTFTKRDPRGEYEEHLGILGPIIRAEVDDVIQVRFKNLASRPYSLHAHGLSYEKSSEGKTYEDDSPEWFKEDNAVQPNSSYTYVWHATERSGPESPGSACRAWAYYSAVNPEKDIHSGLIGPLLICQKGILHKDSNMPVDMREFVLLFMTFDEKKSWYYEKKSRSSWRLTSSEMKKSHEFHAINGMIYSLPGLKMYEQEWVRLHLLNIGGSQDIHVVHFHGQTLLENGNKQHQLGVWPLLPGSFKTLEMKASKPGWWLLNTEVGENQRAGMQTPFLIMDRDCRMPMGLSTGIISDSQIKASEFLGYWEPRLARLNNGGSYNAWSVEKLAAEFASKPWIQVDMQKEVIITGIQTQGAKHYLKSCYTTEFYVAYSSNQINWQIFKGNSTRNVMYFNGNSDASTIKENQFDPPIVARYIRISPTRAYNRPTLRLELQGCEVNGCSTPLGMENGKIENKQITASSFKKSWWGDYWEPFRARLNAQGRVNAWQAKANNNKQWLEIDLLKIKKITAIITQGCKSLSSEMYVKSYTIHYSEQFLKEILIPKDM

SEQ ID NO: 910746 - protein, 832 aa, Homo sapiens
PALGKISHSSETIPIALIVHFPNLQIPLTPDLDQMTLSPDLGETDLSPNFGQMSLSPDLSQVTLSPDISDTTLLPDLSQISPPPDLDQIFYPSESSQSLLLQEFNESFPYPDLGQMPSPSSPTLNDTFLSKEFNPLVIVGLSKDGTDYIEIIPKEEVQSSEDDYAEIDYVPYDDPYTWYLRSNNGNRRNYYIAAEEISWDYSEFVQRETDIEDSDDIPEDTTYKKVVFRKYLDSTFTKRDPRGEYEEHLGILGPIIRAEVDDVIQVRFKNLASRPYSLHAHGLSYEKSSEGKTYEDDSPEWFKEDNAVQPNSSYTYVWHATERSGPESPGSACRAWAYYSAVNPEKDIHSGLIGPLLICQKGILHKDSNMPVDMREFVLLFMTFDEKKSWYYEKKSRSSWRLTSSEMKKSHEFHAINGMIYSLPGLKMYEQEWVRLHLLNIGGSQDIHVVHFHGQTLLENGNKQHQLGVWPLLPGSFKTLEMKASKPGWWLLNTEVGENQRAGMQTPFLIMDRDCRMPMGLSTGIISDSQIKASEFLGYWEPRLARLNNGGSYNAWSVEKLAAEFASKPWIQVDMQKEVIITGIQTQGAKHYLKSCYTTEFYVAYSSNQINWQIFKGNSTRNVMYFNGNSDASTIKENQFDPPIVARYIRISPTRAYNRPTLRLELQGCEVNGCSTPLGMENGKIENKQITASSFKKSWWGDYWEPFRARLNAQGRVNAWQAKANNNKQWLEIDLLKIKKITAIITQGCKSLSSEMYVKSYTIHYSEQGVEWKPYRLKSSMVDKIFEGNTNTKGHVKNFFNPPIISRFIRVIPKTWNQSIALRLELFGCDIY

SEQ ID NO: 910747 - protein, 180 aa, Homo sapiens; identical to SEQ ID NO: 831501

SEQ ID NO: 910748 - protein, 190 aa, Homo sapiens
QLDKRASGQSFTSDVPVLVDGYWGAAVCKKQEQMSDSTDSSFIFSLEADMEVKQLDKRASGQSFEVILKSPSDLSPESPMLSSPPKKKDTSLEELQKRLEAAEERRKTQEAQVLKQLAERREHEREVLHKALEENNNFSRQAEEKLNYKMELSKEIREAHLAALRERLREKELHAAEVRRNKEQREEMSG

SEQ ID NO: 910749 - protein, 180 aa, Homo sapiens; identical to SEQ ID NO: 831501

SEQ ID NO: 910750 - protein, 145 aa, Homo sapiens
MAGALGAARTAGPAREAGTGAGAADRDPLALPRPQAGWQARVPRAAPGGPGAHRGLGRWRRQTQEAQVLKQLAERREHEREVLHKALEENNNFSRQAEEKLNYKMELSKEIREAHLAALRERLREKELHAAEVRRNKEQREEMSG

SEQ ID NO: 910751 - protein, 1259 aa, Homo sapiens
MDASEEPLPPVIYTMENKPIVTCAGDQNLFTSVYPTLSQQLPREPMEWRRSYGRAPKMIHLESNFVQFKEELLPKEGNKALLTFPFLHIYWTECCDTEVYKATVKDDLTKWQNVLKAHSSVDWLIVIVENDAKKKNKTNILPRTSIVDKIRNDFCNKQSDRCVVLSDPLKDSSRTQESWNAFLTKLRTLLLMSFTKNLGKFEDDMRTLREKRTEPGWSFCEYFMVQEELAFVFEMLQQFEDALVQYDELDALFSQYVVNFGAGDGANWLTFFCQPVKSWNGLILRKPIDMEKRESIQRREATLLDLRSYLFSRQCTLLLFLQRPWEVAQRALELLHNCVQELKLLEVSVPPGALDCWVFLSCLEVLQRIEGCCDRAQIDSNIAHTVGLWSYATEKLKSLGYLCGLVSEKGPNSEDLNRTVDLLAGLGAERPETANTAQSPYKKLKEALSSVEAFEKHYLDLSHATIEMYTSIGRIRSAKFVGKDLAEFYMRKKAPQKAEIYLQGALKNYLAEGWALPITHTRKQLAECQKHLGQIENYLQTSSLLASDHHLTEEERKHFCQEILDFASQPSDSPGHKIVLPMHSFAQLRDLHFDPSNAVVHVGGVLCVEITMYSQMPVPVHVEQIVVNVHFSIEKNSYRKTAEWLTKHKTSNGIINFPPETAPFPVSQNSLPALELYEMFERSPSDNSLNTTGIICRNVHMLLRRQESSSSLEMPSGVALEEGAHVLRCSHVTLEPGANQITFRTQAKEPGTYTLRQLCASVGSVWFVLPHIYPIVQYDVYSQEPQLHVEPLADSLLAGIPQRVKFTVTTGHYTIKNGDSLQLSNAEAMLILCQAESRAVVYSNTREQSSEAALRIQSSDKVTSISLPVAPAYHVIEFELEVLSLPSAPALGGESDMLGMAEPHRKHKDKQRTGRCMVTTDHKVSIDCPWSIYSTVIALTFSVPFRTTHSLLSSGTRKYVQVCVQNLSELDFQLSDSYLVDTGDSTDLQLVPLNTQSQQPIYSKQSVFFVWELKWTEEPPPSLHCRFSVGFSPASEEQLSISLKPYTYEFKVENFFTLYNVKAEIFPPSGMEYCRTGSLCSLEVLITRLSDLLEVDKDEALTESDEHFSTKLMYEVVDNSSNWAVCGKSCGVISMPVAARATHRVHMEVMPLFAGYLPLPDVRLFKYLPHHSAHSSQLDADSWIENDSLSVDKHGDDQPDSSSLKSRGSVHSACSSEHKGLPMPRLQALPAGQVFNSSSGTQVLVIPSQDDHVLEVSVT

SEQ ID NO: 910752 - protein, 1259 aa, Homo sapiens; identical to SEQ ID NO: 910751

SEQ ID NO: 910753 - protein, 779 aa, Homo sapiens
MKATVCDFARRKKAPQKAEIYLQGALKNYLAEGWALPITHTRKQLAECQKHLGQIENYLQTSSLLASDHHLTEEERKHFCQEILDFASQPSDSPGHKIVLPMHSFAQLRDLHFDPSNAVVHVGGVLCVEITMYSQMPVPVHVEQIVVNVHFSIEKNSYRKTAEWLTKHKTSNGIINFPPETAPFPVSQNSLPALELYEMFERSPSDNSLNTTGIICRNVHMLLRRQESSSSLEMPSGVALEEGAHVLRCSHVTLEPGANQITFRTQAKEPGTYTLRQLCASVGSVWFVLPHIYPIVQYDVYSQEPQLHVEPLADSLLAGIPQRVKFTVTTGHYTIKNGDSLQLSNAEAMLILCQAESRAVVYSNTREQSSEAALRIQSSDKVTSISLPVAPAYHVIEFELEVLSLPSAPALGGESDMLGMAEPHRKHKDKQRTGRCMVTTDHKVSIDCPWSIYSTVIALTFSVPFRTTHSLLSSGTRKYVQVCVQNLSELDFQLSDSYLVDTGDSTDLQLVPLNTQSQQPIYSKQSVFFVWELKWTEEPPPSLHCRFSVGFSPASEEQLSISLKPYTYEFKVENFFTLYNVKAEIFPPSGMEYCRTGSLCSLEVLITRLSDLLEVDKDEALTESDEHFSTKLMYEVVDNSSNWAVCGKSCGVISMPVAARATHRVHMEVMPLFAGYLPLPDVRLFKYLPHHSAHSSQLDADSWIENDSLSVDKHGDDQPDSSSLKSRGSVHSACSSEHKGLPMPRLQALPAGQVFNSSSGTQVLVIPSQDDHVLEVSVT

SEQ ID NO: 910754 - protein, 820 aa, Homo sapiens
MDASEEPLPPVIYTMENKPIVTCAGDQNLFTSVYPTLSQQLPREPMEWRRSYGRAPKMIHLESNFVQFKEELLPKEGNKALLTFPFLHIYWTECCDTEVYKATVKDDLTKWQNVLKAHSSVDWLIVIVENDAKKKNKTNILPRTSIVDKIRNDFCNKQSDRCVVLSDPLKDSSRTQESWNAFLTKLRTLLLMSFTKNLGKFEDDMRTLREKRTEPGWSFCEYFMVQEELAFVFEMLQQFEDALVQYDELDALFSQYVVNFGAGDGANWLTFFCQPVKSWNGLILRKPIDMEKRESIQRREATLLDLRSYLFSRQCTLLLFLQRPWEVAQRALELLHNCVQELKLLEVSVPPGALDCWVFLSCLEVLQRIEGCCDRAQIDSNIAHTVGLWSYATEKLKSLGYLCGLVSEKGPNSEDLNRTVDLLAGLGAERPETANTAQSPYKKLKEALSSVEAFEKHYLDLSHATIEMYTSIGRIRSAKFVGKDLAEFYMRKKAPQKAEIYLQGALKNYLAEGWALPITHTRKQLAECQKHLGQIENYLQTSSLLASDHHLTEEERKHFCQEILDFASQPSDSPGHKIVLPMHSFAQLRDLHFDPSNAVVHVGGVLCVEITMYSQMPVPVHVEQIVVNVHFSIEKNSYRKTAEWLTKHKTSNGIINFPPETAPFPVSQNSLPALELYEMFERSPSDNSLNTTGIICRNVHMLLRRQESSSSLEMPSGVALEEGAHVLRCSHVTLEPGANQITFRTQAKEPGTYTLRQLCASVGSVWFVLPHIYPIVQYDVYSQEPQLHVEPLAGEWGPQPLRRRAAGAVLRRPAEMPGFS

SEQ ID NO: 910755 - protein, 276 aa, Homo sapiens
MDASEEPLPPVIYTMENKPIVTCAGDQNLFTSVYPTLSQQLPREPMEWRRSYGRAPKMIHLESNFVQFKEELLPKEGNKALLTFPFLHIYWTECCDTEVYKATVKDDLTKWQNVLKAHSSVDWLIVIVENDAKKKNKTNILPRTSIVDKIRNDFCNKQSDRCVVLSDPLKDSSRTQESWNAFLTKLRTLLLMSFTKNLGKFEDDMRTLREKRTEPGWSFCEYFMVQEELAFVFEMLQQFEDALVQYDELDALFSQYVVNFGAGGIKCPFHNSVACW

SEQ ID NO: 910756 - protein, 449 aa, Homo sapiens
MDASEEPLPPVIYTMENKPIVTCAGDQNLFTSVYPTLSQQLPREPMEWRRSYGRAPKMIHLESNFVQFKEELLPKEGNKALLTFPFLHIYWTECCDTEVYKATVKDDLTKWQNVLKAHSSVDWLIVIVENDAKKKNKTNILPRTSIVDKIRNDFCNKQSDRCVVLSDPLKDSSRTQESWNAFLTKLRTLLLMSFTKNLGKFEDDMRTLREKRTEPGWSFCEYFMVQEELAFVFEMLQQFEDALVQYDELDALFSQYVVNFGAGDGANWLTFFCQPVKSWNGLILRKPIDMEKRESIQRREATLLDLRSYLFSRQCTLLLFLQRPWEVAQRALELLHNCVQELKLLEVSVPPGALDCWVFLSCLEVLQRIEGCCDRAQIDSNIAHTVGLWSYATEKLKSLGYLCGLVSEKGPNSEDLNRTVDLLAGLGAERPETGSMYGGKSNEYATQCA

SEQ ID NO: 910757 - protein, 105 aa, Homo sapiens
ISFLFSPFPAQTLYNVKAEIFPPSGMEYCRTGSLCSLEVLITRLSDLLEVDKDEALTESDEHFSTKLMYEGRWSRTHGLKQSSRLGLPECWDYRCEALHSAYLAF

SEQ ID NO: 910758 - protein, 1202 aa, Homo sapiens [sequence omitted]

SEQ ID NO: 910759 - protein, 396 aa, Homo sapiens
WAAVVVAVLSVGEWSESVFVLPPQVSIDCPWSIYSTVIALTFSVPFRTTHSLLSSGTRKYVQVCVQNLSELDFQLSDSYLVDTGDSTDLQLVPLNTQSQQPIYSKQSVFFVWELKWTEEPPPSLHCRFSVGFSPASEEQLSISLKPYTYEFKVENFFGGPGPLARFQLAVSARVSPEEALRFWSLCLSSRCRQTLYNVKAEIFPPSGMEYCRTGSLCSLEVLITRLSDLLEVDKDEALTESDEHFSTKLMYEVVDNSSNWAVCGKSCGVISMPVAARATHRVHMEVMPLFAGYLPLPDVRLFKYLPHHSAHSSQLDADSWIENDSLSVDKHGDDQPDSSSLKSRGSVHSACSSEHKGLPMPRLQALPAGQVFNSSSGTQVLVIPSQDDHVLEVSVT

SEQ ID NO: 910760 - protein, 775 aa, Homo sapiens [sequence omitted]

SEQ ID NO: 910761 - protein, 101 aa, Homo sapiens
AAAYYYYYCSEFKLLTMYGDMCEGRSNFEEPWCQQENLEGDEVWGRSVLAVSTVLTLELISGADGYWLIVLLKIRSGYLTLLRCQYRHRTKAKCLLSKKIK

SEQ ID NO: 910762 - protein, 78 aa, Homo sapiens
MDASEEPLPPVIYTMENKPIVTCECPEAGRARRSLGGPGPWRYAPGAPRPSAPGALRAGPLPGGVTRAAAEAGPSDFS

SEQ ID NO: 910763 - protein, 2307 aa, Homo sapiens
MSPPPPPPPVRALPLLLLLAGPGAAAPPCLDGSPCANGGRCTQLPSREAACLCPPGWVGERCQLEDPCHSGPCAGRGVCQSSVVAGTARFSCRCPRGFRGPDCSLPDPCLSSPCAHGARCSVGPDGRFLCSCPPGYQGRSCRSDVDECRVGEPCRHGGTCLNTPGSFRCQCPAGYTGPLCENPAVPCAPSPCRNGGTCRQSGDLTYDCACLPGFEGQNCEVNVDDCPGHRCLNGGTCVDGVNTYNCQCPPEWTGQFCTEDVDECQLQPNACHNGGTCFNTLGGHSCVCVNGWTGESCSQNIDDCATAVCFHGATCHDRVASFYCACPMGKTGLLCHLDDACVSNPCHEDAICDTNPVNGRAICTCPPGFTGGACDQDVDECSIGANPCEHLGRCVNTQGSFLCQCGRGYTGPRCETDVNECLSGPCRNQATCLDRIGQFTCICMAGFTGTYCEVDIDECQSSPCVNGGVCKDRVNGFSCTCPSGFSGSTCQLDVDECASTPCRNGAKCVDQPDGYECRCAEGFEGTLCDRNVDDCSPDPCHHGRCVDGIASFSCACAPGYTGTRCESQVDECRSQPCRHGGKCLDLVDKYLCRCPSGTTGVNCEVNIDDCASNPCTFGVCRDGINRYDCVCQPGFTGPLCNVEINECASSPCGEGGSCVDGENGFRCLCPPGSLPPLCLPPSHPCAHEPCSHGICYDAPGGFRCVCEPGWSGPRCSQSLARDACESQPCRAGGTCSSDGMGFHCTCPPGVQGRQCELLSPCTPNPCEHGGRCESAPGQLPVCSCPQGWQGPRCQQDVDECAGPAPCGPHGICTNLAGSFSCTCHGGYTGPSCDQDINDCDPNPCLNGGSCQDGVGSFSCSCLPGFAGPRCARDVDECLSNPCGPGTCTDHVASFTCTCPPGYGGFHCEQDLPDCSPSSCFNGGTCVDGVNSFSCLCRPGYTGAHCQHEADPCLSRPCLHGGVCSAAHPGFRCTCLESFTGPQCQTLVDWCSRQPCQNGGRCVQTGAYCLCPPGWSGRLCDIRSLPCREAAAQIGVRLEQLCQAGGQCVDEDSSHYCVCPEGRTGSHCEQEVDPCLAQPCQHGGTCRGYMGGYMCECLPGYNGDNCEDDVDECASQPCQHGGSCIDLVARYLCSCPPGTLGVLCEINEDDCGPGPPLDSGPRCLHNGTCVDLVGGFRCTCPPGYTGLRCEADINECRSGACHAAHTRDCLQDPGGGFRCLCHAGFSGPRCQTVLSPCESQPCQHGGQCRPSPGPGGGLTFTCHCAQPFWGPRCERVARSCRELQCPVGVPCQQTPRGPRCACPPGLSGPSCRSFPGSPPGASNASCAAAPCLHGGSCRPAPLAPFFRCACAQGWTGPRCEAPAAAPEVSEEPRCPRAACQAKRGDQRCDRECNSPGCGWDGGDCSLSVGDPWRQCEALQCWRLFNNSRCDPACSSPACLYDNFDCHAGGRERTCNPVYEKYCADHFADGRCDQGCNTEECGWDGLDCASEVPALLARGVLVLTVLLPPEELLRSSADFLQRLSAILRTSLRFRLDAHGQAMVFPYHRPSPGSEPRARRELAPEVIGSVVMLEIDNRLCLQSPENDHCFPDAQSAADYLGALSAVERLDFPYPLRDVRGEPLEPPEPSVPLLPLLVAGAVLLLVILVLGVMVARRKREHSTLWFPEGFSLHKDVASGHKGRREPVGQDALGMKNMAKGESLMGEVATDWMDTECPEAKRLKVEEPGMGAEEAVDCRQWTQHHLVAADIRVAPAMALTPPQGDADADGMDVNVRGPDGFTPLMLASFCGGALEPMPTEEDEADDTSASIISDLICQGAQLGARTDRTGETALHLAARYARADAAKRLLDAGADTNAQDHSGRTPLHTAVTADAQGVFQILIRNRSTDLDARMADGSTALILAARLAVEGMVEELIASHADVNAVDELGKSALHWAAAVNNVEATLALLKNGANKDMQDSKEETPLFLAAREGSYEAAKLLLDHFANREITDHLDRLPRDVAQERLHQDIVRLLDQPSGPRSPPGPHGLGPLLCPPGAFLPGLKAAQSGSKKSRRPPGKAGLGPQGPRGRGKKLTLACPGPLADSSVTLSPVDSLDSPRPFGGPPASPGGFPLEGPYAAATATAVSLAQLGGPGRAGLGRQPPGGCVLSLGLLNPVAVPLDWARLPPPAPPGPSFLLPLAPGPQLLNPGTPVSPQERPPPYLAVPGHGEEYPVAGAHSSPPKARFLRVPSEHPYLTPSPESPEHWASPSPPSLSDWSESTPSPATATGAMATTTGALPAQPLPLSVPSSLAQAQTQLGPQPEVTPKRQVLA

SEQ ID NO: 910764 - protein, 1515 aa, Homo sapiens
MDLDSSDQMHPIPVEPGFLLNSSQSKAYPSQTGLNGGKVGDQTAFLLSADPCLNGGSCQDGVGSFSCSCLPGFAGPRCARDVDECLSNPCGPGTCTDHVASFTCTCPPGYGGFHCEQDLPDCSPSSCFNGGTCVDGVNSFSCLCRPGYTGAHCQHEADPCLSRPCLHGGVCSAAHPGFRCTCLESFTGPQCQTLVDWCSRQPCQNGGRCVQTGAYCLCPPGWSGRLCDIRSLPCREAAAQIGVRLEQLCQAGGQCVDEDSSHYCVCPEGRTGSHCEQEVDPCLAQPCQHGGTCRGYMGGYMCECLPGYNGDNCEDDVDECASQPCQHGGSCIDLVARYLCSCPPGTLGVLCEINEDDCGPGPPLDSGPRCLHNGTCVDLVGGFRCTCPPGYTGLRCEADINECRSGACHAAHTRDCLQDPGGGFRCLCHAGFSGPRCQTVLSPCESQPCQHGGQCRPSPGPGGGLTFTCHCAQPFWGPRCERVARSCRELQCPVGVPCQQTPRGPRCACPPGLSGPSCRSFPGSPPGASNASCAAAPCLHGGSCRPAPLAPFFRCACAQGWTGPRCEAPAAAPEVSEEPRCPRAACQAKRGDQRCDRECNSPGCGWDGGDCSLSVGDPWRQCEALQCWRLFNNSRCDPACSSPACLYDNFDCHAGGRERTCNPVYEKYCADHFADGRCDQGCNTEECGWDGLDCASEVPALLARGVLVLTVLLPPEELLRSSADFLQRLSAILRTSLRFRLDAHGQAMVFPYHRPSPGSEPRARRELAPEVIGSVVMLEIDNRLCLQSPENDHCFPDAQSAADYLGALSAVERLDFPYPLRDVRGEPLEPPEPSVPLLPLLVAGAVLLLVILVLGVMVARRKREHSTLWFPEGFSLHKDVASGHKGRREPVGQDALGMKNMAKGESLMGEVATDWMDTECPEAKRLKVEEPGMGAEEAVDCRQWTQHHLVAADIRVAPAMALTPPQGDADADGMDVNVRGPDGFTPLMLASFCGGALEPMPTEEDEADDTSASIISDLICQGAQLGARTDRTGETALHLAARYARADAAKRLLDAGADTNAQDHSGRTPLHTAVTADAQGVFQILIRNRSTDLDARMADGSTALILAARLAVEGMVEELIASHADVNAVDELGKSALHWAAAVNNVEATLALLKNGANKDMQDSKEETPLFLAAREGSYEAAKLLLDHFANREITDHLDRLPRDVAQERLHQDIVRLLDQPSGPRSPPGPHGLGPLLCPPGAFLPGLKAAQSGSKKSRRPPGKAGLGPQGPRGRGKKLTLACPGPLADSSVTLSPVDSLDSPRPFGGPPASPGGFPLEGPYAAATATAVSLAQLGGPGRAGLGRQPPGGCVLSLGLLNPVAVPLDWARLPPPAPPGPSFLLPLAPGPQLLNPGTPVSPQERPPPYLAVPGHGEEYPVAGAHSSPPKARFLRVPSEHPYLTPSPESPEHWASPSPPSLSDWSESTPSPATATGAMATTTGALPAQPLPLSVPSSLAQAQTQLGPQPEVTPKRQVLA

SEQ ID NO: 910765 - protein, 1213 aa, Homo sapiens
MCLPGYNGDNCEDDVDECASQPCQHGGSCIDLVARYLCSCPPGTLGVLCEINEDDCGPGPPLDSGPRCLHNGTCVDLVGGFRCTCPPGYTGLRCEADINECRSGACHAAHTRDCLQDPGGGFRCLCHAGFSGPRCQTVLSPCESQPCQHGGQCRPSPGPGGGLTFTCHCAQPFWGPRCERVARSCRELQCPVGVPCQQTPRGPRCACPPGLSGPSCRSFPGSPPGASNASCAAAPCLHGGSCRPAPLAPFFRCACAQGWTGPRCEAPAAAPEVSEEPRCPRAACQAKRGDQRCDRECNSPGCGWDGGDCSLSVGDPWRQCEALQCWRLFNNSRCDPACSSPACLYDNFDCHAGGRERTCNPVYEKYCADHFADGRCDQGCNTEECGWDGLDCASEVPALLARGVLVLTVLLPPEELLRSSADFLQRLSAILRTSLRFRLDAHGQAMVFPYHRPSPGSEPRARRELAPEVIGSVVMLEIDNRLCLQSPENDHCFPDAQSAADYLGALSAVERLDFPYPLRDVRGEPLEPPEPSVPLLPLLVAGAVLLLVILVLGVMVARRKREHSTLWFPEGFSLHKDVASGHKGRREPVGQDALGMKNMAKGESLMGEVATDWMDTECPEAKRLKVEEPGMGAEEAVDCRQWTQHHLVAADIRVAPAMALTPPQGDADADGMDVNVRGPDGFTPLMLASFCGGALEPMPTEEDEADDTSASIISDLICQGAQLGARTDRTGETALHLAARYARADAAKRLLDAGADTNAQDHSGRTPLHTAVTADAQGVFQILIRNRSTDLDARMADGSTALILAARLAVEGMVEELIASHADVNAVDELGKSALHWAAAVNNVEATLALLKNGANKDMQDSKEETPLFLAAREGSYEAAKLLLDHFANREITDHLDRLPRDVAQERLHQDIVRLLDQPSGPRSPPGPHGLGPLLCPPGAFLPGLKAAQSGSKKSRRPPGKAGLGPQGPRGRGKKLTLACPGPLADSSVTLSPVDSLDSPRPFGGPPASPGGFPLEGPYAAATATAVSLAQLGGPGRAGLGRQPPGGCVLSLGLLNPVAVPLDWARLPPPAPPGPSFLLPLAPGPQLLNPGTPVSPQERPPPYLAVPGHGEEYPVAGAHSSPPKARFLRVPSEHPYLTPSPESPEHWASPSPPSLSDWSESTPSPATATGAMATTTGALPAQPLPLSVPSSLAQAQTQLGPQPEVTPKRQVLA

SEQ ID NO: 910766 - protein, 2255 aa, Homo sapiens
MSPPPPPPPVRALPLLLLLAGPGAAAPPCLDGSPCANGGRCTQLPSREAACLCPPGWVGERCQLEDPCHSGPCAGRGVCQSSVVAGTARFSCRCPRGFRGPDCSLPDPCLSSPCAHGARCSVGPDGRFLCSCPPGYQGRSCRSDVDECRVGEPCRHGGTCLNTPGSFRCQCPAGYTGPLCENPAVPCAPSPCRNGGTCRQSGDLTYDCACLPGFEGQNCEVNVDDCPGHRCLNGGTCVDGVNTYNCQCPPEWTGQFCTEDVDECQLQPNACHNGGTCFNTLGGHSCVCVNGWTGESCSQNIDDCATAVCFHGATCHDRVASFYCACPMGKTGLLCHLDDACVSNPCHEDAICDTNPVNGRAICTCPPGFTGGACDQDVDECSIGANPCEHLGRCVNTQGSFLCQCGRGYTGPRCETDVNECLSGPCRNQATCLDRIGQFTCICMAGFTGTYCEVDIDECQSSPCVNGGVCKDRVNGFSCTCPSGFSGSTCQLDVDECASTPCRNGAKCVDQPDGYECRCAEGFEGTLCDRNVDDCSPDPCHHGRCVDGIASFSCACAPGYTGTRCESQVDECRSQPCRHGGKCLDLVDKYLCRCPSGTTGVNCEVNIDDCASNPCTFGVCRDGINRYDCVCQPGFTGPLCNVEINECASSPCGEGGSCVDGENGFRCLCPPGSLPPLCLPPSHPCAHEPCSHGICYDAPGGFRCVCEPGWSGPRCSQSLARDACESQPCRAGGTCSSDGMGFHCTCPPGVQGRQCELLSPCTPNPCEHGGRCESAPGQLPVCSCPQGWQDPCLNGGSCQDGVGSFSCSCLPGFAGPRCARDVDECLSNPCGPGTCTDHVASFTCTCPPGYGGFHCEQDLPDCSPSSCFNGGTCVDGVNSFSCLCRPGYTGAHCQHEADPCLSRPCLHGGVCSAAHPGFRCTCLESFTGPQCQTLVDWCSRQPCQNGGRCVQTGAYCLCPPGWSGRLCDIRSLPCREAAAQIGVRLEQLCQAGGQCVDEDSSHYCVCPEGRTGSHCEQEVDPCLAQPCQHGGTCRGYMGGYMCECLPGYNGDNCEDDVDECASQPCQHGGSCIDLVARYLCSCPPGTLGVLCEINEDDCGPGPPLDSGPRCLHNGTCVDLVGGFRCTCPPGYTGLRCEADINECRSGACHAAHTRDCLQDPGGGFRCLCHAGFSGPRCQTVLSPCESQPCQHGGQCRPSPGPGGGLTFTCHCAQPFWGPRCERVARSCRELQCPVGVPCQQTPRGPRCACPPGLSGPSCRSFPGSPPGASNASCAAAPCLHGGSCRPAPLAPFFRCACAQGWTGPRCEAPAAAPEVSEEPRCPRAACQAKRGDQRCDRECNSPGCGWDGGDCSLSVGDPWRQCEALQCWRLFNNSRCDPACSSPACLYDNFDCHAGGRERTCNPVYEKYCADHFADGRCDQGCNTEECGWDGLDCASEVPALLARGVLVLTVLLPPEELLRSSADFLQRLSAILRTSLRFRLDAHGQAMVFPYHRPSPGSEPRARRELAPEVIGSVVMLEIDNRLCLQSPENDHCFPDAQSAADYLGALSAVERLDFPYPLRDVRGEPLEPPEPSVPLLPLLVAGAVLLLVILVLGVMVARRKREHSTLWFPEGFSLHKDVASGHKGRREPVGQDALGMKNMAKGESLMGEVATDWMDTECPEAKRLKVEEPGMGAEEAVDCRQWTQHHLVAADIRVAPAMALTPPQGDADADGMDVNVRGPDGFTPLMLASFCGGALEPMPTEEDEADDTSASIISDLICQGAQLGARTDRTGETALHLAARYARADAAKRLLDAGADTNAQDHSGRTPLHTAVTADAQGVFQILIRNRSTDLDARMADGSTALILAARLAVEGMVEELIASHADVNAVDELGKSALHWAAAVNNVEATLALLKNGANKDMQDSKEETPLFLAAREGSYEAAKLLLDHFANREITDHLDRLPRDVAQERLHQDIVRLLDQPSGPRSPPGPHGLGPLLCPPGAFLPGLKAAQSGSKKSRRPPGKAGLGPQGPRGRGKKLTLACPGPLADSSVTLSPVDSLDSPRPFGGPPASPGGFPLEGPYAAATATAVSLAQLGGPGRAGLGRQPPGGCVLSLGLLNPVAVPLDWARLPPPAPPGPSFLLPLAPGPQLLNPGTPVSPQERPPPYLAVPGHGEEYPVAGAHSSPPKARFLRVPSEHPYLTPSPESPEHWASPSPPSLSDWSESTPSPATATGAMATTTGALPAQPLPLSVPSSLAQAQTQLGPQPEVTPKRQVLA

SEQ ID NO: 910767 - protein, 1939 aa, Homo sapiens
MSPPPPPPPVRALPLLLLLAGPGAAAPPCLDGSPCANGGRCTQLPSREAACLCPPGWVGERCQLEDPCHSGPCAGRGVCQSSVVAGTARFSCRCPRGFRGPDCSLPDPCLSSPCAHGARCSVGPDGRFLCSCPPGYQGRSCRSDVDECRVGEPCRHGGTCLNTPGSFRCQCPAGYTGPLCENPAVPCAPSPCRNGGTCRQSGDLTYDCACLPGFEGQNCEVNVDDCPGHRCLNGGTCVDGVNTYNCQCPPEWTGQFCTEDVDECQLQPNACHNGGTCFNTLGGHSCVCVNGWTGESCSQNIDDCATAVCFHGATCHDRVASFYCACPMGKTGLLCHLDDACVSNPCHEDAICDTNPVNGRAICTCPPGFTGGACDQDVDECSIGANPCEHLGRCVNTQGSFLCQCGRGYTGPRCETDVNECLSGPCRNQATCLDRIGQFTCICMAGFTGTYCEVDIDECQSSPCVNGGVCKDRVNGFSCTCPSGFSGSTCQLDVDECASTPCRNGAKCVDQPDGYECRCAEGFEGTLCDRNVDDCSPDPCHHGRCVDGIASFSCACAPGYTGTRCESQVDECRSQPCRHGGKCLDLVDKYLCRCPSGTTGVNCEVNIDDCASNPCTFGVCRDGINRYDCVCQPGFTGPLCNVEINECASSPCGEGGSCVDGENGFRCLCPPGSLPPLCLPPSHPCAHEPCSHGICYDAPGGFRCVCEPGWSGPRCSQSLARDACESQPCRAGGTCSSDGMGFHCTCPPGVQGRQCELLSPCTPNPCEHGGRCESAPGQLPVCSCPQGWQDPCLNGGSCQDGVGSFSCSCLPGFAGPRCARDVDECLSNPCGPGTCTDHVASFTCTCPPGYGGFHCEQDLPDCSPSSCFNGGTCVDGVNSFSCLCRPGYTGAHCQHEADPCLSRPCLHGGVCSAAHPGFRCTCLESFTGPQCQTLVDWCSRQPCQNGGRCVQTGAYCLCPPGWSGRLCDIRSLPCREAAAQIGVRLEQLCQAGGQCVDEDSSHYCVCPEGRTGSHCEQEVDPCLAQPCQHGGTCRGYMGGYMCECLPGYNGDNCEDDVDECASQPCQHGGSCIDLVARYLCSCPPGTLGVLCEINEDDCGPGPPLDSGPRCLHNGTCVDLVGGFRCTCPPGYTGLRCEADINECRSGACHAAHTRDCLQDPGGGFRCLCHAGFSGPRCQTVLSPCESQPCQHGGQCRPSPGPGGGLTFTCHCAQPFWGPRCERVARSCRELQCPVGVPCQQTPRGPRCACPPGLSGPSCRSFPGSPPGASNASCAAAPCLHGGSCRPAPLAPFFRCACAQGWTGPRCEAPAAAPEVSEEPRCPRAACQAKRGDQRCDRECNSPGCGWDGGDCSLSVGDPWRQCEALQCWRLFNNSRCDPACSSPACLYDNFDCHAGGRERTCNPVYEKYCADHFADGRCDQGCNTEECGWDGLDCASEVPALLARGVLVLTVLLPPEELLRSSADFLQRLSAILRTSLRFRLDAHGQAMVFPYHRPSPGSEPRARRELAPEVIGSVVMLEIDNRLCLQSPENDHCFPDAQSAADYLGALSAVERLDFPYPLRDVRGEPLEPPEPSVPLLPLLVAGAVLLLVILVLGVMVARRKREHSTLWFPEGFSLHKDVASGHKGRREPVGQDALGMKNMAKGESLMGEVATDWMDTECPEAKRLKVEEPGMGAEEAVDCRQWTQHHLVAADIRVAPAMALTPPQGDADADGMDVNVRGPDGFTPLMLASFCGGALEPMPTEEDEADDTSASIISDLICQGAQLGARTDRTGETALHLAARYARADAAKRLLDAGADTNAQDHSGRTPLHTAVTADAQGVFQILIRNRSTDLDARMADGSTALILAARLAVEGMVEELIASHADVNAVDELGKSALHWAAAVNNVEATLALLKNGANKDMQDSKVSPSPWSTGCQQWHSAIAIQPGQQSETLSKNKTK

SEQ ID NO: 910768 - protein, 1219 aa, Homo sapiens
MSPPPPPPPVRALPLLLLLAGPGAAAPPCLDGSPCANGGRCTQLPSREAACLCPPGWVGERCQLEDPCHSGPCAGRGVCQSSVVAGTARFSCRCPRGFRGPDCSLPDPCLSSPCAHGARCSVGPDGRFLCSCPPGYQGRSCRSDVDECRVGEPCRHGGTCLNTPGSFRCQCPAGYTGPLCENPAVPCAPSPCRNGGTCRQSGDLTYDCACLPGFEGQNCEVNVDDCPGHRCLNGGTCVDGVNTYNCQCPPEWTGQFCTEDVDECQLQPNACHNGGTCFNTLGGHSCVCVNGWTGESCSQNIDDCATAVCFHGATCHDRVASFYCACPMGKTGLLCHLDDACVSNPCHEDAICDTNPVNGRAICTCPPGFTGGACDQDVDECSIGANPCEHLGRCVNTQGSFLCQCGRGYTGPRCETDVNECLSGPCRNQATCLDRIGQFTCICMAGFTGTYCEVDIDECQSSPCVNGGVCKDRVNGFSCTCPSGFSGSTCQLDVDECASTPCRNGAKCVDQPDGYECRCAEGFEGTLCDRNVDDCSPDPCHHGRCVDGIASFSCACAPGYTGTRCESQVDECRSQPCRHGGKCLDLVDKYLCRCPSGTTGVNCEVNIDDCASNPCTFGVCRDGINRYDCVCQPGFTGPLCNVEINECASSPCGEGGSCVDGENGFRCLCPPGSLPPLCLPPSHPCAHEPCSHGICYDAPGGFRCVCEPGWSGPRCSQSLARDACESQPCRAGGTCSSDGMGFHCTCPPGVQGRQCELLSPCTPNPCEHGGRCESAPGQLPVCSCPQGWQDPCLNGGSCQDGVGSFSCSCLPGFAGPRCARDVDECLSNPCGPGTCTDHVASFTCTCPPGYGGFHCEQDLPDCSPSSCFNGGTCVDGVNSFSCLCRPGYTGAHCQHEADPCLSRPCLHGGVCSAAHPGFRCTCLESFTGPQCQTLVDWCSRQPCQNGGRCVQTGAYCLCPPGWSGRLCDIRSLPCREAAAQIGVRLEQLCQAGGQCVDEDSSHYCVCPEGRTGSHCEQEVDPCLAQPCQHGGTCRGYMGGYMCECLPGYNGDNCEDDVDECASQPCQHGGSCIDLVARYLCSCPPGTLGVLCEINEDDCGPGPPLDSGPRCLHNGTCVDLVGGFRCTCPPGYTGLRCEADINECRSGACHAAHTRDCLQDPGGGFRCLCHAGFSGPRCQTVLSPCESQPCQHGGQCRPSPGPGGGLTFTCHCAQVGVGGG

SEQ ID NO: 910769 - protein, 887 aa, Homo sapiens
MSPPPPPPPVRALPLLLLLAGPGAAAPPCLDGSPCANGGRCTQLPSREAACLCPPGWVGERCQLEDPCHSGPCAGRGVCQSSVVAGTARFSCRCPRGFRGPDCSLPDPCLSSPCAHGARCSVGPDGRFLCSCPPGYQGRSCRSDVDECRVGEPCRHGGTCLNTPGSFRCQCPAGYTGPLCENPAVPCAPSPCRNGGTCRQSGDLTYDCACLPGFEGQNCEVNVDDCPGHRCLNGGTCVDGVNTYNCQCPPEWTGQFCTEDVDECQLQPNACHNGGTCFNTLGGHSCVCVNGWTGESCSQNIDDCATAVCFHGATCHDRVASFYCACPMGKTGLLCHLDDACVSNPCHEDAICDTNPVNGRAICTCPPGFTGGACDQDVDECSIGANPCEHLGRCVNTQGSFLCQCGRGYTGPRCETDVNECLSGPCRNQATCLDRIGQFTCICMAGFTGTYCEVDIDECQSSPCVNGGVCKDRVNGFSCTCPSGFSGSTCQLDVDECASTPCRNGAKCVDQPDGYECRCAEGFEGTLCDRNVDDCSPDPCHHGRCVDGIASFSCACAPGYTGTRCESQVDECRSQPCRHGGKCLDLVDKYLCRCPSGTTGVNCEVNIDDCASNPCTFGVCRDGINRYDCVCQPGFTGPLCNVEINECASSPCGEGGSCVDGENGFRCLCPPGSLPPLCLPPSHPCAHEPCSHGICYDAPGGFRCVCEPGWSGPRCSQSLARDACESQPCRAGGTCSSDGMGFHCTCPPGVQGRQCELLSPCTPNPCEHGGRCESAPGQLPVCSCPQGWQGPRCQQDVDECAGPAPCGPHGICTNLAGSFSCTCHGGYTGPSCDQDINDCDPSECRGALGGAALGNTVIKLELCAWHCAVISSSQLSYFSRFIYMETE

SEQ ID NO: 910770 - protein, 2255 aa, Homo sapiens; identical to SEQ ID NO: 910766

SEQ ID NO: 910771 - protein, 1124 aa, Homo sapiens
CRSGPATRHTPGTAAGPARFFFPPPGFFWGPPLFLGSMLASQGPRCQTVLSPCESQPCQHGGQCRPSPGPGGGLTFTCHCAQPFWGPRCERVARSCRELQCPVGVPCQQTPRGPRCACPPGLSGPSCRSFPGSPPGASNASCAAAPCLHGGSCRPAPLAPFFRCACAQGWTGPRCEAPAAAPEVSEEPRCPRAACQAKRGDQRCDRECNSPGCGWDGGDCSLSVGDPWRQCEALQCWRLFNNSRCDPACSSPACLYDNFDCHAGGRERTCNPVYEKYCADHFADGRCDQGCNTEECGWDGLDCASEVPALLARGVLVLTVLLPPEELLRSSADFLQRLSAILRTSLRFRLDAHGQAMVFPYHRPSPGSEPRARRELAPEVIGSVVMLEIDNRLCLQSPENDHCFPDAQSAADYLGALSAVERLDFPYPLRDVRGEPLEPPEPSVPLLPLLVAGAVLLLVILVLGVMVARRKREHSTLWFPEGFSLHKDVASGHKGRREPVGQDALGMKNMAKGESLMGEVATDWMDTECPEAKRLKVEEPGMGAEEAVDCRQWTQHHLVAADIRVAPAMALTPPQGDADADGMDVNVRGPDGFTPLMLASFCGGALEPMPTEEDEADDTSASIISDLICQGAQLGARTDRTGETALHLAARYARADAAKRLLDAGADTNAQDHSGRTPLHTAVTADAQGVFQILIRNRSTDLDARMADGSTALILAARLAVEGMVEELIASHADVNAVDELGKSALHWAAAVNNVEATLALLKNGANKDMQDSKEETPLFLAAREGSYEAAKLLLDHFANREITDHLDRLPRDVAQERLHQDIVRLLDQPSGPRSPPGPHGLGPLLCPPGAFLPGLKAAQSGSKKSRRPPGKAGLGPQGPRGRGKKLTLACPGPLADSSVTLSPVDSLDSPRPFGGPPASPGGFPLEGPYAAATATAVSLAQLGGPGRAGLGRQPPGGCVLSLGLLNPVAVPLDWARLPPPAPPGPSFLLPLAPGPQLLNPGTPVSPQERPPPYLAVPGHGEEYPVAGAHSSPPKARFLRVPSEHPYLTPSPESPEHWASPSPPSLSDWSESTPSPATATGAMATTTGALPAQPLPLSVPSSLAQAQTQLGPQPEVTPKRQVLA

SEQ ID NO: 910772 - protein, 2255 aa, Homo sapiens; identical to SEQ ID NO: 910766

SEQ ID NO: 910773 - protein, 1869 aa, Homo sapiens
MSPPPPPPPVRALPLLLLLAGPGAAAPPCLDGSPCANGGRCTQLPSREAACLCPPGWVGERCQLEDPCHSGPCAGRGVCQSSVVAGTARFSCRCPRGFRGPDCSLPDPCLSSPCAHGARCSVGPDGRFLCSCPPGYQGRSCRSDVDECRVGEPCRHGGTCLNTPGSFRCQCPAGYTGPLCENPAVPCAPSPCRNGGTCRQSGDLTYDCACLPGFEGQNCEVNVDDCPGHRCLNGGTCVDGVNTYNCQCPPEWTGQFCTEDVDECQLQPNACHNGGTCFNTLGGHSCVCVNGWTGESCSQNIDDCATAVCFHGATCHDRVASFYCACPMGKTGLLCHLDDACVSNPCHEDAICDTNPVNGRAICTCPPGFTGGACDQDVDECSIGANPCEHLGRCVNTQGSFLCQCGRGYTGPRCETDVNECLSGPCRNQATCLDRIGQFTCICMAGFTGTYCEVDIDECQSSPCVNGGVCKDRVNGFSCTCPSGFSGSTCQLDVDECASTPCRNGAKCVDQPDGYECRCAEGFEGTLCDRNVDDCSPDPCHHGRCVDGIASFSCACAPGYTGTRCESQVDECRSQPCRHGGKCLDLVDKYLCRCPSGTTGVNCEVNIDDCASNPCTFGVCRDGINRYDCVCQPGFTGPLCNVEINECASSPCGEGGSCVDGENGFRCLCPPGSLPPLCLPPSHPCAHEPCSHGICYDAPGGFRCVCEPGWSGPRCSQSLARDACESQPCRAGGTCSSDGMGFHCTCPPGVQGRQCELLSPCTPNPCEHGGRCESAPGQLPVCSCPQGWQDPCLNGGSCQDGVGSFSCSCLPGFAGPRCARDVDECLSNPCGPGTCTDHVASFTCTCPPGYGGFHCEQDLPDCSPSSCFNGGTCVDGVNSFSCLCRPGYTGAHCQHEADPCLSRPCLHGGVCSAAHPGFRCTCLESFTGPQCQTLVDWCSRQPCQNGGRCVQTGAYCLCPPGWSGRLCDIRSLPCREAAAQIGVRLEQLCQAGGQCVDEDSSHYCVCPEGRTGSHCEQEVDPCLAQPCQHGGTCRGYMGGYMCECLPGYNGDNCEDDVDECASQPCQHGGSCIDLVARYLCSCPPGTLGVLCEINEDDCGPGPPLDSGPRCLHNGTCVDLVGGFRCTCPPGYTGLRCEADINECRSGACHAAHTRDCLQDPGGGFRCLCHAGFSGPRCQTVLSPCESQPCQHGGQCRPSPGPGGGLTFTCHCAQPFWGPRCERVARSCRELQCPVGVPCQQTPRGPRCACPPGLSGPSCRSFPGSPPGASNASCAAAPCLHGGSCRPAPLAPFFRCACAQGWTGPRCEAPAAAPEVSEEPRCPRAACQAKRGDQRCDRECNSPGCGWDGGDCSLSVGDPWRQCEALQCWRLFNNSRCDPACSSPACLYDNFDCHAGGRERTCNPVYEKYCADHFADGRCDQGCNTEECGWDGLDCASEVPALLARGVLVLTVLLPPEELLRSSADFLQRLSAILRTSLRFRLDAHGQAMVFPYHRPSPGSEPRARRELAPEVIGSVVMLEIDNRLCLQSPENDHCFPDAQSAADYLGALSAVERLDFPYPLRDVRGEPLEPPEPSVPLLPLLVAGAVLLLVILVLGVMVARRKREHSTLWFPEGFSLHKDVASGHKGRREPVGQDALGMKNMAKGESLMGEVATDWMDTECPEAKRLKVEEPGMGAEEAVDCRQWTQHHLVAADIRVAPAMALTPPQGDADADGMDVNVRGPDGFTPLMLASFCGGALEPMPTEEDEADDTSASIISDLICQGAQLGARTDRTGETALHLAARYARADAAKRLLDAGADTNAQDHSGRTPLHTAVTADAQGVFQILIRNRSTDLDARMADGSTALILAARLARTSVLARTSDGPHNPYCP

SEQ ID NO: 910774 - protein, 254 aa, Homo sapiens
MVREANIKQATAEKQLKEAQGKIDVLQAEVAALKTLVLSSSPTSPTQEPLPGGKTPFKKGHTRNKSTSSAMSGSHQDLSVIQPIVKDCKEADLSLYNEFRLWKDEPTMDRTCPFLDKIYQEDIFPCLTFSKSELASAVLEAVENNTLSIEPVGLQPIRFVKASAVECGGPKKCALTGQSKSCKHRIKLGDSSNYYYISPFCRYRITSVCNFFTYIRYIQQGLVKQQDVDQMFWEVMQLRKEMSLAKLGYFKEEL

SEQ ID NO: 910775 - protein, 460 aa, Homo sapiens
MANDPLEGFHEVNLASPTSPDLLGVYESGTQEQTTSPSVIYRPHPSALSSVPIQANALDVSELPTQPVYSSPRRLNCAEISSISFHVTDPAPCSTSGVTAGLTKLTTRKDNYNAEREFLQGATITEACDGSDDIFGLSTDSLSRLRSPSVLEVREKGYERLKEELAKAQRELKLKDEECERLSKVRDQLGQELEELTASLFEEAHKMVREANIKQATAEKQLKEAQGKIDVLQAEVAALKTLVLSSSPTSPTQEPLPGGKTPFKKGHTRNKSTSSAMSGSHQDLSVIQPIVKDCKEADLSLYNEFRLWKDEPTMDRTCPFLDKIYQEDIFPCLTFSKSELASAVLEAVENNTLSIEPVGLQPIRFVKASAVECGGPKKCALTGQSKSCKHRIKLGDSSNYYYISPFCRYRITSVCNFFTYIRYIQQGLVKQQDVDQMFWEVMQLRKEMSLAKLGYFKEEL

SEQ ID NO: 910776 - protein, 460 aa, Homo sapiens; identical to SEQ ID NO: 910775

SEQ ID NO: 910777 - protein, 304 aa, Homo sapiens
MANDPLEGFHEVNLASPTSPDLLGVYESGTQEQTTSPSVIYRPHPSALSSVPIQANALDVSELPTQPVYSSPRRLNCAEISSISFHVTDPAPCSTSGVTAGLTKLTTRKDNYNAEREFLQGATITEACDGSDDIFGLSTDSLSRLRSPSVLEVREKGYERLKEELAKAQRELKLKDEECERLSKVRDQLGQELEELTASLFEEAHKMVREANIKQATAEKQLKEAQGKIDVLQAEVAALKTLVLSSSPTSPTQEPLPGGKTPFKKGHTRNKSTSSAMSGSHQDLSVIQPIVKDCKEKMCSHWPE

SEQ ID NO: 910778 - protein, 395 aa, Homo sapiens
MANDPLEGFHEVNLASPTSPDLLGVYESGTQEQTTSPSVIYRPHPSALSSVPIQANALDVSELPTQPVYSSPRRLNCAEISSISFHVTDPAPCSTSGVTAGLTKLTTRKDNYNAEREFLQGATITEACDGSDDIFGLSTDSLSRLRSPSVLEVREKGYERLKEELAKAQRELKLKDEECERLSKVRDQLGQELEELTASLFEEAHKMVREANIKQATAEKQLKEAQGKIDVLQAEVAALKTLVLSSSPTSPTQEPLPGGKTPFKKGHTRNKSTSSAMSGSHQDLSVIQPIVKDCKEADLSLYNEFRLWKDEPTMDRTCPFLDKIYQEDIFPCLTFSKSELASAVLEAVENNTLSIEPVGLQPIRFVKASAVECGGPKSLLYVTFLHTFDTFSRDS

SEQ ID NO: 910779 - protein, 395 aa, Homo sapiens; identical to SEQ ID NO: 910778

SEQ ID NO: 910780 - protein, 320 aa, Homo sapiens
MGLKKMKGLSYDEAFAMANDPLEGFHEVNLASPTSPDLLGVYESGTQEQTTSPSVIYRPHPSALSSVPIQANALDVSELPTQPVYSSPRRLNCAEISSISFHVTDPAPCSTSGVTAGLTKLTTRKDNYNAEREFLQGATITEACDGSDDIFGLSTDSLSRLRSPSVLEVREKGYERLKEELAKAQRELKLKDEECERLSKVRDQLGQELEELTASLFEEAHKMVREANIKQATAEKQLKEAQGKIDVLQAEVAALKTLVLSSSPTSPTQEPLPGGKTPFKKGHTRNKSTSSAMSGSHQDLSVIQPIVKDCKEKMCSHWPE

SEQ ID NO: 910781 - protein, 142 aa, Homo sapiens
GRGRCRCWRRAGRGTRGFGGMPRPGELALRLGTWAPGPWGRRVGGTLATRVSRPPPGLLVGVGRRLLPRARARYTLTARSRAPGAGSPSPAGYLAAGGRGRERRAAVAKRMKREFPNKSEAAHNTGRRAAGLWTWGGFVSQS

SEQ ID NO: 910782 - protein, 167 aa, Homo sapiens
MMLADLSLYNEFRLWKDEPTMDRTCPFLDKIYQEDIFPCLTFSKSELASAVLEAVENNTLSIEPVGLQPIRFVKASAVECGGPKKCALTGQSKSCKHRIKLGDSSNYYYISPFCRYRITSVCNFFTYIRYIQQGLVKQQDVDQMFWEVMQLRKEMSLAKLGYFKEEL

SEQ ID NO: 910783 - protein, 93 aa, Homo sapiens
TTKNQKGSEGNRNDSKATKGEAKRRKKKRTTTANRQTKGKTPNKENNNHNPNAQKQKKSKTPIANKAHNGQDVSFLRQNLPGRYLSMFNILKK

SEQ ID NO: 910784 - protein, 254 aa, Homo sapiens; identical to SEQ ID NO: 910774

SEQ ID NO: 910785 - protein, 460 aa, Homo sapiens; identical to SEQ ID NO: 910775

SEQ ID NO: 910786 - protein, 323 aa, Homo sapiens
MANDPLEGFHEVNLASPTSPDLLGVYESGTQEQTTSPSVIYRPHPSALSSVPIQANALDVSELPTQPVYSSPRRLNCAEISSISFHVTDPAPCSTSGVTAGLTKLTTRKDNYNAEREFLQGATITEACDGSDDIFGLSTDSLSRLRSPSVLEVREKGYERLKEELAKAQRELKLKDEECERLSKVRDQLGQELEELTASLFEEAHKMVREANIKQATAEKQLKEAQGKIDVLQAEVAALKTLVLSSSPTSPTQEPLPGGKTPFKKGHTRNKSTSSAMSGSHQDLSVIQPIVKDCKEAHNGQDVSFLRQNLPGRYLSMFNILKK

SEQ ID NO: 910787 - protein, 476 aa, Homo sapiens
MGLKKMKGLSYDEAFAMANDPLEGFHEVNLASPTSPDLLGVYESGTQEQTTSPSVIYRPHPSALSSVPIQANALDVSELPTQPVYSSPRRLNCAEISSISFHVTDPAPCSTSGVTAGLTKLTTRKDNYNAEREFLQGATITEACDGSDDIFGLSTDSLSRLRSPSVLEVREKGYERLKEELAKAQRELKLKDEECERLSKVRDQLGQELEELTASLFEEAHKMVREANIKQATAEKQLKEAQGKIDVLQAEVAALKTLVLSSSPTSPTQEPLPGGKTPFKKGHTRNKSTSSAMSGSHQDLSVIQPIVKDCKEADLSLYNEFRLWKDEPTMDRTCPFLDKIYQEDIFPCLTFSKSELASAVLEAVENNTLSIEPVGLQPIRFVKASAVECGGPKKCALTGQSKSCKHRIKLGDSSNYYYISPFCRYRITSVCNFFTYIRYIQQGLVKQQDVDQMFWEVMQLRKEMSLAKLGYFKEEL

SEQ ID NO: 910788 - protein, 411 aa, Homo sapiens
MGLKKMKGLSYDEAFAMANDPLEGFHEVNLASPTSPDLLGVYESGTQEQTTSPSVIYRPHPSALSSVPIQANALDVSELPTQPVYSSPRRLNCAEISSISFHVTDPAPCSTSGVTAGLTKLTTRKDNYNAEREFLQGATITEACDGSDDIFGLSTDSLSRLRSPSVLEVREKGYERLKEELAKAQRELKLKDEECERLSKVRDQLGQELEELTASLFEEAHKMVREANIKQATAEKQLKEAQGKIDVLQAEVAALKTLVLSSSPTSPTQEPLPGGKTPFKKGHTRNKSTSSAMSGSHQDLSVIQPIVKDCKEADLSLYNEFRLWKDEPTMDRTCPFLDKIYQEDIFPCLTFSKSELASAVLEAVENNTLSIEPVGLQPIRFVKASAVECGGPKSLLYVTFLHTFDTFSRDS

SEQ ID NO: 910789 - protein, 142 aa, Homo sapiens; identical to SEQ ID NO: 910781

SEQ ID NO: 910790 - protein, 313 aa, Homo sapiens
MANDPLEGFHEVNLASPTSPDLLGVYESGTQEQTTSPSVIYRPHPSALSSVPIQANALDVSELPTQPVYSSPRRLNCAEISSISFHVTDPAPCSTSGVTAGLTKLTTRKDNYNAEREFLQGATITEACDGSDDIFGLSTDSLSRLRSPSVLEVREKGYERLKEELAKAQRELKLKDEECERLSKVRDQLGQELEELTASLFEEAHKMVREANIKQATAEKQLKEAQGKIDVLQAEVAALKTLVLSSSPTSPTQEPLPGGKTPFKKGHTRNKSTSSAMSGSHQDLSVIQPIVKDCKEVTHQGLSPLTLLILVSS

SEQ ID NO: 910791 - protein, 162 aa, Homo sapiens
MPTDSQDSLFASRTLFKSRRLQDSFASETNLDFRSGLAIVSQHDLDQLQADAINAFGESLQKKLLDIEGLYSKVRSRYSFIQALVRRIRGLYDLEATEDHFVRLANALPLFFYQMQIRLLVFQELFVIEQQVPFAVQDVLDAGLGDDGIVTLEPLVYVLPDK

SEQ ID NO: 910792 - protein, 160 aa, Homo sapiens
MRRVAHHGGPRAVVKNFRTKMFHLRTCAAKLRPLTASQTVKTFSQNRPAAARTFQQIRCYSAPVAAEPFLSGTSSNYVEEMYCAWLENPKSVHKKVRLAGLWVCLMLVCWPVPDWSPGKCVRPEESAGRQAAGAPYQPPYLYRTQHSPSRSHGPWIGVQQ

SEQ ID NO: 910793 - protein, 93 aa, Homo sapiens
DSRGTPRCLRAHAFGKSPEIAASLWQSLEYTQILQTVRIPSQRQAIGIEVELNEIESRCEEYPLTRAFCQLISTLVESSFPSNLGAGLAAPWL

SEQ ID NO: 910794 - protein, 149 aa, Homo sapiens
LSVGDLAGSWDHSGGKVSRKELEQIFCQFDSKLEAADEGSGDVKYHLGMYHRRINRVTDRNITLSLVANPPPRESVDALSVGGLPPLTGFLPQWAIIEEFTKNHSLIIPTIIATITLLNLYFYLRLIYSTSIHYLPTRESVGILKITQH

SEQ ID NO: 910795 - protein, 1061 aa, Homo sapiens
TPYAGAGPRVWSPGVGCRRLIRVELSRRQAVVKNFRTKMFHLRTCAAKLRPLTASQTVKTFSQNRPAAARTFQQIRCYSAPVAAEPFLSGTSSNYVEEMYCAWLENPKSVHKSWDIFFRNTNAGAPPGTAYQSPLPLSRGSLAAVAHAQSLVEAQPNVDKLVEDHLAVQSLIRAYQIRGHHVAQLDPLGILDADLDSSVPADIISSTDKLGFYGLDESDLDKVFHLPTTTFIGGQESALPLREIIRRLEMAYCQHIGVEFMFINDLEQCQWIRQKFETPGIMQFTNEEKRTLLARLVRSTRFEEFLQRKWSSEKRFGLEGCEVLIPALKTIIDKSSENGVDYVIMGMPHRGRLNVLANVIRKELEQIFCQFDSKLEAADEGSGDVKYHLGMYHRRINRVTDRNITLSLVANPSHLEAADPVVMGKTKAEQFYCGDTEGKKVMSILLHGDAAFAGQGIVYETFHLSDLPSYTTHGTVHVVVNNQIGFTTDPRMARSSPYPTDVARVVNAPIFHVNSDDPEAVMYVCKVAAEWRSTFHKDVVVDLVCYRRNGHNEMDEPMFTQPLMYKQIRKQKPVLQKYAELLVSQGVVNQPEYEEEISKYDKICEEAFARSKDEKILHIKHWLDSPWPGFFTLDGQPRSMSCPSTGLTEDILTHIGNVASSVPVENFTIHGGLSRILKTRGEMVKNRTVDWALAEYMAFGSLLKEGIHIRLSGQDVERGTFSHRHHVLHDQNVDKRTCIPMNHLWPNQAPYTVCNSSLSEYGVLGFELGFAMASPNALVLWEAQFGDFHNTAQCIIDQFICPGQAKWVRQNGIVLLLPHGMEGMGPEHSSARPERFLQMCNDDPDVLPDLKEANFDINQLYDCNWVVVNCSTPGNFFHVLRRQILLPFRKPLIIFTPKSLLRHPEARSSFDEMLPGTHFQRVIPEDGPAAQNPENVKRLLFCTGKVYYDLTRERKARDMVGQVAITRIEQLSPFPFDLLLKEVQKYPNAELAWCQEEHKNQGYYDYVKPRLRTTISRAKPVWYAGRDPAAAPATGNKKTHLTELQRLLDTAFDLDVFKNFS

SEQ ID NO: 910796 - protein, 2170 aa, Homo sapiens
MDLLRESQLALIVCPLEQLLQGINPRTKKADNVVNIARYLYHGNTNPELAFESAKILCCISCNSNIQIKLVGDFTHDQSISQKLMAGFVECLDCEDAEEFVRLEEGSELEKKLVAIRHETRIHILNLLITSLECNPPNLALYLLGFELKKPVSTTNLQDPGVLGCPRTCLHAILNILEKGTEGRTGPVAVRESPQLAELCYQVIYQLCACSDTSGPTMRYLRTSQDFLFSQLQYLPFSNKEYEISMLNQMSWLMKTASIELRVTSLNRQRSHTQRLLHLLLDDMPVKPYSDGEGGIEDENRSVSGFLHFDTATKVRRKILNILDSIDFSQEIPEPLQLDFFDRAQIEQVIANCEHKNLRGQTVCNVKLLHRVLVAEVNALQGMAAIGQRPLLMEEISTVLQYVVGRNKLLQCLHAKRHALESWRQLVEIILTACPQDLIQAEDRQLIIRDILQDVHDKILDDEAAQELMPVVAGAVFTLTAHLSQAVLTEQKQTSVLGPAEAHYAFMLDSCFTSPPPEENPLVGFASIGDSSLYIILKKLLDFILKTGGGFQRVRTHLYGSLLYYLQIAQRPDEPDTLEAAKKTMWERLTAPEDVFSKLQRENIAIIESYGAALMEVVCRDACDGHEIGRMLALALLDRIVSVDKQQQWLLYLSNSGYLKVLVDSLVEDDRTLQSLLTPQPPLLKALYTYESKMAFLTRVAKIQQGALELLRSGVIVRLAQCQVYDMRPETDPQSMFGMRDPPMFIPTPVDRYRQILLPALQLCQVILTSSMAQHLQAAGQVLQFLISHSDTIQAILRCQDVSAGSLQELALLTGIISKAALPGILSELDVDVNEGSLMELQGHIGRFQRQCLGLLSRFGGSDRLRQFKFQDDNVEGDKVSKKDEIELAMQQICANVMEYCQSLMLQSSPTFQHAVCLFTPSLSETVNRDGPRQDTQAPVVPYWRLPGLGIIIYLLKQSANDFFSYYDSHRQSVSKLQNVEQLPPDEIKELCQSVMPAGVDKISTAQKYVLARRRLVKVINNRAKLLSLCSFIIETCLFILWRHLEYYLLHCMPTDSQDSLFASRTLFKSRRLQDSFASETNLDFRSGLAIVSQHDLDQLQADAINAFGESLQKKLLDIEGLYSKVRSRYSFIQALVRRIRGLYELEATDKYKDCLVGLRFHHSQTVKTFSQNRPAAARTFQQIRCYSAPVAAEPFLSGTSSNYVEEMYCAWLENPKSVHKSWDIFFRNTNAGAPPGTAYQSPLPLSRGSLAAVAHAQSLVEAQPNVDKLVEDHLAVQSLIRAYQIRGHHVAQLDPLGILDADLDSSVPADIISSTDKLGFYGLDESDLDKVFHLPTTTFIGGQESALPLREIIRRLEMAYCQHIGVEFMFINDLEQCQWIRQKFETPGIMQFTNEEKRTLLARLVRSTRFEEFLQRKWSSEKRFGLEGCEVLIPALKTIIDKSSENGVDYVIMGMPHRGRLNVLANVIRKELEQIFCQFDSKLEAADEGSGDVKYHLGMYHRRINRVTDRNITLSLVANPSHLEAADPVVMGKTKAEQFYCGDTEGKKVMSILLHGDAAFAGQGIVYETFHLSDLPSYTTHGTVHVVVNNQIGFTTDPRMARSSPYPTDVARVVNAPIFHVNSDDPEAVMYVCKVAAEWRSTFHKDVVVDLVCYRRNGHNEMDEPMFTQPLMYKQIRKQKPVLQKYAELLVSQGVVNQPEYEEEISKYDKICEEAFARSKDEKILHIKHWLDSPWPGFFTLDGQPRSMSCPSTGLTEDILTHIGNVASSVPVENFTIHGGLSRILKTRGEMVKNRTVDWALAEYMAFGSLLKEGIHIRLSGQDVERGTFSHRHHVLHDQNVDKRTCIPMNHLWPNQAPYTVCNSSLSEYGVLGFELGFAMASPNALVLWEAQFGDFHNTAQCIIDQFICPGQAKWVRQNGIVLLLPHGMEGMGPEHSSARPERFLQMCNDDPDVLPDLKEANFDINQLYDCNWVVVNCSTPGNFFHVLRRQILLPFRKPLIIFTPKSLLRHPEARSSFDEMLPGTHFQRVIPEDGPAAQNPENVKRLLFCTGKVYYDLTRERKARDMVGQVAITRIEQLSPFPFDLLLKEVQKYPNAELAWCQEEHKNQGYYDYVKPRLRTTISRAKPVWYAGRDPAAAPATGNKKTHLTELQRLLDTAFDLDVFKNFS

SEQ ID NO: 910797 - protein, 1788 aa, Homo sapiens
ESSSVPTSYKREEISTVLQYVVGRNKLLQCLHAKRHALESWRQLVEIILTACPQDLIQAEDRQLIIRDILQDVHDKILDDEAAQELMPVVAGAVFTLTAHLSQAVLTEQKQTSVLGPAEAHYAFMLDSCFTSPPPEENPLVGFASIGDSSLYIILKKLLDFILKTGGGFQRVRTHLYGSLLYYLQIAQRPDEPDTLEAAKKTMWERLTAPEDVFSKLQRENIAIIESYGAALMEVVCRDACDGHEIGRMLALALLDRIVSVDKQQQWLLYLSNSGYLKVLVDSLVEDDRTLQSLLTPQPPLLKALYTYESKMAFLTRVAKIQQGALELLRSGVIVRLAQCQVYDMRPETDPQSMFGMRDPPMFIPTPVDRYRQILLPALQLCQVILTSSMAQHLQAAGQVLQFLISHSDTIQAILRCQDVSAGSLQELALLTGIISKAALPGILSELDVDVNEGSLMELQGHIGRFQRQCLGLLSRFGGSDRLRQFKFQDDNVEGDKVSKKDEIELAMQQICANVMEYCQSLMLQSSPTFQHAVCLFTPSLSETVNRDGPRQDTQAPVVPYWRLPGLGIIIYLLKQSANDFFSYYDSHRQSVSKLQNVEQLPPDEIKELCQSVMPAGVDKISTAQKYVLARRRLVKVINNRAKLLSLCSFIIETCLFILWRHLEYYLLHCMPTDSQDSLFASRTLFKSRRLQDSFASETNLDFRSGLAIVSQHDLDQLQADAINAFGESLQKKLLDIEGLYSKVRSRYSFIQALVRRIRGLYNSEATDKYKDCLVGLRFHHSQTVKTFSQNRPAAARTFQQIRCYSAPVAAEPFLSGTSSNYVEEMYCAWLENPKSVHKSWDIFFRNTNAGAPPGTAYQSPLPLSRGSLAAVAHAQSLVEAQPNVDKLVEDHLAVQSLIRAYQIRGHHVAQLDPLGILDADLDSSVPADIISSTDKLGFYGLDESDLDKVFHLPTTTFIGGQESALPLREIIRRLEMAYCQHIGVEFMFINDLEQCQWIRQKFETPGIMQFTNEEKRTLLARLVRSTRFEEFLQRKWSSEKRFGLEGCEVLIPALKTIIDKSSENGVDYVIMGMPHRGRLNVLANVIRKELEQIFCQFDSKLEAADEGSGDVKYHLGMYHRRINRVTDRNITLSLVANPSHLEAADPVVMGKTKAEQFYCGDTEGKKVMSILLHGDAAFAGQGIVYETFHLSDLPSYTTHGTVHVVVNNQIGFTTDPRMARSSPYPTDVARVVNAPIFHVNSDDPEAVMYVCKVAAEWRSTFHKDVVVDLVCYRRNGHNEMDEPMFTQPLMYKQIRKQKPVLQKYAELLVSQGVVNQPEYEEEISKYDKICEEAFARSKDEKILHIKHWLDSPWPGFFTLDGQPRSMSCPSTGLTEDILTHIGNVASSVPVENFTIHGGLSRILKTRGEMVKNRTVDWALAEYMAFGSLLKEGIHIRLSGQDVERGTFSHRHHVLHDQNVDKRTCIPMNHLWPNQAPYTVCNSSLSEYGVLGFELGFAMASPNALVLWEAQFGDFHNTAQCIIDQFICPGQAKWVRQNGIVLLLPHGMEGMGPEHSSARPERFLQMCNDDPDVLPDLKEANFDINQLYDCNWVVVNCSTPGNFFHVLRRQILLPFRKPLIIFTPKSLLRHPEARSSFDEMLPGTHFQRVIPEDGPAAQNPENVKRLLFCTGKVYYDLTRERKARDMVGQVAITRIEQLSPFPFDLLLKEVQKYPNAELAWCQEEHKNQGYYDYVKPRLRTTISRAKPVWYAGRDPAAAPATGNKKTHLTELQRLLDTAFDLDVFKNFS

SEQ ID NO: 910798 - protein, 2522 aa, Homo sapiens
MATPLAVNSAASLWGPYKDIWHKVGNALWRRQPEAVHLLDKILKKHKPDFISLFKNPPKNVQQHEKVQKASTEGVAIQGQQGTRLLPEQLIKEAFILSDLFDIGELAAVELLLAGEHQQPHFPGLTRGLVAVLLYWDGKRCIANSLKALIQSRRGKTWTLELSPELASMTTRFTDELMEQGLTYKVLTLVSQIDVNNEFEKLQRERGLGSEKHRKEVSDLIKECRQSLAESLFAWACQSPLGKEDTLLLIGHLERVTVEANGSLDAVNLALLMALLYCFDISFIEQSTEERDDMIHQLPLLTEKQYIATIHSRLQDSQLWKLPGLQATVRLAWALALRGISQLPDVTALAEFTEADEAMAELAIADNVFLFLMESVVVSEYFYQEEFYIRRVHNLITDFLALMPMKVKQLRNRADEDARMIHMSMQMGNEPPISLRRDLEHLMLLIGELYKKNPFHLELALEYWCPTEPLQTPTIMGSYLGVAHQRPPQRQVVLSKFVRQMGDLLPPTIYIPYLKMLQGLANGPQCAHYCFSLLKVNGSSHVENIQGAGGSPVSWEHFFHSLMLYHEHLRKDLPSADSVQYRHLPSRGITQKEQDGLIAFLQLTSTIITWSENARLALCEHPQWTPVVVILGLLQCSIPPVLKAELLKTLAAFGKSPEIAASLWQSLEYTQILQTVRIPSQRQAIGIEVELNEIESRCEEYPLTRAFCQLISTLVESSFPSNLGAGLRPPGFDPYLQFLRDSVFLRFRTRAYRRAAEKWEVAEVVLEVFYKLLRDYEPQLEDFVDQFVELQGEEIIAYKPPGFSLMYHLLNESPMLELALSLLEEGVKQLDTYAPFPGKKHLEKAVQHCLALLNLTLQKENLFMDLLRESQLALIVCPLEQLLQGINPRTKKADNVVNIARYLYHGNTNPELAFESAKILCCISCNSNIQIKLVGDFTHDQSISQKLMAGFVECLDCEDAEEFVRLEEGSELEKKLVAIRHETRIHILNLLITSLECNPPNLALYLLGFELKKPVSTTNLQDPGVLGCPRTCLHAILNILEKGTEGRTGPVAVRESPQLAELCYQVIYQLCACSDTSGPTMRYLRTSQDFLFSQLQYLPFSNKEYEISMLNQMSWLMKTASIELRVTSLNRQRSHTQRLLHLLLDDMPVKPYSDGEGGIEDENRSVSGFLHFDTATKVRRKILNILDSIDFSQEIPEPLQLDFFDRAQIEQVIANCEHKNLRGQTVCNVKLLHRVLVAEVNALQGMAAIGQRPLLMEEISTVLQYVVGRNKLLQCLHAKRHALESWRQLVEIILTACPQDLIQAEDRQLIIRDILQDVHDKILDDEAAQELMPVVAGAVFTLTAHLSQAVLTEQKQTSVLGPAEAHYAFMLDSCFTSPPPEENPLVGFASIGDSSLYIILKKLLDFILKTGGGFQRVRTHLYGSLLYYLQIAQRPDEPDTLEAAKKTMWERLTAPEDVFSKLQRENIAIIESYGAALMEVVCRDACDGHEIGRMLALALLDRIVSVDKQQQWLLYLSNSGYLKVLVDSLVEDDRTLQSLLTPQPPLLKALYTYESKMAFLTRVAKIQQGALELLRSGVIVRLAQCQVYDMRPETDPQSMFGMRDPPMFIPTPVDRYRQILLPALQLCQVILTSSMAQHLQAAGQVLQFLISHSDTIQAILRCQDVSAGSLQELALLTGIISKAALPGILSELDVDVNEGSLMELQGHIGRFQRQCLGLLSRFGGSDRLRQFKFQDDNVEGDKVSKKDEIELAMQQICANVMEYCQSLMLQSSPTFQHAVCLFTPSLSETVNRDGPRQDTQAPVVPYWRLPGLGIIIYLLKQSANDFFSYYDSHRQSVSKLQNVEQLPPDEIKELCQSVMPAGVDKISTAQKYVLARRRLVKVINNRAKLLSLCSFIIETCLFILWRHLEYYLLHCMPTDSQDSLFASRTLFKSRRLQDSFASETNLDFRSGLAIVSQHDLDQLQADAINAFGESLQKKLLDIEGLYSKVRSRYSFIQALVRRIRGLYELEATDKYKDCLVGLRFHHSQTVKTFSQNRPAAARTFQQIRCYSAPVAAEPFLSGTSSNYVEEMYCAWLENPKSVHKSWDIFFRNTNAGAPPGTAYQSPLPLSRGSLAAVAHAQSLVEAQPNVDKLVEDHLAVQSLIRAYQIRGHHVAQLDPLGILDADLDSSVPADIISSTDKLGFYGLDESDLDKVFHLPTTTFIGGQESALPLREIIRRLEMAYCQHIGVEFMFINDLEQCQWIRQKFETPGIMQFTNEEKRTLLARLVRSTRFEEFLQRKWSSEKRFGLEGCEVLIPALKTIIDKSSENGVDYVIMGMPHRGRLNVLANVIRKELEQIFCQFDSKLEAADEGSGDVKYHLGMYHRRINRVTDRNITLSLVANPSHLEAADPVVMGKTKAEQFYCGDTEGKKVMSILLHGDAAFAGQGIVYETFHLSDLPSYTTHGTVHVVVNNQIGFTTDPRMARSSPYPTDVARVVNAPIFHVNSDDPEAVMYVCKVAAEWRSTFHKDVVVDLPPPPCAP

SEQ ID NO: 910799 - protein, 1067 aa, Homo sapiens
MQSTLLENHYKRNFWTLKDYIQKFDLDIVSYRLLSDVSVASKLEATDKYKDCLVGLRFHHSQTVKTFSQNRPAAARTFQQIRCYSAPVAAEPFLSGTSSNYVEEMYCAWLENPKSVHKSWDIFFRNTNAGAPPGTAYQSPLPLSRGSLAAVAHAQSLVEAQPNVDKLVEDHLAVQSLIRAYQIRGHHVAQLDPLGILDADLDSSVPADIISSTDKLGFYGLDESDLDKVFHLPTTTFIGGQESALPLREIIRRLEMAYCQHIGVEFMFINDLEQCQWIRQKFETPGIMQFTNEEKRTLLARLVRSTRFEEFLQRKWSSEKRFGLEGCEVLIPALKTIIDKSSENGVDYVIMGMPHRGRLNVLANVIRKELEQIFCQFDSKLEAADEGSGDVKYHLGMYHRRINRVTDRNITLSLVANPSHLEAADPVVMGKTKAEQFYCGDTEGKKVMSILLHGDAAFAGQGIVYETFHLSDLPSYTTHGTVHVVVNNQIGFTTDPRMARSSPYPTDVARVVNAPIFHVNSDDPEAVMYVCKVAAEWRSTFHKDVVVDLVCYRRNGHNEMDEPMFTQPLMYKQIRKQKPVLQKYAELLVSQGVVNQPEYEEEISKYDKICEEAFARSKDEKILHIKHWLDSPWPGFFTLDGQPRSMSCPSTGLTEDILTHIGNVASSVPVENFTIHGGLSRILKTRGEMVKNRTVDWALAEYMAFGSLLKEGIHIRLSGQDVERGTFSHRHHVLHDQNVDKRTCIPMNHLWPNQAPYTVCNSSLSEYGVLGFELGFAMASPNALVLWEAQFGDFHNTAQCIIDQFICPGQAKWVRQNGIVLLLPHGMEGMGPEHSSARPERFLQMCNDDPDVLPDLKEANFDINQLYDCNWVVVNCSTPGNFFHVLRRQILLPFRKPLIIFTPKSLLRHPEARSSFDEMLPGTHFQRVIPEDGPAAQNPENVKRLLFCTGKVYYDLTRERKARDMVGQVAITRIEQLSPFPFDLLLKEVQKYPNAELAWCQEEHKNQGYYDYVKPRLRTTISRAKPVWYAGRDPAAAPATGNKKTHLTELQRLLDTAFDLDVFKNFS

SEQ ID NO: 910800 - protein, 1023 aa, Homo sapiens
MFHLRTCAAKLRPLTASQTVKTFSQNRPAAARTFQQIRCYSAPVAAEPFLSGTSSNYVEEMYCAWLENPKSVHKSWDIFFRNTNAGAPPGTAYQSPLPLSRGSLAAVAHAQSLVEAQPNVDKLVEDHLAVQSLIRAYQIRGHHVAQLDPLGILDADLDSSVPADIISSTDKLGFYGLDESDLDKVFHLPTTTFIGGQESALPLREIIRRLEMAYCQHIGVEFMFINDLEQCQWIRQKFETPGIMQFTNEEKRTLLARLVRSTRFEEFLQRKWSSEKRFGLEGCEVLIPALKTIIDKSSENGVDYVIMGMPHRGRLNVLANVIRKELEQIFCQFDSKLEAADEGSGDVKYHLGMYHRRINRVTDRNITLSLVANPSHLEAADPVVMGKTKAEQFYCGDTEGKKVMSILLHGDAAFAGQGIVYETFHLSDLPSYTTHGTVHVVVNNQIGFTTDPRMARSSPYPTDVARVVNAPIFHVNSDDPEAVMYVCKVAAEWRSTFHKDVVVDLVCYRRNGHNEMDEPMFTQPLMYKQIRKQKPVLQKYAELLVSQGVVNQPEYEEEISKYDKICEEAFARSKDEKILHIKHWLDSPWPGFFTLDGQPRSMSCPSTGLTEDILTHIGNVASSVPVENFTIHGGLSRILKTRGEMVKNRTVDWALAEYMAFGSLLKEGIHIRLSGQDVERGTFSHRHHVLHDQNVDKRTCIPMNHLWPNQAPYTVCNSSLSEYGVLGFELGFAMASPNALVLWEAQFGDFHNTAQCIIDQFICPGQAKWVRQNGIVLLLPHGMEGMGPEHSSARPERFLQMCNDDPDVLPDLKEANFDINQLYDCNWVVVNCSTPGNFFHVLRRQILLPFRKPLIIFTPKSLLRHPEARSSFDEMLPGTHFQRVIPEDGPAAQNPENVKRLLFCTGKVYYDLTRERKARDMVGQVAITRIEQLSPFPFDLLLKEVQKYPNAELAWCQEEHKNQGYYDYVKPRLRTTISRAKPVWYAGRDPAAAPATGNKKTHLTELQRLLDTAFDLDVFKNFS

SEQ ID NO: 910801 - protein, 1057 aa, Homo sapiens
TPYAGAGPRVWSPGVGCRRLIRVELSRRQAVVKNFRTKMFHLRTCAAKLRPLTASQTVKTFSQNRPAAARTFQQIRCYSAPVAAEPFLSGTSSNYVEEMYCAWLENPKSVHKSWDIFFRNTNAGAPPGTAYQSPLPLSRGSLAAVAHAQSLVEAQPNVDKLVEDHLAVQSLIRAYQVRGHHIAKLDPLGISCVNFDDAPVTVSSNVGFYGLDESDLDKVFHLPTTTFIGGQESALPLREIIRRLEMAYCQHIGVEFMFINDLEQCQWIRQKFETPGIMQFTNEEKRTLLARLVRSTRFEEFLQRKWSSEKRFGLEGCEVLIPALKTIIDKSSENGVDYVIMGMPHRGRLNVLANVIRKELEQIFCQFDSKLEAADEGSGDVKYHLGMYHRRINRVTDRNITLSLVANPSHLEAADPVVMGKTKAEQFYCGDTEGKKVMSILLHGDAAFAGQGIVYETFHLSDLPSYTTHGTVHVVVNNQIGFTTDPRMARSSPYPTDVARVVNAPIFHVNSDDPEAVMYVCKVAAEWRSTFHKDVVVDLVCYRRNGHNEMDEPMFTQPLMYKQIRKQKPVLQKYAELLVSQGVVNQPEYEEEISKYDKICEEAFARSKDEKILHIKHWLDSPWPGFFTLDGQPRSMSCPSTGLTEDILTHIGNVASSVPVENFTIHGGLSRILKTRGEMVKNRTVDWALAEYMAFGSLLKEGIHIRLSGQDVERGTFSHRHHVLHDQNVDKRTCIPMNHLWPNQAPYTVCNSSLSEYGVLGFELGFAMASPNALVLWEAQFGDFHNTAQCIIDQFICPGQAKWVRQNGIVLLLPHGMEGMGPEHSSARPERFLQMCNDDPDVLPDLKEANFDINQLYDCNWVVVNCSTPGNFFHVLRRQILLPFRKPLIIFTPKSLLRHPEARSSFDEMLPGTHFQRVIPEDGPAAQNPENVKRLLFCTGKVYYDLTRERKARDMVGQVAITRIEQLSPFPFDLLLKEVQKYPNAELAWCQEEHKNQGYYDYVKPRLRTTISRAKPVWYAGRDPAAAPATGNKKTHLTELQRLLDTAFDLDVFKNFS

SEQ ID NO: 910802 - protein, 3033 aa, Homo sapiens
MATPLAVNSAASLWGPYKDIWHKVGNALWRRQPEAVHLLDKILKKHKPDFISLFKNPPKNVQQHEKVQKASTEGVAIQGQQGTRLLPEQLIKEAFILSDLFDIGELAAVELLLAGEHQQPHFPGLTRGLVAVLLYWDGKRCIANSLKALIQSRRGKTWTLELSPELASMTTRFTDELMEQGLTYKVLTLVSQIDVNNEFEKLQRERGLGSEKHRKEVSDLIKECRQSLAESLFAWACQSPLGKEDTLLLIGHLERVTVEANGSLDAVNLALLMALLYCFDISFIEQSTEERDDMIHQLPLLTEKQYIATIHSRLQDSQLWKLPGLQATVRLAWALALRGISQLPDVTALAEFTEADEAMAELAIADNVFLFLMESVVVSEYFYQEEFYIRRVHNLITDFLALMPMKVKQLRNRADEDARMIHMSMQMGNEPPISLRRDLEHLMLLIGELYKKNPFHLELALEYWCPTEPLQTPTIMGSYLGVAHQRPPQRQVVLSKFVRQMGDLLPPTIYIPYLKMLQGLANGPQCAHYCFSLLKVNGSSHVENIQGAGGSPVSWEHFFHSLMLYHEHLRKDLPSADSVQYRHLPSRGITQKEQDGLIAFLQLTSTIITWSENARLALCEHPQWTPVVVILGLLQCSIPPVLKAELLKTLAAFGKSPEIAASLWQSLEYTQILQTVRIPSQRQAIGIEVELNEIESRCEEYPLTRAFCQLISTLVESSFPSNLGAGLRPPGFDPYLQFLRDSVFLRFRTRAYRRAAEKWEVAEVVLEVFYKLLRDYEPQLEDFVDQFVELQGEEIIAYKPPGFSLMYHLLNESPMLELALSLLEEGVKQLDTYAPFPGKKHLEKAVQHCLALLNLTLQKENLFMDLLRESQLALIVCPLEQLLQGINPRTKKADNVVNIARYLYHGNTNPELAFESAKILCCISCNSNIQIKLVGDFTHDQSISQKLMAGFVECLDCEDAEEFVRLEEGSELEKKLVAIRHETRIHILNLLITSLECNPPNLALYLLGFELKKPVSTTNLQDPGVLGCPRTCLHAILNILEKGTEGRTGPVAVRESPQLAELCYQVIYQLCACSDTSGPTMRYLRTSQDFLFSQLQYLPFSNKEYEISMLNQMSWLMKTASIELRVTSLNRQRSHTQRLLHLLLDDMPVKPYSDGEGGIEDENRSVSGFLHFDTATKVRRKILNILDSIDFSQEIPEPLQLDFFDRAQIEQVIANCEHKNLRGQTVCNVKLLHRVLVAEVNALQGMAAIGQRPLLMEEISTVLQYVVGRNKLLQCLHAKRHALESWRQLVEIILTACPQDLIQAEDRQLIIRDILQDVHDKILDDEAAQELMPVVAGAVFTLTAHLSQAVLTEQKQTSVLGPAEAHYAFMLDSCFTSPPPEENPLVGFASIGDSSLYIILKKLLDFILKTGGGFQRVRTHLYGSLLYYLQIAQRPDEPDTLEAAKKTMWERLTAPEDVFSKLQRENIAIIESYGAALMEVVCRDACDGHEIGRMLALALLDRIVSVDKQQQWLLYLSNSGYLKVLVDSLVEDDRTLQSLLTPQPPLLKALYTYESKMAFLTRVAKIQQGALELLRSGVIVRLAQCQVYDMRPETDPQSMFGMRDPPMFIPTPVDRYRQILLPALQLCQVILTSSMAQHLQAAGQVLQFLISHSDTIQAILRCQDVSAGSLQELALLTGIISKAALPGILSELDVDVNEGSLMELQGHIGRFQRQCLGLLSRFGGSDRLRQFKFQDDNVEGDKVSKKDEIELAMQQICANVMEYCQSLMLQSSPTFQHAVCLFTPSLSETVNRDGPRQDTQAPVVPYWRLPGLGIIIYLLKQSANDFFSYYDSHRQSVSKLQNVEQLPPDEIKELCQSVMPAGVDKISTAQKYVLARRRLVKVINNRAKLLSLCSFIIETCLFILWRHLEYYLLHCMPTDSQDSLFASRTLFKSRRLQDSFASETNLDFRSGLAIVSQHDLDQLQADAINAFGESLQKKLLDIEGLYSKVRSRYSFIQALVRRIRGLYELEATDKYKDCLVGLRFHHSQTVKTFSQNRPAAARTFQQIRCYSAPVAAEPFLSGTSSNYVEEMYCAWLENPKSVHKSWDIFFRNTNAGAPPGTAYQSPLPLSRGSLAAVAHAQSLVEAQPNVDKLVEDHLAVQSLIRAYQIRGHHVAQLDPLGILDADLDSSVPADIISSTDKLGFYGLDESDLDKVFHLPTTTFIGGQESALPLREIIRRLEMAYCQHIGVEFMFINDLEQCQWIRQKFETPGIMQFTNEEKRTLLARLVRSTRFEEFLQRKWSSEKRFGLEGCEVLIPALKTIIDKSSENGVDYVIMGMPHRGRLNVLANVIRKELEQIFCQFDSKLEAADEGSGDVKYHLGMYHRRINRVTDRNITLSLVANPSHLEAADPVVMGKTKAEQFYCGDTEGKKVMSILLHGDAAFAGQGIVYETFHLSDLPSYTTHGTVHVVVNNQIGFTTDPRMARSSPYPTDVARVVNAPIFHVNSDDPEAVMYVCKVAAEWRSTFHKDVVVDLVCYRRNGHNEMDEPMFTQPLMYKQIRKQKPVLQKYAELLVSQGVVNQPEYEEEISKYDKICEEAFARSKDEKILHIKHWLDSPWPGFFTLDGQPRSMSCPSTGLTEDILTHIGNVASSVPVENFTIHGGLSRILKTRGEMVKNRTVDWALAEYMAFGSLLKEGIHIRLSGQDVERGTFSHRHHVLHDQNVDKRTCIPMNHLWPNQAPYTVCNSSLSEYGVLGFELGFAMASPNALVLWEAQFGDFHNTAQCIIDQFICPGQAKWVRQNGIVLLLPHGMEGMGPEHSSARPERFLQMCNDDPDVLPDLKEANFDINQLYDCNWVVVNCSTPGNFFHVLRRQILLPFRKPLIIFTPKSLLRHPEARSSFDEMLPGTHFQRVIPEDGPAAQNPENVKRLLFCTGKVYYDLTRERKARDMVGQVAITRIEQLSPFPFDLLLKEVQKYPNAELAWCQEEHKNQGYYDYVKPRLRTTISRAKPVWYAGRDPAAAPATGNKKTHLTELQRLLDTAFDLDVFKNFS

SEQ ID NO: 910803 - protein, 595 aa, Homo sapiens
MSYCSCVNCIRYMRRRQIGFTTDPRMARSSPYPTDVARVVNAPIFHVNSDDPEAVMYVCKVAAEWRSTFHKDVVVDLVCYRRNGHNEMDEPMFTQPLMYKQIRKQKPVLQKYAELLVSQGVVNQPEYEEEISKYDKICEEAFARSKDEKILHIKHWLDSPWPGFFTLDGQPRSMSCPSTGLTEDILTHIGNVASSVPVENFTIHGGLSRILKTRGEMVKNRTVDWALAEYMAFGSLLKEGIHIRLSGQDVERGTFSHRHHVLHDQNVDKRTCIPMNHLWPNQAPYTVCNSSLSEYGVLGFELGFAMASPNALVLWEAQFGDFHNTAQCIIDQFICPGQAKWVRQNGIVLLLPHGMEGMGPEHSSARPERFLQMCNDDPDVLPDLKEANFDINQLYDCNWVVVNCSTPGNFFHVLRRQILLPFRKPLIIFTPKSLLRHPEARSSFDEMLPGTHFQRVIPEDGPAAQNPENVKRLLFCTGKVYYDLTRERKARDMVGQVAITRIEQLSPFPFDLLLKEVQKYPNAELAWCQEEHKNQGYYDYVKPRLRTTISRAKPVWYAGRDPAAAPATGNKKTHLTELQRLLDTAFDLDVFKNFS

SEQ ID NO: 910804 - protein, 537 aa, Homo sapiens
EDDLEDPSRPCHKDVVYDVVCYRRNGHNEMDEPMFTQPLMYKQIRKQKPVLQKYAELLVSQGVVNQPEYEEEISKYDKICEEAFARSKDEKILHIKHWLDSPWPGFFTLDGQPRSMSCPSTGLTEDILTHIGNVASSVPVENFTIHGGLSRILKTRGEMVKNRTVDWALAEYMAFGSLLKEGIHIRLSGQDVERGTFSHRHHVLHDQNVDKRTCIPMNHLWPNQAPYTVCNSSLSEYGVLGFELGFAMASPNALVLWEAQFGDFHNTAQCIIDQFICPGQAKWVRQNGIVLLLPHGMEGMGPEHSSARPERFLQMCNDDPDVLPDLKEANFDINQLYDCNWVVVNCSTPGNFFHVLRRQILLPFRKPLIIFTPKSLLRHPEARSSFDEMLPGTHFQRVIPEDGPAAQNPENVKRLLFCTGKVYYDLTRERKARDMVGQVAITRIEQLSPFPFDLLLKEVQKYPNAELAWCQEEHKNQGYYDYVKPRLRTTISRAKPVWYAGRDPAAAPATGNKKTHLTELQRLLDTAFDLDVFKNFS

SEQ ID NO: 910805 - protein, 255 aa, Homo sapiens
DLGQQQHDAILPHGMEGMGPEHSSARPERFLQMCNDDPDVLPDLKEANFDINQLYDCNWVVVNCSTPGNFFHVLRRQILLPFRKPLIIFTPKSLLRHPEARSSFDEMLPGTHFQRVIPEDGPAAQNPENVKRLLFCTGKVYYDLTRERKARDMVGQVAITRIEQLSPFPFDLLLKEVQKYPNAELAWCQEEHKNQGYYDYVKPRLRTTISRAKPVWYAGRDPAAAPATGNKKTHLTELQRLLDTAFDLDVFKNFS

SEQ ID NO: 910806 - protein, 3038 aa, Homo sapiens
MATPLAVNSAASLWGPYKDIWHKVGNALWRRQPEAVHLLDKILKKHKPDFISLFKNPPKNVQQHEKVQKASTEGVAIQGQQGTRLLPEQLIKEAFILSDLFDIGELAAVELLLAGEHQQPHFPGLTRGLVAVLLYWDGKRCIANSLKALIQSRRGKTWTLELSPELASMTTRFTDELMEQGLTYKVLTLVSQIDVNNEFEKLQRERGLGSEKHRKEVSDLIKECRQSLAESLFAWACQSPLGKEDTLLLIGHLERVTVEANGSLDAVNLALLMALLYCFDISFIEQSTEERDDMIHQLPLLTEKQYIATIHSRLQDSQLWKLPGLQATVRLAWALALRGISQLPDVTALAEFTEADEAMAELAIADNVFLFLMESVVVSEYFYQEEFYIRRVHNLITDFLALMPMKVKQLRNRADEDARMIHMSMQMGNEPPISLRRDLEHLMLLIGELYKKNPFHLELALEYWCPTEPLQTPTIMGSYLGVAHQRPPQRQVVLSKFVRQMGDLLPPTIYIPYLKMLQGLANGPQCAHYCFSLLKVNGSSHVENIQGAGGSPVSWEHFFHSLMLYHEHLRKDLPSADSVQYRHLPSRGITQKEQDGLIAFLQLTSTIITWSENARLALCEHPQWTPVVVILGLLQCSIPPVLKAELLKTLAAFGKSPEIAASLWQSLEYTQILQTVRIPSQRQAIGIEVELNEIESRCEEYPLTRAFCQLISTLVESSFPSNLGAGLRPPGFDPYLQFLRDSVFLRFRTRAYRRAAEKWEVAEVVLEVFYKLLRDYEPQLEDFVDQFVELQGEEIIAYKPPGFSLMYHLLNESPMLELALSLLEEGVKQLDTYAPFPGKKHLEKAVQHCLALLNLTLQKENLFMDLLRESQLALIVCPLEQLLQGINPRTKKADNVVNIARYLYHGNTNPELAFESAKILCCISCNSNIQIKLVGDFTHDQSISQKLMAGFVECLDCEDAEEFVRLEEGSELEKKLVAIRHETRIHILNLLITSLECNPPNLALYLLGFELKKPVSTTNLQDPGVLGCPRTCLHAILNILEKGTEGRTGPVAVRESPQLAELCYQVIYQLCACSDTSGPTMRYLRTSQDFLFSQLQYLPFSNKEYEISMLNQMSWLMKTASIELRVTSLNRQRSHTQRLLHLLLDDMPVKPYSDGEGGIEDENRSVSGFLHFDTATKVRRKILNILDSIDFSQEIPEPLQLDFFDRAQIEQVIANCEHKNLRGQTVCNVKLLHRVLVAEVNALQGMAAIGQRPLLMEEISTVLQYVVGRNKLLQCLHAKRHALESWRQLVEIILTACPQDLIQAEDRQLIIRDILQDVHDKILDDEAAQELMPVVAGAVFTLTAHLSQAVLTEQKQTSVLGPAEAHYAFMLDSCFTSPPPEENPLVGFASIGDSSLYIILKKLLDFILKTGGGFQRVRTHLYGSLLYYLQIAQRPDEPDTLEAAKKTMWERLTAPEDVFSKLQRENIAIIESYGAALMEVVCRDACDGHEIGRMLALALLDRIVSVDKQQQWLLYLSNSGYLKVLVDSLVEDDRTLQSLLTPQPPLLKALYTYESKMAFLTRVAKIQQGALELLRSGVIVRLAQCQVYDMRPETDPQSMFGMRDPPMFIPTPVDRYRQILLPALQLCQVILTSSMAQHLQAAGQVLQFLISHSDTIQAILRCQDVSAGSLQELALLTGIISKAALPGILSELDVDVNEGSLMELQGHIGRFQRQCLGLLSRFGGSDRLRQFKFQDDNVEGDKVSKKDEIELAMQQICANVMEYCQSLMLQSSPTFQHAVCLFTPSLSETVNRDGPRQDTQAPVVPYWRLPGLGIIIYLLKQSANDFFSYYDSHRQSVSKLQNVEQLPPDEIKELCQSVMPAGVDKISTAQKYVLARRRLVKVINNRAKLLSLCSFIIETCLFILWRHLEYYLLHCMPTDSQDSLFASRTLFKSRRLQDSFASETNLDFRSGLAIVSQHDLDQLQADAINAFGESLQKKLLDIEGLYSKVRSRYSFIQALVRRIRGLYELEATDKYKDCLVGLRFHHSQTVKTFSQNRPAAARTFQQIRCYSAPVAAEPFLSGTSSNYVEEMYCAWLENPKSVHKSWDIFFRNTNAGAPPGTAYQSPLPLSRGSLAAVAHAQSLVEAQPNVDKLVEDHLAVQSLIRAYQIRGHHVAQLDPLGILDADLDSSVPADIISSTDKLGFYGLDESDLDKVFHLPTTTFIGGQESALPLREIIRRLEMAYCQHIGVEFMFINDLEQCQWIRQKFETPGIMQFTNEEKRTLLARLVRSTRFEEFLQRKWSSEKRFGLEGCEVLIPALKTIIDKSSENGVDYVIMGMPHRGRLNVLANVIRKELEQIFCQFDSKLEAADEGSGDVKYHLGMYHRRINRVTDRNITLSLVANPSHLEAADPVVMGKTKAEQFYCGDTEGKKVMSILLHGDAAFAGQGIVYETFHLSDLPSYTTHGTVHVVVNNQIGFTTDPRMARSSPYPTDVARVVNAPIFHVNSDDPEAVMYVCKVAAEWRSTFHKDVVVDLVCYRRNGHNEMDEPMFTQPLMYKQIRKQKPVLQKYAELLVSQGVVNQPEYEEEISKYDKICEEAFARSKDEKILHIKHWLDSPWPGFFTLDGQPRSMSCPSTGLTEDILTHIGNVASSVPVENFTIHGGLSRILKTRGEMVKNRTVDWALAEYMAFGSLLKEGIHIRLSGQDVERGTFSHRHHVLHDQNVDKRTCIPMNHLWPNQAPYTVCNSSLSEYGVLGFELGFAMASPNALVLWEAQFGDFHNTAQCIIDQFICPGQAKWVRQNGIVLLLPHGMEGMGPEHSSARPERFLQMCNDDPDVLPDLKEANFDINQLYDCNWVVVNCSTPGNFFHVLRRQILLPFRKPLIIFTPKSLLRHPEARSSFDEMLPGTHFQRVIPEDGPAAQNPENVKRLLFCTGKVYYDLTRERKARDMVGQVAITRIEQLSPFPFDLLLKEVQKYPNAELAWCQEEHKNQGYYDYVKPRLRTTISRAKPVCYAGGPGVFRTEKKHLKSEALEGFDGRSDFRNVLGCGPASTVMPV

SEQ ID NO: 910807 - protein, 149 aa, Homo sapiens [sequence omitted]

SEQ ID NO: 910808 - protein, 1944 aa, Homo sapiens
MATPLAVNSAASLWGPYKDIWHKVGNALWRRQPEAVHLLDKILKKHKPDFISLFKNPPKNVQQHEKVQKASTEGVAIQGQQGTRLLPEQLIKEAFILSDLFDIGELAAVELLLAGEHQQPHFPGLTRGLVAVLLYWDGKRCIANSLKALIQSRRGKTWTLELSPELASMTTRFTDELMEQGLTYKVLTLVSQIDVNNEFEKLQRERGLGSEKHRKEVSDLIKECRQSLAESLFAWACQSPLGKEDTLLLIGHLERVTVEANGSLDAVNLALLMALLYCFDISFIEQSTEERDDMIHQLPLLTEKQYIATIHSRLQDSQLWKLPGLQATVRLAWALALRGISQLPDVTALAEFTEADEAMAELAIADNVFLFLMESVVVSEYFYQEEFYIRRVHNLITDFLALMPMKVKQLRNRADEDARMIHMSMQMGNEPPISLRRDLEHLMLLIGELYKKNPFHLELALEYWCPTEPLQTPTIMGSYLGVAHQRPPQRQVVLSKFVRQMGDLLPPTIYIPYLKMLQGLANGPQCAHYCFSLLKVNGSSHVENIQGAGGSPVSWEHFFHSLMLYHEHLRKDLPSADSVQYRHLPSRGITQKEQDGLIAFLQLTSTIITWSENARLALCEHPQWTPVVVILGLLQCSIPPVLKAELLKTLAAFGKSPEIAASLWQSLEYTQILQTVRIPSQRQAIGIEVELNEIESRCEEYPLTRAFCQLISTLVESSFPSNLGAGLRPPGFDPYLQFLRDSVFLRFRTRAYRRAAEKWEVAEVVLEVFYKLLRDYEPQLEDFVDQFVELQGEEIIAYKPPGFSLMYHLLNESPMLELALSLLEEGVKQLDTYAPFPGKKHLEKAVQHCLALLNLTLQKENLFMDLLRESQLALIVCPLEQLLQGINPRTKKADNVVNIARYLYHGNTNPELAFESAKILCCISCNSNIQIKLVGDFTHDQSISQKLMAGFVECLDCEDAEEFVRLEEGSELEKKLVAIRHETRIHILNLLITSLECNPPNLALYLLGFELKKPVSTTNLQDPGVLGCPRTCLHAILNILEKGTEGRTGPVAVRESPQLAELCYQVIYQLCACSDTSGPTMRYLRTSQDFLFSQLQYLPFSNKEYEISMLNQMSWLMKTASIELRVTSLNRQRSHTQRLLHLLLDDMPVKPYSDGEGGIEDENRSVSGFLHFDTATKVRRKILNILDSIDFSQEIPEPLQLDFFDRAQIEQVIANCEHKNLRGQTVCNVKLLHRVLVAEVNALQGMAAIGQRPLLMEEISTVLQYVVGRNKLLQCLHAKRHALESWRQLVEIILTACPQDLIQAEDRQLIIRDILQDVHDKILDDEAAQELMPVVAGAVFTLTAHLSQAVLTEQKQTSVLGPAEAHYAFMLDSCFTSPPPEENPLVGFASIGDSSLYIILKKLLDFILKTGGGFQRVRTHLYGSLLYYLQIAQRPDEPDTLEAAKKTMWERLTAPEDVFSKLQRENIAIIESYGAALMEVVCRDACDGHEIGRMLALALLDRIVSVDKQQQWLLYLSNSGYLKVLVDSLVEDDRTLQSLLTPQPPLLKALYTYESKMAFLTRVAKIQQGALELLRSGVIVRLAQCQVYDMRPETDPQSMFGMRDPPMFIPTPVDRYRQILLPALQLCQVILTSSMAQHLQAAGQVLQFLISHSDTIQAILRCQDVSAGSLQELALLTGIISKAALPGILSELDVDVNEGSLMELQGHIGRFQRQCLGLLSRFGGSDRLRQFKFQDDNVEGDKVSKKDEIELAMQQICANVMEYCQSLMLQSSPTFQHAVCLFTPSLSETVNRDGPRQDTQAPVVPYWRLPGLGIIIYLLKQSANDFFSYYDSHRQSVSKLQNVEQLPPDEIKELCQSVMPAGVDKISTAQKYVLARRRLVKVINNRAKLLSLCSFIIETCLFILWRHLEYYLLHCMPTDSQDSLFASRTLFKSRRLQGKLSAKN

SEQ ID NO: 910809 - protein, 2188 aa, Homo sapiens
MATPLAVNSAASLWGPYKDIWHKVGNALWRRQPEAVHLLDKILKKHKPDFISLFKNPPKNVQQHEKVQKASTEGVAIQGQQGTRLLPEQLIKEAFILSDLFDIGELAAVELLLAGEHQQPHFPGLTRGLVAVLLYWDGKRCIANSLKALIQSRRGKTWTLELSPELASMTTRFTDELMEQGLTYKVLTLVSQIDVNNEFEKLQRERGLGSEKHRKEVSDLIKECRQSLAESLFAWACQSPLGKEDTLLLIGHLERVTVEANGSLDAVNLALLMALLYCFDISFIEQSTEERDDMIHQLPLLTEKQYIATIHSRLQDSQLWKLPGLQATVRLAWALALRGISQLPDVTALAEFTEADEAMAELAIADNVFLFLMESVVVSEYFYQEEFYIRRVHNLITDFLALMPMKVKQLRNRADEDARMIHMSMQMGNEPPISLRRDLEHLMLLIGELYKKNPFHLELALEYWCPTEPLQTPTIMGSYLGVAHQRPPQRQVVLSKFVRQMGDLLPPTIYIPYLKMLQGLANGPQCAHYCFSLLKVNGSSHVENIQGAGGSPVSWEHFFHSLMLYHEHLRKDLPSADSVQYRHLPSRGITQKEQDGLIAFLQLTSTIITWSENARLALCEHPQWTPVVVILGLLQCSIPPVLKAELLKTLAAFGKSPEIAASLWQSLEYTQILQTVRIPSQRQAIGIEVELNEIESRCEEYPLTRAFCQLISTLVESSFPSNLGAGLRPPGFDPYLQFLRDSVFLRFRTRAYRRAAEKWEVAEVVLEVFYKLLRDYEPQLEDFVDQFVELQGEEIIAYKPPGFSLMYHLLNESPMLELALSLLEEGVKQLDTYAPFPGKKHLEKAVQHCLALLNLTLQKENLFMDLLRESQLALIVCPLEQLLQGINPRTKKADNVVNIARYLYHGNTNPELAFESAKILCCISCNSNIQIKLVGDFTHDQSISQKLMAGFVECLDCEDAEEFVRLEEGSELEKKLVAIRHETRIHILNLLITSLECNPPNLALYLLGFELKKPVSTTNLQDPGVLGCPRTCLHAILNILEKGTEGRTGPVAVRESPQLAELCYQVIYQLCACSDTSGPTMRYLRTSQDFLFSQLQYLPFSNKEYEISMLNQMSWLMKTASIELRVTSLNRQRSHTQRLLHLLLDDMPVKPYSDGEGGIEDENRSVSGFLHFDTATKVRRKILNILDSIDFSQEIPEPLQLDFFDRAQIEQVIANCEHKNLRGQTVCNVKLLHRVLVAEVNALQGMAAIGQRPLLMEEISTVLQYVVGRNKLLQCLHAKRHALESWRQLVEIILTACPQDLIQAEDRQLIIRDILQDVHDKILDDEAAQELMPVVAGAVFTLTAHLSQAVLTEQKQTSVLGPAEAHYAFMLDSCFTSPPPEENPLVGFASIGDSSLYIILKKLLDFILKTGGGFQRVRTHLYGSLLYYLQIAQRPDEPDTLEAAKKTMWERLTAPEDVFSKLQRENIAIIESYGAALMEVVCRDACDGHEIGRMLALALLDRIVSVDKQQQWLLYLSNSGYLKVLVDSLVEDDRTLQSLLTPQPPLLKALYTYESKMAFLTRVAKIQQGALELLRSGVIVRLAQCQVYDMRPETDPQSMFGMRDPPMFIPTPVDRYRQILLPALQLCQVILTSSMAQHLQAAGQVLQFLISHSDTIQAILRCQDVSAGSLQELALLTGIISKAALPGILSELDVDVNEGSLMELQGHIGRFQRQCLGLLSRFGGSDRLRQFKFQDDNVEGDKVSKKDEIELAMQQICANVMEYCQSLMLQSSPTFQHAVCLFTPSLSETVNRDGPRQDTQAPVVPYWRLPGLGIIIYLLKQSANDFFSYYDSHRQSVSKLQNVEQLPPDEIKELCQSVMPAGVDKISTAQKYVLARRRLVKVINNRAKLLSLCSFIIETCLFILWRHLEYYLLHCMPTDSQDSLFASRTLFKSRRLQDSFASETNLDFRSGLAIVSQHDLDQLQADAINAFGESLQKKLLDIEGLYSKVRSRYSFIQALVRRIRGLYELEATDKYKDCLVGLRFHHSQTVKTFSQNRPAAARTFQQIRCYSAPVAAEPFLSGTSSNYVEEMYCAWLENPKSVHKSWDIFFRNTNAGAPPGTAYQSPLPLSRGSLAAVAHAQSLVEAQPNVDKLVEDHLAVQSLIRAYQVRRVLYPHTGKGAVFLRSCLMGPIGLSECMLSLYLYLLKY

SEQ ID NO: 910810 - protein, 2150 aa, Homo sapiens
MATPLAVNSAASLWGPYKDIWHKVGNALWRRQPEAVHLLDKILKKHKPDFISLFKNPPKNVQQHEKVQKASTEGVAIQGQQGTRLLPEQLIKEAFILSDLFDIGELAAVELLLAGEHQQPHFPGLTRGLVAVLLYWDGKRCIANSLKALIQSRRGKTWTLELSPELASMTTRFTDELMEQGLTYKVLTLVSQIDVNNEFEKLQRERGLGSEKHRKEVSDLIKECRQSLAESLFAWACQSPLGKEDTLLLIGHLERVTVEANGSLDAVNLALLMALLYCFDISFIEQSTEERDDMIHQLPLLTEKQYIATIHSRLQDSQLWKLPGLQATVRLAWALALRGISQLPDVTALAEFTEADEAMAELAIADNVFLFLMESVVVSEYFYQEEFYIRRVHNLITDFLALMPMKVKQLRNRADEDARMIHMSMQMGNEPPISLRRDLEHLMLLIGELYKKNPFHLELALEYWCPTEPLQTPTIMGSYLGVAHQRPPQRQVVLSKFVRQMGDLLPPTIYIPYLKMLQGLANGPQCAHYCFSLLKVNGSSHVENIQGAGGSPVSWEHFFHSLMLYHEHLRKDLPSADSVQYRHLPSRGITQKEQDGLIAFLQLTSTIITWSENARLALCEHPQWTPVVVILGLLQCSIPPVLKAELLKTLAAFGKSPEIAASLWQSLEYTQILQTVRIPSQRQAIGIEVELNEIESRCEEYPLTRAFCQLISTLVESSFPSNLGAGLRPPGFDPYLQFLRDSVFLRFRTRAYRRAAEKWEVAEVVLEVFYKLLRDYEPQLEDFVDQFVELQGEEIIAYKPPGFSLMYHLLNESPMLELALSLLEEGVKQLDTYAPFPGKKHLEKAVQHCLALLNLTLQKENLFMDLLRESQLALIVCPLEQLLQGINPRTKKADNVVNIARYLYHGNTNPELAFESAKILCCISCNSNIQIKLVGDFTHDQSISQKLMAGFVECLDCEDAEEFVRLEEGSELEKKLVAIRHETRIHILNLLITSLECNPPNLALYLLGFELKKPVSTTNLQDPGVLGCPRTCLHAILNILEKGTEGRTGPVAVRESPQLAELCYQVIYQLCACSDTSGPTMRYLRTSQDFLFSQLQYLPFSNKEYEISMLNQMSWLMKTASIELRVTSLNRQRSHTQRLLHLLLDDMPVKPYSDGEGGIEDENRSVSGFLHFDTATKVRRKILNILDSIDFSQEIPEPLQLDFFDRAQIEQVIANCEHKNLRGQTVCNVKLLHRVLVAEVNALQGMAAIGQRPLLMEEISTVLQYVVGRNKLLQCLHAKRHALESWRQLVEIILTACPQDLIQAEDRQLIIRDILQDVHDKILDDEAAQELMPVVAGAVFTLTAHLSQAVLTEQKQTSVLGPAEAHYAFMLDSCFTSPPPEENPLVGFASIGDSSLYIILKKLLDFILKTGGGFQRVRTHLYGSLLYYLQIAQRPDEPDTLEAAKKTMWERLTAPEDVFSKLQRENIAIIESYGAALMEVVCRDACDGHEIGRMLALALLDRIVSVDKQQQWLLYLSNSGYLKVLVDSLVEDDRTLQSLLTPQPPLLKALYTYESKMAFLTRVAKIQQGALELLRSGVIVRLAQCQVYDMRPETDPQSMFGMRDPPMFIPTPVDRYRQILLPALQLCQVILTSSMAQHLQAAGQVLQFLISHSDTIQAILRCQDVSAGSLQELALLTGIISKAALPGILSELDVDVNEGSLMELQGHIGRFQRQCLGLLSRFGGSDRLRQFKFQDDNVEGDKVSKKDEIELAMQQICANVMEYCQSLMLQSSPTFQHAVCLFTPSLSETVNRDGPRQDTQAPVVPYWRLPGLGIIIYLLKQSANDFFSYYDSHRQSVSKLQNVEQLPPDEIKELCQSVMPAGVDKISTAQKYVLARRRLVKVINNRAKLLSLCSFIIETCLFILWRHLEYYLLHCMPTDSQDSLFASRTLFKSRRLQDSFASETNLDFRSGLAIVSQHDLDQLQADAINAFGESLQKKLLDIEGLYSKVRSRYSFIQALVRRIRGLYELEATDKYKDCLVGLRFHHSQTVKTFSQNRPAAARTFQQIRCYSAPVAAEPFLSGTSSNYVEEMYCAWLENPKSVHKKVRLAGLWVCLMLVCWPVPDWSPGKCVRPEESAGRQAAGAPYQPPYLYRTQHSPSRSHGPWIGVQQ

SEQ ID NO: 910811 - protein, 2006 aa, Homo sapiens
MATPLAVNSAASLWGPYKDIWHKVGNALWRRQPEAVHLLDKILKKHKPDFISLFKNPPKNVQQHEKVQKASTEGVAIQGQQGTRLLPEQLIKEAFILSDLFDIGELAAVELLLAGEHQQPHFPGLTRGLVAVLLYWDGKRCIANSLKALIQSRRGKTWTLELSPELASMTTRFTDELMEQGLTYKVLTLVSQIDVNNEFEKLQRERGLGSEKHRKEVSDLIKECRQSLAESLFAWACQSPLGKEDTLLLIGHLERVTVEANGSLDAVNLALLMALLYCFDISFIEQSTEERDDMIHQLPLLTEKQYIATIHSRLQDSQLWKLPGLQATVRLAWALALRGISQLPDVTALAEFTEADEAMAELAIADNVFLFLMESVVVSEYFYQEEFYIRRVHNLITDFLALMPMKVKQLRNRADEDARMIHMSMQMGNEPPISLRRDLEHLMLLIGELYKKNPFHLELALEYWCPTEPLQTPTIMGSYLGVAHQRPPQRQVVLSKFVRQMGDLLPPTIYIPYLKMLQGLANGPQCAHYCFSLLKVNGSSHVENIQGAGGSPVSWEHFFHSLMLYHEHLRKDLPSADSVQYRHLPSRGITQKEQDGLIAFLQLTSTIITWSENARLALCEHPQWTPVVVILGLLQCSIPPVLKAELLKTLAAFGKSPEIAASLWQSLEYTQILQTVRIPSQRQAIGIEVELNEIESRCEEYPLTRAFCQLISTLVESSFPSNLGAGLRPPGFDPYLQFLRDSVFLRFRTRAYRRAAEKWEVAEVVLEVFYKLLRDYEPQLEDFVDQFVELQGEEIIAYKPPGFSLMYHLLNESPMLELALSLLEEGVKQLDTYAPFPGKKHLEKAVQHCLALLNLTLQKENLFMDLLRESQLALIVCPLEQLLQGINPRTKKADNVVNIARYLYHGNTNPELAFESAKILCCISCNSNIQIKLVGDFTHDQSISQKLMAGFVECLDCEDAEEFVRLEEGSELEKKLVAIRHETRIHILNLLITSLECNPPNLALYLLGFELKKPVSTTNLQDPGVLGCPRTCLHAILNILEKGTEGRTGPVAVRESPQLAELCYQVIYQLCACSDTSGPTMRYLRTSQDFLFSQLQYLPFSNKEYEISMLNQMSWLMKTASIELRVTSLNRQRSHTQRLLHLLLDDMPVKPYSDGEGGIEDENRSVSGFLHFDTATKVRRKILNILDSIDFSQEIPEPLQLDFFDRAQIEQVIANCEHKNLRGQTVCNVKLLHRVLVAEVNALQGMAAIGQRPLLMEEISTVLQYVVGRNKLLQCLHAKRHALESWRQLVEIILTACPQDLIQAEDRQLIIRDILQDVHDKILDDEAAQELMPVVAGAVFTLTAHLSQAVLTEQKQTSVLGPAEAHYAFMLDSCFTSPPPEENPLVGFASIGDSSLYIILKKLLDFILKTGGGFQRVRTHLYGSLLYYLQIAQRPDEPDTLEAAKKTMWERLTAPEDVFSKLQRENIAIIESYGAALMEVVCRDACDGHEIGRMLALALLDRIVSVDKQQQWLLYLSNSGYLKVLVDSLVEDDRTLQSLLTPQPPLLKALYTYESKMAFLTRVAKIQQGALELLRSGVIVRLAQCQVYDMRPETDPQSMFGMRDPPMFIPTPVDRYRQILLPALQLCQVILTSSMAQHLQAAGQVLQFLISHSDTIQAILRCQDVSAGSLQELALLTGIISKAALPGILSELDVDVNEGSLMELQGHIGRFQRQCLGLLSRFGGSDRLRQFKFQDDNVEGDKVSKKDEIELAMQQICANVMEYCQSLMLQSSPTFQHAVCLFTPSLSETVNRDGPRQDTQAPVVPYWRLPGLGIIIYLLKQSANDFFSYYDSHRQSVSKLQNVEQLPPDEIKELCQSVMPAGVDKISTAQKYVLARRRLVKVINNRAKLLSLCSFIIETCLFILWRHLEYYLLHCMPTDSQDSLFASRTLFKSRRLQDSFASETNLDFRSGLAIVSQHDLDQLQADAINAFGESLQKKLLDIEGLYSKVRSRYSFIQALVRRIRGL

SEQ ID NO: 910812 - protein, 1909 aa, Homo sapiens
MATPLAVNSAASLWGPYKDIWHKVGNALWRRQPEAVHLLDKILKKHKPDFISLFKNPPKNVQQHEKVQKASTEGVAIQGQQGTRLLPEQLIKEAFILSDLFDIGELAAVELLLAGEHQQPHFPGLTRGLVAVLLYWDGKRCIANSLKALIQSRRGKTWTLELSPELASMTTRFTDELMEQGLTYKVLTLVSQIDVNNEFEKLQRERGLGSEKHRKEVSDLIKECRQSLAESLFAWACQSPLGKEDTLLLIGHLERVTVEANGSLDAVNLALLMALLYCFDISFIEQSTEERDDMIHQLPLLTEKQYIATIHSRLQDSQLWKLPGLQATVRLAWALALRGISQLPDVTALAEFTEADEAMAELAIADNVFLFLMESVVVSEYFYQEEFYIRRVHNLITDFLALMPMKVKQLRNRADEDARMIHMSMQMGNEPPISLRRDLEHLMLLIGELYKKNPFHLELALEYWCPTEPLQTPTIMGSYLGVAHQRPPQRQVVLSKFVRQMGDLLPPTIYIPYLKMLQGLANGPQCAHYCFSLLKVNGSSHVENIQGAGGSPVSWEHFFHSLMLYHEHLRKDLPSADSVQYRHLPSRGITQKEQDGLIAFLQLTSTIITWSENARLALCEHPQWTPVVVILGLLQCSIPPVLKAELLKTLAAFGKSPEIAASLWQSLEYTQILQTVRIPSQRQAIGIEVELNEIESRCEEYPLTRAFCQLISTLVESSFPSNLGAGLRPPGFDPYLQFLRDSVFLRFRTRAYRRAAEKWEVAEVVLEVFYKLLRDYEPQLEDFVDQFVELQGEEIIAYKPPGFSLMYHLLNESPMLELALSLLEEGVKQLDTYAPFPGKKHLEKAVQHCLALLNLTLQKENLFMDLLRESQLALIVCPLEQLLQGINPRTKKADNVVNIARYLYHGNTNPELAFESAKILCCISCNSNIQIKLVGDFTHDQSISQKLMAGFVECLDCEDAEEFVRLEEGSELEKKLVAIRHETRIHILNLLITSLECNPPNLALYLLGFELKKPVSTTNLQDPGVLGCPRTCLHAILNILEKGTEGRTGPVAVRESPQLAELCYQVIYQLCACSDTSGPTMRYLRTSQDFLFSQLQYLPFSNKEYEISMLNQMSWLMKTASIELRVTSLNRQRSHTQRLLHLLLDDMPVKPYSDGEGGIEDENRSVSGFLHFDTATKVRRKILNILDSIDFSQEIPEPLQLDFFDRAQIEQVIANCEHKNLRGQTVCNVKLLHRVLVAEVNALQGMAAIGQRPLLMEEISTVLQYVVGRNKLLQCLHAKRHALESWRQLVEIILTACPQDLIQAEDRQLIIRDILQDVHDKILDDEAAQELMPVVAGAVFTLTAHLSQAVLTEQKQTSVLGPAEAHYAFMLDSCFTSPPPEENPLVGFASIGDSSLYIILKKLLDFILKTGGGFQRVRTHLYGSLLYYLQIAQRPDEPDTLEAAKKTMWERLTAPEDVFSKLQRENIAIIESYGAALMEVVCRDACDGHEIGRMLALALLDRIVSVDKQQQWLLYLSNSGYLKVLVDSLVEDDRTLQSLLTPQPPLLKALYTYESKMAFLTRVAKIQQGALELLRSGVIVRLAQCQVYDMRPETDPQSMFGMRDPPMFIPTPVDRYRQILLPALQLCQVILTSSMAQHLQAAGQVLQFLISHSDTIQAILRCQDVSAGSLQELALLTGIISKAALPGILSELDVDVNEGSLMELQGHIGRFQRQCLGLLSRFGGSDRLRQFKFQDDNVEGDKVSKKDEIELAMQQICANVMEYCQSLMLQSSPTFQHAVCLFTPSLSETVNRDGPRQDTQAPVVPYWRLPGLGIIIYLLKQSANDFFSYYDSHRQSVSKLQNVEQLPPDEIKELCQSVMPAGVDKISTAQKYVLARRRLVKVINNRAKLLSLCSCILYEIMHLNDDLEI

SEQ ID NO: 910813 - protein, 1759 aa, Homo sapiens
MATPLAVNSAASLWGPYKDIWHKVGNALWRRQPEAVHLLDKILKKHKPDFISLFKNPPKNVQQHEKVQKASTEGVAIQGQQGTRLLPEQLIKEAFILSDLFDIGELAAVELLLAGEHQQPHFPGLTRGLVAVLLYWDGKRCIANSLKALIQSRRGKTWTLELSPELASMTTRFTDELMEQGLTYKVLTLVSQIDVNNEFEKLQRERGLGSEKHRKEVSDLIKECRQSLAESLFAWACQSPLGKEDTLLLIGHLERVTVEANGSLDAVNLALLMALLYCFDISFIEQSTEERDDMIHQLPLLTEKQYIATIHSRLQDSQLWKLPGLQATVRLAWALALRGISQLPDVTALAEFTEADEAMAELAIADNVFLFLMESVVVSEYFYQEEFYIRRVHNLITDFLALMPMKVKQLRNRADEDARMIHMSMQMGNEPPISLRRDLEHLMLLIGELYKKNPFHLELALEYWCPTEPLQTPTIMGSYLGVAHQRPPQRQVVLSKFVRQMGDLLPPTIYIPYLKMLQGLANGPQCAHYCFSLLKVNGSSHVENIQGAGGSPVSWEHFFHSLMLYHEHLRKDLPSADSVQYRHLPSRGITQKEQDGLIAFLQLTSTIITWSENARLALCEHPQWTPVVVILGLLQCSIPPVLKAELLKTLAAFGKSPEIAASLWQSLEYTQILQTVRIPSQRQAIGIEVELNEIESRCEEYPLTRAFCQLISTLVESSFPSNLGAGLRPPGFDPYLQFLRDSVFLRFRTRAYRRAAEKWEVAEVVLEVFYKLLRDYEPQLEDFVDQFVELQGEEIIAYKPPGFSLMYHLLNESPMLELALSLLEEGVKQLDTYAPFPGKKHLEKAVQHCLALLNLTLQKENLFMDLLRESQLALIVCPLEQLLQGINPRTKKADNVVNIARYLYHGNTNPELAFESAKILCCISCNSNIQIKLVGDFTHDQSISQKLMAGFVECLDCEDAEEFVRLEEGSELEKKLVAIRHETRIHILNLLITSLECNPPNLALYLLGFELKKPVSTTNLQDPGVLGCPRTCLHAILNILEKGTEGRTGPVAVRESPQLAELCYQVIYQLCACSDTSGPTMRYLRTSQDFLFSQLQYLPFSNKEYEISMLNQMSWLMKTASIELRVTSLNRQRSHTQRLLHLLLDDMPVKPYSDGEGGIEDENRSVSGFLHFDTATKVRRKILNILDSIDFSQEIPEPLQLDFFDRAQIEQVIANCEHKNLRGQTVCNVKLLHRVLVAEVNALQGMAAIGQRPLLMEEISTVLQYVVGRNKLLQCLHAKRHALESWRQLVEIILTACPQDLIQAEDRQLIIRDILQDVHDKILDDEAAQELMPVVAGAVFTLTAHLSQAVLTEQKQTSVLGPAEAHYAFMLDSCFTSPPPEENPLVGFASIGDSSLYIILKKLLDFILKTGGGFQRVRTHLYGSLLYYLQIAQRPDEPDTLEAAKKTMWERLTAPEDVFSKLQRENIAIIESYGAALMEVVCRDACDGHEIGRMLALALLDRIVSVDKQQQWLLYLSNSGYLKVLVDSLVEDDRTLQSLLTPQPPLLKALYTYESKMAFLTRVAKIQQGALELLRSGVIVRLAQCQVYDMRPETDPQSMFGMRDPPMFIPTPVDRYRQILLPALQLCQVILTSSMAQHLQAAGQVLQFLISHSDTIQAILRCQDVSAGSLQELALLTGIISKAALPGILSELDVDVNEGSLMELQGHIGRFQRQCLGLLSRFGGSDRLRQFKFQDDNVEGDKVSKKDEIELAMQQVRTM

SEQ ID NO: 910814 - protein, 850 aa, Homo sapiens
MATPLAVNSAASLWGPYKDIWHKVGNALWRRQPEAVHLLDKILKKHKPDFISLFKNPPKNVQQHEKVQKASTEGVAIQGQQGTRLLPEQLIKEAFILSDLFDIGELAAVELLLAGEHQQPHFPGLTRGLVAVLLYWDGKRCIANSLKALIQSRRGKTWTLELSPELASMTTRFTDELMEQGLTYKVLTLVSQIDVNNEFEKLQRERGLGSEKHRKEVSDLIKECRQSLAESLFAWACQSPLGKEDTLLLIGHLERVTVEANGSLDAVNLALLMALLYCFDISFIEQSTEERDDMIHQLPLLTEKQYIATIHSRLQDSQLWKLPGLQATVRLAWALALRGISQLPDVTALAEFTEADEAMAELAIADNVFLFLMESVVVSEYFYQEEFYIRRVHNLITDFLALMPMKVKQLRNRADEDARMIHMSMQMGNEPPISLRRDLEHLMLLIGELYKKNPFHLELALEYWCPTEPLQTPTIMGSYLGVAHQRPPQRQVVLSKFVRQMGDLLPPTIYIPYLKMLQGLANGPQCAHYCFSLLKVNGSSHVENIQGAGGSPVSWEHFFHSLMLYHEHLRKDLPSADSVQYRHLPSRGITQKEQDGLIAFLQLTSTIITWSENARLALCEHPQWTPVVVILGLLQCSIPPVLKAELLKTLAAFGKSPEIAASLWQSLEYTQILQTVRIPSQRQAIGIEVELNEIESRCEEYPLTRAFCQLISTLVESSFPSNLGAGLRPPGFDPYLQFLRDSVFLRFRTRAYRRAAEKWEVAEVVLEVFYKLLRDYEPQLEDFVDQFVELQGEEIIAYKPPGFSLMYHLLNESPMLELALSLLEEGVKQLDTYAPFPGICLKAFMSCKQL

SEQ ID NO: 910815 - protein, 65 aa, Homo sapiens
MAYCQHIGVEFMFINDLEQCQWIRQKFETPGIMQFTNEEKRTLLARLVRSTRYGSGPGPWGRHSQ

SEQ ID NO: 910816 - protein, 2012 aa, Homo sapiens
MATPLAVNSAASLWGPYKDIWHKVGNALWRRQPEAVHLLDKILKKHKPDFISLFKNPPKNVQQHEKVQKASTEGVAIQGQQGTRLLPEQLIKEAFILSDLFDIGELAAVELLLAGEHQQPHFPGLTRGLVAVLLYWDGKRCIANSLKALIQSRRGKTWTLELSPELASMTTRFTDELMEQGLTYKVLTLVSQIDVNNEFEKLQRERGLGSEKHRKEVSDLIKECRQSLAESLFAWACQSPLGKEDTLLLIGHLERVTVEANGSLDAVNLALLMALLYCFDISFIEQSTEERDDMIHQLPLLTEKQYIATIHSRLQDSQLWKLPGLQATVRLAWALALRGISQLPDVTALAEFTEADEAMAELAIADNVFLFLMESVVVSEYFYQEEFYIRRVHNLITDFLALMPMKVKQLRNRADEDARMIHMSMQMGNEPPISLRRDLEHLMLLIGELYKKNPFHLELALEYWCPTEPLQTPTIMGSYLGVAHQRPPQRQVVLSKFVRQMGDLLPPTIYIPYLKMLQGLANGPQCAHYCFSLLKVNGSSHVENIQGAGGSPVSWEHFFHSLMLYHEHLRKDLPSADSVQYRHLPSRGITQKEQDGLIAFLQLTSTIITWSENARLALCEHPQWTPVVVILGLLQCSIPPVLKAELLKTLAAFGKSPEIAASLWQSLEYTQILQTVRIPSQRQAIGIEVELNEIESRCEEYPLTRAFCQLISTLVESSFPSNLGAGLRPPGFDPYLQFLRDSVFLRFRTRAYRRAAEKWEVAEVVLEVFYKLLRDYEPQLEDFVDQFVELQGEEIIAYKPPGFSLMYHLLNESPMLELALSLLEEGVKQLDTYAPFPGKKHLEKAVQHCLALLNLTLQKENLFMDLLRESQLALIVCPLEQLLQGINPRTKKADNVVNIARYLYHGNTNPELAFESAKILCCISCNSNIQIKLVGDFTHDQSISQKLMAGFVECLDCEDAEEFVRLEEGSELEKKLVAIRHETRIHILNLLITSLECNPPNLALYLLGFELKKPVSTTNLQDPGVLGCPRTCLHAILNILEKGTEGRTGPVAVRESPQLAELCYQVIYQLCACSDTSGPTMRYLRTSQDFLFSQLQYLPFSNKEYEISMLNQMSWLMKTASIELRVTSLNRQRSHTQRLLHLLLDDMPVKPYSDGEGGIEDENRSVSGFLHFDTATKVRRKILNILDSIDFSQEIPEPLQLDFFDRAQIEQVIANCEHKNLRGQTVCNVKLLHRVLVAEVNALQGMAAIGQRPLLMEEISTVLQYVVGRNKLLQCLHAKRHALESWRQLVEIILTACPQDLIQAEDRQLIIRDILQDVHDKILDDEAAQELMPVVAGAVFTLTAHLSQAVLTEQKQTSVLGPAEAHYAFMLDSCFTSPPPEENPLVGFASIGDSSLYIILKKLLDFILKTGGGFQRVRTHLYGSLLYYLQIAQRPDEPDTLEAAKKTMWERLTAPEDVFSKLQRENIAIIESYGAALMEVVCRDACDGHEIGRMLALALLDRIVSVDKQQQWLLYLSNSGYLKVLVDSLVEDDRTLQSLLTPQPPLLKALYTYESKMAFLTRVAKIQQGALELLRSGVIVRLAQCQVYDMRPETDPQSMFGMRDPPMFIPTPVDRYRQILLPALQLCQVILTSSMAQHLQAAGQVLQFLISHSDTIQAILRCQDVSAGSLQELALLTGIISKAALPGILSELDVDVNEGSLMELQGHIGRFQRQCLGLLSRFGGSDRLRQFKFQDDNVEGDKVSKKDEIELAMQQICANVMEYCQSLMLQSSPTFQHAVCLFTPSLSETVNRDGPRQDTQAPVVPYWRLPGLGIIIYLLKQSANDFFSYYDSHRQSVSKLQNVEQLPPDEIKELCQSVMPAGVDKISTAQKYVLARRRLVKVINNRAKLLSLCSFIIETCLFILWRHLEYYLLHCMPTDSQDSLFASRTLFKSRRLQDSFASETNLDFRSGLAIVSQHDLDQLQADAINAFGESLQKKLLDIEGLYSKVRSRYSFIQALVRRIRGLLRISRN

SEQ ID NO: 910817 - protein, 338 aa, Homo sapiens
TPYAGAGPRVWSPGVGCRRLIRVELSRRQAVVKNFRTKMFHLRTCAAKLRPLTASQTVKTFSQNRPAAARTFQQIRCYSAPVAAEPFLSGTSSNYVEEMYCAWLENPKSVHKSWDIFFRNTNAGAPPGTAYQSPLPLSRGSLAAVAHAQSLVEAQPNVDKLVEDHLAVQSLIRAYQIRGHHVAQLDPLGILDADLDSSVPADIISSTDKLDLAVFQGNRLSNANSRRGSMGWIESDPRQVLPIGPQANFQSGGTGENPGTLPILDRDKFIRSNWKNWAYTGASKIGGGEIQCPPQETLEHAATVEPRAEDSGEPPWTIVTVTKLAESNRTREAKVRRH

SEQ ID NO: 910818 - protein, 164 aa, Homo sapiens
TPYAGAGPRVWSPGVGCRRLIRVELSRRQAVVKNFRTKMFHLRTCAAKLRPLTASQTVKTFSQNRPAAARTFQQIRCYSAPVAAEPFLSGTSSNYVEEMYCAWLENPKSVHKCWPVPDWSPGKCVRPEESAGRQAAGAPYQPPYLYRTQHSPSRSHGPWIGVQQ

SEQ ID NO: 910819 - protein, 1061 aa, Homo sapiens; identical to SEQ ID NO: 910795

SEQ ID NO: 910820 - protein, 3033 aa, Homo sapiens; identical to SEQ ID NO: 910802

SEQ ID NO: 910821 - protein, 3220 aa, Homo sapiens
MATPLAVNSAASLWGPYKDIWHKVGNALWRRQPEAVHLLDKILKKHKPDFISLFKNPPKNVQQHEKVQKASTEGVAIQGQQGTRLLPEQLIKEAFILSDLFDIGELAAVELLLAGEHQQPHFPGLTRGLVAVLLYWDGKRCIANSLKALIQSRRGKTWTLELSPELASMTTRFTDELMEQGLTYKVLTLVSQIDVNNEFEKLQRERGLGSEKHRKEVSDLIKECRQSLAESLFAWACQSPLGKEDTLLLIGHLERVTVEANGSLDAVNLALLMALLYCFDISFIEQSTEERDDMIHQLPLLTEKQYIATIHSRLQDSQLWKLPGLQATVRLAWALALRGISQLPDVTALAEFTEADEAMAELAIADNVFLFLMESVVVSEYFYQEEFYIRRVHNLITDFLALMPMKVKQLRNRADEDARMIHMSMQMGNEPPISLRRDLEHLMLLIGELYKKNPFHLELALEYWCPTEPLQTPTIMGSYLGVAHQRPPQRQVVLSKFVRQMGDLLPPTIYIPYLKMLQGLANGPQCAHYCFSLLKVNGSSHVENIQGAGGSPVSWEHFFHSLMLYHEHLRKDLPSADSVQYRHLPSRGITQKEQDGLIAFLQLTSTIITWSENARLALCEHPQWTPVVVILGLLQCSIPPVLKAELLKTLAAFGKSPEIAASLWQSLEYTQILQTVRIPSQRQAIGIEVELNEIESRCEEYPLTRAFCQLISTLVESSFPSNLGAGLRPPGFDPYLQFLRDSVFLRFRTRAYRRAAEKWEVAEVVLEVFYKLLRDYEPQLEDFVDQFVELQGEEIIAYKPPGFSLMYHLLNESPMLELALSLLEEGVKQLDTYAPFPGKKHLEKAVQHCLALLNLTLQKENLFMDLLRESQLALIVCPLEQLLQGINPRTKKADNVVNIARYLYHGNTNPELAFESAKILCCISCNSNIQIKLVGDFTHDQSISQKLMAGFVECLDCEDAEEFVRLEEGSELEKKLVAIRHETRIHILNLLITSLECNPPNLALYLLGFELKKPVSTTNLQDPGVLGCPRTCLHAILNILEKGTEGRTGPVAVRESPQLAELCYQVIYQLCACSDTSGPTMRYLRTSQDFLFSQLQYLPFSNKEYEISMLNQMSWLMKTASIELRVTSLNRQRSHTQRLLHLLLDDMPVKPYSDGEGGIEDENRSVSGFLHFDTATKVRRKILNILDSIDFSQEIPEPLQLDFFDRAQIEQVIANCEHKNLRGQTVCNVKLLHRVLVAEVNALQGMAAIGQRPLLMEEISTVLQYVVGRNKLLQCLHAKRHALESWRQLVEIILTACPQDLIQAEDRQLIIRDILQDVHDKILDDEAAQELMPVVAGAVFTLTAHLSQAVLTEQKQTSVLGPAEAHYAFMLDSCFTSPPPEENPLVGFASIGDSSLYIILKKLLDFILKTGGGFQRVRTHLYGSLLYYLQIAQRPDEPDTLEAAKKTMWERLTAPEDVFSKLQRENIAIIESYGAALMEVVCRDACDGHEIGRMLALALLDRIVSVDKQQQWLLYLSNSGYLKVLVDSLVEDDRTLQSLLTPQPPLLKALYTYESKMAFLTRVAKIQQGALELLRSGVIVRLAQCQVYDMRPETDPQSMFGMRDPPMFIPTPVDRYRQILLPALQLCQVILTSSMAQHLQAAGQVLQFLISHSDTIQAILRCQDVSAGSLQELALLTGIISKAALPGILSELDVDVNEGSLMELQGHIGRFQRQCLGLLSRFGGSDRLRQFKFQDDNVEGDKVSKKDEIELAMQQICANVMEYCQSLMLQSSPTFQHAVCLFTPSLSETVNRDGPRQDTQAPVVPYWRLPGLGIIIYLLKQSANDFFSYYDSHRQSVSKLQNVEQLPPDEIKELCQSVMPAGVDKISTAQKYVLARRRLVKVINNRAKLLSLCSFIIETCLFILWRHLEYYLLHCMPTDSQDSLFASRTLFKSRRLQGKLSAEKLMNHEIPICALKSKYQFFFIFVSRLLRVNWVNQELFESLDVAISCILLSVTGHCAEHKNILEPAHQLFLSFLLQLGADPALEEWRRSAIMLILIAGVGLCDLMAIYWIPEVEGNREKLRTLVWTSEMLSRGFHLLKVKIEFPILSRVFHGAIVIIIVIRFLHCVVDRYLHSRYDSVFLSLDSFASETNLDFRSGLAIVSQHDLDQLQADAINAFGESLQKKLLDIEGLYSKVRSRYSFIQALVRRIRGLYNSEATDKYKDCLVGLRFHHSQTVKTFSQNRPAAARTFQQIRCYSAPVAAEPFLSGTSSNYVEEMYCAWLENPKSVHKSWDIFFRNTNAGAPPGTAYQSPLPLSRGSLAAVAHAQSLVEAQPNVDKLVEDHLAVQSLIRAYQIRGHHVAQLDPLGILDADLDSSVPADIISSTDKLGFYGLDESDLDKVFHLPTTTFIGGQESALPLREIIRRLEMAYCQHIGVEFMFINDLEQCQWIRQKFETPGIMQFTNEEKRTLLARLVRSTRFEEFLQRKWSSEKRFGLEGCEVLIPALKTIIDKSSENGVDYVIMGMPHRGRLNVLANVIRKELEQIFCQFDSKLEAADEGSGDVKYHLGMYHRRINRVTDRNITLSLVANPSHLEAADPVVMGKTKAEQFYCGDTEGKKVMSILLHGDAAFAGQGIVYETFHLSDLPSYTTHGTVHVVVNNQIGFTTDPRMARSSPYPTDVARVVNAPIFHVNSDDPEAVMYVCKVAAEWRSTFHKDVVVDLVCYRRNGHNEMDEPMFTQPLMYKQIRKQKPVLQKYAELLVSQGVVNQPEYEEEISKYDKICEEAFARSKDEKILHIKHWLDSPWPGFFTLDGQPRSMSCPSTGLTEDILTHIGNVASSVPVENFTIHGGLSRILKTRGEMVKNRTVDWALAEYMAFGSLLKEGIHIRLSGQDVERGTFSHRHHVLHDQNVDKRTCIPMNHLWPNQAPYTVCNSSLSEYGVLGFELGFAMASPNALVLWEAQFGDFHNTAQCIIDQFICPGQAKWVRQNGIVLLLPHGMEGMGPEHSSARPERFLQMCNDDPDVLPDLKEANFDINQLYDCNWVVVNCSTPGNFFHVLRRQILLPFRKPLIIFTPKSLLRHPEARSSFDEMLPGTHFQRVIPEDGPAAQNPENVKRLLFCTGKVYYDLTRERKARDMVGQVAITRIEQLSPFPFDLLLKEVQKYPNAELAWCQEEHKNQGYYDYVKPRLRTTISRAKPVWYAGRDPAAAPATGNKKTHLTELQRLLDTAFDLDVFKNFS

SEQ ID NO: 910822 - protein, 1490 aa, Homo sapiens
DAWVDPRVAYESKMAFLTRVAKIQQGALELLRSGVIVRLAQCQVYDMRPETDPQSMFGMRDPPMFIPTPVDRYRQILLPALQLCQVILTSSMAQHLQAAGQVLQFLISHSDTIQAILRCQDVSAGSLQELALLTGIISKAALPGILSELDVDVNEGSLMELQGHIGRFQRQCLGLLSRFGGSDRLRQFKFQDDNVEGDKVSKKDEIELAMQQICANVMEYCQSLMLQSSPTFQHAVCLFTPSLSETVNRDGPRQDTQAPVVPYWRLPGLGIIIYLLKQSANDFFSYYDSHRQSVSKLQNVEQLPPDEIKELCQSVMPAGVDKISTAQKYVLARRRLVKVINNRAKLLSLCSFIIETCLFILWRHLEYYLLHCMPTDSQDSLFASRTLFKSRRLQDSFASETNLDFRSGLAIVSQHDLDQLQADAINAFGESLQKKLLDIEGLYSKVRSRYSFIQALVRRIRGLYNSEATDKYKDCLVGLRFHHSQTVKTFSQNRPAAARTFQQIRCYSAPVAAEPFLSGTSSNYVEEMYCAWLENPKSVHKSWDIFFRNTNAGAPPGTAYQSPLPLSRGSLAAVAHAQSLVEAQPNVDKLVEDHLAVQSLIRAYQIRGHHVAQLDPLGILDADLDSSVPADIISSTDKLGFYGLDESDLDKVFHLPTTTFIGGQESALPLREIIRRLEMAYCQHIGVEFMFINDLEQCQWIRQKFETPGIMQFTNEEKRTLLARLVRSTRFEEFLQRKWSSEKRFGLEGCEVLIPALKTIIDKSSENGVDYVIMGMPHRGRLNVLANVIRKELEQIFCQFDSKLEAADEGSGDVKYHLGMYHRRINRVTDRNITLSLVANPSHLEAADPVVMGKTKAEQFYCGDTEGKKVMSILLHGDAAFAGQGIVYETFHLSDLPSYTTHGTVHVVVNNQIGFTTDPRMARSSPYPTDVARVVNAPIFHVNSDDPEAVMYVCKVAAEWRSTFHKDVVVDLVCYRRNGHNEMDEPMFTQPLMYKQIRKQKPVLQKYAELLVSQGVVNQPEYEEEISKYDKICEEAFARSKDEKILHIKHWLDSPWPGFFTLDGQPRSMSCPSTGLTEDILTHIGNVASSVPVENFTIHGGLSRILKTRGEMVKNRTVDWALAEYMAFGSLLKEGIHIRLSGQDVERGTFSHRHHVLHDQNVDKRTCIPMNHLWPNQAPYTVCNSSLSEYGVLGFELGFAMASPNALVLWEAQFGDFHNTAQCIIDQFICPGQAKWVRQNGIVLLLPHGMEGMGPEHSSARPERFLQMCNDDPDVLPDLKEANFDINQLYDCNWVVVNCSTPGNFFHVLRRQILLPFRKPLIIFTPKSLLRHPEARSSFDEMLPGTHFQRVIPEDGPAAQNPENVKRLLFCTGKVYYDLTRERKARDMVGQVAITRIEQLSPFPFDLLLKEVQKYPNAELAWCQEEHKNQGYYDYVKPRLRTTISRAKPVWYAGRDPAAAPATGNKKTHLTELQRLLDTAFDLDVFKNFS

SEQ ID NO: 910823 - protein, 1023 aa, Homo sapiens; identical to SEQ ID NO: 910800

SEQ ID NO: 910824 - protein, 2469 aa, Homo sapiens
MATPLAVNSAASLWGPYKDIWHKVGNALWRRQPEAVHLLDKILKKHKPDFISLFKNPPKNVQQHEKVQKASTEGVAIQGQQGTRLLPEQLIKEAFILSDLFDIGELAAVELLLAGEHQQPHFPGLTRGLVAVLLYWDGKRCIANSLKALIQSRRGKTWTLELSPELASMTTRFTDELMEQGLTYKVLTLVSQIDVNNEFEKLQRERGLGSEKHRKEVSDLIKECRQSLAESLFAWACQSPLGKEDTLLLIGHLERVTVEANGSLDAVNLALLMALLYCFDISFIEQSTEERDDMIHQLPLLTEKQYIATIHSRLQDSQLWKLPGLQATVRLAWALALRGISQLPDVTALAEFTEADEAMAELAIADNVFLFLMESVVVSEYFYQEEFYIRRVHNLITDFLALMPMKVKQLRNRADEDARMIHMSMQMGNEPPISLRRDLEHLMLLIGELYKKNPFHLELALEYWCPTEPLQTPTIMGSYLGVAHQRPPQRQVVLSKFVRQMGDLLPPTIYIPYLKMLQGLANGPQCAHYCFSLLKVNGSSHVENIQGAGGSPVSWEHFFHSLMLYHEHLRKDLPSADSVQYRHLPSRGITQKEQDGLIAFLQLTSTIITWSENARLALCEHPQWTPVVVILGLLQCSIPPVLKAELLKTLAAFGKSPEIAASLWQSLEYTQILQTVRIPSQRQAIGIEVELNEIESRCEEYPLTRAFCQLISTLVESSFPSNLGAGLRPPGFDPYLQFLRDSVFLRFRTRAYRRAAEKWEVAEVVLEVFYKLLRDYEPQLEDFVDQFVELQGEEIIAYKPPGFSLMYHLLNESPMLELALSLLEEGVKQLDTYAPFPGKKHLEKAVQHCLALLNLTLQKENLFMDLLRESQLALIVCPLEQLLQGINPRTKKADNVVNIARYLYHGNTNPELAFESAKILCCISCNSNIQIKLVGDFTHDQSISQKLMAGFVECLDCEDAEEFVRLEEGSELEKKLVAIRHETRIHILNLLITSLECNPPNLALYLLGFELKKPVSTTNLQDPGVLGCPRTCLHAILNILEKGTEGRTGPVAVRESPQLAELCYQVIYQLCACSDTSGPTMRYLRTSQDFLFSQLQYLPFSNKEYEISMLNQMSWLMKTASIELRVTSLNRQRSHTQRLLHLLLDDMPVKPYSDGEGGIEDENRSVSGFLHFDTATKVRRKILNILDSIDFSQEIPEPLQLDFFDRAQIEQVIANCEHKNLRGQTVCNVKLLHRVLVAEVNALQGMAAIGQRPLLMEEISTVLQYVVGRNKLLQCLHAKRHALESWRQLVEIILTACPQDLIQAEDRQLIIRDILQDVHDKILDDEAAQELMPVVAGAVFTLTAHLSQAVLTEQKQTSVLGPAEAHYAFMLDSCFTSPPPEENPLVGFASIGDSSLYIILKKLLDFILKTGGGFQRVRTHLYGSLLYYLQIAQRPDEPDTLEAAKKTMWERLTAPEDVFSKLQRENIAIIESYGAALMEVVCRDACDGHEIGRMLALALLDRIVSVDKQQQWLLYLSNSGYLKVLVDSLVEDDRTLQSLLTPQPPLLKALYTYESKMAFLTRVAKIQQGALELLRSGVIVRLAQCQVYDMRPETDPQSMFGMRDPPMFIPTPVDRYRQILLPALQLCQVILTSSMAQHLQAAGQVLQFLISHSDTIQAILRCQDVSAGSLQELALLTGIISKAALPGILSELDVDVNEGSLMELQGHIGRFQRQCLGLLSRFGGSDRLRQFKFQDDNVEGDKVSKKDEIELAMQQICANVMEYCQSLMLQSSPTFQHAVCLFTPSLSETVNRDGPRQDTQAPVVPYWRLPGLGIIIYLLKQSANDFFSYYDSHRQSVSKLQNVEQLPPDEIKELCQSVMPAGVDKISTAQKYVLARRRLVKVINNRAKLLSLCSFIIETCLFILWRHLEYYLLHCMPTDSQDSLFASRTLFKSRRLQDSFASETNLDFRSGLAIVSQHDLDQLQADAINAFGESLQKKLLDIEGLYSKVRSRYSFIQALVRRIRGLYELEATDKYKDCLVGLRFHHSQTVKTFSQNRPAAARTFQQIRCYSAPVAAEPFLSGTSSNYVEEMYCAWLENPKSVHKSWDIFFRNTNAGAPPGTAYQSPLPLSRGSLAAVAHAQSLVEAQPNVDKLVEDHLAVQSLIRAYQIRGHHVAQLDPLGILDADLDSSVPADIISSTDKLGFYGLDESDLDKVFHLPTTTFIGGQESALPLREIIRRLEMAYCQHIGVEFMFINDLEQCQWIRQKFETPGIMQFTNEEKRTLLARLVRSTRFEEFLQRKWSSEKRFGLEGCEVLIPALKTIIDKSLLRHPEARSSFDEMLPGTHFQRVIPEDGPAAQNPENVKRLLFCTGKVYYDLTRERKARDMVGQVAITRIEQLSPFPFDLLLKEVQKYPNAELAWCQEEHKNQGYYDYVKPRLRTTISRAKPVWYAGRDPAAAPATGNKKTHLTELQRLLDTAFDLDVFKNFS

SEQ ID NO: 910825 - protein, 946 aa, Homo sapiens
MSWDIFFRNTNAGAPPGTAYQSPLPLSRGSLAAVAHAQSLVEAQPNVDKLVEDHLAVQSLIRAYQVRGHHIAKLDPLGISCVNFDDAPVTVSSNVGFYGLDESDLDKVFHLPTTTFIGGQESALPLREIIRRLEMAYCQHIGVEFMFINDLEQCQWIRQKFETPGIMQFTNEEKRTLLARLVRSTRFEEFLQRKWSSEKRFGLEGCEVLIPALKTIIDKSSENGVDYVIMGMPHRGRLNVLANVIRKELEQIFCQFDSKLEAADEGSGDVKYHLGMYHRRINRVTDRNITLSLVANPSHLEAADPVVMGKTKAEQFYCGDTEGKKVMSILLHGDAAFAGQGIVYETFHLSDLPSYTTHGTVHVVVNNQIGFTTDPRMARSSPYPTDVARVVNAPIFHVNSDDPEAVMYVCKVAAEWRSTFHKDVVVDLVCYRRNGHNEMDEPMFTQPLMYKQIRKQKPVLQKYAELLVSQGVVNQPEYEEEISKYDKICEEAFARSKDEKILHIKHWLDSPWPGFFTLDGQPRSMSCPSTGLTEDILTHIGNVASSVPVENFTIHGGLSRILKTRGEMVKNRTVDWALAEYMAFGSLLKEGIHIRLSGQDVERGTFSHRHHVLHDQNVDKRTCIPMNHLWPNQAPYTVCNSSLSEYGVLGFELGFAMASPNALVLWEAQFGDFHNTAQCIIDQFICPGQAKWVRQNGIVLLLPHGMEGMGPEHSSARPERFLQMCNDDPDVLPDLKEANFDINQLYDCNWVVVNCSTPGNFFHVLRRQILLPFRKPLIIFTPKSLLRHPEARSSFDEMLPGTHFQRVIPEDGPAAQNPENVKRLLFCTGKVYYDLTRERKARDMVGQVAITRIEQLSPFPFDLLLKEVQKYPNAELAWCQEEHKNQGYYDYVKPRLRTTISRAKPVWYAGRDPAAAPATGNKKTHLTELQRLLDTAFDLDVFKNFS

SEQ ID NO: 910826 - protein, 522 aa, Homo sapiens
EDDLEDPSRPCHNEMDEPMFTQPLMYKQIRKQKPVLQKYAELLVSQGVVNQPEYEEEISKYDKICEEAFARSKDEKILHIKHWLDSPWPGFFTLDGQPRSMSCPSTGLTEDILTHIGNVASSVPVENFTIHGGLSRILKTRGEMVKNRTVDWALAEYMAFGSLLKEGIHIRLSGQDVERGTFSHRHHVLHDQNVDKRTCIPMNHLWPNQAPYTVCNSSLSEYGVLGFELGFAMASPNALVLWEAQFGDFHNTAQCIIDQFICPGQAKWVRQNGIVLLLPHGMEGMGPEHSSARPERFLQMCNDDPDVLPDLKEANFDINQLYDCNWVVVNCSTPGNFFHVLRRQILLPFRKPLIIFTPKSLLRHPEARSSFDEMLPGTHFQRVIPEDGPAAQNPENVKRLLFCTGKVYYDLTRERKARDMVGQVAITRIEQLSPFPFDLLLKEVQKYPNAELAWCQEEHKNQGYYDYVKPRLRTTISRAKPVWYAGRDPAAAPATGNKKTHLTELQRLLDTAFDLDVFKNFS

SEQ ID NO: 910827 - protein, 3033 aa, Homo sapiens; identical to SEQ ID NO: 910802

SEQ ID NO: 910828 - protein, 190 aa, Homo sapiens
NRLSRGAWYSAEADLLHSGTLIIFTPKSLLRHPEARSSFDEMLPGTHFQRVIPEDGPAAQNPENVKRLLFCTGKVYYDLTRERKARDMVGQVAITRIEQLSPFPFDLLLKEVQKYPNAELAWCQEEHKNQGYYDYVKPRLRTTISRAKPVWYAGRDPAAAPATGNKKTHLTELQRLLDTAFDLDVFKNFS

SEQ ID NO: 910829 - protein, 104 aa, Homo sapiens
MPHPPLLGPGSTWSPQSLCVARKPRSGSHRRGTGCSVLVLLTLHLLSWTPSPPQPLFLSPLTQWRLSDASFSLLCQSRSEEGEEGLGVRGQAMAKGPAAPHLSL

SEQ ID NO: 910830 - protein, 2327 aa, Homo sapiens
MATPLAVNSAASLWGPYKDIWHKVGNALWRRQPEAVHLLDKILKKHKPDFISLFKNPPKNVQQHEKVQKASTEGVAIQGQQGTRLLPEQLIKEAFILSDLFDIGELAAVELLLAGEHQQPHFPGLTRGLVAVLLYWDGKRCIANSLKALIQSRRGKTWTLELSPELASMTTRFTDELMEQGLTYKVLTLVSQIDVNNEFEKLQRERGLGSEKHRKEVSDLIKECRQSLAESLFAWACQSPLGKEDTLLLIGHLERVTVEANGSLDAVNLALLMALLYCFDISFIEQSTEERDDMIHQLPLLTEKQYIATIHSRLQDSQLWKLPGLQATVRLAWALALRGISQLPDVTALAEFTEADEAMAELAIADNVFLFLMESVVVSEYFYQEEFYIRRVHNLITDFLALMPMKVKQLRNRADEDARMIHMSMQMGNEPPISLRRDLEHLMLLIGELYKKNPFHLELALEYWCPTEPLQTPTIMGSYLGVAHQRPPQRQVVLSKFVRQMGDLLPPTIYIPYLKMLQGLANGPQCAHYCFSLLKVNGSSHVENIQGAGGSPVSWEHFFHSLMLYHEHLRKDLPSADSVQYRHLPSRGITQKEQDGLIAFLQLTSTIITWSENARLALCEHPQWTPVVVILGLLQCSIPPVLKAELLKTLAAFGKSPEIAASLWQSLEYTQILQTVRIPSQRQAIGIEVELNEIESRCEEYPLTRAFCQLISTLVESSFPSNLGAGLRPPGFDPYLQFLRDSVFLRFRTRAYRRAAEKWEVAEVVLEVFYKLLRDYEPQLEDFVDQFVELQGEEIIAYKPPGFSLMYHLLNESPMLELALSLLEEGVKQLDTYAPFPGKKHLEKAVQHCLALLNLTLQKENLFMDLLRESQLALIVCPLEQLLQGINPRTKKADNVVNIARYLYHGNTNPELAFESAKILCCISCNSNIQIKLVGDFTHDQSISQKLMAGFVECLDCEDAEEFVRLEEGSELEKKLVAIRHETRIHILNLLITSLECNPPNLALYLLGFELKKPVSTTNLQDPGVLGCPRTCLHAILNILEKGTEGRTGPVAVRESPQLAELCYQVIYQLCACSDTSGPTMRYLRTSQDFLFSQLQYLPFSNKEYEISMLNQMSWLMKTASIELRVTSLNRQRSHTQRLLHLLLDDMPVKPYSDGEGGIEDENRSVSGFLHFDTATKVRRKILNILDSIDFSQEIPEPLQLDFFDRAQIEQVIANCEHKNLRGQTVCNVKLLHRVLVAEVNALQGMAAIGQRPLLMEEISTVLQYVVGRNKLLQCLHAKRHALESWRQLVEIILTACPQDLIQAEDRQLIIRDILQDVHDKILDDEAAQELMPVVAGAVFTLTAHLSQAVLTEQKQTSVLGPAEAHYAFMLDSCFTSPPPEENPLVGFASIGDSSLYIILKKLLDFILKTGGGFQRVRTHLYGSLLYYLQIAQRPDEPDTLEAAKKTMWERLTAPEDVFSKLQRENIAIIESYGAALMEVVCRDACDGHEIGRMLALALLDRIVSVDKQQQWLLYLSNSGYLKVLVDSLVEDDRTLQSLLTPQPPLLKALYTYESKMAFLTRVAKIQQGALELLRSGVIVRLAQCQVYDMRPETDPQSMFGMRDPPMFIPTPVDRYRQILLPALQLCQVILTSSMAQHLQAAGQVLQFLISHSDTIQAILRCQDVSAGSLQELALLTGIISKAALPGILSELDVDVNEGSLMELQGHIGRFQRQCLGLLSRFGGSDRLRQFKFQDDNVEGDKVSKKDEIELAMQQICANVMEYCQSLMLQSSPTFQHAVCLFTPSLSETVNRDGPRQDTQAPVVPYWRLPGLGIIIYLLKQSANDFFSYYDSHRQSVSKLQNVEQLPPDEIKELCQSVMPAGVDKISTAQKYVLARRRLVKVINNRAKLLSLCSFIIETCLFILWRHLEYYLLHCMPTDSQDSLFASRTLFKSRRLQDSFASETNLDFRSGLAIVSQHDLDQLQADAINAFGESLQKKLLDIEGLYSKVRSRYSFIQALVRRIRGLYELEATDKYKDCLVGLRFHHSQTVKTFSQNRPAAARTFQQIRCYSAPVAAEPFLSGTSSNYVEEMYCAWLENPKSVHKSWDIFFRNTNAGAPPGTAYQSPLPLSRGSLAAVAHAQSLVEAQPNVDKLVEDHLAVQSLIRAYQIRGHHVAQLDPLGILDADLDSSVPADIISSTDKLGFYGLDESDLDKVFHLPTTTFIGGQESALPLREIIRRLEMAYCQHIGVEFMFINDLEQCQWIRQKFETPGIMQFTNEEKRTLLARLVRSTRYGSGPGPWGRHSQGSSDPVCVDRACVQPVGRGERGFGVVQAKLHLHMCEETPDK

SEQ ID NO: 910831 - protein, 2077 aa, Homo sapiens
MATPLAVNSAASLWGPYKDIWHKVGNALWRRQPEAVHLLDKILKKHKPDFISLFKNPPKNVQQHEKVQKASTEGVAIQGQQGTRLLPEQLIKEAFILSDLFDIGELAAVELLLAGEHQQPHFPGLTRGLVAVLLYWDGKRCIANSLKALIQSRRGKTWTLELSPELASMTTRFTDELMEQGLTYKVLTLVSQIDVNNEFEKLQRERGLGSEKHRKEVSDLIKECRQSLAESLFAWACQSPLGKEDTLLLIGHLERVTVEANGSLDAVNLALLMALLYCFDISFIEQSTEERDDMIHQLPLLTEKQYIATIHSRLQDSQLWKLPGLQATVRLAWALALRGISQLPDVTALAEFTEADEAMAELAIADNVFLFLMESVVVSEYFYQEEFYIRRVHNLITDFLALMPMKVKQLRNRADEDARMIHMSMQMGNEPPISLRRDLEHLMLLIGELYKKNPFHLELALEYWCPTEPLQTPTIMGSYLGVAHQRPPQRQVVLSKFVRQMGDLLPPTIYIPYLKMLQGLANGPQCAHYCFSLLKVNGSSHVENIQGAGGSPVSWEHFFHSLMLYHEHLRKDLPSADSVQYRHLPSRGITQKEQDGLIAFLQLTSTIITWSENARLALCEHPQWTPVVVILGLLQCSIPPVLKAELLKTLAAFGKSPEIAASLWQSLEYTQILQTVRIPSQRQAIGIEVELNEIESRCEEYPLTRAFCQLISTLVESSFPSNLGAGLRPPGFDPYLQFLRDSVFLRFRTRAYRRAAEKWEVAEVVLEVFYKLLRDYEPQLEDFVDQFVELQGEEIIAYKPPGFSLMYHLLNESPMLELALSLLEEGVKQLDTYAPFPGKKHLEKAVQHCLALLNLTLQKENLFMDLLRESQLALIVCPLEQLLQGINPRTKKADNVVNIARYLYHGNTNPELAFESAKILCCISCNSNIQIKLVGDFTHDQSISQKLMAGFVECLDCEDAEEFVRLEEGSELEKKLVAIRHETRIHILNLLITSLECNPPNLALYLLGFELKKPVSTTNLQDPGVLGCPRTCLHAILNILEKGTEGRTGPVAVRESPQLAELCYQVIYQLCACSDTSGPTMRYLRTSQDFLFSQLQYLPFSNKEYEISMLNQMSWLMKTASIELRVTSLNRQRSHTQRLLHLLLDDMPVKPYSDGEGGIEDENRSVSGFLHFDTATKVRRKILNILDSIDFSQEIPEPLQLDFFDRAQIEQVIANCEHKNLRGQTVCNVKLLHRVLVAEVNALQGMAAIGQRPLLMEEISTVLQYVVGRNKLLQCLHAKRHALESWRQLVEIILTACPQDLIQAEDRQLIIRDILQDVHDKILDDEAAQELMPVVAGAVFTLTAHLSQAVLTEQKQTSVLGPAEAHYAFMLDSCFTSPPPEENPLVGFASIGDSSLYIILKKLLDFILKTGGGFQRVRTHLYGSLLYYLQIAQRPDEPDTLEAAKKTMWERLTAPEDVFSKLQRENIAIIESYGAALMEVVCRDACDGHEIGRMLALALLDRIVSVDKQQQWLLYLSNSGYLKVLVDSLVEDDRTLQSLLTPQPPLLKALYTYESKMAFLTRVAKIQQGALELLRSGVIVRLAQCQVYDMRPETDPQSMFGMRDPPMFIPTPVDRYRQILLPALQLCQVILTSSMAQHLQAAGQVLQFLISHSDTIQAILRCQDVSAGSLQELALLTGIISKAALPGILSELDVDVNEGSLMELQGHIGRFQRQCLGLLSRFGGSDRLRQFKFQDDNVEGDKVSKKDEIELAMQQICANVMEYCQSLMLQSSPTFQHAVCLFTPSLSETVNRDGPRQDTQAPVVPYWRLPGLGIIIYLLKQSANDFFSYYDSHRQSVSKLQNVEQLPPDEIKELCQSVMPAGVDKISTAQKYVLARRRLVKVINNRAKLLSLCSFIIETCLFILWRHLEYYLLHCMPTDSQDSLFASRTLFKSRRLQDSFASETNLDFRSGLAIVSQHDLDQLQADAINAFGESLQKKLLDIEGLYSKVRSRYSFIQALVRRIRGLYDLEATEDHFVRLANALPLFFYQMQIRLLVFQELFVIEQQVPFAVQDVLDAGLGDDGIVTLEPLVYVLPDK

SEQ ID NO: 910832 - protein, 1896 aa, Homo sapiens
MATPLAVNSAASLWGPYKDIWHKVGNALWRRQPEAVHLLDKILKKHKPDFISLFKNPPKNVQQHEKVQKASTEGVAIQGQQGTRLLPEQLIKEAFILSDLFDIGELAAVELLLAGEHQQPHFPGLTRGLVAVLLYWDGKRCIANSLKALIQSRRGKTWTLELSPELASMTTRFTDELMEQGLTYKVLTLVSQIDVNNEFEKLQRERGLGSEKHRKEVSDLIKECRQSLAESLFAWACQSPLGKEDTLLLIGHLERVTVEANGSLDAVNLALLMALLYCFDISFIEQSTEERDDMIHQLPLLTEKQYIATIHSRLQDSQLWKLPGLQATVRLAWALALRGISQLPDVTALAEFTEADEAMAELAIADNVFLFLMESVVVSEYFYQEEFYIRRVHNLITDFLALMPMKVKQLRNRADEDARMIHMSMQMGNEPPISLRRDLEHLMLLIGELYKKNPFHLELALEYWCPTEPLQTPTIMGSYLGVAHQRPPQRQVVLSKFVRQMGDLLPPTIYIPYLKMLQGLANGPQCAHYCFSLLKVNGSSHVENIQGAGGSPVSWEHFFHSLMLYHEHLRKDLPSADSVQYRHLPSRGITQKEQDGLIAFLQLTSTIITWSENARLALCEHPQWTPVVVILGLLQCSIPPVLKAELLKTLAAFGKSPEIAASLWQSLEYTQILQTVRIPSQRQAIGIEVELNEIESRCEEYPLTRAFCQLISTLVESSFPSNLGAGLRPPGFDPYLQFLRDSVFLRFRTRAYRRAAEKWEVAEVVLEVFYKLLRDYEPQLEDFVDQFVELQGEEIIAYKPPGFSLMYHLLNESPMLELALSLLEEGVKQLDTYAPFPGKKHLEKAVQHCLALLNLTLQKENLFMDLLRESQLALIVCPLEQLLQGINPRTKKADNVVNIARYLYHGNTNPELAFESAKILCCISCNSNIQIKLVGDFTHDQSISQKLMAGFVECLDCEDAEEFVRLEEGSELEKKLVAIRHETRIHILNLLITSLECNPPNLALYLLGFELKKPVSTTNLQDPGVLGCPRTCLHAILNILEKGTEGRTGPVAVRESPQLAELCYQVIYQLCACSDTSGPTMRYLRTSQDFLFSQLQYLPFSNKEYEISMLNQMSWLMKTASIELRVTSLNRQRSHTQRLLHLLLDDMPVKPYSDGEGGIEDENRSVSGFLHFDTATKVRRKILNILDSIDFSQEIPEPLQLDFFDRAQIEQVIANCEHKNLRGQTVCNVKLLHRVLVAEVNALQGMAAIGQRPLLMEEISTVLQYVVGRNKLLQCLHAKRHALESWRQLVEIILTACPQDLIQAEDRQLIIRDILQDVHDKILDDEAAQELMPVVAGAVFTLTAHLSQAVLTEQKQTSVLGPAEAHYAFMLDSCFTSPPPEENPLVGFASIGDSSLYIILKKLLDFILKTGGGFQRVRTHLYGSLLYYLQIAQRPDEPDTLEAAKKTMWERLTAPEDVFSKLQRENIAIIESYGAALMEVVCRDACDGHEIGRMLALALLDRIVSVDKQQQWLLYLSNSGYLKVLVDSLVEDDRTLQSLLTPQPPLLKALYTYESKMAFLTRVAKIQQGALELLRSGVIVRLAQCQVYDMRPETDPQSMFGMRDPPMFIPTPVDRYRQILLPALQLCQVILTSSMAQHLQAAGQVLQFLISHSDTIQAILRCQDVSAGSLQELALLTGIISKAALPGILSELDVDVNEGSLMELQGHIGRFQRQCLGLLSRFGGSDRLRQFKFQDDNVEGDKVSKKDEIELAMQQICANVMEYCQSLMLQSSPTFQHAVCLFTPSLSETVNRDGPRQDTQAPVVPYWRLPGLGIIIYLLKQSANDFFSYYDSHRQSVSKLQNVEQLPPDEIKELCQSVMPAGVDKISTAQKYVLARRRLVKVINNRAKLLSLCSWG

SEQ ID NO: 910833 - protein, 1915 aa, Homo sapiens
MATPLAVNSAASLWGPYKDIWHKVGNALWRRQPEAVHLLDKILKKHKPDFISLFKNPPKNVQQHEKVQKASTEGVAIQGQQGTRLLPEQLIKEAFILSDLFDIGELAAVELLLAGEHQQPHFPGLTRGLVAVLLYWDGKRCIANSLKALIQSRRGKTWTLELSPELASMTTRFTDELMEQGLTYKVLTLVSQIDVNNEFEKLQRERGLGSEKHRKEVSDLIKECRQSLAESLFAWACQSPLGKEDTLLLIGHLERVTVEANGSLDAVNLALLMALLYCFDISFIEQSTEERDDMIHQLPLLTEKQYIATIHSRLQDSQLWKLPGLQATVRLAWALALRGISQLPDVTALAEFTEADEAMAELAIADNVFLFLMESVVVSEYFYQEEFYIRRVHNLITDFLALMPMKVKQLRNRADEDARMIHMSMQMGNEPPISLRRDLEHLMLLIGELYKKNPFHLELALEYWCPTEPLQTPTIMGSYLGVAHQRPPQRQVVLSKFVRQMGDLLPPTIYIPYLKMLQGLANGPQCAHYCFSLLKVNGSSHVENIQGAGGSPVSWEHFFHSLMLYHEHLRKDLPSADSVQYRHLPSRGITQKEQDGLIAFLQLTSTIITWSENARLALCEHPQWTPVVVILGLLQCSIPPVLKAELLKTLAAFGKSPEIAASLWQSLEYTQILQTVRIPSQRQAIGIEVELNEIESRCEEYPLTRAFCQLISTLVESSFPSNLGAGLRPPGFDPYLQFLRDSVFLRFRTRAYRRAAEKWEVAEVVLEVFYKLLRDYEPQLEDFVDQFVELQGEEIIAYKPPGFSLMYHLLNESPMLELALSLLEEGVKQLDTYAPFPGKKHLEKAVQHCLALLNLTLQKENLFMDLLRESQLALIVCPLEQLLQGINPRTKKADNVVNIARYLYHGNTNPELAFESAKILCCISCNSNIQIKLVGDFTHDQSISQKLMAGFVECLDCEDAEEFVRLEEGSELEKKLVAIRHETRIHILNLLITSLECNPPNLALYLLGFELKKPVSTTNLQDPGVLGCPRTCLHAILNILEKGTEGRTGPVAVRESPQLAELCYQVIYQLCACSDTSGPTMRYLRTSQDFLFSQLQYLPFSNKEYEISMLNQMSWLMKTASIELRVTSLNRQRSHTQRLLHLLLDDMPVKPYSDGEGGIEDENRSVSGFLHFDTATKVRRKILNILDSIDFSQEIPEPLQLDFFDRAQIEQVIANCEHKNLRGQTVCNVKLLHRVLVAEVNALQGMAAIGQRPLLMEEISTVLQYVVGRNKLLQCLHAKRHALESWRQLVEIILTACPQDLIQAEDRQLIIRDILQDVHDKILDDEAAQELMPVVAGAVFTLTAHLSQAVLTEQKQTSVLGPAEAHYAFMLDSCFTSPPPEENPLVGFASIGDSSLYIILKKLLDFILKTGGGFQRVRTHLYGSLLYYLQIAQRPDEPDTLEAAKKTMWERLTAPEDVFSKLQRENIAIIESYGAALMEVVCRDACDGHEIGRMLALALLDRIVSVDKQQQWLLYLSNSGYLKVLVDSLVEDDRTLQSLLTPQPPLLKALYTYESKMAFLTRVAKIQQGALELLRSGVIVRLAQCQVYDMRPETDPQSMFGMRDPPMFIPTPVDRYRQILLPALQLCQVILTSSMAQHLQAAGQVLQFLISHSDTIQAILRCQDVSAGSLQELALLTGIISKAALPGILSELDVDVNEGSLMELQGHIGRFQRQCLGLLSRFGGSDRLRQFKFQDDNVEGDKVSKKDEIELAMQQICANVMEYCQSLMLQSSPTFQHAVCLFTPSLSETVNRDGPRQDTQAPVVPYWRLPGLGIIIYLLKQSANDFFSYYDSHRQSVSKLQNVEQLPPDEIKELCQSVMPAGVDKISTAQKYVLARRRLVKVINNRAKLLSLCSYRDLPIILWRHQRELQGSSKR

SEQ ID NO: 910834 - protein, 94 aa, Homo sapiens
MYKQIRKQKPVLQKYAELLVSQGVVNQPEYEVRPCGSIPVPFPGLAMTRKGGPQGQFSLLPVMRIHVRGCEIFTTTAFQCITFWRIWATEMLYK

SEQ ID NO: 910835 - protein, 375 aa, Homo sapiens
MDELQDVQLTEIKPLLNDKNGTRNFQDFDCQEHDIETTHGVVHVTIRGLPKGNRPVILTYHDIGLNHKSCFNAFFNFEDMQEITQHFAVCHVDAPGQQEGAPSFPTGYQYPTMDELAEMLPPVLTHLSLKSIIGIGVGAGAYILSRFALNHPELVEGLVLINVDPCAKGWIDWAASKLSGLTTNVVDIILAHHFGQEELQANLDLIQTYRMHIAQDINQDNLQLFLNSYNGRRDLEIERPILGQNDNKSKTLKCSTLLVVGDNSPAVEAVVECNSRLNPINTTLLKMADCGGLPQVVQPGKLTEAFKYFLQGMGYIPSASMTRLARSRTHSTSSSLGSGESPFSRSVTSNQSDGTQESCESPDVLDRHQTMEVSC

SEQ ID NO: 910836 - protein, 363 aa, Homo sapiens
MDELQDVQLTEIKPLLNDKEHDIETTHGVVHVTIRGLPKGNRPVILTYHDIGLNHKSCFNAFFNFEDMQEITQHFAVCHVDAPGQQEGAPSFPTGYQYPTMDELAEMLPPVLTHLSLKSIIGIGVGAGAYILSRFALNHPELVEGLVLINVDPCAKGWIDWAASKLSGLTTNVVDIILAHHFGQEELQANLDLIQTYRMHIAQDINQDNLQLFLNSYNGRRDLEIERPILGQNDNKSKTLKCSTLLVVGDNSPAVEAVVECNSRLNPINTTLLKMADCGGLPQVVQPGKLTEAFKYFLQGMGYIPSASMTRLARSRTHSTSSSLGSGESPFSRSVTSNQSDGTQESCESPDVLDRHQTMEVSC

SEQ ID NO: 910837 - protein, 286 aa, Homo sapiens
MDELQDVQLTEIKPLLNDKNGTRNFQDFDCQEHDIETTHGVVHVTIRVGAGAYILSRFALNHPELVEGLVLINVDPCAKGWIDWAASKLSGLTTNVVDIILAHHFGQEELQANLDLIQTYRMHIAQDINQDNLQLFLNSYNGRRDLEIERPILGQNDNKSKTLKCSTLLVVGDNSPAVEAVVECNSRLNPINTTLLKMADCGGLPQVVQPGKLTEAFKYFLQGMGYIPSASMTRLARSRTHSTSSSLGSGESPFSRSVTSNQSDGTQESCESPDVLDRHQTMEVSC

SEQ ID NO: 910838 - protein, 286 aa, Homo sapiens; identical to SEQ ID NO: 910837

SEQ ID NO: 910839 - protein, 286 aa, Homo sapiens; identical to SEQ ID NO: 910837

SEQ ID NO: 910840 - protein, 363 aa, Homo sapiens; identical to SEQ ID NO: 910836

SEQ ID NO: 910841 - protein, 286 aa, Homo sapiens; identical to SEQ ID NO: 910837

SEQ ID NO: 910842 - protein, 350 aa, Homo sapiens [sequence omitted]

SEQ ID NO: 910843 - protein, 266 aa, Homo sapiens
IIPNLFHSLQACTPPALSQQAAPLTSRSPVSCPRACVAPVPVAPVPVAPLPPLTMGPGPRLLLPLVLCVGLGALVFSSGAEGFRKRGPSVTAKVFFDVRIGDKDVGRIVIGLFGKVVPKTVENFVALATGEKGYGYKGSKFHRVIKDFMIQGGDITTGDGTGGVSIYGETFPDENFKLKHYGIGWVSMANAGPDTNGSQFFITLTKPTWLDGKHVVFGKVIDGMTVVHSIELQATDGHDRPLTNCSIINSGKIDVKTPFVVEIADW

SEQ ID NO: 910844 - protein, 266 aa, Homo sapiens; identical to SEQ ID NO: 910843

SEQ ID NO: 910845 - protein, 266 aa, Homo sapiens; identical to SEQ ID NO: 910843

SEQ ID NO: 910846 - protein, 74 aa, Homo sapiens
MAWWECPCCICMKPLLFRPHSHQNPACPPATPPQQCHSHLPQRSYSAKPSQGLFLWTRASLVIICCRVSSFTVC

SEQ ID NO: 910847 - protein, 475 aa, Homo sapiens [sequence omitted]

SEQ ID NO: 910848 - protein, 475 aa, Homo sapiens [sequence omitted]

SEQ ID NO: 910849 - protein, 104 aa, Homo sapiens
MASAARLTMMWEEVTCPICLDPFVEPVSIECGHSFCQECISQVGKGGGSVCPVCRQRFLLKNLRPNRQLANMVNNLKEISQEAREGTQGERCAVHGERLHPNSS

SEQ ID NO: 910850 - protein, 249 aa, Homo sapiens [sequence omitted]

SEQ ID NO: 910851 - protein, 1189 aa, Homo sapiens
MKSEEQPMDLENRSTANVLEETTVKKEKEDEKELVKLPVIVKLEKPLPENEEKKIIKEESDSFKENVKPIKVEVKECRADPKDTKSSMEKPVAQEPERIEFGGNIKSSHEITEKSTEETEKLKNDQQAKIPLKKREIKLSDDFDSPVKGPLCKSVTPTKEFLKDEIKQEEETCKRISTITALGHEGKQLVNGEVSDERVAPNFKTEPIETKFYETKEESYSPSKDRNIITEGNGTESLNSVITSMKTGELEKETAPLRKDADSSISVLEIHSQKAQIEEPDPPEMETSLDSSEMAKDLSSKTALSSTESCTMKGEEKSPKTKKDKRPPILECLEKLEKSKKTFLDKDAQRLSPIPEEVPKSTLESEKPGSPEAAETSPPSNIIDHCEKLASEKEVVECQSTSTVGGQSVKKVDLETLKEDSEFTKVEMDNLDNAQTSGIEEPSETKGSMQKSKFKYKLVPEEETTASENTEITSERQKEGIKLTIRISSRKKKPDSPPKVLEPENKQEKTEKEEEKTNVGRTLRRSPRISRPTAKVAEIRDQKADKKRGEGEDEVEEESTALQKTDKKEILKKSEKDTNSKVSKVKPKGKVRWTGSRTRGRWKYSSNDESEGSGSEKSSAASEEEEEKESEEAILADDDEPCKKCGLPNHPELILLCDSCDSGYHTACLRPPLMIIPDGEWFCPPCQHKLLCEKLEEQLQDLDVALKKKERAERRKERLVYVGISIENIIPPQEPDFSEDQEEKKKDSKKSKANLLERRSTRTRKCISYRFDEFDEAIDEAIEDDIKEADGGGVGRGKDISTITGHRGKDISTILDEERKENKRPQRAAAARRKKRRRLNDLDSDSNLDEEESEDEFKISDGSQDEFVVSDENPDESEEDPPSNDDSDTDFCSRRLRRHPSRPMRQSRRLRRKTPKKKYSDDDEEEESEENSRDSESDFSDDFSDDFVETRRRRSRRNQKRQINYKEDSESDGSQKSLRRGKEIRRVHKRRLSSSESEESYLSKNSEDDELAKESKRSVRKRGRSTDEYSEADEEEEEEEGKPSRKRLHRIETDEEESCDNAHGDANQPARDSQPRVLPSEQESTKKPYRIESDEEEDFENVGKVGSPLDYSLVDLPSTNGQSPGKAIENLIGKPTEKSQTPKDNSTASASLASNGTSGGQEAGAPEEEEDELLRVTDLVDYVCNSEQL

SEQ ID NO: 910852 - protein, 945 aa, Homo sapiens
MKTGELEKETAPLRKDADSSISVLEIHSQKAQIEEPDPPEMETSLDSSEMAKDLSSKTALSSTESCTMKGEEKSPKTKKDKRPPILECLEKLEKSKKTFLDKDAQRLSPIPEEVPKSTLESEKPGSPEAAETSPPSNIIDHCEKLASEKEVVECQSTSTVGGQSVKKVDLETLKEDSEFTKVEMDNLDNAQTSGIEEPSETKGSMQKSKFKYKLVPEEETTASENTEITSERQKEGIKLTIRISSRKKKPDSPPKVLEPENKQEKTEKEEEKTNVGRTLRRSPRISRPTAKVAEIRDQKADKKRGEGEDEVEEESTALQKTDKKEILKKSEKDTNSKVSKVKPKGKVRWTGSRTRGRWKYSSNDESEGSGSEKSSAASEEEEEKESEEAILADDDEPCKKCGLPNHPELILLCDSCDSGYHTACLRPPLMIIPDGEWFCPPCQHKLLCEKLEEQLQDLDVALKKKERAERRKERLVYVGISIENIIPPQEPDFSEDQEEKKKDSKKSKANLLERRSTRTRKCISYRFDEFDEAIDEAIEDDIKEADGGGVGRGKDISTITGHRGKDISTILDEERKENKRPQRAAAARRKKRRRLNDLDSDSNLDEEESEDEFKISDGSQDEFVVSDENPDESEEDPPSNDDSDTDFCSRRLRRHPSRPMRQSRRLRRKTPKKKYSDDDEEEESEENSRDSESDFSDDFSDDFVETRRRRSRRNQKRQINYKEDSESDGSQKSLRRGKEIRRVHKRRLSSSESEESYLSKNSEDDELAKESKRSVRKRGRSTDEYSEADEEEEEEEGKPSRKRLHRIETDEEESCDNAHGDANQPARDSQPRVLPSEQESTKKPYRIESDEEEDFENVGKVGSPLDYSLVDLPSTNGQSPGKAIENLIGKPTEKSQTPKDNSTASASLASNGTSGGQEAGAPEEEEDELLRVTDLVDYVCNSEQL

SEQ ID NO: 910853 - protein, 1209 aa, Homo sapiens
MIKMALHGNALSEEQKESEKMKSEEQPMDLENRSTANVLEETTVKKEKEDEKELVKLPVIVKLEKPLPENEEKKIIKEESDSFKENVKPIKVEVKECRADPKDTKSSMEKPVAQEPERIEFGGNIKSSHEITEKSTEETEKLKNDQQAKIPLKKREIKLSDDFDSPVKGPLCKSVTPTKEFLKDEIKQEEETCKRISTITALGHEGKQLVNGEVSDERVAPNFKTEPIETKFYETKEESYSPSKDRNIITEGNGTESLNSVITSMKTGELEKETAPLRKDADSSISVLEIHSQKAQIEEPDPPEMETSLDSSEMAKDLSSKTALSSTESCTMKGEEKSPKTKKDKRPPILECLEKLEKSKKTFLDKDAQRLSPIPEEVPKSTLESEKPGSPEAAETSPPSNIIDHCEKLASEKEVVECQSTSTVGGQSVKKVDLETLKEDSEFTKVEMDNLDNAQTSGIEEPSETKGSMQKSKFKYKLVPEEETTASENTEITSERQKEGIKLTIRISSRKKKPDSPPKVLEPENKQEKTEKEEEKTNVGRTLRRSPRISRPTAKVAEIRDQKADKKRGEGEDEVEEESTALQKTDKKEILKKSEKDTNSKVSKVKPKGKVRWTGSRTRGRWKYSSNDESEGSGSEKSSAASEEEEEKESEEAILADDDEPCKKCGLPNHPELILLCDSCDSGYHTACLRPPLMIIPDGEWFCPPCQHKLLCEKLEEQLQDLDVALKKKERAERRKERLVYVGISIENIIPPQEPDFSEDQEEKKKDSKKSKANLLERRSTRTRKCISYRFDEFDEAIDEAIEDDIKEADGGGVGRGKDISTITGHRGKDISTILDEERKENKRPQRAAAARRKKRRRLNDLDSDSNLDEEESEDEFKISDGSQDEFVVSDENPDESEEDPPSNDDSDTDFCSRRLRRHPSRPMRQSRRLRRKTPKKKYSDDDEEEESEENSRDSESDFSDDFSDDFVETRRRRSRRNQKRQINYKEDSESDGSQKSLRRGKEIRRVHKRRLSSSESEESYLSKNSEDDELAKESKRSVRKRGRSTDEYSEADEEEEEEEGKPSRKRLHRIETDEEESCDNAHGDANQPARDSQPRVLPSEQESTKKPYRIESDEEEDFENVGKVGSPLDYSLVDLPSTNGQSPGKAIENLIGKPTEKSQTPKDNSTASASLASNGTSGGQEAGAPEEEEDELLRVTDLVDYVCNSEQL

SEQ ID NO: 910854 - protein, 548 aa, Homo sapiens
MQKCGLPNHPELILLCDSCDSGYHTACLRPPLMIIPDGEWFCPPCQHKLLCEKLEEQLQDLDVALKKKERAERRKERLVYVGISIENIIPPQEPDFSEDQEEKKKDSKKSKANLLERRSTRTRKCISYRFDEFDEAIDEAIEDDIKEADGGGVGRGKDISTITGHRGKDISTILDEERKENKRPQRAAAARRKKRRRLNDLDSDSNLDEEESEDEFKISDGSQDEFVVSDENPDESEEDPPSNDDSDTDFCSRRLRRHPSRPMRQSRRLRRKTPKKKYSDDDEEEESEENSRDSESDFSDDFSDDFVETRRRRSRRNQKRQINYKEDSESDGSQKSLRRGKEIRRVHKRRLSSSESEESYLSKNSEDDELAKESKRSVRKRGRSTDEYSEADEEEEEEEGKPSRKRLHRIETDEEESCDNAHGDANQPARDSQPRVLPSEQESTKKPYRIESDEEEDFENVGKVGSPLDYSLVDLPSTNGQSPGKAIENLIGKPTEKSQTPKDNSTASASLASNGTSGGQEAGAPEEEEDELLRVTDLVDYVCNSEQL

SEQ ID NO: 910855 - protein, 1058 aa, Homo sapiens
IRRGAHLRAPPVVCKVALPSLGTPTSPAPPSPPRSILQFKMATAAAAAAVMAPPGCPGSCPNFAVVCSFLERYGPLLDLPELPFPELERVLQAPPPDVGNGEVPKELVELHLKLMRKIGKSVTADRWEKYLIKICQEFNSTWAWEMEKKGYLEMSVECKLALLKYLCECQFDDNLKFKNIINEEDADTMRLQPIGRDKDGLMYWYQLDQDHNVRMYIEEQDDQDGSSWKCIVRNRNELAETLALLKAQIDPVLLKNSSQQDNSSRESPSLEDEETKKEEETPKQEEQKESEKMKSEEQPMDLENRSTANVLEETTVKKEKEDEKELVKLPVIVKLEKPLPENEEKKIIKEESDSFKENVKPIKVEVKECRADPKDTKSSMEKPVAQEPERIEFGGNIKSSHEITEKSTEETEKLKNDQQAKIPLKKREIKLSDDFDSPVKGPLCKSVTPTKEFLKDEIKQEEETCKRISTITALGHEGKQLVNGEVSDERVAPNFKTEPIETKFYETKEESYSPSKDRNIITEGNGTESLNSVITSMKTGELEKETAPLRKDADSSISVLEIHSQKAQIEEPDPPEMETSLDSSEMAKDLSSKTALSSTESCTMKGEEKSPKTKKDKRPPILECLEKLEKSKKTFLDKDAQRLSPIPEEVPKSTLESEKPGSPEAAETSPPSNIIDHCEKLASEKEVVECQSTSTVGGQSVKKVDLETLKEDSEFTKVEMDNLDNAQTSGIEEPSETKGSMQKSKFKYKLVPEEETTASENTEITSERQKEGIKLTIRISSRKKKPDSPPKVLEPENKQEKTEKEEEKTNVGRTLRRSPRISRPTAKVAEIRDQKADKKRGEGEDEVEEESTALQKTDKKEILKKSEKDTNSKVSKVKPKGKVRWTGSRTRGRWKYSSNDESEGSGSEKSSAASEEEEEKESEEAILADDDEPCKKCGLPNHPELILLCDSCDSGYHTACLRPPLMIIPDGEWFCPPCQHKLLCEKLEEQLQDLDVALKKKERAERRYFYMCVNVLFGNMRAELSHCMDKWIHLKQGLAYCGLWAKSSLLFVFVLPAN

SEQ ID NO: 910856 - protein, 328 aa, Homo sapiens
IRRGAHLRAPPVVCKVALPSLGTPTSPAPPSPPRSILQFKMATAAAAAAVMAPPGCPGSCPNFAVVCSFLERYGPLLDLPELPFPELERVLQAPPPDVGNGEVPKELVELHLKLMRKIGKSVTADRWEKYLIKICQEFNSTWAWEMEKKGYLEMSVECKLALLKYLCECQFDDNLKFKNIINEEDADTMRLQPIGRDKDGLMYWYQLDQDHNVRMYIEEQDDQDGSSWKCIVSSKQWLQNFLAHEKIWFDKFKYDDARKEILRADERACGKVASRQENGASVILRDIGKSQKRTSRNPGWKLRPRGSGGTSGRPRVSSASGWQAGSGE

SEQ ID NO: 910857 - protein, 1481 aa, Homo sapiens
IRRGAHLRAPPVVCKVALPSLGTPTSPAPPSPPRSILQFKMATAAAAAAVMAPPGCPGSCPNFAVVCSFLERYGPLLDLPELPFPELERVLQAPPPDVGNGEVPKELVELHLKLMRKIGKSVTADRWEKYLIKICQEFNSTWAWEMEKKGYLEMSVECKLALLKYLCECQFDDNLKFKNIINEEDADTMRLQPIGRDKDGLMYWYQLDQDHNVRMYIEEQDDQDGSSWKCIVRNRNELAETLALLKAQIDPVLLKNSSQQDNSSRESPSLEDEETKKEEETPKQEEQKESEKMKSEEQPMDLENRSTANVLEETTVKKEKEDEKELVKLPVIVKLEKPLPENEEKKIIKEESDSFKENVKPIKVEVKECRADPKDTKSSMEKPVAQEPERIEFGGNIKSSHEITEKSTEETEKLKNDQQAKIPLKKREIKLSDDFDSPVKGPLCKSVTPTKEFLKDEIKQEEETCKRISTITALGHEGKQLVNGEVSDERVAPNFKTEPIETKFYETKEESYSPSKDRNIITEGNGTESLNSVITSMKTGELEKETAPLRKDADSSISVLEIHSQKAQIEEPDPPEMETSLDSSEMAKDLSSKTALSSTESCTMKGEEKSPKTKKDKRPPILECLEKLEKSKKTFLDKDAQRLSPIPEEVPKSTLESEKPGSPEAAETSPPSNIIDHCEKLASEKEVVECQSTSTVGGQSVKKVDLETLKEDSEFTKVEMDNLDNAQTSGIEEPSETKGSMQKSKFKYKLVPEEETTASENTEITSERQKEGIKLTIRISSRKKKPDSPPKVLEPENKQEKTEKEEEKTNVGRTLRRSPRISRPTAKVAEIRDQKADKKRGEGEDEVEEESTALQKTDKKEILKKSEKDTNSKVSKVKPKGKVRWTGSRTRGRWKYSSNDESEGSGSEKSSAASEEEEEKESEEAILADDDEPCKKCGLPNHPELILLCDSCDSGYHTACLRPPLMIIPDGEWFCPPCQHKLLCEKLEEQLQDLDVALKKKERAERRKERLVYVGISIENIIPPQEPDFSEDQEEKKKDSKKSKANLLERRSTRTRKCISYRFDEFDEAIDEAIEDDIKEADGGGVGRGKDISTITGHRGKDISTILDEERKENKRPQRAAAARRKKRRRLNDLDSDSNLDEEESEDEFKISDGSQDEFVVSDENPDESEEDPPSNDDSDTDFCSRRLRRHPSRPMRQSRRLRRKTPKKKYSDDDEEEESEENSRDSESDFSDDFSDDFVETRRRRSRRNQKRQINYKEDSESDGSQKSLRRGKEIRRVHKRRLSSSESEESYLSKNSEDDELAKESKRSVRKRGRSTDEYSEADEEEEEEEGKPSRKRLHRIETDEEESCDNAHGDANQPARDSQPRVLPSEQESTKKPYRIESDEEEDFENVGKVGSPLDYSLVDLPSTNGQSPGKAIENLIGKPTEKSQTPKDNSTASASLASNGTSGGQEAGAPEEEEDELLRVTDLVDYVCNSEQL

SEQ ID NO: 910858 - protein, 1450 aa, Homo sapiens
IRRGAHLRAPPVVCKVALPSLGTPTSPAPPSPPRSILQFKMATAAAAAAVMAPPGCPGSCPNFAVVCSFLERYGPLLDLPELPFPELERVLQAPPPDVGNGEVPKELVELHLKLMRKIGKSVTADRWEKYLIKYLCECQFDDNLKFKNIINEEDADTMRLQPIGRDKDGLMYWYQLDQDHNVRMYIEEQDDQDGSSWKCIVRNRNELAETLALLKAQIDPVLLKNSSQQDNSSRESPSLEDEETKKEEETPKQEEQKESEKMKSEEQPMDLENRSTANVLEETTVKKEKEDEKELVKLPVIVKLEKPLPENEEKKIIKEESDSFKENVKPIKVEVKECRADPKDTKSSMEKPVAQEPERIEFGGNIKSSHEITEKSTEETEKLKNDQQAKIPLKKREIKLSDDFDSPVKGPLCKSVTPTKEFLKDEIKQEEETCKRISTITALGHEGKQLVNGEVSDERVAPNFKTEPIETKFYETKEESYSPSKDRNIITEGNGTESLNSVITSMKTGELEKETAPLRKDADSSISVLEIHSQKAQIEEPDPPEMETSLDSSEMAKDLSSKTALSSTESCTMKGEEKSPKTKKDKRPPILECLEKLEKSKKTFLDKDAQRLSPIPEEVPKSTLESEKPGSPEAAETSPPSNIIDHCEKLASEKEVVECQSTSTVGGQSVKKVDLETLKEDSEFTKVEMDNLDNAQTSGIEEPSETKGSMQKSKFKYKLVPEEETTASENTEITSERQKEGIKLTIRISSRKKKPDSPPKVLEPENKQEKTEKEEEKTNVGRTLRRSPRISRPTAKVAEIRDQKADKKRGEGEDEVEEESTALQKTDKKEILKKSEKDTNSKVSKVKPKGKVRWTGSRTRGRWKYSSNDESEGSGSEKSSAASEEEEEKESEEAILADDDEPCKKCGLPNHPELILLCDSCDSGYHTACLRPPLMIIPDGEWFCPPCQHKLLCEKLEEQLQDLDVALKKKERAERRKERLVYVGISIENIIPPQEPDFSEDQEEKKKDSKKSKANLLERRSTRTRKCISYRFDEFDEAIDEAIEDDIKEADGGGVGRGKDISTITGHRGKDISTILDEERKENKRPQRAAAARRKKRRRLNDLDSDSNLDEEESEDEFKISDGSQDEFVVSDENPDESEEDPPSNDDSDTDFCSRRLRRHPSRPMRQSRRLRRKTPKKKYSDDDEEEESEENSRDSESDFSDDFSDDFVETRRRRSRRNQKRQINYKEDSESDGSQKSLRRGKEIRRVHKRRLSSSESEESYLSKNSEDDELAKESKRSVRKRGRSTDEYSEADEEEEEEEGKPSRKRLHRIETDEEESCDNAHGDANQPARDSQPRVLPSEQESTKKPYRIESDEEEDFENVGKVGSPLDYSLVDLPSTNGQSPGKAIENLIGKPTEKSQTPKDNSTASASLASNGTSGGQEAGAPEEEEDELLRVTDLVDYVCNSEQL

SEQ ID NO: 910859 - protein, 417 aa, Homo sapiens
KGKLLINTYFSLPELPPPNSGVGRGKDISTITGHRGKDISTILDEERKENKRPQRAAAARRKKRRRLNDLDSDSNLDEEESEDEFKISDGSQDEFVVSDENPDESEEDPPSNDDSDTDFCSRRLRRHPSRPMRQSRRLRRKTPKKKYSDDDEEEESEENSRDSESDFSDDFSDDFVETRRRRSRRNQKRQINYKEDSESDGSQKSLRRGKEIRRVHKRRLSSSESEESYLSKNSEDDELAKESKRSVRKRGRSTDEYSEADEEEEEEEGKPSRKRLHRIETDEEESCDNAHGDANQPARDSQPRVLPSEQESTKKPYRIESDEEEDFENVGKVGSPLDYSLVDLPSTNGQSPGKAIENLIGKPTEKSQTPKDNSTASASLASNGTSGGQEAGAPEEEEDELLRVTDLVDYVCNSEQL

SEQ ID NO: 910860 - protein, 994 aa, Homo sapiens
IRRGAHLRAPPVVCKVALPSLGTPTSPAPPSPPRSILQFKMATAAAAAAVMAPPGCPGSCPNFAVVCSFLERYGPLLDLPELPFPELERVLQAPPPDVGNGEVPKELVELHLKLMRKIGKSVTADRWEKYLIKICQEFNSTWAWEMEKKGYLEMSVECKLALLKYLCECQFDDNLKFKNIINEEDADTMRLQPIGRDKDGLMYWYQLDQDHNVRMYIEEQDDQDGSSWKCIVRNRNELAETLALLKAQIDPVLLKNSSQQDNSSRESPSLEDEETKKEEETPKQEEQKESEKMKSEEQPMDLENRSTANVLEETTVKKEKEDEKELVKLPVIVKLEKPLPENEEKKIIKEESDSFKENVKPIKVEVKECRADPKDTKSSMEKPVAQEPERIEFGGNIKSSHEITEKSTEETEKLKNDQQAKIPLKKREIKLSDDFDSPVKGPLCKSVTPTKEFLKDEIKQEEETCKRISTITALGHEGKQLVNGEVSDERVAPNFKTEPIETKFYETKEESYSPSKDRNIITEGNGTESLNSVITSMKTGELEKETAPLRKDADSSISVLEIHSQKAQIEEPDPPEMETSLDSSEMAKDLSSKTALSSTESCTMKGEEKSPKTKKDKRPPILECLEKLEKSKKTFLDKDAQRLSPIPEEVPKSTLESEKPGSPEAAETSPPSNIIDHCEKLASEKEVVECQSTSTVGGQSVKKVDLETLKEDSEFTKVEMDNLDNAQTSGIEEPSETKGSMQKSKFKYKLVPEEETTASENTEITSERQKEGIKLTIRISSRKKKPDSPPKVLEPENKQEKTEKEEEKTNVGRTLRRSPRISRPTAKVAEIRDQKADKKRGEGEDEVEEESTALQKTDKKEILKKSEKDTNSKVSKVKPKGKVRWTGSRTRGRWKYSSNDESEGSGSEKSSAASEEEEEKESEEAILADDDEPCKKCGLPNHPELSTKCCIMDFHLILIATLGEEQKESEKMKSEEQPMDLENRSTANVLEETT

SEQ ID NO: 910861 - protein, 881 aa, Homo sapiens
SGVVQEDACAAHTADLPWALLAVALRVSGTLAQLTFSFPLQGPAGERGEQGAPGPSGFQGLPGPPGPPGEGGKPGDQGVPGEAGAPGLVGPRGERGFPGERGSPGAQGLQGPRGLPGTPGTDGPKGASGPAGPPGAQGPPGLQGMPGERGAAGIAGPKGDRGDVGEKGPEGAPGKDGGRGLTGPIGPPGPAGANGEKGEVGPPGPAGSAGARGAPGERGETGPPGPAGFAGPPGADGQPGAKGEQGEAGQKGDAGAPGPQGPSGAPGPQGPTGVTGPKGARGAQGPPGATGFPGAAGRVGPPGSNGNPGPPGPPGPSGKDGPKGARGDSGPPGRAGEPGLQGPAGPPGEKGEPGDDGPSGAEGPPGPQGLAGQRGIVGLPGQRGERGFPGLPGPSGEPGKQGAPGASGDRGPPGPVGPPGLTGPAGEPGREGSPGADGPPGRDGAAGVKGDRGETGAVGAPGAPGPPGSPGPAGPTGKQGDRGEAGAQGPMGPSGPAGARGIQGPQGPRGDKGEAGEPGERGLKGHRGFTGLQGLPGPPGPSGDQGASGPAGPSGPRGPPGPVGPSGKDGANGIPGPIGPPGPRGRSGETGPAGPPGNPGPPGPPGPPGPGIDMSAFAGLGPREKGPDPLQYMRADQAAGGLRQHDAEVDATLKSLNNQIESIRSPEGSRKNPARTCRDLKLCHPEWKSGDYWIDPNQGCTLDAMKVFCNMETGETCVYPNPANVPKKNWWSSKSKEKKHIWFGETINGGFHFSYGDDNLAPNTANVQMTFLRLLSTEGSQNITYHCKNSIAYLDEAAGNLKKALLIQGSNDVEIRAEGNSRFTYTALKDGCTKHTGKWGKTVIEYRSQKTSRLPIIDIAPMDIGGPEQEFGVDIGPVCFL

SEQ ID NO: 910862 - protein, 1303 aa, Homo sapiens
MIRLGAPQSLVLLTLLVAAVLRCQGQDVRQPGPKGQKGEPGDIKDIVGPKGPPGPQGPAGEQGPRGDRGDKGEKGAPGPRGRDGEPGTPGNPGPPGPPGPPGPPGLGGNFAAQMAGGFDEKAGGAQLGVMQGPMGPMGPRGPPGPAGAPGPQGFQGNPGEPGEPGVSGPMGPRGPPGPPGKPGDDGEAGKPGKAGERGPPGPQGARGFPGTPGLPGVKGHRGYPGLDGAKGEAGAPGVKGESGSPGENGSPGPMGPRGLPGERGRTGPAGAAGARGNDGQPGPAGPPGPVGPAGGPGFPGAPGAKGEAGPTGARGPEGAQGPRGEPGTPGSPGPAGASGNPGTDGIPGAKGSAGAPGIAGAPGFPGPRGPPGPQGATGPLGPKGQTGEPGIAGFKGEQGPKGEPGPAGPQGAPGPAGEEGKRGARGEPGGVGPIGPPGERGAPGNRGFPGQDGLAGPKGAPGERGPSGLAGPKGANGDPGRPGEPGLPGARGLTGRPGDAGPQGKVGPSGAPGEDGRPGPPGPQGARGQPGVMGFPGPKGANGEPGKAGEKGLPGAPGLRGLPGKDGETGAAGPPGPAGPAGERGEQGAPGPSGFQGLPGPPGPPGEGGKPGDQGVPGEAGAPGLVGPRGERGFPGERGSPGAQGLQGPRGLPGTPGTDGPKGASGPAGPPGAQGPPGLQGMPGERGAAGIAGPKGDRGDVGEKGPEGAPGKDGGRGLTGPIGPPGPAGANGEKGEVGPPGPAGSAGARGAPGERGETGPPGPAGFAGPPGADGQPGAKGEQGEAGQKGDAGAPGPQGPSGAPGPQGPTGVTGPKGARGAQGPPGATGFPGAAGRVGPPGSNGNPGPPGPPGPSGKDGPKGARGDSGPPGRAGEPGLQGPAGPPGEKGEPGDDGPSGAEGPPGPQGLAGQRGIVGLPGQRGERGFPGLPGPSGEPGKQGAPGASGDRGPPGPVGPPGLTGPAGEPGREGSPGADGPPGRDGAAGVKGDRGETGAVGAPGAPGPPGSPGPAGPTGKQGDRGEAGAQGPMGPSGPAGARGIQGPQGPRGDKGEAGEPGERGLKGHRGFTGLQGLPGPPGPSGDQGASGPAGPSGPRGPPGPVGPSGKDGANGIPGPIGPPGPRGRSGETGPAGPPGNPGPPGPPGPPGPGIDMSAFAGLGPREKGPDPLQYMRADQAAGGLRQHDAEVDATLKSLNNQIESIRSPEGSRKNPARTCRDLKLCHPEWKSGDYWIDPNQGCTLDAMKVFCNMETGETCVYPNPANVPKKNWWSSKSKEKKHIWFGETINGGFHFSYWDDILGPHLPR

SEQ ID NO: 910863 - protein, 1286 aa, Homo sapiens
MIRLGAPQSLVLLTLLVAAVLRCQGQDVRQPGPKGQKGEPGDIKDIVGPKGPPGPQGPAGEQGPRGDRGDKGEKGAPGPRGRDGEPGTPGNPGPPGPPGPPGPPGLGGNFAAQMAGGFDEKAGGAQLGVMQGPMGPMGPRGPPGPAGAPGPQGFQGNPGEPGEPGVSGPMGPRGPPGPPGKPGDDGEAGKPGKAGERGPPGPQGARGFPGTPGLPGVKGHRGYPGLDGAKGEAGAPGVKGESGSPGENGSPGPMGPRGLPGERGRTGPAGAAGARGNDGQPGPAGPPGPVGPAGGPGFPGAPGAKGEAGPTGARGPEGAQGPRGEPGTPGSPGPAGASGNPGTDGIPGAKGSAGAPGIAGAPGFPGPRGPPGPQGATGPLGPKGQTGEPGIAGFKGEQGPKGEPGPAGPQGAPGPAGEEGKRGARGEPGGVGPIGPPGERGAPGNRGFPGQDGLAGPKGAPGERGPSGLAGPKGANGDPGRPGEPGLPGARGLTGRPGDAGPQGKVGPSGAPGEDGRPGPPGPQGARGQPGVMGFPGPKGANGEPGKAGEKGLPGAPGLRGLPGKDGETGAAGPPGPAGPAGERGEQGAPGPSGFQGLPGPPGPPGEGGKPGDQGVPGEAGAPGLVGPRGERGFPGERGSPGAQGLQGPRGLPGTPGTDGPKGASGPAGPPGAQGPPGLQGMPGERGAAGIAGPKGDRGDVGEKGPEGAPGKDGGRGLTGPIGPPGPAGANGEKGEVGPPGPAGSAGARGAPGERGETGPPGPAGFAGPPGADGQPGAKGEQGEAGQKGDAGAPGPQGPSGAPGPQGPTGVTGPKGARGAQGPPGATGFPGAAGRVGPPGSNGNPGPPGPPGPSGKDGPKGARGDSGPPGRAGEPGLQGPAGPPGEKGEPGDDGPSGAEGPPGPQGLAGQRGIVGLPGQRGERGFPGLPGPSGEPGKQGAPGASGDRGPPGPVGPPGLTGPAGEPGREGSPGADGPPGRDGAAGVKGDRGETGAVGAPGAPGPPGSPGPAGPTGKQGDRGEAGAQGPMGPSGPAGARGIQGPQGPRGDKGEAGEPGERGLKGHRGFTGLQGLPGPPGPSGDQGASGPAGPSGPRGPPGPVGPSGKDGANGIPGPIGPPGPRGRSGETGPAGPPGNPGPPGPPGPPGPGIDMSAFAGLGPREKGPDPLQYMRADQAAGGLRQHDAEVDATLKSLNNQIESIRSPEGSRKNPARTCRDLKLCHPEWKSGDYWIDPNQGCTLDAMKVFCNMETGETCVYPNPANVPKKNWWSSKSKERDDIWVPNTGRS

SEQ ID NO: 910864 - protein, 1418 aa, Homo sapiens
MIRLGAPQSLVLLTLLVAAVLRCQGQDVRQPGPKGQKGEPGDIKDIVGPKGPPGPQGPAGEQGPRGDRGDKGEKGAPGPRGRDGEPGTPGNPGPPGPPGPPGPPGLGGNFAAQMAGGFDEKAGGAQLGVMQGPMGPMGPRGPPGPAGAPGPQGFQGNPGEPGEPGVSGPMGPRGPPGPPGKPGDDGEAGKPGKAGERGPPGPQGARGFPGTPGLPGVKGHRGYPGLDGAKGEAGAPGVKGESGSPGENGSPGPMGPRGLPGERGRTGPAGAAGARGNDGQPGPAGPPGPVGPAGGPGFPGAPGAKGEAGPTGARGPEGAQGPRGEPGTPGSPGPAGASGNPGTDGIPGAKGSAGAPGIAGAPGFPGPRGPPGPQGATGPLGPKGQTGEPGIAGFKGEQGPKGEPGPAGPQGAPGPAGEEGKRGARGEPGGVGPIGPPGERGAPGNRGFPGQDGLAGPKGAPGERGPSGLAGPKGANGDPGRPGEPGLPGARGLTGRPGDAGPQGKVGPSGAPGEDGRPGPPGPQGARGQPGVMGFPGPKGANGEPGKAGEKGLPGAPGLRGLPGKDGETGAAGPPGPAGPAGERGEQGAPGPSGFQGLPGPPGPPGEGGKPGDQGVPGEAGAPGLVGPRGERGFPGERGSPGAQGLQGPRGLPGTPGTDGPKGASGPAGPPGAQGPPGLQGMPGERGAAGIAGPKGDRGDVGEKGPEGAPGKDGGRGLTGPIGPPGPAGANGEKGEVGPPGPAGSAGARGAPGERGETGPPGPAGFAGPPGADGQPGAKGEQGEAGQKGDAGAPGPQGPSGAPGPQGPTGVTGPKGARGAQGPPGATGFPGAAGRVGPPGSNGNPGPPGPPGPSGKDGPKGARGDSGPPGRAGEPGLQGPAGPPGEKGEPGDDGPSGAEGPPGPQGLAGQRGIVGLPGQRGERGFPGLPGPSGEPGKQGAPGASGDRGPPGPVGPPGLTGPAGEPGREGSPGADGPPGRDGAAGVKGDRGETGAVGAPGAPGPPGSPGPAGPTGKQGDRGEAGAQGPMGPSGPAGARGIQGPQGPRGDKGEAGEPGERGLKGHRGFTGLQGLPGPPGPSGDQGASGPAGPSGPRGPPGPVGPSGKDGANGIPGPIGPPGPRGRSGETGPAGPPGNPGPPGPPGPPGPGIDMSAFAGLGPREKGPDPLQYMRADQAAGGLRQHDAEVDATLKSLNNQIESIRSPEGSRKNPARTCRDLKLCHPEWKSGDYWIDPNQGCTLDAMKVFCNMETGETCVYPNPANVPKKNWWSSKSKEKKHIWFGETINGGFHFSYGDDNLAPNTANVQMTFLRLLSTEGSQNITYHCKNSIAYLDEAAGNLKKALLIQGSNDVEIRAEGNSRFTYTALKDGCTKHTGKWGKTVIEYRSQKTSRLPIIDIAPMDIGGPEQEFGVDIGPVCFL

SEQ ID NO: 910865 - protein, 855 aa, Homo sapiens
SGVVQEDACAAHTADLPWALLAVALRVSGTLAQLTFSFPLQGPAGERGEQGAPGPSGFQGLPGPPGPPGEGGKPGDQGVPGEAGAPGLVGPRGERGFPGERGSPGAQGLQGPRGLPGTPGTDGPKGASGPAGPPGAQGPPGLQGMPGERGAAGIAGPKGDRGDVGEKGPEGAPGKDGGRGLTGPIGPPGPAGANGEKGEVGPPGPAGSAGARGAPGERGETGPPGPAGFAGPPGADGQPGAKGEQGEAGQKGDAGAPGPQGPSGAPGPQGPTGVTGPKGGNPGPPGPPGPSGKDGPKGARGDSGPPGRAGEPGLQGPAGPPGEKGEPGDDGPSGAEGPPGPQGLAGQRGIVGLPGQRGERGFPGLPGPSGEPGKQGAPGASGDRGPPGPVGPPGLTGPAGEPGREGSPGADGPPGRDGAAGVKGDRGETGAVGAPGAPGPPGSPGPAGPTGKQGDRGEAGAQGPMGPSGPAGARGIQGPQGPRGDKGEAGEPGERGLKGHRGFTGLQGLPGPPGPSGDQGASGPAGPSGPRGPPGPVGPSGKDGANGIPGPIGPPGPRGRSGETGPAGPPGNPGPPGPPGPPGPGIDMSAFAGLGPREKGPDPLQYMRADQAAGGLRQHDAEVDATLKSLNNQIESIRSPEGSRKNPARTCRDLKLCHPEWKSGDYWIDPNQGCTLDAMKVFCNMETGETCVYPNPANVPKKNWWSSKSKEKKHIWFGETINGGFHFSYGDDNLAPNTANVQMTFLRLLSTEGSQNITYHCKNSIAYLDEAAGNLKKALLIQGSNDVEIRAEGNSRFTYTALKDGCTKHTGKWGKTVIEYRSQKTSRLPIIDIAPMDIGGPEQEFGVDIGPVCFL

SEQ ID NO: 910866 - protein, 215 aa, Homo sapiens
MIRLGAPQSLVLLTLLVAAVLRCQGQDVRQPGPKGQKGEPGDIKDIVGPKGPPGPQGPAGEQGPRGDRGDKGEKGAPGPRGRDGEPGTPGNPGPPGPPGPPGPPGLGGNFAAQMAGGFDEKAGGAQLGVMQGPMGPMGPRGPPGPAGAPGPQGFQGNPGEPGEPGVSGPMGPRGPPGPPGKPGDDGEAGKPGKAGPGQGLQLCCPVQEPRAKCGI

SEQ ID NO: 910867 - protein, 266 aa, Homo sapiens [sequence omitted]

SEQ ID NO: 910868 - protein, 85 aa, Homo sapiens
RQVVLHRRLYSTRQVVLHRQVVLQNGDWTFQTLVMLETVPRSGEVYTCQVEHPSLTSPLTVEWKHGLKVQYAILEYNLPWGILES

SEQ ID NO: 910869 - protein, 266 aa, Homo sapiens [sequence omitted]

SEQ ID NO: 910870 - protein, 128 aa, Homo sapiens
MVCLKLPGGSCMAALTVTLTVLSSPLALAGDTQPRFLEQAKCECHFLNGTERVWNLIRYIYNQEEYARYNSDLGEYQAVTELGRPDAEYWNSQKDLLEAEAGRGGHLLQTQLRGCVRASQCSGESSLR

SEQ ID NO: 910871 - protein, 268 aa, Homo sapiens
ETKAGKVAASKLGQKVSAVNVVIFTVSSGILLAEVQSVLLIPEVEWNSPAPRKEQGQATKPPDSHSASWLWADSDPCSSMSTVERAHQALGAPLGKVYNLSNFRGTLSSITRVRKVQYSALDHPSSVTARYSPGPVLFSSMVCLKFPGGSCMAALTVTLMVLSSPLALAGDTRPRFLEQAKCECHFLNGTERVWNLIRYIYNQEEYARYNSDLGEYQAVTELGRPDAEYWNSQKDLLEAEAGRGGHLLQTQLRGCVRASQCSGESSLR

SEQ ID NO: 910872 - protein, 108 aa, Homo sapiens
MLETVPRSGEVYTCQVEHPSLTSPLTVEWRARSESAQSKMLSGVGGFVLGLLFLGAGLFIYFRNQKGHSGLQPTGNTFSSSLRNRFGGQAQWLTPVIPALWEAEAGES

SEQ ID NO: 910873 - protein, 157 aa, Homo sapiens
RVGPVKVPSARTPPRESGLVASLSVSSQEAALCDRIVRVPTARFLEQAKCECHFLNGTERVWNLIRYIYNQEEYARYNSDLGEYQAVTELGRPDAEYWNSQKDLLEAEAGRGGHLLQTQLRGCVRASQCSGEVSMVEGGAWVPVSGESVYVCVCVCV

SEQ ID NO: 910874 - protein, 257 aa, Homo sapiens
ETKAGKVAASKLGQKVSAVNVVIFTVSSGILLAEVQSVLLIPEVEWNSPAPRKEQGQATKPPDSHSASWLWADSDPCSSMSTVERAHQALGAPLGKVYNLSNFRGTLSSITRVRKVQYSALDHPSVRHRPVLPWSCPVLQHGVSEVPWRLLHGSSDSDTDGAELPTGFGWGHPTTFLVSRLNMSVISSTGRSGCGSWIRYFYNQEEYVRFDSDVGEYRAVTELGRPERRVLEQPEGPPGRQRRAAVDTYCRHNYGVV

SEQ ID NO: 910875 - protein, 175 aa, Homo sapiens
YPVRRRLSPTPRWTPTADTTTGLCESFTVQRRVQPKVTVYPSKTQPLQHHNLLVCSVNGFYPGSIEVRWFRNGQEEKAGVVSTGLIQNGDWTFQTLVMLETVPRSGEVYTCQVEHPSLTSPLTVEWRARSESAQSKMLSGVGGFVLGLLFLGAGLFIYFRNQKGHSGLQPTGFLS

SEQ ID NO: 910876 - protein, 228 aa, Homo sapiens
ETKAGKVAASKLGQKVSAVNVVIFTVSSGILLAEVQSVLLIPEVEWNSPAPRKEQGQATKPPDSHSASWLWADSDPCSSMSTVERAHQALGAPLGKVYNLSNFRGTLSSITRVRKVQYSALDHPSSVTARYSPGPVLFSSMVCLKFPGGSCMAALTVTLMVLSSPLALAGDTRPRFLEQAKCECHFLNGTERVWNLIRYIYNQEEYARYNSDLGEYQAVTELGPSRPW

SEQ ID NO: 910877 - protein, 266 aa, Homo sapiens [sequence omitted]

SEQ ID NO: 910878 - protein, 525 aa, Homo sapiens
MRRRRRRDGFYPAPDFRDREAEDMAGVFDIDLDQPEDAGSEDELEEGGQLNESMDHGGVGPYELGMEHCEKFEISETSVNRGPEKIRPECFELLRVLGKGGYGKVFQVRKVTGANTGKIFAMKVLKKAMIVRNAKDTAHTKAERNILEEVKHPFIVDLIYAFQTGGKLYLILEYLSGGELFMQLEREGIFMEDTACFYLAEISMALGHLHQKGIIYRDLKPENIMLNHQGHVKLTDFGLCKESIHDGTVTHTFCGTIEYMAPEILMRSGHNRAVDWWSLGALMYDMLTGAPPFTGENRKKTIDKILKCKLNLPPYLTQEARDLLKKLLKRNAASRLGAGPGDAGEVQAHPFFRHINWEELLARKVEPPFKPLLQSEEDVSQFDSKFTRQTPVDSPDDSTLSESANQVFLGFTYVAPSVLESVKEKFSFEPKIRSPRRFIGSPRTPVSPVKFSPGDFWGRGASASTANPQTPVEYPMETSGIEQMDVTMSGEASAPLPIRQPNSGPYKKQAFPMISKRPEHLRMNL

SEQ ID NO: 910879 - protein, 502 aa, Homo sapiens
MAGVFDIDLDQPEDAGSEDELEEGGQLNESMDHGGVGPYELGMEHCEKFEISETSVNRGPEKIRPECFELLRVLGKGGYGKVFQVRKVTGANTGKIFAMKVLKKAMIVRNAKDTAHTKAERNILEEVKHPFIVDLIYAFQTGGKLYLILEYLSGGELFMQLEREGIFMEDTACFYLAEISMALGHLHQKGIIYRDLKPENIMLNHQGHVKLTDFGLCKESIHDGTVTHTFCGTIEYMAPEILMRSGHNRAVDWWSLGALMYDMLTGAPPFTGENRKKTIDKILKCKLNLPPYLTQEARDLLKKLLKRNAASRLGAGPGDAGEVQAHPFFRHINWEELLARKVEPPFKPLLQSEEDVSQFDSKFTRQTPVDSPDDSTLSESANQVFLGFTYVAPSVLESVKEKFSFEPKIRSPRRFIGSPRTPVSPVKFSPGDFWGRGASASTANPQTPVEYPMETSGIEQMDVTMSGEASAPLPIRQPNSGPYKKQAFPMISKRPEHLRMNL

SEQ ID NO: 910880 - protein, 301 aa, Homo sapiens
MALGHLHQKGIIYRDLKPENIMLNHQGHVKLTDFGLCKESIHDGTVTHTFCGTIEYMAPEILMRSGHNRAVDWWSLGALMYDMLTGAPPFTGENRKKTIDKILKCKLNLPPYLTQEARDLLKKAHPFFRHINWEELLARKVEPPFKPLLQSEEDVSQFDSKFTRQTPVDSPDDSTLSESANQVFLGFTYVAPSVLESVKEKFSFEPKIRSPRRFIGSPRTPVSPVKFSPGDFWGRGASASTANPQTPVEYPMETSGIEQMDVTMSGEASAPLPIRQPNSGPYKKQAFPMISKRPEHLRMNL

SEQ ID NO: 910881 - protein, 502 aa, Homo sapiens; identical to SEQ ID NO: 910879

SEQ ID NO: 910882 - protein, 531 aa, Homo sapiens
MRRRRRRDGFYPAPDFRDREAEDMAGVFDIDLDQPEDAGSEDELEEGGQLNESMDHGGVGPYELGMEHCEKFEISETSVNRGPEKIRPECFELLRVLGKGGYGKVFQVRKVTGANTGKIFAMKVLKKMISFPLAMIVRNAKDTAHTKAERNILEEVKHPFIVDLIYAFQTGGKLYLILEYLSGGELFMQLEREGIFMEDTACFYLAEISMALGHLHQKGIIYRDLKPENIMLNHQGHVKLTDFGLCKESIHDGTVTHTFCGTIEYMAPEILMRSGHNRAVDWWSLGALMYDMLTGAPPFTGENRKKTIDKILKCKLNLPPYLTQEARDLLKKLLKRNAASRLGAGPGDAGEVQAHPFFRHINWEELLARKVEPPFKPLLQSEEDVSQFDSKFTRQTPVDSPDDSTLSESANQVFLGFTYVAPSVLESVKEKFSFEPKIRSPRRFIGSPRTPVSPVKFSPGDFWGRGASASTANPQTPVEYPMETSGIEQMDVTMSGEASAPLPIRQPNSGPYKKQAFPMISKRPEHLRMNL

SEQ ID NO: 910883 - protein, 451 aa, Homo sapiens
MRRRRRRDGFYPAPDFRDREAEDMAGVFDIDLDQPEDAGSEDELEEGGQLNESMDHGGVGPYELGMEHCEKFEISETSVNRGPEKIRPECFELLRVLGKGGYGKVFQVRKVTGANTGKIFAMKVLKKAMIVRNAKDTAHTKAERNILEEVKHPFIVDLIYAFQTGGKLYLILEYLSGGELFMQLEREGIFMEDTACFYLAEISMALGHLHQKGIIYRDLKPENIMLNHQGHVKLTDFGLCKESIHDGTVTHTFCGTIEYMAPEILMRSGHNRAVDWWSLGALMYDMLTGAPPFTGENRKKTIDKILKCKLNLPPYLTQEARDLLKKLLKRNAASRLGAGPGDAGEVQAHPFFRHINWEELLARKVEPPFKPLLQSEEDVSQFDSKFTRQTPVDSPDDSTLSESANQVFLGFTYVAPSVLESVKEKFSFEPKIRSPRRFIGSPRTPVSSSLS

SEQ ID NO: 910884 - protein, 304 aa, Homo sapiens
MRRRRRRDGFYPAPDFRDREAEDMAGVFDIDLDQPEDAGSEDELEEGGQLNESMDHGGVGPYELGMEHCEKFEISETSVNRGPEKIRPECFELLRVLGKGGYGKVFQVRKVTGANTGKIFAMKVLKKAMIVRNAKDTAHTKAERNILEEVKHPFIVDLIYAFQTGGKLYLILEYLSGGELFMQLEREGIFMEDTACFYLAEISMALGHLHQKGIIYRDLKPENIMLNHQGHVKLTDFGLCKESIHDGTVTHTFCGTIEYMAPEILMRSGHNRAVDWWSLGALMYDMLTGAVGAQLKAACIIGLC

SEQ ID NO: 910885 - protein, 95 aa, Homo sapiens
RLFFQKLRGSERTVCAPQDGREEAKIVLIRFPMQRNLVVIPKSVTPERIAENFKVFDFELSSQDMTTLLSYNRNWRVCALLSCTSHKDYPFHEEF

SEQ ID NO: 910886 - protein, 238 aa, Homo sapiens
LLCRLCILRGSRSFSFQSPPGQVTEAVKVAIDVGYRHIDCAHVYQNENEVGVAIQEKLREQVVKREELFIVSKLWCTYHEKGLVKGACQKTLSDLKLDYLDLYLIHWPTGFKPGKEFFPLDESGNVVPSDTNILDTWAAMEELVDEGLVKAIGISNFNHLQVEMILNKPGLKYKPAVNQIECHPYLTQEKVNPVLPVQRHRGDQPTAPSALLTGPGPSPKDPSLLGGSQDQGDRSQAQ

SEQ ID NO: 910887 - protein, 351 aa, Homo sapiens
MGCLLFSLKHSLSHQIQQLRNSFLPRGARASVGGGKNPLPLGPGGRSIPADPWGRPPRHPQRNQSEGSFAQRRANRRRPFCRPHGLFKGTRRGQGRTVLGGGLGSAAAMASRLLLNNGAKMPILGLGTWKSPPGQVTEAVKVAIDVGYRHIDCAHVYQNENEVGVAIQEKLREQVVKREELFIVSKLWCTYHEKGLVKGACQKTLSDLKLDYLDLYLIHWPTGFKPGKEFFPLDESGNVVPSDTNILDTWAAMEELVDEGLVKAIGISNFNHLQVEMILNKPGLKYKPAVNQIECHPYLTQEKVNPVLPVQRHRGDQPTAPSALLTGPGPSPKDPSLLGGSQDQGDRSQAQ

SEQ ID NO: 910888 - protein, 243 aa, Homo sapiens
MASRLLLNNGAKMPILGLGTWKSPPGQVTEAVKVAIDVGYRHIDCAHVYQNENEVGVAIQEKLREQVVKREELFIVSKLWCTYHEKGLVKGACQKTLSDLKLDYLDLYLIHWPTGFKPGKEFFPLDESGNVVPSDTNILDTWAAMEELVDEGLVKAIGISNFNHLQVEMILNKPGLKYKPAVNQIECHPYLTQEKVNPVLPVQRHRGDQPTAPSALLTGPGPSPKDPSLLGGSQDQGDRSQAQ

SEQ ID NO: 910889 - protein, 243 aa, Homo sapiens; identical to SEQ ID NO: 910888

SEQ ID NO: 910890 - protein, 243 aa, Homo sapiens; identical to SEQ ID NO: 910888

SEQ ID NO: 910891 - protein, 243 aa, Homo sapiens; identical to SEQ ID NO: 910888

SEQ ID NO: 910892 - protein, 273 aa, Homo sapiens
LATAPGDYGNIATEPQLSDVSHAVRGSAAAMASRLLLNNGAKMPILGLGTWKSPPGQVTEAVKVAIDVGYRHIDCAHVYQNENEVGVAIQEKLREQVVKREELFIVSKLWCTYHEKGLVKGACQKTLSDLKLDYLDLYLIHWPTGFKPGKEFFPLDESGNVVPSDTNILDTWAAMEELVDEGLVKAIGISNFNHLQVEMILNKPGLKYKPAVNQIECHPYLTQEKVNPVLPVQRHRGDQPTAPSALLTGPGPSPKDPSLLGGSQDQGDRSQAQ

SEQ ID NO: 910893 - protein, 243 aa, Homo sapiens; identical to SEQ ID NO: 910888

SEQ ID NO: 910894 - protein, 243 aa, Homo sapiens; identical to SEQ ID NO: 910888

SEQ ID NO: 910895 - protein, 196 aa, Homo sapiens
MGFGERRLLCLSSQEAALWLAMMTCALSLAELWCTYHEKGLVKGACQKTLSDLKLDYLDLYLIHWPTGFKPGKEFFPLDESGNVVPSDTNILDTWAAMEELVDEGLVKAIGISNFNHLQVEMILNKPGLKYKPAVNQIECHPYLTQEKVNPVLPVQRHRGDQPTAPSALLTGPGPSPKDPSLLGGSQDQGDRSQAQ

SEQ ID NO: 910896 - protein, 243 aa, Homo sapiens; identical to SEQ ID NO: 910888

SEQ ID NO: 910897 - protein, 351 aa, Homo sapiens; identical to SEQ ID NO: 910887

SEQ ID NO: 910898 - protein, 178 aa, Homo sapiens
MASRLLLNNGAKMPILGLGTWKSPPGQVTEAVKVAIDVGYRHIDCAHVYQNENEVGVAIQEKLREQVVKREELFIVSKAMEELVDEGLVKAIGISNFNHLQVEMILNKPGLKYKPAVNQIECHPYLTQEKVNPVLPVQRHRGDQPTAPSALLTGPGPSPKDPSLLGGSQDQGDRSQAQ

SEQ ID NO: 910899 - protein, 391 aa, Homo sapiens
MGCLLFSLKHSLSHQIQQLRNSFLPRGARASVGGGKNPLPLGPGGRSIPADPWGRPPRHPQRNQSEGSFAQRRANRRRPFCRPHGLFKGTRRGQGRTVLGGGLGSAAAMASRLLLNNGAKMPILGLGTWKSPPGQVTEAVKVAIDVGYRHIDCAHVYQNENEVGVAIQEKLREQVVKREELFIVSKLWCTYHEKGLVKGACQKTLSDLKLDYLDLYLIHWPTGFKPGKEFFPLDESGNVVPSDTNILDTWAAMEELVDEGLVKAIGISNFNHLQVEMILNKPGLKYKPAVNQIECHPYLTQEKVNPVLPVQRHRGDQPTAPSALLTGPGPSSRTLYSWERFRGIKETSKAEARSKSNRTRVPASRYPNATRTTSGEEPTRLRQPERHCSET

SEQ ID NO: 910900 - protein, 119 aa, Homo sapiens
MTTIPDRGGPVFGQGYTSSCAPLLEPPNKLSCQALGQARRTLLSWEDPRIKAIAAKHNKTTAQIPKSVTPERIAENFKVFDFELSSQDMTTLLSYNRNWRVCALLSCTSHKDYPFHEEF

SEQ ID NO: 910901 - protein, 243 aa, Homo sapiens; identical to SEQ ID NO: 910888

SEQ ID NO: 910902 - protein, 93 aa, Homo sapiens
MPVVPATREVLGQQSKTSSLKTNKQTNYQGACQKTLSDLKLDYLDLYLIHWPTGFKPGKEFFPLDESGNVVPSDTNILDTWAGKTAPGWTLFS

SEQ ID NO: 910903 - protein, 267 aa, Homo sapiens
MARGGTRRGQGRTVLGGGLGSAAAMASRLLLNNGAKMPILGLGTWKSPPGQVTEAVKVAIDVGYRHIDCAHVYQNENEVGVAIQEKLREQVVKREELFIVSKLWCTYHEKGLVKGACQKTLSDLKLDYLDLYLIHWPTGFKPGKEFFPLDESGNVVPSDTNILDTWAAMEELVDEGLVKAIGISNFNHLQVEMILNKPGLKYKPAVNQIECHPYLTQEKVNPVLPVQRHRGDQPTAPSALLTGPGPSPKDPSLLGGSQDQGDRSQAQ

SEQ ID NO: 910904 - protein, 243 aa, Homo sapiens; identical to SEQ ID NO: 910888

SEQ ID NO: 910905 - protein, 243 aa, Homo sapiens; identical to SEQ ID NO: 910888

SEQ ID NO: 910906 - protein, 243 aa, Homo sapiens; identical to SEQ ID NO: 910888

SEQ ID NO: 910907 - protein, 243 aa, Homo sapiens; identical to SEQ ID NO: 910888

SEQ ID NO: 910908 - protein, 309 aa, Homo sapiens
MGCLLFSLKHSLSHQIQQLRNSFLPRGARASVGGGKNPLPLGPGGRSIPADPWGRPPRHPQRNQSEGSFAQRRANRRRPFCRPHGLFKSPPGQVTEAVKVAIDVGYRHIDCAHVYQNENEVGVAIQEKLREQVVKREELFIVSKLWCTYHEKGLVKGACQKTLSDLKLDYLDLYLIHWPTGFKPGKEFFPLDESGNVVPSDTNILDTWAAMEELVDEGLVKAIGISNFNHLQVEMILNKPGLKYKPAVNQIECHPYLTQEKVNPVLPVQRHRGDQPTAPSALLTGPGPSPKDPSLLGGSQDQGDRSQAQ

SEQ ID NO: 910909 - protein, 243 aa, Homo sapiens; identical to SEQ ID NO: 910888

SEQ ID NO: 910910 - protein, 208 aa, Homo sapiens
MASRLLLNNGAKMPILGLGTWKSPPGQVTEAVKVAIDVGYRHIDCAHVYQNENEVGVAIQEKLREQVVKREELFIVSKLWCTYHEKGLVKGACQKTLSDLKLDYLDLYLIHWPTGFKPGKEFFPLDESGNVVPSDTNILDTWAAMEELVDEGLVKAIGISNFNHLQVEMILNKPGLKYKPAVNQRRKLIQYCQSKGIVVTSLQPPRLS

SEQ ID NO: 910911 - protein, 202 aa, Homo sapiens
MASRLLLNNGAKMPILGLGTWKSPPGQVTEAVKVAIDVGYRHIDCAHVYQNENEVGVAIQEKLREQVVKREELFIVSKLWCTYHEKGLVKGACQKTLSDLKLDYLDLYLIHWPTGFKPGKEFFPLDESGNVVPSDTNILDTWAIECHPYLTQEKVNPVLPVQRHRGDQPTAPSALLTGPGPSPKDPSLLGGSQDQGDRSQAQ

SEQ ID NO: 910912 - protein, 113 aa, Homo sapiens
MGTRRGQGRTVLGGGLGSAAAMASRLLLNNGAKMPILGLGTWKSPPGQVTEAVKVAIDVGYRHIDCAHVYQNENEVGVAIQEKLREQAGESYWHLQLQPSPGGDDLKQTWLEV

SEQ ID NO: 910913 - protein, 154 aa, Homo sapiens
MASRLLLNNGAKMPILGLGTWKSPPGQVTEAVKVAIDVGYRHIDCAHVYQNENEVGVAIQEKLREQVVKREELFIVSKLWCTYHEKGLVKGACQKTLSDLKLDYLDLYLIHWPTGFKPGKEFFPLDESGNVVPSDTNILDTWAGKTAPGWTLFS

SEQ ID NO: 910914 - protein, 897 aa, Homo sapiens
MVLAQGLLSMALLALCWERSLAGAEETIPLQTLRCYNDYTSHITCRWADTQDAQRLVNVTLIRRVNEDLLEPVSCDLSDDMPWSACPHPRCVPRRCVIPCQSFVVTDVDYFSFQPDRPLGTRLTVTLTQHVQPPEPRDLQISTDQDHFLLTWSVALGSPQSHWLSPGDLEFEVVYKRLQDSWEDAAILLSNTSQATLGPEHLMPSSTYVARVRTRLAPGSRLSGRPSKWSPEVCWDSQPGDEAQPQNLECFFDGAAVLSCSWEVRKEVASSVSFGLFYKPSPDAGEEECSPVLREGLGSLHTRHHCQIPVPDPATHGQYIVSVQPRRAEKHIKSSVNIQMAPPSLNVTKDGDSYSLRWETMKMRYEHIDHTFEIQYRKDTATWKDSKTETLQNAHSMALPALEPSTRYWARVRVRTSRTGYNGIWSEWSEARSWDTESVLPMWVLALIVIFLTIAVLLALRFCGIYGYRLRRKWEEKIPNPSKSHLFQNGSAELWPPGSMSAFTSGSPPHQGPWGSRFPELEGVFPVGFGDSEVSPLTIEDPKHVCDPPSGPDTTPAASDLPTEQPPSPQPGPPAASHTPEKQASSFDFNGPYLGPPHSRSLPDILGQPEPPQEGGSQKSPPPGSLEYLCLPAGGQVQLVPLAQAMGPGQAVEVERRPSQGAAGSPSLESGGGPAPPALGPRVGGQDQKDSPVAIPMSSGDTEDPGVASGYVSSADLVFTPNSGASSVSLVPSLGLPSDQTPSLCPGLASGPPGAPGPVKSGFEGYVELPPIEGRSPRSPRNNPVPPEAKSPVLNPGERPADVSPTSPQPEGLLVLQQVGDYCFLPGLGPGPLSLRSKPSSPGPGPEIKNLDQAFQVKKPPGQAVPQVPVIQLFKALKQQDYLSLPPWEVNKPGEVC

SEQ ID NO: 910915 - protein, 897 aa, Homo sapiens; identical to SEQ ID NO: 910914

SEQ ID NO: 910916 - protein, 739 aa, Homo sapiens
VLEVGFHLREDAQLSPLTVASGLLGDAAILLSNTSQATLGPEHLMPSSTYVARVRTRLAPGSRLSGRPSKWSPEVCWDSQPGDEAQPQNLECFFDGAAVLSCSWEVRKEVASSVSFGLFYKPSPDAGEEECSPVLREGLGSLHTRHHCQIPVPDPATHGQYIVSVQPRRAEKHIKSSVNIQMAPPSLNVTKDGDSYSLRWETMKMRYEHIDHTFEIQYRKDTATWKDSKTETLQNAHSMALPALEPSTRYWARVRVRTSRTGYNGIWSEWSEARSWDTESVLPMWVLALIVIFLTIAVLLALRFCGIYGYRLRRKWEEKIPNPSKSHLFQNGSAELWPPGSMSAFTSGSPPHQGPWGSRFPELEGVFPVGFGDSEVSPLTIEDPKHVCDPPSGPDTTPAASDLPTEQPPSPQPGPPAASHTPEKQASSFDFNGPYLGPPHSRSLPDILGQPEPPQEGGSQKSPPPGSLEYLCLPAGGQVQLVPLAQAMGPGQAVEVERRPSQGAAGSPSLESGGGPAPPALGPRVGGQDQKDSPVAIPMSSGDTEDPGVASGYVSSADLVFTPNSGASSVSLVPSLGLPSDQTPSLCPGLASGPPGAPGPVKSGFEGYVELPPIEGRSPRSPRNNPVPPEAKSPVLNPGERPADVSPTSPQPEGLLVLQQVGDYCFLPGLGPGPLSLRSKPSSPGPGPEIKNLDQAFQVKKPPGQAVPQVPVIQLFKALKQQDYLSLPPWEVNKPGEVC

SEQ ID NO: 910917 - protein, 74 aa, Homo sapiens
AFYGVRVTCALQSARLSIAFMLKPYSFADEGLRLTEETGLAQGPSAAGGRGGLEPPVSTQKAMQALTAPQRSSP

SEQ ID NO: 910918 - protein, 897 aa, Homo sapiens; identical to SEQ ID NO: 910914

SEQ ID NO: 910919 - protein, 427 aa, Homo sapiens
MAGAYGERGQAKREHLFQNGSAELWPPGSMSAFTSGSPPHQGPWGSRFPELEGVFPVGFGDSEVSPLTIEDPKHVCDPPSGPDTTPAASDLPTEQPPSPQPGPPAASHTPEKQASSFDFNGPYLGPPHSRSLPDILGQPEPPQEGGSQKSPPPGSLEYLCLPAGGQVQLVPLAQAMGPGQAVEVERRPSQGAAGSPSLESGGGPAPPALGPRVGGQDQKDSPVAIPMSSGDTEDPGVASGYVSSADLVFTPNSGASSVSLVPSLGLPSDQTPSLCPGLASGPPGAPGPVKSGFEGYVELPPIEGRSPRSPRNNPVPPEAKSPVLNPGERPADVSPTSPQPEGLLVLQQVGDYCFLPGLGPGPLSLRSKPSSPGPGPEIKNLDQAFQVKKPPGQAVPQVPVIQLFKALKQQDYLSLPPWEVNKPGEVC

SEQ ID NO: 910920 - protein, 2341 aa, Homo sapiens
MGSQTLQILRQGVWAALSGGWYYDPHQATFVNALHLYLWLFLLGLPFTLYMALPSTMIIVAVYCPVIAAVFIVLKMVNYRLHRALDAGEVVDRTANEFTDQRTKAEQGNCSTRRKDSNGPSDPGGGIEMSEFIREATPPVGCSSRNSYAGLDPSNQIGSGSSRLGTAATIKGDTDTAKTSDDISLSLGQSSSLCKEGSEEQDLAADRKLFRLVSNDSFISIQPSLSSCGQDLPRDFSDKVNLPSHNHHHHVDQSLSSACDTEVASLVPLHSHSYRKDHRPRGVPRTSSSAVAFPDTSLNDFPLYQQRRGLDPVSELESSKPLSGSKESLVENSGLSGEFQLAGDLKINTSQPPTKSGKSKPLKAEKSMDSLRSLSTRSSGSTESYCSGTDRDTNSTVSSYKSEQTSSTHIESILSEHEESPKAGTKSGRKKECCAGPEEKNSCASDKRTSSEKIAMEASTNSGVHEAKDPTPSDEMHNQRGLSTSASEEANKNPHANEFTSQGDRPPGNTAENKEEKSDKSAVSVDSKVRKDVGGKQKEGDVRPKSSSVIHRTASAHKSGRRRTGKKRASSFDSSRHRDYVCFRGVSGTKPHSAIFCHDEDSSDQSDLSRASSVQSAHQFSSDSSSSTTSHSCQSPEGRYSALKTKHTHKERGTDSEHTHKAHLVPEGTSKKRATRRTSSTNSAKTRARVLSLDSGTVACLNDSNRLMAPESIKPLTTSKSDLEAKEGEVLDELSLLGRASQLETVTRSRNSLPNQVAFPEGEEQDAVSGAAQASEEAVSFRRERSTFRRQAVRRRHNAGSNPTPPTLLIGSPLSLQDGQQGQQSTAQVKVQSRPPSQAAVLSASASLLVRNGSVHLEASHDNASAVGGSSLHDELGKFSSTLYETGGCDMSLVNFEPAARRASNICDTDSHVSSSTSVRFYPHDVLSLPQIRLNRLLTIDTDLLEQQDIDLSPDLAATYGPTEEAAQKVKHYYRFWILPQLWIGINFDRLTLLALFDRNREILENVLAVILAILVAFLGSILLIQGFFRDIWVFQFCLVIASCQYSLLKSVQPDSSSPRHGHNRIIAYSRPVYFCICCGLIWLLDYGSRNLTATKFKLYGITFTNPLVFISARDLVIVFTLCFPIVFFIGLLPQVNTFVMYLCEQLDIHIFGGNATTSLLAALYSFICSIVAVALLYGLCYGALKDSWDGQHIPVLFSIFCGLLVAVSYHLSRQSSDPSVLFSLVQSKIFPKTEEKNPEDPLSEVKDPLPEKLRNSVSERLQSDLVVCIVIGVLYFAIHVSTVFTVLQPALKYVLYTLVGFVGFVTHYVLPQVRKQLPWHCFSHPLLKTLEYNQYEVRNAATMMWFEKLHVWLLFVEKNIIYPLIVLNELSSSAETIASPKKLNTELGALMITVAGLKLLRSSFSSPTYQYVTVIFTVLFFKFDYEAFSETMLLDLFFMSILFNKLWELLYKLQFVYTYIAPWQITWGSAFHAFAQPFAVPHSAMLFIQAAVSAFFSTPLNPFLGSAIFITSYVRPVKFWERDYNTKRVDHSNTRLASQLDRNPGSDDNNLNSIFYEHLTRSLQHSLCGDLLLGRWGNYSTGDCFILASDYLNALVHLIEIGNGLVTFQLRGLEFRGTYCQQREVEAITEGVEEDEGFCCCEPGHIPHMLSFNAAFSQRWLAWEVIVTKYILEGYSITDNSAASMLQVFDLRKVLTTYYVKGIIYYVTTSSKLEEWLANETMQEGLRLCADRNYVDVDPTFNPNIDEDYDHRLAGISRESFCVIYLNWIEYCSSRRAKPVDVDKDSSLVTLCYGLCVLGRRALGTASHHMSSNLESFLYGLHALFKGDFRISSIRDEWIFADMELLRKVVVPGIRMSIKLHQDHFTSPDEYDDPTVLYEAIVSHEKNLVIAHEGDPAWRSAVLANSPSLLALRHVMDDGTNEYKIIMLNRRYLSFRVIKVNKECVRGLWAGQQQELVFLRNRNPERGSIQNAKQALRNMINSSCDQPIGYPIFVSPLTTSYSDSHEQLKDILGGPISLGNIRNFIVSTWHRLRKGCGAGCNSGGNIEDSDTGGGTSCTGNNATTANNPHSNVTQGSIGNPGQGSGTGLHPPVTSYPPTLGTSHSSHSVQSGLVRQSPARASVASQSSYCYSSRHSSLRMSTTGFVPCRRSSTSQISLRNLPSSIQSRLSMVNQMEPSGQSGLACVQHGLPSSSSSSQSIPACKHHTLVGFLATEGGQSSATDAQPGNTLSPANNSHSKKAEVIYRVQIVDPSQILEGINLSKRKELQWPDEGIRLKAGRNSWKDWSPQEGMEGHVIHRWVPCSRDPGTRSHIDKAVLLVQIDDKYVTVIETGVLELGAEV

SEQ ID NO: 910921 - protein, 2341 aa, Homo sapiens; identical to SEQ ID NO: 910920

SEQ ID NO: 910922 - protein, 2341 aa, Homo sapiens
MGSQTLQILRQGVWAALSGGWYYDPHQATFVNALHLYLWLFLLGLPFTLYMALPSTMIIVAVYCPVIAAVFIVLKMVNYRLHRALDAGEVVDRTANEFTDQRTKAEQGNCSTRRKDSNGPSDPGGGIEMSEFIREATPPVGCSSRNSYAGLDPSNQIGSGSSRLGTAATIKGDTDTAKTSDDISLSLGQSSSLCKEGSEEQDLAADRKLFRLVSNDSFISIQPSLSSCGQDLPRDFSDKVNLPSHNHHHHVDQSLSSACDTEVASLVPLHSHSYRKDHRPRGVPRTSSSAVAFPDTSLNDFPLYQQRRGLDPVSELESSKPLSGSKESLVENSGLSGEFQLAGDLKINTSQPPTKSGKSKPLKAEKSMDSLRSLSTRSSGSTESYCSGTDRDTNSTVSSYKSEQTSSTHIESILSEHEESPKAGTKSGRKKECCAGPEEKNSCASDKRTSSEKIAMEASTNSGVHEAKDPTPSDEMHNQRGLSTSASEEANKNPHANEFTSQGDRPPGNTAENKEEKSDKSAVSVDSKVRKDVGGKQKEGDVRPKSSSVIHRTASAHKSGRRRTGKKRASSFDSSRHRDYVCFRGVSGTKPHSAIFCHDEDSSDQSDLSRASSVQSAHQFSSDSSSSTTSHSCQSPEGRYSALKTKHTHKERGTDSEHTHKAHLVPEGTSKKRATRRTSSTNSAKTRARVLSLDSGTVACLNDSNRLMAPESIKPLTTSKSDLEAKEGEVLDELSLLGRASQLETVTRSRNSLPNQVAFPEGEEQDAVSGAAQASEEAVSFRRERSTFRRQAVRRRHNAGSNPTPPTLLIGSPLSLQDGQQGQQSTAQVKVQSRPPSQAAVLSASASLLVRNGSVHLEASHDNASAVGGSSLHDELGKFSSTLYETGGCDMSLVNFEPAARRASNICDTDSHVSSSTSVRFYPHDVLSLPQIRLNRLLTIDTDLLEQQDIDLSPDLAATYGPTEEAAQKVKHYYRFWILPQLWIGINFDRLTLLALFDRNREILENVLAVILAILVAFLGSILLIQGFFRDIWVFQFCLVIASCQYSLLKSVQPDSSSPRHGHNRIIAYSRPVYFCICCGLIWLLDYGSRNLTATKFKLYGITFTNPLVFISARDLVIVFTLCFPIVFFIGLLPQVNTFVMYLCEQLDIHIFGGNATTSLLAALYSFICSIVAVALLYGLCYGALKDSWDGQHIPVLFSIFCGLLVAVSYHLSRQSSDPSVLFSLVQSKIFPKTEEKNPEDPLSEVKDPLPEKLRNSVSERLQSDLVVCIVIGVLYFAIHVSTVFTVLQPALKYVLYTLVGFVGFVTHYVLPQVRKQLPWHCFSHPLLKTLEYNQYEVRNAATMMWFEKLHVWLLFVEKNIIYPLIVLNELSSSAETIASPKKLNTELGALMITVAGLKLLRSSFSSPTYQYVTVIFTVLFFKFDYEAFSETMLLDLFFMSILFNKLWELLYKLQFVYTYIAPWQITWGSAFHAFAQPFAVPHSAMLFIQAAVSAFFSTPLNPFLGSAIFITSYVRPVKFWERDYNTKRVDHSNTRLASQLDRNPGSDDNNLNSIFYEHLTRSLQHSLCGDLLLGRWGNYSTGDCFILASDYLNALVHLIEIGNGLVTFQLRGLEFRGTYCQQREVEAITEGVEEDEGFCCCEPGHIPHMLSFNAAFSQRWLAWEVIVTKYILEGYSITDNSAASMLQVFDLRKVLTTYYVKGIIYYVTTSSKLEEWLANETMQEGLRLCADRNYVDVDPTFNPNIDEDYDHRLAGISRESFCVIYLNWIEYCSSRRAKPVDVDKDSSLVTLCYGLCVLGRRALGTASHHMSSNLESFLYGLHALFKGDFRISSIRDEWIFADMELLRKVVVPGIRMSIKLHQDHFTSPDEYDDPTVLYEAIVSHEKNLVIAHEGDPAWRSAVLANSPSLLALRHVMDDGTNEYKIIMLNRRYLSFRVIKVNKECVRGLWAGQQQELVFLRNRNPERGSIQNAKQALRNMINSSCDQPIGYPIFVSPLTTSYSDSHEQLKDILGGPISLGNIRNFIVSTWHRLRKGCGAGCNSGGNIEDSDTGGGTSCTGNNATTANNPHSNVTQGSIGNPGQGSGTGLHPPVTSYPPTLGTSHSSHSVQSGLVRQSPARASVASQSSYCYSSRHSSLRMSTTGFVPCRRSSTSQISLRNLPSSIQSRLSMVNQMEPSGQSGLACVQHGLPSSSSSSQSIPACKHHTLVGFLATEGGQSSATDAQPGNTLSPANNSHSRKAEVIYRVQIVDPSQILEGINLSKRKELQWPDEGIRLKAGRNSWKDWSPQEGMEGHVIHRWVPCSRDPGTRSHIDKAVLLVQIDDKYVTVIETGVLELGAEV

SEQ ID NO: 910923 - protein, 866 aa, Homo sapiens
MGSQTLQILRQGVWAALSGGWYYDPHQATFVNALHLYLWLFLLGLPFTLYMALPSTMIIVAVYCPVIAAVFIVLKMVNYRLHRALDAGEVVDRTANEFTDQRTKAEQGNCSTRRKDSNGPSDPGGGIEMSEFIREATPPVGCSSRNSYAGLDPSNQIGSGSSRLGTAATIKGDTDTAKTSDDISLSLGQSSSLCKEGSEEQDLAADRKLFRLVSNDSFISIQPSLSSCGQDLPRDFSDKVNLPSHNHHHHVDQSLSSACDTEVASLVPLHSHSYRKDHRPRGVPRTSSSAVAFPDTSLNDFPLYQQRRGLDPVSELESSKPLSGSKESLVENSGLSGEFQLAGDLKINTSQPPTKSGKSKPLKAEKSMDSLRSLSTRSSGSTESYCSGTDRDTNSTVSSYKSEQTSSTHIESILSEHEESPKAGTKSGRKKECCAGPEEKNSCASDKRTSSEKIAMEASTNSGVHEAKDPTPSDEMHNQRGLSTSASEEANKNPHANEFTSQGDRPPGNTAENKEEKSDKSAVSVDSKVRKDVGGKQKEGDVRPKSSSVIHRTASAHKSGRRRTGKKRASSFDSSRHRDYVCFRGVSGTKPHSAIFCHDEDSSDQSDLSRASSVQSAHQFSSDSSSSTTSHSCQSPEGRYSALKTKHTHKERGTDSEHTHKAHLVPEGTSKKRATRRTSSTNSAKTRARVLSLDSGTVACLNDSNRLMAPESIKPLTTSKSDLEAKEGEVLDELSLLGRASQLETVTRSRNSLPNQVAFPEGEEQDAVSGAAQASEEAVSFRRERSTFRRQAVRRRHNAGSNPTPPTLLIGSPLSLQDGQQGQQSTAQVKVQSRPPSQAAVLSASASLLVSSLLRCMRLVAVICHL

SEQ ID NO: 910924 - protein, 218 aa, Homo sapiens
MGSQTLQILRQGVWAALSGGWYYDPHQATFVNALHLYLWLFLLGLPFTLYMALPSTMIIVAVYCPVIAAVFIVLKMVNYRLHRALDAGEVVDRTANEFTDQRTKAEQGNCSTRRKDSNGPSDPGGGIEMSEFIREATPPVGCSSRNSYAGLDPSNQIGSGSSRLGTAATIKGDTDTAKTSDDISLSLGQSSSLCKEGSEEQGKNVILYHDVIYCGDQS

SEQ ID NO: 910925 - protein, 2341 aa, Homo sapiens; identical to SEQ ID NO: 910922

SEQ ID NO: 910926 - protein, 2341 aa, Homo sapiens; identical to SEQ ID NO: 910922

SEQ ID NO: 910927 - protein, 760 aa, Homo sapiens
MDSLRSLSTRSSGSTESYCSGTDRDTNSTVSSYKSEQTSSTHIESILSEHEESPKAGTKSGRKKECCAGPEEKNSCASDKRTSSEKIAMEASTNSGVHEAKDPTPSDEMHNQRGLSTSASEEANKNPHANEFTSQGDRPPGNTAENKEEKSDKSAVSVDSKVRKDVGGKQKEGDVRPKSSSVIHRTASAHKSGRRRTGKKRASSFDSSRHRDYVCFRGVSGTKPHSAIFCHDEDSSDQSDLSRASSVQSAHQFSSDSSSSTTSHSCQSPEGRYSALKTKHTHKERGTDSEHTHKAHLVPEGTSKKRATRRTSSTNSAKTRARVLSLDSGTVACLNDSNRLMAPESIKPLTTSKSDLEAKEGEVLDELSLLGRASQLETVTRSRNSLPNQVAFPEGEEQDAVSGAAQASEEAVSFRRERSTFRRQAVRRRHNAGSNPTPPTLLIGSPLSLQDGQQGQQSTAQVKVQSRPPSQAAVLSASASLLVRNGSVHLEASHDNASAVGGSSLHDELGKFSSTLYETGGCDMSLVNFEPAARRASNICDTDSHVSSSTSVRFYPHDVLSLPQIRLNRLLTIDTDLLEQQDIDLSPDLAATYGPTEEAAQKVKHYYRFWILPQLWIGINFDRLTLLALFDRNREILENVLAVILAILVAFLGSILLIQGFFRDIWVFQFCLVIASCQYSLLKSVQPDSSSPRHGHNRIIAYSRPVYFCICCGLIWLLDYGSRNLTATKFKLYGITFTNPLVFISARDLVIGEYICNVPL

SEQ ID NO: 910928 - protein, 2341 aa, Homo sapiens; identical to SEQ ID NO: 910920

SEQ ID NO: 910929 - protein, 580 aa, Homo sapiens
MAGTVRTACLVVAMLLSLDFPGQAQPPPPPPDATCHQVRSFFQRLQPGLKWVPETPVPGSDLQVCLPKGPTCCSRKMEEKYQLTARLNMEQLLQSASMELKFLIIQNAAVFQEAFEIVVRHAKNYTNAMFKNNYPSLTPQAFEFVGEFFTDVSLYILGSDINVDDMVNELFDSLFPVIYTQLMNPGLPDSALDINECLRGARRDLKVFGNFPKLIMTQVSKSLQVTRIFLQALNLGIEVINTTDHLKFSKDCGRMLTRMWYCSYCQGLMMVKPCGGYCNVVMQGCMAGVVEIDKYWREYILSLEELVNGMYRIYDMENVLLGLFSTIHDSIQYVQKNAGKLTTTIGKLCAHSQQRQYRSAYYPEDLFIDKKVLKVAHVEHEETLSSRRRELIQKLKSFISFYSALPGYICSHSPVAENDTLCWNGQELVERYSQKAARNGMKNQFNLHELKMKGPEPVVSQIIDKLKHINQLLRTMSMPKGRVLDKNLDEEGFESGDCGDDEDECIGGSGDGMIKVKNQLRFLAELAYDLDVDDAPGNSQQATPKDNEISTFHNLGNVHSPLKLLTSMAISVVCFFFLVH

SEQ ID NO: 910930 - protein, 580 aa, Homo sapiens; identical to SEQ ID NO: 910929

SEQ ID NO: 910931 - protein, 562 aa, Homo sapiens
MAGTVRTACLVVAMLLSLDFPGQAQPPPPPPDATCHQVRSFFQRLQPGLKWVPETPVPGSDLQVCLPKGPTCCSRKMEDMELKFLIIQNAAVFQEAFEIVVRHAKNYTNAMFKNNYPSLTPQAFEFVGEFFTDVSLYILGSDINVDDMVNELFDSLFPVIYTQLMNPGLPDSALDINECLRGARRDLKVFGNFPKLIMTQVSKSLQVTRIFLQALNLGIEVINTTDHLKFSKDCGRMLTRMWYCSYCQGLMMVKPCGGYCNVVMQGCMAGVVEIDKYWREYILSLEELVNGMYRIYDMENVLLGLFSTIHDSIQYVQKNAGKLTTTIGKLCAHSQQRQYRSAYYPEDLFIDKKVLKVAHVEHEETLSSRRRELIQKLKSFISFYSALPGYICSHSPVAENDTLCWNGQELVERYSQKAARNGMKNQFNLHELKMKGPEPVVSQIIDKLKHINQLLRTMSMPKGRVLDKNLDEEGFESGDCGDDEDECIGGSGDGMIKVKNQLRFLAELAYDLDVDDAPGNSQQATPKDNEISTFHNLGNVHSPLKLLTSMAISVVCFFFLVH

SEQ ID NO: 910932 - protein, 573 aa, Homo sapiens
MAGTVRTACLVVAMLLSLDFPGQAQPPPPPPDATCHQVRSFFQRLQPGLKWVPETPVPGSDLQVCLPKGPTCCSRKMEEKYQLTARLNMEQLLQSASMELKFLIIQNAAVFQEAFEIVVRHAKNYTNAMFKNNYPSLTPQAFEFVGEFFTDVSLYILGSDINVDDMVNELFDSLFPVIYTQLMNPGLPDSALDINECLRGARRDLKVFGNFPKLIMTQVSKSLQVTRIFLQALNLGIEVINTTDHLKFSKDCGRMLTRMWYCSYCQGLMMVKPCGGYCNVVMQGCMAGVVEIDKYWREYILSLEELVNGMYRIYDMENVLLGLFSTIHDSIQYVQKNAGKLTTTIGKLCAHSQQRQYRSAYYPEDLFIDKKVLKVAHVEHEETLSSRRRELIQKLKSFISFYSALPGYICSHSPVAENDTLCWNGQELVERNGMKNQFNLHELKMKGPEPVVSQIIDKLKHINQLLRTMSMPKGRVLDKNLDEEGFESGDCGDDEDECIGGSGDGMIKVKNQLRFLAELAYDLDVDDAPGNSQQATPKDNEISTFHNLGNVHSPLKLLTSMAISVVCFFFLVH

SEQ ID NO: 910933 - protein, 105 aa, Homo sapiens
LCQYICSVFNPSVEREGFESGDCGDDEDECIGGSGDGMIKVKNQLRFLAELAYDLDVDDAPGNSQQATPKDNEISTFHNLGNVHSPLKLLTSMAISVVCFFFLVH

SEQ ID NO: 910934 - protein, 108 aa, Homo sapiens
MAPLHSSLGDRARLHLVSSLQEKRRDVQGRDECIGGSGDGMIKVKNQLRFLAELAYDLDVDDAPGNSQQATPKDNEISTFHNLGNVHSPLKLLTSMAISVVCFFFLVH

SEQ ID NO: 910935 - protein, 551 aa, Homo sapiens
MAGTVRTACLVVAMLLSLDFPGQAQPPPPPPDATCHQVRSFFQRLQPGLKWVPETPVPGSDLQVCLPKGPTCCSRKMEEKYQLTARLNMEQLLQSASMELKFLIIQNAAVFQEAFEIVVRHAKNYTNAMFKNNYPSLTPQAFEFVGEFFTDVSLYILGSDINVDDMVNELFDSLFPVIYTQLMNPGLPDSALDINECLRGARRDLKVFGNFPKLIMTQVSKSLQVTRIFLQALNLGIEVINTTDHLKFSKDCGRMLTRMWYCSYCQGLMMVKPCGGYCNVVMQGCMAGVVEIDKYWREYILSLEELVNGMYRIYDMENVLLGLFSTIHDSIQYVQKNAGKLTTTIGKLCAHSQQRQYRSAYYPEDLFIDKKVLKVAHVEHEETLSSRRRELIQKLKSFISFYSALPGYICSHSPVAENDTLCWNGQELVERYSQKAARNGMKNQFNLHELKMKGPEPVVSQIIDKLKHINQLWDPCLMPKGGVLDPGKEGCEVETAVMMRCLLGYELDVDERLEPVAATSRAAREGRVQRGEVMARGSGSREGVGRAGWWG

SEQ ID NO: 910936 - protein, 580 aa, Homo sapiens; identical to SEQ ID NO: 910929

SEQ ID NO: 910937 - protein, 486 aa, Homo sapiens
MLLKKDGRKIPTNSTIEHGTAASVCKYGAQVLNYSECCGFPSLTPQAFEFVGEFFTDVSLYILGSDINVDDMVNELFDSLFPVIYTQLMNPGLPDSALDINECLRGARRDLKVFGNFPKLIMTQVSKSLQVTRIFLQALNLGIEVINTTDHLKFSKDCGRMLTRMWYCSYCQGLMMVKPCGGYCNVVMQGCMAGVVEIDKYWREYILSLEELVNGMYRIYDMENVLLGLFSTIHDSIQYVQKNAGKLTTTIGKLCAHSQQRQYRSAYYPEDLFIDKKVLKVAHVEHEETLSSRRRELIQKLKSFISFYSALPGYICSHSPVAENDTLCWNGQELVERYSQKAARNGMKNQFNLHELKMKGPEPVVSQIIDKLKHINQLLRTMSMPKGRVLDKNLDEEGFESGDCGDDEDECIGGSGDGMIKVKNQLRFLAELAYDLDVDDAPGNSQQATPKDNEISTFHNLGNVHSPLKLLTSMAISVVCFFFLVH

SEQ ID NO: 910938 - protein, 510 aa, Homo sapiens
MAGTVRTACLVVAMLLSLDFPGQAQPPPPPPDATCHQVRSFFQRLQPGLKWVPETPVPGSDLQVCLPKGPTCCSRKMEEKYQLTARLNMEQLLQSASMELKFLIIQNAAVFQEAFEIVVRHAKNYTNAMFKNNYPSLTPQAFEFVGEFFTDVSLYILGSDINVDDMVNELFDSLFPVIYTQLMNPGLPDSALDINECLRGARRDLKVFGNFPKLIMTQVSKSLQVTRIFLQALNLGIEVINTTDHLKFSKDCGRMLTRMWYCSYCQGLMMVKPCGGYCNVVMQGCMAGVVEIDKYWREYILSLEELVNGMYRIYDMENVLLGLFSTIHDSIQYVQKNAGKLTTTIGKLCAHSQQRQYRSAYYPEDLFIDKKVLKVAHVEHEETLSSRRRELIQKLKSFISFYSALPGYICSHSPVAENDTLCWNGQELVERYSQKAARNGMKNQFNLHELKMKGPEPVVSQIIDKLKHINQLLRTMSMPKGRVLDKNLDEEGFESGDCGDDEDECIGGSG

SEQ ID NO: 910939 - protein, 529 aa, Homo sapiens
MAGTVRTACLVVAMLLSLDFPGQAQPPPPPPDATCHQVRSFFQRLQPGLKWVPETPVPGSDLQVCLPKGPTCCSRKMEEKYQLTARLNMEQLLQSASMELKFLIIQNAAVFQEAFEIVVRHAKNYTNAMFKNNYPSLTPQAFEFVGEFFTDVSLYILGSDINVDDMVNELFDSLFPVIYTQLMNPGLPDSALDINECLRGARRDLKVFGNFPKLIMTQVSKSLQVTRIFLQALNLGIEVINTTDHLKFSKDCGRMLTRMWYCSYCQGLMMVKPCGGYCNVVMQGCMAGVVEIDKYWREYILSLEELVNGMYRIYDMENVLLGLFSTIHDSIQYVQKNAGKLTTTIGKLCAHSQQRQYRSAYYPEDLFIDKKVLKVAHVEHEETLSSRRRELIQKLKSFISFYSALPGYICSHSPVAENDTLCWNGQELVERYSQKAARNGMKNQFNLHELKMKGPEPVVSQIIDKLKHINQLLRTMSMPKGRVLDKNLDEEGFESGDCGDDEDECIGGSFNFFNGSQNSVTNFWSSCFH

SEQ ID NO: 910940 - protein, 200 aa, Homo sapiens; identical to SEQ ID NO: 826041

SEQ ID NO: 910941 - protein, 140 aa, Homo sapiens
MAQQRALPQSKETLLQSYNKRLKDDIKSIMDNFTEIIKTAKIEDETQVSRATQGEQDNYEMHVRAANIVRAGESLMKLVSDLKQFLILNDFPSVNEAIDQRNQQLRTLQEECDRKLITLRDEISIDLYELEEEYYSSRYK

SEQ ID NO: 910942 - protein, 140 aa, Homo sapiens; identical to SEQ ID NO: 910941

SEQ ID NO: 910943 - protein, 140 aa, Homo sapiens; identical to SEQ ID NO: 910941

SEQ ID NO: 910944 - protein, 131 aa, Homo sapiens; identical to SEQ ID NO: 826044

SEQ ID NO: 910945 - protein, 341 aa, Homo sapiens
MVGEMETKEKPKPTPDYLMQLMNDKKLMSSLPNFCGIFNHLERLLDEEISRVRKDMYNDTLNGSTEKRSAELPDAVGPIVQLQEKLYVPVKEYPDFNFVGRILGPRGLTAKQLEAETGCKIMVRGKGSMRDKKKEEQNRGKPNWEHLNEDLHVLITVEDAQNRAEIKLKRAVEEVKKLLVPAAEGEDSLKKMQLMELAILNGTYRDANIKSPALAFSLAATAQAAPRIITGPAPVLPPAALRTPTPAGPTIMPLIRQIQTAVMPNGTPHPTAAIVPPGPEAGLIYTPYEYPYTLAPATSILEYPIEPSGVLGAVATKVRRHDMRVHPYQRIVTADRAATGN

SEQ ID NO: 910946 - protein, 652 aa, Homo sapiens
MVIYKGVYSSILTAEVYYTVCFTNHLIHCSSYLLTQSLKPQSVGFKNCFETFLSDETLEVVLRLANNLSVLNMALFEVVLLQERHFSEYVTSKAEICLDLIELMKYCNLGIVMNGYNRLRPKMFEMNAILIDAYIHDILWLILKLLCLNVFLETFVVNEHLKSILINLLLMFFPPLGMFSNFVLVIAIELGAVATKVRRHDMRVHPYQRIVTADRGSLVLQFLSIRNALGVHKICNTTPDEKNVIAYLHTVFFPFLNLFVIIDRFKGWVFCFGLVFSPFIFELIKSSIIMYYDLFLLKHKLVNLGSYEILMLPQLFSLITFAKIYLLKVRNLGLVLQNELNGWCFNERSKGIYASCVLLEKTEDLVSIFLYNKIFEPLYKHEGAHVKYLAKINKVRTVKITFMYVGFFYINESVNSLLFLHSLAKMDPLILSFAAKIYYLKVNCLLKFCGGMRSSCVNIIFDYTCDWKISLHFLLYNFYNLCPVYALGPFYKLFLLIEEWYFRFIDIELFSKFFHHKIGISSMVVKKDFLQVSIMAHCFLQIKLIKVSNISGGKSAGFVLQLYIFYEFMKDLPALCDYLEYLMINTRHSCCPHQKYHAFPKDIVNICLAKSIKNVEDFETNVFITNSDCSVNKIDPSSVVVYEDGIPCKCSV

SEQ ID NO: 910947 - protein, 315 aa, Homo sapiens
METKEKPKPTPDYLMQLMNDKKLMSSLPNFCGIFNHLERLLDEEISRVRKDMYNDTLNGSTEKRSAELPDAVGPIVQLQEKLYVPVKEYPDFNFVGRILGPRGLTAKQLEAETGCKIMVRGKGSMRDKKKEEQNRGKPNWEHLNEDLHVLITVEDAQNRAEIKLKRAVEEVKKLLVPAAEGEDSLKKMQLMELAILNGTYRDANIKSPALAFSLAATAQAAPRIITGPAPVLPPAALRTPTPAGPTIMPLIRQIQTAVMPNGTPHPTAAIVPPGPEAGLIYTPYEYPYTLAPATSILEYPIEPSGVLGMAFPTKG

SEQ ID NO: 910948 - protein, 341 aa, Homo sapiens [sequence omitted]

SEQ ID NO: 910949 - protein, 341 aa, Homo sapiens; identical to SEQ ID NO: 910945

SEQ ID NO: 910950 - protein, 325 aa, Homo sapiens
MVGEMETKEKPKPTPDYLMQLMNDKKLMSSLPNFCGIFNHLERLLDEEISRVRKDMYNDTLNGSTEKRSAELPDAVGPIVQLQEKLYVPVKEYPDFNFVGRILGPRGLTAKQLEAETGCKIMVRGKGSMRDKKKEEQNRGKPNWEHLNEDLHVLITVEDAQNRAEIKLKRAVEEVKKLLVPAAEGEDSLKKMQLMELAILNGTYRDANIKSPALAFSLAATAQAAPRIITGPAPVLPPAALRTPTPAGPTIMPLIRQIQTAVMPNGTPHPTAAIVPPGPEAGLIYTPYEYPYTLAPATSILEYPIEPSGVLEWIEMPVMPDISAH

SEQ ID NO: 910951 - protein, 341 aa, Homo sapiens; identical to SEQ ID NO: 910945

SEQ ID NO: 910952 - protein, 551 aa, Homo sapiens
MKYCNLGIVMNGYNRLRPKMFEMNAILIDAYIHDILWLILKLLCLNVFLETFVVNEHLKSILINLLLMFFPPLGMFSNFVLVIAIYLGAVATKVRRHDMRVHPYQRIVTADRGSLVLQFLSIRNALGVHKICNTTPDEKNVIAYLHTVFFPFLNLFVIIDRFKGWVFCFGLVFSPFIFELIKSSIIMYYDLFLLKHKLVNLGSYEILMLPQLFSLITFAKIYLLKVLKFGVGMQNELNGWCFNERSKGIYASCVLLEKTEDLVSIFLYNKIFEPLYKHEGAHVKYLAKINKVRTVKITFMYVGFFYINYERQFPFILTFSCQNGSFDFVSFAAKIYYLKVNCLLKFCGGMRSSCVNIIFDYTCDLENKSSFFSFTTFIICVLYDALGPFYKLFLLIEEWYFRFIDIELFSKFFHHKIGISSMVVKKDFLQVSIMAHCFLQIKLIKVSNISGGKSAGFVLQLYIFYEFMKDLPALCDYLEYLMINTRHSCCPHQKSHAFPKDIVNICLAKSIKNVEDFYTNVFITNSDCSVNKIDPSSVVVYEDGIPCKCSV

SEQ ID NO: 910953 - protein, 258 aa, Homo sapiens
MVGEMETKEKPKPTPDYLMQLMNDKKLMSSLPNFCGIFNHLERLLDEEISRVRKDMYNDTLNGSTEKRSAELPDAVGPIVQLQEKLYVPVKEYPDFNFVGRILGPRGLTAKQLEAETGCKIMVRGKGSMRDKKKEEQNRGKPNWEHLNEDLHVLITVEDAQNRAEIKLKRAVEEVKKLLVPAAEGEDSLKKMQLMELAILNGTYRDANIKSPALAAAMKKSLSAPLHPEFEEVYRFGAESRKLLLREPVDAMPNRITR

SEQ ID NO: 910954 - protein, 967 aa, Homo sapiens
MFKFFFSINTLSCGPVHAPFPRTPLCCTHSICSRGVMTLDFLQGWGSYHQLLFQHFQRKISLILPRGIVLVYDYLIYNEYRGDGPVYCLEIARGTAVKLVSHCKASCLLFVGKFLLIEDLIIRLVKIKTKICRFLIGIHKVNNNKCPMKKSIMVNFISCFATYAVKHDIDHLENSENYFKFLSYNKFATQITCMLFMSHLTLNYFKITVPFKTDADMCVGSSEEIGISIKSSLMIIFNSLPFIFRYGFPNERLRIQELVLTETLIRSEFNKCLVSAASGGKKLSLAVSDLLALFAHRYKVEIMLLIWFSLKYYTVMVIYKGVYSSILTAEVYYTVCFTNHLIHCSSYLLTQSLKPQSVGFKNCFETFLSDETLEVVLRLANNLSVLNMALFEVVLLQERHFSEYVTSKAEICLDLIELMKYCNLGIVMNGYNRLRPKMFEMNAILIDAYIHDILWLILKLLCLNVFLETFVVNEHLKSILINLLLMFFPPLGMFSNFVLVIAIYLGAVATKVRRHDMRVHPYQRIVTADRGSLVLQFLSIRNALGVHKICNTTPDEKNVIAYLHTVFFPFLNLFVIIDRFKGWVFCFGLVFSPFIFELIKSSIIMYYDLFLLKHKLVNLGSYEILMLPQLFSLITFAKIYLLKVLKFGVGMQNELNGWCFNERSKGIYASCVLLEKTEDLVSIFLYNKIFEPLYKHEGAHVKYLAKINKVRTVKITFMYVGFFYIIRASIPFYSYILLPKWILSFLSFAAKIYYLKVNCLLKFCGGMRSSCVNIIFDYTCDWKISLHFLLYNFYNLCPVYALGPFYKLFLLIEEWYFRFIDIELFSKFFHHKIGISSMVVKKDFLQVSIMAHCFLQIKLIKVSNISGGKSAGFVLQLYIFYEFMKDLPALCDYLEYLMINTRHSCCPHQKSHAFPKDIVNICLAKSIKNVEDFETNVFITNSDCSVNKIDPSSVVVYEDGIPCKCSV

SEQ ID NO: 910955 - protein, 319 aa, Homo sapiens
MVGEMETKEKPKPTPDYLMQLMNDKKLMSSLPNFCGIFNHLERLLDEEISRVRKDMYNDTLNGSTEKRSAELPDAVGPIVQLQEKLYVPVKEYPDFNFVGRILGPRGLTAKQLEAETGCKIMVRGKGSMRDKKKEEQNRGKPNWEHLNEDLHVLITVEDAQNRAEIKLKRAVEEVKKLLVPAAEGEDSLKKMQLMELAILNGTYRDANIKSPALAFSLAATAQAAPRIITGPAPVLPPAALRTPTPAGPTIMPLIRQIQTAVMPNGTPHPTAAIVPPGPEAGLIYTPYEYPYTLAPATSILEYPIEPSGVLGMAFPTKG

SEQ ID NO: 910956 - protein, 361 aa, Homo sapiens
MLSLSSLRRNSGRNSGGAWNMVGEMETKEKPKPTPDYLMQLMNDKKLMSSLPNFCGIFNHLERLLDEEISRVRKDMYNDTLNGSTEKRSAELPDAVGPIVQLQEKLYVPVKEYPDFNFVGRILGPRGLTAKQLEAETGCKIMVRGKGSMRDKKKEEQNRGKPNWEHLNEDLHVLITVEDAQNRAEIKLKRAVEEVKKLLVPAAEGEDSLKKMQLMELAILNGTYRDANIKSPALAFSLAATAQAAPRIITGPAPVLPPAALRTPTPAGPTIMPLIRQIQTAVMPNGTPHPTAAIVPPGPEAGLIYTPYEYPYTLAPATSILEYPIEPSGVLGAVATKVRRHDMRVHPYQRIVTADRAATGN

SEQ ID NO: 910957 - protein, 551 aa, Homo sapiens; identical to SEQ ID NO: 910952

SEQ ID NO: 910958 - protein, 354 aa, Homo sapiens
MVGEMETKEKPKPTPDYLMQLMNDKKLMSSLPNFCGIFNHLERLLDEEISRVRKDMYNDTLNGSTEKRSAELPDAVGPIVQLQEKLYVPVKEYPDFNFVGRILGPRGLTAKQLEAETGCKIMVRGKGSMRDKKKEEQNRGKPNWEHLNEDLHVLITVEDAQNRAEIKLKRAVEEVKKLLVPAAEGEDSLKKMQLMELAILNGTYRDANIKSPALAFSLAATAQAAPRIITGPAPVLPPAALRTPTPAGPTIMPLIRQIQTAVMPNGTPHPTAAIVPPGPEAGLIYTPYEYPYTLAPATSILEYPIEPSGVLGAVATKVRRHDMRVHPYQRIVTADRGRPPGNLNFGTFGTLEIF

SEQ ID NO: 910959 - protein, 160 aa, Homo sapiens
MVGEMETKEKPKPTPDYLMQLMNDKKLMSSLPNFCGIFNHLERLLDEEISRVRKDMYNDTLNGSTEKRSAELPDAVGPIVQLQEKLYVPVKEYPDFNFVGRILGPRGLTAKQLEAETGCKIMVRGKGSMRDKKKEDAKSELAHCEHNEDYIVLSSESRYR

SEQ ID NO: 910960 - protein, 347 aa, Homo sapiens [sequence omitted]

SEQ ID NO: 910961 - protein, 112 aa, Homo sapiens
MWKGGRSHPFLPCSSRRAGSGGQLDSILPHQSPAWGPWGCKDLSSGVPSFLTSSILWKSAVFAEDNGLKIHLCSYKRDDLVLFYDCTSFVLTFGPSPWFLTQGFLNPLEFSA

SEQ ID NO: 910962 - protein, 446 aa, Homo sapiens
CAPLADGGEPADAERVLRPAVGAASSPGSATSRGSGGGPGPRGMALRSAQGDGPTSGHWDGGAEKADFNAKRKKKVAEIHQALNSDPTDVAALRRMAISEGGLLTDEIRRKVWPKLLNVNANDPPPISGKNLRQMSKDYQQVLLDVRRSLRRFPPGMPEEQREGLQEELIDIILLILERNPQLHYYQGYHDIVVTFLLVVGERLATSLVEKLSTHHLRDFMDPTMDNTKHILNYLMPIIDQVNPELHDFMQSAEVGTIFALSWLITWFGHVLSDFRHVVRLYDFFLACHPLMPIYFAAVIVLYREQEVLDCDCDMASVHHLLSQIPQDLPYETLISRAGDLFVQFPPSELAREAAAQQQAERTAASTFKDFELASAQQRPDMVLRQRFRGLLRPEDRTKDVLTKPRTNRFVKLAVMGLTVALGAAALAVVKSALEWAPKFQLQLFP

SEQ ID NO: 910963 - protein, 422 aa, Homo sapiens
CAPLADGGEPADAERVLRPAVGAASSPGSATSRGSGGGPGPRGMALRSAQGDGPTSGHWDGGAEKADFNAKRKKKVAEIHQALNSDPTDVAALRRMAISEGGLLTDEIRRKVWPKLLNVNANDPPPISGKNLRQMSKDYQQVLLDVRRSLRRFPPGMPEEQREGLQEELIDIILLILERNPQLHYYQGYHDIVVTFLLVVGERLATSLVEKLSTHHLRDFMDPTMDNTKHILNYLMPIIDQVNPELHDFMQRHVVRLYDFFLACHPLMPIYFAAVIVLYREQEVLDCDCDMASVHHLLSQIPQDLPYETLISRAGDLFVQFPPSELAREAAAQQQAERTAASTFKDFELASAQQRPDMVLRQRFRGLLRPEDRTKDVLTKPRTNRFVKLAVMGLTVALGAAALAVVKSALEWAPKFQLQLFP

SEQ ID NO: 910964 - protein, 72 aa, Homo sapiens
SWSALRSRPGLPSPGSWLSRIADDPLPSVSWPALSSARYFYSFSYSFFQCLQTTLLIKGTFITIFRIYTPHM

SEQ ID NO: 910965 - protein, 446 aa, Homo sapiens; identical to SEQ ID NO: 910962

SEQ ID NO: 910966 - protein, 446 aa, Homo sapiens; identical to SEQ ID NO: 910962

SEQ ID NO: 910967 - protein, 178 aa, Homo sapiens
CAPLADGGEPADAERVLRPAVGAASSPGSATSRGSGGGPGPRGMALRSAQGDGPTSGHWDGGAEKADFNAKRKKKVAEIHQALNSDPTDVAALRRMAISEGGLLTDEIRRKVWPKLLNVNANDPPPISGKNLRQMSKDYQQVLLDVRRSLRRFPPGEKLSRSCHIWKDCICSRSYHVT

SEQ ID NO: 910968 - protein, 446 aa, Homo sapiens; identical to SEQ ID NO: 910962

SEQ ID NO: 910969 - protein, 446 aa, Homo sapiens; identical to SEQ ID NO: 910962

SEQ ID NO: 910970 - protein, 134 aa, Homo sapiens
MVCGLLVSLDWLGDLGQYLQSCCFCFICKNYDPHTPAAAQGTVIFYTCVDVFVHSSWFITPITLCYNVGTLQASENGISVCDLLLPHFTCSTPDFNLTVAHKTLIPERVLPHTRKEERCTERPRSIWTDRPCWV

SEQ ID NO: 910971 - protein, 446 aa, Homo sapiens; identical to SEQ ID NO: 910962

SEQ ID NO: 910972 - protein, 211 aa, Homo sapiens
YTGVVLSRRQTDPRLRRGSAVPLGASASPSPASPASSASSPAAGTRDPSVCPTPDPARDMSTPARRRLMRDFKRLQEDPPAGVSGAPSENNIMVWNAVIFGPEGTPFEDGTFKLTIEFTEEYPNKPPTVRFVSKMFHPNVYADGSICLDILQNRWSPTYDVSSILTSIQSLLDEPNPNSPANSQAAQLYQENKREYEKRVSAIVEQSWRDC

SEQ ID NO: 910973 - protein, 181 aa, Homo sapiens
YTGVVLSRRQTDPRLRRGSAVPLGASASPSPASPASSASSPAAGTRDPSVCPTPDPARDMSTPARRRLMRDFKRLQEDPPAGVSGAPSENNIMVWNAVIFGPEGTPFEDVYADGSICLDILQNRWSPTYDVSSILTSIQSLLDEPNPNSPANSQAAQLYQENKREYEKRVSAIVEQSWRDC

SEQ ID NO: 910974 - protein, 144 aa, Homo sapiens
YTGVVLSRRQTDPRLRRGSAVPLGASASPSPASPASSASSPAAGTRDPSVCPTPDPARDMSTPARRRLMRDFKRLQEDPPAGVSGAPSENNIMVWNAVIFGPEGTPFEDGTFKLTIEFTEEYPNKPPTVRFVSKMFHPNGKYHF

SEQ ID NO: 910975 - protein, 196 aa, Homo sapiens
YTGVVLSRRQTDPRLRRGSAVPLGASASPSPASPASSASSPAAGTRDPSVCPTPDPARDMSTPARRRLMRDFKRLQEDPPAGVSGAPSENNIMVWNAVIFGPEGTPFEDGTFKLTIEFTEEYPNIYADGSICLDILQNRWSPTYDVSSILTSIQSLLDEPNPNSPANSQAAQLYQENKREYEKRVSAIVEQSWRDC

SEQ ID NO: 910976 - protein, 211 aa, Homo sapiens; identical to SEQ ID NO: 910972

SEQ ID NO: 910977 - protein, 101 aa, Homo sapiens
YTGVVLSRRQTDPRLRRGSAVPLGASASPSPASPASSASSPAAGTRDPSVCPTPDPARDMSTPARRRLMRDFKRLQEDPPAGVSGAPSENNIMVWNAVIFG

SEQ ID NO: 910978 - protein, 211 aa, Homo sapiens; identical to SEQ ID NO: 910972

SEQ ID NO: 910979 - protein, 101 aa, Homo sapiens; identical to SEQ ID NO: 910977

SEQ ID NO: 910980 - protein, 128 aa, Homo sapiens
LIRLSENNIMVWNAVIFGPEGTPFEDGTFKLTIEFTEEYPNKPPTVRFVSKMFHPNVYADGSICLDILQNRWSPTYDVSSILTSIQSLLDEPNPNSPANSQAAQLYQENKREYEKRVSAIVEQSWRDC

SEQ ID NO: 910981 - protein, 211 aa, Homo sapiens; identical to SEQ ID NO: 910972

SEQ ID NO: 910982 - protein, 144 aa, Homo sapiens; identical to SEQ ID NO: 910974

SEQ ID NO: 910983 - protein, 151 aa, Homo sapiens
YTGVVLSRRQTDPRLRRGSAVPLGASASPSPASPASSASSPAAGTRDPSVCPTPDPARDMSTPARRRLMRDFKRLQEDPPAGVSGAPSENNIMVWNAVIFGPEGTPFEDGKREFLYPLFRSLVIWGKGSQSSWKCLLLRNLPLPSLCLLKA

SEQ ID NO: 910984 - protein, 476 aa, Homo sapiens
MGPRGAAGAERGYKRPRAPRARPPRSGRALGKAWTDAAQRPGTFRAWTSRARAMLRVRCLRGGSRGAEAVHYIGSRLGRTLTGWVQRTFQSTQAATASSRNSCAADDKATEPLPKDCPVSSYNEWDPLEEVIVGRAENACVPPFTIEVKANTYEKYWPFYQKQGGHYFPKDHLKKAVAEIEEMCNILKTEGVTVRRPDPIDWSLKYKTPDFESTGLYSAMPRDILIVVGNEIIEAPMAWRSRFFEYRAYRSIIKDYFHRGAKWTTAPKPTMADELYNQDYPIHSVEDRHKLAAQGKFVTTEFEPCFDAADFIRAGRDIFAQRSQVTNYLGIEWMRRHLAPDYRVHIISFKDPNPMHIDATFNIIGPGIVLSNPDRPCHQIDLFKKAGWTIITPPTPIIPDDHPLWMSSKWLSMNVLMLDEKRVMVDANEVPIQKMFEKLGITTIKVNIRNANSLGGGFHCWTCDVRRRGTLQSYLD

SEQ ID NO: 910985 - protein, 559 aa, Homo sapiens
DKFNPVSDLEGSNFEVIGNIHQYSNLLVDDTDRISPDDIGNDIHEFLHGGDEVMAVEYENGGHGYVEHASIGGVIVHVFYADDKEEEDEIMLDNFVELKNKYADELGNRGRKCDEMKFTSEKVNELIGVDEAFKVPNKLMSIMMNVNNVSKRLKHFWKLSVIHHSIGSMNIFQSTQAATASSRNSCAADDKATEPLPKDCPVSSYNEWDPLEEVIVGRAENACVPPFTIEVKANTYEKYWPFYQKQGGHYFPKDHLKKAVAEIEEMCNILKTEGVTVRRPDPIDWSLKYKTPDFESTGLYSAMPRDILIVVGNEIIEAPMAWRSRFFEYRAYRSIIKDYFHRGAKWTTAPKPTMADELYNQDYPIHSVEDRHKLAAQGKFVTTEFEPCFDAADFIRAGRDIFAQRSQVTNYLGIEWMRRHLAPDYRVHIISFKDPNPMHIDATFNIIGPGIVLSNPDRPCHQIDLFKKAGWTIITPPTPIIPDDHPLWMSSKWLSMNVLMLDEKRVMVDANEVPIQKMFEKLGITTIKVNIRNANSLGGGFHCWTCDVRRRGTLQSYLD

SEQ ID NO: 910986 - protein, 458 aa, Homo sapiens
MGPRGAAGAERGYKRPRAPRARPPRSGRALGKAWTDAAQRPGTFRAWTSRARAMLRVRCLRGGSRGAEAVHYIGSRLGRTLTGWVQRTFQSTQAATASSRNSCAADDKATEPLPKDCPVSSYNEWDPLEEVIVGRAENACVPPFTIEVKANTYEKYWPFYQKQGGHYFPKDHLKKAVAEIEEMCNILKTEGVTVRRPDPIDWSLKYKTPDFESTGLYSAMPRDILIVVGNEIIEAPMAWRSRFFEYRAYRSIIKDYFHRGAKWTTAPKPTMADELYNQDYPIHSVEDRHKLAAQGTGRDIFAQRSQVTNYLGIEWMRRHLAPDYRVHIISFKDPNPMHIDATFNIIGPGIVLSNPDRPCHQIDLFKKAGWTIITPPTPIIPDDHPLWMSSKWLSMNVLMLDEKRVMVDANEVPIQKMFEKLGITTIKVNIRNANSLGGGFHCWTCDVRRRGTLQSYLD

SEQ ID NO: 910987 - protein, 240 aa, Homo sapiens
MAWRSRFFEYRAYRSIIKDYFHRGAKWTTAPKPTMADELYNQDYPIHSVEDRHKLAAQGKFVTTEFEPCFDAADFIRAGRDIFAQRSQVTNYLGIEWMRRHLAPDYRVHIISFKDPNPMHIDATFNIIGPGIVLSNPDRPCHQIDLFKKAGWTIITPPTPIIPDDHPLWMSSKWLSMNVLMLDEKRVMVDANEVPIQKMFEKLGITTIKVNIRNANSLGGGFHCWTCDVRRRGTLQSYLD

SEQ ID NO: 910988 - protein, 458 aa, Homo sapiens
MGPRGAAGAERGYKRPRAPRARPPRSGRALGKAWTDAAQRPGTFRAWTSRARAMLRVRCLRGGSRGAEAVHYIGSRLGRTLTGWVQRTFQSTQAATASSRNSCAADDKATEPLPKDCPVSSYNEWDPLEEVIVGRAENACVPPFTIEVKANTYEKYWPFYQKQGGHYFPKDHLKKAVAEIEEMCNILKTEGVTVRRPDPIDWSLKYKTPDFESTGLYSAMPRDILIVVGNEIIEAPMAWRSRFFEYRAYRSIIKDYFHRGAKWTTAPKPTMADELYNQDYPIHSVEDRHKLAAQGKFVTTEFEPCFDAADFIRAGRDIFAQRSQVTNYLGIEWMRRHLAPDYRVHIISFKDPNPMHIDATFNIIGPGIVLSNPDRPCHQIDLFKKAGWTIITPPTPIIPDDHPLWMSSKWLSMNVLMLDEKRVMVDANEVPIPNSLGGGFHCWTCDVRRRGTLQSYLD

SEQ ID NO: 910989 - protein, 504 aa, Homo sapiens
RAFLRRSGLGPGPDVQQKPSVAPLAKKGQASEARASGRGASRQFLIRGATPAPPPVPGSQWGRGGRPGRSAATKGLRAPRARPPRSGRALGKAWTDAAQRPGTFRAWTSRARAMLRVRCLRGGSRGAEAVHYIGSRLGRTLTGWVQRTFQSTQAATASSRNSCAADDKATEPLPKDCPVSSYNEWDPLEEVIVGRAENACVPPFTIEVKANTYEKYWPFYQKQGGHYFPKDHLKKAVAEIEEMCNILKTEGVTVRRPDPIDWSLKYKTPDFESTGLYSAMPRDILIVVGNEIIEAPMAWRSRFFEYRAYRSIIKDYFHRGAKWTTAPKPTMADELYNQDYPIHSVEDRHKLAAQGKFVTTEFEPCFDAADFIRAGRDIFAQRSQVTNYLGIEWMRRHLAPDYRVHIISFKDPNPMHIDATFNIIGPGIVLSNPDRPCHQIDLFKKAGWTIITPPTPIIPDDHPLWMSSKWLSMNVLMLDEKRVMVDANEVPIQKMFEKLGMYNK

SEQ ID NO: 910990 - protein, 390 aa, Homo sapiens
RAFLRRSGLGPGPDVQQKPSVAPLAKKGQASEARASGRGASRQFLIRGATPAPPPVPGSQWGRGGRPGRSAATKGLRAPRARPPRSGRALGKAWTDAAQRPGTFRAWTSRARAMLRVRCLRGGSRGAEAVHYIGSRLGRTLTGWVQRTFQSTQAATASSRNSCAADDKATEPLPKDCPVSSYNEWDPLEEVIVGRAENACVPPFTIEVKANTYEKYWPFYQKQGGHYFPKDHLKKAVAEIEEMCNILKTEGVTVRRPDPIDWSLKYKTPDFESTGLYSAMPRDILIVVGNEIIEAPMAWRSRFFEYRAYRSIIKDYFHRGAKWTTAPKPTMADELYNQDYPIHSVEDRHKLAAQGKFVTTEFEPCFDAADFIRAGRDIFAQRSQVTNYLG

SEQ ID NO: 910991 - protein, 254 aa, Homo sapiens
MGPRGAAGAERGYKRPRAPRARPPRSGRALGKAWTDAAQRPGTFRAWTSRARAMLRVRCLRGGSRGAEAVHYIGSRLGRTLTGWVQRTFQSTQAATASSRNSCAADDKATEPLPKDCPVSSYNEWDPLEEVIVGRAENACVPPFTIEVKANTYEKYWPFYQKQGGHYFPKDHLKKAVAEIEEMCNILKTEGVTVRRPDPIDWSLKYKTPDFESTGLYSAMPRDILIVVGNEIIEAPMAWRSRFFEYRAYRSIIA

SEQ ID NO: 910992 - protein, 257 aa, Homo sapiens
MPRDILIVVGNEIIEAPMAWRSRFFEYRAYRSIIKDYFHRGAKWTTAPKPTMADELYNQDYPIHSVEDRHKLAAQGKFVTTEFEPCFDAADFIRAGRDIFAQRSQVTNYLGIEWMRRHLAPDYRVHIISFKDPNPMHIDATFNIIGPGIVLSNPDRPCHQIDLFKKAGWTIITPPTPIIPDDHPLWMSSKWLSMNVLMLDEKRVMVDANEVPIQKMFEKLGITTIKVNIRNANSLGGGFHCWTCDVRRRGTLQSYLD

SEQ ID NO: 910993 - protein, 294 aa, Homo sapiens
MCNILKTEGVTVRRPDPIDWSLKYKTPDFESTGLYSAMPRDILIVVGNEIIEAPMAWRSRFFEYRAYRSIIKDYFHRGAKWTTAPKPTMADELYNQDYPIHSVEDRHKLAAQGKFVTTEFEPCFDAADFIRAGRDIFAQRSQVTNYLGIEWMRRHLAPDYRVHIISFKDPNPMHIDATFNIIGPGIVLSNPDRPCHQIDLFKKAGWTIITPPTPIIPDDHPLWMSSKWLSMNVLMLDEKRVMVDANEVPIQKMFEKLGITTIKVNIRNANSLGGGFHCWTCDVRRRGTLQSYLD

SEQ ID NO: 910994 - protein, 476 aa, Homo sapiens; identical to SEQ ID NO: 910984

SEQ ID NO: 910995 - protein, 504 aa, Homo sapiens; identical to SEQ ID NO: 910989

SEQ ID NO: 910996 - protein, 523 aa, Homo sapiens
MAGVSYAAPWWVSLLHRLPHFDLSWEATSSQFRPEDTDYQQALLLLGAAALACLALDLLFLLFYSFWLCCRRRKSEEHLDADCCCTAWCVIIATLVCSAGIAVGFYGNGETSDGIHRATYSLRHANRTVAGVQDRVWDTAVGLNHTAEPSLQTLERQLAGRPEPLRAVQRLQGLLETLLGYTAAIPFWRNTAVSLEVLAEQVDLYDWYRWLGYLGLLLLDVIICLLVLVGLIRSSKGILVGVCLLGVLALVISWGALGLELAVSVGSSDFCVDPDAYVTKMVEEYSVLSGDILQYYLACSPRAANPFQQKLSGSHKALVEMQDVVAELLRTVPWEQPATKDPLLRVQEVLNGTEVNLQHLTALVDCRSLHLDYVQALTGFCYDGVEGLIYLALFSFVTALMFSSIVCSVPHTWQQKRGPDEDGEEEAAPGPRQAHDSLYRVHMPSLYSCGSSYGSETSIPAAAHTVSNAPVTEYMSQNANFQNPRCENTPLIGRESPPPSYTSSMRAKYLATSQPRPDSSGSH

SEQ ID NO: 910997 - protein, 245 aa, Homo sapiens
VLLVSPRWRVLGRERRADPAAPMDLVSSLEQKLSGSHKALVEMQDVVAELLRTVPWEQPATKDPLLRVQEVLNGTEVNLQHLTALVDCRSLHLDYVQALTGFCYDGVEGLIYLALFSFVTALMFSSIVCSVPHTWQQKRGPDEDGEEEAAPGPRQAHDSLYRVHMPSLYSCGSSYGSETSIPAAAHTVSNAPVTEYMSQNANFQNPRCENTPLIGRESPPPSYTSSMRAKYLATSQPRPDSSGSH

SEQ ID NO: 910998 - protein, 192 aa, Homo sapiens
AVRAPQDPLLRVQEVLNGTEVNLQHLTALVDCRSLHLDYVQALTGFCYDGVEGLIYLALFSFVTALMFSSIVCSVPHTWQQKRGPDEDGEEEAAPGPRQAHDSLYRVHMPSLYSCGSSYGSETSIPAAAHTVSNAPVTEYMSQNANFQNPRCENTPLIGRESPPPSRYLAALDSGSHAGWQFKPMDSARTLW

SEQ ID NO: 910999 - protein, 207 aa, Homo sapiens
MAGVSYAAPWWVSLLHRLPHFDLSWEATSSQFRPEDTDYQQALLLLGAAALACLALDLLFLLFYSFWLCCRRRKSEEHLDADCCCTAWCVIIATLVCSAGIAVGFYGNGETSDGIHRATYSLRHAHPQAHPSCRLPEAPSSRASLRCPSFTLSLSTCPAGGPSPPWTAGATWSPGRSPATQCWPPSWCQTPFPHPETGQLCLVRSLH

SEQ ID NO: 911000 - protein, 523 aa, Homo sapiens; identical to SEQ ID NO: 910996

SEQ ID NO: 911001 - protein, 148 aa, Homo sapiens
ASYVIRSRPGLNQPRAWHCAWVKAGPCSGAGRQPQQFTDAWLFLPEQPAATWTGNVLIPSLGPGSALAFLCEPLLSLCWCLGPKRGNMGGQSGEGSPWAWGPKPGRLSSPGMTKPQWRGLCFRPRLADILSPPRRPRHSQPAQSFLWA

SEQ ID NO: 911002 - protein, 523 aa, Homo sapiens; identical to SEQ ID NO: 910996

SEQ ID NO: 911003 - protein, 526 aa, Homo sapiens
MAGVSYAAPWWVSLLHRLPHFDLSWEATSSQFRPEDTDYQQALLLLGAAALACLALDLLFLLFYSFWLCCRRRKSEEHLDADCCCTAWCVIIATLVCSAGIAVGFYGNGETSDGIHRATYSLRHANRTVAGVQDRVWDTAVGLNHTAEPSLQTLERQLAGRPEPLRAVQRLQGLLETLLGYTAAIPFWRNTAVSLEVLAEQVDLYDWYRWLGYLGLLLLDVIICLLVLVGLIRSSKGILVGVCLLGVLALVISWGALGLELAVSVGSSDFCVDPDAYVTKMVEEYSVLSGDILQYYLACSPRAANPFQQKLSGSHKALVEMQDVVAELLRTVPWEQPATKDPLLRVQEVLNGTEVNLQHLTALVDCRSLHLDYVQALTGFCYDGVEGLIYLALFSFVTALMFSSIVCSVPHTWQQKRGPDEDGEEEAAPGPRQAHDSLYRVHMPSLYSCGSSYGSETSIPAAAHTVSNAPVTEYMSQNANFQNPRCENTPLIGRESPPPSRYLAALDSGSHAGWQFKPMDSARTLW

SEQ ID NO: 911004 - protein, 121 aa, Homo sapiens
MPKCRWCGHGRLCVRPSSEETSPVLSLESSGAAPPSASARPRAQGPPASGPSLAPPYRLCQGTLYCPILPPGLLAQPSEDHAEGAPGCVRHAGALLMPPPCLPPVHLQHESQIPRHEPASP

SEQ ID NO: 911005 - protein, 130 aa, Homo sapiens
LQAQGQHMPGCRGHRALPRATPQPCPLLTSQCPRHPCQAREVLLWPRVYWDPIGSNLIWDRVRLQAPALWLAGCFQSWWGFGGCILGAAGQSGESGLTVGGGIPHGCRLWLWGCRGLEKEGVAQGRDQEP

SEQ ID NO: 911006 - protein, 244 aa, Homo sapiens
ALSVGVLEISVLAHVLSDRGVADGVGRGRDAGLTAVAAATAVQAGHVDAVEAVVRLPRPWSDPLLRVQEVLNGTEVNLQHLTALVDCRSLHLDYVQALTGFCYDGVEGLIYLALFSFVTALMFSSIVCSVPHTWQQKRGPDEDGEEEAAPGPRQAHDSLYRVHMPSLYSCGSSYGSETSIPAAAHTVSNAPVTEYMSQNANFQNPRCENTPLIGRESPPPSYTSSMRAKYLATSQPRPDSSGSH

SEQ ID NO: 911007 - protein, 191 aa, Homo sapiens [sequence omitted]

SEQ ID NO: 911008 - protein, 523 aa, Homo sapiens; identical to SEQ ID NO: 910996

SEQ ID NO: 911009 - protein, 523 aa, Homo sapiens; identical to SEQ ID NO: 910996

SEQ ID NO: 911010 - protein, 523 aa, Homo sapiens; identical to SEQ ID NO: 910996

SEQ ID NO: 911011 - protein, 307 aa, Homo sapiens
MAGVSYAAPWWVSLLHRLPHFDLSWEATSSQFRPEDTDYQQALLLLGAAALACLALDLLFLLFYSFWLCCRRRKSEEHLDADCCCTAWCVIIATLVCSAGIAVGFYGNGETSDGIHRATYSLRHANRTVAGVQDRVWDTAVGLNHTAEPSLQTLERQLAGRPEPLRAVQRLQGLLETLLGYTAAIPFWRNTAVSLEVLAEQVDLYDWYRWLGYLGLLLLDVIICLLVLVGLIRSSKGILVGVCLLGVLALVISWGALGLELAVSVGSSDFCVDPDAYVTKMVEEYSVLSGASCSTTMPTTPCRTDPQ

SEQ ID NO: 911012 - protein, 282 aa, Homo sapiens
MRPQDGIGEEVLKMSTEEIIQRTRLLDSEIKIMKSEVLRVTHELQAMKDKIKENSEKIKVNKTLPYLVSNVIELLDVDPNDQEEDGANIDLDSQRKGKCAVIKTSTRQTYFLPVIGLVDAEKLKPGDLVGVNKDSYLILETLPTEYDSRVKAMEVDERPTEQYSDIGGLDKQIQELVEAIVLPMNHKEKFENLGIQPPKGVLMYGPPGTGKTLLARACAAQTKATFLKLAGPQLVQMFIGDGAKLVRDAFALAKEKAPSIIFIDELDAIGTKRKLEVKGGRV

SEQ ID NO: 911013 - protein, 504 aa, Homo sapiens
CGQGLVFGIGEADSLLRSTAGAGRVKSRDLWGEVFHWSREGFKKDGINLPLRLPPGPIFCPLLQEMNLLPNIESPVTRQEKMATVWDEAEQDGIGEEVLKMSTEEIIQRTRLLDSEIKIMKSEVLRVTHELQAMKDKIKENSEKIKVNKTLPYLVSNVIELLDVDPNDQEEDGANIDLDSQRKGKCAVIKTSTRQTYFLPVIGLVDAEKLKPGDLVGVNKDSYLILETLPTEYDSRVKAMEVDERPTEQYSDIGGLDKQIQELVEAIVLPMNHKEKFENLGIQPPKGVLMYGPPGTGKTLLARACAAQTKATFLKLAGPQLVQMFIGDGAKLVRDAFALAKEKAPSIIFIDELDAIGTKRFDSEKAGDREVQRTMLELLNQLDGFQPNTQVKVIAATNRVDILDPALLRSGRLDRKIEFPMPNEEARARIMQIHSRKMNVSPDVNYEELARCTDDFNGAQCKAVCVEAGMIALRRGATELTHEDYMEGILEVQAKKKANLQYYA

SEQ ID NO: 911014 - protein, 423 aa, Homo sapiens
MATVWDEAEQDGIGEEVLKMSTEEIIQRTRLLDSEIKIMKSEVLRVTHELQAMKDKIKENSEKIKVNKTLPYLVSNVIELLDVDPNDQEEDGANIDLDSQRKGKCAVIKTSTRQTYFLPVIGLVDAEKLKPGDLVGVNKDSYLILETLPTEYDSRVKAMEVDERPTEQYSDIGGLDKQIQELVEAIVLPMNHKEKFENLGIQPPKGVLMYGPPGTGKTLLARACAAQTKATFLKLAGPQLVQMFIGDGAKLVRDAFALAKEKAPSIIFIDELDAIGTKRFDSEKAGDREVQRTMLELLNQLDGFQPNTQVKVIAATNRVDILDPALLRSGRLDRKIEFPMPNEEARARIMQIHSRKMNVSPDVNYEELARCTDDFNGAQCKAVCVEAGMIALRRGATELTHEDYMEGILEVQAKKKANLQYYA

SEQ ID NO: 911015 - protein, 487 aa, Homo sapiens
CGQGLVFGIGEADSLLRSTAGAGRVKSRDLWGEVFHWSREGFKKDGINLPLRLPPGPIFCPLLQEMNLLPNIESPVTRQEKMATVWDEAEQDGIGEEVLKMSTEEIIQRTRLLDSEIKIMKSEVLRVTHELQAMKDKIKENSEKIKVNKTLPYLVSNVIELLDVDPNDQEEDGANIDLDSQRKGKCAVIKTSTRQTYFLPVIGLVDAEKLKPGDLVGVNKDSYLILETLPTEYDSRVKAMEVDERPTEQYSDIGGLDKQIQELVEAIVLPMNHKEKFENLGIQPPKGVLMYGPPGTGKTLLARACAAQTKATFLKLAGPQLVQMFIGDGAKLVRDAFALAKEKAPSIIFIDELDAIGTKRFDSEKAGDREVQRTMLELLNQLDGFQPNTQVKVIAATNRVDILDPALLRSGRLDRKIEFPMPNEEARARIMQIHSRKMNVSPDVNYEELARCTDDFNGAQCKAVCVEAGMIALRRGATELTHESSGR

SEQ ID NO: 911016 - protein, 408 aa, Homo sapiens
CGQGLVFGIGEADSLLRSTAGAGRVKSRDLWGEVFHWSREGFKKDGINLPLRLPPGPIFCPLLQEMNLLPNIESPVTRQEKMATVWDEAEQDGIGEEVLKMSTEEIIQRTRLLDSEIKIMKSEVLRVTHELQAMKDKIKENSEKIKVNKTLPYLVSNVIELLDVDPNDQEEDGANIDLDSQRKGKCAVIKTSTRQTYFLPVIGLVDAEKLKPGDLVGVNKDSYLILETLPTEYDSRVKAMEVDERPTEQYSDIGGLDKQIQELVEAIVLPMNHKEKFENLGIQPPKGVLMYGPPGTGKTLLARACAAQTKATFLKLAGPQLVQMFIGDGAKLVRDAFALAKEKAPSIIFIDELDAIGTKRFDSEKAGDREVQRTMLELLNQLDGFQPNTQVKVIAASSVVDSSPGVSR

SEQ ID NO: 911017 - protein, 373 aa, Homo sapiens
CGQGLVFGIGEADSLLRSTAGAGRVKSRDLWGEVFHWSREGFKKDGINLPLRLPPGPIFCPLLQEMNLLPNIESPVTRQEKMATVWDEAEQDGIGEEVLKMSTEEIIQRTRLLDSEIKIMKSEVLRVTHELQAMKDKIKENSEKIKVNKTLPYLVSNVIELLDVDPNDQEEDGANIDLDSQRKGKCAVIKTSTRQTYFLPVIGLVDAEKLKPGDLVGVNKDSYLILETLPTEYDSRVKAMEVDERPTEQYSDIGGLDKQIQELVEAIVLPMNHKEKFENLGIQPPKGVLMYGPPGTGKTLLARACAAQTKATFLKLAGPQLVQMFIGDGAKLVRDAFALAKEKAPSIIFIDELDAIGTKRTPPSSARAALTAR

SEQ ID NO: 911018 - protein, 369 aa, Homo sapiens
CGQGLVFGIGEADSLLRSTAGAGRVKSRDLWGEVFHWSREGFKKDGINLPLRLPPGPIFCPLLQEMNLLPNIESPVTRQEKMATVWDEAEQDGIGEEVLKMSTEEIIQRTRLLDSEIKIMKSEVLRVTHELQAMKDKIKENSEKIKVNKTLPYLVSNVIELLDVDPNDQEEDGANIDLDSQRKGKCAVIKTSTRQTYFLPVIGLVDAEKLKPGDLVGVNKDSYLILETLPTEYDSRVKAMEVDERPTEQYSDIGGLDKQIQELVEAIVLPMNHKEKFENLGIQPPKGVLMYGPPGTGKTLLARACAAQTKATFLKLAGPQLVQMFIGDGAKLVRDAFALAKEKAPSIIFIDELDAIGTKRKLEVKGGRV

SEQ ID NO: 911019 - protein, 426 aa, Homo sapiens
PVVLAISGRMRPQDGIGEEVLKMSTEEIIQRTRLLDSEIKIMKSEVLRVTHELQAMKDKIKENSEKIKVNKTLPYLVSNVIELLDVDPNDQEEDGANIDLDSQRKGKCAVIKTSTRQTYFLPVIGLVDAEKLKPGDLVGVNKDSYLILETLPTEYDSRVKAMEVDERPTEQYSDIGGLDKQIQELVEAIVLPMNHKEKFENLGIQPPKGVLMYGPPGTGKTLLARACAAQTKATFLKLAGPQLVQMFIGDGAKLVRDAFALAKEKAPSIIFIDELDAIGTKRFDSEKAGDREVQRTMLELLNQLDGFQPNTQVKVIAATNRVDILDPALLRSGRLDRKIEFPMPNEEARARIMQIHSRKMNVSPDVNYEELARCTDDFNGAQCKAVCVEAGMIALRRGATELTHEDYMEGILEVQAKKKANLQYYA

SEQ ID NO: 911020 - protein, 417 aa, Homo sapiens
MRPQDGIGEEVLKMSTEEIIQRTRLLDSEIKIMKSEVLRVTHELQAMKDKIKENSEKIKVNKTLPYLVSNVIELLDVDPNDQEEDGANIDLDSQRKGKCAVIKTSTRQTYFLPVIGLVDAEKLKPGDLVGVNKDSYLILETLPTEYDSRVKAMEVDERPTEQYSDIGGLDKQIQELVEAIVLPMNHKEKFENLGIQPPKGVLMYGPPGTGKTLLARACAAQTKATFLKLAGPQLVQMFIGDGAKLVRDAFALAKEKAPSIIFIDELDAIGTKRFDSEKAGDREVQRTMLELLNQLDGFQPNTQVKVIAATNRVDILDPALLRSGRLDRKIEFPMPNEEARARIMQIHSRKMNVSPDVNYEELARCTDDFNGAQCKAVCVEAGMIALRRGATELTHEDYMEGILEVQAKKKANLQYYA

SEQ ID NO: 911021 - protein, 426 aa, Homo sapiens
HAYAHAVGGMRPQDGIGEEVLKMSTEEIIQRTRLLDSEIKIMKSEVLRVTHELQAMKDKIKENSEKIKVNKTLPYLVSNVIELLDVDPNDQEEDGANIDLDSQRKGKCAVIKTSTRQTYFLPVIGLVDAEKLKPGDLVGVNKDSYLILETLPTEYDSRVKAMEVDERPTEQYSDIGGLDKQIQELVEAIVLPMNHKEKFENLGIQPPKGVLMYGPPGTGKTLLARACAAQTKATFLKLAGPQLVQMFIGDGAKLVRDAFALAKEKAPSIIFIDELDAIGTKRFDSEKAGDREVQRTMLELLNQLDGFQPNTQVKVIAATNRVDILDPALLRSGRLDRKIEFPMPNEEARARIMQIHSRKMNVSPDVNYEELARCTDDFNGAQCKAVCVEAGMIALRRGATELTHEDYMEGILEVQAKKKANLQYYA

SEQ ID NO: 911022 - protein, 405 aa, Homo sapiens
HAYAHAVGGMRPQDGIGEEVLKMSTEEIIQRTRLLDSEIKIMKSEVLRVTHELQAMKDKIKENSEKIKVNKTLPYLVSNVIELLDVDPNDQEEDGANIDLDSQRKGKCAVIKTSTRQTYFLPVIGLVDAEKLKPGDLVGVNKDSYLILETLPTEYDSRVKAMEVDERPTEQYSDIGGLDKQIQELVEAIVLPMNHKEKFENLGIQPPKGVLMYGPPGTGKTLLARACAAQTKLVRDAFALAKEKAPSIIFIDELDAIGTKRFDSEKAGDREVQRTMLELLNQLDGFQPNTQVKVIAATNRVDILDPALLRSGRLDRKIEFPMPNEEARARIMQIHSRKMNVSPDVNYEELARCTDDFNGAQCKAVCVEAGMIALRRGATELTHEDYMEGILEVQAKKKANLQYYA

SEQ ID NO: 911023 - protein, 149 aa, Homo sapiens
DIKKPAEDEWGKTPDAMKAAMALEKKLNQALLDLHALGSARTDPHLCDDPALLRSGRLDRKIEFPMPNEEARARIMQIHSRKMNVSPDVNYEELARCTDDFNGAQCKAVCVEAGMIALRRGATELTHEDYMEGILEVQAKKKANLQYYA

SEQ ID NO: 911024 - protein, 332 aa, Homo sapiens
PVVLAISGRMRPQDGIGEEVLKMSTEEIIQRTRLLDSEIKIMKSEVLRVTHELQAMKDKIKENSEKIKVNKTLPYLVSNVIELLDVDPNDQEEDGANIDLDSQRKGKCAVIKTSTRQTYFLPVIGLVDAEKLKPGDLVGVNKDSYLILETLPTEYDSRVKAMEVDERPTEQYSDIGGLDKQIQELVEAIVLPMNHKEKFENLGIQPPKGVLMYGPPGTGKTLLARACAAQTKATFLKLAGPQLVQMFIGDGAKLVRDAFALAKEKAPSIIFIDELDAIGTKRFDSEKAGDREVQRTMLELLNQLDGFQPNTQVKVLQHKQGGHLDPPPRSAA

SEQ ID NO: 911025 - protein, 504 aa, Homo sapiens; identical to SEQ ID NO: 911013

SEQ ID NO: 911026 - protein, 504 aa, Homo sapiens; identical to SEQ ID NO: 911013

SEQ ID NO: 911027 - protein, 430 aa, Homo sapiens
CGQGLVFGIGEADSLLRSTAGAGRVKSRDLWGEVFHWSREGFKKDGINLPLRLPPGPIFCPLLQEMNLLPNIESPVTRQEKMATVWDEAEQDGIGEEVLKMSTEEIIQRTRLLDSEIKIMKSEVLRVTHELQAMKDKIKENSEKIKVNKTLPYLVSNVIELLDVDPNDQEEDGANIDLDSQRKGKCAVIKTSTRQTYFLPVIGLVDAEKLKPGDLVGVNKDSYLILETLPTEYDSRVKAMEVDERPTEQYSDIGGLDKQIQELVEAIVLPMNHKEKFENLGIQPPKGVLMYGPPGTGKTLLARACAAQTKATFLKLAGPQLVQMFIGDGAKLVRDAFALAKEKAPSIIFIDELDAIGTKRFDSEKAGDREVQRTMLELLNQLDGFQPNTQVKVLQHNRVDIWTRLLVGRLTQMSPSHEEPANRTSEIVAE

SEQ ID NO: 911028 - protein, 413 aa, Homo sapiens
CGQGLVFGIGEADSLLRSTAGAGRVKSRDLWGEVFHWSREGFKKDGINLPLRLPPGPIFCPLLQEMNLLPNIESPVTRQEKMATVWDEAEQDGIGEEVLKMSTEEIIQRTRLLDSEIKIMKSEVLRVTHELQAMKDKIKENSEKIKVNKTLPYLVSNVIELLDVDPNDQEEDGANIDLDSQRKGKCAVIKTSTRQTYFLPVIGLVDAEKLKPGDLVGVNKDSYLILETLPTEYDSRVKAMEVDERPTEQYSDIGGLDKQIQELVEAIVLPMNHKEKFENLGIQPPKGVLMYGPPGTGKTLLARACAAQTKATFLKLAGPQLVQMFIGDGAKLVRDAFALAKEKAPSIIFIDELDAIGTKRLFVPAVGHDRTAQGCHGAHPRGLHGRHPGGAGQEESQPTILRLGHTGQPQSHG

SEQ ID NO: 911029 - protein, 483 aa, Homo sapiens
CGQGLVFGIGEADSLLRSTAGAGRVKSRDLWGEVFHWSREGFKKDGINLPLRLPPGPIFCPLLQEMNLLPNIESPVTRQEKMATVWDEAEQDGIGEEVLKMSTEEIIQRTRLLDSEIKIMKSEVLRVTHELQAMKDKIKENSEKIKVNKTLPYLVSNVIELLDVDPNDQEEDGANIDLDSQRKGKCAVIKTSTRQTYFLPVIGLVDAEKLKPGDLVGVNKDSYLILETLPTEYDSRVKAMEVDERPTEQYSDIGGLDKQIQELVEAIVLPMNHKEKFENLGIQPPKGVLMYGPPGTGKTLLARACAAQTKLVRDAFALAKEKAPSIIFIDELDAIGTKRFDSEKAGDREVQRTMLELLNQLDGFQPNTQVKVIAATNRVDILDPALLRSGRLDRKIEFPMPNEEARARIMQIHSRKMNVSPDVNYEELARCTDDFNGAQCKAVCVEAGMIALRRGATELTHEDYMEGILEVQAKKKANLQYYA

SEQ ID NO: 911030 - protein, 451 aa, Homo sapiens
MATVWDEAEVGTGRAGGPGTGARRETPLTRGKEVAGQQDGIGEEVLKMSTEEIIQRTRLLDSEIKIMKSEVLRVTHELQAMKDKIKENSEKIKVNKTLPYLVSNVIELLDVDPNDQEEDGANIDLDSQRKGKCAVIKTSTRQTYFLPVIGLVDAEKLKPGDLVGVNKDSYLILETLPTEYDSRVKAMEVDERPTEQYSDIGGLDKQIQELVEAIVLPMNHKEKFENLGIQPPKGVLMYGPPGTGKTLLARACAAQTKATFLKLAGPQLVQMFIGDGAKLVRDAFALAKEKAPSIIFIDELDAIGTKRFDSEKAGDREVQRTMLELLNQLDGFQPNTQVKVIAATNRVDILDPALLRSGRLDRKIEFPMPNEEARARIMQIHSRKMNVSPDVNYEELARCTDDFNGAQCKAVCVEAGMIALRRGATELTHEDYMEGILEVQAKKKANLQYYA

SEQ ID NO: 911031 - protein, 483 aa, Homo sapiens
CGQGLVFGIGEADSLLRSTAGAGRVKSRDLWGEVFHWSREGFKKDGINLPLRLPPGPIFCPLLQEMNLLPNIESPVTRQEKMATVWDEAEQDGIGEEVLKMSTEEIIQRTRLLDSEIKIMKSEVLRVTHELQAMKDKIKENSEKIKVNKTLPYLVSNVIELLDVDPNDQEEDGANIDLDSQRKGKCAVIKTSTRQGVNKDSYLILETLPTEYDSRVKAMEVDERPTEQYSDIGGLDKQIQELVEAIVLPMNHKEKFENLGIQPPKGVLMYGPPGTGKTLLARACAAQTKATFLKLAGPQLVQMFIGDGAKLVRDAFALAKEKAPSIIFIDELDAIGTKRFDSEKAGDREVQRTMLELLNQLDGFQPNTQVKVIAATNRVDILDPALLRSGRLDRKIEFPMPNEEARARIMQIHSRKMNVSPDVNYEELARCTDDFNGAQCKAVCVEAGMIALRRGATELTHEDYMEGILEVQAKKKANLQYYA

SEQ ID NO: 911032 - protein, 266 aa, Homo sapiens
CGQGLVFGIGEADSLLRSTAGAGRVKSRDLWGEVFHWSREGFKKDGINLPLRLPPGPIFCPLLQEMNLLPNIESPVTRQEKMATVWDEAEQDGIGEEVLKMSTEEIIQRTRLLDSEIKIMKSEVLRVTHELQAMKDKIKENSEKIKVNKTLPYLVSNVIELLDVDPNDQEEDGANIDLDSQRKGKCAVIKTSTRQTYFLPVIGLVDAEKLKPGDLVGVNKDSYLILETLPTEYDSRVKPEGHKARTYRTWGGNHRPRACRRPGLMG

SEQ ID NO: 911033 - protein, 219 aa, Homo sapiens
SGLPAGPPSGRRDGSRLQSARPPRAGAESRSAPATRRPGALERTRGAMRRQPAKVAALLLGLLLECTEAKKHCWYFEGLYPTYYICRSYEDCCGSRCCVRALSIQRLWYFWFLLMMGVLFCCGAGFFIRRRMYPPPLIEEPAFNVSYTRQPPNPGPGAQQPGPPYYTDPGGPGMNPVGNSMAMAFQVPPNSPQGSVACPPPPAYCNTPPPPYEQVVKAK

SEQ ID NO: 911034 - protein, 219 aa, Homo sapiens; identical to SEQ ID NO: 911033

SEQ ID NO: 911035 - protein, 219 aa, Homo sapiens; identical to SEQ ID NO: 911033

SEQ ID NO: 911036 - protein, 219 aa, Homo sapiens; identical to SEQ ID NO: 911033

SEQ ID NO: 911037 - protein, 219 aa, Homo sapiens; identical to SEQ ID NO: 911033

SEQ ID NO: 911038 - protein, 215 aa, Homo sapiens
SGLPAGPPSGRRDGSRLQSARPPRAGAESRSAPATRRPGALERTRGAMRRQPAKVAALLLGLLLECTEAKKHCWYFEGLYPTYYICRSYEDCCGSRCCVRALSIQRLWYFWFLLMMGVLFCCGAGFFIRRRMYPPPLIEEPAFNVSYTRQPPNPGPGAQQPGPPYYTDPGGPGMNPVGNSMAMAFQVPPNSPQGSVACPPPPAYCNTPPPPYELG

SEQ ID NO: 911039 - protein, 219 aa, Homo sapiens; identical to SEQ ID NO: 911033

SEQ ID NO: 911040 - protein, 219 aa, Homo sapiens; identical to SEQ ID NO: 911033

SEQ ID NO: 911041 - protein, 219 aa, Homo sapiens; identical to SEQ ID NO: 911033

SEQ ID NO: 911042 - protein, 219 aa, Homo sapiens; identical to SEQ ID NO: 911033

SEQ ID NO: 911043 - protein, 44 aa, Homo sapiens
GAGFFIRRRMYPPPLIEEPAFNVSYTRQPPNPGPGQPALSLSLL

SEQ ID NO: 911044 - protein, 70 aa, Homo sapiens
HPGRCLNLFRLPKWPQEKGPQAPHCICANGRQTVSWAVTPKSLGNVNFTVSAEALESLASFPLKPNSENA

SEQ ID NO: 911045 - protein, 155 aa, Homo sapiens
PLFSFPLYSLSYVWFQVSVQLEASPAFLAVPVEKEQAPHCICANGRQTVSWAVTPKSLGNVNFTVSAEALESQELCGTEVPSVPEHGRKDTVIKPLLVEPEGLEKETTFNSLLCPSGGEVSEELSLKLPPNVVEESARASVSVLGESPAPSGSGH

SEQ ID NO: 911046 - protein, 688 aa, Homo sapiens
MGKNKLLHPSLVLLLLVLLPTDASVSGKPQYMVLVPSLLHTETTEKGCVLLSYLNETVTVSASLESVRGNRSLFTDLEAENDVLHCVAFAVPKSSSNEEVMFLTVQVKGPTQEFKKRTTVMVKNEDSLVFVQTDKSIYKPGQTVKFRVVSMDENFHPLNELIPLVYIQDPKGNRIAQWQSFQLEGGLKQFSFPLSSEPFQGSYKVVVQKKSGGRTEHPFTVEEFVLPKFEVQVTVPKIITILEEEMNVSVCGLYTYGKPVPGHVTVSICRKYSDASDCHGEDSQAFCEKFSGQLNSHGCFYQQVKTKVFQLKRKEYEMKLHTEAQIQEEGTVVELTGRQSSEITRTITKLSFVKVDSHFRQGIPFFGQVRLVDGKGVPIPNKVIFIRGNEANYYSNATTDEHGLVQFSINTTNVMGTSLTVRVNYKDRSPCYGYQWVSEEHEEAHHTAYLVFSPSKSFVHLEPMSHELPCGHTQTVQAHYILNGGTLLGLKKLSFYYLIMAKGGIVRTGTHGLLVKQEDMKGHFSISIPVKSDIAPVARLLIYAVLPTGDVIGDSAKYDVENCLANKVDLSFSPSQSLPASHAHLRVTAAPQSVCALRAVDQSVLLMKPDAELSASSVYNLLPEKDLTGFPGPLNDQDDEDCINRHNVYINGITYTPVSSTNEKDMYSFLEDMGLKAFTNSKIRKPKM

SEQ ID NO: 911047 - protein, 1364 aa, Homo sapiens
MGKNKLLHPSLVLLLLVLLPTDASVSGKPQYMVLVPSLLHTETTEKGCVLLSYLNETVTVSASLESVRGNRSLFTDLEAENDVLHCVAFAVPKSSSNEEVMFLTVQVKGPTQEFKKRTTVMVKNEDSLVFVQTDKSIYKPGQTVKFRVVSMDENFHPLNELIPLVYIQDPKGNRIAQWQSFQLEGGLKQFSFPLSSEPFQGSYKVVVQKKSGGRTEHPFTVEEFVLPKFEVQVTVPKIITILEEEMNVSVCGLYTYGKPVPGHVTVSICRKYSDASDCHGEDSQAFCEKFSGQLNSHGCFYQQVKTKVFQLKRKEYEMKLHTEAQIQEEGTVVELTGRQSSEITRTITKLSFVKVDSHFRQGIPFFGQVRLVDGKGVPIPNKVIFIRGNEANYYSNATTDEHGLVQFSINTTNVMGTSLTVRVNYKDRSPCYGYQWVSEEHEEAHHTAYLVFSPSKSFVHLEPMSHELPCGHTQTVQAHYILNGGTLLGLKKLSFYYLIMAKGGIVRTGTHGLLVKQEDMKGHFSISIPVKSDIAPVARLLIYAVLPTGDVIGDSAKYDVAASHAHLRVTAAPQSVCALRAVDQSVLLMKPDAELSASSVYNLLPEKDLTGFPGPLNDQDDEDCINRHNVYINGITYTPVSSTNEKDMYSFLEDMGLKAFTNSKIRKPKMCPQLQQYEMHGPEGLRVGFYESDVMGRGHARLVHVEEPHTETVRKYFPETWIWDLVVVNSAGVAEVGVTVPDTITEWKAGAFCLSEDAGLGISSTASLRAFQPFFVELTMPYSVIRGEAFTLKATVLNYLPKCIRVSVQLEASPAFLAVPVEKEQAPHCICANGRQTVSWAVTPKSLGNVNFTVSAEALESQELCGTEVPSVPEHGRKDTVIKPLLVEPEGLEKETTFNSLLCPSGGEVSEELSLKLPPNVVEESARASVSVLGDILGSAMQNTQNLLQMPYGCGEQNMVLFAPNIYVLDYLNETQQLTPEIKSKAIGYLNTGYQRQLNYKHYDGSYSTFGERYGRNQGNTWLTAFVLKTFAQARAYIFIDEAHITQALIWLSQRQKDNGCFRSSGSLLNNAIKGGVEDEVTLSAYITIALLEIPLTVTHPVVRNALFCLESAWKTAQEGDHGSHVYTKALLAYAFALAGNQDKRKEVLKSLNEEAVKKDNSVHWERPQKPKAPVGHFYEPQAPSAEVEMTSYVLLAYLTAQPAPTSEDLTSATNIVKWITKQQNAQGGFSSTQDTVVALHALSKYGAATFTRTGKAAQVTIQSSGTFSSKFQVDNNNRLLLQQVSLPELPGEYSMKVTGEGCVYLQTSLKYNILPEKEEFPFALGVQTLPQTCDEPKAPHQLPNLPKCQLHREAALPSQHGDR

SEQ ID NO: 911048 - protein, 875 aa, Homo sapiens
MDARIAGEARKTLKGHFSISIPVKSDIAPVARLLIYAVLPTGDVIGDSAKYDVENCLANKVDLSFSPSQSLPASHAHLRVTAAPQSVCALRAVDQSVLLMKPDAELSASSVYNLLPEKDLTGFPGPLNDQDDEDCINRHNVYINGITYTPVSSTNEKDMYSFLEDMGLKAFTNSKIRKPKMCPQLQQYEMHGPEGLRVGFYESDVMGRGHARLVHVEEPHTETVRKYFPETWIWDLVVVNSAGVAEVGVTVPDTITEWKAGAFCLSEDAGLGISSTASLRAFQPFFVELTMPYSVIRGEAFTLKATVLNYLPKCIRVSVQLEASPAFLAVPVEKEQAPHCICANGRQTVSWAVTPKSLGNVNFTVSAEALESQELCGTEVPSVPEHGRKDTVIKPLLVEPEGLEKETTFNSLLCPSGGEVSEELSLKLPPNVVEESARASVSVLGDILGSAMQNTQNLLQMPYGCGEQNMVLFAPNIYVLDYLNETQQLTPEIKSKAIGYLNTGYQRQLNYKHYDGSYSTFGERYGRNQGNTWLTAFVLKTFAQARAYIFIDEAHITQALIWLSQRQKDNGCFRSSGSLLNNAIKGGVEDEVTLSAYITIALLEIPLTVTHPVVRNALFCLESAWKTAQEGDHGSHVYTKALLAYAFALAGNQDKRKEVLKSLNEEAVKKDNSVHWERPQKPKAPVGHFYEPQAPSAEVEMTSYVLLAYLTAQPAPTSEDLTSATNIVKWITKQQNAQGGFSSTQDTVVALHALSKYGAATFTRTGKAAQVTIQSSGTFSSKFQVDNNNRLLLQQVSLPELPGEYSMKVTGEGCVYLQTSLKYNILPEKEEFPFALGVQTLPQTCDEPKAPHQLPNLPKCQLHREAALPSQHGDR

SEQ ID NO: 911049 - protein, 798 aa, Homo sapiens
MALLQLNQSVCALRAVDQSVLLMKPDAELSASSVYNLLPEKDLTGFPGPLNDQDDEDCINRHNVYINGITYTPVSSTNEKDMYSFLEDMGLKAFTNSKIRKPKMCPQLQQYEMHGPEGLRVGFYESDVMGRGHARLVHVEEPHTETVRKYFPETWIWDLVVVNSAGVAEVGVTVPDTITEWKAGAFCLSEDAGLGISSTASLRAFQPFFVELTMPYSVIRGEAFTLKATVLNYLPKCIRVSVQLEASPAFLAVPVEKEQAPHCICANGRQTVSWAVTPKSLGNVNFTVSAEALESQELCGTEVPSVPEHGRKDTVIKPLLVEPEGLEKETTFNSLLCPSGGEVSEELSLKLPPNVVEESARASVSVLGDILGSAMQNTQNLLQMPYGCGEQNMVLFAPNIYVLDYLNETQQLTPEIKSKAIGYLNTGYQRQLNYKHYDGSYSTFGERYGRNQGNTWLTAFVLKTFAQARAYIFIDEAHITQALIWLSQRQKDNGCFRSSGSLLNNAIKGGVEDEVTLSAYITIALLEIPLTVTHPVVRNALFCLESAWKTAQEGDHGSHVYTKALLAYAFALAGNQDKRKEVLKSLNEEAVKKDNSVHWERPQKPKAPVGHFYEPQAPSAEVEMTSYVLLAYLTAQPAPTSEDLTSATNIVKWITKQQNAQGGFSSTQDTVVALHALSKYGAATFTRTGKAAQVTIQSSGTFSSKFQVDNNNRLLLQQVSLPELPGEYSMKVTGEGCVYLQTSLKYNILPEKEEFPFALGVQTLPQTCDEPKAPHQLPNLPKCQLHREAALPSQHGDR

SEQ ID NO: 911050 - protein, 639 aa, Homo sapiens
VVIAEFQRDPMLYHMTLTITEWKAGAFCLSEDAGLGISSTASLRAFQPFFVELTMPYSVIRGEAFTLKATVLNYLPKCIRVSVQLEASPAFLAVPVEKEQAPHCICANGRQTVSWAVTPKSLGNVNFTVSAEALESQELCGTEVPSVPEHGRKDTVIKPLLVEPEGLEKETTFNSLLCPSGGEVSEELSLKLPPNVVEESARASVSVLGDILGSAMQNTQNLLQMPYGCGEQNMVLFAPNIYVLDYLNETQQLTPEIKSKAIGYLNTGYQRQLNYKHYDGSYSTFGERYGRNQGNTWLTAFVLKTFAQARAYIFIDEAHITQALIWLSQRQKDNGCFRSSGSLLNNAIKGGVEDEVTLSAYITIALLEIPLTVTHPVVRNALFCLESAWKTAQEGDHGSHVYTKALLAYAFALAGNQDKRKEVLKSLNEEAVKKDNSVHWERPQKPKAPVGHFYEPQAPSAEVEMTSYVLLAYLTAQPAPTSEDLTSATNIVKWITKQQNAQGGFSSTQDTVVALHALSKYGAATFTRTGKAAQVTIQSSGTFSSKFQVDNNNRLLLQQVSLPELPGEYSMKVTGEGCVYLQTSLKYNILPEKEEFPFALGVQTLPQTCDEPKAPHQLPNLPKCQLHREAALPSQHGDR

SEQ ID NO: 911051 - protein, 1382 aa, Homo sapiens
MGKNKLLHPSLVLLLLVLLPTDASVSGKPQYMVLVPSLLHTETTEKGCVLLSYLNETVTVSASLESVRGNRSLFTDLEAENDVLHCVAFAVPKSSSNEEVMFLTVQVKGPTQEFKKRTTVMVKNEDSLVFVQTDKSIYKPGQTVKFRVVSMDENFHPLNELIPLVYIQDPKGNRIAQWQSFQLEGGLKQFSFPLSSEPFQGSYKVVVQKKSGGRTEHPFTVEEFVLPKFEVQVTVPKIITILEEEMNVSVCGLYTYGKPVPGHVTVSICRKYSDASDCHGEDSQAFCEKFSGQLNSHGCFYQQVKTKVFQLKRKEYEMKLHTEAQIQEEGTVVELTGRQSSEITRTITKLSFVKVDSHFRQGIPFFGQVRLVDGKGVPIPNKVIFIRGNEANYYSNATTDEHGLVQFSINTTNVMGTSLTVRVNYKDRSPCYGYQWVSEEHEEAHHTAYLVFSPSKSFVHLEPMSHELPCGHTQTVQAHYILNGGTLLGLKKLSFYYLIMAKGGIVRTGTHGLLVKQEDMKGHFSISIPVKSDIAPVARLLIYAVLPTGDVIGDSAKYDVENCLANKVDLSFSPSQSLPASHAHLRVTAAPQSVCALRAVDQSVLLMKPDAELSASSVYNLLPEKDLTGFPGPLNDQDDEDCINRHNVYINGITYTPVSSTNEKDMYSFLEDMGLKAFTNSKIRKPKMCPQLQQYEMHGPEGLRVGFYESDVMGRGHARLVHVEEPHTETVRKYFPETWIWDLVVVNSAGVAEVGVTVPDTITEWKAGAFCLSEDAGLGISSTASLRAFQPFFVELTMPYSVIRGEAFTLKATVLNYLPKCIRVSVQLEASPAFLAVPVEKEQAPHCICANGRQTVSWAVTPKSLGNVNFTVSAEALESQELCGTEVPSVPEHGRKDTVIKPLLVEPEGLEKETTFNSLLCPSGGEVSEELSLKLPPNVVEESARASVSVLGDILGSAMQNTQNLLQMPYGCGEQNMVLFAPNIYVLDYLNETQQLTPEIKSKAIGYLNTGYQRQLNYKHYDGSYSTFGERYGRNQGNTWLTAFVLKTFAQARAYIFIDEAHITQALIWLSQRQKDNGCFRSSGSLLNNAIKGGVEDEVTLSAYITIALLEIPLTVTHPVVRNALFCLESAWKTAQEGDHGSHVYTKALLAYAFALAGNQDKRKEVLKSLNEEAVKKDNSVHWERPQKPKAPVGHFYEPQAPSAEVEMTSYVLLAYLTAQPAPTSEDLTSATNIVKWITKQQNAQGGFSSTQDTVVALHALSKYGAATFTRTGKAAQVTIQSSGTFSSKFQVDNNNRLLLQQVSLPELPGEYSMKVTGEGCVYLQTSLKYNILPEKEEFPFALGVQTLPQTCDEPKAPHQLPNLPKCQLHREAALPSQHGDR

SEQ ID NO: 911052 - protein, 399 aa, Homo sapiens
GVCFIDEDVGSSLGKSLQNKAVSQVLPGYQRQLNYKHYDGSYSTFGERYGRNQGNTWLTAFVLKTFAQARAYIFIDEAHITQALIWLSQRQKDNGCFRSSGSLLNNAIKGGVEDEVTLSAYITIALLEIPLTVTHPVVRNALFCLESAWKTAQEGDHGSHVYTKALLAYAFALAGNQDKRKEVLKSLNEEAVKKDNSVHWERPQKPKAPVGHFYEPQAPSAEVEMTSYVLLAYLTAQPAPTSEDLTSATNIVKWITKQQNAQGGFSSTQDTVVALHALSKYGAATFTRTGKAAQVTIQSSGTFSSKFQVDNNNRLLLQQVSLPELPGEYSMKVTGEGCVYLQTSLKYNILPEKEEFPFALGVQTLPQTCDEPKAPHQLPNLPKCQLHREAALPSQHGDR

SEQ ID NO: 911053 - protein, 351 aa, Homo sapiens
EGGARGGTGTGRSSPSGRGQARAYIFIDEAHITQALIWLSQRQKDNGCFRSSGSLLNNAIKGGVEDEVTLSAYITIALLEIPLTVTHPVVRNALFCLESAWKTAQEGDHGSHVYTKALLAYAFALAGNQDKRKEVLKSLNEEAVKKDNSVHWERPQKPKAPVGHFYEPQAPSAEVEMTSYVLLAYLTAQPAPTSEDLTSATNIVKWITKQQNAQGGFSSTQDTVVALHALSKYGAATFTRTGKAAQVTIQSSGTFSSKFQVDNNNRLLLQQVSLPELPGEYSMKVTGEGCVYLQTSLKYNILPEKEEFPFALGVQTLPQTCDEPKAPHQLPNLPKCQLHREAALPSQHGDR

SEQ ID NO: 911054 - protein, 1382 aa, Homo sapiens; identical to SEQ ID NO: 911051

SEQ ID NO: 911055 - protein, 322 aa, Homo sapiens
MLLLALNRFLLPPRHSGGSPCSVQIWSSHIYQDWEGCTGDYPAFRDIFQQIPSGQQQHPVVRNALFCLESAWKTAQEGDHGSHVYTKALLAYAFALAGNQDKRKEVLKSLNEEAVKKDNSVHWERPQKPKAPVGHFYEPQAPSAEVEMTSYVLLAYLTAQPAPTSEDLTSATNIVKWITKQQNAQGGFSSTQDTVVALHALSKYGAATFTRTGKAAQVTIQSSGTFSSKFQVDNNNRLLLQQVSLPELPGEYSMKVTGEGCVYLQTSLKYNILPEKEEFPFALGVQTLPQTCDEPKAPHQLPNLPKCQLHREAALPSQHGDR

SEQ ID NO: 911056 - protein, 1382 aa, Homo sapiens; identical to SEQ ID NO: 911051

SEQ ID NO: 911057 - protein, 1382 aa, Homo sapiens; identical to SEQ ID NO: 911051

SEQ ID NO: 911058 - protein, 1382 aa, Homo sapiens; identical to SEQ ID NO: 911051

SEQ ID NO: 911059 - protein, 1382 aa, Homo sapiens; identical to SEQ ID NO: 911051

SEQ ID NO: 911060 - protein, 1382 aa, Homo sapiens; identical to SEQ ID NO: 911051

SEQ ID NO: 911061 - protein, 1374 aa, Homo sapiens
MGKNKLLHPSLVLLLLVLLPTDASVSGKPQYMVLVPSLLHTETTEKGCVLLSYLNETVTVSASLESVRGNRSLFTDLEAENDVLHCVAFAVPKSSSNEEVMFLTVQVKGPTQEFKKRTTVMVKNEDSLVFVQTDKSIYKPGQTVKFRVVSMDENFHPLNELIPLVYIQDPKGNRIAQWQSFQLEGGLKQFSFPLSSEPFQGSYKVVVQKKSGGRTEHPFTVEEFVLPKFEVQVTVPKIITILEEEMNVSVCGLYTYGKPVPGHVTVSICRKYSDASDCHGEDSQAFCEKFSGQLNSHGCFYQQVKTKVFQLKRKEYEMKLHTEAQIQEEGTVVELTGRQSSEITRTITKLSFVKVDSHFRQGIPFFGQVRLVDGKGVPIPNKVIFIRGNEANYYSNATTDEHGLVQFSINTTNVMGTSLTVRVNYKDRSPCYGYQWVSEEHEEAHHTAYLVFSPSKSFVHLEPMSHELPCGHTQTVQAHYILNGGTLLGLKKLSFYYLIMAKGGIVRTGTHGLLVKQEDMKGHFSISIPVKSDIAPVARLLIYAVLPTGDVIGDSAKYDVENCLANKVDLSFSPSQSLPASHAHLRVTAAPQSVCALRAVDQSVLLMKPDAELSASSVYNLLPEKDLTGFPGPLNDQDDEDCINRHNVYINGITYTPVSSTNEKDMYSFLEDMGLKAFTNSKIRKPKMCPQLQQYEMHGPEGLRVGFYESDVMGRGHARLVHVEEPHTETVRKYFPETWIWDLVVVNSAGVAEVGVTVPDTITEWKAGAFCLSEDAGLGISSTASLRAFQPFFVELTMPYSVIRGEAFTLKATVLNYLPKCIRVSVQLEASPAFLAVPVEKEQAPHCICANGRQTVSWAVTPKSLGNVNFTVSAEALESQELCGTEVPSVPEHGRKDTVIKPLLVEPEGLEKETTFNSLLCPSGGEVSEELSLKLPPNVVEESARASVSVLGDILGSAMQNTQNLLQMPYGCGEQNMVLFAPNIYVLDYLNETQQLTPEIKSKAIGYLNTGYQRQLNYKHYDGSYSTFGERYGRNQGNTWLTAFVLKTFAQARAYIFIDEAHITQALIWLSQRQKDNGCFRSSGSLLNNAIKGGVEDEVTLSAYITIALLEIPLTVTHPVVRNALFCLESAWKTAQEGDHGSHVYTKALLAYAFALAGNQDKRKEVLKSLNEEAVKKDNSVHWERPQKPKAPVGHFYEPQAPSAEVEMTSYVLLAYLTAQPAPTSEDLTSATNIVKWITKQQNAQGGFSSTQDTVVALHALSKYGAATFTRTGKAAQVTIQSSGTFSSKFQVDNNNRLLLQQVSLPELPGEYSMKVTGEGCVYLQTSLKYNILPEKEEFPFALGVQTLPQTCDEPKAPHQLPNLPKCQLHREPL

SEQ ID NO: 911062 - protein, 1331 aa, Homo sapiens
MGKNKLLHPSLVLLLLVLLPTDASVSGKPQYMVLVPSLLHTETTEKGCVLLSYLNETVTVSASLESVRGNRSLFTDLEAENDVLHCVAFAVPKSSSNEEVMFLTVQVKGPTQEFKKRTTVMVKNEDSLVFVQTDKSIYKPGQTVKFRVVSMDENFHPLNELIPLVYIQDPKGNRIAQWQSFQLEGGLKQFSFPLSSEPFQGSYKVVVQKKSGGRTEHPFTVEEFVLPKFEVQVTVPKIITILEEEMNVSVCGLYTYGKPVPGHVTVSICRKYSDASDCHGEDSQAFCEKFSGQLNSHGCFYQQVKTKVFQLKRKEYEMKLHTEAQIQEEGTVVELTGRQSSEITRTITKLSFVKVDSHFRQGIPFFGQVRLVDGKGVPIPNKVIFIRGNEANYYSNATTDEHGLVQFSINTTNVMGTSLTVRVNYKDRSPCYGYQWVSEEHEEAHHTAYLVFSPSKSFVHLEPMSHELPCGHTQTVQAHYILNGGTLLGLKKLSFYYLIMAKGGIVRTGTHGLLVKQEDMKGHFSISIPVKSDIAPVARLLIYAVLPTGDVIGDSAKYDVENCLANKVDLSFSPSQSLPASHAHLRVTAAPQSVCALRAVDQSVLLMKPDAELSASSVYNLLPEKDLTGFPGPLNDQDDEDCINRHNVYINGITYTPVSSTNEKDMYSFLEDMGLKAFTNSKIRKPKMCPQLQQYEMHGPEGLRVGFYESDVMGRGHARLVHVEEPHTETVRKYFPETWIWDLVVVNSAGVAEVGVTVPDTITEWKAGAFCLSEDAGLGISSTASLRAFQPFFVELTMPYSVIRGEAFTLKATVLNYLPKCIRVSVQLEASPAFLAVPVEKEQAPHCICANGRQTVSWAVTPKSLGNVNFTVSAEALESQELCGTEVPSVPEHGRKDTVIKPLLVEPEGLEKETTFNSLLCPSGGEVSEELSLKLPPNVVEESARASVSVLGDILGSAMQNTQNLLQMPYGCGEQNMVLFAPNIYVLDYLNETQQLTPEIKSKAIGYLNTGYQRQLNYKHYDGSYSTFGERYGRNQGNTWLTAFVLKTFAQARAYIFIDEAHITQALIWLSQRQKDNGCFRSSGSLLNNAIKGGVEDEVTLSAYITIALLEIPLTVTHPVVRNALFCLESAWKTAQEGDHGSHVYTKALLAYAFALAGNQDKRKEVLKSLNEEAVKKDNSVHWERPQKPKAPVGHFYEPQAPSAEVEMTSYVLLAYLTAQPAPTSEDLTSATNIVKWITKQQNAQGGFSSTQDTVVALHALSKYGAATFTRTGKAAQVTIQSSGTFSSKFQVDNNNRLLLQQVSLPELPGEYSMKVTGEGCVYLQVRLLGR

SEQ ID NO: 911063 - protein, 1125 aa, Homo sapiens
MGKNKLLHPSLVLLLLVLLPTDASVSGKPQYMVLVPSLLHTETTEKGCVLLSYLNETVTVSASLESVRGNRSLFTDLEAENDVLHCVAFAVPKSSSNEEVMFLTVQVKGPTQEFKKRTTVMVKNEDSLVFVQTDKSIYKPGQTVKFRVVSMDENFHPLNELIPLVYIQDPKGNRIAQWQSFQLEGGLKQFSFPLSSEPFQGSYKVVVQKKSGGRTEHPFTVEEFVLPKFEVQVTVPKIITILEEEMNVSVCGLYTYGKPVPGHVTVSICRKYSDASDCHGEDSQAFCEKFSGQLNSHGCFYQQVKTKVFQLKRKEYEMKLHTEAQIQEEGTVVELTGRQSSEITRTITKLSFVKVDSHFRQGIPFFGQVRLVDGKGVPIPNKVIFIRGNEANYYSNATTDEHGLVQFSINTTNVMGTSLTVRVNYKDRSPCYGYQWVSEEHEEAHHTAYLVFSPSKSFVHLEPMSHELPCGHTQTVQAHYILNGGTLLGLKKLSFYYLIMAKGGIVRTGTHGLLVKQEDMKGHFSISIPVKSDIAPVARLLIYAVLPTGDVIGDSAKYDVENCLANKVDLSFSPSQSLPASHAHLRVTAAPQSVCALRAVDQSVLLMKPDAELSASSVYNLLPEKDLTGFPGPLNDQDDEDCINRHNVYINGITYTPVSSTNEKDMYSFLEDMGLKAFTNSKIRKPKMCPQLQQYEMHGPEGLRVGFYESDVMGRGHARLVHVEEPHTETVRKYFPETWIWDLVVVNSAGVAEVGVTVPDTITEWKAGAFCLSEDAGLGISSTASLRAFQPFFVELTMPYSVIRGEAFTLKATVLNYLPKCIRVSVQLEASPAFLAVPVEKEQAPHCICANGRQTVSWAVTPKSLGNVNFTVSAEALESQELCGTEVPSVPEHGRKDTVIKPLLVEPEGLEKETTFNSLLCPSGGEVSEELSLKLPPNVVEESARASVSVLGDILGSAMQNTQNLLQMPYGCGEQNMVLFAPNIYVLDYLNETQQLTPEIKSKAIGYLNTGYQRQLNYKHYDGSYSTFGERYGRNQGNTWLTAFVLKTFAQARAYIFIDEAHITQALIWLSQRQKDNGCFRSSGSLLNNAIKGGVEDEVTLSAYITIALLEIPLTVTVGTTPFLC

SEQ ID NO: 911064 - protein, 976 aa, Homo sapiens
MGKNKLLHPSLVLLLLVLLPTDASVSGKPQYMVLVPSLLHTETTEKGCVLLSYLNETVTVSASLESVRGNRSLFTDLEAENDVLHCVAFAVPKSSSNEEVMFLTVQVKGPTQEFKKRTTVMVKNEDSLVFVQTDKSIYKPGQTVKFRVVSMDENFHPLNELIPLVYIQDPKGNRIAQWQSFQLEGGLKQFSFPLSSEPFQGSYKVVVQKKSGGRTEHPFTVEEFVLPKFEVQVTVPKIITILEEEMNVSVCGLYTYGKPVPGHVTVSICRKYSDASDCHGEDSQAFCEKFSGQLNSHGCFYQQVKTKVFQLKRKEYEMKLHTEAQIQEEGTVVELTGRQSSEITRTITKLSFVKVDSHFRQGIPFFGQVRLVDGKGVPIPNKVIFIRGNEANYYSNATTDEHGLVQFSINTTNVMGTSLTVRVNYKDRSPCYGYQWVSEEHEEAHHTAYLVFSPSKSFVHLEPMSHELPCGHTQTVQAHYILNGGTLLGLKKLSFYYLIMAKGGIVRTGTHGLLVKQEDMKGHFSISIPVKSDIAPVARLLIYAVLPTGDVIGDSAKYDVENCLANKVDLSFSPSQSLPASHAHLRVTAAPQSVCALRAVDQSVLLMKPDAELSASSVYNLLPEKDLTGFPGPLNDQDDEDCINRHNVYINGITYTPVSSTNEKDMYSFLEDMGLKAFTNSKIRKPKMCPQLQQYEMHGPEGLRVGFYESDVMGRGHARLVHVEEPHTETVRKYFPETWIWDLVVVNSAGVAEVGVTVPDTITEWKAGAFCLSEDAGLGISSTASLRAFQPFFVELTMPYSVIRGEAFTLKATVLNYLPKCIRVSVQLEASPAFLAVPVEKEQAPHCICANGRQTVSWAVTPKSLGNVNFTVSAEALESQELCGTEVPSVPEHGRKDTVIKPLLVEPEGLEKETTFNSLLCPSGGEVSEELSLKLPPNVVEESARASVSVLGDILGSAMPHLLTSMYWIIYAQQLL

SEQ ID NO: 911065 - protein, 720 aa, Homo sapiens
MGKNKLLHPSLVLLLLVLLPTDASVSGKPQYMVLVPSLLHTETTEKGCVLLSYLNETVTVSASLESVRGNRSLFTDLEAENDVLHCVAFAVPKSSSNEEVMFLTVQVKGPTQEFKKRTTVMVKNEDSLVFVQTDKSIYKPGQTVKFRVVSMDENFHPLNELIPLVYIQDPKGNRIAQWQSFQLEGGLKQFSFPLSSEPFQGSYKVVVQKKSGGRTEHPFTVEEFVLPKFEVQVTVPKIITILEEEMNVSVCGLYTYGKPVPGHVTVSICRKYSDASDCHGEDSQAFCEKFSGQLNSHGCFYQQVKTKVFQLKRKEYEMKLHTEAQIQEEGTVVELTGRQSSEITRTITKLSFVKVDSHFRQGIPFFGQVRLVDGKGVPIPNKVIFIRGNEANYYSNATTDEHGLVQFSINTTNVMGTSLTVRVNYKDRSPCYGYQWVSEEHEEAHHTAYLVFSPSKSFVHLEPMSHELPCGHTQTVQAHYILNGGTLLGLKKLSFYYLIMAKGGIVRTGTHGLLVKQEDMKGHFSISIPVKSDIAPVARLLIYAVLPTGDVIGDSAKYDVENCLANKVDLSFSPSQSLPASHAHLRVTAAPQSVCALRAVDQSVLLMKPDAELSASSVYNLLPEKDLTGFPGPLNDQDDEDCINRHNVYINGITYTPVSSTNEKDMYSFLEDMGLKAFTNSKIRKPKMCPQLQQYEMHGPEGLRVGFYGKQKINKYILPN

SEQ ID NO: 911066 - protein, 688 aa, Homo sapiens; identical to SEQ ID NO: 911046

SEQ ID NO: 911067 - protein, 190 aa, Homo sapiens
MGKNKLLHPSLVLLLLVLLPTDASVSGKPQYMVLVPSLLHTETTEKGCVLLSYLNETVTVSASLESVRGNRSLFTDLEAENDVLHCVAFAVPKSSSNEEVMFLTVQVKGPTQEFKKRTTVMVKNEDSLVFVQTDKSIYKPGQTVKFRVVSMDENFHPLNELIPLVYIQDPKGNRIAHGRVSSRGAKWAEL

SEQ ID NO: 911068 - protein, 68 aa, Homo sapiens
ASSHSLCAPVKGHFSISIPVKSDIAPVARLLIYAVLPTGDVIGDSAKYDVENCLANKVCVLDHKIFNM

SEQ ID NO: 911069 - protein, 114 aa, Homo sapiens
GEAFSRNFSPHARPDNIFEYDGYRPAVQSGDVHCAATQSLEKQKDSIRWKLAQEAQLLPRGHLPEIRPIRPLQLRPGPQISLSVSYTGEPLCPPNMAIVDVKMVSGFIPPEAQQ

SEQ ID NO: 911070 - protein, 86 aa, Homo sapiens
REREREREREREREREREREVGYNTVCSPPAPSFCNMGKNKLLHPSLVLLLLVLLPTDASVSGKPIADFSLYHSFFFPMILSSSYL

SEQ ID NO: 911071 - protein, 1382 aa, Homo sapiens; identical to SEQ ID NO: 911051

SEQ ID NO: 911072 - protein, 1364 aa, Homo sapiens
MGKNKLLHPSLVLLLLVLLPTDASVSGKPQYMVLVPSLLHTETTEKGCVLLSYLNETVTVSASLESVRGNRSLFTDLEAENDVLHCVAFAVPKSSSNEEVMFLTVQVKGPTQEFKKRTTVMVKNEDSLVFVQTDKSIYKPGQTVKFRVVSMDENFHPLNELIPLVYIQDPKGNRIAQWQSFQLEGGLKQFSFPLSSEPFQGSYKVVVQKKSGGRTEHPFTVEEFVLPKFEVQVTVPKIITILEEEMNVSVCGLYTYGKPVPGHVTVSICRKYSDASDCHGEDSQAFCEKFSGQLNSHGCFYQQVKTKVFQLKRKEYEMKLHTEAQIQEEGTVVELTGRQSSEITRTITKLSFVKVDSHFRQGIPFFGQVRLVDGKGVPIPNKVIFIRGNEANYYSNATTDEHGLVQFSINTTNVMGTSLTVRVNYKDRSPCYGYQWVSEEHEEAHHTAYLVFSPSKSFVHLEPMSHELPCGHTQTVQAHYILNGGTLLGLKKLSFYYLIMAKGGIVRTGTHGLLVKQEDMKGHFSISIPVKSDIAPVARLLIYAVLPTGDVIGDSAKYDVENCLANKVDLSFSPSQSLPASHAHLRVTAAPQSVCALRAVDQSVLLMKPDAELSASSVYNLLPEKDLTGFPGPLNDQDDEDCINRHNVYINGITYTPVSSTNEKDMYSFLEDMGLKAFTNSKIRKPKMCPQLQQYEMHGPEGLRVGFYESDVMGRGHARLVHVEEPHTETVRKYFPETWIWDLVVVNSAGVAEVGVTVPDTITEWKAGAFCLSEDAGLGISSTASLRAFQPFFVELTMPYSVIRGEAFTLKATVLNYLPKCIRVSVQLEASPAFLAVPVEKEQAPHCICANGRQTVSWAVTPKSLGNVNFTVSAEALESQELCGTEVPSVPEHGRKDTVIKPLLVEPEGLEKETTFNSLLCPSGGEVSEELSLKLPPNVVEESARASVSVLGDILGSAMQNTPPNIYVLDYLNETQQLTPEIKSKAIGYLNTGYQRQLNYKHYDGSYSTFGERYGRNQGNTWLTAFVLKTFAQARAYIFIDEAHITQALIWLSQRQKDNGCFRSSGSLLNNAIKGGVEDEVTLSAYITIALLEIPLTVTHPVVRNALFCLESAWKTAQEGDHGSHVYTKALLAYAFALAGNQDKRKEVLKSLNEEAVKKDNSVHWERPQKPKAPVGHFYEPQAPSAEVEMTSYVLLAYLTAQPAPTSEDLTSATNIVKWITKQQNAQGGFSSTQDTVVALHALSKYGAATFTRTGKAAQVTIQSSGTFSSKFQVDNNNRLLLQQVSLPELPGEYSMKVTGEGCVYLQTSLKYNILPEKEEFPFALGVQTLPQTCDEPKAPHQLPNLPKCQLHREAALPSQHGDR

SEQ ID NO: 911073 - protein, 891 aa, Homo sapiens
RLFSYSFLVNRTPQTSQAKGFSPVWVLMGEAVCLPQEDIVSDIAPVARLLIYAVLPTGDVIGDSAKYDVENCLANKVDLSFSPSQSLPASHAHLRVTAAPQSVCALRAVDQSVLLMKPDAELSASSVYNLLPEKDLTGFPGPLNDQDDEDCINRHNVYINGITYTPVSSTNEKDMYSFLEDMGLKAFTNSKIRKPKMCPQLQQYEMHGPEGLRVGFYESDVMGRGHARLVHVEEPHTETVRKYFPETWIWDLVVVNSAGVAEVGVTVPDTITEWKAGAFCLSEDAGLGISSTASLRAFQPFFVELTMPYSVIRGEAFTLKATVLNYLPKCIRVSVQLEASPAFLAVPVEKEQAPHCICANGRQTVSWAVTPKSLGNVNFTVSAEALESQELCGTEVPSVPEHGRKDTVIKPLLVEPEGLEKETTFNSLLCPSGGEVSEELSLKLPPNVVEESARASVSVLGDILGSAMQNTQNLLQMPYGCGEQNMVLFAPNIYVLDYLNETQQLTPEIKSKAIGYLNTGYQRQLNYKHYDGSYSTFGERYGRNQGNTWLTAFVLKTFAQARAYIFIDEAHITQALIWLSQRQKDNGCFRSSGSLLNNAIKGGVEDEVTLSAYITIALLEIPLTVTHPVVRNALFCLESAWKTAQEGDHGSHVYTKALLAYAFALAGNQDKRKEVLKSLNEEAVKKDNSVHWERPQKPKAPVGHFYEPQAPSAEVEMTSYVLLAYLTAQPAPTSEDLTSATNIVKWITKQQNAQGGFSSTQDTVVALHALSKYGAATFTRTGKAAQVTIQSSGTFSSKFQVDNNNRLLLQQVSLPELPGEYSMKVTGEGCVYLQTSLKYNILPEKEEFPFALGVQTLPQTCDEPKAPHQLPNLPKCQLHREAALPSQHGDR

SEQ ID NO: 911074 - protein, 585 aa, Homo sapiens
MPYSVIRGEAFTLKATVLNYLPKCIRVSVQLEASPAFLAVPVEKEQAPHCICANGRQTVSWAVTPKSLGNVNFTVSAEALESQELCGTEVPSVPEHGRKDTVIKPLLVEPEGLEKETTFNSLLCPSGGEVSEELSLKLPPNVVEESARASVSVLGDILGSAMQNTQNLLQMPYGCGEQNMVLFAPNIYVLDYLNETQQLTPEIKSKAIGYLNTGYQRQLNYKHYDGSYSTFGERYGRNQGNTWLTAFVLKTFAQARAYIFIDEAHITQALIWLSQRQKDNGCFRSSGSLLNNAIKGGVEDEVTLSAYITIALLEIPLTVTHPVVRNALFCLESAWKTAQEGDHGSHVYTKALLAYAFALAGNQDKRKEVLKSLNEEAVKKDNSVHWERPQKPKAPVGHFYEPQAPSAEVEMTSYVLLAYLTAQPAPTSEDLTSATNIVKWITKQQNAQGGFSSTQDTVVALHALSKYGAATFTRTGKAAQVTIQSSGTFSSKFQVDNNNRLLLQQVSLPELPGEYSMKVTGEGCVYLQTSLKYNILPEKEEFPFALGVQTLPQTCDEPKAPHQLPNLPKCQLHREAALPSQHGDR

SEQ ID NO: 911075 - protein, 1382 aa, Homo sapiens; identical to SEQ ID NO: 911051

SEQ ID NO: 911076 - protein, 353 aa, Homo sapiens
RGGGRRGGGDRGAAVGAARGEQARAYIFIDEAHITQALIWLSQRQKDNGCFRSSGSLLNNAIKGGVEDEVTLSAYITIALLEIPLTVTHPVVRNALFCLESAWKTAQEGDHGSHVYTKALLAYAFALAGNQDKRKEVLKSLNEEAVKKDNSVHWERPQKPKAPVGHFYEPQAPSAEVEMTSYVLLAYLTAQPAPTSEDLTSATNIVKWITKQQNAQGGFSSTQDTVVALHALSKYGAATFTRTGKAAQVTIQSSGTFSSKFQVDNNNRLLLQQVSLPELPGEYSMKVTGEGCVYLQTSLKYNILPEKEEFPFALGVQTLPQTCDEPKAPHQLPNLPKCQLHREAALPSQHGDR

SEQ ID NO: 911077 - protein, 1382 aa, Homo sapiens; identical to SEQ ID NO: 911051

SEQ ID NO: 911078 - protein, 1382 aa, Homo sapiens; identical to SEQ ID NO: 911051

SEQ ID NO: 911079 - protein, 1382 aa, Homo sapiens; identical to SEQ ID NO: 911051

SEQ ID NO: 911080 - protein, 1382 aa, Homo sapiens; identical to SEQ ID NO: 911051

SEQ ID NO: 911081 - protein, 1382 aa, Homo sapiens; identical to SEQ ID NO: 911051

SEQ ID NO: 911082 - protein, 1366 aa, Homo sapiens
MGKNKLLHPSLVLLLLVLLPTDASVSGKPQYMVLVPSLLHTETTEKGCVLLSYLNETVTVSASLESVRGNRSLFTDLEAENDVLHCVAFAVPKSSSNEEVMFLTVQVKGPTQEFKKRTTVMVKNEDSLVFVQTDKSIYKPGQTVKFRVVSMDENFHPLNELIPLVYIQDPKGNRIAQWQSFQLEGGLKQFSFPLSSEPFQGSYKVVVQKKSGGRTEHPFTVEEFVLPKFEVQVTVPKIITILEEEMNVSVCGLYTYGKPVPGHVTVSICRKYSDASDCHGEDSQAFCEKFSGQLNSHGCFYQQVKTKVFQLKRKEYEMKLHTEAQIQEEGTVVELTGRQSSEITRTITKLSFVKVDSHFRQGIPFFGQVRLVDGKGVPIPNKVIFIRGNEANYYSNATTDEHGLVQFSINTTNVMGTSLTVRVNYKDRSPCYGYQWVSEEHEEAHHTAYLVFSPSKSFVHLEPMSHELPCGHTQTVQAHYILNGGTLLGLKKLSFYYLIMAKGGIVRTGTHGLLVKQEDMKGHFSISIPVKSDIAPVARLLIYAVLPTGDVIGDSAKYDVENCLANKVDLSFSPSQSLPASHAHLRVTAAPQSVCALRAVDQSVLLMKPDAELSASSVYNLLPEKDLTGFPGPLNDQDDEDCINRHNVYINGITYTPVSSTNEKDMYSFLEDMGLKAFTNSKIRKPKMCPQLQQYEMHGPEGLRVGFYESDVMGRGHARLVHVEEPHTETVRKYFPETWIWDLVVVNSAGVAEVGVTVPDTITEWKAGAFCLSEDAGLGISSTASLRAFQPFFVELTMPYSVIRGEAFTLKATVLNYLPKCIRVSVQLEASPAFLAVPVEKEQAPHCICANGRQTVSWAVTPKSLGNVNFTVSAEALESQELCGTEVPSVPEHGRKDTVIKPLLVEPEGLEKETTFNSLLCPSGGEVSEELSLKLPPNVVEESARASVSVLGDILGSAMQNTQNLLQMPYGCGEQNMVLFAPNIYVLDYLNETQQLTPEIKSKAIGYLNTGYQRQLNYKHYDGSYSTFGERYGRNQGNTWLTAFVLKTFAQARAYIFIDEAHITQALIWLSQRQKDNGCFRSSGSLLNNAIKGGVEDEVTLSAYITIALLEIPLTVTHPVVRNALFCLESAWKTAQEGDHGSHVYTKALLAYAFALAGNQDKRKEVLKSLNEEAVKKDNSVHWERPQKPKAPVGHFYEPQAPSAEVEMTSYVLLAYLTAQPAPTSEDLTSATNIVKWITKQQNAQGGFSSTQDTVVALHALSKYGAATFTRTGKAAQVTIQSSGTFSSKFQVDNNNRLLLQQVSLPELPGEYSMKVTGEGCVYLQKTLILSSPGVLSYTGEPLCPPNMAIVDVKMVSGFIPPEAQQ

SEQ ID NO: 911083 - protein, 1331 aa, Homo sapiens; identical to SEQ ID NO: 911062

SEQ ID NO: 911084 - protein, 1101 aa, Homo sapiens
MGKNKLLHPSLVLLLLVLLPTDASVSGKPQYMVLVPSLLHTETTEKGCVLLSYLNETVTVSASLESVRGNRSLFTDLEAENDVLHCVAFAVPKSSSNEEVMFLTVQVKGPTQEFKKRTTVMVKNEDSLVFVQTDKSIYKPGQTVKFRVVSMDENFHPLNELIPLVYIQDPKGNRIAQWQSFQLEGGLKQFSFPLSSEPFQGSYKVVVQKKSGGRTEHPFTVEEFVLPKFEVQVTVPKIITILEEEMNVSVCGLYTYGKPVPGHVTVSICRKYSDASDCHGEDSQAFCEKFSGQLNSHGCFYQQVKTKVFQLKRKEYEMKLHTEAQIQEEGTVVELTGRQSSEITRTITKLSFVKVDSHFRQGIPFFGQVRLVDGKGVPIPNKVIFIRGNEANYYSNATTDEHGLVQFSINTTNVMGTSLTVRVNYKDRSPCYGYQWVSEEHEEAHHTAYLVFSPSKSFVHLEPMSHELPCGHTQTVQAHYILNGGTLLGLKKLSFYYLIMAKGGIVRTGTHGLLVKQEDMKGHFSISIPVKSDIAPVARLLIYAVLPTGDVIGDSAKYDVENCLANKVDLSFSPSQSLPASHAHLRVTAAPQSVCALRAVDQSVLLMKPDAELSASSVYNLLPEKDLTGFPGPLNDQDDEDCINRHNVYINGITYTPVSSTNEKDMYSFLEDMGLKAFTNSKIRKPKMCPQLQQYEMHGPEGLRVGFYESDVMGRGHARLVHVEEPHTETVRKYFPETWIWDLVVVNSAGVAEVGVTVPDTITEWKAGAFCLSEDAGLGISSTASLRAFQPFFVELTMPYSVIRGEAFTLKATVLNYLPKCIRVSVQLEASPAFLAVPVEKEQAPHCICANGRQTVSWAVTPKSLGNVNFTVSAEALESQELCGTEVPSVPEHGRKDTVIKPLLVEPEGLEKETTFNSLLCPSGGEVSEELSLKLPPNVVEESARASVSVLGDILGSAMQNTQNLLQMPYGCGEQNMVLFAPNIYVLDYLNETQQLTPEIKSKAIGYLNTGYQRQLNYKHYDGSYSTFGERYGRNQGNTWLTAFVLKTFAQARAYIFIFYSSLYGIVGSDPELLKQPLSFCLWESHMRAWLMCASSDEDVE

SEQ ID NO: 911085 - protein, 872 aa, Homo sapiens
MGKNKLLHPSLVLLLLVLLPTDASVSGKPQYMVLVPSLLHTETTEKGCVLLSYLNETVTVSASLESVRGNRSLFTDLEAENDVLHCVAFAVPKSSSNEEVMFLTVQVKGPTQEFKKRTTVMVKNEDSLVFVQTDKSIYKPGQTVKFRVVSMDENFHPLNELIPLVYIQDPKGNRIAQWQSFQLEGGLKQFSFPLSSEPFQGSYKVVVQKKSGGRTEHPFTVEEFVLPKFEVQVTVPKIITILEEEMNVSVCGLYTYGKPVPGHVTVSICRKYSDASDCHGEDSQAFCEKFSGQLNSHGCFYQQVKTKVFQLKRKEYEMKLHTEAQIQEEGTVVELTGRQSSEITRTITKLSFVKVDSHFRQGIPFFGQVRLVDGKGVPIPNKVIFIRGNEANYYSNATTDEHGLVQFSINTTNVMGTSLTVRVNYKDRSPCYGYQWVSEEHEEAHHTAYLVFSPSKSFVHLEPMSHELPCGHTQTVQAHYILNGGTLLGLKKLSFYYLIMAKGGIVRTGTHGLLVKQEDMKGHFSISIPVKSDIAPVARLLIYAVLPTGDVIGDSAKYDVENCLANKVDLSFSPSQSLPASHAHLRVTAAPQSVCALRAVDQSVLLMKPDAELSASSVYNLLPEKDLTGFPGPLNDQDDEDCINRHNVYINGITYTPVSSTNEKDMYSFLEDMGLKAFTNSKIRKPKMCPQLQQYEMHGPEGLRVGFYESDVMGRGHARLVHVEEPHTETVRKYFPETWIWDLVVVNSAGVAEVGVTVPDTITEWKAGAFCLSEDAGLGISSTASLRAFQPFFVELTMPYSVIRGEAFTLKATVLNYLPKCIRVSVQLEASPAFLAVPVEKEQAPHCICANGRQTVSWAVTPKSLGEQKTAR

SEQ ID NO: 911086 - protein, 767 aa, Homo sapiens
MGKNKLLHPSLVLLLLVLLPTDASVSGKPQYMVLVPSLLHTETTEKGCVLLSYLNETVTVSASLESVRGNRSLFTDLEAENDVLHCVAFAVPKSSSNEEVMFLTVQVKGPTQEFKKRTTVMVKNEDSLVFVQTDKSIYKPGQTVKFRVVSMDENFHPLNELIPLVYIQDPKGNRIAQWQSFQLEGGLKQFSFPLSSEPFQGSYKVVVQKKSGGRTEHPFTVEEFVLPKFEVQVTVPKIITILEEEMNVSVCGLYTYGKPVPGHVTVSICRKYSDASDCHGEDSQAFCEKFSGQLNSHGCFYQQVKTKVFQLKRKEYEMKLHTEAQIQEEGTVVELTGRQSSEITRTITKLSFVKVDSHFRQGIPFFGQVRLVDGKGVPIPNKVIFIRGNEANYYSNATTDEHGLVQFSINTTNVMGTSLTVRVNYKDRSPCYGYQWVSEEHEEAHHTAYLVFSPSKSFVHLEPMSHELPCGHTQTVQAHYILNGGTLLGLKKLSFYYLIMAKGGIVRTGTHGLLVKQEDMKGHFSISIPVKSDIAPVARLLIYAVLPTGDVIGDSAKYDVENCLANKVDLSFSPSQSLPASHAHLRVTAAPQSVCALRAVDQSVLLMKPDAELSASSVYNLLPEKDLTGFPGPLNDQDDEDCINRHNVYINGITYTPVSSTNEKDMYSFLEDMGLKAFTNSKIRKPKMCPQLQQYEMHGPEGLRVGFYESDVMGRGHARLVHVEEPVWVNQHVWLEVGVTSPWHPFPVGRALCLFEDLAWVLFCPFR

SEQ ID NO: 911087 - protein, 182 aa, Homo sapiens
MGKNKLLHPSLVLLLLVLLPTDASVSGKPQYMVLVPSLLHTETTEKGCVLLSYLNETVTVSASLESVRGNRSLFTDLEAENDVLHCVAFAVPKSSSNEEVMFLTVQVKGPTQEFKKRTTVMVKNEDSLVFVQTDKSIYKPGQTVKFRVVSMDENFHPLNELIPLVYIQDPKGNRIAHGRVSS

SEQ ID NO: 911088 - protein, 515 aa, Homo sapiens
MACKISPGANSASLPGHPNKVICERVRLQSLFPLLPSDQNTTVQEDAHFKAFFQSEDSPSPKRQRLSHSVFDYTSASPAPSPPMRPWEMTSNRQPPSVRPSQHHFSGERCNTPARNRRSPPVRRQRGRRDRLSRHNSISQDENYHHLPYAQQQAIEEPRAFHPPNVSPRLLHPAAHPPQQNAVMVDIHDQLHQGTVPVSYTVTTVAPHGIPLCTGQHIPACSTQQVPGCSVVFSGQHLPVCSVPPPMLQACSVQHLPVPYAAFPPLISSDPFLIHPPHLSPHHPPHLPPPGQFVPFQTQQSRSPLQRIENEVELLGEHLPVGGFTYPPSAHPPTLPPSAPLQFLTHDPLHQEVSFGVPYPPFMPRRLTGRSRYRSQQPIPPPPYHPSLLPYVLSMLPVPPAVGPTFSFELDVEDGEVENYEALLNLAERLGEAKPRGLTKADIEQLPSYRFNPNNHQSEQTLCVVCMCDFESRQLLRVLPCNHEFHAKCVDKWLKANRTCPICRADASEVHRDSE

SEQ ID NO: 911089 - protein, 427 aa, Homo sapiens [sequence omitted]

SEQ ID NO: 911090 - protein, 427 aa, Homo sapiens [sequence omitted]

SEQ ID NO: 911091 - protein, 515 aa, Homo sapiens; identical to SEQ ID NO: 911088

SEQ ID NO: 911092 - protein, 432 aa, Homo sapiens
MRPWEMTSNRQPPSVRPSQHHFSGERCNTPARNRRSPPVRRQRGRRDRLSRHNSISQDENYHHLPYAQQQAIEEPRAFHPPNVSPRLLHPAAHPPQQNAVMVDIHDQLHQGTVPVSYTVTTVAPHGIPLCTGQHIPACSTQQVPGCSVVFSGQHLPVCSVPPPMLQACSVQHLPVPYAAFPPLISSDPFLIHPPHLSPHHPPHLPPPGQFVPFQTQQSRSPLQRIENEVELLGEHLPVGGFTYPPSAHPPTLPPSAPLQFLTHDPLHQEVSFGVPYPPFMPRRLTGRSRYRSQQPIPPPPYHPSLLPYVLSMLPVPPAVGPTFSFELDVEDGEVENYEALLNLAERLGEAKPRGLTKADIEQLPSYRFNPNNHQSEQTLCVVCMCDFESRQLLRVLPCNHEFHAKCVDKWLKANRTCPICRADASEVHRDSE

SEQ ID NO: 911093 - protein, 615 aa, Homo sapiens
AAAAVAAAAASAAAAAAHFQPQSSSPRPGPAELGPPRRPRPPPPPPRPEPAATDRLSPPGHGPLRAGAQGGGACGRAPGAGSVGASFQCQSIHHDHICHDDSDKISPGANSASLPGHPNKVICERVRLQSLFPLLPSDQNTTVQEDAHFKAFFQSEDSPSPKRQRLSHSVFDYTSASPAPSPPMRPWEMTSNRQPPSVRPSQHHFSGERCNTPARNRRSPPVRRQRGRRDRLSRHNSISQDENYHHLPYAQQQAIEEPRAFHPPNVSPRLLHPAAHPPQQNAVMVDIHDQLHQGTVPVSYTVTTVAPHGIPLCTGQHIPACSTQQVPGCSVVFSGQHLPVCSVPPPMLQACSVQHLPVPYAAFPPLISSDPFLIHPPHLSPHHPPHLPPPGQFVPFQTQQSRSPLQRIENEVELLGEHLPVGGFTYPPSAHPPTLPPSAPLQFLTHDPLHQEVSFGVPYPPFMPRRLTGRSRYRSQQPIPPPPYHPSLLPYVLSMLPVPPAVGPTFSFELDVEDGEVENYEALLNLAERLGEAKPRGLTKADIEQLPSYRFNPNNHQSEQTLCVVCMCDFESRQLLRVLPCNHEFHAKCVDKWLKANRTCPICRADASEVHRDSE

SEQ ID NO: 911094 - protein, 409 aa, Homo sapiens
MTSNRQPPSVRPSQHHFSGERCNTPARNRRSPPVRRQRGRRDRLSRHNSISQDAFHPPNVSPRLLHPAAHPPQQNAVMVDIHDQLHQGTVPVSYTVTTVAPHGIPLCTGQHIPACSTQQVPGCSVVFSGQHLPVCSVPPPMLQACSVQHLPVPYAAFPPLISSDPFLIHPPHLSPHHPPHLPPPGQFVPFQTQQSRSPLQRIENEVELLGEHLPVGGFTYPPSAHPPTLPPSAPLQFLTHDPLHQEVSFGVPYPPFMPRRLTGRSRYRSQQPIPPPPYHPSLLPYVLSMLPVPPAVGPTFSFELDVEDGEVENYEALLNLAERLGEAKPRGLTKADIEQLPSYRFNPNNHQSEQTLCVVCMCDFESRQLLRVLPCNHEFHAKCVDKWLKANRTCPICRADASEVHRDSE

SEQ ID NO: 911095 - protein, 171 aa, Homo sapiens
MRPWEMTSNRQPPSVRPSQHHFSGERCNTPARNRRSPPVRRQRGRRDRLSRHNSISQDENYHHLPYAQQQAIEEPRAFHPPNVSPRLLHPAAHPPQQNAVMVDIHDQLHQGTVPVSYTVTTVAPHGIPLCTGQHIPACSTQQVPGCSVVFSGQHLPVCSVPPPVSLYLCSH

SEQ ID NO: 911096 - protein, 427 aa, Homo sapiens [sequence omitted]

SEQ ID NO: 911097 - protein, 465 aa, Homo sapiens
MACKSEDSPSPKRQRLSHSVFDYTSASPAPSPPMRPWEMTSNRQPPSVRPSQHHFSGERCNTPARNRRSPPVRRQRGRRDRLSRHNSISQDENYHHLPYAQQQAIEEPRAFHPPNVSPRLLHPAAHPPQQNAVMVDIHDQLHQGTVPVSYTVTTVAPHGIPLCTGQHIPACSTQQVPGCSVVFSGQHLPVCSVPPPMLQACSVQHLPVPYAAFPPLISSDPFLIHPPHLSPHHPPHLPPPGQFVPFQTQQSRSPLQRIENEVELLGEHLPVGGFTYPPSAHPPTLPPSAPLQFLTHDPLHQEVSFGVPYPPFMPRRLTGRSRYRSQQPIPPPPYHPSLLPYVLSMLPVPPAVGPTFSFELDVEDGEVENYEALLNLAERLGEAKPRGLTKADIEQLPSYRFNPNNHQSEQTLCVVCMCDFESRQLLRVLPCNHEFHAKCVDKWLKANRTCPICRADASEVHRDSE

SEQ ID NO: 911098 - protein, 427 aa, Homo sapiens [sequence omitted]

SEQ ID NO: 911099 - protein, 427 aa, Homo sapiens [sequence omitted]

SEQ ID NO: 911100 - protein, 153 aa, Homo sapiens
MPRRLTGRSRYRSQQPIPPPPYHPSLLPYVLSMLPVPPAVGPTFSFELDVEDGEVENYEALLNLAERLGEAKPRGLTKADIEQLPSYRFNPNNHQSEQTLCVVCMCDFESRQLLRVLPCNHEFHAKCVDKWLKANRTCPICRADASEVHRDSE

SEQ ID NO: 911101 - protein, 333 aa, Homo sapiens
GAAENFPQAACSPGFFKFEASESPCLECPEHTLPSPEGATSCECEEGFFRAPQDPASMPCTRPPSAPHYLTAVGMGAKVELRWTPPQDSGGREDIVYSVTCEQCWPESGECGPCEASVRYSEPPHGLTRTSVTVSDLEPHMNYTFTVEARNGVSGLVTSRSFRTASVSINQTEPPKVRLEGRSTTSLSVSWSIPPPQQSRVWKYEVTYRKKGDSNSYNVRRTEGFSVTLDDLAPDTTYLVQVQALTQEGQGAGSKVHEFQTLSRRDLATWRDGGVVSGGCLWWRSGLFPAGDPCPARGCRPCIESLICPLAPGGSDPVRRARGARLRGRSGAP

SEQ ID NO: 911102 - protein, 673 aa, Homo sapiens
MSCGGGGLARRYRGHLGGQFHSTRPPSAPHYLTAVGMGAKVELRWTPPQDSGGREDIVYSVTCEQCWPESGECGPCEASVRYSEPPHGLTRTSVTVSDLEPHMNYTFTVEARNGVSGLVTSRSFRTASVSINQTEPPKVRLEGRSTTSLSVSWSIPPPQQSRVWKYEVTYRKKGDSNSYNVRRTEGFSVTLDDLAPDTTYLVQVQALTQEGQGAGSKVHEFQTLSPEGSGNLAVIGGVAVGVVLLLVLAGVGFFIHRRRKNQRARQSPEDVYFSKSEQLKPLKTYVDPHTYEDPNQAVLKFTTEIHPSCVTRQKVIGAGEFGEVYKGMLKTSSGKKEVPVAIKTLKAGYTEKQRVDFLGEAGIMGQFSHHNIIRLEGVISKYKPMMIITEYMENGALDKFLREKDGEFSVLQLVGMLRGIAAGMKYLANMNYVHRDLAARNILVNSNLVCKVSDFGLSRVLEDDPEATYTTSGGKIPIRWTAPEAISYRKFTSASDVWSFGIVMWEVMTYGERPYWELSNHEVMKAINDGFRLPTPMDCPSAIYQLMMQCWQQERARRPKFADIVSILDKLIRAPDSLKTLADFDPRVSIRLPSTSGSEGVPFRTVSEWLESIKMQQYTEHFMAAGYTAIEKVVQMTNDDIKRIGVRLPGHQKRIAYSLLGLKDQVNTVGIPI

SEQ ID NO: 911103 - protein, 561 aa, Homo sapiens
QGSGTAGLCRSFRTASVSINQTEPPKVRLEGRSTTSLSVSWSIPPPQQSRVWKYEVTYRKKGDSNSYNVRRTEGFSVTLDDLAPDTTYLVQVQALTQEGQGAGSKVHEFQTLSPEGSGNLAVIGGVAVGVVLLLVLAGVGFFIHRRRKNQRARQSPEDVYFSKSEQLKPLKTYVDPHTYEDPNQAVLKFTTEIHPSCVTRQKVIGAGEFGEVYKGMLKTSSGKKEVPVAIKTLKAGYTEKQRVDFLGEAGIMGQFSHHNIIRLEGVISKYKPMMIITEYMENGALDKFLREKDGEFSVLQLVGMLRGIAAGMKYLANMNYVHRDLAARNILVNSNLVCKVSDFGLSRVLEDDPEATYTTSGGKIPIRWTAPEAISYRKFTSASDVWSFGIVMWEVMTYGERPYWELSNHEVMKAINDGFRLPTPMDCPSAIYQLMMQCWQQERARRPKFADIVSILDKLIRAPDSLKTLADFDPRVSIRLPSTSGSEGVPFRTVSEWLESIKMQQYTEHFMAAGYTAIEKVVQMTNDDIKRIGVRLPGHQKRIAYSLLGLKDQVNTVGIPI

SEQ ID NO: 911104 - protein, 1022 aa, Homo sapiens
GAEVARRPAGGSGHRGRRAGVRVCGSRARGDRTESEKRGMELQAARACFALLWGCALAAAAAAQGKEVVLLDFAAAGGELGWLTHPYGKGWDLMQNIMNDMPIYMYSVCNVMSGDQDNWLRTNWVYRGEAERIFIELKFTVRDCNSFPGGASSCKETFNLYYAESDLDYGTNFQKRLFTKIDTIAPDEITVSSDFEARHVKLNVEERSVGPLTRKGFYLAFQDIGACVALLSVRVYYKKCPELLQGLAHFPETIAGSDAPSLATVAGTCVDHAVVPPGGEEPRMHCAVDGEWLVPIGQCLCQAGYEKVEDACQACSPGFFKFEASESPCLECPEHTLPSPEGATSCECEEGFFRAPQDPASMPCTRPPSAPHYLTAVGMGAKVELRWTPPQDSGGREDIVYSVTCEQCWPESGECGPCEASVRYSEPPHGLTRTSVTVSDLEPHMNYTFTVEARNGVSGLVTSRSFRTASVSINQTEPPKVRLEGRSTTSLSVSWSIPPPQQSRVWKYEVTYRKKGDSNSYNVRRTEGFSVTLDDLAPDTTYLVQVQALTQEGQGAGSKVHEFQTLSPEGSGNLAVIGGVAVGVVLLLVLAGVGFFIHRRRKNQRARQSPEDVYFSKSEQLKPLKTYVDPHTYEDPNQAVLKFTTEIHPSCVTRQKVIGAGEFGEVYKGMLKTSSGKKEVPVAIKTLKAGYTEKQRVDFLGEAGIMGQFSHHNIIRLEGVISKYKPMMIITEYMENGALDKFLREKDGEFSVLQLVGMLRGIAAGMKYLANMNYVHRDLAARNILVNSNLVCKVSDFGLSRVLEDDPEATYTTSGGKIPIRWTAPEAISYRKFTSASDVWSFGIVMWEVMTYGERPYWELSNHEVMKAINDGFRLPTPMDCPSAIYQLMMQCWQQERARRPKFADIVSILDKLIRALPHGVRVAGVHQDAAVYGALHGGRLHCHREGGADDQRRHQEDWGAAARPPEAHRLQPAGTQGPGEHCGDPHLSLDRAWSPIGQEYLKKQSGLPAVPCWATGDFIYF

SEQ ID NO: 911105 - protein, 360 aa, Homo sapiens
GAEVARRPAGGSGHRGRRAGVRVCGSRARGDRTESEKRGMELQAARACFALLWGCALAAAAAAQGKEVVLLDFAAAGGELGWLTHPYGKGWDLMQNIMNDMPIYMYSVCNVMSGDQDNWLRTNWVYRGEAERIFIELKFTVRDCNSFPGGASSCKETFNLYYAESDLDYGTNFQKLPFTSASDVWSFGIVMWEVMTYGERPYWELSNHEVMKAINDGFRLPTPMDCPSAIYQLMMQCWQQERARRPKFADIVSILDKLIRAPDSLKTLADFDPRVSIRLPSTSGSEGVPFRTVSEWLESIKMQQYTEHFMAAGYTAIEKVVQMTNDDIKRIGVRLPGHQKRIAYSLLGLKDQVNTVGIPI

SEQ ID NO: 911106 - protein, 1015 aa, Homo sapiens
GAEVARRPAGGSGHRGRRAGVRVCGSRARGDRTESEKRGMELQAARACFALLWGCALAAAAAAQGKEVVLLDFAAAGGELGWLTHPYGKGWDLMQNIMNDMPIYMYSVCNVMSGDQDNWLRTNWVYRGEAERIFIELKFTVRDCNSFPGGASSCKETFNLYYAESDLDYGTNFQKRLFTKIDTIAPDEITVSSDFEARHVKLNVEERSVGPLTRKGFYLAFQDIGACVALLSVRVYYKKCPELLQGLAHFPETIAGSDAPSLATVAGTCVDHAVVPPGGEEPRMHCAVDGEWLVPIGQCLCQAGYEKVEDACQACSPGFFKFEASESPCLECPEHTLPSPEGATSCECEEGFFRAPQDPASMPCTRPPSAPHYLTAVGMGAKVELRWTPPQDSGGREDIVYSVTCEQCWPESGECGPCEASVRYSEPPHGLTRTSVTVSDLEPHMNYTFTVEARNGVSGLVTSRSFRTASVSINQTEPPKVRLEGRSTTSLSVSWSIPPPQQSRVWKYEVTYRKKGDSNSYNVRRTEGFSVTLDDLAPDTTYLVQVQALTQEGQGAGSKVHEFQTLSPEGSGNLAVIGGVAVGVVLLLVLAGVGFFIHRRRKNQRARQSPEDVYFSKSEQLKPLKTYVDPHTYEDPNQAVLKFTTEIHPSCVTRQKVIGAGEFGEVYKGMLKTSSGKKEVPVAIKTLKAGYTEKQRVDFLGEAGIMGQFSHHNIIRLEGVISKYKPMMIITEYMENGALDKFLREKDGEFSVLQLVGMLRGIAAGMKYLANMNYVHRDLAARNILVNSNLVCKVSDFGLSRVLEDDPEATYTTSGGKIPIRWTAPEAISYRKFTSASDVWSFGIVMWEVMTYGERPYWELSNHEVMKAINDGFRLPTPMDCPSAIYQLMMQCWQQERARRPKFADIVSILDKLIRAPDSLKTLADFDPRVSIRLPSTSGSEGVPFRTVSEWLESIKMQQYTEHFMAAGYTAIEKVVQMTNDDIKRIGVRLPGHQKRIAYSLLGLKDQVNTVGIPI

SEQ ID NO: 911107 - protein, 1015 aa, Homo sapiens; identical to SEQ ID NO: 911106

SEQ ID NO: 911108 - protein, 1015 aa, Homo sapiens; identical to SEQ ID NO: 911106

SEQ ID NO: 911109 - protein, 482 aa, Homo sapiens
GAEVARRPAGGSGHRGRRAGVRVCGSRARGDRTESEKRGMELQAARACFALLWGCALAAAAAAQGKEVVLLDFAAAGGELGWLTHPYGKGWDLMQNIMNDMPIYMYSVCNVMSGDQDNWLRTNWVYRGEAERIFIELKFTVRDCNSFPGGASSCKETFNLYYAESDLDYGTNFQKRLFTKIDTIAPDEITVSSDFEARHVKLNVEERSVGPLTRKGFYLAFQDIGACVALLSVRVYYKKCPELLQGLAHFPETIAGSDAPSLATVAGTCVDHAVVPPGGEEPRMHCAVDGEWLVPIGQCLCQAGYEKVEDACQACSPGFFKFEASESPCLECPEHTLPSPEGATSCECEEGFFRAPQDPASMPCTRPPSAPHYLTAVGMGAKVELRWTPPQDSGGREDIVYSVTCEQCWPESGECGPCEASVRYSEPPHGLTRTSVTVSDLEPHMNYTFTVEARNGVSGLVTSRSFRTASVSINQTGWSAMA

SEQ ID NO: 911110 - protein, 315 aa, Homo sapiens
GAEVARRPAGGSGHRGRRAGVRVCGSRARGDRTESEKRGMELQAARACFALLWGCALAAAAAAQGKEVVLLDFAAAGGELGWLTHPYGKGWDLMQNIMNDMPIYMYSVCNVMSGDQDNWLRTNWVYRGEAERIFIELKFTVRDCNSFPGGASSCKETFNLYYAESDLDYGTNFQKRLFTKIDTIAPDEITVSSDFEARHVKLNVEERSVGPLTRKGFYLAFQDIGACVALLSVRVYYKKCPELLQGLAHFPETIAGSDAPSLATVAGTCVDHAVVPPGGEEPRMHCAVDGEWLVPIGQCLCQAGYEKVEDACQGE

SEQ ID NO: 911111 - protein, 1015 aa, Homo sapiens; identical to SEQ ID NO: 911106

SEQ ID NO: 911112 - protein, 164 aa, Homo sapiens
RGTKEARGTKEARGTKEARGTKEAVLKFTTEIHPSCVTRQKVIGAGEFGEVYKGMLKTSSGKKEVPVAIKTLKAGYTEKQRVDFLGEAGIMGQFSHHNIIRLEGVISKCEAWGLPTLGGEGPLSRGSVCDCAHLPYTCAHLPPTPAPTSSTTVPTSPQYLYPPP

SEQ ID NO: 911113 - protein, 563 aa, Homo sapiens
SLSEVTELPGLGFCPRRCCSINQTEPPKVRLEGRSTTSLSVSWSIPPPQQSRVWKYEVTYRKKGDSNSYNVRRTEGFSVTLDDLAPDTTYLVQVQALTQEGQGAGSKVHEFQTLSPEGSGNLAVIGGVAVGVVLLLVLAGVGFFIHRRRKNQRARQSPEDVYFSKSEQLKPLKTYVDPHTYEDPNQAVLKFTTEIHPSCVTRQKVIGAGEFGEVYKGMLKTSSGKKEVPVAIKTLKAGYTEKQRVDFLGEAGIMGQFSHHNIIRLEGVISKYKPMMIITEYMENGALDKFLREKDGEFSVLQLVGMLRGIAAGMKYLANMNYVHRDLAARNILVNSNLVCKVSDFGLSRVLEDDPEATYTTSGGKIPIRWTAPEAISYRKFTSASDVWSFGIVMWEVMTYGERPYWELSNHEVMKAINDGFRLPTPMDCPSAIYQLMMQCWQQERARRPKFADIVSILDKLIRAPDSLKTLADFDPRVSIRLPSTSGSEGVPFRTVSEWLESIKMQQYTEHFMAAGYTAIEKVVQMTNDDIKRIGVRLPGHQKRIAYSLLGLKDQVNTVGIPI

SEQ ID NO: 911114 - protein, 243 aa, Homo sapiens
MVEAGCELARHILVNSNLVCKVSDFGLSRVLEDDPEATYTTSGGKIPIRWTAPEAISYRKFTSASDVWSFGIVMWEVMTYGERPYWELSNHEVMKAINDGFRLPTPMDCPSAIYQLMMQCWQQERARRPKFADIVSILDKLIRAPDSLKTLADFDPRVSIRLPSTSGSEGVPFRTVSEWLESIKMQQYTEHFMAAGYTAIEKVVQMTNDDIKRIGVRLPGHQKRIAYSLLGLKDQVNTVGIPI

SEQ ID NO: 911115 - protein, 135 aa, Homo sapiens [sequence omitted]

SEQ ID NO: 911116 - protein, 1015 aa, Homo sapiens; identical to SEQ ID NO: 911106

SEQ ID NO: 911117 - protein, 919 aa, Homo sapiens
GAEVARRPAGGSGHRGRRAGVRVCGSRARGDRTESEKRGMELQAARACFALLWGCALAAAAAAQGKEVVLLDFAAAGGELGWLTHPYGKGWDLMQNIMNDMPIYMYSVCNVMSGDQDNWLRTNWVYRGEAERIFIELKFTVRDCNSFPGGASSCKETFNLYYAESDLDYGTNFQKRLFTKIDTIAPDEITVSSDFEARHVKLNVEERSVGPLTRKGFYLAFQDIGACVALLSVRVYYKKCPELLQGLAHFPETIAGSDAPSLATVAGTCVDHAVVPPGGEEPRMHCAVDGEWLVPIGQCLCQAGYEKVEDACQACSPGFFKFEASESPCLECPEHTLPSPEGATSCECEEGFFRAPQDPASMPCTRPPSAPHYLTAVGMGAKVELRWTPPQDSGGREDIVYSVTCEQCWPESGECGPCEASVRYSEPPHGLTRTSVTVSDLEPHMNYTFTVEARNGVSGLVTSRSFRTASVSINQTEPPKVRLEGRSTTSLSVSWSIPPPQQSRVWKYEVTYRKKGDSNSYNVRRTEGFSVTLDDLAPDTTYLVQVQALTQEGQGAGSKVHEFQTLSPEGSGNLAVIGGVAVGVVLLLVLAGVGFFIHRRRKNQRARQSPEDVYFSKSEQLKPLKTYVDPHTYEDPNQAVLKFTTEIHPSCVTRQKVIGAGEFGEVYKGMLKTSSGKKEVPVAIKTLKAGYTEKQRVDFLGEAGIMGQFSHHNIIRLEGVISKYKPMMIITEYMENGALDKFLREKDGEFSVLQLVGMLRGIAAGMKYLANMNYVHRDLAARNILVNSNLVCKVSDFGLSRVLEDDPEATYTTSGGKIPIRWTAPEAISYRKFTSASDVWSFGIVMWEVMTYGERPYWELSNHELDEAIMMGSGPNHVLPFALQVLMRVGDVPRPVVLSVWHLLGLSSDVLPPGSGAPG

SEQ ID NO: 911118 - protein, 637 aa, Homo sapiens
GAEVARRPAGGSGHRGRRAGVRVCGSRARGDRTESEKRGMELQAARACFALLWGCALAAAAAAQGKEVVLLDFAAAGGELGWLTHPYGKGWDLMQNIMNDMPIYMYSVCNVMSGDQDNWLRTNWVYRGEAERIFIELKFTVRDCNSFPGGASSCKETFNLYYAESDLDYGTNFQKRLFTKIDTIAPDEITVSSDFEARHVKLNVEERSVGPLTRKGFYLAFQDIGACVALLSVRVYYKKCPELLQGLAHFPETIAGSDAPSLATVAGTCVDHAVVPPGGEEPRMHCAVDGEWLVPIGQCLCQAGYEKVEDACQACSPGFFKFEASESPCLECPEHTLPSPEGATSCECEEGFFRAPQDPASMPCTRPPSAPHYLTAVGMGAKVELRWTPPQDSGGREDIVYSVTCEQCWPESGECGPCEASVRYSEPPHGLTRTSVTVSDLEPHMNYTFTVEARNGVSGLVTSRSFRTASVSINQTEPPKVRLEGRSTTSLSVSWSIPPPQQSRVWKYEVTYRKKGDSNSYNVRRTEGFSVTLDDLAPDTTYLVQVQALTQEGQGAGSKVHEFQTLSRRDLATWRDGGVVSGGCLWWRSGLFPAGDPCPARGCRPCIESLICPLAPGGSDPVRRARGARLRGRSGAP

SEQ ID NO: 911119 - protein, 102 aa, Homo sapiens
MSPFPAASPDELHAGRPAPWQAEAGRGAEPAGGEEGSAAGGEGRGRRPVAWGLGRPRRASGWILSRWKPCKGRRQGPDVFGLRLQEGPLAASGRIIWRRAGR

SEQ ID NO: 911120 - protein, 102 aa, Homo sapiens; identical to SEQ ID NO: 911119

SEQ ID NO: 911121 - protein, 102 aa, Homo sapiens; identical to SEQ ID NO: 911119

SEQ ID NO: 911122 - protein, 102 aa, Homo sapiens; identical to SEQ ID NO: 911119

SEQ ID NO: 911123 - protein, 215 aa, Homo sapiens
RGSGAAGSSQTGDALGKALASIYSPDHTNNSFSSNPSTPVGSPPSLSAGTAVWSRNGGQASSSPNYEGPLHSLQSRIEDRLERLDDAIHVLRNHAVGPSTAMPGGHGDMHGIIGPSHNGAMGGLGSGYGTGLLSANRHSLMVGTHREDGVALRGSHSLLPNQVPVPQLPVQSATSPDLNPPQDPYRGMPPGLQGQSVSSGSSEIKSDDESGRRYG

SEQ ID NO: 911124 - protein, 191 aa, Homo sapiens
MSARKPNILCIVNCQSHLNQSQGQVDIKILPKTWHKMEKFPENSGRKQSNVDTFFFPTPLENVASLLSHSNNDDEDLTPEQKAEREKERRMANNARERLRVRDINEAFKELGRMVQLHLKSDKPQTKLLILHQAVAVILSLEQQVRERNLNPKAACLKRREEEKVSSEPPPLSLAGPHPGMGDASNHMGQM

SEQ ID NO: 911125 - protein, 191 aa, Homo sapiens; identical to SEQ ID NO: 911124

SEQ ID NO: 911126 - protein, 156 aa, Homo sapiens
MPGGHGDMHGIIGPSHNGAMGGLGSGYGTGLLSANRHSLMVGTHREDGVALRGSHSLLPNQVPVPQLPVQSATSPDLNPPQDPYRGMPPGLQGQSVSSGSSEIKSDDEGDENLQDTKSSEDKKLDDDKKDIKSITRSRSSNNDDEDPLPASLPHPQ

SEQ ID NO: 911127 - protein, 191 aa, Homo sapiens; identical to SEQ ID NO: 911124

SEQ ID NO: 911128 - protein, 191 aa, Homo sapiens; identical to SEQ ID NO: 911124

SEQ ID NO: 911129 - protein, 274 aa, Homo sapiens
RGSGAAGSSQTGDALGKALASIYSPDHTNNSFSSNPSTPVGSPPSLSAGTAVWSRNGGQASSSPNYEGPLHSLQSRIEDRLERLDDAIHVLRNHAVGPSTAMPGGHGDMHGIIGPSHNGAMGGLGSGYGTGLLSANRHSLMVGTHREDGVALRGSHSLLPNQVPVPQLPVQSATSPDLNPPQDPYRGMPPGLQGQSVSSGSSEIKSDDEGDENLQDTKSSEDKKLDDDKKDIKSITRSRSRTCPEPMGGEGAERATCAEAVEAGPTAFKTRLGP

SEQ ID NO: 911130 - protein, 122 aa, Homo sapiens
TQQLQNGSHMGRHGSQGGIVMAISPSEETKLQMFMWSRIIFSLGFVISGHYKDFARDVAASIAFTNDLNGEHPHKAADMEGLYTLDTAEVDDRSYWVRFQSSSLASWSGTRSRVSSMAPLTL

SEQ ID NO: 911131 - protein, 1199 aa, Homo sapiens
MASAGTQHYSIGLRQKNSFKQSGPSGTVPATPPEKPSEGRVWPQAHQQVKPIWKLEKKQVETLSAGLGPGLLGVPPQPAYFFCPSTLCSSGTTAVIAGHSSSCYLHSLPDLFNSTLLYRRSSYRQKPYQQLESFCLRSSPSEKSPFSLPQKSLPVSLTANKATSSMVFSMAQPMASSSTEPYLCLAAAGENPSGKSLASAISGKIPSPLSSSYKPMLNNNSFMWPNSTPVPLLQTTQGLKPVSPPKIQPVSWHHSGGTGDCAPQPVDHKVPKSIGTVPADASAHIALSTASSHDTSTTSVASSWYNRNNLAMRAEPLSCALDDSSDSQDPTKEIRFTEAVRKLTARGFEKMPRQGCQLEQSSFLNPSFQWNVLNRSRRWKPPAVNQQFPQEDAGSVRRVLPGASDTLGLDNTVFCTKRISIHLLASHASGLNHNPACESVIDSSAFGEGKAPGPPFPQTLGIANVATRLSSIQLGQSEKERPEEARELDSSDRDISSATDLQPDQAETEDTEEELVDGLEDCCSRDENEEEEGDSECSSLSAVSPSESVAMISRSCMEILTKPLSNHEKVVRPALIYSLFPNVPPTIYFGTRDERVEKLPWEQRKLLRWKMSTVTPNIVKQTIGRSHFKISKRNDDWLGCWGHHMKSPSFRSIREHQKLNHFPGSFQIGRKDRLWRNLSRMQSRFGKKEFSFFPQSFILPQDAKLLRKAWESSSRQKWIVKPPASARGIGIQVIHKWSQLPKRRPLLVQRYLHKPYLISGSKFDLRIYVYVTSYDPLRIYLFSDGLVRFASCKYSPSMKSLGNKFMHLTNYSVNKKNAEYQANADEMACQGHKWALKALWNYLSQKGVNSDAIWEKIKDVVVKTIISSEPYVTSLLKMYVRRPYSCHELFGFDIMLDENLKPWVLEVNISPSLHSSSPLDISIKGQMIRDLLNLAGFVLPNAEDIISSPSSCSSSTTSLPTSPGDKCRMAPEHVTAQKMKKAYYLTQKIPDQDFYASVLDVLTPDDVRILVEMEDEFSRRGQFERIFPSHISSRYLRFFEQPRYFNILTTQWEQKYHGNKLKGVDLLRSWCYKGFHMGVVSDSAPVWSLPTSLLTISKDDVILNAFSKSETSKLGKQSSCEVSLLLSEDGTTPKSKKTQAGLSPYPQKPSSSKDSEDTSKEPSLSTQTLPVIKCSGQTSRLSASSTFQSISDSLLAVSP

SEQ ID NO: 911132 - protein, 1199 aa, Homo sapiens; identical to SEQ ID NO: 911131

SEQ ID NO: 911133 - protein, 1351 aa, Homo sapiens
MASAGTQHYSIGLRQKNSFKQSGPSGTVPATPPEKPSEGRVWPQAHQQVKPIWKLEKKQVETLSAGLGPGLLGVPPQPAYFFCPSTLCSSGTTAVIAGHSSSCYLHSLPDLFNSTLLYRRSSYRQKPYQQLESFCLRSSPSEKSPFSLPQKSLPVSLTANKATSSMVFSMAQPMASSSTEPYLCLAAAGENPSGKSLASAISGKIPSPLSSSYKPMLNNNSFMWPNSTPVPLLQTTQGLKPVSPPKIQPVSWHHSGGTGDCAPQPVDHKVPKSIGTVPADASAHIALSTASSHDTSTTSVASSWYNRNNLAMRAEPLSCALDDSSDSQDPTKEIRFTEAVRKLTARGFEKMPRQGCQLEQSSFLNPSFQWNVLNRSRRWKPPAVNQQFPQEDAGSVRRVLPGASDTLGLDNTVFCTKRISIHLLASHASGLNHNPACESVIDSSAFGEGKAPGPPFPQTLGIANVATRLSSIQLGQSEKERPEEARELDSSDRDISSATDLQPDQAETEDTEEELVDGLEDCCSRDENEEEEGDSECSSLSAVSPSESVAMISRSCMEILTKPLSNHEKVVRPALIYSLFPNVPPTIYFGTRDERGKPGQVSKPRRAPGRRLLAKLGGGGSRKERVSRMAVVAVVTLCSVPHVVVGLMQPFSCLSFSCPFSALPCHAEFMLFNLVAFPFQSSLSLFLIPAQPLFFPKVCSSETLIWSNSYVTCLPREDGQPCHLFCLLIMTLCSSPSPIPTPLAFFPVEKLPWEQRKLLRWKMSTVTPNIVKQTIGRSHFKISKRNDDWLGCWGHHMKSPSFRSIREHQKLNHFPGSFQIGRKDRLWRNLSRMQSRFGKKEFSFFPQSFILPQDAKLLRKAWESSSRQKWIVKPPASARGIGIQVIHKWSQLPKRRPLLVQRYLHKPYLISGSKFDLRIYVYVTSYDPLRIYLFSDGLVRFASCKYSPSMKSLGNKFMHLTNYSVNKKNAEYQANADEMACQGHKWALKALWNYLSQKGVNSDAIWEKIKDVVVKTIISSEPYVTSLLKMYVRRPYSCHELFGFDIMLDENLKPWVLEVNISPSLHSSSPLDISIKGQMIRDLLNLAGFVLPNAEDIISSPSSCSSSTTSLPTSPGDKCRMAPEHVTAQKMKKAYYLTQKIPDQDFYASVLDVLTPDDVRILVEMEDEFSRRGQFERIFPSHISSRYLRFFEQPRYFNILTTQWEQKYHGNKLKGVDLLRSWCYKGFHMGVVSDSAPVWSLPTSLLTISKDDVILNAFSKSETSKLGKQSSCEVSLLLSEDGTTPKSKKTQAGLSPYPQKPSSSKDSEDTSKEPSLSTQTLPVIKCSGQTSRLSASSTFQSISDSLLAVSP

SEQ ID NO: 911134 - protein, 1138 aa, Homo sapiens
MASAGTQHYSIGLRQKNSFKQSGPSGTVPATPPEKPSEGRVWPQAHQQVKPIWKLEKKQVETLSAGLGPGLLGVPPQPAYFFCPSTLCSSGTTAVIAGHSSSCYLHSLPDLFNSTLLYRRSSYRQKPYQQLESFCLRSSPSEKSPFSLPQKSLPVSLTANKATSSMVFSMAQPMASSSTEPYLCLAAAGENPSGKSLASAISGKIPSPLSSSYKPMLNNNSFMWPNSTPVPLLQTTQGLKPVSPPKIQPVSWHHSGGTGDCAPQPVDHKVPKSIGTVPADASAHIALSTASSHDTSTTSVASSWYNRNNLAMRAEPLSCALDDSSDSQDPTKEIRFTEAVRKLTARGFEKMPRQGCQLEQSSFLNPSFQWNVLNRSRRWKPPAVNQQFPQEDAGSVRRVLPGASDTLGLDNTVFCTKRISIHLLASHASGLNHNPACESVIDSSAFGEGKAPGPPFPQTLGIANVATRLSSIQLGQSEKERPEEARELDSSDRDISSATDLQPDQAETEDTEEELVDGLEDCCSRDENEEEEGDSECSSLSAVSPSESVAMISRSCMEILTKPLSNHEKVVRPALIYSLFPNVPPTIYFGTRDERVEKLPWEQRKLLRWKMSTVTPNIVKQTIGRSHFKISKRNDDWLGCWGHHMKSPSFRSIREHQKLNHFPGSFQIGRKDRLWRNLSRMQSRFGKKEFSFFPQSFILPQDAKLLRKAWESSSRQKWIVKPPASARGIGIQVIHKWSQLPKRRPLLVQRYLHKPYLISGSKFDLRIYVYVTSYDPLRIYLFSDGLVRFASCKYSPSMKSLGNKFMHLTNYSVNKKNAEYQANADEMACQGHKWALKALWNYLSQKGVNSDAIWEKIKDVVVKTIISSEPYVTSLLKMYVRRPYSCHELFGFDIMLDENLKPWVLEVNISPSLHSSSPLDISIKGQMIRDLLNLAGFVLPNAEDIISSPSSCSSSTTSLPTSPGDKCRMAPEHVTAQKMKKAYYLTQKIPDQDFYASVLDVLTPDDVRILVEMEDEFSRRGQFERIFPSHISSRYLRFFEQPRYFNILTTQWEQKYHGNKLKGVDLLRSWCYKGFHMGVVSDSAPVWSLPTSLLTISKDDVILNAFSKSETSKLGNPVPQRTVRTPAKSPAFLPRRYL

SEQ ID NO: 911135 - protein, 586 aa, Homo sapiens
SLCPWTELLARLIPDVPPIGNDDWLGCWGHHMKSPSFRSIREHQKLNHFPGSFQIGRKDRLWRNLSRMQSRFGKKEFSFFPQSFILPQDAKLLRKAWESSSRQKWIVKPPASARGIGIQVIHKWSQLPKRRPLLVQRYLHKPYLISGSKFDLRIYVYVTSYDPLRIYLFSDGLVRFASCKYSPSMKSLGNKFMHLTNYSVNKKNAEYQANADEMACQGHKWALKALWNYLSQKGVNSDAIWEKIKDVVVKTIISSEPYVTSLLKMYVRRPYSCHELFGFDIMLDENLKPWVLEVNISPSLHSSSPLDISIKGQMIRDLLNLAGFVLPNAEDIISSPSSCSSSTTSLPTSPGDKCRMAPEHVTAQKMKKAYYLTQKIPDQDFYASVLDVLTPDDVRILVEMEDEFSRRGQFERIFPSHISSRYLRFFEQPRYFNILTTQWEQKYHGNKLKGVDLLRSWCYKGFHMGVVSDSAPVWSLPTSLLTISKDDVILNAFSKSETSKLGKQSSCEVSLLLSEDGTTPKSKKTQAGLSPYPQKPSSSKDSEDTSKEPSLSTQTLPVIKCSGQTSRLSASSTFQSISDSLLAVSP

SEQ ID NO: 911136 - protein, 912 aa, Homo sapiens
MASAGTQHYSIGLRQKNSFKQSGPSGTVPATPPEKPSEGRVWPQAHQQVKPIWKLEKKQVETLSAGLGPGLLGVPPQPAYFFCPSTLCSSGTTAVIAGHSSSCYLHSLPDLFNSTLLYRRSSYRQKPYQQLESFCLRSSPSEKSPFSLPQKSLPVSLTANKATSSMVFSMAQPMASSSTEPYLCLAAAGENPSGKSLASAISGKIPSPLSSSYKPMLNNNSFMWPNSTPVPLLQTTQGLKPVSPPKIQPVSWHHSGGTGDCAPQPVDHKVPKSIGTVPADASAHIALSTASSHDTSTTSVASSWYNRNNLAMRAEPLSCALDDSSDSQDPTKEIRFTEAVRKLTARGFEKMPRQGCQLEQSSFLNPSFQWNVLNRSRRWKPPAVNQQFPQEDAGSVRRVLPGASDTLGLDNTVFCTKRISIHLLASHASGLNHNPACESVIDSSAFGEGKAPGPPFPQTLGIANVATRLSSIQLGQSEKERPEEARELDSSDRDISSATDLQPDQAETEDTEEELVDGLEDCCSRDENEEEEGDSECSSLSAVSPSESVAMISRSCMEILTKPLSNHEKVVRPALIYSLFPNVPPTIYFGTRDERVEKLPWEQRKLLRWKMSTVTPNIVKQTIGRSHFKISKRNDDWLGCWGHHMKSPSFRSIREHQKLNHFPGSFQIGRKDRLWRNLSRMQSRFGKKEFSFFPQSFILPQDAKLLRKAWESSSRQKWIVKPPASARGIGIQVIHKWSQLPKRRPLLVQRYLHKPYLISGSKFDLRIYVYVTSYDPLRIYLFSDGLVRFASCKYSPSMKSLGNKFMHLTNYSVNKKNAEYQANADEMACQGHKWALKALWNYLSQKGVNSDAIWEKIKDVVVKTIISSEPYVTSLLKMYVRRPYSCHELFGFDIMLDENLKPWVLEVNISPR

SEQ ID NO: 911137 - protein, 1199 aa, Homo sapiens; identical to SEQ ID NO: 911131

SEQ ID NO: 911138 - protein, 1034 aa, Homo sapiens
MVFSMAQPMASSSTEPYLCLAAAGENPSGKSLASAISGKIPSPLSSSYKPMLNNNSFMWPNSTPVPLLQTTQGLKPVSPPKIQPVSWHHSGGTGDCAPQPVDHKVPKSIGTVPADASAHIALSTASSHDTSTTSVASSWYNRNNLAMRAEPLSCALDDSSDSQDPTKEIRFTEAVRKLTARGFEKMPRQGCQLEQSSFLNPSFQWNVLNRSRRWKPPAVNQQFPQEDAGSVRRVLPGASDTLGLDNTVFCTKRISIHLLASHASGLNHNPACESVIDSSAFGEGKAPGPPFPQTLGIANVATRLSSIQLGQSEKERPEEARELDSSDRDISSATDLQPDQAETEDTEEELVDGLEDCCSRDENEEEEGDSECSSLSAVSPSESVAMISRSCMEILTKPLSNHEKVVRPALIYSLFPNVPPTIYFGTRDERVEKLPWEQRKLLRWKMSTVTPNIVKQTIGRSHFKISKRNDDWLGCWGHHMKSPSFRSIREHQKLNHFPGSFQIGRKDRLWRNLSRMQSRFGKKEFSFFPQSFILPQDAKLLRKAWESSSRQKWIVKPPASARGIGIQVIHKWSQLPKRRPLLVQRYLHKPYLISGSKFDLRIYVYVTSYDPLRIYLFSDGLVRFASCKYSPSMKSLGNKFMHLTNYSVNKKNAEYQANADEMACQGHKWALKALWNYLSQKGVNSDAIWEKIKDVVVKTIISSEPYVTSLLKMYVRRPYSCHELFGFDIMLDENLKPWVLEVNISPSLHSSSPLDISIKGQMIRDLLNLAGFVLPNAEDIISSPSSCSSSTTSLPTSPGDKCRMAPEHVTAQKMKKAYYLTQKIPDQDFYASVLDVLTPDDVRILVEMEDEFSRRGQFERIFPSHISSRYLRFFEQPRYFNILTTQWEQKYHGNKLKGVDLLRSWCYKGFHMGVVSDSAPVWSLPTSLLTISKDDVILNAFSKSETSKLGKQSSCEVSLLLSEDGTTPKSKKTQAGLSPYPQKPSSSKDSEDTSKEPSLSTQTLPVIKCSGQTSRLSASSTFQSISDSLLAVSP

SEQ ID NO: 911139 - protein, 1072 aa, Homo sapiens
MGQCYYNETWASHAWLAQVSLPQKSLPVSLTANKATSSMVFSMAQPMASSSTEPYLCLAAAGENPSGKSLASAISGKIPSPLSSSYKPMLNNNSFMWPNSTPVPLLQTTQGLKPVSPPKIQPVSWHHSGGTGDCAPQPVDHKVPKSIGTVPADASAHIALSTASSHDTSTTSVASSWYNRNNLAMRAEPLSCALDDSSDSQDPTKEIRFTEAVRKLTARGFEKMPRQGCQLEQSSFLNPSFQWNVLNRSRRWKPPAVNQQFPQEDAGSVRRVLPGASDTLGLDNTVFCTKRISIHLLASHASGLNHNPACESVIDSSAFGEGKAPGPPFPQTLGIANVATRLSSIQLGQSEKERPEEARELDSSDRDISSATDLQPDQAETEDTEEELVDGLEDCCSRDENEEEEGDSECSSLSAVSPSESVAMISRSCMEILTKPLSNHEKVVRPALIYSLFPNVPPTIYFGTRDERVEKLPWEQRKLLRWKMSTVTPNIVKQTIGRSHFKISKRNDDWLGCWGHHMKSPSFRSIREHQKLNHFPGSFQIGRKDRLWRNLSRMQSRFGKKEFSFFPQSFILPQDAKLLRKAWESSSRQKWIVKPPASARGIGIQVIHKWSQLPKRRPLLVQRYLHKPYLISGSKFDLRIYVYVTSYDPLRIYLFSDGLVRFASCKYSPSMKSLGNKFMHLTNYSVNKKNAEYQANADEMACQGHKWALKALWNYLSQKGVNSDAIWEKIKDVVVKTIISSEPYVTSLLKMYVRRPYSCHELFGFDIMLDENLKPWVLEVNISPSLHSSSPLDISIKGQMIRDLLNLAGFVLPNAEDIISSPSSCSSSTTSLPTSPGDKCRMAPEHVTAQKMKKAYYLTQKIPDQDFYASVLDVLTPDDVRILVEMEDEFSRRGQFERIFPSHISSRYLRFFEQPRYFNILTTQWEQKYHGNKLKGVDLLRSWCYKGFHMGVVSDSAPVWSLPTSLLTISKDDVILNAFSKSETSKLGKQSSCEVSLLLSEDGTTPKSKKTQAGLSPYPQKPSSSKDSEDTSKEPSLSTQTLPVIKCSGQTSRLSASSTFQSISDSLLAVSP

SEQ ID NO: 911140 - protein, 1199 aa, Homo sapiens; identical to SEQ ID NO: 911131

SEQ ID NO: 911141 - protein, 577 aa, Homo sapiens
SLCPWTELLARLIPDVPPIGNDDWLGCWGHHMKSPSFRSIREHQKIGRKDRLWRNLSRMQSRFGKKEFSFFPQSFILPQDAKLLRKAWESSSRQKWIVKPPASARGIGIQVIHKWSQLPKRRPLLVQRYLHKPYLISGSKFDLRIYVYVTSYDPLRIYLFSDGLVRFASCKYSPSMKSLGNKFMHLTNYSVNKKNAEYQANADEMACQGHKWALKALWNYLSQKGVNSDAIWEKIKDVVVKTIISSEPYVTSLLKMYVRRPYSCHELFGFDIMLDENLKPWVLEVNISPSLHSSSPLDISIKGQMIRDLLNLAGFVLPNAEDIISSPSSCSSSTTSLPTSPGDKCRMAPEHVTAQKMKKAYYLTQKIPDQDFYASVLDVLTPDDVRILVEMEDEFSRRGQFERIFPSHISSRYLRFFEQPRYFNILTTQWEQKYHGNKLKGVDLLRSWCYKGFHMGVVSDSAPVWSLPTSLLTISKDDVILNAFSKSETSKLGKQSSCEVSLLLSEDGTTPKSKKTQAGLSPYPQKPSSSKDSEDTSKEPSLSTQTLPVIKCSGQTSRLSASSTFQSISDSLLAVSP

SEQ ID NO: 911142 - protein, 364 aa, Homo sapiens
MSVMVVRKKVTRKWEKLPGRNTFCCDGRVMMARQKGIFYLTLFLILGTCTLFFAFECRYLAVQLSPAIPVFAAMLFLFSMATLLRTSFSDPGVIPRALPDEAAFIEMEIEATNGAVPQGQRPPPRIKNFQINNQIVKLKYCYTCKIFRPPRASHCSICDNCVERFDHHCPWVGNCVGKRNYRYFYLFILSLSLLTIYVFAFNIVYVALKSLKIGFLETLKETPGTVLEVLICFFTLWSVVGLTGFHTFLVALNQTTNEDIKGSWTGKNRVQNPYSHGNIVKNCCEVLCGPLPPSVLDRRGILPLEESGSRPPSTQETSSSLLPQSPAPTEHLNSNEMPEDSSTPEEMPPPEPPEPPQEAAEAEK

SEQ ID NO: 911143 - protein, 364 aa, Homo sapiens; identical to SEQ ID NO: 911142

SEQ ID NO: 911144 - protein, 364 aa, Homo sapiens; identical to SEQ ID NO: 911142

SEQ ID NO: 911145 - protein, 364 aa, Homo sapiens; identical to SEQ ID NO: 911142

SEQ ID NO: 911146 - protein, 364 aa, Homo sapiens; identical to SEQ ID NO: 911142

SEQ ID NO: 911147 - protein, 291 aa, Homo sapiens [sequence omitted]

SEQ ID NO: 911148 - protein, 290 aa, Homo sapiens
IKRLLISRSMNSVHNIFNTISGRDDGNPSKGTRGADLRDKREEMRQRPGLGQLGVPECQAPPHVLWVKAPPPGEQVYGTEDAGLGGDPKRFDHHCPWVGNCVGKRNYRYFYLFILSLSLLTIYVFAFNIVYVALKSLKIGFLETLKETPGTVLEVLICFFTLWSVVGLTGFHTFLVALNQTTNEDIKGSWTGKNRVQNPYSHGNIVKNCCEVLCGPLPPSVLDRRGILPLEESGSRPPSTQETSSSLLPQSPAPTEHLNSNEMPEDSSTPEEMPPPEPPEPPQEAAEAEK

SEQ ID NO: 911149 - protein, 208 aa, Homo sapiens
MSVMVVRKKVTRKWEKLPGRNTFCCDGRVMMARQKGIFYLTLFLILGTCTLFFAFECRYLAVQLSPAIPVFAAMLFLFSMATLLRTSFSDPGVIPRALPDEAAFIEMEIEATNGAVPQGQRPPPRIKNFQINNQIVKLKYCYTCKIFRPPRASHCSICDNCVERFDHHCPWVGVGRGCLLLPKLPLTRAPLGWRGSSKLSIDLYYILG

SEQ ID NO: 911150 - protein, 208 aa, Homo sapiens
MSVMVVRKKVTRKWEKLPGRNTFCCDGRVMMARQKGIFYLTLFLILGTCTLFFAFECRYLAVQLSPAIPVFAAMLFLFSMATLLRTSFSDPGVIPRALPDEAAFIEMEIEATNGAVPQGQRPPPRIKNFQINNQIVKLKYCYTCKIFRPPRASHCSICDNCVDFPVLDFHVGPTLHSGRRHLVHWRAALRKEGLSKTQPKKRKVASIY

SEQ ID NO: 911151 - protein, 123 aa, Homo sapiens
SRAMLALGGQENLLTPLSLLFSPEDPKNPVRIPWPEVSVTASGYGNHTGGFLQAPLFQHFHRQSPRATSPWGWAVAPSQLCSGPALFQGRRFMYYMWLYFLEHLCFPLSKPGSCLDDLCGGGV

SEQ ID NO: 911152 - protein, 364 aa, Homo sapiens; identical to SEQ ID NO: 911142

SEQ ID NO: 911153 - protein, 364 aa, Homo sapiens; identical to SEQ ID NO: 911142

SEQ ID NO: 911154 - protein, 364 aa, Homo sapiens; identical to SEQ ID NO: 911142

SEQ ID NO: 911155 - protein, 251 aa, Homo sapiens
MGIVLIVIFYHRETQLQHQTRTSPQPSQLEINFGEPPRASHCSICDNCVERFDHHCPWVGNCVGKRNYRYFYLFILSLSLLTIYVFAFNIVYVALKSLKIGFLETLKETPGTVLEVLICFFTLWSVVGLTGFHTFLVALNQTTNEDIKGSWTGKNRVQNPYSHGNIVKNCCEVLCGPLPPSVLDRRGILPLEESGSRPPSTQETSSSLLPQSPAPTEHLNSNEMPEDSSTPEEMPPPEPPEPPQEAAEAEK

SEQ ID NO: 911156 - protein, 364 aa, Homo sapiens; identical to SEQ ID NO: 911142

SEQ ID NO: 911157 - protein, 164 aa, Homo sapiens
MSVMVVRKKVTRKWEKLPGRNTFCCDGRVMMARQKGIFYLTLFLILGTCTLFFAFECRYLAVQLSPAIPVFAAMLFLFSMATLLRTSFSDPGVIPRALPDEAAFIEMEIEATNGAVPQGQRPPPRIKNFQINNQIVKLKYCYTCKIFRPPRASHCSICDNCVGE

SEQ ID NO: 911158 - protein, 696 aa, Homo sapiens
MKFAEHLSAHITPEWRKQYIQYEAFKDMLYSAQDQAPSVEVTDEDTVKRYFAKFEEKFFQTCEKELAKINTFYSEKLAEAQRRFATLQNELQSSLDAQKESTGVTTLRQRRKPVFHLSHEERVQHRNIKDLKLAFSEFYLSLILLQNYQNLNFTGFRKILKKHDKILETSRGADWRVAHVEVAPFYTCKKINQLISETEAVVTNELEDGDRQKAMKRLRVPPLGAAQPAPAWTTFRVGLFCGIFIVLNITLVLAAVFKLETDRSIWPLIRIYRGGFLLIEFLFLLGINTYGWRQAGVNHVLIFELNPRSNLSHQHLFEIAGFLGILWCLSLLACFFAPISVIPTYVYPLALYGFMVFFLINPTKTFYYKSRFWLLKLLFRVFTAPFHKVGFADFWLADQLNSLSVILMDLEYMICFYSLELKWDESKGLLPNNSEESGICHKYTYGVRAIVQCIPAWLRFIQCLRRYRDTKRAFPHLVNAGKYSTTFFMVTFAALYSTHKERGHSDTMVFFYLWIVFYIISSCYTLIWDLKMDWGLFDKNAGENTFLREEIVYPQKAYYYCAIIEDVILRFAWTIQISITSTTLLPHSGDIIATVFAPLEVFRRFVWNFFRLENEHLNNCGEFRAVRDISVAPLNADDQTLLEQMMDQDDGVRNRQKNRSWKYNQSISLRRPRLASQSKARDTKVLIEDTDDEANT

SEQ ID NO: 911159 - protein, 696 aa, Homo sapiens; identical to SEQ ID NO: 911158

SEQ ID NO: 911160 - protein, 696 aa, Homo sapiens; identical to SEQ ID NO: 911158

SEQ ID NO: 911161 - protein, 340 aa, Homo sapiens [sequence omitted]

SEQ ID NO: 911162 - protein, 603 aa, Homo sapiens [sequence omitted]

SEQ ID NO: 911163 - protein, 394 aa, Homo sapiens [sequence omitted]

SEQ ID NO: 911164 - protein, 696 aa, Homo sapiens; identical to SEQ ID NO: 911158

SEQ ID NO: 911165 - protein, 696 aa, Homo sapiens; identical to SEQ ID NO: 911158

SEQ ID NO: 911166 - protein, 696 aa, Homo sapiens; identical to SEQ ID NO: 911158

SEQ ID NO: 911167 - protein, 696 aa, Homo sapiens; identical to SEQ ID NO: 911158

SEQ ID NO: 911168 - protein, 702 aa, Homo sapiens
MKFAEHLSAHITPEWRKQYIQYEAFKDMLYSAQDQAPSVEVTDEDTVKRYFAKFEEKFFQTCEKELAKINTFYSEKLAEAQRRFATLQNELQSSLDAQKESTGVTTLRQRRKPVFHLSHEERVQHRNIKDLKLAFSEFYLSLILLQNYQNLNFTGFRKILKKHDKILETSRGADWRVAHVEVAPFYTCKKINQLISETEAVVTNELEDGDRQKAMKRLRVPPLGAAQPAPAWTTFRVGLFCGIFIVLNITLVLAAVFKLETDRSIWPLIRIYRGGFLLIEFLFLLGINTYGWRQAGVNHVLIFELNPRSNLSHQHLFEIAGFLGILWCLSLLACFFAPISVIPTYVYPLALYGFMVFFLINPTKTFYYKSRFWLLKLLFRVFTAPFHKVGFADFWLADQLNSLSVILMDLEYMICFYSLELKWDESKGLLPNNSEESGICHKYTYGVRAIVQCIPAWLRFIQCLRRYRDTKRAFPHLVNAGKYSTTFFMVTFAALYSTHKERGHSDTMVFFYLWIVFYIISSCYTLIWDLKMDWGLFDKNAGENTFLREEIVYPQKAYYYCAIIEDVILRFAWTIQISITSTTLLPHSGDIIATVFAPLEVFRQKLETEDKPERESMTLESTCHQSSLQTSAPSLPHLPECLGLAPELPIAAATFPHPLLSLSCVLLHQFFKRNSSKKRKIPHDDFLFKIICLLTKSNVLSH

SEQ ID NO: 911169 - protein, 384 aa, Homo sapiens
RGGRAGLGWAERAYPHGPASGRRGQQRLRVAAAVGCAGVSSLWSAAGWWREEGTAAGAGRGRRAAGAMAEPGSRESETRARSPSVAAMASPQLCRALVSAQWVAEALRAPRAGQPLQLLDASWYLPKLGRDARREFEERHIPGAAFFDIDQCSDRTSPYDHMLPGAEHFAEYAGRLGVGAATHVVIYDASDQGLYSAPRVWWMFRAFGHHAVSLLDGGLRHWLRQNLPLSSGKSQPAPAEFRAQLDPAFIKTYEDIKENLESRRFQVVDSRATGRFRGTEPEPRDGIEPGHIPGTVNIPFTDFLSQEGLEKSPEEIRHLFQEKKVDLSKPLVATCGSGVTACHVALGAYLCGKPDVPIYDGSWVEWYMRARPEDVISEGRGKTH

SEQ ID NO: 911170 - protein, 352 aa, Homo sapiens
GAGAARAWAGRSGRTPTARPVEGAGSSGSEWPRRWAVPESPPFGPLQARSPSVAAMASPQLCRALVSAQWVAEALRAPRAGQPLQLLDASWYLPKLGRDARREFEERHIPGAAFFDIDQCSDRTSPYDHMLPGAEHFAEYAGRLGVGAATHVVIYDASDQGLYSAPRVWWMFRAFGHHAVSLLDGGLRHWLRQNLPLSSGKSQPAPAEFRAQLDPAFIKTYEDIKENLESRRFQVVDSRATGRFRGTEPEPRDGIEPGHIPGTVNIPFTDFLSQEGLEKSPEEIRHLFQEKKVDLSKPLVATCGSGVTACHVALGAYLCGKPDVPIYDGSWVEWYMRARPEDVISEGRGKTH

SEQ ID NO: 911171 - protein, 384 aa, Homo sapiens; identical to SEQ ID NO: 911169

SEQ ID NO: 911172 - protein, 341 aa, Homo sapiens
ARGPRGPGLGGAGVPPRPGQWKARAAAAPSGRGGGLCRSLLPLVRCRPAARVSPPWLRRSSAARWCRRNGWRRRCGPRALGSLCSCWTPPGTCRSWGATRAAFFDIDQCSDRTSPYDHMLPGAEHFAEYAGRLGVGAATHVVIYDASDQGLYSAPRVWWMFRAFGHHAVSLLDGGLRHWLRQNLPLSSGKSQPAPAEFRAQLDPAFIKTYEDIKENLESRRFQVVDSRATGRFRGTEPEPRDGIEPGHIPGTVNIPFTDFLSQEGLEKSPEEIRHLFQEKKVDLSKPLVATCGSGVTACHVALGAYLCGKPDVPIYDGSWVEWYMRARPEDVISEGRGKTH

SEQ ID NO: 911173 - protein, 347 aa, Homo sapiens
RGGRAGLGWAERAYPHGPASGRRGQQRLRVAAAVGCAGVSSLWSAAGWWREEGTAAGAGRGRRAAGAMAEPGSRESETRARSPSVAAMASPQLCRALVSAQWVAEALRAPRAGQPLQLLDASWYLPKLGRDARREFEERHIPGAAFFDIDQCSDRTSPYDHMLPGAEHFAEYAGRLGVGAATHVVIYDASDQGLYSAPRVWWMFRAFGHHAFIKTYEDIKENLESRRFQVVDSRATGRFRGTEPEPRDGIEPGHIPGTVNIPFTDFLSQEGLEKSPEEIRHLFQEKKVDLSKPLVATCGSGVTACHVALGAYLCGKPDVPIYDGSWVEWYMRARPEDVISEGRGKTH

SEQ ID NO: 911174 - protein, 368 aa, Homo sapiens
RGGRAGLGWAERAYPHGPASGRRGQQRLRVAAAVGCAGVSSLWSAAGWWREEGTAAGAGRGRRAAGAMAEPGSRESETRARSPSVAAMASPQLCRALVSAQWVAEALRAPRAGQPLQLLDASWYLPKLGRDARREFEERHIPGAAFFDIDQCSDRTSPYDHMLPGAEHFAEYAGRLGVGAATHVVIYDASDQGLYSAPRVWWMFRAFGHHAVSLLDGGLRHWLRQNLPLSSGKSQPAPAEFRAQLDPAFIKTYEDIKENLESRRFQVVDSRATGRFRGTEPEPRDDFLSQEGLEKSPEEIRHLFQEKKVDLSKPLVATCGSGVTACHVALGAYLCGKPDVPIYDGSWVEWYMRARPEDVISEGRGKTH

SEQ ID NO: 911175 - protein, 130 aa, Homo sapiens [sequence omitted]

SEQ ID NO: 911176 - protein, 178 aa, Homo sapiens
ARGPRGPGLGGAGVPPRPGQWKARAAAAPSGRGGGLCRSLLPLVRCRLVAGGGDSCGRGEGAPRRGGHGGARKPGVRDPGIEPGHIPGTVNIPFTDFLSQEGLEKSPEEIRHLFQEKKVDLSKPLVATCGSGVTACHVALGAYLCGKPDVPIYDGSWVEWYMRARPEDVISEGRGKTH

SEQ ID NO: 911177 - protein, 257 aa, Homo sapiens
RGGRAGLGWAERAYPHGPASGRRGQQRLRVAAAVGCAGVSSLWSAAGWWREEGTAAGAGRGRRAAGAMAEPGSRESETRARSPSVAAMASPQLCRALVSAQWVAEALRAPRAGQPLQLLDASWYLPKLGRDARREFEERHIPGAAFFDIDQCSDRTSPYDHMLPGAEHFAEYAGRLGVGAATHVVIYDASDQGLYSAPRVWWMFRAFGHHAVSLLDGGLRHWLRQNLPLSSGKSQPAPAEFRAQLDPRLLSVLFLRK

SEQ ID NO: 911178 - protein, 384 aa, Homo sapiens; identical to SEQ ID NO: 911169

SEQ ID NO: 911179 - protein, 297 aa, Homo sapiens
MASPQLCRALVSAQWVAEALRAPRAGQPLQLLDASWYLPKLGRDARREFEERHIPGAAFFDIDQCSDRTSPYDHMLPGAEHFAEYAGRLGVGAATHVVIYDASDQGLYSAPRVWWMFRAFGHHAVSLLDGGLRHWLRQNLPLSSGKSQPAPAEFRAQLDPAFIKTYEDIKENLESRRFQVVDSRATGRFRGTEPEPRDGIEPGHIPGTVNIPFTDFLSQEGLEKSPEEIRHLFQEKKVDLSKPLVATCGSGVTACHVALGAYLCGKPDVPIYDGSWVEWYMRARPEDVISEGRGKTH

SEQ ID NO: 911180 - protein, 240 aa, Homo sapiens
NKTERRRGPAQHQVGSSELWPPSSRARLRLSSRPYLATHVVIYDASDQGLYSAPRVWWMFRAFGHHAVSLLDGGLRHWLRQNLPLSSGKSQPAPAEFRAQLDPAFIKTYEDIKENLESRRFQVVDSRATGRFRGTEPEPRDGIEPGHIPGTVNIPFTDFLSQEGLEKSPEEIRHLFQEKKVDLSKPLVATCGSGVTACHVALGAYLCGKPDVPIYDGSWVEWYMRARPEDVISEGRGKTH

SEQ ID NO: 911181 - protein, 416 aa, Homo sapiens
RGGRAGLGWAERAYPHGPASGRRGQQRLRVAAAVGCAGVSSLWSAAGWWREEGTAAGAGRGRRAAGAMAEPGSRESETRARSPSVAAMASPQLCRALVSAQWVAEALRAPRAGQPLQLLDASWYLPKLGRDARREFEERHIPGAAFFDIDQCSDRTSPYDHMLPGAEHFAEYAGRLGVGAATHVVIYDASDQGLYSAPRVWWMFRAFGHHAVSLLDGGLRHWLRQNLPLSSGKSQPAPAEFRAQLDPAFIKTYEDIKENLESRRFQVVDSRATGRFRGTEPEPRDAGVQWRNLGSPNLRLPGSSDSPALASRVAGITGIEPGHIPGTVNIPFTDFLSQEGLEKSPEEIRHLFQEKKVDLSKPLVATCGSGVTACHVALGAYLCGKPDVPIYDGSWVEWYMRARPEDVISEGRGKTH

SEQ ID NO: 911182 - protein, 216 aa, Homo sapiens
MTHSSLSTDSGVLSLCQGLRIDTDTWVSSSCGGVTPLRRETKAEAGQESEWLRFESFVLGGFLFVFVSVVVVVIVLRRSFALVSQLEYSGAISAHHNLRLPGSSDSPALASRVAGITGIEPGHIPGTVNIPFTDFLSQEGLEKSPEEIRHLFQEKKVDLSKPLVATCGSGVTACHVALGAYLCGKPDVPIYDGSWVEWYMRARPEDVISEGRGKTH

SEQ ID NO: 911183 - protein, 360 aa, Homo sapiens
RGGRAGLGWAERAYPHGPASGRRGQQRLRVAAAVGCAGVSSLWSAAGWWREEGTAAGAGRGRRAAGAMAEPGSRESETRARSPSVAAMASPQLCRALVSAQWVAEALRAPRAGQPLQLLDASWYLPKLGRDARREFEERHIPGAAFFDIDQCSDRTSPYDHMLPGAEHFAEYAGRLGVGAATHVVIYDASDQGLYSAPRVWWMFRAFGHHAVSLLDGGLRHWLRQNLPLSSGKSQPAPAEFRAQLDPAFIKTYEDIKENLESRRFQVVDSRATGRFRGTEPEPRDDGNAGEGGRRSSGARPLRPEQCPGLDLSFIFLIYLAFISFPFFFPFLPFPFPPFPLFPTLAFLHSSLGNKSKTPS

SEQ ID NO: 911184 - protein, 234 aa, Homo sapiens
RGGRAGLGWAERAYPHGPASGRRGQQRLRVAAAVGCAGVSSLWSAAGWWREEGTAAGAGRGRRAAGAMAEPGSRESETRARSPSVAAMASPQLCRALVSAQWVAEALRAPRAGQPLQLLDASWYLPKLGRDARREFEERHIPGAAFFDIDQCSDRTSPYDHMLPGAEHFAEYAGRLGVGAATHVVIYDASDQGLYSAPRVWWMFRAFGHHAVSLLDGGLRHWLRQNLPLSSGCQ

SEQ ID NO: 911185 - protein, 263 aa, Homo sapiens
RAGEGAGAPRTRTGRRRAPSGGHRAGAATMEGGAYGAGKAGGAFDPYTLVRQPHTILRVVSWLFSIVVFGSIVNEGYLNSASEGEEFCIYNRNPNACSYGVAVGVLAFLTCLLYLALDVYFPQISSVKDRKKAVLSDIGVSAFWAFLWFVGFCYLANQWQVSKPKDNPLNEGTDAARAAIAFSFFSIFTWAGQAVLAFQRYQIGADSALFSQDYMDPSQDSSMPYAPYVEPNTGPDPAGMGGTYQQPANTFDTEPQGYQSQGY

SEQ ID NO: 911186 - protein, 220 aa, Homo sapiens
RAGEGAGAPRTRTGRRRAPSGGHRAGAATMEGGAYGAGKAGGAFDPYTLVRQPHTILRVVSWLFSIVVFGSIVNEGYLNSASEGEEFCIYNRNPNACSYGVAVGVLAFLTCLLYLALDVYFPQISSVKDRKKAVLSDIGVSAFWAFLWFVGFCYLANQWQVSKPKDNPLNEGTDAARAAIAFSFFSIFTWSLTAALAVRRFKDLSFQEEYSTLFPASAQP

SEQ ID NO: 911187 - protein, 65 aa, Homo sapiens
MEGGAYGAGKAGGAFDPYTLVRQPHTILRVVSWAGGSGMITVHYNLHLLGSRDPPPHLPWYLRLQ

SEQ ID NO: 911188 - protein, 241 aa, Homo sapiens
RAGEGAGAPRTRTGRRRAPSGGHRAGAATMEGGAYGAGKAGGAFDPYTLVRQPHTILRVVSWLFSIVVFGSIVNEGYLNSASEGEEFCIYNRNPNACSYGVAVGVLAFLTCLLYLALDVYFPQISSVKDRKKAVLSDIGVSAFWAFLWFVGFCYLANQWQVSKPKDNPLNEGTDAARAAIAFSFFSIFTWDYMDPSQDSSMPYAPYVEPNTGPDPAGMGGTYQQPANTFDTEPQGYQSQGY

SEQ ID NO: 911189 - protein, 220 aa, Homo sapiens; identical to SEQ ID NO: 911186

SEQ ID NO: 911190 - protein, 220 aa, Homo sapiens; identical to SEQ ID NO: 911186

SEQ ID NO: 911191 - protein, 200 aa, Homo sapiens
QQACLLGLMLTLEFGILEFDPSWIGSWTQRSWVSWRSRPGCELFSIVVFGSIVNEGYLNSASEGEEFCIYNRNPNACSYGVAVGVLAFLTCLLYLALDVYFPQISSVKDRKKAVLSDIGVSAFWAFLWFVGFCYLANQWQVSKPKDNPLNEGTDAARAAIAFSFFSIFTWSLTAALAVRRFKDLSFQEEYSTLFPASAQP

SEQ ID NO: 911192 - protein, 220 aa, Homo sapiens; identical to SEQ ID NO: 911186

SEQ ID NO: 911193 - protein, 243 aa, Homo sapiens
QQACLLGLMLTLEFGILEFDPSWIGSWTQRSWVSWRSRPGCELFSIVVFGSIVNEGYLNSASEGEEFCIYNRNPNACSYGVAVGVLAFLTCLLYLALDVYFPQISSVKDRKKAVLSDIGVSAFWAFLWFVGFCYLANQWQVSKPKDNPLNEGTDAARAAIAFSFFSIFTWAGQAVLAFQRYQIGADSALFSQDYMDPSQDSSMPYAPYVEPNTGPDPAGMGGTYQQPANTFDTEPQGYQSQGY

SEQ ID NO: 911194 - protein, 263 aa, Homo sapiens; identical to SEQ ID NO: 911185

SEQ ID NO: 911195 - protein, 62 aa, Homo sapiens
MGDALLNVPLFLGFPIFSPLTLSPMCGTAYSARSWDPPAFWAFLWFVGFCYLANQWQVSKPK

SEQ ID NO: 911196 - protein, 401 aa, Homo sapiens
METGKDGARRGTQSPERKRRSPVPRAPSTKLRPAAAARAMDPVAAEAPGEAFLARRRPEGGGGSARPRYSLLAEIGRGSYGVVYEAVAGRSGARVAVKKIRCDAPENVELALAEFWALTSLKRRHQNVVQFEECVLQRNGLAQRMSHGNKSSQLYLRLVETSLKGERILGYAEEPCYLWFVMEFCEGGDLNQYVLSRRPDPATNKSFMLQLTSAIAFLHKNHIVHRDLKPDNILITERSGTPILKVADFGLSKVCAGLAPRGKEGNQDNKNVNVNKYWLSSACGSDFYMAPEVWEGHYTAKADIFALGIIIWAMIERITFIDSETKKELLGTYIKQGTEIVPVGEALLENPKMELHIPQKRRTSMSEGIKQLLKDMLAANPQDRPDAFELETRMDQVTCAA

SEQ ID NO: 911197 - protein, 401 aa, Homo sapiens; identical to SEQ ID NO: 911196

SEQ ID NO: 911198 - protein, 401 aa, Homo sapiens; identical to SEQ ID NO: 911196

SEQ ID NO: 911199 - protein, 104 aa, Homo sapiens
MLALTRLPLTPLLALRAGALVALTLGWSQTIPPLGWFSLLGLSGSPQTDVAPGSLGPGNLGRAKLTLFSSSGHWVLEAEVQRYWLCQAVVLGCGTAFETTRVYL

SEQ ID NO: 911200 - protein, 401 aa, Homo sapiens; identical to SEQ ID NO: 911196

SEQ ID NO: 911201 - protein, 401 aa, Homo sapiens; identical to SEQ ID NO: 911196

SEQ ID NO: 911202 - protein, 1007 aa, Homo sapiens [sequence omitted]

SEQ ID NO: 911203 - protein, 200 aa, Homo sapiens
MSRRKQRKPQQLISDCEGPSASENGDASEEDHPQVCAKCCAQFTDPTEFLAHQNACSTDPPVMVIIGGQENPNNSSASSEPRPEGHNNPQVMDTEHSNPPDSGSSVPTDPTWGPERRGEESSGHFLVAATEPVCGIPVKWPAHEALEFQLHLHYHSKPGPTSAVWPRNCGWEGASNNGIQGSQGEDSPPPISASCTQGSA

SEQ ID NO: 911204 - protein, 1007 aa, Homo sapiens [sequence omitted]

SEQ ID NO: 911205 - protein, 1038 aa, Homo sapiens
WVQRLPQTQRPSPPSIPISIVSHPTWPSTSPTTMAHESERSSRLGVPCGEPAELGGDASEEDHPQVCAKCCAQFTDPTEFLAHQNACSTDPPVMVIIGGQENPNNSSASSEPRPEGHNNPQVMDTEHSNPPDSGSSVPTDPTWGPERRGEESSGHFLVAATGTAAGGGGGLILASPKLGATPLPPESTPAPPPPPPPPPPPGVGSGHLNIPLILEELRVLQQRQIHQMQMTEQICRQVLLLGSLGQTVGAPASPSELPGTGTASSTKPLLPLFSPIKPVQTSKTLASSSSSSSSSSGAETPKQAFFHLYHPLGSQHPFSAGGVGRSHKPTPAPSPALPGSTDQLIASPHLAFPSTTGLLAAQCLGAARGLEATASPGLLKPKNGSGELSYGEVMGPLEKPGGRHKCRFCAKVFGSDSALQIHLRSHTGERPYKCNVCGNRFTTRGNLKVHFHRHREKYPHVQMNPHPVPEHLDYVITSSGLPYGMSVPPEKAEEEAATPGGGVERKPLVASTTALSATESLTLLSTSAGTATAPGLPAFNKFVLMKAVEPKNKADENTPPGSEGSAISGVAESSTATRMQLSKLVTSLPSWALLTNHFKSTGSFPFPYVLEPLGASPSETSKLQQLVEKIDRQGAVAVTSAASGAPTTSAPAPSSSASSGPNQCVICLRVLSCPRALRLHYGQHGGERPFKCKVCGRAFSTRGNLRAHFVGHKASPAARAQNSCPICQKKFTNAVTLQQHVRMHLGGQIPNGGTALPEGGGAAQENGSEQSTVSGAGSFPQQQSQQPSPEEELSEEEEEEDEEEEEDVTDEDSLAGRGSESGGEKAISVRGDSEEASGAEEEVGTVAAAATAGKEMDSNEKTTQQSSLPPPPPPDSLDQPQPMEQGSSGVLGGKEEGGKPERSSSPASALTPEGEATSVTLVEELSLQEAMRKEPGESSSRKACEVCGQAFPSQAALEEHQKTHPKEGPLFTCVFCRQGFLERATLKKHMLLAHHQVQPFAPHGPQNIAALSLVPGCSPSITSTGLSPFPRKDDPTIP

SEQ ID NO: 911206 - protein, 231 aa, Homo sapiens
WVQRLPQTQRPSPPSIPISIVSHPTWPSTSPTTMAHESERSSRLGVPCGEPAELGGDASEEDHPQVCAKCCAQFTDPTEFLAHQNACSTDPPVMVIIGGQENPNNSSASSEPRPEGHNNPQVMDTEHSNPPDSGSSVPTDPTWGPERRGEESSGHFLVAATEPVCGIPVKWPAHEALEFQLHLHYHSKPGPTSAVWPRNCGWEGASNNGIQGSQGEDSPPPISASCTQGSA

SEQ ID NO: 911207 - protein, 369 aa, Homo sapiens
LTSSRSAGSGEAQMSNVNLSVSDFWRVMMRVCWLVRQDSRHQRIRLPHLEAVVIGRGPETKITDKKCSRQQVQLKAECNKGYVKVKQVGVNPTSIDSVVIGKDQEVKLQPGQVLHMVNELYPYIVEFEEEAKNPGLETHRKRKRSGNSDSIERDAAQEAEAGTGLEPGSNSGQCSVPLKKGKDAPIKKESLGHWSQGLKISMQDPKMQVYKDEQVVVIKDKYPKARYHWLVLPWTSISSLKAVAREHLELLKHMHTVGEKVIVDFAGSSKLRFRLGYHAIPSMSHVHLHVISQDFDSPCLKNKKHWNSFNTEYFLESQAVIEMVQEAGRVTVRDGMPELLKLPLRCHECQQLLPSIPQLKEHLRKHWTQ

SEQ ID NO: 911208 - protein, 341 aa, Homo sapiens [sequence omitted]

SEQ ID NO: 911209 - protein, 168 aa, Homo sapiens
MQDPKMQVYKDEQVVVIKDKYPKARYHWLVLPWTSISSLKAVAREHLELLKHMHTVGEKVIVDFAGSSKLRFRLGYHAIPSMSHVHLHVISQDFDSPCLKNKKHWNSFNTEYFLESQAVIEMVQEAGRVTVRDGMPELLKLPLRCHECQQLLPSIPQLKEHLRKHWTQ

SEQ ID NO: 911210 - protein, 112 aa, Homo sapiens
LTSSRSAGSGEAQMSNVNLSVSDFWRVMMRVCWLVRQDSRHQRIRLPHLEAVVIGRGPETKITDKKCSRQQVQLKAECNKGYVKVKQSLRKRQRTLAWKHTGRERDQATVIL

SEQ ID NO: 911211 - protein, 315 aa, Homo sapiens
LTSSRSAGSGEAQMSNVNLSVSDFWRVMMRVCWLVRQDSRHQRIRLPHLEAVVIGRGPETKITDKKCSRQQEFEEEAKNPGLETHRKRKRSGNSDSIERDAAQEAEAGTGLEPGSNSGQCSVPLKKGKDAPIKKESLGHWSQGLKISMQDPKMQVYKDEQVVVIKDKYPKARYHWLVLPWTSISSLKAVAREHLELLKHMHTVGEKVIVDFAGSSKLRFRLGYHAIPSMSHVHLHVISQDFDSPCLKNKKHWNSFNTEYFLESQAVIEMVQEAGRVTVRDGMPELLKLPLRCHECQQLLPSIPQLKEHLRKHWTQ

SEQ ID NO: 911212 - protein, 349 aa, Homo sapiens
LTSSRSAGSGEAQMSNVNLSVSDFWRVMMRVCWLVRQDSRHQRIRLPHLEAVVIGRGPETKITDKKCSRQQVQLKAECNKGYVKVKQVGVNPTSIDSVVIGKDQEVKLQPGQVLHMVNELYPYIVEFEEEAKNPGLETHRKRKRSGNSDSIERDAAQEAEAGTGLEPGSNSGQCSVPLKKGKDAPIKKVYKDEQVVVIKDKYPKARYHWLVLPWTSISSLKAVAREHLELLKHMHTVGEKVIVDFAGSSKLRFRLGYHAIPSMSHVHLHVISQDFDSPCLKNKKHWNSFNTEYFLESQAVIEMVQEAGRVTVRDGMPELLKLPLRCHECQQLLPSIPQLKEHLRKHWTQ

SEQ ID NO: 911213 - protein, 319 aa, Homo sapiens
LTSSRSAGSGEAQMSNVNLSVSDFWRVMMRVCWLVRQDSRHQRIRLPHLEAVVIGRGPETKITDKKCSRQQVQLKAECNKGYVKVKQVGVNPTSIDSVVIGKDQEVKLQPGQVLHMVNELYPYIVEFEEEAKNPGLETHRKRKRSGNSDSIERDAAQEAEAGTGLEPGSNSGQCSVPLKKGKDAPIKKESLGHWSQGLKISMQDPKMQVYKDEQVVVIKDKYPKARYHWLVLPWTSISSLKAVAREHLELLKHMHTVGEKVIVDFAGSSKLRFRLGYHAIPSMSHVHLHVISQDFDSPCLKNKKHWNSFNTEYFLESQE

SEQ ID NO: 911214 - protein, 297 aa, Homo sapiens
LTSSRSAGSGEAQMSNVNLSVSDFWRVMMRVCWLVRQDSRHQRIRLPHLEAVVIGRGPETKITDKKCSRQQVQLKAECNKGYVKVKQVGVNPTSIDSVVIGKDQEVKLQPGQVLHMESLGHWSQGLKISMQDPKMQVYKDEQVVVIKDKYPKARYHWLVLPWTSISSLKAVAREHLELLKHMHTVGEKVIVDFAGSSKLRFRLGYHAIPSMSHVHLHVISQDFDSPCLKNKKHWNSFNTEYFLESQAVIEMVQEAGRVTVRDGMPELLKLPLRCHECQQLLPSIPQLKEHLRKHWTQ

SEQ ID NO: 911215 - protein, 125 aa, Homo sapiens [sequence omitted]

SEQ ID NO: 911216 - protein, 168 aa, Homo sapiens; identical to SEQ ID NO: 911209

SEQ ID NO: 911217 - protein, 342 aa, Homo sapiens
MMRVCWLVRQDSRHQRIRLPHLEAVVIGRGPETKITDKKCSRQQVQLKAECNKGYVKVKQVGVNPTSIDSVVIGKDQEVKLQPGQVLHMVNELYPYIVEFEEEAKNPGLETHRKRKRSGNSDSIERDAAQEAEAGTGLEPGSNSGQCSVPLKKGKDAPIKKESLGHWSQGLKISMQDPKMQVYKDEQVVVIKDKYPKARYHWLVLPWTSISSLKAVAREHLELLKHMHTVGEKVIVDFAGSSKLRFRLGYHAIPSMSHVHLHVISQDFDSPCLKNKKHWNSFNTEYFLESQAVIEMVQEAGRVTVRDGMPELLKLPLRCHECQQLLPSIPQLKEHLRKHWTQ

SEQ ID NO: 911218 - protein, 168 aa, Homo sapiens; identical to SEQ ID NO: 911209

SEQ ID NO: 911219 - protein, 342 aa, Homo sapiens; identical to SEQ ID NO: 911217

SEQ ID NO: 911220 - protein, 288 aa, Homo sapiens
MMRVCWLVRQDSRHQRIRLPHLEAVVIGRGPETKITDKKCSRQQEFEEEAKNPGLETHRKRKRSGNSDSIERDAAQEAEAGTGLEPGSNSGQCSVPLKKGKDAPIKKESLGHWSQGLKISMQDPKMQVYKDEQVVVIKDKYPKARYHWLVLPWTSISSLKAVAREHLELLKHMHTVGEKVIVDFAGSSKLRFRLGYHAIPSMSHVHLHVISQDFDSPCLKNKKHWNSFNTEYFLESQAVIEMVQEAGRVTVRDGMPELLKLPLRCHECQQLLPSIPQLKEHLRKHWTQ

SEQ ID NO: 911221 - protein, 168 aa, Homo sapiens; identical to SEQ ID NO: 911209

SEQ ID NO: 911222 - protein, 259 aa, Homo sapiens
AGAFRRLLPSRRRVLGGAFLRVLGPRPRAVPVGRCGPAFLALLSGLGVGLGWWGGWGGWEEWGMVVGVKKGKDGGMKKESLGHWSQGLKISMQDPKMQVYKDEQVVVIKDKYPKARYHWLVLPWTSISSLKAVAREHLELLKHMHTVGEKVIVDFAGSSKLRFRLGYHAIPSMSHVHLHVISQDFDSPCLKNKKHWNSFNTEYFLESQAVIEMVQEAGRVTVRDGMPELLKLPLRCHECQQLLPSIPQLKEHLRKHWTQ

SEQ ID NO: 911223 - protein, 33 aa, Homo sapiens
MLEPGGSSPQTNSIGLGSCCFSRVVQGGIINQI

SEQ ID NO: 911224 - protein, 83 aa, Homo sapiens
VRNSRVEYYYIIRGRVTRLDLYNLVYQNLTWLQYEIFVQNYFLKHLFHEIMFNPVPGVILKLIACNLTLLIMFIIFPNNALTD

SEQ ID NO: 911225 - protein, 683 aa, Homo sapiens
RHYQARAGNMAAAGVVSGKIIYEQEGVYIHSSCGKTNDQDGLISGILRVLEKDAEVIVDWRPLDDALDSSSILYARKDSSSVVEWTQAPKERGHRGSEHLNSYEAEWDMVNTVSFKRKPHTNGDAPSHRNGKSKWSFLFSLTDLKSIKQNKEGMGWSYLVFCLKDDVVLPALHFHQGDSKLLIESLEKYVVLCESPQDKRTLLVNCQNKSLSQSFENLLDEPAYGLIQKIKKDPYTATMIGFSKVTNYIFDSLRGSDPSTHQRPPSEMADFLSDAIPGLKINQQEEPGFEVITRIDLGERPVVQRREPVSLEEWTKNIDSEGRILNVDNMKQMIFRGGLSHALRKQAWKFLLGYFPWDSTKEERTQLQKQKTDEYFRMKLQWKSISQEQEKRNSRLRDYRSLIEKDVNRTDRTNKFYEGQDNPGLILLHDILMTYCMYDFDLGYVQGMSDLLSPLLYVMENEVDAFWCFASYMDQMHQNFEEQMQGMKTQLIQLSTLLRLLDSGFCSYLESQDSGYLYFCFRWLLIRFKREFSFLDILRLWEVMWTELPCTNFHLLLCCAILESEKQQIMEKHYGFNEILKHINELSMKIDVEDILCKAEAISLQMVKCKELPQAVCEILGLQGSEVTTPDSDVGEDENVVMTPCPTSAFQSNALPTLSASGARNDSPTQIPVSSDVCRLTPA

SEQ ID NO: 911226 - protein, 306 aa, Homo sapiens [sequence omitted]

SEQ ID NO: 911227 - protein, 683 aa, Homo sapiens; identical to SEQ ID NO: 911225

SEQ ID NO: 911228 - protein, 683 aa, Homo sapiens; identical to SEQ ID NO: 911225

SEQ ID NO: 911229 - protein, 683 aa, Homo sapiens; identical to SEQ ID NO: 911225

SEQ ID NO: 911230 - protein, 445 aa, Homo sapiens
MIGFSKVTNYIFDSLRGSDPSTHQRPPSEMADFLSDAIPGLKINQQEEPGFEVITRIDLGERPVVQRREPVSLEEWTKNIDSEGRILNVDNMKQMIFRGGLSHALRKQAWKFLLGYFPWDSTKEERTQLQKQKTDEYFRMKLQWKSISQEQEKRNSRLRDYRSLIEKDVNRTDRTNKFYEGQDNPGLILLHDILMTYCMYDFDLGYVQGMSDLLSPLLYVMENEVDAFWCFASYMDQMHQNFEEQMQGMKTQLIQLSTLLRLLDSGFCSYLESQDSGYLYFCFRWLLIRFKREFSFLDILRLWEVMWTELPCTNFHLLLCCAILESEKQQIMEKHYGFNEILKHINELSMKIDVEDILCKAEAISLQMVKCKELPQAVCEILGLQGSEVTTPDSDVGEDENVVMTPCPTSAFQSNALPTLSASGARNDSPTQIPVSSDVCRLTPA

SEQ ID NO: 911231 - protein, 665 aa, Homo sapiens
RHYQARAGNMAAAGVVSGKIIYEQEGVYIHSSCGKTNDQDGLISGILRVLEKDAEVIVDWRPLDDALDSSSILYARKDSSSVVEWTQAPKERGHRGSEHLNSYEAEWDMVNTVSFKRKPHTNGDAPSHRNGKSKWSFLFSLTDLKSIKQNKEGMGWSYLVFCLKDDVVLPALHFHQGDSKLLIESLEKYVVLCESPQDKRTLLVNCQNKSLSQSFENLLDEPAYGLIQKIKKDPYTATMIGFSKVTNYIFDSLRGSDPSTHQRPPSEMADFLSDAIPGLKINQQEEPGFEVITRIDLGERPVVQRREPVSLEEWTKNIDSEGRILNVDNMKQMIFRGGLSHALRKQAWKFLLGYFPWDSTKEERTQLQKQKTDEYFRMKLQWKSISQEQEKRNSRLRDYRSLIEKDVNRTDRTNKFYEGQDNPGLILLHDILMTYCMYDFDLGYVQGMSDLLSPLLYVMENEVDAFWCFASYMDQMHQNFEEQMQGMKTQLIQLSTLLRLLDSGFCSYLESQDSGYLYFCFRWLLIRFKREFSFLDILRLWEVMWTELPCTNFHLLLCCAILESEKQQIMEKHYGFNEILKHINELSMKIDVEDILCKAEAISLQMVKCKELPQAVCEILGLQGSEVTTPDSDVGEDATLSASGARNDSPTQIPVSSDVCRLTPA

SEQ ID NO: 911232 - protein, 626 aa, Homo sapiens
RHYQARAGNMAAAGVVSGKIIYEQEGVYIHSSCGKTNDQDGLISGILRVLEKDAEVIVDWRPLDDALDSSSILYARKDSSSVVEWTQAPKERGHRGSEHLNSYEAEWDMVNTVSFKRKPHTNGDAPSHRNGKSKWSFLFSLTDLKSIKQNKEGMGWSYLVFCLKDDVVLPALHFHQGDSKLLIESLEKYVVLCESPQDKRTLLVNCQNKSLSQSFENLLDEPAYGLIQKIKKDPYTATMIGFSKVTNYIFDSLRGSDPSTHQRPPSEMADFLSDAIPGLKINQQEEPGFEVITRIDLGERPVVQRREPVSLEEWTKNIDSEGRILNVDNMKQMIFRGGLSHALRKQAWKFLLGYFPWDSTKEERTQLQKQKTDEYFRMKLQWKSISQEQEKRNSRLRDYRSLIEKDVNRTDRTNKFYEGQDNPGLILLHDILMTYCMYDFDLGYVQGMSDLLSPLLYVMENEVDAFWCFASYMDQMHQNFEEQMQGMKTQLIQLSTLLRLLDSGFCSYLESQDSGYLYFCFRWLLIRFKREFSFLDILRLWEVMWTELPCTNFHLLLCCAILESEKQQIMEKHYGFNEILKHINELSMKIDVEDILCKAEAISLQMVKCKVYSVSSNCKICLFLVG

SEQ ID NO: 911233 - protein, 138 aa, Homo sapiens
MPNFSGNWKIIRSENFEELLKVLGVNVMLRKIAVAAASKPAVEIKQEGDTFYIKTSTTVRTTEINFKVGEEFEEQTVDGRPCKSLVKWESENKMVCEQKLLKGEGPKTSWTRELTNDGELILTMTADDVVCTRVYVRE

SEQ ID NO: 911234 - protein, 138 aa, Homo sapiens; identical to SEQ ID NO: 911233

SEQ ID NO: 911235 - protein, 138 aa, Homo sapiens; identical to SEQ ID NO: 911233

SEQ ID NO: 911236 - protein, 138 aa, Homo sapiens; identical to SEQ ID NO: 911233

SEQ ID NO: 911237 - protein, 133 aa, Homo sapiens
MPNFSGNWKIIRSENFEELLKVLGVNVMLRKIAVAAASKPAVEIKQEGDTFYIKTSTTVRTTEINFKVGEEFEEQTVDGRPCKSLVKWESENKMVCEQKLLKGEGPKTSRIALPLPQSLLGVTGMPLAGSCFL

SEQ ID NO: 911238 - protein, 138 aa, Homo sapiens; identical to SEQ ID NO: 911233

SEQ ID NO: 911239 - protein, 1018 aa, Homo sapiens
MKMWLLVSHLVIISITTCLAEFTWYRRYGHGVSEEDKGFGPIFEEQPINTIYPEESLEGKVSLNCRARASPFPVYKWRMNNGDVDLTSDRYSMVGGNLVINNPDKQKDAGIYYCLASNNYGMVRSTEATLSFGYLDPFPPEERPEVRVKEGKGMVLLCDPPYHFPDDLSYRWLLNEFPVFITMDKRRFVSQTNGNLYIANVEASDKGNYSCFVSSPSITKSVFSKFIPLIPIPERTTKPYPADIVVQFKDVYALMGQNVTLECFALGNPVPDIRWRKVLEPMPSTAEISTSGAVLKIFNIQLEDEGIYECEAENIRGKDKHQARIYVQAFPEWVEHINDTEVDIGSDLYWPCVATGKPIPTIRWLKNGYAYHKGELRLYDVTFENAGMYQCIAENTYGAIYANAELKILALAPTFEMNPMKKKILAAKGGRVIIECKPKAAPKPKFSWSKGTEWLVNSSRILIWEDGSLEINNITRNDGGIYTCFAENNRGKANSTGTLVITDPTRIILAPINADITVGENATMQCAASFDPALDLTFVWSFNGYVIDFNKENIHYQRNFMLDSNGELLIRNAQLKHAGRYTCTAQTIVDNSSASADLVVRGPPGPPGGLRIEDIRATSVALTWSRGSDNHSPISKYTIQTKTILSDDWKDAKTDPPIIEGNMEAARAVDLIPWMEYEFRVVATNTLGRGEPSIPSNRIKTDGAAPNVAPSDVGGGGGRNRELTITWAPLSREYHYGNNFGYIVAFKPFDGEEWKKVTVTNPDTGRYVHKDETMSPSTAFQVKVKAFNNKGDGPYSLVAVINSAQDAPSEAPTEVGVKVLSSSEISVHWEHVLEKIVESYQIRYWAAHDKEEAANRVQVTSQEYSARLENLLPDTQYFIEVGACNSAGCGPPSDMIEAFTKKAPPSQPPRIISSVRSGSRYIITWDHVVALSNESTVTGYKVLYRPDGQHDGKLYSTHKHSIEVPIPRDGEYVVEVRAHSDGGDGVVSQVKISGAPTLSPSLLGLLLPAFGILVYLEF

SEQ ID NO: 911240 - protein, 1072 aa, Homo sapiens
AEPGWAPPRRGGAPVGRCAPRCLQRKWETCRVWSSCAAPRRAGAGNRCLKLSNCHRAKFFFGKLNRTSTEYKMKMWLLVSHLVIISITTCLAEFTWYRRYGHGVSEEDKGFGPIFEEQPINTIYPEESLEGKVSLNCRARASPFPVYKWRMNNGDVDLTSDRYSMVGGNLVINNPDKQKDAGIYYCLASNNYGMVRSTEATLSFGYLDPFPPEERPEVRVKEGKGMVLLCDPPYHFPDDLSYRWLLNEFPVFITMDKRRFVSQTNGNLYIANVEASDKGNYSCFVSSPSITKSVFSKFIPLIPIPERTTKPYPADIVVQFKDVYALMGQNVTLECFALGNPVPDIRWRKVLEPMPSTAEISTSGAVLKIFNIQLEDEGIYECEAENIRGKDKHQARIYVQAFPEWVEHINDTEVDIGSDLYWPCVATGKPIPTIRWLKNGYAYHKGELRLYDVTFENAGMYQCIAENTYGAIYANAELKILALAPTFEMNPMKKKILAAKGGRVIIECKPKAAPKPKFSWSKGTEWLVNSSRILIWEDGSLEINNITRNDGGIYTCFAENNRGKANSTGTLVITDPTRIILAPINADITVGENATMQCAASFDPALDLTFVWSFNGYVIDFNKENIHYQRNFMLDSNGELLIRNAQLKHAGRYTCTAQTIVDNSSASADLVVRGPPGPPGGLRIEDIRATSVALTWSRGSDNHSPISKYTIQTKTILSDDWKDAKTDPPIIEGNMEAARAVDLIPWMEYEFRVVATNTLGRGEPSIPSNRIKTDGAAPNVAPSDVGGGGGRNRELTITWAPLSREYHYGNNFGYIVAFKPFDGEEWNMSPSTAFQVKVKAFNNKGDGPYSLVAVINSAQDAPSEAPTEVGVKVLSSSEISVHWEHVLEKIVESYQIRYWAAHDKEEAANRVQVTSQEYSARLENLLPDTQYFIEVGACNSAGCGPPSDMIEAFTKKAPPSQPPRIISSVRSGSRYIITWDHVVALSNESTVTGYKVLYRPDGQHDGKLYSTHKHSIEVPIPRDGEYVVEVRAHSDGGDGVVSQVKISGAPTLSPSLLGLLLPAFGILVYLEF

SEQ ID NO: 911241 - protein, 337 aa, Homo sapiens
SVCFCGVWCWSFLSISSDSFRSSAPNVAPSDVGGGGGRNRELTITWAPLSREYHYGNNFGYIVAFKPFDGEEWKKVTVTNPDTGRYVHKDETMSPSTAFQVKVKAFNNKGDGPYSLVAVINSAQDAPSEAPTEVGVKVLSSSEISVHWEHVLEKIVESYQIRYWAAHDKEEAANRVQVTSQEYSARLENLLPDTQYFIEVGACNSAGCGPPSDMIEAFTKKAPPSQPPRIISSVRSGSRYIITWDHVVALSNESTVTGYKVLYRPDGQHDGKLYSTHKHSIEVPIPRDGEYVVEVRAHSDGGDGVVSQVKISGAPTLSPSLLGLLLPAFGILVYLEF

SEQ ID NO: 911242 - protein, 699 aa, Homo sapiens
AEPGWAPPRRGGAPVGRCAPRCLQRKWETCRVWSSCAAPRRAGAGNRCLKLSNCHRAKFFFGKLNRTSTEYKMKMWLLVSHLVIISITTCLAEFTWYRRYGHGVSEEDKGFGPIFEEQPINTIYPEESLEGKVSLNCRARASPFPVYKWRMNNGDVDLTSDRYSMVGGNLVINNPDKQKDAGIYYCLASNNYGMVRSTEATLSFGYLDPFPPEERPEVRVKEGKGMVLLCDPPYHFPDDLSYRWLLNEFPVFITMDKRRFVSQTNGNLYIANVEASDKGNYSCFVSSPSITKSVFSKFIPLIPIPERTTKPYPADIVVQFKDVYALMGQNVTLECFALGNPVPDIRWRKVLEPMPSTAEISTSGAVLKIFNIQLEDEGIYECEAENIRGKDKHQARIYVQAFPEWVEHINDTEVDIGSDLYWPCVATGKPIPTIRWLKNGYAYHKGELRLYDVTFENAGMYQCIAENTYGAIYANAELKILALAPTFEMNPMKKKILAAKGGRVIIECKPKAAPKPKFSWSKGTEWLVNSSRILIWEDGSLEINNITRNDGGIYTCFAENNRGKANSTGTLVITDPTRIILAPINADITVGENATMQCAASFDPALDLTFVWSFNGYVIDFNKENIHYQRNFMLDSNGELLIRNAQLKHAGRYTCTAQTIVDNSSASADLVVRGKNRKGGEKNMVDSFLPVCASLPPTW

SEQ ID NO: 911243 - protein, 1090 aa, Homo sapiens
AEPGWAPPRRGGAPVGRCAPRCLQRKWETCRVWSSCAAPRRAGAGNRCLKLSNCHRAKFFFGKLNRTSTEYKMKMWLLVSHLVIISITTCLAEFTWYRRYGHGVSEEDKGFGPIFEEQPINTIYPEESLEGKVSLNCRARASPFPVYKWRMNNGDVDLTSDRYSMVGGNLVINNPDKQKDAGIYYCLASNNYGMVRSTEATLSFGYLDPFPPEERPEVRVKEGKGMVLLCDPPYHFPDDLSYRWLLNEFPVFITMDKRRFVSQTNGNLYIANVEASDKGNYSCFVSSPSITKSVFSKFIPLIPIPERTTKPYPADIVVQFKDVYALMGQNVTLECFALGNPVPDIRWRKVLEPMPSTAEISTSGAVLKIFNIQLEDEGIYECEAENIRGKDKHQARIYVQAFPEWVEHINDTEVDIGSDLYWPCVATGKPIPTIRWLKNGYAYHKGELRLYDVTFENAGMYQCIAENTYGAIYANAELKILALAPTFEMNPMKKKILAAKGGRVIIECKPKAAPKPKFSWSKGTEWLVNSSRILIWEDGSLEINNITRNDGGIYTCFAENNRGKANSTGTLVITDPTRIILAPINADITVGENATMQCAASFDPALDLTFVWSFNGYVIDFNKENIHYQRNFMLDSNGELLIRNAQLKHAGRYTCTAQTIVDNSSASADLVVRGPPGPPGGLRIEDIRATSVALTWSRGSDNHSPISKYTIQTKTILSDDWKDAKTDPPIIEGNMEAARAVDLIPWMEYEFRVVATNTLGRGEPSIPSNRIKTDGAAPNVAPSDVGGGGGRNRELTITWAPLSREYHYGNNFGYIVAFKPFDGEEWKKVTVTNPDTGRYVHKDETMSPSTAFQVKVKAFNNKGDGPYSLVAVINSAQDAPSEAPTEVGVKVLSSSEISVHWEHVLEKIVESYQIRYWAAHDKEEAANRVQVTSQEYSARLENLLPDTQYFIEVGACNSAGCGPPSDMIEAFTKKAPPSQPPRIISSVRSGSRYIITWDHVVALSNESTVTGYKVLYRPDGQHDGKLYSTHKHSIEVPIPRDGEYVVEVRAHSDGGDGVVSQVKISGAPTLSPSLLGLLLPAFGILVYLEF

SEQ ID NO: 911244 - protein, 1079 aa, Homo sapiens
AEPGWAPPRRGGAPVGRCAPRCLQRKWETCRVWSSCAAPRRAGAGNRCLKLSNCHRAKFFFGKLNRTSTEYKMKMWLLVSHLVIISITTCLAVSEEDKGFGPIFEEQPINTIYPEESLEGKVSLNCRARASPFPVYKWRMNNGDVDLTSDRYSMVGGNLVINNPDKQKDAGIYYCLASNNYGMVRSTEATLSFGYLDPFPPEERPEVRVKEGKGMVLLCDPPYHFPDDLSYRWLLNEFPVFITMDKRRFVSQTNGNLYIANVEASDKGNYSCFVSSPSITKSVFSKFIPLIPIPERTTKPYPADIVVQFKDVYALMGQNVTLECFALGNPVPDIRWRKVLEPMPSTAEISTSGAVLKIFNIQLEDEGIYECEAENIRGKDKHQARIYVQAFPEWVEHINDTEVDIGSDLYWPCVATGKPIPTIRWLKNGYAYHKGELRLYDVTFENAGMYQCIAENTYGAIYANAELKILALAPTFEMNPMKKKILAAKGGRVIIECKPKAAPKPKFSWSKGTEWLVNSSRILIWEDGSLEINNITRNDGGIYTCFAENNRGKANSTGTLVITDPTRIILAPINADITVGENATMQCAASFDPALDLTFVWSFNGYVIDFNKENIHYQRNFMLDSNGELLIRNAQLKHAGRYTCTAQTIVDNSSASADLVVRGPPGPPGGLRIEDIRATSVALTWSRGSDNHSPISKYTIQTKTILSDDWKDAKTDPPIIEGNMEAARAVDLIPWMEYEFRVVATNTLGRGEPSIPSNRIKTDGAAPNVAPSDVGGGGGRNRELTITWAPLSREYHYGNNFGYIVAFKPFDGEEWKKVTVTNPDTGRYVHKDETMSPSTAFQVKVKAFNNKGDGPYSLVAVINSAQDAPSEAPTEVGVKVLSSSEISVHWEHVLEKIVESYQIRYWAAHDKEEAANRVQVTSQEYSARLENLLPDTQYFIEVGACNSAGCGPPSDMIEAFTKKAPPSQPPRIISSVRSGSRYIITWDHVVALSNESTVTGYKVLYRPDGQHDGKLYSTHKHSIEVPIPRDGEYVVEVRAHSDGGDGVVSQVKISGAPTLSPSLLGLLLPAFGILVYLEF

SEQ ID NO: 911245 - protein, 1087 aa, Homo sapiens
AEPGWAPPRRGGAPVGRCAPRCLQRKWETCRVWSSCAAPRRAGAGNRCLKLSNCHRAKFFFGKLNRTSTEYKMKMWLLVSHLVIISITTCLAEFTWYRRYGHGVSEEDKGFGPIFEEQPINTIYPEESLEGKVSLNCRARASPFPVYKWRMNNGDVDLTSDRYSMVGGNLVINNPDKQKDAGIYYCLASNNYGMVRSTEATLSFGYLDPFPPEERPEVRVKEGKGMVLLCDPPYHFPDDLSYRWLLNEFPVFITMDKRRFVSQTNGNLYIANVEASDKGNYSCFVSSPSITKSVFSKFIPLIPIPERTTKPYPADIVVQFKDVYALMGQNVTLECFALGNPVPDIRWRKVLEPMPSTAEISTSGAVLKIFNIQLEDEGIYECEAENIRGKDKHQARIYVQAFPEWVEHINDTEVDIGSDLYWPCVATGKPIPTIRWLKNGYAYHKGELRLYDVTFENAGMYQCIAENTYGAIYANAELKILALAPTFEMNPMKKKILAAKGGRVIIECKPKAAPKPKFSWSKGTEWLVNSSRILIWEDGSLEINNITRNDGGIYTCFAENNRGKANSTGTLVITDPTRIILAPINADITVGENATMQCAASFDPALDLTFVWSFNGYVIDFNKENIHYQRNFMLDSNGELLIRNAQLKHAGRYTCTAQTIVDNSSASADLVVRGPPGPPGGLRIEDIRATSVALTWSRGSDNHSPISKYTIQTKTILSDDWKDAKTDPPIIEGNMEAARAVDLIPWMEYEFRVVATNTLGRGEPSIPSNRIKTDGAAPNVAPSDVGGGGGRNRELTITWAPLSREYHYGNNFGYIVAFKPFDGEEWKKVTVTNPDTGRYVHKDETMSPSTAFQVKVKAFNNKGDGPYSLVAVINSAQDAPSEAPTEVGVKVLSSSEISVHWEHVLEKIVESYQIRYWAAHDKEEAANRVQVTSQEYSARLENLLPDTQYFIEVGACNSAGCGPPSDMIEAFTKKAPPSQPPRIISSVRSGSRYIITWDHVVALSNESTVTGYKVLYRPDGQHDGKLYSTHKHSIEVPIPRDGEYVVEVRAHSDGGDGVVSQVKISEGKSTSLRSKTAKDHRSIRTMS

SEQ ID NO: 911246 - protein, 758 aa, Homo sapiens
AEPGWAPPRRGGAPVGRCAPRCLQRKWETCRVWSSCAAPRRAGAGNRCLKLSNCHRAKFFFGKLNRTSTEYKMKMWLLVSHLVIISITTCLAEFTWYRRYGHGVSEEDKGFGPIFEEQPINTIYPEESLEGKVSLNCRARASPFPVYKWRMNNGDVDLTSDRYSMVGGNLVINNPDKQKDAGIYYCLASNNYGMVRSTEATLSFGYLDPFPPEERPEVRVKEGKGMVLLCDPPYHFPDDLSYRWLLNEFPVFITMDKRRFVSQTNGNLYIANVEASDKGNYSCFVSSPSITKSVFSKFIPLIPIPERTTKPYPADIVVQFKDVYALMGQNVTLECFALGNPVPDIRWRKVLEPMPSTAEISTSGAVLKIFNIQLEDEGIYECEAENIRGKDKHQARIYVQAFPEWVEHINDTEVDIGSDLYWPCVATGKPIPTIRWLKNGYAYHKGELRLYDVTFENAGMYQCIAENTYGAIYANAELKILALAPTFEMNPMKKKILAAKGGRVIIECKPKAAPKPKFSWSKGTEWLVNSSRILIWEDGSLEINNITRNDGGIYTCFAENNRGKANSTGTLVITDPTRIILAPINADITVGENATMQCAASFDPALDLTFVWSFNGYVIDFNKENIHYQRNFMLDSNGELLIRNAQLKHAGRYTCTAQTIVDNSSASADLVVRGPPGPPGGLRIEDIRATSVALTWSRGSDNHSPISKYTIQTKTILSDDWKDAKTDPPIIEGTTDTVSNYDTSLTQINALVHTVAHI

SEQ ID NO: 911247 - protein, 414 aa, Homo sapiens [sequence omitted]

SEQ ID NO: 911248 - protein, 258 aa, Homo sapiens
AKGNSPPAINSEAWVAPEGPLAVLRDRAQQISCPLYLCPMLEALEEGGPPLTLGLEGEHQRSNAALALQLAHCWLQRQDRHGAGEPKASRPGLLWQLPLAPVFQPTSHMRLGLRNTEWPGRTQVLRRGPLTWYLDGAHTASSAQACVRWFRQALQGRERPSGGPEVRVLLFNATGDRDPAALLKLLQPCQFDYAVFCPNLTEVSSTGNADQQNFTVTLDQVLLRCLEHQQHWNHLDEEQASPDLWSAPSPEPGGLSVR

SEQ ID NO: 911249 - protein, 587 aa, Homo sapiens [sequence omitted]

SEQ ID NO: 911250 - protein, 587 aa, Homo sapiens [sequence omitted]

SEQ ID NO: 911251 - protein, 435 aa, Homo sapiens
MSRARSHLRAALFLAAASARGVTTQVAARRGLSAWPVPQEPSMEYQDAVRMLNTLQTNAGYLEQVKRQRGDPQTQLEAMELYLARSGLQVEDLDRLNIIHVTGTKGKGSTCAFTECILRSYGLKTGFFSSPHLVQVRERIRINGQPISPELFTKYFWRLYHRLEETKDGSCVSMPPYFRFLTLMAFHVFLQEKVDLAVVEVGIGGAYDCTNIIRKPVVCGVSSLGIDHTSLLGDTVEKIAWQKGGIFKQGVPAFTVLQPEGPLAVLRDRAQQISCPLYLCPMLEALEEGGPPLTLGLEGEHQRSNAALALQLAHCWLQRQDRHGAGEPKASRPGLLWQLPLAPVFQPTSHMRLGLRNTEWPGRTQVLRRGPLTWYLDGAHTASSAQACVRWFRQALQGRERPSGGPEVRVLLFNATGDRDPAALLKLLQTNRTSQ

SEQ ID NO: 911252 - protein, 537 aa, Homo sapiens
MLNTLQTNAGYLEQVKRQRGDPQTQLEAMELYLARSGLQVEDLDRLNIIHVTGTKGKGSTCAFTECILRSYGLKTGFFSSPHLVQVRERIRINGQPISPELFTKYFWRLYHRLEETKDGSCVSMPPYFRFLTLMAFHVFLQEKVDLAVVEVGIGGAYDCTNIIRKPVVCGVSSLGIDHTSLLGDTVEKIAWQKGGIFKQGVPAFTVLQPEGPLAVLRDRAQQISCPLYLCPMLEALEEGGPPLTLGLEGEHQRSNAALALQLAHCWLQRQDRHGAGEPKASRPGLLWQLPLAPVFQPTSHMRLGLRNTEWPGRTQVLRRGPLTWYLDGAHTASSAQACVRWFRQALQGRERPSGGPEVRVLLFNATGDRDPAALLKLLQPCQFDYAVFCPNLTEVSSTGNADQQNFTVTLDQVLLRCLEHQQHWNHLDEEQASPDLWSAPSPEPGGSASLLLAPHPPHTCSASSLVFSCISHALQWISQGRDPIFQPPSPPKGLLTHPVAHSGASILREAAAIHVLVTGSLHLVGGVLKLLEPALSQ

SEQ ID NO: 911253 - protein, 537 aa, Homo sapiens; identical to SEQ ID NO: 911252

SEQ ID NO: 911254 - protein, 503 aa, Homo sapiens
MGHQEQTEGHRRDEATEASSISPCRVGEGQDAREGSPDDPSCPGSSPHLVQVRERIRINGQPISPELFTKYFWRLYHRLEETKDGSCVSMPPYFRFLTLMAFHVFLQEKVDLAVVEVGIGGAYDCTNIIRKPVVCGVSSLGIDHTSLLGDTVEKIAWQKGGIFKQGVPAFTVLQPEGPLAVLRDRAQQISCPLYLCPMLEALEEGGPPLTLGLEGEHQRSNAALALQLAHCWLQRQDRHGAGEPKASRPGLLWQLPLAPVFQPTSHMRLGLRNTEWPGRTQVLRRGPLTWYLDGAHTASSAQACVRWFRQALQGRERPSGGPEVRVLLFNATGDRDPAALLKLLQPCQFDYAVFCPNLTEVSSTGNADQQNFTVTLDQVLLRCLEHQQHWNHLDEEQASPDLWSAPSPEPGGSASLLLAPHPPHTCSASSLVFSCISHALQWISQGRDPIFQPPSPPKGLLTHPVAHSGASILREAAAIHVLVTGSLHLVGGVLKLLEPALSQ

SEQ ID NO: 911255 - protein, 511 aa, Homo sapiens
MLNTLQTNAGYLEQVKRQRGDPQTQLEAMELYLARSGLQVEDLDRLNIIHVTGTKGKGSTCAFTECILRSYGLKTGFFSSPHLVQVRERIRINGQPISPELFTKYFWRLYHRLEETKVDLAVVEVGIGGAYDCTNIIRKPVVCGVSSLGIDHTSLLGDTVEKIAWQKGGIFKQGVPAFTVLQPEGPLAVLRDRAQQISCPLYLCPMLEALEEGGPPLTLGLEGEHQRSNAALALQLAHCWLQRQDRHGAGEPKASRPGLLWQLPLAPVFQPTSHMRLGLRNTEWPGRTQVLRRGPLTWYLDGAHTASSAQACVRWFRQALQGRERPSGGPEVRVLLFNATGDRDPAALLKLLQPCQFDYAVFCPNLTEVSSTGNADQQNFTVTLDQVLLRCLEHQQHWNHLDEEQASPDLWSAPSPEPGGSASLLLAPHPPHTCSASSLVFSCISHALQWISQGRDPIFQPPSPPKGLLTHPVAHSGASILREAAAIHVLVTGSLHLVGGVLKLLEPALSQ

SEQ ID NO: 911256 - protein, 343 aa, Homo sapiens
GGGGKNKLGTRLGVTEGPLAVLRDRAQQISCPLYLCPMLEALEEGGPPLTLGLEGEHQRSNAALALQLAHCWLQRQDRHGAGEPKASRPGLLWQLPLAPVFQPTSHMRLGLRNTEWPGRTQVLRRGPLTWYLDGAHTASSAQACVRWFRQALQGRERPSGGPEVRVLLFNATGDRDPAALLKLLQPCQFDYAVFCPNLTEVSSTGNADQQNFTVTLDQVLLRCLEHQQHWNHLDEEQASPDLWSAPSPEPGGSASLLLAPHPPHTCSASSLVFSCISHALQWISQGRDPIFQPPSPPKGLLTHPVAHSGASILREAAAIHVLVTGSLHLVGGVLKLLEPALSQ

SEQ ID NO: 911257 - protein, 375 aa, Homo sapiens [sequence omitted]

SEQ ID NO: 911258 - protein, 237 aa, Homo sapiens [sequence omitted]

SEQ ID NO: 911259 - protein, 333 aa, Homo sapiens
MSRARSHLRAALFLAAASARGVTTQVAARRGLSAWPVPQEPSMEYQDAVRMLNTLQTNAGYLEQVKRQRGDPQTQLEAMELYLARSGLQVEDLDRLNIIHVTGTKGKGSTCAFTECILRSYGLKTGFFSSPHLVQVRERIRINGQPISPELFTKYFWRLYHRLEETKDGSCVSMPPYFRFLTLMAFHVFLQEKVDLAVVEVGIGGAYDCTNIIRKPVVCGVSSLGIDHTSLLGDTVEKIAWQKGGIFKQGVPAFTVLQPEGPLAVLRDRAQQISHSWKPWNCTWHGVGCRWRSLDRLNIIHVTGTKGKGSTCAFTECILRSYGLKTGFFSSPH

SEQ ID NO: 911260 - protein, 587 aa, Homo sapiens [sequence omitted]

SEQ ID NO: 911261 - protein, 256 aa, Homo sapiens
GGGGKNKLGTRLGVTEGPLAVLRDRAQQISCPLYLCPMLEALEEGGPPLTLGLEGEHQRSNAALALQLAHCWLQRQDRHGAGEPKASRPGLLWQLPLAPVFQPTSHMRLGLRNTEWPGRTQVLRRGPLTWYLDGAHTASSAQACVRWFRQALQGRERPSGGPEVRVLLFNATGDRDPAALLKLLQPCQFDYAVFCPNLTEVSSTGNADQQNFTVTLDQVLLRCLEHQQHWNHLDEEQASPDLWSAPSPEPGGLSVR

SEQ ID NO: 911262 - protein, 184 aa, Homo sapiens
MKGAGSLAASLPMAEKFWWEGTMEGPSGYPSSAKTASFQDAVRMLNTLQTNAGYLEQVKRQRGDPQTQLEAMELYLARSGLQVEDLDRLNIIHVTGTKGKGSTCAFTECILRSYGLKTGFFRYWLVGGCGVCVPMDPGGLWNQPVLQDQGHPQEVSCMSLCPVFIHSINIQLAISLGDRANCYL

SEQ ID NO: 911263 - protein, 537 aa, Homo sapiens; identical to SEQ ID NO: 911252

SEQ ID NO: 911264 - protein, 580 aa, Homo sapiens
MKGAGSLAASLPMAEKFWWEGTMEGPSGYPSSAKTASFQDAVRMLNTLQTNAGYLEQVKRQRGDPQTQLEAMELYLARSGLQVEDLDRLNIIHVTGTKGKGSTCAFTECILRSYGLKTGFFSSPHLVQVRERIRINGQPISPELFTKYFWRLYHRLEETKDGSCVSMPPYFRFLTLMAFHVFLQEKVDLAVVEVGIGGAYDCTNIIRKPVVCGVSSLGIDHTSLLGDTVEKIAWQKGGIFKQGVPAFTVLQPEGPLAVLRDRAQQISCPLYLCPMLEALEEGGPPLTLGLEGEHQRSNAALALQLAHCWLQRQDRHGAGEPKASRPGLLWQLPLAPVFQPTSHMRLGLRNTEWPGRTQVLRRGPLTWYLDGAHTASSAQACVRWFRQALQGRERPSGGPEVRVLLFNATGDRDPAALLKLLQPCQFDYAVFCPNLTEVSSTGNADQQNFTVTLDQVLLRCLEHQQHWNHLDEEQASPDLWSAPSPEPGGSASLLLAPHPPHTCSASSLVFSCISHALQWISQGRDPIFQPPSPPKGLLTHPVAHSGASILREAAAIHVLVTGSLHLVGGVLKLLEPALSQ

SEQ ID NO: 911265 - protein, 616 aa, Homo sapiens
MSRARSHLRAALFLAAASARGVTTQVAARRGLSAWPVPQEPSMEYQDAVRMLNTLQTNAGYLEQVKRQRGDPQTQLEAMELYLARSGLQVEDLDRLNIIHVTGTKGKGSTCAFTECILRSYGLKTGFFSSPHLVQVRERIRINGQPISPELFTKYFWRLYHRLEETKDGSCVSMPPYFRFLTLMAFHVFLQEKVDLAVVEVGIGGAYDCTNIIRKPVVCGVSSLGIDHTSLLGDTVEKIAWQKGGIFKVTRQTGGRERHGRPGSLRFHPGFTVSLEQQGVPAFTVLQPEGPLAVLRDRAQQISCPLYLCPMLEALEEGGPPLTLGLEGEHQRSNAALALQLAHCWLQRQDRHGAGEPKASRPGLLWQLPLAPVFQPTSHMRLGLRNTEWPGRTQVLRRGPLTWYLDGAHTASSAQACVRWFRQALQGRERPSGGPEVRVLLFNATGDRDPAALLKLLQPCQFDYAVFCPNLTEVSSTGNADQQNFTVTLDQVLLRCLEHQQHWNHLDEEQASPDLWSAPSPEPGGSASLLLAPHPPHTCSASSLVFSCISHALQWISQGRDPIFQPPSPPKGLLTHPVAHSGASILREAAAIHVLVTGSLHLVGGVLKLLEPALSQ

SEQ ID NO: 911266 - protein, 375 aa, Homo sapiens [sequence omitted]

SEQ ID NO: 911267 - protein, 356 aa, Homo sapiens
MCDPALGRSRGRTGASLQGVPAFTVLQPEGPLAVLRDRAQQISCPLYLCPMLEALEEGGPPLTLGLEGEHQRSNAALALQLAHCWLQRQDRHGAGEPKASRPGLLWQLPLAPVFQPTSHMRLGLRNTEWPGRTQVLRRGPLTWYLDGAHTASSAQACVRWFRQALQGRERPSGGPEVRVLLFNATGDRDPAALLKLLQPCQFDYAVFCPNLTEVSSTGNADQQNFTVTLDQVLLRCLEHQQHWNHLDEEQASPDLWSAPSPEPGGSASLLLAPHPPHTCSASSLVFSCISHALQWISQGRDPIFQPPSPPKGLLTHPVAHSGASILREAAAIHVLVTGSLHLVGGVLKLLEPALSQ

SEQ ID NO: 911268 - protein, 500 aa, Homo sapiens
MSRARSHLRAALFLAAASARGVTTQVAARRGLSAWPVPQEPSMEYQDAVRMLNTLQTNAGYLEQVKRQRGDPQTQLEAMELYLARSGLQVEDLDRLNIIHVTGTKGKGSTCAFTECILRSYGLKTGFFSSPHLVQVRERIRINGQPISPELFTKYFWRLYHRLEETKDGSCVSMPPYFRFLTLMAFHVFLQEKVDLAVVEVGIGGAYDCTNIIRKPVVCGVSSLGIDHTSLLGDTVEKIAWQKGGIFKQGVPAFTVLQPEGPLAVLRDRAQQISCPLYLCPMLEALEEGGPPLTLGLEGEHQRSNAALALQLAHCWLQRQDRHGAGEPKASRPGLLWQLPLAPVFQPTSHMRLGLRNTEWPGRTQVLRRGPLTWYLDGAHTASSAQACVRWFRQALQGRERPSGGPEVRVLLFNATGDRDPAALLKLLQPCQFDYAVFCPNLTEVSSTGNADQQNFTVTLDQVLLRCLEHQQHWNHLDEEQASPDLWSAPSPEPGGLSVR

SEQ ID NO: 911269 - protein, 301 aa, Homo sapiens
QACVRWFRQALQGRERPSGGPEVRVLLFNATGDRDPAALLKLLQPCQFDYAVFCPNLTEVSSTGNADESLALSPRLECNVLRRGPLTWYLDGAHTASSAQACVRWFRQALQGRERPSGGPEVRVLLFNATGDRDPAALLKLLQPCQFDYAVFCPNLTEVSSTGNADQQNFTVTLDQVLLRCLEHQQHWNHLDEEQASPDLWSAPSPEPGGSASLLLAPHPPHTCSASSLVFSCISHALQWISQGRDPIFQPPSPPKGLLTHPVAHSGASILREAAAIHVLVTGSLHLVGGVLKLLEPALSQ

SEQ ID NO: 911270 - protein, 174 aa, Homo sapiens [sequence omitted]

SEQ ID NO: 911271 - protein, 328 aa, Homo sapiens
MGPAGSLLGSGQMQITLWGSLAAVAIFFVITFLIFLCSSCDREKKPRQHSGDHENLMNVPSDKEMFSRSVTSLATDAPASSEQNGALTNGDILSEDSTLTCMQHYEEVQTSASDLLDSQDSTGKPKCHQSRELPRIPPESAVDTMLTARSVDGDQGLGMEGPYEVLKDSSSQENMVEDCLYETVKEIKEVAAAAHLEKGHSGKAKSTSASKELPGPQTEGKAEFAEYASVDRNKKCRQSVNVESILGNSCDPEEEAPPPVPVKLLDENENLQEKEGGEAEESATDTTSETNKVGTGVFVLSLWVPVLVRNLAGPGVVLGNICKHFPVC

SEQ ID NO: 911272 - protein, 432 aa, Homo sapiens
MGPAGSLLGSGQMQITLWGSLAAVAIFFVITFLIFLCSSCDREKKPRQHSGDHENLMNVPSDKEMFSRSVTSLATDAPASSEQNGALTNGDILSEDSTLTCMQHYEEVQTSASDLLDSQDSTGKPKCHQSRELPRIPPESAVDTMLTARSVDGDQGLGMEGPYEVLKDSSSQENMVEDCLYETVKEIKEVAAAAHLEKGHSGKAKSTSASKELPGPQTEGKAEFAEYASVDRNKKCRQSVNVESILGNSCDPEEEAPPPVPVKLLDENENLQEKEGGEAEESATDTTSETNKRFSSLSYKSREEDPTLTEEEISAMYSSVNKPGQLVNKSGQSLTVPESTYTSIQGDPQRSPSSCNDLYATVKDFEKTPNSTLPPAGRPSEEPEPDYEAIQTLNREEEKATLGTNGHHGLVPKENDYESISDLQQGRDITRL

SEQ ID NO: 911273 - protein, 318 aa, Homo sapiens [sequence omitted]

SEQ ID NO: 911274 - protein, 678 aa, Homo sapiens
RPAVRKSAGQTLFSTIGAHGTLLQHSTWHTVIWKVLFHLLDRVRESSTTADKEKIESGGGNILIHHSRDTAEKQWAETWVLTLAGVARIFNTRRYLLQPLGDFSRAWDVLLDHIQSAALSKNNEVSLAALKSFQEILQIVSPVRDSDKPETPPVVNVPVPVLIGPISGMSRPFVRTDSIGEKLGRYSSSEPPIVTDELEDLNLWWAAWNTWYRIGSESTKPPITFDKLTFIPSQPFLTALIQIFPALYQHIKTGFNMDDLQKLGVILHSAISVPISSDASPFILPSYTEAVLTSLQEAVLTALDVLQKAICVGPENMQIMYPAIFDQLLAFVEFSCKPPQYGQLETKHIANAKYNQYFRRKWVALNYVPFAERSLEVVVDLYQKTACHKAVVNEKVLQNIIKTLRVPLSLKYSCPSESTWKLAVSSLLRVLSIGLPVARQHASSGKFDSMWPELANTFEDFLFTKSIPPDNLSIQEFQRNENIDVEVVQLISNEILPYANFIPKEFVGQIMTMLNKGSIHSQSSSFTEAEIDIRLREEFSKMCFETLLQFSFSNKVTTPQEGYISRMALSVLLKRSQDVLHRYIEDERLSGKCPLPRQQVTEIIFVLKAVSTLIDSLKKTQPENVDGNTWAQVIALYPTLVECITCSSSEVCSALKEALVPFKDFMQPPASRVQNGES

SEQ ID NO: 911275 - protein, 678 aa, Homo sapiens; identical to SEQ ID NO: 911274

SEQ ID NO: 911276 - protein, 166 aa, Homo sapiens [sequence omitted]

SEQ ID NO: 911277 - protein, 678 aa, Homo sapiens; identical to SEQ ID NO: 911274

SEQ ID NO: 911278 - protein, 278 aa, Homo sapiens
NFPFSGGEMDSLEWNWALVYELSGEHHDEEWSVKTYQEVAQKFVETHPEFIGIKIIYSDHRSKDVAVIAESIRMAMGLRIKFPTVVAGFDLVGHEDTGHSLRDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 911279 - protein, 272 aa, Homo sapiens
ETMPKAVEDLNKVYELSGEHHDEEWSVKTYQEVAQKFVETHPEFIGIKIIYSDHRSKDVAVIAESIRMAMGLRIKFPTVVAGFDLVGHEDTGHSLRDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 911280 - protein, 460 aa, Homo sapiens
VSGAVPSPVESPSEPFPSPGIPMLVDGPSERPALCFLLLAVAMSFFGSALSIDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRARLLPVYELSGEHHDEEWSVKTYQEVAQKFVETHPEFIGIKIIYSDHRSKDVAVIAESIRMAMGLRIKFPTVVAGFDLVGHEDTGHSLRDYKEALMIPAKDGVKLPYFFHAGETDWQGTSIDRNILDALMLNTTRIGHGFALSKHPAVRTYSWKKDIPIEVCPISNQVLKLVSDLIRPHAIRMDSAMTVTGH

SEQ ID NO: 911281 - protein, 581 aa, Homo sapiens
GKPLPVCTCRSFLWGLEEESFNILPSGNLRAGREKEDQSSTLKSVGFHSPTLLCSPVESPSEPFPSPGIPMLVDGPSERPALCFLLLAVAMSFFGSALSIDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRARLLPVYELSGEHHDEEWSVKTYQEVAQKFVETHPEFIGIKIIYSDHRSKDVAVIAESIRMAMGLRIKFPTVVAGFDLVGHEDTGHSLRDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 911282 - protein, 533 aa, Homo sapiens
VSGAVPSPVESPSEPFPSPGIPMLVDGPSERPALCFLLLAVAMSFFGSALSIDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRARLLPVYELSGEHHDEEWSVKTYQEVAQKFVETHPEFIGIKIIYSDHRSKDVAVIAESIRMAMGLRIKFPTVVAGFDLVGHEDTGHSLRDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 911283 - protein, 117 aa, Homo sapiens
RKKKIVSSGRVRPLVSPPPHPIRFNLDPFRRLPLPVTQRAPTPAALSSSNVLGSIPCLGLFSFSLPGTFLLSPFVLPTPVYPSSFKFMSLSQRGFPVLALFLSGSLALFHHASNHSL

SEQ ID NO: 911284 - protein, 142 aa, Homo sapiens
MKADEAHIANVMQMWTFIVALVFTHKGYLNMEFNPSDHPRASTIFLSKSQTDVREKRKSLFINHHPPGQIARKYSSCSTIFLDDSTVSQPNLKYTIKCCVASGNILSTSKKQGTQMDGCSSDIFGLKIFTPLFEIPKWPPDY

SEQ ID NO: 911285 - protein, 341 aa, Homo sapiens
MGNTTSCCVSSSPKLRRNAHSRLESYRPDTDLSREDTGCNLQHISDRENIDDLNMEFNPSDHPRASTIFLSKSQTDVREKRKSLFINHHPPGQIARKYSSCSTIFLDDSTVSQPNLKYTIKCVALAIYYHIKNRDPDGRMLLDIFDENLHPLSKSEVPPDYDKHNPEQKQIYRFVRTLFSAAQLTAECAIVTLVYLERLLTYAEIDICPANWKRIVLGAILLASKVWDDQAVWNVDYCQILKDITVEDMNELERQFLELLQFNINVPSSVYAKYYFDLRSLAEANNLSFPLEPLSRERAHKLEAISRLCEDKYKDLRRSARKRSASADNLTLPRWSPAIIS

SEQ ID NO: 911286 - protein, 287 aa, Homo sapiens
MEFNPSDHPRASTIFLSKSQTDVREKRKSLFINHHPPGQIARKYSSCSTIFLDDSTVSQPNLKYTIKCVALAIYYHIKNRDPDGRMLLDIFDENLHPLSKSEVPPDYDKHNPEQKQIYRFVRTLFSAAQLTAECAIVTLVYLERLLTYAEIDICPANWKRIVLGAILLASKVWDDQAVWNVDYCQILKDITVEDMNELERQFLELLQFNINVPSSVYAKYYFDLRSLAEANNLSFPLEPLSRERAHKLEAISRLCEDKYKDLRRSARKRSASADNLTLPRWSPAIIS

SEQ ID NO: 911287 - protein, 287 aa, Homo sapiens; identical to SEQ ID NO: 911286

SEQ ID NO: 911288 - protein, 287 aa, Homo sapiens; identical to SEQ ID NO: 911286

SEQ ID NO: 911289 - protein, 287 aa, Homo sapiens; identical to SEQ ID NO: 911286

SEQ ID NO: 911290 - protein, 287 aa, Homo sapiens; identical to SEQ ID NO: 911286

SEQ ID NO: 911291 - protein, 275 aa, Homo sapiens
MEFNPSDHPRASTIFLSKSQTDVREKRKSLFINHHPPGQIARKYSSCSTIFLDDSTVSQPNLKYTIKWDPDGRMLLDIFDENLHPLSKSEVPPDYDKHNPEQKQIYRFVRTLFSAAQLTAECAIVTLVYLERLLTYAEIDICPANWKRIVLGAILLASKVWDDQAVWNVDYCQILKDITVEDMNELERQFLELLQFNINVPSSVYAKYYFDLRSLAEANNLSFPLEPLSRERAHKLEAISRLCEDKYKDLRRSARKRSASADNLTLPRWSPAIIS

SEQ ID NO: 911292 - protein, 341 aa, Homo sapiens; identical to SEQ ID NO: 911285

SEQ ID NO: 911293 - protein, 341 aa, Homo sapiens; identical to SEQ ID NO: 911285

SEQ ID NO: 911294 - protein, 111 aa, Homo sapiens
QQLPWAQGIIGRLGAQNLTGDIWVCFCFFFPFLFLRIAPSSCLDERPCSKAWRKRQCPGDPSSLSPLSATALPSWRKWTRILEEEIKGKGSRGEAGKMVKQPGPLESPWGR

SEQ ID NO: 911295 - protein, 341 aa, Homo sapiens; identical to SEQ ID NO: 911285

SEQ ID NO: 911296 - protein, 341 aa, Homo sapiens; identical to SEQ ID NO: 911285

SEQ ID NO: 911297 - protein, 341 aa, Homo sapiens; identical to SEQ ID NO: 911285

SEQ ID NO: 911298 - protein, 341 aa, Homo sapiens; identical to SEQ ID NO: 911285

SEQ ID NO: 911299 - protein, 307 aa, Homo sapiens
MGNTTSCCVSSSPKLRRNAHSRLESYRPDTDLSREDTGCNLQHISDRENIDDLNMEFNPSDHPRASTIFLSKSQTDVREKRKSLFINHHPPGQIARKYSSCSTIFLDDSTVSQPNLKYTIKCVALAIYYHIKNRDPDGRMLLDIFDENLHPLSKSEVPPDYDKHNPEQKQIYRFVRTLFSAAQLTAECAIVTLVYLERLLTYAEIDICPANWKRIVLGAILLASKVWDDQAVWNVDYCQILKDITVEDMNELERQFLELLQFNINVPSSVYAKYYFDLRSLAEANNLSFPLEPLSRERAHKLEGKMV

SEQ ID NO: 911300 - protein, 341 aa, Homo sapiens; identical to SEQ ID NO: 911285

SEQ ID NO: 911301 - protein, 287 aa, Homo sapiens; identical to SEQ ID NO: 911286

SEQ ID NO: 911302 - protein, 341 aa, Homo sapiens; identical to SEQ ID NO: 911285

SEQ ID NO: 911303 - protein, 287 aa, Homo sapiens; identical to SEQ ID NO: 911286

SEQ ID NO: 911304 - protein, 287 aa, Homo sapiens; identical to SEQ ID NO: 911286

SEQ ID NO: 911305 - protein, 287 aa, Homo sapiens; identical to SEQ ID NO: 911286

SEQ ID NO: 911306 - protein, 202 aa, Homo sapiens
MLLDIFDENLHPLSKSEVPPDYDKHNPEQKQIYRFVRTLFSAAQLTAECAIVTLVYLERLLTYAEIDICPANWKRIVLGAILLASKVWDDQAVWNVDYCQILKDITVEDMNELERQFLELLQFNINVPSSVYAKYYFDLRSLAEANNLSFPLEPLSRERAHKLEAISRLCEDKYKDLRRSARKRSASADNLTLPRWSPAIIS

SEQ ID NO: 911307 - protein, 341 aa, Homo sapiens; identical to SEQ ID NO: 911285

SEQ ID NO: 911308 - protein, 341 aa, Homo sapiens; identical to SEQ ID NO: 911285

SEQ ID NO: 911309 - protein, 341 aa, Homo sapiens; identical to SEQ ID NO: 911285

SEQ ID NO: 911310 - protein, 341 aa, Homo sapiens; identical to SEQ ID NO: 911285

SEQ ID NO: 911311 - protein, 341 aa, Homo sapiens; identical to SEQ ID NO: 911285

SEQ ID NO: 911312 - protein, 69 aa, Homo sapiens
MDADMARPDPHCLSCPSGHLSPLRGQVQGPKKIREEALSQCRQPDSAPVVPSHHLLTTEARRRPHHPLV

SEQ ID NO: 911313 - protein, 211 aa, Homo sapiens
MCPGNWLWASMTFMARFSRSSSRSPVRTRGTLEEMPTVQHPFLNVFELERLLYTGKTACNHADEVWPGLYLGDQDMANNRRELRRLGITHVLNASHSRWRGTPEAYEGLGIRYLGVEAHDSPAFDMSIHFQTAADFIHRALSQPGGKILVHCAVGVSRSATLVLAYLMLYHHLTLVEAIKKVKDHRGIIPNRGFLRQLLALDRRLRQGLEA

SEQ ID NO: 911314 - protein, 211 aa, Homo sapiens; identical to SEQ ID NO: 911313

SEQ ID NO: 911315 - protein, 158 aa, Homo sapiens
MCPGNWLWASMTFMARFSRSSSRSPVRTRGTLEEMPTVQHPFLNVFELERLLYTGKTACNHADEVWPGLYLGDQDMANNRRELRRLGITHVLNASHSRWRGTPEAYEGLGIRYLGVEAHDSPAFDMSIHFQTAADFIHQNKRAISALHLCRKSGIRQA

SEQ ID NO: 911316 - protein, 147 aa, Homo sapiens
MCPGNWLWASMTFMARFSRSSSRSPVRTRGTLEEMPTVQHPFLNVFELERLLYTGKTACNHADEVWPGLYLGDQDMANNRRELRRLGITHVLNASHSRWRGTPEAYEGLGIRYLGVEAHDSPAFDMRGRGKRTRPRTGEGLNTKWRK

SEQ ID NO: 911317 - protein, 211 aa, Homo sapiens; identical to SEQ ID NO: 911313

SEQ ID NO: 911318 - protein, 1409 aa, Homo sapiens
DSPTTTSGPSPSPRDLRPSSAPPGALAFRSPNYAERAPRPERPSTRPPPAASSAAGPDRARDAAAPLPAQRRPGGTMQAQQLPYEFFSEENAPKWRGLLVPALKKVQGQVHPTLESNDDALQYVEELILQLLNMLCQAQPRSASDVEERVQKSFPHPIDKWAIADAQSAIEKRKRRNPLSLPVEKIHPLLKEVLGYKIDHQVSVYIVAVLEYISADILKLVGNYVRNIRHYEITKQDIKVAMCADKVLMDMFHQDVEDINILSLTDEEPSTSGEQTYYDLVKAFMAEIRQYIRELNLIIKVFREPFVSNSKLFSANDVENIFSRIVDIHELSVKLLGHIEDTVEMTDEGSPHPLVGSCFEDLAEELAFDPYESYARDILRPGFHDRFLSQLSKPGAALYLQSIGEGFKEAVQYVLPRLLLAPVYHCLHYFELLKQLEEKSEDQEDKECLKQAITALLNVQSGMEKICSKSLAKRRLSESACRFYSQQMKGKQLAIKKMNEIQKNIDGWEGKDIGQCCNEFIMEGTLTRVGAKHERHIFLFDGLMICCKSNHGQPRLPGASNAEYRLKEKFFMRKVQINDKDDTNEYKHAFEIILKDENSVIFSAKSAEEKNNWMAALISLQYRSTLERMLDVTMLQEEKEEQMRLPSADVYRFAEPDSEENIIFEENMQPKAGIPIIKAGTVIKLIERLTYHMYADPNFVRTFLTTYRSFCKPQELLSLIIERFEIPEPEPTEADRIAIENGDQPLSAELKRFRKEYIQPVQLRVLNVCRHWVEHHFYDFERDAYLLQRMEEFIGTVRGKAMKKWVESITKIIQRKKIARDNGPGHNITFQSSPPTVEWHISRPGHIETFDLLTLHPIEIARQLTLLESDLYRAVQPSELVGSVWTKEDKEINSPNLLKMIRHTTNLTLWFEKCIVETENLEERVAVVSRIIEILQVFQELNNFNGVLEVVSAMNSSPVYRLDHTFEQIPSRQKKILEEAHELSEDHYKKYLAKLRSINPPCVPFFGIYLTNILKTEEGNPEVLKRHGKELINFSKRRKVAEITGEIQQYQNQPYCLRVESDIKRFFENLNPMGNSMEKEFTDYLFNKSLEIEPRNPKPLPRFPKKYSYPLKSPGVRPSNPRPGTMRHPTPLQQEPRKISYSRIPESETESTASAPNSPRTPLTPPPASGASSTTDVCSVFDSDHSSPFHSSNDTVFIQVTLPHGPRSASVSSISLTKGTDEVPVPPPVPPRRRPESAPAESSPSKIMSKHLDSPPAIPPRQPTSKAYSPRYSISDRTSISDPPESPPLLPPREPVRTPDVFSSSPLHLQPPPLGKKSDHGNAFFPNSPSPFTPPPPQTPSPHGTRRHLPSPPLTQEVDLHSIAGPPVPPRQSTSQHIPKLPPKTYKREHTHPSMHRDGPPLLENAHSS

SEQ ID NO: 911319 - protein, 1409 aa, Homo sapiens; identical to SEQ ID NO: 911318

SEQ ID NO: 911320 - protein, 1394 aa, Homo sapiens
DSPTTTSGPSPSPRDLRPSSAPPGALAFRSPNYAERAPRPERPSTRPPPAASSAAGPDRARDAAAPLPAQRRPGGTMQAQQLPYEFFSEENAPKWRGLLVPALKKVQGQVHPTLESNDDALQYVEELILQLLNMLCQAQPRSASDVEERVQKSFPHPIDKWAIADAQSAIEKRKRRNPLSLPVEKIHPLLKEVLGYKIDHQVSVYIVAVLEYISADILKLVGNYVRNIRHYEITKQDIKVAMCADKVLMDMFHQDVEDINILSLTDEEPSTSGEQTYYDLVKAFMAEIRQYIRELNLIIKVFREPFVSNSKLFSANDVENIFSRIVDIHELSVKLLGHIEDTVEMTDEGSPHPLVGSCFEDLAEELAFDPYESYARDILRPGFHDRFLSQLSKPGAALYLQSIGEGFKEAVQYVLPRLLLAPVYHCLHYFELLKQLEEKSEDQEDKECLKQAITALLNVQSGMEKICSKSLAKRRLSESACRFYSQQMKGKQLAIKKMNEIQKNIDGWEGKDIGQCCNEFIMEGTLTRVGAKHERHIFLFDGLMICCKSNHGQPRLPGASNAEYRLKEKFFMRKVQINDKDDTNEYKHAFEIILKDENSVIFSAKSAEEKNNWMAALISLQYRSTLERMLDVTMLQEEKEEQMRLPSADVYRFAEPDSEENIIFEENMQPKAGIPIIKAGTVIKLIERLTYHMYADPNFVRTFLTTYRSFCKPQELLSLIIERFEIPEPEPTEADRIAIENGDQPLSAELKRFRKEYIQPVQLRVLNVCRHWVEHHFYDFERDAYLLQRMEEFIGTVRGKAMKKWVESITKIIQRKKIARDNGPGHNITFQSSPPTVEWHISRPGHIETFDLLTLHPIEIARQLTLLESDLYRAVQPSELVGSVWTKEDKEINSPNLLKMIRHTTNLTLWFEKCIVETENLEERVAVVSRIIEILQVFQELNNFNGVLEVVSAMNSSPVYRLDHTFEQIPSRQKKILEEAHELSEDHYKKYLAKLRSINPPCVPFFGIYLTNILKTEEGNPEVLKRHGKELINFSKRRKVAEITGEIQQYQNQPYCLRVESDIKRFFENLNPMGNSMEKEFTDYLFNKSLEIEPRNPKPLPRFPKKYSYPLKSPGVRPSNPRPGTMRHPTPLQQEPRKISYSRIPESETESTASAPNSPRTPLTPPPASGASSTTDVCSVFDSDHSSPFHSRSASVSSISLTKGTDEVPVPPPVPPRRRPESAPAESSPSKIMSKHLDSPPAIPPRQPTSKAYSPRYSISDRTSISDPPESPPLLPPREPVRTPDVFSSSPLHLQPPPLGKKSDHGNAFFPNSPSPFTPPPPQTPSPHGTRRHLPSPPLTQEVDLHSIAGPPVPPRQSTSQHIPKLPPKTYKREHTHPSMHRDGPPLLENAHSS

SEQ ID NO: 911321 - protein, 362 aa, Homo sapiens
ELGTLIGSQVRVESDIKRFFENLNPMGNSMEKEFTDYLFNKSLEIEPRNPKPLPRFPKKYSYPLKSPGVRPSNPRPGTMRHPTPLQQEPRKISYSRIPESETESTASAPNSPRTPLTPPPASGASSTTDVCSVFDSDHSSPFHSSNDTVFIQVTLPHGPRSASVSSISLTKGTDEVPVPPPVPPRRRPESAPAESSPSKIMSKHLDSPPAIPPRQPTSKAYSPRYSISDRTSISDPPESPPLLPPREPVRTPDVFSSSPLHLQPPPLGKKSDHGNAFFPNSPSPFTPPPPQTPSPHGTRRHLPSPPLTQEVDLHSIAGPPVPPRQSTSQHIPKLPPKTYKREHTHPSMHRDGPPLLENAHSS

SEQ ID NO: 911322 - protein, 711 aa, Homo sapiens
DSPTTTSGPSPSPRDLRPSSAPPGALAFRSPNYAERAPRPERPSTRPPPAASSAAGPDRARDAAAPLPAQRRPGGTMQAQQLPYEFFSEENAPKWRGLLVPALKKVQGQVHPTLESNDDALQYVEELILQLLNMLCQAQPRSASDVEERVQKSFPHPIDKWAIADAQSAIEKRKRRNPLSLPVEKIHPLLKEVLGYKIDHQVSVYIVAVLEYISADILKLVGNYVRNIRHYEITKQDIKVAMCADKVLMDMFHQDVEDINILSLTDEEPSTSGEQTYYDLVKAFMAEIRQYIRELNLIIKVFREPFVSNSKLFSANDVENIFSRIVDIHELSVKLLGHIEDTVEMTDEGSPHPLVGSCFEDLAEELAFDPYESYARDILRPGFHDRFLSQLSKPGAALYLQSIGEGFKEAVQYVLPRLLLAPVYHCLHYFELLKQLEEKSEDQEDKECLKQAITALLNVQSGMEKICSKSLAKRRLSESACRFYSQQMKGKQLAIKKMNEIQKNIDGWEGKDIGQCCNEFIMEGTLTRVGAKHERHIFLFDGLMICCKSNHGQPRLPGASNAEYRLKEKFFMRKVQINDKDDTNEYKHAFEIILKDENSVIFSAKSAEEKNNWMAALISLQYRSTLERMLDVTMLQEEKEEQMRLPSADVYRFAEPDSEENIIFEENMQPKAGIPIIKAGTVIKLIERLTYHMYAGKNYAVACHFCFPASN

SEQ ID NO: 911323 - protein, 333 aa, Homo sapiens
DSPTTTSGPSPSPRDLRPSSAPPGALAFRSPNYAERAPRPERPSTRPPPAASSAAGPDRARDAAAPLPAQRRPGGTMQAQQLPYEFFSEENAPKWRGLLVPALKKVQGQVHPTLESNDDALQYVEELILQLLNMLCQAQPRSASDVEERVQKSFPHPIDKWAIADAQSAIEKRKRRNPLSLPVEKIHPLLKEVLGYKIDHQVSVYIVAVLEYISADILKLVGNYVRNIRHYEITKQDIKVAMCADKVLMDMFHQDVEDINILSLTDEEPSTSGEQTYYDLVKAFMAEIRQYIRELNLIIKVFREPFVSNSKLFSANVSIIVYMPLIECVVKFA

SEQ ID NO: 911324 - protein, 1065 aa, Homo sapiens [sequence omitted]

SEQ ID NO: 911325 - protein, 1125 aa, Homo sapiens
GPDVKERRCKKEIDKGKHLFPCVSDSKWFSANDVENIFSRIVDIHELSVKLLGHIEDTVEMTDEGSPHPLVGSCFEDLAEELAFDPYESYARDILRPGFHDRFLSQLSKPGAALYLQSIGEGFKEAVQYVLPRLLLAPVYHCLHYFELLKQLEEKSEDQEDKECLKQAITALLNVQSGMEKICSKSLAKRRLSESACRFYSQQMKGKQLAIKKMNEIQKNIDGWEGKDIGQCCNEFIMEGTLTRVGAKHERHIFLFDGLMICCKSNHGQPRLPGASNAEYRLKEKFFMRKVQINDKDDTNEYKHAFEIILKDENSVIFSAKSAEEKNNWMAALISLQYRSTLERMLDVTMLQEEKEEQMRLPSADVYRFAEPDSEENIIFEENMQPKAGIPIIKAGTVIKLIERLTYHMYADPNFVRTFLTTYRSFCKPQELLSLIIERFEIPEPEPTEADRIAIENGDQPLSAELKRFRKEYIQPVQLRVLNVCRHWVEHHFYDFERDAYLLQRMEEFIGTVRGKAMKKWVESITKIIQRKKIARDNGPGHNITFQSSPPTVEWHISRPGHIETFDLLTLHPIEIARQLTLLESDLYRAVQPSELVGSVWTKEDKEINSPNLLKMIRHTTNLTLWFEKCIVETENLEERVAVVSRIIEILQVFQELNNFNGVLEVVSAMNSSPVYRLDHTFEQIPSRQKKILEEAHELSEDHYKKYLAKLRSINPPCVPFFGIYLTNILKTEEGNPEVLKRHGKELINFSKRRKVAEITGEIQQYQNQPYCLRVESDIKRFFENLNPMGNSMEKEFTDYLFNKSLEIEPRNPKPLPRFPKKYSYPLKSPGVRPSNPRPGTMRHPTPLQQEPRKISYSRIPESETESTASAPNSPRTPLTPPPASGASSTTDVCSVFDSDHSSPFHSSNDTVFIQVTLPHGPRSASVSSISLTKGTDEVPVPPPVPPRRRPESAPAESSPSKIMSKHLDSPPAIPPRQPTSKAYSPRYSISDRTSISDPPESPPLLPPREPVRTPDVFSSSPLHLQPPPLGKKSDHGNAFFPNSPSPFTPPPPQTPSPHGTRRHLPSPPLTQEVDLHSIAGPPVPPRQSTSQHIPKLPPKTYKREHTHPSMHRDGPPLLENAHSS

SEQ ID NO: 911326 - protein, 1267 aa, Homo sapiens
DSPTTTSGPSPSPRDLRPSSAPPGALAFRSPNYAERAPRPERPSTRPPPAASSAAGPDRARDAAAPLPAQRRPGGTMQAQQLPYEFFSEENAPKWRGLLVPALKKVQGQVHPTLESNDDALQYVEELILQLLNMLCQAQPRSASDVEERVQKSFPHPIDKWAIADAQSAIEKRKRRNPLSLPVEKIHPLLKEVLGYKIDHQVSVYIVAVLEYISADILKLVGNYVRNIRHYEITKQDIKVAMCADKVLMDMFHQDVEDINILSLTDEEPSTSGEQTYYDLVKAFMAEIRQYIRELNLIIKVFREPFVSNSKLFSANDVENIFSRIVDIHELSVKLLGHIEDTVEMTDEGSPHPLVGSCFEDLAEELAFDPYESYARDILRPGFHDRFLSQLSKPGAALYLQSIGEGFKEAVQYVLPRLLLAPVYHCLHYFELLKQLEEKSEDQEDKECLKQAITALLNVQSGMEKICSKSLAKRRLSESACRFYSQQMKGKQLAIKKMNEIQKNIDGWEGKDIGQCCNEFIMEGTLTRVGAKHERHIFLFDGLMICCKSNHGQPRLPGASNAEYRLKEKFFMRKVQINDKDDTNEYKHAFEIILKDENSVIFSAKSAEEKNNWMAALISLQYRSTLERMLDVTMLQEEKEEQMRLPSADVYRFAEPDSEENIIFEENMQPKAGIPIIKAGTVIKLIERLTYHMYADPNFVRTFLTTYRSFCKPQELLSLIIERFEIPEPEPTEADRIAIENGDQPLSAELKRFRKEYIQPVQLRVLNVCRHWVEHHFYDFERDAYLLQRMEEFIGTVRGKAMKKWVESITKIIQRKKIARDNGPGHNITFQSSPPTVEWHISRPGHIETFDLLTLHPIEIARQLTLLESDLYRAVQPSELVGSVWTKEDKEINSPNLLKMIRHTTNLTLWFEKCIVETENLEERVAVVSRIIEILQVFQELNNFNGVLEVVSAMNSSPVYRLDHTFEQIPSRQKKILEEAHELSEDHYKKYLAKLRSINPPCVPFFGIYLTNILKTEEGNPEVLKRHGKELINFSKRRKVAEITGEIQQYQNQPYCLRVESDIKRFFENLNPMGNSMEKEFTDYLFNKSLEIEPRNPKPLPRFPKKYSYPLKSPGVRPSNPRPGTMRHPTPLQQEPRKISYSRIPESETESTASAPNSPRTPLTPPPASGASSTTDVCSVFDSDHSSPFHSSNDTVFIQVTLPHGPRSASVSSISLTKGTDEVPVPPPVPPRRRPESAPAESSPSKIMSKHLDSPPAIPPRQPTSNI

SEQ ID NO: 911327 - protein, 176 aa, Homo sapiens
MMPTPVILLKEGTDSSQGIPQLVSNISACQVIAEAVRTTLGPRGMDKLIVDGRGKATISNDGATILKLLDVVHPAAKTLVDIAKSQDAEVGDGTTSVTLLAAEFLKQVKPYVEEGLHPQIIIRAFRTATQLAVNKIKEIAVTVKKADKVEQRKLLETVCHDRSELQADLPAESFLC

SEQ ID NO: 911328 - protein, 88 aa, Homo sapiens
NSRPRRPRRRQKGAQGGTWYGVDINNEDIADNFEAFVWEPAMVRINALTAASEAACLIVSVDETIKNPRSTVDAPTAAGRGRGRGRPH

SEQ ID NO: 911329 - protein, 85 aa, Homo sapiens
LLNSRPVDRHAQGGTWYGVDINNEDIADNFEAFVWEPAMVRINALTAASEAACLIVSVDETIKNPRSTVDAPTAAGRGRGRGRPH

SEQ ID NO: 911330 - protein, 92 aa, Homo sapiens
TTTFAAGRLLNKLRARHAQGGTWYGVDINNEDIADNFEAFVWEPAMVRINALTAASEAACLIVSVDETIKNPRSTVDAPTAAGRGRGRGRPH

SEQ ID NO: 911331 - protein, 303 aa, Homo sapiens
MVELELKAEKDNAEIRVHTVEDYQAIVDAEWNILYDKLEKIHHSGAKVVLSKLPIGDVATQYFADRDMFCAGRVPEEDLKRTMMACGGSIQTSVNALSADVLGRCQVFEETQIGGERYNFFTGCPKAKTCTFILRGGAEQFMEETERSLHDAIMIVRRAIKNDSVVAGGGAIEMELSKYLRDYSRTIPGKQQLLIGAYAKALEIIPRQLCDNAGFDATNILNKLRARHAQGGTWYGVDINNEDIADNFEAFVWEPAMVRINALTAASEAACLIVSVDETIKNPRSTVDAPTAAGRGRGRGRPH

SEQ ID NO: 911332 - protein, 303 aa, Homo sapiens; identical to SEQ ID NO: 911331

SEQ ID NO: 911333 - protein, 303 aa, Homo sapiens; identical to SEQ ID NO: 911331

SEQ ID NO: 911334 - protein, 303 aa, Homo sapiens; identical to SEQ ID NO: 911331

SEQ ID NO: 911335 - protein, 303 aa, Homo sapiens; identical to SEQ ID NO: 911331

SEQ ID NO: 911336 - protein, 303 aa, Homo sapiens; identical to SEQ ID NO: 911331

SEQ ID NO: 911337 - protein, 279 aa, Homo sapiens
MVELELKAEKDNAEIRVHTVEDYQAIVDAEWNILYDKLEKIHHSGAKVVLSKLPIGDVATQYFADRDMFCAGRVPEEDLKRTMMACGGSIQTSVNALSADVLGRCQVFEETQIGGERYNFFTGCPKAKTCTFILRGGAEQFMEETERSLHDAIMIVRRAIKNDSVVAGGGAIEMELSKYLRDYSRTIPGKQQLLIGAYAKALEIIPRQLCDNAGFDATNILNKLRARHAQPAMVRINALTAASEAACLIVSVDETIKNPRSTVDAPTAAGRGRGRGRPH

SEQ ID NO: 911338 - protein, 277 aa, Homo sapiens
MVELELKAEKDNAEIRVHTVEDYQAIVDAEWNILYDKLEKIHHSGAKVVLSKLPIGDVATQYFADRDMFCAGRVPEEDLKRTMMACGGSIQTSVNALSADVLGRCQVFEETQIGGERYNFFTGCPKAKTCTFILRGGAEQFMEETERSLHDAIMIVRRAIKNDSVVAGGGAIEMELSKYLRDYSRTIPGKQQLLIGAYAKALEIIPRQLCDNAGFDATNILNKLRARHAQCGCSHSSRPGPWSWPPPLRGTPPITWLAGCWVHLPSLAWLLHFTRKG

SEQ ID NO: 911339 - protein, 234 aa, Homo sapiens
MVELELKAEKDNAEIRVHTVEDYQAIVDAEWNILYDKLEKIHHSGAKVVLSKLPIGDVATQYFADRDMFCAGRVPEEDLKRTMMACGGSIQTSVNALSADVLGRCQVFEETQIGGERYNFFTGCPKAKTCTFILRGGAEQFMEETERSLHDAIMIVRRAIKGGTWYGVDINNEDIADNFEAFVWEPAMVRINALTAASEAACLIVSVDETIKNPRSTVDAPTAAGRGRGRGRPH

SEQ ID NO: 911340 - protein, 176 aa, Homo sapiens; identical to SEQ ID NO: 911327

SEQ ID NO: 911341 - protein, 303 aa, Homo sapiens; identical to SEQ ID NO: 911331

SEQ ID NO: 911342 - protein, 176 aa, Homo sapiens; identical to SEQ ID NO: 911327

SEQ ID NO: 911343 - protein, 176 aa, Homo sapiens; identical to SEQ ID NO: 911327

SEQ ID NO: 911344 - protein, 303 aa, Homo sapiens; identical to SEQ ID NO: 911331

SEQ ID NO: 911345 - protein, 303 aa, Homo sapiens; identical to SEQ ID NO: 911331

SEQ ID NO: 911346 - protein, 303 aa, Homo sapiens; identical to SEQ ID NO: 911331

SEQ ID NO: 911347 - protein, 303 aa, Homo sapiens; identical to SEQ ID NO: 911331

SEQ ID NO: 911348 - protein, 303 aa, Homo sapiens; identical to SEQ ID NO: 911331

SEQ ID NO: 911349 - protein, 303 aa, Homo sapiens; identical to SEQ ID NO: 911331

SEQ ID NO: 911350 - protein, 303 aa, Homo sapiens; identical to SEQ ID NO: 911331

SEQ ID NO: 911351 - protein, 303 aa, Homo sapiens; identical to SEQ ID NO: 911331

SEQ ID NO: 911352 - protein, 303 aa, Homo sapiens; identical to SEQ ID NO: 911331

SEQ ID NO: 911353 - protein, 303 aa, Homo sapiens; identical to SEQ ID NO: 911331

SEQ ID NO: 911354 - protein, 294 aa, Homo sapiens
GCESAPRVHTVEDYQAIVDAEWNILYDKLEKIHHSGAKVVLSKLPIGDVATQYFADRDMFCAGRVPEEDLKRTMMACGGSIQTSVNALSADVLGRCQVFEETQIGGERYNFFTGCPKAKTCTFILRGGAEQFMEETERSLHDAIMIVRRAIKNDSVVAGGGAIEMELSKYLRDYSRTIPGKQQLLIGAYAKALEIIPRQLCDNAGFDATNILNKLRARHAQGGTWYGVDINNEDIADNFEAFVWEPAMVRINALTAASEAACLIVSVDETIKNPRSTVDAPTAAGRGRGRGRPH

SEQ ID NO: 911355 - protein, 313 aa, Homo sapiens
RSPCTVRSPCTVRSPCTVRSPCTVRSPCTVEDYQAIVDAEWNILYDKLEKIHHSGAKVVLSKLPIGDVATQYFADRDMFCAGRVPEEDLKRTMMACGGSIQTSVNALSADVLGRCQVFEETQIGGERYNFFTGCPKAKTCTFILRGGAEQFMEETERSLHDAIMIVRRAIKNDSVVAGGGAIEMELSKYLRDYSRTIPGKQQLLIGAYAKALEIIPRQLCDNAGFDATNILNKLRARHAQGGTWYGVDINNEDIADNFEAFVWEPAMVRINALTAASEAACLIVSVDETIKNPRSTVDAPTAAGRGRGRGRPH

SEQ ID NO: 911356 - protein, 176 aa, Homo sapiens; identical to SEQ ID NO: 911327

SEQ ID NO: 911357 - protein, 270 aa, Homo sapiens
MMPTPVILLKEGTDSSQGIPQLVSNISACQVIAEAVRTTLGPRGMDKLIVDGRGKATISNDGATILKLLDVVHPAAKTLVDIAKSQDAEVGDGTTSVTLLAAEFLKQVKPYVEEGLHPQIIIRASRTGQPPAGHTIRMVTEAYEQRAEVCMTSGSADLRSSARWDADDAHDAVKMIKSGARDLVYCVVKISTRVNAPKYHNPKMPLCRARVKAEKTAEMSPKLSIHVSEEISSSKNHIDQCLSIHGMGTVLLTECRGILRIERMRLEVNN

SEQ ID NO: 911358 - protein, 176 aa, Homo sapiens; identical to SEQ ID NO: 911327

SEQ ID NO: 911359 - protein, 176 aa, Homo sapiens; identical to SEQ ID NO: 911327

SEQ ID NO: 911360 - protein, 92 aa, Homo sapiens; identical to SEQ ID NO: 911330

SEQ ID NO: 911361 - protein, 303 aa, Homo sapiens; identical to SEQ ID NO: 911331

SEQ ID NO: 911362 - protein, 303 aa, Homo sapiens; identical to SEQ ID NO: 911331

SEQ ID NO: 911363 - protein, 303 aa, Homo sapiens; identical to SEQ ID NO: 911331

SEQ ID NO: 911364 - protein, 303 aa, Homo sapiens; identical to SEQ ID NO: 911331

SEQ ID NO: 911365 - protein, 303 aa, Homo sapiens; identical to SEQ ID NO: 911331

SEQ ID NO: 911366 - protein, 347 aa, Homo sapiens
MVELELKAEKDNAEIRVHTVEDYQAIVDAEWNILYDKLEKIHHSGAKVVLSKLPIGDVATQYFADRDMFCAGRVPEEDLKRTMMACGGSIQTSVNALSADVLGRCQVFEETQIGGERYNFFTGCPKAKTCTFILRGGAEQFMEETERSLHDAIMIVRRAIKNDSVVAGGGAIEMELSKYLRDYSRTIPGKQQLLIGAYAKALEIIPRQLCDNAGFDATNILNKLRARHAQGGTWYGVDINNEDIADNFEAFVWEPAMVRINALTAASEAACLIVSVDETIKNPRSTVDAPTAAGRGRGRGRPMERDHHNGWCCGASSWLVLLSSRGDGLFGVKGIKHTKTVFGKKAV

SEQ ID NO: 911367 - protein, 284 aa, Homo sapiens
MVELELKAEKDNAEIRVHTVEIHHSGAKVVLSKLPIGDVATQYFADRDMFCAGRVPEEDLKRTMMACGGSIQTSVNALSADVLGRCQVFEETQIGGERYNFFTGCPKAKTCTFILRGGAEQFMEETERSLHDAIMIVRRAIKNDSVVAGGGAIEMELSKYLRDYSRTIPGKQQLLIGAYAKALEIIPRQLCDNAGFDATNILNKLRARHAQGGTWYGVDINNEDIADNFEAFVWEPAMVRINALTAASEAACLIVSVDETIKNPRSTVDAPTAAGRGRGRGRPH

SEQ ID NO: 911368 - protein, 176 aa, Homo sapiens; identical to SEQ ID NO: 911327

SEQ ID NO: 911369 - protein, 303 aa, Homo sapiens; identical to SEQ ID NO: 911331

SEQ ID NO: 911370 - protein, 176 aa, Homo sapiens; identical to SEQ ID NO: 911327

SEQ ID NO: 911371 - protein, 303 aa, Homo sapiens; identical to SEQ ID NO: 911331

SEQ ID NO: 911372 - protein, 303 aa, Homo sapiens; identical to SEQ ID NO: 911331

SEQ ID NO: 911373 - protein, 303 aa, Homo sapiens; identical to SEQ ID NO: 911331

SEQ ID NO: 911374 - protein, 303 aa, Homo sapiens; identical to SEQ ID NO: 911331

SEQ ID NO: 911375 - protein, 303 aa, Homo sapiens; identical to SEQ ID NO: 911331

SEQ ID NO: 911376 - protein, 303 aa, Homo sapiens; identical to SEQ ID NO: 911331

SEQ ID NO: 911377 - protein, 303 aa, Homo sapiens; identical to SEQ ID NO: 911331

SEQ ID NO: 911378 - protein, 303 aa, Homo sapiens; identical to SEQ ID NO: 911331

SEQ ID NO: 911379 - protein, 304 aa, Homo sapiens
EKDYARVYRVAYTKLDGLVRQIVCMAGDVKMPLLHNALALQIHHSGAKVVLSKLPIGDVATQYFADRDMFCAGRVPEEDLKRTMMACGGSIQTSVNALSADVLGRCQVFEETQIGGERYNFFTGCPKAKTCTFILRGGAEQFMEETERSLHDAIMIVRRAIKNDSVVAGGGAIEMELSKYLRDYSRTIPGKQQLLIGAYAKALEIIPRQLCDNAGFDATNILNKLRARHAQGGTWYGVDINNEDIADNFEAFVWEPAMVRINALTAASEAACLIVSVDETIKNPRSTVDAPTAAGRGRGRGRPH

SEQ ID NO: 911380 - protein, 125 aa, Homo sapiens
MVELELKAEKDNAEIRVHTVEDYQAIVDAEWNILYDKLEKIHHSGAKVVLSKLPIGDVATQYFADRDMFCAGRVPEEDLKRTMMACGGSIQTSVNALSADVLGRCQVFEETQIGGESQLWCGSMR

SEQ ID NO: 911381 - protein, 124 aa, Homo sapiens
LRPTLLPLLHSLVWRPGMEEGGIKLVGDAGRAKTLRALRSTTEMRRPLFNERPSLESPRSPASGPSSRTESVVTNHRVAEVVRSLPLPGAELLGISIARGIVGCWAARSRRRGESGGPLNKLPK

SEQ ID NO: 911382 - protein, 1261 aa, Homo sapiens
MIAHKQKKTKKKRAWASGQLSTDITTSEMGLKSLSSNSIFDPDYIKELVNDIRKFSHMLLYLKEAIFSDCFKEVIHIRLEELLRVLKSIMNKHQNLNSVDLQNAAEMLTAKVKAVNFTEVNEENKNDLFQEVFSSIETLAFTFGNILTNFLMGDVGNDSLLRLPVSRETKSFENVSVESVDSSSEKGNFSPLELDNVLLKNTDSIELALSYAKTWSKYTKNIVSWVEKKLNLELESTRNMVKLAEATRTNIGIQEFMPLQSLFTNALLNDIESSHLLQQTIAALQANKFVQPLLGRKNEMEKQRKEIKELWKQEQNKMLEAENALKKAKLLCMQRQDEYEKAKSSMFRAEEEHLSSSGGLAKNLNKQLEKKRRLEEEALQKVEEANELYKVCVTNVEERRNDLENTKREILAQLRTLVFQCDLTLKAVTVNLFHMQHLQAASLADSLQSLCDSAKLYDPGQEYSEFVKATNSTEEEKVDGNVNKHLNSSQPSGFGPANSLEDVVRLPDSSNKIEEDRCSNSADITGPSFIRSWTFGMFSDSESTGGSSESRSLDSESISPGDFHRKLPRTPSSGTMSSADDLDEREPPSPSETGPNSLGTFKKTLMSKAALTHKFRKLRSPTKCRDCEGIVVFQGVECEECLLVCHRKCLENLVIICGHQKLPGKIHLFGAEFTQVAKKEPDGIPFILKICASEIENRALCLQGIYRVCGNKIKTEKLCQALENGMHLVDISEFSSHDICDVLKLYLRQLPEPFILFRLYKEFIDLAKEIQHVNEEQETKKNSLEDKKWPNMCIEINRILLKSKDLLRQLPASNFNSLHFLIVHLKRVVDHAEENKMNSKNLGVIFGPSLIRPRATTAPITISSLAEYSNQARLVEFLITYSQKIFDGSLQPQDVMCSIGVVDQGCFPKPLLSPEERDIERSMKSLFFSSKEDIHTSESESKIFERATSFEESERKQNALGKCDACLSDKAQLLLDQEAESASQKIEDGKTPKPLSLKSDRSTNNVERHTPRTKIRPVSLPVDRLLLASPPNERNGRNMGNVNLDKFCKNPAFEGVNRKDAATTVCSKFNGFDQQTLQKIQDKQYEQNSLTAKTTMIMPSALQEKGVTTSLQISGDHSINATQPSKPYAEPVRSVREASERRSSDSYPLAPVRAPRTLQPQHWTTFYKPHAPIISIRGNEEKPASPSAAVPPGTDHDPHGLVVKSMPDPDKASACPGQATGQPKEDSEELGLPDVNPMCQRPRLKRMQQFEDLEDEIPQFV

SEQ ID NO: 911383 - protein, 392 aa, Homo sapiens
PVACEGSLTWKTLPKIFDGSLQPQDVMCSIGVVDQGCFPKPLLSPEERDIERSMKSLFFSSKEDIHTSESESKIFERATSFEESERKQNALGKCDACLSDKAQLLLDQEAESASQKIEDGKTPKPLSLKSDRSTNNVERHTPRTKIRPVSLPVDRLLLASPPNERNGRNMGNVNLDKFCKNPAFEGVNRKDAATTVCSKFNGFDQQTLQKIQDKQYEQNSLTAKTTMIMPSALQEKGVTTSLQISGDHSINATQPSKPYAEPVRSVREASERRSSDSYPLAPVRAPRTLQPQHWTTFYKPHAPIISIRGNEEKPASPSAAVPPGTDHDPHGLVVKSMPDPDKASACPGQATGQPKEDSEELGLPDVNPMCQRPRLKRMQQFEDLEDEIPQFV

SEQ ID NO: 911384 - protein, 223 aa, Homo sapiens [sequence omitted]

SEQ ID NO: 911385 - protein, 1261 aa, Homo sapiens
MIAHKQKKTKKKRAWASGQLSTDITTSEMGLKSLSSNSIFDPDYIKELVNDIRKFSHMLLYLKEAIFSDCFKEVIHIRLEELLRVLKSIMNKHQNLNSVDLQNAAEMLTAKVKAVNFTEVNEENKNDLFQEVFSSIETLAFTFGNILTNFLMGDVGNDSLLRLPVSRETKSFENVSVESVDSSSEKGNFSPLELDNVLLKNTDSIELALSYAKTWSKYTKNIVSWVEKKLNLELESTRNMVKLAEATRTNIGIQEFMPLQSLFTNALLNDIESSHLLQQTIAALQANKFVQPLLGRKNEMEKQRKEIKELWKQEQNKMLEAENALKKAKLLCMQRQDEYEKAKSSMFRAEEEHLSSSGGLAKNLNKQLEKKRRLEEEALQKVEEANELYKVCVTNVEERRNDLENTKREILAQLRTLVFQCDLTLKAVTVNLFHMQHLQAASLADSLQSLCDSAKLYDPGQEYSEFVKATNSTEEEKVDGNVNKHLNSSQPSGFGPANSLEDVVRLPDSSNKIEEDRCSNSADITGPSFIRSWTFGMFSDSESTGGSSESRSLDSESISPGDFHRKLPRTPSSGTMSSADDLDEREPPSPSETGPNSLGTFKKTLMSKAALTHKFRKLRSPTKCRDCEGIVVFQGVECEECLLVCHRKCLENLVIICGHQKLPGKIHLFGAEFTQVAKKEPDGIPFILKICASEIENRALCLQGIYRVCGNKIKTEKLCQALENGMHLVDISEFSSHDICDVLKLYLRQLPEPFILFRLYKEFIDLAKEIQHVNEEQETKKNSLEDKKWPNMCIEINRILLKSKDLLRQLPASNFNSLHFLIVHLKRVVDHAEENKMNSKNLGVIFGPSLIRPRPTTAPITISSLAEYSNQARLVEFLITYSQKIFDGSLQPQDVMCSIGVVDQGCFPKPLLSPEERDIERSMKSLFFSSKEDIHTSESESKIFERATSFEESERKQNALGKCDACLSDKAQLLLDQEAESASQKIEDGKTPKPLSLKSDRSTNNVERHTPRTKIRPVSLPVDRLLLASPPNERNGRNMGNVNLDKFCKNPAFEGVNRKDAATTVCSKFNGFDQQTLQKIQDKQYEQNSLTAKTTMIMPSALQEKGVTTSLQISGDHSINATQPSKPYAEPVRSVREASERRSSDSYPLAPVRAPRTLQPQHWTTFYKPHAPIISIRGNEEKPASPSAAVPPGTDHDPHGLVVKSMPDPDKASACPGQATGQPKEDSEELGLPDVNPMCQRPRLKRMQQFEDLEDEIPQFV

SEQ ID NO: 911386 - protein, 1197 aa, Homo sapiens
MERRDCFKEVIHIRLEELLRVLKSIMNKHQNLNSVDLQNAAEMLTAKVKAVNFTEVNEENKNDLFQEVFSSIETLAFTFGNILTNFLMGDVGNDSLLRLPVSRETKSFENVSVESVDSSSEKGNFSPLELDNVLLKNTDSIELALSYAKTWSKYTKNIVSWVEKKLNLELESTRNMVKLAEATRTNIGIQEFMPLQSLFTNALLNDIESSHLLQQTIAALQANKFVQPLLGRKNEMEKQRKEIKELWKQEQNKMLEAENALKKAKLLCMQRQDEYEKAKSSMFRAEEEHLSSSGGLAKNLNKQLEKKRRLEEEALQKVEEANELYKVCVTNVEERRNDLENTKREILAQLRTLVFQCDLTLKAVTVNLFHMQHLQAASLADSLQSLCDSAKLYDPGQEYSEFVKATNSTEEEKVDGNVNKHLNSSQPSGFGPANSLEDVVRLPDSSNKIEEDRCSNSADITGPSFIRSWTFGMFSDSESTGGSSESRSLDSESISPGDFHRKLPRTPSSGTMSSADDLDEREPPSPSETGPNSLGTFKKTLMSKAALTHKFRKLRSPTKCRDCEGIVVFQGVECEECLLVCHRKCLENLVIICGHQKLPGKIHLFGAEFTQVAKKEPDGIPFILKICASEIENRALCLQGIYRVCGNKIKTEKLCQALENGMHLVDISEFSSHDICDVLKLYLRQLPEPFILFRLYKEFIDLAKEIQHVNEEQETKKNSLEDKKWPNMCIEINRILLKSKDLLRQLPASNFNSLHFLIVHLKRVVDHAEENKMNSKNLGVIFGPSLIRPRPTTAPITISSLAEYSNQARLVEFLITYSQKIFDGSLQPQDVMCSIGVVDQGCFPKPLLSPEERDIERSMKSLFFSSKEDIHTSESESKIFERATSFEESERKQNALGKCDACLSDKAQLLLDQEAESASQKIEDGKTPKPLSLKSDRSTNNVERHTPRTKIRPVSLPVDRLLLASPPNERNGRNMGNVNLDKFCKNPAFEGVNRKDAATTVCSKFNGFDQQTLQKIQDKQYEQNSLTAKTTMIMPSALQEKGVTTSLQISGDHSINATQPSKPYAEPVRSVREASERRSSDSYPLAPVRAPRTLQPQHWTTFYKPHAPIISIRGNEEKPASPSAAVPPGTDHDPHGLVVKSMPDPDKASACPGQATGQPKEDSEELGLPDVNPMCQRPRLKRMQQFEDLEDEIPQFV

SEQ ID NO: 911387 - protein, 366 aa, Homo sapiens [sequence omitted]

SEQ ID NO: 911388 - protein, 171 aa, Homo sapiens
MSLTKTERTIIVSMWAKISTQADTIGTETLERLFLSHPQTKTYFPHFDLHPGSAQLRAHGSKVVAAVGDAVKSIDDIGGALSKLSELHAYILRVDPVNFKLLSHCLLVTLAARFPADFTPRPTPPGTSSIGRILCPDREVPLSAAPGPPGQAAAPPPSWRFPSPTYRVMRQ

SEQ ID NO: 911389 - protein, 230 aa, Homo sapiens
MSLTKTERTIIVSMWAKISTQADTIGTETLERLFLSHPQTKTYFPHFDLHPGSAQLRAHGSKVVAAVGDAVKSIDDIGGALSKLSELHAYILRVDPVNFKALHGVPQHQGLLPAPERLPGRDAAAEPRAAHAGGCGRGGAARGQPARRAEPAGGPARARAARGPSQLSAANPVFPRRAGLPPAGRVHRANASGVGQVPDWCGRGADRKIPLSPVLRRPWSVPVNKQRPEP

SEQ ID NO: 911390 - protein, 142 aa, Homo sapiens
HVSDQDLGAIIVSMWAKISTQADTIGTETLERLFLSHPQTKTYFPHFDLHPGSAQLRAHGSKVVAAVGDAVKSIDDIGGALSKLSELHAYILRVDPVNFKLLSHCLLVTLAARFPADFTAEAHAAWAKFLSVVSSVLTEKYR

SEQ ID NO: 911391 - protein, 147 aa, Homo sapiens
STSGGAMLSAQERAQIAQVWDLIAGHEAQFGAELLLRLFTVYPSTKVYFPHLSACQDATQLLSHGQRMLAAVGAAVQHVDNLRAALSPLADLHALVLRVDPANFPLLIQCFHVVLASHLQDEFTVQMQAAWDKFLTGVAVVLTEKYR

SEQ ID NO: 911392 - protein, 128 aa, Homo sapiens
GSGLCLLTGTDQGLRSTRLFTVYPSTKVYFPHLSACQDATQLLSHGQRMLAAVGAAVQHVDNLRAALSPLADLHALVLRVDPANFPLLIQCFHVVLASHLQDEFTVQMQAAWDKFLTGVAVVLTEKYR

SEQ ID NO: 911393 - protein, 76 aa, Homo sapiens
TPGTLAPICFGEPDPETPAGCLINSSSASSPASHLLCAPRQSAQSHVHPRSALSPAHHQSVHSPAHLSSASRNILL

SEQ ID NO: 911394 - protein, 109 aa, Homo sapiens
MAPSSKRAVETRSHSQICPGMQVPLRMWCRSYKCGAEDSFKEERNIDPETPAGCLINSSSASSPASHLLCAPRQSAQSHVHPRSALSPAHHQSVHSPAHLSSASRNILL

SEQ ID NO: 911395 - protein, 114 aa, Homo sapiens
MWCRRQLQRGKEYRCQEPAILPKQPFVLCSSQPTGTLLQIMIREMACEIAHDPETPAGCLINSSSASSPASHLLCAPRQSAQSHVHPRSALSPAHHQSVHSPAHLSSASRNILL

SEQ ID NO: 911396 - protein, 114 aa, Homo sapiens; identical to SEQ ID NO: 911395

SEQ ID NO: 911397 - protein, 1783 aa, Homo sapiens [sequence omitted]

SEQ ID NO: 911398 - protein, 359 aa, Homo sapiens
PSFKEFAASASPSFAGWARSQSAGGEGRRSRDLAGARLLALAPVPAAWGRRNPAARRGRSAEEPWAPGAPPSSAARSSRPRGAPRRLSPSPAAAAPRPRRRQTPPRTPPSLPRTPPPRYGRAGPPAPGARVFGGGGGGGGVPPISAERTSQPIQPHLQTQECEPLFGGFSGSFAPGRGQSSGERGGGLASLSRVSRGGDCAMRNNKTRALPTAAEPFCALFRWEPCSPRRRSCAEGDPWRMDPGPGLRSSEMRKVSCEARTRGGARRGAQPPSGSPSRTALDASGAWSERVWYPVLLRQRPEQAPPSRGRESLGCSSLRARKNLGRRCVSRRNDRFRKPASALAFAQRFACRLSWPNTR

SEQ ID NO: 911399 - protein, 1783 aa, Homo sapiens [sequence omitted]

SEQ ID NO: 911400 - protein, 1325 aa, Homo sapiens
MGAGSSTEQRSPEQPPEGSSTPAEPEPSGGGPSAEAAPDTTADPAIAASDPATKLLQKNGQLSTINGVAEQDELSLQEGDLNGQKGALNGQGALNSQEEEEVIVTEVGQRDSEDVSERDSDKEMATKSAVVHDITDDGQEETPEIIEQIPSSESNLEELTQPTESQANDIGFKKVFKFVGFKFTVKKDKTEKPDTVQLLTVKKDEGEGAAGAGDHKDPSLGAGEAASKESEPKQSTEKPEETLKREQSHAEISPPAESGQAVEECKEEGEEKQEKEPSKSAESPTSPVTSETGSTFKKFFTQGWAGWRKKTSFRKPKEDEVEASEKKKEQEPEKVDTEEDGKAEVASEKLTASEQAHPQEPAESAHEPRLSAEYEKVELPSEEQVSGSQGPSEEKPAPLATEVFDEKIEVHQEEVVAEVHVSTVEERTEEQKTEVEETAGSVPAEELVEMDAEPQEAEPAKELVKLKETCVSGEDPTQGADLSPDEKVLSKPPEGVVSEVEMLSSQERMKVQGSPLKKLFTSTGLKKLSGKKQKGKRGGGDEESGEHTQVPADSPDSQEEQKGESSASSPEEPEEITCLEKGLAEVQQDGEAEEGATSDGEKKREGVTPWASFKKMVTPKKRVRRPSESDKEDELDKVKSATLSSTESTASEMQEEMKGSVEEPKPEEPKRKVDTSVSWEALICVGSSKKRARRGSSSDEEGGPKAMGGDHQKADEAGKDKETGTDGILAGSQEHDPGQGSSSPEQAGSPTEGEGVSTWESFKRLVTPRKKSKSKLEEKSEDSIAGSGVEHSTPDTEPGKEESWVSIKKFIPGRRKKRPDGKQEQAPVEDAGPTGANEDDSDVPAVVPLSEYDAVEREKMEAQQAQKSAEQPEQKAATEVSKELSESQVHMMAAAVADGTRAATIIEERSPSWISASVTEPLEQVEAEAALLTEEVLEREVIAEEEPPTVTEPLPENREARGDTVVSEAELTPEAVTAAETAGPLGAEEGTEASAAEETTEMVSAVSQLTDSPDTTEEATPVQEVEGGVPDIEEQERRTQEVLQAVAEKVKEESQLPGTGGPEDVLQPVQRAEAERPEEQAEASGLKKETDVVLKVDAQEAKTEPFTQGKVVGQTTPESFEKAPQVTESIESSELVTTCQAETLAGVKSQEMVMEQAIPPDSVETPTDSETDGSTPVADFDAPGTTQKDEIVEIHEENEVASGTQSGGTEAEAVPAQKERPPAPSSFVFQEETKEQSKMEDTLEHTDKEVSVETVSILSKTEGTQEADQYADEKTKDVPFFEGLEGSIDTGITVSREKVTEVALKGEGTEEAGMAELFQEAELGP

SEQ ID NO: 911401 - protein, 140 aa, Homo sapiens
MGAGSSTEQRSPEQPPEGSSTPAEPEPSGGGPSAEAAPDTTADPAIAASDPATKLLQKNGQLSTINGVAEQDELSLQEGDLNGQKGALNGQGALNSQEEEEVIVTEGKPPLQELEGTQHLQQTLDSAENTLSYCLVVDWC

SEQ ID NO: 911402 - protein, 1685 aa, Homo sapiens [sequence omitted]

SEQ ID NO: 911403 - protein, 1783 aa, Homo sapiens [sequence omitted]

SEQ ID NO: 911404 - protein, 1234 aa, Homo sapiens
MGAGSSTEQRSPEQPPEGSSTPAEPEPSGGGPSAEAAPDTTADPAIAASDPATKLLQKNGQLSTINGVAEQDELSLQEGDLNGQKGALNGQGALNSQEEEEVIVTEVGQRDSEDVSERDSDKEMATKSAVVHDITDDGQEETPEIIEQIPSSESNLEELTQPTESQANDIGFKKVFKFVGFKFTVKKDKTEKPDTVQLLTVKKDEGEGAAGAGDHKDPSLGAGEAASKESEPKQSTEKPEETLKREQSHAEISPPAESGQAVEECKEEGEEKQEKEPSKSAESPTSPVTSETGSTFKKFFTQGWAGWRKKTSFRKPKEDEVEASEKKKEQEPEKVDTEEDGKAEVASEKLTASEQAHPQEPAESAHEPRLSAEYEKVELPSEEQVSGSQGPSEEKPAPLATEVFDEKIEVHQEEVVAEVHVSTVEERTEEQKTEVEETAGSVPAEELVEMDAEPQEAEPAKELVKLKETCVSGEDPTQGADLSPDEKVLSKPPEGVVSEVEMLSSQERMKVQGSPLKKLFTSTGLKKLSGKKQKGKRGGGDEESGEHTQVPADSPDSQEEQKGESSASSPEEPEEITCLEKGLAEVQQDGEAEEGATSDGEKKREGVTPWASFKKMVTPKKRVRRPSESDKEDELDKVKSATLSSTESTASEMQEEMKGSVEEPKPEEPKRKVDTSVSWEALICVGSSKKRARRGSSSDEEGGPKAMGGDHQKADEAGKDKETGTDGILAGSQEHDPGQGSSSPEQAGSPTEGEGVSTWESFKRLVTPRKKSKSKLEEKSEDSIAGSGVEHSTPDTEPGKEESWVSIKKFIPGRRKKRPDGKQEQAPVEDAGPTGANEDDSDVPAVVPLSEYDAVEREKMEAQQAQKSAEQPEQKAATEVSKELSESQVHMMAAAVADGTRAATIIEERSPSWISASVTEPLEQVEAEAALLTEEVLEREVIAEEEPPTVTEPLPENREARGDTVVSEAELTPEAVTAAETAGPLGAEEGTEASAAEETTEMVSAVSQLTDSPDTTEEATPVQEVEGGVPDIEEQERRTQEVLQAVAEKVKEESQLPGTGGPEDVLQPVQRAEAERPEEQAEASGLKKETDVVLKVDAQEAKTEPFTQGKVVGQTTPESFEKAPQVTESIESSELVTTCQAETLAGVKSQEMVMEQAIPPDSVETPTDSETDGSTPVADFDAPGTTQKDEIVEIHEENEVASGTQSGGTEAEAVPAQKERPPAPSSFVFQEETK

SEQ ID NO: 911405 - protein, 113 aa, Homo sapiens
AGTKSVPEDDGHALLAERIEKSLVEPKEDEKGDDVDDPENQNSALADTDASGGLTKESPDTNGPKQKEKEDAQEVELQEGKVHSESDKAITPQAQEELQKQERESAKSELTES

SEQ ID NO: 911406 - protein, 876 aa, Homo sapiens
MGPEALSSLLLLLLVASGDADMKGHFDPAKCRYALGMQDRTIPDSDISASSSWSDSTAARHSRLESSDGDGAWCPAGSVFPKEEEYLQVDLQRLHLVALVGTQGRHAGGLGKEFSRSYRLRYSRDGRRWMGWKDRWGQEVISGNEDPEGVVLKDLGPPMVARLVRFYPRADRVMSVCLRVELYGCLWRDGLLSYTAPVGQTMYLSEAVYLNDSTYDGHTVGGLQYGGLGQLADGVVGLDDFRKSQELRVWPGYDYVGWSNHSFSSGYVEMEFEFDRLRAFQAMQVHCNNMHTLGARLPGGVECRFRRGPAMAWEGEPMRHNLGGNLGDPRARAVSVPLGGRVARFLQCRFLFAGPWLLFSEISFISDVVNNSSPALGGTFPPAPWWPPGPPPTNFSSLELEPRGQQPVAKAEGSPTAILIGCLVAIILLLLLIIALMLWRLHWRRLLSKAERRVLEEELTVHLSVPGDTILINNRPGPREPPPYQEPRPRGNPPHSAPCVPNGSAYSGDYMEPEKPGAPLLPPPPQNSVPHYAEADIVTLQGVTGGNTYAVPALPPGAVGDGPPRVDFPRSRLRFKEKLGEGQFGEVHLCEVDSPQDLVSLDFPLNVRKGHPLLVAVKILRPDATKNARNDFLKEVKIMSRLKDPNIIRLLGVCVQDDPLCMITDYMENGDLNQFLSAHQLEDKAAEGAPGDGQAAQGPTISYPMLLHVAAQIASGMRYLATLNFVHRDLATRNCLVGENFTIKIADFGMSRNLYAGDYYRVQGRAVLPIRWMAWECILMGKFTTASDVWAFGVTLWEVLMLCRAQPFGQLTDEQVIENAGEFFRDQGRQVYLSRPPACPQGLYELMLRCWSRESEQRPPFSQLHRFLAEDALNTV

SEQ ID NO: 911407 - protein, 913 aa, Homo sapiens
MGPEALSSLLLLLLVASGDADMKGHFDPAKCRYALGMQDRTIPDSDISASSSWSDSTAARHSRLESSDGDGAWCPAGSVFPKEEEYLQVDLQRLHLVALVGTQGRHAGGLGKEFSRSYRLRYSRDGRRWMGWKDRWGQEVISGNEDPEGVVLKDLGPPMVARLVRFYPRADRVMSVCLRVELYGCLWRDGLLSYTAPVGQTMYLSEAVYLNDSTYDGHTVGGLQYGGLGQLADGVVGLDDFRKSQELRVWPGYDYVGWSNHSFSSGYVEMEFEFDRLRAFQAMQVHCNNMHTLGARLPGGVECRFRRGPAMAWEGEPMRHNLGGNLGDPRARAVSVPLGGRVARFLQCRFLFAGPWLLFSEISFISDVVNNSSPALGGTFPPAPWWPPGPPPTNFSSLELEPRGQQPVAKAEGSPTAILIGCLVAIILLLLLIIALMLWRLHWRRLLSKAERRVLEEELTVHLSVPGDTILINNRPGPREPPPYQEPRPRGNPPHSAPCVPNGSALLLSNPAYRLLLATYARPPRGPGPPTPAWAKPTNTQAYSGDYMEPEKPGAPLLPPPPQNSVPHYAEADIVTLQGVTGGNTYAVPALPPGAVGDGPPRVDFPRSRLRFKEKLGEGQFGEVHLCEVDSPQDLVSLDFPLNVRKGHPLLVAVKILRPDATKNARNDFLKEVKIMSRLKDPNIIRLLGVCVQDDPLCMITDYMENGDLNQFLSAHQLEDKAAEGAPGDGQAAQGPTISYPMLLHVAAQIASGMRYLATLNFVHRDLATRNCLVGENFTIKIADFGMSRNLYAGDYYRVQGRAVLPIRWMAWECILMGKFTTASDVWAFGVTLWEVLMLCRAQPFGQLTDEQVIENAGEFFRDQGRQVYLSRPPACPQGLYELMLRCWSRESEQRPPFSQLHRFLAEDALNTV

SEQ ID NO: 911408 - protein, 919 aa, Homo sapiens
MGPEALSSLLLLLLVASGDADMKGHFDPAKCRYALGMQDRTIPDSDISASSSWSDSTAARHSRLESSDGDGAWCPAGSVFPKEEEYLQVDLQRLHLVALVGTQGRHAGGLGKEFSRSYRLRYSRDGRRWMGWKDRWGQEVISGNEDPEGVVLKDLGPPMVARLVRFYPRADRVMSVCLRVELYGCLWRDGLLSYTAPVGQTMYLSEAVYLNDSTYDGHTVGGLQYGGLGQLADGVVGLDDFRKSQELRVWPGYDYVGWSNHSFSSGYVEMEFEFDRLRAFQAMQVHCNNMHTLGARLPGGVECRFRRGPAMAWEGEPMRHNLGGNLGDPRARAVSVPLGGRVARFLQCRFLFAGPWLLFSEISFISDVVNNSSPALGGTFPPAPWWPPGPPPTNFSSLELEPRGQQPVAKAEGSPTAILIGCLVAIILLLLLIIALMLWRLHWRRLLSKAERRVLEEELTVHLSVPGDTILINNRPGPREPPPYQEPRPRGNPPHSAPCVPNGSALLLSNPAYRLLLATYARPPRGPGPPTPAWAKPTNTQAYSGDYMEPEKPGAPLLPPPPQNSVPHYAEADIVTLQGVTGGNTYAVPALPPGAVGDGPPRVDFPRSRLRFKEKLGEGQFGEVHLCEVDSPQDLVSLDFPLNVRKGHPLLVAVKILRPDATKNASFSLFSRNDFLKEVKIMSRLKDPNIIRLLGVCVQDDPLCMITDYMENGDLNQFLSAHQLEDKAAEGAPGDGQAAQGPTISYPMLLHVAAQIASGMRYLATLNFVHRDLATRNCLVGENFTIKIADFGMSRNLYAGDYYRVQGRAVLPIRWMAWECILMGKFTTASDVWAFGVTLWEVLMLCRAQPFGQLTDEQVIENAGEFFRDQGRQVYLSRPPACPQGLYELMLRCWSRESEQRPPFSQLHRFLAEDALNTV

SEQ ID NO: 911409 - protein, 913 aa, Homo sapiens; identical to SEQ ID NO: 911407

SEQ ID NO: 911410 - protein, 913 aa, Homo sapiens; identical to SEQ ID NO: 911407

SEQ ID NO: 911411 - protein, 913 aa, Homo sapiens; identical to SEQ ID NO: 911407

SEQ ID NO: 911412 - protein, 913 aa, Homo sapiens; identical to SEQ ID NO: 911407

SEQ ID NO: 911413 - protein, 918 aa, Homo sapiens
MCPSQKRPEALSSLLLLLLVASGDADMKGHFDPAKCRYALGMQDRTIPDSDISASSSWSDSTAARHSRLESSDGDGAWCPAGSVFPKEEEYLQVDLQRLHLVALVGTQGRHAGGLGKEFSRSYRLRYSRDGRRWMGWKDRWGQEVISGNEDPEGVVLKDLGPPMVARLVRFYPRADRVMSVCLRVELYGCLWRDGLLSYTAPVGQTMYLSEAVYLNDSTYDGHTVGGLQYGGLGQLADGVVGLDDFRKSQELRVWPGYDYVGWSNHSFSSGYVEMEFEFDRLRAFQAMQVHCNNMHTLGARLPGGVECRFRRGPAMAWEGEPMRHNLGGNLGDPRARAVSVPLGGRVARFLQCRFLFAGPWLLFSEISFISDVVNNSSPALGGTFPPAPWWPPGPPPTNFSSLELEPRGQQPVAKAEGSPTAILIGCLVAIILLLLLIIALMLWRLHWRRLLSKAERRVLEEELTVHLSVPGDTILINNRPGPREPPPYQEPRPRGNPPHSAPCVPNGSALLLSNPAYRLLLATYARPPRGPGPPTPAWAKPTNTQAYSGDYMEPEKPGAPLLPPPPQNSVPHYAEADIVTLQGVTGGNTYAVPALPPGAVGDGPPRVDFPRSRLRFKEKLGEGQFGEVHLCEVDSPQDLVSLDFPLNVRKGHPLLVAVKILRPDATKNARNDFLKEVKIMSRLKDPNIIRLLGVCVQDDPLCMITDYMENGDLNQFLSAHQLEDKAAEGAPGDGQAAQGPTISYPMLLHVAAQIASGMRYLATLNFVHRDLATRNCLVGENFTIKIADFGMSRNLYAGDYYRVQGRAVLPIRWMAWECILMGKFTTASDVWAFGVTLWEVLMLCRAQPFGQLTDEQVIENAGEFFRDQGRQVYLSRPPACPQGLYELMLRCWSRESEQRPPFSQLHRFLAEDALNTV

SEQ ID NO: 911414 - protein, 913 aa, Homo sapiens; identical to SEQ ID NO: 911407

SEQ ID NO: 911415 - protein, 567 aa, Homo sapiens
AAPTTTKFAAARRRCMAWECILMGKFTTASDVWAFGVTLCEVLMLCRAQPIASVTDEQVIENAGEFFRDQGAEWGGFPRGLGLLLLIIALMLWRLHWRRLLSKAERRVLEEELTVHLSVPGDTILINNRPGPREPPPYQEPRPRGNPPHSAPCVPNGSALLLSNPAYRLLLATYARPPRGPGPPTPAWAKPTNTQAYSGDYMEPEKPGAPLLPPPPQNSVPHYAEADIVTLQGVTGGNTYAVPALPPGAVGDGPPRVDFPRSRLRFKEKLGEGQFGEVHLCEVDSPQDLVSLDFPLNVRKGHPLLVAVKILRPDATKNARNDFLKEVKIMSRLKDPNIIRLLGVCVQDDPLCMITDYMENGDLNQFLSAHQLEDKAAEGAPGDGQAAQGPTISYPMLLHVAAQIASGMRYLATLNFVHRDLATRNCLVGENFTIKIADFGMSRNLYAGDYYRVQGRAVLPIRWMAWECILMGKFTTASDVWAFGVTLWEVLMLCRAQPFGQLTDEQVIENAGEFFRDQGRQVYLSRPPACPQGLYELMLRCWSRESEQRPPFSQLHRFLAEDALNTV

SEQ ID NO: 911416 - protein, 913 aa, Homo sapiens; identical to SEQ ID NO: 911407

SEQ ID NO: 911417 - protein, 383 aa, Homo sapiens
MGPEALSSLLLLLLVASGDADMKGHFDPAKCRYALGMQDRTIPDSDISASSSWSDSTAARHSRLESSDGDGAWCPAGSVFPKEEEYLQVDLQRLHLVALVGTQGRHAGGLGKEFSRSYRLRYSRDGRRWMGWKDRWGQEVISGNEDPEGVVLKDLGPPMVARLVRFYPRADRVMSVCLRVELYGCLWRDGLLSYTAPVGQTMYLSEAVYLNDSTYDGHTVGGLQYGGLGQLADGVVGLDDFRKSQELRVWPGYDYVGWSNHSFSSGYVEMEFEFDRLRAFQAMQVHCNNMHTLGARLPGGVECRFRRGPAMAWEGEPMRHNLGGNLGDPRARAVSVPLGGRVARFLQCRFLFAGPWLLFSEISFISDSAAGRVCAGRPPLHDY

SEQ ID NO: 911418 - protein, 293 aa, Homo sapiens
MALVHLCEVDSPQDLVSLDFPLNVRKGHPLLVAVKILRPDATKNARNDFLKEVKIMSRLKDPNIIRLLGVCVQDDPLCMITDYMENGDLNQFLSAHQLEDKAAEGAPGDGQAAQGPTISYPMLLHVAAQIASGMRYLATLNFVHRDLATRNCLVGENFTIKIADFGMSRNLYAGDYYRVQGRAVLPIRWMAWECILMGKFTTASDVWAFGVTLWEVLMLCRAQPFGQLTDEQVIENAGEFFRDQGRQVYLSRPPACPQGLYELMLRCWSRESEQRPPFSQLHRFLAEDALNTV

SEQ ID NO: 911419 - protein, 941 aa, Homo sapiens
MGPEALSSLLLLLLVASGDADMKGHFDPAKCRYALGMQDRTIPDSDISASSSWSDSTAARHSRLESSDGDGAWCPAGSVFPKEEEYLQVDLQRLHLVALVGTQGRHAGGLGKEFSRSYRLRYSRDGRRWMGWKDRWGQEVISGNEDPEGVVLKDLGPPMVARLVRFYPRADRVMSVCLRVELYGCLWRDGLLSYTAPVGQTMYLSEAVYLNDSTYDGHTVGGLQYGGLGQLADGVVGLDDFRKSQELRVWPGYDYVGWSNHSFSSGYVEMEFEFDRLRAFQAMQVHCNNMHTLGARLPGGVECRFRRGPAMAWEGEPMRHNLGGNLGDPRARAVSVPLGGRVARFLQCRFLFAGPWLLFSEISFISDVVNNSSPALGGTFPPAPWWPPGPPPTNFSSLELEPRGQQPVAKAEGSPTAILIGCLVAIILLLLLIIALMLWRLHWRRLLSKAERRVLEEELTVHLSVPGDTILINNRPGPREPPPYQEPRPRGNPPHSAPCVPNGSALLLSNPAYRLLLATYARPPRGPGPPTPAWAKPTNTQAYSGDYMEPEKPGAPLLPPPPQNSVPHYAEADIVTLQGVTGGNTYAVPALPPGAVGDGPPRVDFPRSRLRFKEKLGEGQFGEVHLCEVDSPQDLVSLDFPLNVRKGHPLLVAVKILRPDATKNARNDFLKEVKIMSRLKDPNIIRLLGVCVQDDPLCMITDYMENGDLNQFLSAHQLEDKAAEGAPGDGQAAQGPTISYPMLLHVAAQIASGMRYLATLNFVHRDLATRNCLVGENFTIKIADFGMSRNLYAGDYYRVQGRAVLPIRWMAWECILMGKFTTASDVWAFGVTLWEVLMLCRAQPFGQLTDEQVIENAGEFFRDQGRQVYLSRPPACPQGLYELMLRCWSRESEQRPPFSQLHRFLAEDALNTCRPPSWSCGWDPLHPPLAIPWGRVGRNIG

SEQ ID NO: 911420 - protein, 189 aa, Homo sapiens
TQARYEAGFKFGRGSYPMLLHVAAQIASGMRYLATLNFVHRDLATRNCLVGENFTIKIADFGMSRNLYAGDYYRVQGRAVLPIRWMAWECILMGKFTTASDVWAFGVTLWEVLMLCRAQPFGQLTDEQVIENAGEFFRDQGRQVYLSRPPACPQGLYELMLRCWSRESEQRPPFSQLHRFLAEDALNTV

SEQ ID NO: 911421 - protein, 913 aa, Homo sapiens; identical to SEQ ID NO: 911407

SEQ ID NO: 911422 - protein, 683 aa, Homo sapiens
MGPEALSSLLLLLLVASGDADMKGHFDPAKCRYALGMQDRTIPDSDISASSSWSDSTAARHSRLESSDGDGAWCPAGSVFPKEEEYLQVDLQRLHLVALVGTQGRHAGGLGKEFSRSYRLRYSRDGRRWMGWKDRWGQEVISGNEDPEGVVLKDLGPPMVARLVRFYPRADRVMSVCLRVELYGCLWRDGLLSYTAPVGQTMYLSEAVYLNDSTYDGHTVGGLQYGGLGQLADGVVGLDDFRKSQELRVWPGYDYVGWSNHSFSSGYVEMEFEFDRLRAFQAMQVHCNNMHTLGARLPGGVECRFRRGPAMAWEGEPMRHNLGGNLGDPRARAVSVPLGGRVARFLQCRFLFAGPWLLFSEISFISDVVNNSSPALGGTFPPAPWWPPGPPPTNFSSLELEPRGQQPVAKAEGSPTAILIGCLVAIILLLLLIIALMLWRLHWRRLLSKAERRVLEEELTVHLSVPGDTILINNRPGPREPPPYQEPRPRGNPPHSAPCVPNGSAYSGDYMEPEKPGAPLLPPPPQNSVPHYAEADIVTLQGVTGGNTYAVPALPPGAVGDGPPRVDFPRSRLRFKEKLGEGQFGEVHLCEVDSPQDLVSLDFPLNVRKGHPLLVAVKILRPDATKNARNDFLKEVKIMSRLKDPNIIRLLGVCVQDDPLCMITDYMENGDLNQFLSAHQLED

SEQ ID NO: 911423 - protein, 516 aa, Homo sapiens
MGPEALSSLLLLLLVASGDADMKGHFDPAKCRYALGMQDRTIPDSDISASSSWSDSTAARHSRLESSDGDGAWCPAGSVFPKEEEYLQVDLQRLHLVALVGTQGRHAGGLGKEFSRSYRLRYSRDGRRWMGWKDRWGQEVISGNEDPEGVVLKDLGPPMVARLVRFYPRADRVMSVCLRVELYGCLWRDGLLSYTAPVGQTMYLSEAVYLNDSTYDGHTVGGLQYGGLGQLADGVVGLDDFRKSQELRVWPGYDYVGWSNHSFSSGYVEMEFEFDRLRAFQAMQVHCNNMHTLGARLPGGVECRFRRGPAMAWEGEPMRHNLGGNLGDPRARAVSVPLGGRVARFLQCRFLFAGPWLLFSEISFISDVVNNSSPALGGTFPPAPWWPPGPPPTNFSSLELEPRGQQPVAKAEGSPTAILIGCLVAIILLLLLIIALMLWRLHWRRLLSKAERRVLEEELTVHLSVPGDTILINNRPGPREPPPYQEPRPRGNPPHSAPCVPNGSGKTCLVPVAPLS

SEQ ID NO: 911424 - protein, 314 aa, Homo sapiens
MGPEALSSLLLLLLVASGDADMKGHFDPAKCRYALGMQDRTIPDSDISASSSWSDSTAARHSRLESSDGDGAWCPAGSVFPKEEEYLQVDLQRLHLVALVGTQGRHAGGLGKEFSRSYRLRYSRDGRRWMGWKDRWGQEVISGNEDPEGVVLKDLGPPMVARLVRFYPRADRVMSVCLRVELYGCLWRDGLLSYTAPVGQTMYLSEAVYLNDSTYDGHTVGGLQYGGLGQLAEVVESGSPAETLLLALLDTRYEADLTFFNTLVRKKSKLGDLEGAKALLPVLAKRGLVPNLQTFCNLAIGCHRPKGRLQLLTD

SEQ ID NO: 911425 - protein, 98 aa, Homo sapiens
RLLGVCVQDDPLCMITDYMENGDLNQFLSAHQLEDKAAEGAPGDGQAAQGPTIRYLLTQAGPCSEFPQGISSSPLASAWRKRGERGGGKGERFQEGLG

SEQ ID NO: 911426 - protein, 876 aa, Homo sapiens; identical to SEQ ID NO: 911406

SEQ ID NO: 911427 - protein, 102 aa, Homo sapiens
MSPSVPQVPLPFSAFYTSHLPVSLSFTLCAPVSLLFPSTLCFTPAPPSLVLASCPLDLSAQLSSLLSSLPSSLRSLFPTLFPSRVHFSSFIQFSPFLPKLQS

SEQ ID NO: 911428 - protein, 913 aa, Homo sapiens; identical to SEQ ID NO: 911407

SEQ ID NO: 911429 - protein, 876 aa, Homo sapiens; identical to SEQ ID NO: 911406

SEQ ID NO: 911430 - protein, 913 aa, Homo sapiens; identical to SEQ ID NO: 911407

SEQ ID NO: 911431 - protein, 364 aa, Homo sapiens
MGPEALSSLLLLLLVASGDADMKGHFDPAKCRYALGMQDRTIPDSDISASSSWSDSTAARHSRLESSDGDGAWCPAGSVFPKEEEYLQVDLQRLHLVALVGTQGRHAGGLGKEFSRSYRLRYSRDGRRWMGWKDRWGQEVISGNEDPEGVVLKDLGPPMVARLVRFYPRADRVMSVCLRVELYGCLWRDGLLSYTAPVGQTMYLSEAVYLNDSTYDGHTVGGLQYGGLGQLADGVVGLDDFRKSQELRVWPGYDYVGWSNHSFSSGYVEMEFEFDRLRAFQAMQVHCNNMHTLGARLPGGVECRFRRGPAMAWEGEPMRHNLGGNLGDPRARAVSVPLGGRVARFLQCRSAPTSPEQRPPLCRG

SEQ ID NO: 911432 - protein, 767 aa, Homo sapiens
MGPEALSSLLLLLLVASGDADMKGHFDPAKCRYALGMQDRTIPDSDISASSSWSDSTAARHSRLESSDGDGAWCPAGSVFPKEEEYLQVDLQRLHLVALVGTQGRHAGGLGKEFSRSYRLRYSRDGRRWMGWKDRWGQEVISGNEDPEGVVLKDLGPPMVARLVRFYPRADRVMSVCLRVELYGCLWRDGLLSYTAPVGQTMYLSEAVYLNDSTYDGHTVGGLQYGGLGQLADGVVGLDDFRKSQELRVWPGYDYVGWSNHSFSSGYVEMEFEFDRLRAFQAMQVHCNNMHTLGARLPGGVECRFRRGPAMAWEGEPMRHNLGGNLGDPRARAVSVPLGGRVARFLQCRFLFAGPWLLFSEISFISDVVNNSSPALGGTFPPAPWWPPGPPPTNFSSLELEPRGQQPVAKAEGSPTAILIGCLVAIILLLLLIIALMLWRLHWRRLLSKVLESHPRTRSPGLVGIRPTPLPVSPMALVHLCEVDSPQDLVSLDFPLNVRKGHPLLVAVKILRPDATKNARNDFLKEVKIMSRLKDPNIIRLLGVCVQDDPLCMITDYMENGDLNQFLSAHQLEDKAAEGAPGDGQAAQGPTISYPMLLHVAAQIASGMRYLATLNFVHRDLATRNCLVGENFTIKIADFGMSRNLYAGDYYRVQGRAVLPIRWMAWECILMGKFTTASDVWAFGVTLWEVLMLCRAQPFGQLTDEQVIENAGEFFRDQGRQVYLSRPPACPQGLYELMLRCWSRESEQRPPFSQLHRFLAEDALNTV

SEQ ID NO: 911433 - protein, 347 aa, Homo sapiens
TQARYEAGFKFGRGSGGNTYAVPALPPGAVGDGPPRVDFPRSRLRFKEKLGEGQFGEVHLCEVDSPQDLVSLDFPLNVRKGHPLLVAVKILRPDATKNARNDFLKEVKIMSRLKDPNIIRLLGVCVQDDPLCMITDYMENGDLNQFLSAHQLEDKAAEGAPGDGQAAQGPTISYPMLLHVAAQIASGMRYLATLNFVHRDLATRNCLVGENFTIKIADFGMSRNLYAGDYYRVQGRAVLPIRWMAWECILMGKFTTASDVWAFGVTLWEVLMLCRAQPFGQLTDEQVIENAGEFFRDQGRQVYLSRPPACPQGLYELMLRCWSRESEQRPPFSQLHRFLAEDALNTV

SEQ ID NO: 911434 - protein, 913 aa, Homo sapiens; identical to SEQ ID NO: 911407

SEQ ID NO: 911435 - protein, 913 aa, Homo sapiens; identical to SEQ ID NO: 911407

SEQ ID NO: 911436 - protein, 913 aa, Homo sapiens; identical to SEQ ID NO: 911407

SEQ ID NO: 911437 - protein, 913 aa, Homo sapiens; identical to SEQ ID NO: 911407

SEQ ID NO: 911438 - protein, 293 aa, Homo sapiens
MGPEALSSLLLLLLVASGDADMKGHFDPAKCRYALGMQDRTIPDSDISASSSWSDSTAARHSRLESSDGDGAWCPAGSVFPKEEEYLQVDLQRLHLVALVGTQGRHAGGLGKEFSRSYRLRYSRDGRRWMGWKDRWGQEVISGNEDPEGVVLKDLGPPMVARLVRFYPRADRVMSVCLRVELYGCLWRDGLLSYTAPVGQTMYLSEAVYLNDSTYDGHTVGGLQYGGLGQLADGVVGLDDFRKSQELRVWPGYDYVGWSNHSFSTPPSPETLDLGVAPPQPSVTPTSHLQSCS

SEQ ID NO: 911439 - protein, 1026 aa, Homo sapiens
RARQPGSPRPPPAPRWPGLSRPRFMAAHEWDWFQREELIGQISDIRVQNLQVERENVQKRTFTRWINLHLEKCNPPLEVKDLFVDIQDGKILMALLEVLSGRNLLHEYKSSSHRIFRLNNIAKALKFLEDSNVKLVSIDAAEIADGNPSLVLGLIWNIILFFQIKELTGNLSRNSPSSSLSPGSGGTDSDSSFPPTPTAERSVAISVKDQRKAIKALLAWVQRKTRKYGVAVQDFAGSWRSGLAFLAVIKAIDPSLVDMKQALENSTRENLEKAFSIAQDALHIPRLLEPEDIMVDTPDEQSIMTYVAQFLERFPELEAEDIFDSDKEVPIESTFVRIKETPSEQESKVFVLTENGERTYTVNHETSHPPPSKVFVCDKPESMKEFRLDGVSSHALSDSSTEFMHQIIDQVLQGGPGKTSDISEPSPESSILSSRKENGRSNSLPIKKTVHFEADTYKDPFCSKNLSLCFEGSPRVAKESLRQDGHVLAVEVAEEKEQKQESSKIPESSSDKVAGDIFLVEGTNNNSQSSSCNGALESTARHDEESHSLSPPGENTVMADSFQIKVNLMTVEALEEGDYFEAIPLKASKFNSDLIDFASTSQAFNKVPSPHETKPDEDAEAFENHAEKLGKRSIKSAHKKKDSPEPQVKMDKHEPHQDSGEEAEGCPSAPEETPVDKKPEVHEKAKRKSTRPHYEEEGEDDDLQGVGEELSSSPPSSCVSLETLGSHSEEGLDFKPSPPLSKVSVIPHDLFYFPHYEVPLAAVLEAYVEDPEDLKNEEMDLEEPEGYMPDLDSREEEADGSQSSSSSSVPGESLPSASDQVLYLSRGGVGTTPASEPAPLAPHEDHQQRETKENDPMDSHQSQESPNLENIANPLEENVTKESISSKKKEKRKHVDHVESSLFVAPGSVQSSDDLEEDSSDYSIPSRTSHSDSSIYLRRHTHRSSESDHFSYVQLRNAADLDDRRNRILTRKANSSGEAMSLGSHSPQSDSLTQLVQQPDMMYFILFLWLLVYCLLLFPQLDVSRL

SEQ ID NO: 911440 - protein, 660 aa, Homo sapiens
RRNFAELKIKRLRKKFAQKMLRKARRKLIYEKAKHYHKEYIIDQVLQGGPGKTSDISEPSPESSILSSRKENGRSNSLPIKKTVHFEADTYKDPFCSKNLSLCFEGSPRVAKESLRQDGHVLAVEVAEEKEQKQESSKIPESSSDKVAGDIFLVEGTNNNSQSSSCNGALESTARHDEESHSLSPPGENTVMADSFQIKVNLMTVEALEEGDYFEAIPLKASKFNSDLIDFASTSQAFNKVPSPHETKPDEDAEAFENHAEKLGKRSIKSAHKKKDSPEPQVKMDKHEPHQDSGEEAEGCPSAPEETPVDKKPEVHEKAKRKSTRPHYEEEGEDDDLQGVGEELSSSPPSSCVSLETLGSHSEEGLDFKPSPPLSKVSVIPHDLFYFPHYEVPLAAVLEAYVEDPEDLKNEEMDLEEPEGYMPDLDSREEEADGSQSSSSSSVPGESLPSASDQVLYLSRGGVGTTPASEPAPLAPHEDHQQRETKENDPMDSHQSQESPNLENIANPLEENVTKESISSKKKEKRKHVDHVESSLFVAPGSVQSSDDLEEDSSDYSIPSRTSHSDSSIYLRRHTHRSSESDHFSYVQLRNAADLDDRRNRILTRKANSSGEAMSLGSHSPQSDSLTQLVQQPDMMYFILFLWLLVYCLLLFPQLDVSRL

SEQ ID NO: 911441 - protein, 1028 aa, Homo sapiens
RARQPGSPRPPPAPRWPGLSRPRFMAAHEWDWFQREELIGQISDIRVQNLQVERENVQKRTFTRWINLHLEKCNPPLEVKDLFVDIQDGKILMALLEVLSGRNLLHEYKSSSHRIFRLNNIAKALKFLEDSNVKLVSIDAAEIADGNPSLVLGLIWNIILFFQIKELTGNLSRNSPSSSLSPGSGGTDSDSSFPPTPTAERSVAISVKDQRKAIKALLAWVQRKTRKYGVAVQDFAGSWRSGLAFLAVIKAIDPSLVDMKQALENSTRENLEKAFSIAQDALHIPRLLEPEDIMVDTPDEQSIMTYVAQFLERFPELEAEDIFDSDKEVPIESTFVRIKETPSEQESKVFVLTENGERTYTVNHETSHPPPSKVFVCDKPESMKEFRLDGVSSHALSDSSTEFMHQIIDQVLQGGPGKTSDISEPSPESSILSSRKENGRSNSLPIKKTVHFEADTYKDPFCSKNLSLCFEGSPRVAKESLRQDGHVLAVEVAEEKEQKQESSKIPESSSDKVAGDIFLVEGTNNNSQSSSCNGALESTARHDEESHSLSPPGENTVMADSFQIKVNLMTVEALEEGDYFEAIPLKASKFNSDLIDFASTSQAFNKVPSPHETKPDEDAEAFENHAEKLGKRSIKSAHKKKDSPEPQVKMDKHEPHQDSGEEAEGCPSAPEETPVDKKPEVHEKAKRKSTRPHYEEEGEDDDLQGVGEELSSSPPSSCVSLETLGSHSEEGLDFKPSPPLSKVSVIPHDLFYFPHYEVPLAAVLEAYVEDPEDLKNEEMDLEEPEGYMPDLDSREEEADGSQSSSSSSVPGESLPSASDQVLYLSRGGVGTTPASEPAPLAPHEDHQQRETKENDPMDSHQSQESPNLENIANPLEENVTKESISSKKKEKRKHVDHVESSLFVAPGSVQSSDDLEEDSSDYSIPSRTSHSDSSIYLRRHTHRSSESDHFSYVQLRNAADLDDRRNRILTRYSTQKLTELILQFYGIRADMKRESKHARMSMKVFLAVGELLAWPNVAELLETCPFKT

SEQ ID NO: 911442 - protein, 1405 aa, Homo sapiens
MSPLICYSLSLLFFFFWCGTFFNNFLRKRTWEVNMVVNILRFLHDLRCLYSALNRNVAEHRMQVENNTLPEPLPSVLVEISDAILIPVPLYVTSGFFIHPSWKHLRSLYSWCLNCHDGVVSRVLNLVLGLHGKFLKFSCDYLHSFFLDHLLFQCWTLPYTQADALIFFIFSIFRLCFCSAFRKNYSFLSSQSECFIEFLFSKLIKPLVIILSLFYSVLLLMRGCRFCLSVDVNDCGLRGSLFCSLCCPHFLWVLFILVVSVSIFHVVNFSQIYGDPMDLFMFLRVRHPKADWKLCVPTGELFHQGHQVGTWTHHWRTLPVSICTCFLWGSFCFLRDIPTTLLPGKRAYTGLLAYAEYSCGFKNGVPSGQKSPGALGLTGKGHLLPLPPDIPSSELGQCSRNNEKARFELLIALFSQVPLCNAQTVGPYPETLVYTQCARVLTAEQAASSPVSIYTFIKLLQPLLCLVSLSWSCSDFSMEYGAQWSSGCMGRTGDLRANKCPGLQPHVSPHPSYSNPQASPGGHRASLLTTLWPPLCRHVVLGSPSLLTFPSVPFLHKEVASSCLLFSSVFCVHGCINITFIPLLLFSWGFMREETGSCVQYTILIHKPHLSYLTGCLGGLLLCLVCERALSPAGTAATSILLSCGLLSDFVYCCAKCRRGIHSMAKLCLNAMISYYLPSFPLVLLPIVSEMILDLLPPQRYSLCGGLGSRFSLPPLLHLRNRKLARHSSGSHLKSQPFGRPRQEDRLRPGIQDQPAQHSKTPSLQKVKFKLVVAYTYSPSYSEDEAGELFEAHDFEVTVSYDPAILLHLSDRARRCLKNKETSSPHRCLPANKQRGFSVERGQHCLVEVCIFAIVDDQVVGASWSDLTFVGRCSPTKAQKQDTLAAPRAATQNMGVSISEVQHSSPHPLPMQCMPALYQDGTEEKAEALGAACVVDLCKSQTVRKPQELCKRSVPHLRDEKLKIRKRKRLVALLVDDLQIAIFIPSEVYYKTTASAAEANLPTHHRWGLRTPWSSSLQQKSELASTDVSYENVRIHHGCFGEELFSFRGHAIGRQLYDKNAFTCAPIFLTLQKDFRSLWSFETRPLSPFCLETPSWGSPLHSPPVFLCGALRPQVPEMGCVGASSQPGISGPSQPGNETAQSPVRPSCVISPSPHCIITADTAFGEDLTSWASSCHLEPSPHSRLFCPIQLMRGLPYDKVQDLGWVVEGWELEWALLCFCAENCYGSFPLTASVGEPNMRHKHPLELHRSCALLSSGISLENSSQQLMEVSPVHRLCMDFAQVPFPSCADTCIFGLHVSTCPLHSDFFFKRQHLTLSPRLEYSGVITAHCSLKLLGSGNPPASASRVAGSTGACHHAHLIFLSFIDTGLTVAQAGLELLASSDPPALAYQNAGIIGMNHCAWPSL

SEQ ID NO: 911443 - protein, 1539 aa, Homo sapiens
MIFKPDRQGPAGPYKSHEEWLGWNQLPAVLELGGGVASCPLKLWCTPPSECMSWNGHSLWSLVMGFLKRLSGQHSGSRPAQEVCERREASLAPLPPVFLSPRLPLLSPPCQDSGPWGVSALVPPPLALPFRKHVPGNPYKITNESGGDSVSILSSWTQRAEQLDQDHIADQGQTCSETQAPDALSRAVTPCRKLPLGTPMSCEKDKMTRIKMSTFKQNQNSYSPSSSSPIPSEIPLTAATACHLTYQRRSYSRNHVSFFASQGLAHFKQWVSSLQNSSMAKKNLHSTSESMTAKIWPLNQSDYSLSPLLKEFQPSNQKAAGSLEDSIWKAKSPMENELINELPGINEKLKGTDNKDYVIVYNSGHHAVLAYIRCSKSLGRANPNVNHFILWVQTLFRKTSARYFSHLLQLVILFKTSTGKMPESHLVQVGSQLIFCKGKEKSHLSIGFYGRSWIKKMDVEVCRTNHPIACKFFLNEKKYNKAFNKNQQSPKSRCLEVTTFNSLMFAFLHNVLTLYFLIKKHLLACCHSRGGFHSYHTVLWFSSIARSHHLVHFYEVLTLPGALKDCGLPSPAVCYGYMSFLLQMSPLICYSLSLLFFFFWCGTFFNNFLRKRTWEVNMVVNILRFLHDLRCLYSALNRNVAEHENDRWKIIPSPSPSQACWLRFLMPFYSRTFICDLGFFIHPSWKHLRSLYSCVLNCHDGVVSRVLNLVLGLHGKFLKFSCDYLHSFFLDHLLFQCWTLPYTQADALIFFIFSIFRLCFCSAFRKNYSFLSSQSECFIEFLFSKLIKPLVIILSLFYSVLLLMRGCRFCLSVDVNDCGLRGSLFCSLCCPHFLRVLFILVVSVSIFHVVNFSQIYGDPMDLFMFLRVRHPKADWKLCVPTGELFHQGHQVGTWTHHWRTLPVSICTCFLWGSFCFLRDIPTTLLPGKRAYTGLLAYAEYSCGFKNGVPSGQKSPGALGLTGKGHLLPLPPDIPSSELGQCSRNNEKARFELLIALFSQVPLCNAQTVGPYPETLVYTQCARVLTAEQAASSPVSIYTFIKLLQPLLCLVSLSWSCSDFSMEYGAQWSSGCMGRTGDLRANKCPGLQPHVSPHPSYSNPQASPGGHRASLLTTLWPPLCRHVVLGSPSLLTFPSVPFLHKEVASSCLLFSSVFCVHGCINITFIPLLLFSWGFMREETGSCVQYTILIHKPHLSYLTGCLGGLLLCLVCERALSPAGTAATSILLSCGLLSDFVECCAKCRRGIHSMAKLCLNAMISYYLPSFPLVLLPIVSEMILDLLPPQRYSLCGGLGSRFSLPPLLHLRNRKLARHSSGSHLKSQPFGRPRQEDRLRPGIQDQPAQHSKTPSLQKVKFKLVVAYTYSPSYSEDEAGELFEAHDFEVTVSYDPAILLHLSDRARRCLKNKETSSPHRCLPANKQRGFSVERGQHCLVEVCIIAIVDDQVVGASWSDLTFVGRCSPTKAQKQDTLAAPRAATQNMGVSISEVQHSSPHPLPMQCMPALYQDGTEGRQRHWGQPVLLISVSHRLFENLRNYVSVQCLI

SEQ ID NO: 911444 - protein, 1184 aa, Homo sapiens
MYQATLIKSQMSQEGTQGASCLAGPRETEQLDQDHIADQGQTCSETQAPDALSRAVTPCRKLPLGTPMSREKDKMTRIKMSTFKQNQNSYSPSSSSPIPSEIPLTAATACHLTYQRRSYSRNHVSFFASQGLAHFKQWVSSLQNSSMAKKNLHSTSESMTAKIWPLNQSDYSLSPLLKEFQPSNQKAAGSLEDSIWKAKSPMENELINELPGINEKLKGTDNKDYVIVYNSGHHAVLAYIRCSKSLGRANPNVNHFILWVQTLFRKTSARYFSHLLQLVILFKTSTGKMPESHLVQVGSQLIFCKGKEKSHLSIGFYGRSWIKKMDVEVCRTNHPIACKFFLNYKKYNKAFNKNQQSPKSRCLEVTTFNSLMFAFLHNVLTLYFLIKKHLLACCHSRGGFHSYHTVLWFSSIARSHHLVHFYEVLTLPGALKDCGLPSPAVCYGYMSFLLQMSPLICYSLSLLFFFFWCGTFFNNFLRKRTWEVNMVVNILRFLHDLRCLYSALNRNVAEHENDRWKIIPSPSPSQACWLRFLMPFCSRTFICDLGFFIHPSWKHLRSLYSCVLNCHDGVVSRVLNLVLGLHGKFLKFSCDYLHSFFLDHLLFQCWTLPYTQADALIFFIFSIFRLCFCSAFRKNYSFLSSQSECFIEFLFSKLIKPLVIILSLFYSVLLLMRGCRFCLSVDVNDCGLRGSLFCSLCCPHFLSVLFILVVSVSIFHVVNFSQIYGDPMDLFMFLRVRHPKADWKLCVPTGELFHQGHQVGTWTHHWRTLPVSICTCFLWGSFCFLRDIPTTLLPGKRAYTGLLAYAEYSCGFKNGVPSGQKSPSALGLTGKGHLLPLPPDIPSSELGQCSRNNEKARFELLIALFSQVPLCNAQTVGPYPETLVYTQCARVLTAEQAASSPVSIYTFIKLLQPLLCLVSLSWSCSDFSMEYGAQWSSGCMGRTGDLRANKCPGLQPHVSPHPSYSNPQASPGGHRASLLTTLWPPLCRHVVLGSPSLLTFPSVPFLHKEVASSCLLFSSVFCVHGCINITFIPLLLFSWGFMREETGSCVQYTILIHKPHLSYLTGCLGGLLLCLVCERALSPAGTAATSILLSCGLLSDFVECCAKCRRGIHSMAKLCLNAMISYYLPSFPLVLLPIVSEMILDLLPPQRYSLCGGLGSRFSLPPLLHLRNRKLARHSSGSHL

SEQ ID NO: 911445 - protein, 1323 aa, Homo sapiens
MSDSRTFICDLGFFIHPSWKHLRSLYSCVLNCHDGVVSRVLNLVLGLHGKFLKFSCDYLHSFFLDHLLFQCWTLPYTQADAANIFYLFYFSSMFLICFQEELFIFIFLNLNVLFEFLFSKLIKPLVIILSLFYSVLLLMRGCRFCLSVDVNDCGLRGSLFCSLCCPHFLWVLFILVVSVSIFHVVNFSQIYGDPMDLFMFLRVRHPKADWKLCVPTGELFHQGHQVGTWTHHWRTLPVSICTCFLWGSFCFLRDIPTTLLPGKRAYTGLLAYAEYSCGFKNGVPSGQKSPGALGLTGKGHLLPLPPDIPSSELGQCSRNNEKARFELLIALFSQVPLCNAQTVGPYPETLVYTQCARVLTAEQAASSPVSIYTFIKLLQPLLCLVSLSWSCSDFSMEYGAQWSSGCMGRTGDLRANKCPGLQPHVSPHPSYSNPQASPGGHRASLLTTLWPPLCRHVVLGSPSLLTFPSVPFLHKEVASSCLLFSSVFCVHGCINITFIPLLLFSWGFMREETGSCVQYTILIHKPHLSYLTGCLGGLLLCLVCERALSPAGTAATSILLSCGLLSDFVYCCAKCRRGIHSMAKLCLNAMISYYLPSFPLVLLPIVSEMILDLLPPQRYSLCGGLGSRFSLPPLLHLRNRKLARHSSGSHLKSQPFGRPRQEDRLRPGIQDQPAQHSKTPSLQKVKFKLVVAYTYSPSYSEDEAGELFEAHDFEVTVSYDPAILLHLSDRARRCLKNKETSSPHRCLPANKQRGFSVERGQHCLVEVCIFAIVDDQVVGASWSDLTFVGRCSPTKAQKQDTLAAPRAATQNMGVSISEVQHSSPHPLPMQCMPALYQDGTEEKAEALGAACVVDLCKSQTVRKPQELCKRSVPHLRDEKLKIRKRKRLVALLVDDLQIAIFIPSEVYYKTTASAAEANLPTHHRWGLRTPWSSSLQQKSELASTDVSYENVRIHHGCFGEELFSFRGHAIGRQLYDKNAFTCAPIFLTLQKDFRSLWSFETRPLSPFCLETPSWGSPLHSPPVFLCGALRPQVPEMGCVGASSQPGISGPSQPGNETAQSPVRPSCVISPSPHCIITADTAFGEDLTSWASSCHLEPSPHSRLFCPIQLMRGLPYDKVQDLGWVVEGWELEWALLCFCAENCYGSFPLTASVGEPNMRHKHPLELHRSCALLSSGISLENSSQQLMEVSPVHRLCMDFAQVPFPSCADTCIFGLHVSTCPLHSDFFFKRQHLTLSPRLEYSGVITAHCSLKLLGSGNPPASASRVAGSTGACHHAHLIFLSFIDTGLTVAQAGLELLASSDPPALAYQNAGIIGMNHCAWPSL

SEQ ID NO: 911446 - protein, 886 aa, Homo sapiens
MASPTLSPDSSSQEALSAPTCSPTSDSENLSPDELELLAKLEEQNRLLEADSKSMRSMNGSRRNSGSSLVSSSSASSNLSHLEEDTWILWGRIANEWEEWRRRKEKLLKELIRKGIPHHFRAIVWQLLCSATDMPVKNQYSELLKMSSPCEKLIRRDIARTYPEHEFFKGQDSLGQEVLFNVMKAYSLVDREVGYCQGSAFIVGLLLMQMPEEEAFCVFVRLMQEYRLRELFKPSMAELGLCIYQFEYMLQEQLPDLNTHFRSQSFHTSMYASSWFLTLFLTTFPLPVATRVFDIFMYEGLEIVFRVGLALLQVNQAELMQLDMEGMSQYFQRVIPHQFDSCPDKLVLKAYQVKYNPKKMKRLEKEYAAMKSKEMEEQIEIKRLRTENRLLKQRIETLEKGQVTRAQEAEENYVIKRELAVVRQQCSSAAEDLQKAQSTIRQLQEQQENPRLTEDFVSHLETELEQSRLRETETLGALREMQDKVLDMEKRNSSLPDENNVAQLQEELKALKVREGQAVASTRELKLQLQELSDTWQAHLARGGRWKESPRKLVVGELQDELMSVRLREAQALAEGRELRQRVVELETQDHIHRNLLNRVEAERAALQEKLQYLAAQNKGLQTQLSESRRKQAEAECKSKEEVMAVRLREADSMAAVAEMRQRIAELEIQREEGRIQGQLNHSDSSQYIRELKDQIEELKAEVRLLKGPPPFEDPLAFDGLSLARHLDEDSLPSSDEELLGVGVGAALQDALYPLSPRDARFFRRLERPAKDSEGSSDSDADELAAPYSQGLDTEAMPSAPGVRRPQPRGAPGQSAFCSPPAALDKLRALCGSATPKARPGEAAQRVGSDLGSSGPRGRLSLPSSVYPSWSVPLRALWRSRGAWRG

SEQ ID NO: 911447 - protein, 741 aa, Homo sapiens
MASPTLSPDSSSQEALSAPTCSPTSDSENLSPDELELLAKLEEQNRLLEADSKSMRSMNGSRRNSGSSLVSSSSASSNLSHLEEDTWILWGRIANEWEEWRRRKEKLLKELIRKGIPHHFRAIVWQLLCSATDMPVKNQYSELLKMSSPCEKLIRRDIARTYPEHEFFKGQDSLGQEVLFNVMKAYSLVDREVGYCQGSAFIVGLLLMQMPEEEAFCVFVRLMQEYRLRELFKPSMAELGLCIYQFEYMLQEQLPDLNTHFRSQSFHTSMYASSWFLTLFLTTFPLPVATRVFDIFMYEGLEIVFRVGLALLQVNQAELMQLDMEGMSQYFQRVIPHQFDSCPDKLVLKAYQVKYNPKKMKRLEKEYAAMKSKEMEEQIEIKRLRTENRLLKQRIETLEKESAALADRLIQGQVTRAQEAEENYVIKRELAVVRQQCSSAAEDLQKAQSTIRQLQEQQENPRLTEDFVSHLETELEQSRLRETETLGALREMQDKVLDMEKRNSSLPDENNVAQLQEELKALKVREGQAVASTRELKLQLQELSDTWQDQIEELKAEVRLLKGPPPFEDPLAFDGLSLARHLDEDSLPSSDEELLGVGVGAALQDALYPLSPRDARFFRRLERPAKDSEGSSDSDADELAAPYSQGLDNEAMPSAPGVRRPQPRGAPGQSAFCSPPAALDKLRALCGSATPKARPGEAAQRVGSDLGSSGPRGRLSLPSSVYPSWSVPLRALWRSRGAWRG

SEQ ID NO: 911448 - protein, 151 aa, Homo sapiens
MASPTLSPDSSSQEALSAPTCSPTSDSENLSPDELELLAKLEEQNRLLEADSKSMRSMNVRLLKGPPPFEDPLAFDGLSLARHLDEDSLPSSDEELLGVGVGAALQDALYPLSPRDARFFRRLERPAKDSEGSSDSDADELAAPYSQGLDN

SEQ ID NO: 911449 - protein, 338 aa, Homo sapiens [sequence omitted]

SEQ ID NO: 911450 - protein, 139 aa, Homo sapiens
YTHFIAEELQPGSTGESAPRGPCQGGRPPPSEPPKAELRRKRGWGRLSCRKGHAAALLPQALTPLFPQRNSSLPDENNVAQLQEELKALKVREGQAVASTRELKLQLQELSDTWQVRAGWAPAGRAPPRAIPSGFLGGG

SEQ ID NO: 911451 - protein, 730 aa, Homo sapiens
MASPTLSPDSSSQEALSAPTCSPTSDSENLSPDELELLAKLEEQNRLLEADSKSMRSMNGSRRNSGSSLVSSSSASSNLSHLEEDTWILWGRIANEWEEWRRRKEKLLKELIRKGIPHHFRAIVWQLLCSATDMPVKNQYSELLKMSSPCEKLIRRDIARTYPEHEFFKGQDSLGQEVLFNVMKAYSLVDREVGYCQGSAFIVGLLLMQMPEEEAFCVFVRLMQEYRLRELFKPSMAELGLCIYQFEYMLQEQLPDLNTHFRSQSFHTSMYASSWFLTLFLTTFPLPVATRVFDIFMYEGLEIVFRVGLALLQVNQAELMQLDMEGMSQYFQRVIPHQFDSCPDKLVLKAYQVKYNPKKMKRLEKEYAAMKSKEMEEQIEIKRLRTENRLLKQRIETLEKGQVTRAQEAEENYVIKRELAVVRQQCSSAAEDLQKAQSTIRQLQEQQENPRLTEDFVSHLETELEQSRLRETETLGALREMQDKVLDMEKRNSSLPDENNVAQLQEELKALKVREGQAVASTRELKLQLQELSDTWQDQIEELKAEVRLLKGPPPFEDPLAFDGLSLARHLDEDSLPSSDEELLGVGVGAALQDALYPLSPRDARFFRRLERPAKDSEGSSDSDADELAAPYSQGLDNEAMPSAPGVRRPQPRGAPGQSAFCSPPAALDKLRALCGSATPKARPGEAAQRVGSDLGSSGPRGRLSLPSSVYPSWSVPLRALWRSRGAWRG

SEQ ID NO: 911452 - protein, 886 aa, Homo sapiens; identical to SEQ ID NO: 911446

SEQ ID NO: 911453 - protein, 509 aa, Homo sapiens
MASPTLSPDSSSQEALSAPTCSPTSDSENLSPDELELLAKLEEQNRLLEADSKSMRSMNGSRRNSGSSLVSSSSASSNLSHLEEDTWILWGRIANEWEEWRRRKEKLLKELIRKGIPHHFRAIVWQLLCSATDMPVKNQYSELLKMSSPCEKLIRRDIARTYPEHEFFKGQDSLGQEVLFNVMKAYSLVDREVGYCQGSAFIVGLLLMQMPEEEAFCVFVRLMQEYRLRELFKPSMAELGLCIYQFEYMLQEQLPDLNTHFRSQSFHTSMYASSWFLTLFLTTFPLPVATRVFDIFMYEGLEIVFRVGLALLQVNQAELMQLDMEGMSQYFQRVIPHQFDSCPDKLVLKAYQVKYNPKKMKRLEKEYAAMKSKEMEEQIEIKRLRTENRLLKQRIETLEKGQVTRAQEAEENYVIKRELAVVRQQCSSAAEDLQKAQSTIRQLQEQQENPRLTEDFVSHLETELEQSRLRETETLGALREMQDKVLDMEKRNSSLPDENNVAQLQEDLQ

SEQ ID NO: 911454 - protein, 482 aa, Homo sapiens
SWNRDHWSLSGRSSWNGSTATQPGVGLVGAKVQGDRGGRSLERRSASLPLAGLAPVAGAHPAAAADSSRARGSLRGRGSRTCAGDQRKVPARLGGQQGPGRGCGCRRGPHRATFLPGGCRWKMSQERPTFYRQELNKTIWEVPERYQNLSPVGSGAYGSVCAAFDTKTGLRVAVKKLSRPFQSIIHAKRTYRELRLLKHMKHENVIGLLDVFTPARSLEEFNDVYLVTHLMGADLNNIVKCQKLTDDHVQFLIYQILRGLKYIHSADIIHRDLKPSNLAVNEDCELKILDFGLARHTDDEMTGYVATRWYRAPEIMLNWMHYNQTVDIWSVGCIMAELLTGRTLFPGTDHINQLQQIMRLTGTPPAYLINRMPSHEARNYIQSLTQMPKMNFANVFIGANPLAVDLLEKMLVLDSDKRITAAQALAHAYFAQYHDPDDEPVADPYDQSFESRDLLIDEWKSLTYDEVISFVPPPLDQEEMES

SEQ ID NO: 911455 - protein, 419 aa, Homo sapiens
SWNRDHWSLSGRSSWNGSTATQPGVGLVGAKVQGDRGGRSLERRSASLPLAGLAPVAGAHPAAAADSSRARGSLRGRGSRTCAGDQRKVPARLGGQQGPGRGCGCRRGPHRATFLPGGCRWKMSQERPTFYRQELNKTIWEVPERYQNLSPVGSGAYGSVCAAFDTKTGLRVAVKKLSRPFQSIIHAKRTYRELRLLKHMKHENVIGLLDVFTPARSLEEFNDVYLVTHLMGADLNNIVKCQKLTDDHVQFLIYQILRGLKYIHSADIIHRDLKPSNLAVNEDCELKILDFGLARHTDDEMTGYVATRWYRAPEIMLNWMHYNQTVDIWSVGCIMAELLTGRTLFPGTDHIDQLKLILRLVGTPGAELLKKISSESARNYIQSLTQMPKMNFANVFIGANPLGKLTIYPHLMDIELVMI

SEQ ID NO: 911456 - protein, 482 aa, Homo sapiens
SWNRDHWSLSGRSSWNGSTATQPGVGLVGAKVQGDRGGRSLERRSASLPLAGLAPVAGAHPAAAADSSRARGSLRGRGSRTCAGDQRKVPARLGGQQGPGRGCGCRRGPHRATFLPGGCRWKMSQERPTFYRQELNKTIWEVPERYQNLSPVGSGAYGSVCAAFDTKTGLRVAVKKLSRPFQSIIHAKRTYRELRLLKHMKHENVIGLLDVFTPARSLEEFNDVYLVTHLMGADLNNIVKCQKLTDDHVQFLIYQILRGLKYIHSADIIHRDLKPSNLAVNEDCELKILDFGLARHTDDEMTGYVATRWYRAPEIMLNWMHYNQTVDIWSVGCIMAELLTGRTLFPGTDHIDQLKLILRLVGTPGAELLKKISSESARNYIQSLTQMPKMNFANVFIGANPLAVDLLEKMLVLDSDKRITAAQALAHAYFAQYHDPDDEPVADPYDQSFESRDLLIDEWKSLTYDEVISFVPPPLDQEEMES

SEQ ID NO: 911457 - protein, 482 aa, Homo sapiens; identical to SEQ ID NO: 911456

SEQ ID NO: 911458 - protein, 482 aa, Homo sapiens; identical to SEQ ID NO: 911456

SEQ ID NO: 911459 - protein, 482 aa, Homo sapiens; identical to SEQ ID NO: 911456

SEQ ID NO: 911460 - protein, 482 aa, Homo sapiens; identical to SEQ ID NO: 911456

SEQ ID NO: 911461 - protein, 482 aa, Homo sapiens; identical to SEQ ID NO: 911456

SEQ ID NO: 911462 - protein, 360 aa, Homo sapiens
MSQERPTFYRQELNKTIWEVPERYQNLSPVGSGAYGSVCAAFDTKTGLRVAVKKLSRPFQSIIHAKRTYRELRLLKHMKHENVIGLLDVFTPARSLEEFNDVYLVTHLMGADLNNIVKCQKLTDDHVQFLIYQILRGLKYIHSADIIHRDLKPSNLAVNEDCELKILDFGLARHTDDEMTGYVATRWYRAPEIMLNWMHYNQTVDIWSVGCIMAELLTGRTLFPGTDHIDQLKLILRLVGTPGAELLKKISSESARNYIQSLTQMPKMNFANVFIGANPLAVDLLEKMLVLDSDKRITAAQALAHAYFAQYHDPDDEPVADPYDQSFESRDLLIDEWKSLTYDEVISFVPPPLDQEEMES

SEQ ID NO: 911463 - protein, 482 aa, Homo sapiens; identical to SEQ ID NO: 911456

SEQ ID NO: 911464 - protein, 482 aa, Homo sapiens; identical to SEQ ID NO: 911456

SEQ ID NO: 911465 - protein, 111 aa, Homo sapiens
DCSELAAVRPQVHSSRGWASSRLMIQALTLALGAPKDNNIPCCEPWGLTAQNLLLSCCGWMEGWMDGWMAVDGRGCAVPCIPKPGGSVLLSMTACSRNICVPICVDKNIYT

SEQ ID NO: 911466 - protein, 580 aa, Homo sapiens
MEVPQPEPAPGSALSPAGVCGGAQRPGHLPGLLLGSHGLLGSPVRAAASSPVTTLTQTMHDLAGLGSETPKSQVGTLLFRSRSRLTHLSLSRRASESSLSSESSESSDAGLCMDSPSPMDPHMAEQTFEQAIQAASRIIRNEQFAIRRFQSMPVRLLGHSPVLRNITNSQAPDGRRKSEAGSGAASSSGEDKENDGFVFKMPWKPTHPSSTHALAEWASRREAFAQRPSSAPDLMCLSPDRKMEVEELSPLALGRFSLTPAEGDTEEDDGFVDILESDLKDDDAVPPGMESLISAPLVKTLEKEEEKDLVMYSKCQRLFRSPSMPCSVIRPILKRLERPQDRDTPVQNKRRRSVTPPEEQQEAEEPKARVLRSKSLCHDEIENLLDSDHRELIGDYSKAFLLQTVDGKHQDLKYISPETMVALLTGKFSNIVDKFVIVDCRYPYEYEGGHIKTAVNLPLERDAESFLLKSPIAPCSLDKRVILIFHCEFSSERGPRMCRFIRERDRAVNDYPSLYYPEMYILKGGYKEFFPQHPNFCEPQDYRPMNHEAFKDELKTFRLKTRSWAGERSRRELCSRLQDQ

SEQ ID NO: 911467 - protein, 601 aa, Homo sapiens
MEVPQPEPAPGSALSPAGVCGGAQRPGHLPGLLLGSHGLLGSPVRAAASSPVTTLTQTMHDLAGLGSRSRLTHLSLSRRASESSLSSESSESSDAGLCMDSPSPMDPHMAEQTFEQAIQAASRIIRNEQFAIRRFQSMPVRLLGHSPVLRNITNSQAPDGRRKSEAGSGAASSSGEDKENVRFWKAGVGALREEEGACWGGSLACEDPPLPSWLQDGFVFKMPWKPTHPSSTHALAEWASRREAFAQRPSSAPDLMCLSPDRKMEVEELSPLALGRFSLTPAEGDTEEDDGFVDILESDLKDDDAVPPGMESLISAPLVKTLEKEEEKDLVMYSKCQRLFRSPSMPCSVIRPILKRLERPQDRDTPVQNKRRRSVTPPEEQQEAEEPKARVLRSKSLCHDEIENLLDSDHRELIGDYSKAFLLQTVDGKHQDLKYISPETMVALLTGKFSNIVDKFVIVDCRYPYEYEGGHIKTAVNLPLERDAESFLLKSPIAPCSLDKRVILIFHCEFSSERGPRMCRFIRERDRAVNDYPSLYYPEMYILKGGYKEFFPQHPNFCEPQDYRPMNHEAFKDELKTFRLKTRSWAGERSRRELCSRLQDQ

SEQ ID NO: 911468 - protein, 468 aa, Homo sapiens
MDSPSPMDPHMAEQTFEQAIQAASRIIRNEQFAIRRFQSMPVRLLGHSPVLRNITNSQAPDGRRKSEAGSGAASSSGEDKENDGFVFKMPWKPTHPSSTHALAEWASRREAFAQRPSSAPDLMCLSPDRKMEVEELSPLALGRFSLTPAEGDTEEDDGFVDILESDLKDDDAVPPGMESLISAPLVKTLEKEEEKDLVMYSKCQRLFRSPSMPCSVIRPILKRLERPQDRDTPVQNKRRRSVTPPEEQQEAEEPKARVLRSKSLCHDEIENLLDSDHRELIGDYSKAFLLQTVDGKHQDLKYISPETMVALLTGKFSNIVDKFVIVDCRYPYEYEGGHIKTAVNLPLERDAESFLLKSPIAPCSLDKRVILIFHCEFSSERGPRMCRFIRERDRAVNDYPSLYYPEMYILKGGYKEFFPQHPNFCEPQDYRPMNHEAFKDELKTFRLKTRSWAGERSRRELCSRLQDQ

SEQ ID NO: 911469 - protein, 516 aa, Homo sapiens
MHSETPKSQVGTLLFRSRSRLTHLSLSRRASESSLSSESSESSDAGLCMDSPSPMDPHMAEQTFEQAIQAASRIIRNEQFAIRRFQSMPVRLLGHSPVLRNITNSQAPDGRRKSEAGSGAASSSGEDKENDGFVFKMPWKPTHPSSTHALAEWASRREAFAQRPSSAPDLMCLSPDRKMEVEELSPLALGRFSLTPAEGDTEEDDGFVDILESDLKDDDAVPPGMESLISAPLVKTLEKEEEKDLVMYSKCQRLFRSPSMPCSVIRPILKRLERPQDRDTPVQNKRRRSVTPPEEQQEAEEPKARVLRSKSLCHDEIENLLDSDHRELIGDYSKAFLLQTVDGKHQDLKYISPETMVALLTGKFSNIVDKFVIVDCRYPYEYEGGHIKTAVNLPLERDAESFLLKSPIAPCSLDKRVILIFHCEFSSERGPRMCRFIRERDRAVNDYPSLYYPEMYILKGGYKEFFPQHPNFCEPQDYRPMNHEAFKDELKTFRLKTRSWAGERSRRELCSRLQDQ

SEQ ID NO: 911470 - protein, 553 aa, Homo sapiens
MEVPQPEPAPGSALSPAGVCGGAQRPGHLPGLLLGSHGLLGSPVRAAASSPVTTLTQTMHDLAGLGSETPKSQVGTLLFRSRSRLTHLSLSRRASESSLSSESSESSDAGLCMDSPSPMDPHMAEQTFEQAIQAASRIIRNEQFAIRRFQSMPVRLLGHSPVLRNITNSQAPDGRRKSEAGSGAASSSGEDKENDGFVFKMPWKPTHPSSTHALAEWASRREAFAQRPSSAPDLMCLSPDRKMEVEELSPLALGRFSLTPAEGDTEEDDGFVDILESDLKDLVMYSKCQRLFRSPSMPCSVIRPILKRLERPQDRDTPVQNKRRRSVTPPEEQQEAEEPKARVLRSKSLCHDEIENLLDSDHRELIGDYSKAFLLQTVDGKHQDLKYISPETMVALLTGKFSNIVDKFVIVDCRYPYEYEGGHIKTAVNLPLERDAESFLLKSPIAPCSLDKRVILIFHCEFSSERGPRMCRFIRERDRAVNDYPSLYYPEMYILKGGYKEFFPQHPNFCEPQDYRPMNHEAFKDELKTFRLKTRSWAGERSRRELCSRLQDQ

SEQ ID NO: 911471 - protein, 363 aa, Homo sapiens
IAHASADAWGPSSGPDLMCLSPDRKMEVEELSPLALGRFSLTPAEGDTEEDDGFVDILESDLKDDDAVPPGMESLISAPLVKTLEKEEEKDLVMYSKCQRLFRSPSMPCSVIRPILKRLERPQDRDTPVQNKRRRSVTPPEEQQEAEEPKARVLRSKSLCHDEIENLLDSDHRELIGDYSKAFLLQTVDGKHQDLKYISPETMVALLTGKFSNIVDKFVIVDCRYPYEYEGGHIKTAVNLPLERDAESFLLKSPIAPCSLDKRVILIFHCEFSSERGPRMCRFIRERDRAVNDYPSLYYPEMYILKGGYKEFFPQHPNFCEPQDYRPMNHEAFKDELKTFRLKTRSWAGERSRRELCSRLQDQ

SEQ ID NO: 911472 - protein, 601 aa, Homo sapiens
MEVPQPEPAPGSALSPAGVCGGAQRPGHLPGLLLGSHGLLGSPVRAAASSPVTTLTQTMHDLAGLGSETPKSQVGTLLFRSRSRLTHLSLSRRASESSLSSESSESSDAGLCMDSPSPMDPHMAEQTFEQAIQAASRIIRNEQFAIRRFQSMPVRLLGHSPVLRNITNSQAPDGRRKSEAGSGAASSSGEDKENDGFVFKMPWKPTHPSSTHALAEWASRREAFAQRPSSAPDLMCLSPDRKMEVEELSPLALGRFSLTPAEGDTEEDDGFVDILESDLKDDDAVPPGMESLISAPLVKTLEKEEEKDLVMYSKCQRLFRSPSMPCSVIRPILKRLERPQDRDTPVQNKRRRSVTPPEEQQEAEEPKARVLRSKSLCHDEIENLLDSDHRELIGDYSKAFLLQTVDGKHQDLKYISPETMVALLTGKFSNIVDKFVIVDCRYPYEYEGGHIKTAVNLPLERDAESFLLKAGTSTAVNLPLERDAESFLLKSPIAPCSLDKRVILIFHCEFSSERGPRMCRFIRERDRAVNDYPSLYYPEMYILKGGYKEFFPQHPNFCEPQDYRPMNHEAFKDELKTFRLKTRSWAGERSRRELCSRLQDQ

SEQ ID NO: 911473 - protein, 580 aa, Homo sapiens; identical to SEQ ID NO: 911466

SEQ ID NO: 911474 - protein, 580 aa, Homo sapiens; identical to SEQ ID NO: 911466

SEQ ID NO: 911475 - protein, 580 aa, Homo sapiens; identical to SEQ ID NO: 911466

SEQ ID NO: 911476 - protein, 580 aa, Homo sapiens; identical to SEQ ID NO: 911466

SEQ ID NO: 911477 - protein, 580 aa, Homo sapiens; identical to SEQ ID NO: 911466

SEQ ID NO: 911478 - protein, 289 aa, Homo sapiens
MEVPQPEPAPGSALSPAGVCGGAQRPGHLPGLLLGSHGLLGSPVRAAASSPVTTLTQTMHDLAGLGSETPKSQVGTLLFRSRSRLTHLSLSRRASESSLSSESSESSDAGLCMDSPSPMDPHMAEQTFEQAIQAASRIIRNEQFAIRRFQSMPVRLLGHSPVLRNITNSQAPDGRRKSEAGSGAASSSGEDKENDGFVFKMPWKPTHPSSTHALAEWASRREAFAQRPSSAPDLMCLSPDRKMEVEELSPLALGRFSLTPAEGDTEEDDGFVDILESDLKGLCVSLYRE

SEQ ID NO: 911479 - protein, 634 aa, Homo sapiens
ARGRQKKNKRNFPQSNNPPPHPSPAASLGPASCAGVCWLPCARPSSQPSAGPAAMEVPQPEPAPGSALSPAGVCGGAQRPGHLPGLLLGSHGLLGSPVRAAASSPVTTLTQTMHDLAGLGSETPKSQVGTLLFRSRSRLTHLSLSRRASESSLSSESSESSDAGLCMDSPSPMDPHMAEQTFEQAIQAASRIIRNEQFAIRRFQSMPVRLLGHSPVLRNITNSQAPDGRRKSEAGSGAASSSGEDKENDGFVFKMPWKPTHPSSTHALAEWASRREAFAQRPSSAPDLMCLSPDRKMEVEELSPLALGRFSLTPAEGDTEEDDGFVDILESDLKDDDAVPPGMESLISAPLVKTLEKEEEKDLVMYSKCQRLFRSPSMPCSVIRPILKRLERPQDRDTPVQNKRRRSVTPPEEQQEAEEPKARVLRSKSLCHDEIENLLDSDHRELIGDYSKAFLLQTVDGKHQDLKYISPETMVALLTGKFSNIVDKFVIVDCRYPYEYEGGHIKTAVNLPLERDAESFLLKSPIAPCSLDKRVILIFHCEFSSERGPRMCRFIRERDRAVNDYPSLYYPEMYILKGGYKEFFPQHPNFCEPQDYRPMNHEAFKDELKTFRLKTRSWAGERSRRELCSRLQDQ

SEQ ID NO: 911480 - protein, 566 aa, Homo sapiens
MEVPQPEPAPGSALSPAGVCGGAQRPGHLPGLLLGSHGLLGSPVRAAASSPVTTLTQTMHDLAGLGSRSRLTHLSLSRRASESSLSSESSESSDAGLCMDSPSPMDPHMAEQTFEQAIQAASRIIRNEQFAIRRFQSMPVRLLGHSPVLRNITNSQAPDGRRKSEAGSGAASSSGEDKENDGFVFKMPWKPTHPSSTHALAEWASRREAFAQRPSSAPDLMCLSPDRKMEVEELSPLALGRFSLTPAEGDTEEDDGFVDILESDLKDDDAVPPGMESLISAPLVKTLEKEEEKDLVMYSKCQRLFRSPSMPCSVIRPILKRLERPQDRDTPVQNKRRRSVTPPEEQQEAEEPKARVLRSKSLCHDEIENLLDSDHRELIGDYSKAFLLQTVDGKHQDLKYISPETMVALLTGKFSNIVDKFVIVDCRYPYEYEGGHIKTAVNLPLERDAESFLLKSPIAPCSLDKRVILIFHCEFSSERGPRMCRFIRERDRAVNDYPSLYYPEMYILKGGYKEFFPQHPNFCEPQDYRPMNHEAFKDELKTFRLKTRSWAGERSRRELCSRLQDQ

SEQ ID NO: 911481 - protein, 539 aa, Homo sapiens
MEVPQPEPAPGSALSPAGVCGGAQRPGHLPGLLLGSHGLLGSPVRAAASSPVTTLTQTMHDLAGLGSETPKSQVGTLLFRSRSRLTHLSLSRRASESSLSSESSESSDAGLCMDSPSPMDPHMAEQTFEQAIQAASRIIRNEQFAIRRFQSMPDGFVFKMPWKPTHPSSTHALAEWASRREAFAQRPSSAPDLMCLSPDRKMEVEELSPLALGRFSLTPAEGDTEEDDGFVDILESDLKDDDAVPPGMESLISAPLVKTLEKEEEKDLVMYSKCQRLFRSPSMPCSVIRPILKRLERPQDRDTPVQNKRRRSVTPPEEQQEAEEPKARVLRSKSLCHDEIENLLDSDHRELIGDYSKAFLLQTVDGKHQDLKYISPETMVALLTGKFSNIVDKFVIVDCRYPYEYEGGHIKTAVNLPLERDAESFLLKSPIAPCSLDKRVILIFHCEFSSERGPRMCRFIRERDRAVNDYPSLYYPEMYILKGGYKEFFPQHPNFCEPQDYRPMNHEAFKDELKTFRLKTRSWAGERSRRELCSRLQDQ

SEQ ID NO: 911482 - protein, 468 aa, Homo sapiens; identical to SEQ ID NO: 911468

SEQ ID NO: 911483 - protein, 580 aa, Homo sapiens; identical to SEQ ID NO: 911466

SEQ ID NO: 911484 - protein, 606 aa, Homo sapiens
MEVPQPEPAPGSALSPAGVCGGAQRPGHLPGLLLGSHGLLGSPVRAAASSPVTTLTQTMHDLAGLGSETPKSQVGTLLFRSRSRLTHLSLSRRASESSLSSESSESSDAGLCMDSPSPMDPHMAEQTFEQAIQAASRIIRNEQFAIRRFQSMPVRLLGHSPVLRNITNSQAPDGRRKSEAGSGAASSSGEDKENDGFVFKMPWKPTHPSSTHALAEWASRREAFAQRPSSAPDLMCLSPDRKMEVEELSPLALGRFSLTPAEGDTEEDDGFVDILESDLKDDDAVPPGMESLISAPLVKTLEKEEEKDLVMYSKCQRLFRSPSMPCSVIRPILKRLERPQDRDTPVQNKRRRSVTPPEEQQEAEEPKARVLRSKSLCHDEIENLLDSDHRELIGDYSKVVPWVSDPRGASQLPWEPELNLKAKQAFLLQTVDGKHQDLKYISPETMVALLTGKFSNIVDKFVIVDCRYPYEYEGGHIKTAVNLPLERDAESFLLKSPIAPCSLDKRVILIFHCEFSSERGPRMCRFIRERDRAVNDYPSLYYPEMYILKGGYKEFFPQHPNFCEPQDYRPMNHEAFKDELKTFRLKTRSWAGERSRRELCSRLQDQ

SEQ ID NO: 911485 - protein, 580 aa, Homo sapiens; identical to SEQ ID NO: 911466

SEQ ID NO: 911486 - protein, 474 aa, Homo sapiens
ISSTTPSRNEQFAIRRFQSMAVRLLGHSPVLRNITNSQAPDGRRKSEAGSGAASSSGEDKENDGFVFKMPWKPTHPSSTHALAEWASRREAFAQRPSSAPDLMCLSPDRKMEVEELSPLALGRFSLTPAEGDTEEDDGFVDILESDLKDDDAVPPGMESLISAPLVKTLEKEEEKDLVMYSKCQRLFRSPSMPCSVIRPILKRLERPQDRDTPVQNKRRRSVTPPEEQQEAEEPKARVLRSKSLCHDEIENLLDSDHRELIGDYSKVVPWVSDPRGASQLPWEPELNLKAKQAFLLQTVDGKHQDLKYISPETMVALLTGKFSNIVDKFVIVDCRYPYEYEGGHIKTAVNLPLERDAESFLLKSPIAPCSLDKRVILIFHCEFSSERGPRMCRFIRERDRAVNDYPSLYYPEMYILKGGYKEFFPQHPNFCEPQDYRPMNHEAFKDELKTFRLKTRSWAGERSRRELCSRLQDQ

SEQ ID NO: 911487 - protein, 179 aa, Homo sapiens
QFTASGSVYSVRVSLQRQMVALLTGKFSNIVDKFVIVDCRYPYEYEGGHIKTAVNLPLERDAESFLLKSPIAPCSLDKRVILIFHCEFSSERGPRMCRFIRERDRAVNDYPSLYYPEMYILKGGYKEFFPQHPNFCEPQDYRPMNHEAFKDELKTFRLKTRSWAGERSRRELCSRLQDQ

SEQ ID NO: 911488 - protein, 580 aa, Homo sapiens; identical to SEQ ID NO: 911466

SEQ ID NO: 911489 - protein, 580 aa, Homo sapiens; identical to SEQ ID NO: 911466

SEQ ID NO: 911490 - protein, 253 aa, Homo sapiens
MEVPQPEPAPGSALSPAGVCGGAQRPGHLPGLLLGSHGLLGSPVRAAASSPVTTLTQTMHDLAGLGSETPKSQVGTLLFRSRSRLTHLSLSRRASESSLSSESSESSDAGLCMDSPSPMDPHMAEQTFEQAIQAASRIIRNEQFAIRRFQSMPVRLLGHSPVLRNITNSQAPDGRRKSEAGSGAASSSGEDKENDGFVFKMPWKPTHPSSTHALAEWASRREAFAQRPSSAPDLMFLSPDRKMDVEEDDLEVA

SEQ ID NO: 911491 - protein, 262 aa, Homo sapiens
MKTPFGKTPGQRSRADAGHAGVSANMMKKRTSHKKHRSSVGPSKPVSQPRRNIVGCRIQHGWKEGNGPVTQWKGTVLDQVPVNPSLYLIKYDGFDCVYGLELNKDERVSALEVLPDRVATSRISDAHLADTMIGKAVEHMFETEDGSKDEWRGMVLARAPVMNTWFYITYEKDPVLYMYQLLDDYKEGDLRIMPDSNDSPPAEREPGEVVDSLVGKQVEYAKEDGSKRTGMVIHQVEAKPSVYFIKFDDDFHIYVYDLVKTS

SEQ ID NO: 911492 - protein, 306 aa, Homo sapiens
RGRRSSAGAVRVRPDCWGAGGVRGEGAGAGRRRLAQAGAGGSANERRRNPWACGLQPRRSAGHAGVSANMMKKRTSHKKHRSSVGPSKPVSQPRRNIVGCRIQHGWKEGNGPVTQWKGTVLDQVPVNPSLYLIKYDGFDCVYGLELNKDERVSALEVLPDRVATSRISDAHLADTMIGKAVEHMFETEDGSKDEWRGMVLARAPVMNTWFYITYEKDPVLYMYQLLDDYKEGDLRIMPDSNDSPPAEREPGEVVDSLVGKQVEYAKEDGSKRTGMVIHQVEAKPSVYFIKFDDDFHIYVYDLVKTS

SEQ ID NO: 911493 - protein, 262 aa, Homo sapiens; identical to SEQ ID NO: 911491

SEQ ID NO: 911494 - protein, 262 aa, Homo sapiens; identical to SEQ ID NO: 911491

SEQ ID NO: 911495 - protein, 131 aa, Homo sapiens
MIGKAVEHMFETEDGSKDEWRGMVLARAPVMNTWFYITYEKDPVLYMYQLLDDYKEGDLRIMPDSNDSPPAEREPGEVVDSLVGKQVEYAKEDGSKRTGMVIHQVEAKPSVYFIKFDDDFHIYVYDLVKTS

SEQ ID NO: 911496 - protein, 262 aa, Homo sapiens; identical to SEQ ID NO: 911491

SEQ ID NO: 911497 - protein, 262 aa, Homo sapiens; identical to SEQ ID NO: 911491

SEQ ID NO: 911498 - protein, 262 aa, Homo sapiens; identical to SEQ ID NO: 911491

SEQ ID NO: 911499 - protein, 262 aa, Homo sapiens; identical to SEQ ID NO: 911491

SEQ ID NO: 911500 - protein, 262 aa, Homo sapiens; identical to SEQ ID NO: 911491

SEQ ID NO: 911501 - protein, 262 aa, Homo sapiens; identical to SEQ ID NO: 911491

SEQ ID NO: 911502 - protein, 262 aa, Homo sapiens; identical to SEQ ID NO: 911491

SEQ ID NO: 911503 - protein, 262 aa, Homo sapiens; identical to SEQ ID NO: 911491

SEQ ID NO: 911504 - protein, 262 aa, Homo sapiens; identical to SEQ ID NO: 911491

SEQ ID NO: 911505 - protein, 262 aa, Homo sapiens; identical to SEQ ID NO: 911491

SEQ ID NO: 911506 - protein, 262 aa, Homo sapiens; identical to SEQ ID NO: 911491

SEQ ID NO: 911507 - protein, 99 aa, Homo sapiens
RGRRSSAGAVRVRPDCWGAGGVRGEGAGAGRRRLAQAGAGGSANERRRNPWACGLQPRRSAAMRSYCVAQAALELLDSSDLPTLVFQSVGITGSLSRQC

SEQ ID NO: 911508 - protein, 263 aa, Homo sapiens
MISPVLILFSSFLCHVAIAGRTCPKPDDLPFSTVVPLKTFYEPGEEITYSCKPGYVSRGGMRKFICPLTGLWPINTLKCTPRVCPFAGNLRKMGAVRYYGLFEYPNTISFSCNTGFYLNGADSAKCTEEGKWSPELPVCAPIICPPPSIPTFATLRVYKPSAGNNSLYRDTAVFECLPQHAMFGNDTITCTTHGNWTKLPECREVKCPFPSRPDNGFVNYPAKPTLYYKDKATFGCHDGYSLDGPEEIECTQTGKLVLPMPKL

SEQ ID NO: 911509 - protein, 263 aa, Homo sapiens; identical to SEQ ID NO: 911508

SEQ ID NO: 911510 - protein, 263 aa, Homo sapiens; identical to SEQ ID NO: 911508

SEQ ID NO: 911511 - protein, 283 aa, Homo sapiens
KQWYQRTVPITAGCQCDSSTMISPVLILFSSFLCHVAIAGRTCPKPDDLPFSTVVPLKTFYEPGEEITYSCKPGYVSRGGMRKFICPLTGLWPINTLKCTPRVCPFAGNLRKMGAVRYYGLFEYPNTISFSCNTGFYLNGADSAKCTEEGKWSPELPVCAPIICPPPSIPTFATLRVYKPSAGNNSLYRDTAVFECLPQHAMFGNDTITCTTHGNWTKLPECREVKCPFPSRPDNGFVNYPAKPTLYYKDKATFGCHDGYSLDGPEEIECTQTGKLVLPMPKL

SEQ ID NO: 911512 - protein, 263 aa, Homo sapiens; identical to SEQ ID NO: 911508

SEQ ID NO: 911513 - protein, 263 aa, Homo sapiens; identical to SEQ ID NO: 911508

SEQ ID NO: 911514 - protein, 263 aa, Homo sapiens; identical to SEQ ID NO: 911508

SEQ ID NO: 911515 - protein, 263 aa, Homo sapiens; identical to SEQ ID NO: 911508

SEQ ID NO: 911516 - protein, 245 aa, Homo sapiens
MISPVLILFSSFLCHVAIAGRTCPKPDDLPFSTVVPLKTFYEPGEEITYSCKPGYVSRGGMRKFICPLTGLWPINTLKCTPRVCPFAGNLRKMGAVRYYGLFEYPNTISFSCNTGFYLNGADSAKCTEEGIPTFATLRVYKPSAGNNSLYRDTAVFECLPQHAMFGNDTITCTTHGNWTKLPECREVKCPFPSRPDNGFVNYPAKPTLYYKDKATFGCHDGYSLDGPEEIECTQTGKLVLPMPKL

SEQ ID NO: 911517 - protein, 211 aa, Homo sapiens
MISPVLILFSSFLCHVAIAGRTCPKPDDLPFSTVVPLKTFYEPGEEITYSCKPGYVSRGGMRKFICPLTGLWPINTLKCTPRVCPFAGNLRKMGAVRYYGLFEYPNTISFSCNTGFYLNGADSAKCTEEGKWSPELPVCAPIICPPPSIPTFATLRVYKPSAGNNSLYRDTAVFECLPQHAMFGNDTITCTTHGNWTKLPECRETNTLLQG

SEQ ID NO: 911518 - protein, 188 aa, Homo sapiens
MISPVLILFSSFLCHVAIAGRTCPKPDDLPFSTVVPLKTFYEPGEEITYSCKPGYVSRGGMRKFICPLTGLWPINTLKCTPRVCPFAGNLRKMGAVRYYGLFEYPNTISFSCNTGFYLNGADSAKCTEEGIPTFATLRVYKPSAGNNSLYRDTAVFECLPQHAMFGNDTITCTTHGNWTKLPECRVSP

SEQ ID NO: 911519 - protein, 263 aa, Homo sapiens; identical to SEQ ID NO: 911508

SEQ ID NO: 911520 - protein, 263 aa, Homo sapiens; identical to SEQ ID NO: 911508

SEQ ID NO: 911521 - protein, 263 aa, Homo sapiens; identical to SEQ ID NO: 911508

SEQ ID NO: 911522 - protein, 263 aa, Homo sapiens; identical to SEQ ID NO: 911508

SEQ ID NO: 911523 - protein, 263 aa, Homo sapiens; identical to SEQ ID NO: 911508

SEQ ID NO: 911524 - protein, 266 aa, Homo sapiens
MISPVLILFSSFLCHVAIAGRTCPKPDDLPFSTVVPLKTFYEPGEEITYSCKPGYVSRGGMRKFICPLTGLWPINTLKCTPRVCPFAGNLRKMGAVRYYGLFEYPNTISFSCNTGFYLNGADSAKCTEEGKWSPELPVCAPIICPPPSIPTFATLRVYKPSAGNNSLYRDTAVFECLPQHAMFGNDTITCTTHGNWTKLPECREVKCPFPSRPDNGFVNYPAFSGWPGRNRMYPNWETGPAHAQVVKHLVKYPVKKAHCGVPKERE

SEQ ID NO: 911525 - protein, 203 aa, Homo sapiens
MRKFICPLTGLWPINTLKCTPRVCPFAGNLRKMGAVRYYGLFEYPNTISFSCNTGFYLNGADSAKCTEEGKWSPELPVCAPIICPPPSIPTFATLRVYKPSAGNNSLYRDTAVFECLPQHAMFGNDTITCTTHGNWTKLPECREVKCPFPSRPDNGFVNYPAKPTLYYKDKATFGCHDGYSLDGPEEIECTQTGKLVLPMPKL

SEQ ID NO: 911526 - protein, 174 aa, Homo sapiens
MISPVLILFSSFLCHVAIAGRTCPKPDDLPFSTVVPLKTFYEPGEEITYSCKPGYVSRGGMRKFICPLTGLWPINTLKCTPRVCPFAGNLRKMGAVRYYGLFEYPNTISFSCNTGFYLNGADSAKCTEEGKWSPELPVCAPIICPPPSIPTFATLRVYKPSAGNNSHQDQTMDL

SEQ ID NO: 911527 - protein, 104 aa, Homo sapiens
MISPVLILFSSFLCHVAIAGRTCPKPDDLPFSTVVPLKTFYEPGEEITYSCKPGYVSRGGMRKFICPLTGLWPINTLKCTPRVCPFAGILSCNTVFYLNGAGPF

SEQ ID NO: 911528 - protein, 159 aa, Homo sapiens
MPLMWLPAAGWPFVYLSEPVPPTLKLGQWRYSENCPFGDDPPTVGLPLITLPDRTLPFLDLGDSPDSSTPKLSRAQRPQSCTSVGRVTVHSTPVRRSSGPAPQSLLSARRVSALPTPASRRCSGLPPMTPKTMPRAVGSPLCVPARRRSSEPRKNSAMR

SEQ ID NO: 911529 - protein, 113 aa, Homo sapiens [sequence omitted]

SEQ ID NO: 911530 - protein, 739 aa, Homo sapiens
MEGGGGRDEPSACRAGDVNMDDPKKEDILLLADEKFDFDLSLSSSSANEDDEVFFGPFGHKERCIAASLELNNPVPEQPPLPTSESPFAWSPLAGEKFVEVYKEAHLLALHIESSSRNQAAQAAKPEDPRSQGVERFIQESKLKINLFEKEKEMKKSPTSLKRETYYLSDSPLLGPPVGEPRLLASSPALPSSGAQARLTRAPGPPHSAHALPRESCTAHAASQAATQRKPGTKLLLPRAASVRGRSIPGAAEKPKKEIPASPSRTKIPAEKESHRDVLPDKPAPGAVNVPAAGSHLGQGKRAIPVPNKLGLKKTLLKAPGSTSNLARKSSSGPVWSGASSACTSPAVGKAKSSEFASIPANSSRPLSNISKSGRMGPAMLRPALPAGPVGASSWQAKRVDVSELAAEQLTAPPSASPTQPQTPEGGGQWLNSSCAWSESSQLNKTRSIRRRDSCLNSKTKVMPTPTNQFKIPKFSIGDSPDSSTPKLSRAQRPQSCTSVGRVTVHSTPVRRSSGPAPQSLLSARRVSALPTPASRRCSGLPPMTPKTMPRAVGSPLCVPARRRSSEPRKNSAMRTEPTRESNRKTDSRLVDVSPDRGSPPSRVPQALNFSPEESDSTFSKSTATEVAREEAKPGGDAAPSEALLVDIKLEPLAVTPDAASQPLIDLPLIDFCDTPEAHVAVGSESRPLIDLMTNTPDMNKNVAKPSPVVGQLIDLSSPLIQLSPEADKENVDSPLLKF

SEQ ID NO: 911531 - protein, 739 aa, Homo sapiens; identical to SEQ ID NO: 911530

SEQ ID NO: 911532 - protein, 586 aa, Homo sapiens
MKKSPTSLKRETYYLSDSPLLGPPVGEPRLLASSPALPSSGAQARLTRAPGPPHSAHALPRESCTAHAASQAATQRKPGTKLLLPRAASVRGRSIPGAAEKPKKEIPASPSRTKIPAEKESHRDVLPDKPAPGAVNVPAAGSHLGQGKRAIPVPNKLGLKKTLLKAPGSTSNLARKSSSGPVWSGASSACTSPAVGKAKSSEFASIPANSSRPLSNISKSGRMGPAMLRPALPAGPVGASSWQAKRVDVSELAAEQLTAPPSASPTQPQTPEGGGQWLNSSCAWSESSQLNKTRSIRRRDSCLNSKTKVMPTPTNQFKIPKFSIGDSPDSSTPKLSRAQRPQSCTSVGRVTVHSTPVRRSSGPAPQSLLSARRVSALPTPASRRCSGLPPMTPKTMPRAVGSPLCVPARRRSSEPRKNSAMRTEPTRESNRKTDSRLVDVSPDRGSPPSRVPQALNFSPEESDSTFSKSTATEVAREEAKPGGDAAPSEALLVDIKLEPLAVTPDAASQPLIDLPLIDFCDTPEAHVAVGSESRPLIDLMTNTPDMNKNVAKPSPVVGQLIDLSSPLIQLSPEADKENVDSPLLKF

SEQ ID NO: 911533 - protein, 721 aa, Homo sapiens
MTVDFFPLDILLLADEKFDFDLSLSSSSANEDDEVFFGPFGHKERCIAASLELNNPVPEQPPLPTSESPFAWSPLAGEKFVEVYKEAHLLALHIESSSRNQAAQAAKPEDPRSQGVERFIQESKLKINLFEKEKEMKKSPTSLKRETYYLSDSPLLGPPVGEPRLLASSPALPSSGAQARLTRAPGPPHSAHALPRESCTAHAASQAATQRKPGTKLLLPRAASVRGRSIPGAAEKPKKEIPASPSRTKIPAEKESHRDVLPDKPAPGAVNVPAAGSHLGQGKRAIPVPNKLGLKKTLLKAPGSTSNLARKSSSGPVWSGASSACTSPAVGKAKSSEFASIPANSSRPLSNISKSGRMGPAMLRPALPAGPVGASSWQAKRVDVSELAAEQLTAPPSASPTQPQTPEGGGQWLNSSCAWSESSQLNKTRSIRRRDSCLNSKTKVMPTPTNQFKIPKFSIGDSPDSSTPKLSRAQRPQSCTSVGRVTVHSTPVRRSSGPAPQSLLSARRVSALPTPASRRCSGLPPMTPKTMPRAVGSPLCVPARRRSSEPRKNSAMRTEPTRESNRKTDSRLVDVSPDRGSPPSRVPQALNFSPEESDSTFSKSTATEVAREEAKPGGDAAPSEALLVDIKLEPLAVTPDAASQPLIDLPLIDFCDTPEAHVAVGSESRPLIDLMTNTPDMNKNVAKPSPVVGQLIDLSSPLIQLSPEADKENVDSPLLKF

SEQ ID NO: 911534 - protein, 640 aa, Homo sapiens
MEGGGGRDEPSACRAGDVNMDDPKKEDILLLADEKFDFDLSLSSSSANEDDEVFFGPFGHKERCIAASLELNNPVPEQPPLPTSESPFAWSPLAGEKFVEVYKEAHLLALHIESSSRNQAAQAAKPEDPRSQGVERFIQESKLKINLFEKEKEMKKSPTSLKRETYYLSDSPLLGPPVGEPRLLASSPALPSSGAQARLTRAPGPPHSAHALPRESCTAHAASQAATQRKPGTKLLLPRAASVRGRSIPGAAEKPKKEIPASPSRTKIPAEKESHRDVLPDKPAPGAVNVPAAGSHLGQGKRAIPVPNKLGLKKTLLKAPGSTSNLARKSSSGPVWSGASSACTSPAVGKAKSSEFASIPANSSRPLSNISKSGRMGPAMLRPALPAGPVGASSWQAKRVDVSELAAEQLTAPPSASPTQPQTPEGGGQWLNSSCAWSESSQLNKTRSIRRRDSCLNSKTKVMPTPTNQFKIPKFSIGDSPDSSTPKLSRAQRPQSCTSVGRVTVHSTPVRRSSGPAPQSLLSARRVSALPTPASRRCSGLPPMTPKTMPRAVGSPLCVPARRRSSEPRKNSAMRTEPTRESNRKTDSRLVDVSPDRGSPPSRVPQALNFSPEESDSTFSKSTSSHRLLRYPRSTRGCRI

SEQ ID NO: 911535 - protein, 657 aa, Homo sapiens
NAYRLGTRPGVESAEGERGVKEAHLLALHIESSSRNQAAQAAKPEDPRSQGVERFIQESKLKINLFEKEKEMKKSPTSLKRETYYLSDSPLLGPPVGEPRLLASSPALPSSGAQARLTRAPGPPHSAHALPRESCTAHAASQAATQRKPGTKLLLPRAASVRGRSIPGAAEKPKKEIPASPSRTKIPAEKESHRDVLPDKPAPGAVNVPAAGSHLGQGKRAIPVPNKLGLKKTLLKAPGSTSNLARKSSSGPVWSGASSACTSPAVGKAKSSEFASIPANSSRPLSNISKSGRMGPAMLRPALPAGPVGASSWQAKRVDVSELAAEQLTAPPSASPTQPQTPEGGGQWLNSSCAWSESSQLNKTRSIRRRDSCLNSKTKVMPTPTNQFKIPKFSIGDSPDSSTPKLSRAQRPQSCTSVGRVTVHSTPVRRSSGPAPQSLLSARRVSALPTPASRRCSGLPPMTPKTMPRAVGSPLCVPARRRSSEPRKNSAMRTEPTRESNRKTDSRLVDVSPDRGSPPSRVPQALNFSPEESDSTFSKSTATEVAREEAKPGGDAAPSEALLVDIKLEPLAVTPDAASQPLIDLPLIDFCDTPEAHVAVGSESRPLIDLMTNTPDMNKNVAKPSPVVGQLIDLSSPLIQLSPEADKENVDSPLLKF

SEQ ID NO: 911536 - protein, 276 aa, Homo sapiens
MTPSRPCELRSLLPGDSPDSSTPKLSRAQRPQSCTSVGRVTVHSTPVRRSSGPAPQSLLSARRVSALPTPASRRCSGLPPMTPKTMPRAVGSPLCVPARRRSSEPRKNSAMRTEPTRESNRKTDSRLVDVSPDRGSPPSRVPQALNFSPEESDSTFSKSTATEVAREEAKPGGDAAPSEALLVDIKLEPLAVTPDAASQPLIDLPLIDFCDTPEAHVAVGSESRPLIDLMTNTPDMNKNVAKPSPVVGQLIDLSSPLIQLSPEADKENVDSPLLKF

SEQ ID NO: 911537 - protein, 451 aa, Homo sapiens
MEGGGGRDEPSACRAGDVNMDDPKKEDILLLADEKFDFDLSLSSSSANEDDEVFFGPFGHKERCIAASLELNNPVPEQPPLPTSESPFAWSPLAGEKFVEVYKEAHLLALHIESSSRNQAAQAAKPEDPRSQGVERFIQESKLKINLFEKEKEMKKSPTSLKRETYYLSDSPLLGPPVGEPRLLASSPALPSSGAQARLTRAPGPPHSAHALPRESCTAHAASQAATQRKPGTKLLLPRAASVRGRSIPGAAEKPKKEIPASPSRTKIPAEKESHRDVLPDKPAPGAVNVPAAGSHLGQGKRAIPVPNKLGLKKTLLKAPGSTSNLARKSSSGPVWSGASSACTSPAVGKAKSSEFASIPANSSRPLSNISKSGRMGPAMLRPALPAGPVGASSWQAKRVDVSELAAEQLTAPPSASPTQPQTPEGGGHTDHPRPLLPAATLLAAILWAGM

SEQ ID NO: 911538 - protein, 575 aa, Homo sapiens
MEGGGGRDEPSACRAGDVNMDDPKKEDILLLADEKFDFDLSLSSSSANEDDEVFFGPFGHKERCIAASLELNNPVPEQPPLPTSESPFAWSPLAGEKFVEVYKEAHLLALHIESSSRNQAAQAAKPEDPRSQGVERFIQESKLKINLFEKEKEMKKSPTSLKRETYYLSDSPLLGPPVGEPRLLASSPALPSSGAQARLTRAPGPPHSAHALPRESCTAHAASQAATQRKPGTKLLLPRAASVRGRSIPGAAEKPKKEIPASPSRTKIPAEKESHRDVLPDKPAPGAVNVPAAGSHLGQGKRAIPVPNKLGLKKTLLKAPGSTSNLARKSSSGPVWSGASSACTSPAVGKAKSSEFASIPANSSRPLSNISKSGRMGPAMLRPALPAGPVGASSWQAKRVDVSELAAEQLTAPPSASPTQPQTPEGGGQWLNSSCAWSESSQLNKTRSIRRRDSCLNSKTKVMPTPTNQFKIPKFSIGDSPDSSTPKLSRAQRPQSCTSVGRVTVHSTPVRRSSGPAPQSLLSARRVSALPTPASRRCSGLPPMTPKTMPRAVGSPLCVPARRRSSEPRKNSAMR

SEQ ID NO: 911539 - protein, 406 aa, Homo sapiens
MEGGGGRDEPSACRAGDVNMDDPKKEDILLLADEKFDFDLSLSSSSANEDDEVFFGPFGHKERCIAASLELNNPVPEQPPLPTSESPFAWSPLAGEKFVEVYKEAHLLALHIESSSRNQAAQAAKPEDPRSQGVERFIQESKLKINLFEKEKEMKKSPTSLKRETYYLSDSPLLGPPVGEPRLLASSPALPSSGAQARLTRAPGPPHSAHALPRESCTAHAASQAATQRKPGTKLLLPRAASVRGRSIPGAAEKPKKEIPASPSRTKIPAEKESHRDVLPDKPAPGAVNVPAAGSHLGQGKRAIPVPNKLGLKKTLLKAPGSTSNLARKSSSGPVWSGASSACTSPAVGKAKSSEFASIPANSSRPLSNISKSGRMGPAMLRPALPAGPVGASSWQAKRVRIFSIE

SEQ ID NO: 911540 - protein, 739 aa, Homo sapiens; identical to SEQ ID NO: 911530

SEQ ID NO: 911541 - protein, 739 aa, Homo sapiens; identical to SEQ ID NO: 911530

SEQ ID NO: 911542 - protein, 739 aa, Homo sapiens; identical to SEQ ID NO: 911530

SEQ ID NO: 911543 - protein, 658 aa, Homo sapiens
MEGGGGRDEPSACRAGDVNMDDPKKEDILLLADEKFDFDLSLSSSSANEDDEVFFGPFGHKERCIAASLELNNPVPEQPPLPTSESPFAWSPLAGEKFVEVYKEAHLLALHIESSSRNQAAQAAKPEDPRSQGVERFIQESKLKINLFEKEKEMKKSPTSLKRETYYLSDSPLLGPPVGEPRLLASSPALPSSGAQARLTRAPGPPHSAHALPRESCTAHAASQAATQRKPGTKLLLPRAASVRGRSIPGAAEKPKKEIPASPSRTKIPAEKESHRDVLPDKPAPGAVNVPAAGSHLGQGKRAIPVPNKLGLKKTLLKAPGSTSNLARKSSSGPVWSGASSACTSPAVGKAKSSEFASIPANSSRPLSNISKSGRMGPAMLRPALPAGPVGASSWQAKRVDVSELAAEQLTAPPSASPTQPQTPEGGGQWLNSSCAWSESSQLNKTRSIRRRDSCLNSKTKVMPTPTNQFKIPKFSIGDSPDSSTPKLSRAQRPQSCTSVGRVTVHSTPVRRSSGPAPQSLLSARRVSALPTPASRRCSGLPPMTPKTMPRAVGSPLCVPARRRSSEPRKNSAMRTEPTRESNRKTDSRLVDVSPDRGSPPSRVPQALNFSPEESDSTFSKSTATEVAREEAKPGGDAAPSEVGGLLEPRSSGPAWEI

SEQ ID NO: 911544 - protein, 578 aa, Homo sapiens
MEGGGGRDEPSACRAGDVNMDDPKKEDILLLADEKFDFDLSLSSSSANEDDEVFFGPFGHKERCIAASLELNNPVPEQPPLPTSESPFAWSPLAGEKFVEVYKEAHLLALHIESSSRNQAAQAAKPEDPRSQGVERFIQESKLKINLFEKEKEMKKSPTSLKRETYYLSDSPLLGPPVGEPRLLASSPALPSSGAQARLTRAPGPPHSAHALPRESCTAHAASQAATQRKPGTKLLLPRAASVRGRSIPGAAEKPKKEIPASPSRTKIPAEKESHRDVLPDKPAPGAVNVPAAGSHLGQGKRAIPVPNKLGLKKTLLKAPGSTSNLARKSSSGPVWSGASSACTSPAVGKAKSSEFASIPANSSRPLSNISKSGRMGPAMLRPALPAGPVGASSWQAKRVDVSELAAEQLTAPPSASPTQPQTPEGGGQWLNSSCAWSESSQLNKTRSIRRRDSCLNSKTKVMPTPTNQFKIPKFSIGDSPDSSTPKLSRAQRPQSCTSVGRVTVHSTPVRRSSGPAPQSLLSARRVSALPTPASRRCSGLPPMTPKTMPRAVGSPLCVPARRRSSEPRKNSAMRLFL

SEQ ID NO: 911545 - protein, 323 aa, Homo sapiens
MPLMWLPAAGWPFVYLSEPVPPTLKLGQWRYSENCPFGDDPPTVGLPLITLPDRTLPFLDLGDSPDSSTPKLSRAQRPQSCTSVGRVTVHSTPVRRSSGPAPQSLLSARRVSALPTPASRRCSGLPPMTPKTMPRAVGSPLCVPARRRSSEPRKNSAMRTEPTRESNRKTDSRLVDVSPDRGSPPSRVPQALNFSPEESDSTFSKSTATEVAREEAKPGGDAAPSEALLVDIKLEPLAVTPDAASQPLIDLPLIDFCDTPEAHVAVGSESRPLIDLMTNTPDMNKNVAKPSPVVGQLIDLSSPLIQLSPEADKENVDSPLLKF

SEQ ID NO: 911546 - protein, 652 aa, Homo sapiens
MEGGGGRDEPSACRAGDVNMDDPKKEDILLLADEKFDFDLSLSSSSANEDDEVFFGPFGHKERCIAASLELNNPVPEQPPLPTSESPFAWSPLAGEKFVEVYKEAHLLALHIESSSRNQAAQAAKPEDPRSQGVERFIQESKLKINLFEKEKEMKKSPTSLKRETYYLSDSPLLGPPVGEPRLLASSPALPSSGAQARLTRAPGPPHSAHALPRESCTAHAASQAATQRKPGTKLLLPRAASVRGRSIPGAAEKPKKEIPASPSRTKIPAEKESHRDVLPDKPAPGAVNVPAAGSHLGQGKRAIPVPNKLGLKKTLLKAPGSTSNLARKSSSGPVWSGASSACTSPAVGKAKSSEFASIPANSSRPLSNISKSGRMGPAMLRPALPAGPVGASSWQAKRVDVSELAAEQLTAPPSASPTQPQTPEGGGQWLNSSCAWSESSQLNKTRSIRRRDSCLNSKTKVMPTPTNQFKIPKFSIGDSPDSSTPKLSRAQRPQSCTSVGRVTVHSTPVRRSSGPAPQSLLSARRVSALPTPASRRCSGLPPMTPKTMPRAVGSPLCVPARRRSSEPRKNSAMRTEPTRESNRKTDSRLVDVSPDRGSPPSRVPQALNFSPEESDSTFSKSTATEVAREEAKPGGDAAPSEVGRTGAAGFC

SEQ ID NO: 911547 - protein, 451 aa, Homo sapiens; identical to SEQ ID NO: 911537

SEQ ID NO: 911548 - protein, 324 aa, Homo sapiens
MEGGGGRDEPSACRAGDVNMDDPKKEDILLLADEKFDFDLSLSSSSANEDDEVFFGPFGHKERCIAASLELNNPVPEQPPLPTSESPFAWSPLAGEKFVEVYKEAHLLALHIESSSRNQAAQAAKPEDPRSQGVERFIQESKLKINLFEKEKKKKKKKKRGRRARRGPRGKKSFLKPMRGGARGGHRGRKEGTRGAKSGFPRGENARGRGHRERAGEISPTQNKKRPRGGQPREGSGKKNPERGSSREGPIRGEHLYTKRRSPQSGEPPEDIQKYKAPRRGGGPTHQKQAARGTPRTSRPRRRDKQRRPQRRPPQRHHNDVTTS

SEQ ID NO: 911549 - protein, 359 aa, Homo sapiens
MSLQRLLQHSSNGNLADFCAGPAYSSYSTLTGSLTMDDNRRIQMLADTVATLPRGRKQLALTRSSSLSDFSWSQRKLVTVEKQDNETFGFEIQSYRPQNQNACSSEMFTLICKIQEDSPAHCAGLQAGDVLANINGVSTEGFTYKQVVDLIRSSGNLLTIETLNGTMILKRTELEAKLQVLKQTLKQKWVEYRSLQLQEHRLLHGDAANCPSLENMDLDELSLFGPLPGPGPALVDRNRLSSESSCKSWLSSMTMDSEDGYQTCVSEDSSRGAFSRQTSTDDECFIPKEGDDFLRRSSSRRNRSISNTSSGSMSPLWEGNLSSMFGTLPRKSRKGSVRKQLLKFIPGLHRAVEEEESRF

SEQ ID NO: 911550 - protein, 359 aa, Homo sapiens; identical to SEQ ID NO: 911549

SEQ ID NO: 911551 - protein, 324 aa, Homo sapiens
MDDNRRIQMLADTVATLPRGRKQLALTRSSSLSDFSWSQRKLVTVEKQDNETFGFEIQSYRPQNQNACSSEMFTLICKIQEDSPAHCAGLQAGDVLANINGVSTEGFTYKQVVDLIRSSGNLLTIETLNGTMILKRTELEAKLQVLKQTLKQKWVEYRSLQLQEHRLLHGDAANCPSLENMDLDELSLFGPLPGPGPALVDRNRLSSESSCKSWLSSMTMDSEDGYQTCVSEDSSRGAFSRQTSTDDECFIPKEGDDFLRRSSSRRNRSISNTSSGSMSPLWEGNLSSMFGTLPRKSRKGSVRKQLLKFIPGLHRAVEEEESRF

SEQ ID NO: 911552 - protein, 219 aa, Homo sapiens
MSLQRLLQHSSNGNLADFCAGPAYSSYSTLTGSLTMDDNRRIQMLADTVATLPRGRKQLALTRSSSLSDFSWSQRKLVTVEKQDNETFGFEIQSYRPQNQNACSSEMFTLICKIQEDSPAHCAGLQAGDVLANINGVSTEGFTYKQVVDLIRSSGNLLTIETLNGTMILKRTELEAKLQVLKQTLKQKWVEYRSLQLQEHRLLHGKCNFLFRNHTNITS

SEQ ID NO: 911553 - protein, 183 aa, Homo sapiens
MSLQRLLQHSSNGNLADFCAGPAYSSYSTLTGSLTMDDNRRIQMLADTVATLPRGRKQLALTRSSSLSDFSWSQRKLVTVEKQDNETFGFEIQSYRPQNQNACSSEMFTLICKIQEDSPAHCAGLQAGDVLANINGVSTEGFTYKQVVDLIRSSGNLLTIETLNGTMILKRTELEAKLQVLKE

SEQ ID NO: 911554 - protein, 359 aa, Homo sapiens; identical to SEQ ID NO: 911549

SEQ ID NO: 911555 - protein, 193 aa, Homo sapiens [sequence omitted]

SEQ ID NO: 911556 - protein, 211 aa, Homo sapiens
FTSIIGTVLVPKKVGGNVVLACFHSEILSHDIGAWVHYSHCRNRHGGLRTGLGSKSNECRSGRTYRVAIAMSVQGPSDMGIEATALVDRNRLSSESSCKSWLSSMTMDSEDGYQTCVSEDSSRGAFSRQTSTDDECFIPKEGDDFLRRSSSRRNRSISNTSSGSMSPLWEGNLSSMFGTLPRKSRKGSVRKQLLKFIPGLHRAVEEEESRF

SEQ ID NO: 911557 - protein, 576 aa, Homo sapiens
MAASETVRLRLQFDYPPPATPHCTAFWLLVDLNRCRVVTDLISLIRQRFGFSSGAFLGLYLEGGLLPPAESARLVRDNDCLRVKLEERGVAENSVVISNGDINLSLRKAKKRAFQLEEGEETEPDCKYSKKHWKSRENNNNNEKVLDLEPKAVTDQTVSKKNKRKNKATCGTVGDDNEEAKRKSPKKKEKCEYKKKAKNPKSPKVQAVKDWANQRCSSPKGSARNSLVKAKRKGSVSVCSKESPSSSSESESCDESISDGPSKVTLEARNSSEKLPTELSKEEPSTKNTTADKLAIKLGFSLTPSKGKTSGTTSSSSDSSAESDDQCLMSSSTPECAAGFLKTVGLFAGRGRPGPGLSSQTAGAAGWRRSGSNGGGQAPGASPSVSLPASLGRGWGREENLFSWKGAKGRGMRGRGRGRGHPVSCVVNRSTDNQRQQQLNDVVKNSSTIIQNPVETPKKDYSLLPLLAAAPQVGEKIAFKLLELTSSYSPDVSDYKEGRILSHNPETQQVDIEILSSLPALREPGKFDLVYHNENGAEVVEYAVTQESKITVFWKELIDPRLIIESPSNTSSTEPA

SEQ ID NO: 911558 - protein, 195 aa, Homo sapiens
GRCLRPARAATVPALRATRRRDRLAASSSSASPFQTKIEKMVDLTQVMDDEVFMAFASYATIILSKMMLMSTATAFYRLTRKVFANPEDCVAFGKGENAKKYLRTDDRVERVRRAHLNDLENIIPFLGIGLLYSLSGPDPSTAILHFRLFVGARIYHTIAYLTPLPQPNRALSFFVGYGVTLSMAYRLLKSKLYL

SEQ ID NO: 911559 - protein, 187 aa, Homo sapiens
GRCLRPARAATVPALRATRRRDRLAASSSSASPFQTKIEKMVDLTQVMDDEVFMAFASYATIILSKMMLMSTATAFYRLTRKVFANPEDCVAFGKGENAKKYLRTDDRVERVRRAQEILGPERQIQKNLHVNETGVEMRMAGNAWKQTCNCLMAWSSKSQRMECNGMISAHRNLCLPDSSDSPASAS

SEQ ID NO: 911560 - protein, 164 aa, Homo sapiens
GRCLRPARAATVPALRATRRRDRLAASSSSASPFQTKIEKMVDLTQVMDDEVFMAFASYATIILSKMMLMSTATAFYRLTRKVFANPEDCVAFGKGENAKKYLRTDDRVERVRRAQEILGPERQIQKNLHVNETGVEMRMAGNAWKQTCNCLMAWSSKSQSRLA

SEQ ID NO: 911561 - protein, 195 aa, Homo sapiens; identical to SEQ ID NO: 911558

SEQ ID NO: 911562 - protein, 195 aa, Homo sapiens; identical to SEQ ID NO: 911558

SEQ ID NO: 911563 - protein, 155 aa, Homo sapiens
MVDLTQVMDDEVFMAFASYATIILSKMMLMSTATAFYRLTRKVFANPEDCVAFGKGENAKKYLRTDDRVERVRRAHLNDLENIIPFLGIGLLYSLSGPDPSTAILHFRLFVGARIYHTIAYLTPLPQPNRALSFFVGYGVTLSMAYRLLKSKLYL

SEQ ID NO: 911564 - protein, 261 aa, Homo sapiens
SSSSSSIVLIILFFIFILQPQFLAFTGTTFAAFFPLAGVVSIAASSEVIFLIVIVILIIFVILIVLILWAGAAAAAFIAAGSISSSSSSSSSSSSSASPFQTKIEKMVDLTQVMDDEVFMAFASYATIILSKMMLMSTATAFYRLTRKVFANPEDCVAFGKGENAKKYLRTDDRVERVRRAHLNDLENIIPFLGIGLLYSLSGPDPSTAILHFRLFVGARIYHTIAYLTPLPQPNRALSFFVGYGVTLSMAYRLLKSKLYL

SEQ ID NO: 911565 - protein, 86 aa, Homo sapiens
GRCLRPARAATVPALRATRRRDRLAASSSSASPFQTKIEKMVDLTQVMDDEVFMAFASYATIILSKMMLMSTATAFYRLTRKSPPE

SEQ ID NO: 911566 - protein, 195 aa, Homo sapiens; identical to SEQ ID NO: 911558

SEQ ID NO: 911567 - protein, 146 aa, Homo sapiens
GRCLRPARAATVPALRATRRRDRLAASSSSASPFQTKIEKMVDLTQVMDDEVFMAFASYATIILSKMMLMSTATAFYRLTRKVFANPEDCVAFGKGENAKKYLRTDDRVERVRSHCKAVTISIFERQSQNGATNEVKSMLYRVQQL

SEQ ID NO: 911568 - protein, 149 aa, Homo sapiens
GRCLRPARAATVPALRATRRRDRLAASSSSASPFQTKIEKMVDLTQVMDDEVFMAFASYATIILSKMMLMSTATAFYRLTRKVFANPEDCVAFGKGENAKKYLRTDDRVERVRSLEWSRPLYSHPALQTICRSTDLPHHCIFDTPSPAK

SEQ ID NO: 911569 - protein, 86 aa, Homo sapiens; identical to SEQ ID NO: 911565

SEQ ID NO: 911570 - protein, 100 aa, Homo sapiens
GRCLRPARAATVPALRATRRRDRLAASSSSASPFQTKIEKMVDLTQVMDDEVFMAFASYATIILSKMMLMSTATAFYRLTRKGTGDLRPRKADSEEPTCK

SEQ ID NO: 911571 - protein, 146 aa, Homo sapiens; identical to SEQ ID NO: 911567

SEQ ID NO: 911572 - protein, 141 aa, Homo sapiens
GRCLRPARAATVPALRATRRRDRLAASSSSASPFQTKIEKMVDLTQVMDDEVFMAFASYATIILSKMMLMSTATAFYRLTRKVFANPEDCVAFGKGENAKKYLRTDDRVERVRRRSFVLVVQDGVQWHDLSSPQPLPPGFK

SEQ ID NO: 911573 - protein, 195 aa, Homo sapiens; identical to SEQ ID NO: 911558

SEQ ID NO: 911574 - protein, 155 aa, Homo sapiens; identical to SEQ ID NO: 911563

SEQ ID NO: 911575 - protein, 155 aa, Homo sapiens; identical to SEQ ID NO: 911563

SEQ ID NO: 911576 - protein, 169 aa, Homo sapiens [sequence omitted]

SEQ ID NO: 911577 - protein, 195 aa, Homo sapiens; identical to SEQ ID NO: 911558

SEQ ID NO: 911578 - protein, 195 aa, Homo sapiens; identical to SEQ ID NO: 911558

SEQ ID NO: 911579 - protein, 193 aa, Homo sapiens
SSSSSSIVLIILFFIFILQPQFLAFTGTTFAAFFPLAGVVSIAASSEVIFLIVIVILIIFVILIVLILWAGAAAAAFIAAGSISSSSSSSSSSSSSASPFQTKIEKMVDLTQVMDDEVFMAFASYATIILSKMMLMSTATAFYRLTRKVFANPEDCVAFGKGENAKKYLRTDDRVERVRRIKQTLSIYLASSI

SEQ ID NO: 911580 - protein, 509 aa, Homo sapiens
RPGLSFLLALLFFLGQAAGDLGDVGPPIPSPGFSSFPGVDSSSSFSSSSRSGSSSSRSLGSGGSVSQLFSNFTGSVDDRGTCQCSVSLPDTTFPVDRVERLEFTAHVLSQKFEKELSKVREYVQLISVYEKKLLNLTVRIDIMEKDTISYTELDFELIKVEVKEMEKLVIQLKESFGGSSEIVDQLEVEIRNMTLLVEKLETLDKNNVLAIRREIVALKTKLKECEASKDQNTPVVHPPPTPGSCGHGGVVNISKPSVVQLNWRGFSYLYGAWGRDYSPQHPNKGLYWVAPLNTDGRLLEYYRLYNTLDDLLLYINARELRITYGQGSGTAVYNNNMYVNMYNTGNIARVNLTTNTIAVTQTLPNAAYNNRFSYANVAWQDIDFAVDENGLWVIYSTEASTGNMVISKLNDTTLQVLNTWYTKQYKPSASNAFMVCGVLYATRTMNTRTEEIFYYYDTNTGKEGKLDIVMHKMQEKVQSINYNPFDQKLYVYNDGYLLNYDLSVLQKPQ

SEQ ID NO: 911581 - protein, 92 aa, Homo sapiens
TQRTTMTGELRASQPIARIMISYKDQEFSQEEAPAFSFLSLSTLLKVSRIFYLITSFQRQLRRLEPDLLTNSTPHQPPSTAYFKKINSFLWN

SEQ ID NO: 911582 - protein, 341 aa, Homo sapiens
PEPPGAVHTFPGHSLFSYMLAMGKSPLGTIRSPWALCRASGSSFSSSSRSGSSSSRSLGSGGSVSQLFSNFTGSVDDRGTCQCSVSLPDTTFPVDRVERLEFTAHVLSQKFEKELSKVREYVQLISVYEKKLLNLTVRIDIMEKDTISYTELDFELDQGSGTAVYNNNMYVNMYNTGNIARVNLTTNTIAVTQTLPNAAYNNRFSYANVAWQDIDFAVDENGLWVIYSTEASTGNMVISKLNDTTLQVLNTWYTKQYKPSASNAFMVCGVLYATRTMNTRTEEIFYYYDTNTGKEGKLDIVMHKMQEKVQSINYNPFDQKLYVYNDGYLLNYDLSVLQKPQ

SEQ ID NO: 911583 - protein, 275 aa, Homo sapiens
RPGLSFLLALLFFLGQAAGDLGDVGPPIPSPGFSSFPGVDSSSSFSSSSRSGSSSSRSLGSGGSVSQLFSNFTGSVDDRGTCQCSVSLPDTTFPVDRVERLEFTAHVLSQKFEKELSKVREYVQLISVYEKKLLNLTVRIDIMEKDTISYTELDFELIKVEVKEMEKLVIQLKESFGGSSEIVDQLEVEIRNMTLLVEKLETLDKNNVLAIRREIVALKTKLKECEASKDQNTPVVHPPPTPGSCGHGGVVNITSKQRTVLGGAIEYRWETVGVL

SEQ ID NO: 911584 - protein, 352 aa, Homo sapiens [sequence omitted]

SEQ ID NO: 911585 - protein, 352 aa, Homo sapiens [sequence omitted]

SEQ ID NO: 911586 - protein, 352 aa, Homo sapiens [sequence omitted]

SEQ ID NO: 911587 - protein, 335 aa, Homo sapiens
RRPTPAAPPPPPPPPPGLLFMWEYSTNYGQAPLSLLVSYTKSYLSMVGSCCTSASPTVCFLKERLQLKHLSLLTTLSNRVCSQYAAYGEKKSRLSNLIKLAQKVPTADLEDVLPLAEDITNILSKCCESASEDCMAKELPEHTVKLCDNLSTKNSKFEDCCQEKTAMDVFVCTYFMPAAQLPELPDVELPTNKDVCDPGNTKVMDKYTFELSRRTHLPEVFLSKVLEPTLKSLGECCDVEDSTTCFNAKGPLLKKELSSFIDKGQELCADYSENTFTEYKKKLAERLKAKLPDATPTELAKLVNKRSDFASNCCSINSPPLYCDSEIDAELKNIL

SEQ ID NO: 911588 - protein, 315 aa, Homo sapiens
MKSVRRSGKIQRNMLIISYTKSYLSMVGSCCTSASPTVCFLKERLQLKHLSLLTTLSNRVCSQYAAYGEKKSRLSNLIKLAQKVPTADLEDVLPLAEDITNILSKCCESASEDCMAKELPEHTVKLCDNLSTKNSKFEDCCQEKTAMDVFVCTYFMPAAQLPELPDVELPTNKDVCDPGNTKVMDKYTFELSRRTHLPEVFLSKVLEPTLKSLGECCDVEDSTTCFNAKGPLLKKELSSFIDKGQELCADYSENTFTEYKKKLAERLKAKLPDATPTELAKLVNKRSDFASNCCSINSPPLYCDSEIDAELKNIL

SEQ ID NO: 911589 - protein, 334 aa, Homo sapiens
MAALKHQPQEFPTYVEPTNDEICEAFRKDPKEYANQFMWEYSTNYGQAPLSLLVSYTKSYLSMVGSCCTSASPTVCFLKERLQLKHLSLLTTLSNRVCSQYAAYGEKKSRLSNLIKLAQKVPTADLEDVLPLAEDITNILSKCCESASEDCMAKELPEHTVKLCDNLSTKNSKFEDCCQEPELPDVELPTNKDVCDPGNTKVMDKYTFELSRRTHLPEVFLSKVLEPTLKSLGECCDVEDSTTCFNAKGPLLKKELSSFIDKGQELCADYSENTFTEYKKKLAERLKAKLPDATPTELAKLVNKRSDFASNCCSINSPPLYCDSEIDAELKNIL

SEQ ID NO: 911590 - protein, 317 aa, Homo sapiens
MAALKHQPQEFPTYVEPTNDEICEAFRKDPKEYANQFMWEYSTNYGQAPLSLLVSYTKSYLSMVGSCCTSASPTVCFLKERLQLKHLSLLTTLSNRVCSQYAAYGEKKSRLSNLIKLAQKVPTADLEDVLPLAEDITNILSKCCESASEDCMAKELPEHTVKLCDNLSTKNSKFEDCCQEKTAMDVFVCTYFMPAAQLPELPDVELPTNKDVCDPGNTKVMDKYTFELSRRTHLPEVFLSKVLEPTLKSLGECCDVEDSTTCFNAKGPLLKKELSSFIDKGQELCADYSENTFTEYKKKNWQSWLTSAQTLPPTAVP

SEQ ID NO: 911591 - protein, 303 aa, Homo sapiens
MAALKHQPQEFPTYVEPTNDEICEAFRKDPKEYANQFMWEYSTNYGQAPLSLLVSYTKSYLSMVGSCCTSASPTVCFLKERLQLKHLSLLTTLSNRVCSQYAAYGEKKSRLSNLIKLAQKVPTADLEDVLPLAEDITNILSKCCESASEDCMAKELPEHTVKLCDNLSTKNSKFEDCCQEKTAMDVFVCTYFMPAAQLPELPDVELPTNKDVCDPGNTKVMDKYTFELSRRTHLPEVFLSKVLEPTLKSLGECCDVEDSTTCFNAKGPLLKKELSSFIDKGQELCADYSENTFTEYKKKLMLN

SEQ ID NO: 911592 - protein, 228 aa, Homo sapiens
MAALKHQPQEFPTYVEPTNDEICEAFRKDPKEYANQFMWEYSTNYGQAPLSLLVSYTKSYLSMVGSCCTSASPTVCFLKERLQLKHLSLLTTLSNRVCSQYAAYGEKKSRLSNLIKLAQKVPTADLEDVLPLAEDITNILSKCCESASEDCMAKELPEHTVKLCDNLSTKNSKFEDCCQEKTAMDVFVCTYFMPAAQLPELPDVELPTNKDVCDPGNTKVMDKYTFEL

SEQ ID NO: 911593 - protein, 352 aa, Homo sapiens [sequence omitted]

SEQ ID NO: 911594 - protein, 352 aa, Homo sapiens [sequence omitted]

SEQ ID NO: 911595 - protein, 352 aa, Homo sapiens [sequence omitted]

SEQ ID NO: 911596 - protein, 335 aa, Homo sapiens
LYKFIIYNTYALPTTKLSLFMWEYSTNYGQAPLSLLVSYTKSYLSMVGSCCTSASPTVCFLKERLQLKHLSLLTTLSNRVCSQYAAYGEKKSRLSNLIKLAQKVPTADLEDVLPLAEDITNILSKCCESASEDCMAKELPEHTVKLCDNLSTKNSKFEDCCQEKTAMDVFVCTYFMPAAQLPELPDVELPTNKDVCDPGNTKVMDKYTFELSRRTHLPEVFLSKVLEPTLKSLGECCDVEDSTTCFNAKGPLLKKELSSFIDKGQELCADYSENTFTEYKKKLAERLKAKLPDATPTELAKLVNKRSDFASNCCSINSPPLYCDSEIDAELKNIL

SEQ ID NO: 911597 - protein, 352 aa, Homo sapiens [sequence omitted]

SEQ ID NO: 911598 - protein, 334 aa, Homo sapiens
MAALKHQPQEFPTYVEPTNDEICEAFRKDPKEYANQFMWEYSTNYGQAPLSLLVSYTKSYLSMVGSCCTSASPTVCFLKERLQLKHLSLLTTLSNRVCSQYAAYGEKKSRLSNLIKLAQKVPTADLEDVLPLAEDITNILSKCCESASEDCMAKELPEHTVKLCDNLSTKNSKFEDCCQEKTAMDVFVCTYFMPAAQLPELPDVELPTNKDVCDPGNTKVMDKYTFELSRRTHLPEVFLSKVLEPTLKGPLLKKELSSFIDKGQELCADYSENTFTEYKKKLAERLKAKLPDATPTELAKLVNKRSDFASNCCSINSPPLYCDSEIDAELKNIL

SEQ ID NO: 911599 - protein, 317 aa, Homo sapiens
MAALKHQPQEFPTYVEPTNDEICEAFRKDPKEYANQFMWEYSTNYGQAPLSLLVSYTKSYLSMVGSCCTSASPTVCFLKERLQLKHLSLLTTLSNRVCSQYAAYGEKKSRLSNLIKLAQKVPTADLEDVLPLAEDITNILSKCCESASEDCMAKELPEHTVKLCDNLSTKNSKFEDCCQEKTAMDVFVCTYFMPAAQLPELPDVELPTNKDVCDPGNTKVMDKYTFELSRRTHLPEVFLSKVLEPTLKSLGECCDVEDSTTCFNAKGPLLKKELSSFIDKGQELCADYSDFASNCCSINSPPLYCDSEIDAELKNIL

SEQ ID NO: 911600 - protein, 140 aa, Homo sapiens [sequence omitted]

SEQ ID NO: 911601 - protein, 140 aa, Homo sapiens [sequence omitted]

SEQ ID NO: 911602 - protein, 140 aa, Homo sapiens [sequence omitted]

SEQ ID NO: 911603 - protein, 140 aa, Homo sapiens [sequence omitted]

SEQ ID NO: 911604 - protein, 36 aa, Homo sapiens
MAEMNPAQMESCCVVTQAGVQWHDLGSLQPAPPGFK

SEQ ID NO: 911605 - protein, 402 aa, Homo sapiens
MAEMNPAQGHVVFEDVAIYFSQEEWGHLDEAQRLLYRDVMLENLALLSSLGCCHGAEDEEAPLEPGVSVGVSQVMAPKPCLSTQNTQPCETCSSLLKDILRLAEHDGTHPEQGLYTCPAHLHQHQKEQIREKLSRGDGGRPTFVKNHRVHMAGKTFLCSECGKAFSHKHKLSDHQKIHTGERTYKCSKCGILFMERSTLNRHQRTHTGERPYECNECGKAFLCKSHLVRHQTIHSGERPYECSECGKLFMWSSTLITHQRVHTGKRPYGCSECGKFFKCNSNLFRHYRIHTGKRSYGCSECGKFFMERSTLSRHQRVHTGERPYECNECGKFFSLKSVLIQHQRVHTGERPYECSECGKAFLTKSHLICHQTVHTAAKQCSECGKFFRYNSTLLRHQKVHTG

SEQ ID NO: 911606 - protein, 148 aa, Homo sapiens
MNIKGSPWKAGSLLLLLVSNLLLCQSVAPLPICPGGAARCQVTLRDLFDRAVVLSHYIHNLSSEMFSEFDKRYTHGRGFITKAINSCHTSSLATPEDKEQAQQMNQKDFLSLIVSILRSWNEPLYHLVTEVPWYARSPGGYPIQSCRD

SEQ ID NO: 911607 - protein, 108 aa, Homo sapiens
MSLCIIWSRKYRGMQEAPEAILSKAVEIEEQTKRLLEGMELIVSQVHPETKENEIYPVWSGLPSLQMADEESRLSAYYNLLHCLRRDSHKIDNYLKLLKCRIIHNNNC

SEQ ID NO: 911608 - protein, 152 aa, Homo sapiens
GINHLRVARVLIEAGSLLLLLVSNLLLCQSVAPLPICPGGAARCQVTLRDLFDRAVVLSHYIHNLSSEMFSEFDKRYTHGRGFITKAINSCHTSSLATPEDKEQAQQMNQKDFLSLIVSILRSWNEPLYHLVTEVPWYARSPGGYPIQSCRD

SEQ ID NO: 911609 - protein, 148 aa, Homo sapiens; identical to SEQ ID NO: 911606

SEQ ID NO: 911610 - protein, 148 aa, Homo sapiens; identical to SEQ ID NO: 911606

SEQ ID NO: 911611 - protein, 148 aa, Homo sapiens; identical to SEQ ID NO: 911606

SEQ ID NO: 911612 - protein, 148 aa, Homo sapiens; identical to SEQ ID NO: 911606

SEQ ID NO: 911613 - protein, 148 aa, Homo sapiens; identical to SEQ ID NO: 911606

SEQ ID NO: 911614 - protein, 148 aa, Homo sapiens; identical to SEQ ID NO: 911606

SEQ ID NO: 911615 - protein, 148 aa, Homo sapiens; identical to SEQ ID NO: 911606

SEQ ID NO: 911616 - protein, 148 aa, Homo sapiens; identical to SEQ ID NO: 911606

SEQ ID NO: 911617 - protein, 153 aa, Homo sapiens
MAGITNMNIRDSPWKGSLLLLLVSNLLLCQSVAPLPICPGGAARCQVTLRDLFDRAVVLSHYIHNLSSEMFSEFDKRYTHGRGFITKAINSCHTSSLATPEDKEQAQQMNQKDFLSLIVSILRSWNEPLYHLVTEVPWYARSPGGYPIQSCRD

SEQ ID NO: 911618 - protein, 108 aa, Homo sapiens; identical to SEQ ID NO: 911607

SEQ ID NO: 911619 - protein, 148 aa, Homo sapiens; identical to SEQ ID NO: 911606

SEQ ID NO: 911620 - protein, 148 aa, Homo sapiens; identical to SEQ ID NO: 911606

SEQ ID NO: 911621 - protein, 148 aa, Homo sapiens; identical to SEQ ID NO: 911606

SEQ ID NO: 911622 - protein, 148 aa, Homo sapiens; identical to SEQ ID NO: 911606

SEQ ID NO: 911623 - protein, 148 aa, Homo sapiens; identical to SEQ ID NO: 911606

SEQ ID NO: 911624 - protein, 148 aa, Homo sapiens; identical to SEQ ID NO: 911606

SEQ ID NO: 911625 - protein, 148 aa, Homo sapiens; identical to SEQ ID NO: 911606

SEQ ID NO: 911626 - protein, 108 aa, Homo sapiens; identical to SEQ ID NO: 911607

SEQ ID NO: 911627 - protein, 108 aa, Homo sapiens; identical to SEQ ID NO: 911607

SEQ ID NO: 911628 - protein, 108 aa, Homo sapiens
MNIKGSPWKAGSLLLLLVSNLLLCQSVAPLPICPGGAARCQVTLRDLFDRAVVLSHYIHNLSSEMFSEFDKRYTHGRGFITKAINSCHTSSLATPEDKEQAQQMNQTF

SEQ ID NO: 911629 - protein, 108 aa, Homo sapiens; identical to SEQ ID NO: 911607

SEQ ID NO: 911630 - protein, 108 aa, Homo sapiens; identical to SEQ ID NO: 911607

SEQ ID NO: 911631 - protein, 108 aa, Homo sapiens; identical to SEQ ID NO: 911607

SEQ ID NO: 911632 - protein, 148 aa, Homo sapiens; identical to SEQ ID NO: 911606

SEQ ID NO: 911633 - protein, 148 aa, Homo sapiens; identical to SEQ ID NO: 911606

SEQ ID NO: 911634 - protein, 148 aa, Homo sapiens; identical to SEQ ID NO: 911606

SEQ ID NO: 911635 - protein, 148 aa, Homo sapiens; identical to SEQ ID NO: 911606

SEQ ID NO: 911636 - protein, 148 aa, Homo sapiens; identical to SEQ ID NO: 911606

SEQ ID NO: 911637 - protein, 148 aa, Homo sapiens; identical to SEQ ID NO: 911606

SEQ ID NO: 911638 - protein, 148 aa, Homo sapiens; identical to SEQ ID NO: 911606

SEQ ID NO: 911639 - protein, 148 aa, Homo sapiens; identical to SEQ ID NO: 911606

SEQ ID NO: 911640 - protein, 148 aa, Homo sapiens; identical to SEQ ID NO: 911606

SEQ ID NO: 911641 - protein, 152 aa, Homo sapiens
MSLCIIWSRKYRGMQEAPEAILSKAVEIEEQTKRLLEGMELIVSQVHPETKENEIYPVWSGLPSLQMADEESRLSAYYNLLHCLRRDSHKIDNYLKLPSPEGEHPTTGSPTITNREAKKPGAPRTLNAGDKPLKGADHSHTGRATRMGGRGR

SEQ ID NO: 911642 - protein, 148 aa, Homo sapiens; identical to SEQ ID NO: 911606

SEQ ID NO: 911643 - protein, 148 aa, Homo sapiens; identical to SEQ ID NO: 911606

SEQ ID NO: 911644 - protein, 139 aa, Homo sapiens
MNIKGSPWKAGSLLLLLVSNLLLCQSVAPLPICPGGAARCQVTLRDLFDRAVVLSHYIHNDKRYTHGRGFITKAINSCHTSSLATPEDKEQAQQMNQKDFLSLIVSILRSWNEPLYHLVTEVPWYARSPGGYPIQSCRD

SEQ ID NO: 911645 - protein, 148 aa, Homo sapiens; identical to SEQ ID NO: 911606

SEQ ID NO: 911646 - protein, 79 aa, Homo sapiens
GSVRAVLLAGGVKMAARGVRFEDGAVFLAACSSGDTDEVRKLLARGADINTVNVDGLTALHQVTPFLVLEASSLLQMRL

SEQ ID NO: 911647 - protein, 170 aa, Homo sapiens
RERAGGTTGGRSKDGGARVSALCSGLKRSERGGSGNSSPNSNLVLVVLAAAAEAGAMAELEHLGGKRAESARMRRAEQLRRWRGSLTEQEPAERRGAGRQPLTRRGSPRVRFEDGAVFLAACSSGDTDEVRKLLARGADINTVNVDGLTALHQVTPFLVLEASSLLQMRL

SEQ ID NO: 911648 - protein, 224 aa, Homo sapiens
MDKNENEEADLDEQSSKRLSIRERRRPKERRRGTGINFWTKDEDETDGSEEVKETWHERLSRLESGGSNPTTSDSYGDRASARARREAREARLATLTSRVEEDSNRDYKKLYESALTENQKLKTKLQEAQLELADIKSKLEKVAQQKQEKTSDRSSVLEMEKRERRALERKMSEMEEEMKNLHQLKQIQTLKQMNEQLQAENRALTRVVARLSESIESSDTQEL

SEQ ID NO: 911649 - protein, 208 aa, Homo sapiens
MDKNENEEADLDEQSSKRLSIRERRRPKERRRGTGINFWTKDEDETDGSEEVKETWHERLSRLESGGSNPTTSDSYGDRASARARREAREARLATLTSRVEEDSNRDYKKLYESALTENQKLKTKLQEAQLELADIKSKLEKVAQQKQEKTSDRSSVLEMEKRERRALERKMSEMEEEMKVLTELKSDNQRLKDENGALIRVISKLSK

SEQ ID NO: 911650 - protein, 105 aa, Homo sapiens
GAGAPSGFDDAPSRWARSSIRNVHSIHQRSRKRLSQDAYRRNSVRFLQQRRRQARPGPQSPGSPLEEERQTQRSKPQPAVPPRPSADLILNRCSESTKRKLASAV

SEQ ID NO: 911651 - protein, 322 aa, Homo sapiens [sequence omitted]

SEQ ID NO: 911652 - protein, 442 aa, Homo sapiens
KARYEAGVKSADQSWGTPSSVTSPCWALRSASYPASTMYMFLVKWQDLSEKVVYRRFTEIYEFHKTLKEMFPIEAGAINPENRIIPHLPAPKWFDGQRAAENHQGTLTEYCSTLMSLPTKISRCPHLLDFFKVRPDDLKLPTDNQTKKPETYLMPKDGKSTATDITGPIILQTYRAIANYEKTSGSEMALSTGDVVEVVEKSESGWWFCQMKAKRGWIPASFLEPLDSPDETEDPEPNYAGEPYVAIKAYTAVEGDEVSLLEGEAVEVIHKLLDGWWVISKYLSPAVTWICYPPPLPRLWKDCWKGLSCTDQETEAQQRKDDVTGYFPSMYLQKSGQDVSQAQRQIKRGAPPRRSSIRNVHSIHQRSRKRLSQDAYRRNSVRFLQQRRRQARPGPQSPGSPLEEERQTQRSKPQPAVPPRPSADLILNRCSESTKRKLASAV

SEQ ID NO: 911653 - protein, 322 aa, Homo sapiens [sequence omitted]

SEQ ID NO: 911654 - protein, 473 aa, Homo sapiens
KARYEAGVKSADQSWGTPSSVTSPCWALRSASYPASTMYMFLVKWQDLSEKVVYRRFTEIYEFHRWDFAMLPRLVSNSWTQVILPPQLPKLLGLQKTLKEMFPIEAGAINPENRIIPHLPAPKWFDGQRAAENHQGTLTEYCSTLMSLPTKISRCPHLLDFFKVRPDDLKLPTDNQTKKPETYLMPKDGKSTATDITGPIILQTYRAIANYEKTSGSEMALSTGDVVEVVEKSESGWWFCQMKAKRGWIPASFLEPLDSPDETEDPEPNYAGEPYVAIKAYTAVEGDEVSLLEGEAVEVIHKLLDGWWVISKYLSPAVTWICYPPPLPRLWKDCWKGLSCTDQETEAQQRKDDVTGYFPSMYLQKSGQDVSQAQRQIKRGAPPRRSSIRNVHSIHQRSRKRLSQDAYRRNSVRFLQQRRRQARPGPQSPGSPLEEERQTQRSKPQPAVPPRPSADLILNRCSESTKRKLASAV

SEQ ID NO: 911655 - protein, 442 aa, Homo sapiens; identical to SEQ ID NO: 911652

SEQ ID NO: 911656 - protein, 113 aa, Homo sapiens [sequence omitted]

SEQ ID NO: 911657 - protein, 126 aa, Homo sapiens
KARYEAGVKSADQSWGTPSSVTSPCWALRSASYPASTMYMFLVKWQDLSEKVVYRRFTEIYEFHKTLKEMFPIEAGAINPENRIIPHLPAPKWFDGQRAAENHQGTLTEYCSTLMSLPTHKVGGIL

SEQ ID NO: 911658 - protein, 254 aa, Homo sapiens [sequence omitted]

SEQ ID NO: 911659 - protein, 403 aa, Homo sapiens
KARYEAGVKSADQSWGTPSSVTSPCWALRSASYPASTMYMFLVKWQDLSEKVVYRRFTEIYEFHKTLKEMFPIEAGAINPENRIIPHLPAPKWFDGQRAAENHQGTLTEYCSTLMSLPTKISRCPHLLDFFKVRPDDLKLPTDNQTKKPETYLMPKDGKSTATDITGPIILQTYRAIANYEKTSGSEMALSTGDVVEVVEKSESGWWFCQMKAKRGWIPASFLEPLDSPDETEDPEPNYAGEPYVAIKAYTAVEGDEVSLLEGEAVEVIHKLLDGWWVIRKDDVTGYFPSMYLQKSGQDVSQAQRQIKRGAPPRRSSIRNVHSIHQRSRKRLSQDAYRRNSVRFLQQRRRQARPGPQSPGSPLEEERQTQRSKPQPAVPPRPSADLILNRCSESTKRKLASAV

SEQ ID NO: 911660 - protein, 322 aa, Homo sapiens [sequence omitted]

SEQ ID NO: 911661 - protein, 320 aa, Homo sapiens
MFLVKWQDLSEKVVYRRFTEIYEFHKTLKEMFPIEAGAINPENRIIPHLPAPKWFDGQRAAENHQGTLTEYCSTLMSLPTKISRCPHLLDFFKVRPDDLKLPTDNQTKKPETYLMPKDGKSTATDITGPIILQTYRAIANYEKTSGSEMALSTGDVVEVVEKSESGWWFCQMKAKRGWIPASFLEPLDSPDETEDPEPNYAGEPYVAIKAYTAVEGDEVSLLEGEAVEERRRHRLLPVHVPAKVRARRVPGPTPDQAGGAAPQVVHPQRAQHPPAVAEAPQPGRLSPQQRPFSAAATPPGAAGTAEPREPARGGAADAAL

SEQ ID NO: 911662 - protein, 328 aa, Homo sapiens
MSLPTKISRCPHLLDFFKVRPDDLKLPTDNQTKKPETYLMPKDGKSTATDITGPIILQTYRAIANYEKTSGSEMALSTGDVVEVVEKSESGWWFCQMKAKRGWIPASFLEPLDSPDETEDPEPNYAGEPYVAIKAYTAVEGDEVSLLEGEAVEVIHKLLDGWWVISKYLSPAVTWICYPPPLPRLWKDCWKGLSCTDQETEAQQRKDDVTGYFPSMYLQKSGQDVSQAQRQIKRGAPPRRSSIRNVHSIHQRSRKRLSQDAYRRNSVRFLQQRRRQARPGPQSPGSPLEEERQTQRSKPQPAVPPRPSADLILNRCSESTKRKLASAV

SEQ ID NO: 911663 - protein, 176 aa, Homo sapiens
KARYEAGVKSADQSWGTPSSVTSPCWALRSASYPASTMYMFLVKWQDLSEKVVYRRFTEIYEFHDKKARDILDAQRWQEYRDRHHRPHHPADVPRHCQLREDLGLRDGSVHGGRGGGRGEERERSDLPPYGAPSPGAQEPTATSPLPRLRQPGPWEDSSSVRGPKCPPHTVGRLLS

SEQ ID NO: 911664 - protein, 139 aa, Homo sapiens
MSKSQHSIHTTDNREPNMSDSIPMLQREEILGINFKGCEGPFKENSKPLLKEIKEDTNKWKNIPCSWVGRINSVKMAILPKVIYRFNAIPIKLPMTFFTELEKTTLKFIWNQKRARIAKSILSHDIPEEDSELLLGRLL

SEQ ID NO: 911665 - protein, 474 aa, Homo sapiens
MRRVVRQSKFRHVFGQAVKNDQCYDDIRVSRVTWDSSFCAVNPRFVAIIIEASGGGAFLVLPLHKTGRIDKSYPTVCGHTGPVLDIDWCPHNDQVIASGSEDCTVMVWQIPENGLTLSLTEPVVILEGHSKRVGIVAWHPTARNVLLSAGCDNAIIIWNVGTGEALINLDDMHSDMIYNVSWNRNGSLICTASKDKKVRVIDPRKQEIVAEKEKAHEGARPMRAIFLADGNVFTTGFSRMSERQLALWNPKNMQEPIALHEMDTSNGVLLPFYDPDTSIIYLCGKGDSSIRYFEITDESPYVHYLNTFSSKEPQRGMGYMPKRGLDVNKCEIARFFKLHERKCEPIIMTVPRKSDLFQDDLYPDTAGPEAALEAEEWFEGKNADPILISLKHGYIPGKNRDLKVVKKNILDSKPTANKKCDLISIPKKTTDTASVQNEAKLDEILKEIKSIKDTICNQDERISKLEQQMAKIAA

SEQ ID NO: 911666 - protein, 474 aa, Homo sapiens; identical to SEQ ID NO: 911665

SEQ ID NO: 911667 - protein, 474 aa, Homo sapiens; identical to SEQ ID NO: 911665

SEQ ID NO: 911668 - protein, 331 aa, Homo sapiens
MVLPVLGCDNAIIIWNVGTGEALINLDDMHSDMIYNVSWNRNGSLICTASKDKKVRVIDPRKQEIVAEKEKAHEGARPMRAIFLADGNVFTTGFSRMSERQLALWNPKNMQEPIALHEMDTSNGVLLPFYDPDTSIIYLCGKGDSSIRYFEITDESPYVHYLNTFSSKEPQRGMGYMPKRGLDVNKCEIARFFKLHERKCEPIIMTVPRKSDLFQDDLYPDTAGPEAALEAEEWFEGKNADPILISLKHGYIPGKNRDLKVVKKNILDSKPTANKKCDLISIPKKTTDTASVQNEAKLDEILKEIKSIKDTICNQDERISKLEQQMAKIAA

SEQ ID NO: 911669 - protein, 474 aa, Homo sapiens; identical to SEQ ID NO: 911665

SEQ ID NO: 911670 - protein, 68 aa, Homo sapiens
RIMAVPECRGSKKCDLISIPKKTTDTASVQNEAKLDEILKEIKSIKDTICNQDERISKLEQQMAKIAA

SEQ ID NO: 911671 - protein, 494 aa, Homo sapiens
MRRVVRQSKFRHVFGQAVKNDQCYDDIRVSRVTWDSSFCAVNPRFVAIIIEASGGGAFLVLPLHKTGRIDKSYPTVCGHTGPVLDIDWCPHNDQVIASGSEDCTVMVWQIPENGLTLSLTEPVVILEGHSKRVGIVAWHPTARNVLLSAGCDNAIIIWNVGTGEALINLDDMHSDMIYNVSWNRNGSLICTASKDKKVRVIDPRKQEIVAEKEKAHEGARPMRAIFLADGNVFTTGFSRMSERQLALWNPKNMQEPIALHEMDTSNGVLLPFYDPDTSIIYLCGKGDSSIRYFEITDESPYVHYLNTFSSKEPQRGMGYMPKRGLDVNKCEIARFFKLHERKCEPIIMTVPRKSDLFQDDLYPDTAGPEAALEAEEWFEGKNADPILISLKHGYIPGKNRDLKVVKKNILDSKPTANKKCDLISIPKKTTDTASVQNEAKLDEILKEIKSIKDTICNQDERISKLEQQMAKIATRRSNTHCAEMKADKESVEEI

SEQ ID NO: 911672 - protein, 142 aa, Homo sapiens
MVLQLSCSVYFVLLCRKPSTCGNSNNVEQLRENDKRIMKNNIYMRRTFIVKLHKKTGNQVEGLSVIEREMCSAIGTTKGILAHARAGVGMGLAGNVCMQGARVRAECGDSRTWSNVRVEKGPCSYPANTGSAVSTISGHLNV

SEQ ID NO: 911673 - protein, 312 aa, Homo sapiens
MRRVVRQSKFRHVFGQAVKNDQCYDDIRVSRVTWDSSFCAVNPRFVAIIIEASGGGAFLVLPLHKTGRIDKSYPTVCGHTGPVLDIDWCPHNDQVIASGSEDCTVMVWQIPENGLTLSLTEPVVILEGHSKRVGIVAWHPTARNVLLSAGCDNAIIIWNVGTGEALINLDDMHSDMIYNVSWNRNGSLICTASKDKKVRVIDPRKQEIVAEKGEKPLKAKTMTTIFLCRWTMFFNNRVTDRIRPEQVTWGIFWHSRTKVMQETKWSTLPDVTLTNGASCTRHPNNHSTRNNWISSTTFEANTNIEKIAISGI

SEQ ID NO: 911674 - protein, 312 aa, Homo sapiens; identical to SEQ ID NO: 911673

SEQ ID NO: 911675 - protein, 474 aa, Homo sapiens; identical to SEQ ID NO: 911665

SEQ ID NO: 911676 - protein, 474 aa, Homo sapiens; identical to SEQ ID NO: 911665

SEQ ID NO: 911677 - protein, 406 aa, Homo sapiens
DSSRILWPRGFLGPVLDIDWCPHNDQVIASGSEDCTVMVWQIPENGLTLSLTEPVVILEGHSKRVGIVAWHPTARNVLLSAGCDNAIIIWNVGTGEALINLDDMHSDMIYNVSWNRNGSLICTASKDKKVRVIDPRKQEIVAEKEKAHEGARPMRAIFLADGNVFTTGFSRMSERQLALWNPKNMQEPIALHEMDTSNGVLLPFYDPDTSIIYLCGKGDSSIRYFEITDESPYVHYLNTFSSKEPQRGMGYMPKRGLDVNKCEIARFFKLHERKCEPIIMTVPRKSDLFQDDLYPDTAGPEAALEAEEWFEGKNADPILISLKHGYIPGKNRDLKVVKKNILDSKPTANKKCDLISIPKKTTDTASVQNEAKLDEILKEIKSIKDTICNQDERISKLEQQMAKIAA

SEQ ID NO: 911678 - protein, 474 aa, Homo sapiens; identical to SEQ ID NO: 911665

SEQ ID NO: 911679 - protein, 474 aa, Homo sapiens; identical to SEQ ID NO: 911665

SEQ ID NO: 911680 - protein, 392 aa, Homo sapiens
RAARGRGLRAVAGAVAAARAPPPHGAQCQAGGGSGWRLRPALQRGLRRRRLRHLGPDTMRRVVRQSKFRHVFGQAVKNDQCYDDIRVSRVTWDSSFCAVNPRFVAIIIEASGGGAFLVLPLHKTGRIDKSYPTVCGHTGPVLDIDWCPHNDQVIASGSEDCTVMVWQIPENGLTLSLTEPVVILEGHSKRVGIVAWHPTARNVLLSAGCDNAIIIWNVGTGEALINLDDMHSDMIYNVSWNRNGSLICTASKDKKVRVIDPRKQEIVAEKEKAHEGARPMRAIFLADGNVFTTGFSRMSERQLALWNPKNMQEPIALHEMDTSNGVLLPFYDPDTSIIYLCGKGDSSIRYFEITDESPYVHYLNTFSSKEPQRGMGYMPKRGLDVNKCEIAR

SEQ ID NO: 911681 - protein, 1688 aa, Homo sapiens
MKLRGVSLAAGLFLLALSLWGQPAEAAACYGCSPGSKCDCSGIKGEKGERGFPGLEGHPGLPGFPGPEGPPGPRGQKGDDGIPGPPGPKGIRGPPGLPGFPGTPGLPGMPGHDGAPGPQGIPGCNGTKGERGFPGSPGFPGLQGPPGPPGIPGMKGEPGSIIMSSLPGPKGNPGYPGPPGIQGLPGPTGIPGPIGPPGPPGLMGPPGPPGLPGPKGNMGLNFQGPKGEKGEQGLQGPPGPPGQISEQKRPIDVEFQKGDQGLPGDRGPPGPPGIRGPPGPPGGEKGEKGEQGEPGKRGKPGKDGENGQPGIPGLPGDPGYPGEPGRDGEKGQKGDTGPPGPPGLVIPRPGTGITIGEKGNIGLPGLPGEKGERGFPGIQGPPGLPGPPGAAVMGPPGPPGFPGERGQKGDEGPPGISIPGPPGLDGQPGAPGLPGPPGPAGPHIPPSDEICEPGPPGPPGSPGDKGLQGEQGVKGDKGDTCFNCIGTGISGPPGQPGLPGLPGPPGSLGFPGQKGEKGQAGATGPKGLPGIPGAPGAPGFPGSKGEPGDILTFPGMKGDKGELGSPGAPGLPGLPGTPGQDGLPGLPGPKGEPGGITFKGERGPPGNPGLPGLPGNIGPMGPPGFGPPGPVGEKGIQGVAGNPGQPGIPGPKGDPGQTITQPGKPGLPGNPGRDGDVGLPGDPGLPGQPGLPGIPGSKGEPGIPGIGLPGPPGPKGFPGIPGPPGAPGTPGRIGLEGPPGPPGFPGPKGEPGFALPGPPGPPGLPGFKGALGPKGDRGFPGPPGPPGRTGLDGLPGPKGDVGPNGQPGPMGPPGLPGIGVQGPPGPPGIPGPIGQPGLHGIPGEKGDPGPPGLDVPGPPGERGSPGIPGAPGPIGPPGSPGLPGKAGASGFPGTKGEMGMMGPPGPPGPLGIPGRSGVPGLKGDDGLQGQPGLPGPTGEKGSKGEPGLPGPPGPMDPNLLGSKGEKGEPGLPGIPGVSGPKGYQGLPGDPGQPGLSGQPGLPGPPGPKGNPGLPGQPGLIGPPGLKGTIGDMGFPGPQGVEGPPGPSGVPGQPGSPGLPGQKGDKGDPGISSIGLPGLPGPKGEPGLPGYPGNPGIKGSVGDPGLPGLPGTPGAKGQPGLPGFPGTPGPPGPKGISGPPGNPGLPGEPGPVGGGGHPGQPGPPGEKGKPGQDGIPGPAGQKGEPGQPGFGNPGPPGLPGLSGQKGDGGLPGIPGNPGLPGPKGEPGFHGFPGVQGPPGPPGSPGPALEGPKGNPGPQGPPGRPGYEGLPGPEGPPGLPGNGGIKGEKGNPGQPGLPGLPGLKGDQGPPGLQGNPGRPGLNGMKGDPGLPGVPGFPGMKGPSGVPGSAGPEGEPGLIGPPGPPGLPGPSGQSIIIKGDAGPPGIPGQPGLKGLPGPQGPQGLPGPTGPPGDPGRNGLPGFDGAGGRKGDPGLPGQPGTRGLDGPPGPDGLQGPPGPPGTSSVAHGFLITRHSQTTDAPQCPQGTLQVYEGFSLLYVQGNKRAHGQDLGTAGSCLRRFSTMPFMFCNINNVCNFASRNDYSYWLSTPEPMPMSMQPLKGQSIQPFISRCAVCEAPAVVIAVHSQTIQIPHCPQGWDSLWIGYSFMMHTSAGAEGSGQALASPGSCLEEFRSAPFIECHGRGTCNYYANSYSFWLATVDVSDMFSKPQSETLKAGDLRTRISRCQVCMKRT

SEQ ID NO: 911682 - protein, 1688 aa, Homo sapiens; identical to SEQ ID NO: 911681

SEQ ID NO: 911683 - protein, 1069 aa, Homo sapiens
MGPPGFGPPGPVGEKGIQGVAGNPGQPGIPGPKGDPGQTITQPGKPGLPGNPGRDGDVGLPGDPGLPGQPGLPGIPGSKGEPGIPGIGLPGPPGPKGFPGIPGPPGAPGTPGRIGLEGPPGPPGFPGPKGEPGFALPGPPGPPGLPGFKGALGPKGDRGFPGPPGPPGRTGLDGLPGPKGDVGPNGQPGPMGPPGLPGIGVQGPPGPPGIPGPIGQPGLHGIPGEKGDPGPPGLDVPGPPGERGSPGIPGAPGPIGPPGSPGLPGKAGASGFPGTKGEMGMMGPPGPPGPLGIPGRSGVPGLKGDDGLQGQPGLPGPTGEKGSKGEPGLPGPPGPMDPNLLGSKGEKGEPGLPGIPGVSGPKGYQGLPGDPGQPGLSGQPGLPGPPGPKGNPGLPGQPGLIGPPGLKGTIGDMGFPGPQGVEGPPGPSGVPGQPGSPGLPGQKGDKGDPGISSIGLPGLPGPKGEPGLPGYPGNPGIKGSVGDPGLPGLPGTPGAKGQPGLPGFPGTPGPPGPKGISGPPGNPGLPGEPGPVGGGGHPGQPGPPGEKGKPGQDGIPGPAGQKGEPGQPGFGNPGPPGLPGLSGQKGDGGLPGIPGNPGLPGPKGEPGFHGFPGVQGPPGPPGSPGPALEGPKGNPGPQGPPGRPGYKGLPGPEGPPGLPGNGGIKGEKGNPGQPGLPGLPGLKGDQGPPGLQGNPGRPGLNGMKGDPGLPGVPGFPGMKGPSGVPGSAGPEGEPGLIGPPGPPGLPGPSGQSIIIKGDAGPPGIPGQPGLKGLPGPQGPQGLPGPTGPPGDPGRNGLPGFDGAGGRKGDPGLPGQPGTRGLDGPPGPDGLQGPPGPPGTSSVAHGFLITRHSQTTDAPQCPQGTLQVYEGFSLLYVQGNKRAHGQDLGTAGSCLRRFSTMPFMFCNINNVCNFASRNDYSYWLSTPEPMPMSMQPLKGQSIQPFISRCAVCEAPAVVIAVHSQTIQIPHCPQGWDSLWIGYSFMMHTSAGAEGSGQALASPGSCLEEFRSAPFIECHGRGTCNYYANSYSFWLATVDVSDMFSKPQSETLKAGDLRTRISRCQVCMKRT

SEQ ID NO: 911684 - protein, 1670 aa, Homo sapiens
MKLRGVSLAAGLFLLALSLWGQPAEAAACYGCSPGSKCDCSGIKGEKGERGFPGLEGHPGLPGFPGPEGPPGPRGQKGDDGIPGPPGPKGIRGPPGLPGFPGTPGLPGMPGHDGAPGPQGIPGCNGTKGERGFPGSPGFPGLQGPPGPPGIPGMKGEPGSIIMSSLPGPKGNPGYPGPPGIQGLPGPTGIPGPIGPPGPPGLMGPPGPPGLPGPKGNMGLNFQGPKGEKGEQGLQGPPGPPGQISEQKRPIDVEFQKGDQGLPGDRGPPGPPGIRGPPGPPGGEKGEKGEQGEPGKRGKPGKDGENGQPGIPGLPGDPGYPGEPGRDGEKGQKGDTGPPGPPGLVIPRPGTGITIGEKGNIGLPGLPGEKGERGFPGIQGPPGLPGPPGAAVMGPPGPPGFPGERGQKGDEGPPGISIPGPPGLDGQPGAPGLPGPPGPAGPHIPPSDEICEPGPPGPPGSPGDKGLQGEQGVKGDKGDTCFNCIGTGISGPPGQPGLPGLPGPPGSLGFPGQKGEKGQAGATGPKGLPGIPGAPGAPGFPGSKGEPGDILTFPGMKGDKGELGSPGAPGLPGLPGTPGQDGLPGLPGPKGEPGGITFKGERGPPGNPGLPGLPGNIGPMGPPGFGPPGPVGEKGIQGVAGNPGQPGIPGPKGDPGQTITQPGKPGLPGNPGRDGDVGLPGDPGLPGQPGLPGIPGSKGEPGIPGIGLPGPPGPKGFPGIPGPPGAPGTPGRIGLEGPPGPPGFPGPKGEPGFALPGPPGPPGLPGFKGALGPKGDRGFPGPPGPPGRTGLDGLPGPKGDVGPNGQPGPMGPPGLPGIGVQGPPGPPGIPGPIGQPGLHGIPGEKGDPGPPGLDVPGPPGERGSPGIPGAPGPIGPPGSPGLPGKAGASGFPGTKGEMGMMGPPGPPGPLGIPGRSGVPGLKGDDGLQGQPGLPGPTGEKGSKGEPGLPGPPGPMDPNLLGSKGEKGEPGLPGIPGVSGPKGYQGLPGDPGQPGLSGQPGLPGPPGPKGNPGLPGQPGLIGPPGLKGTIGDMGFPGPQGVEGPPGPSGVPGQPGSPGLPGQKGDKGDPGISSIGLPGLPGPKGEPGLPGYPGNPGIKGSVGDPGLPGLPGTPGAKGQPGLPGFPGTPGPPGPKGISGPPGNPGLPGEPGPVGGGGHPGQPGPPGEKGKPGQDGIPGPAGQKGEPGQPGFGNPGPPGLPGLSGQKGDGGLPGIPGNPGLPGPKGEPGFHGFPGVQGPPGPPGSPGPALEGPKGNPGPQGPPGRPGYEGLPGPEGPPGLPGNGGIKGEKGNPGQPGLPGLPGLKGDQGPPGLQGNPGRPGLNGMKGDPGLPGVPGFPGMKGPSGVPGSAGPEGEPGLIGPPGPPGLPGPSGQSIIIKGDAGPPGIPGQPGLKGLPGPQGPQGLPGPTGPPGDPGRNGLPGFDGAGGRKGDPGLPGQPGTRGLDGPPGPDGLQGPPGPPGTSSVAHGFLITRHSQTTDAPQCPQGTLQVYEGFSLLYVQGNNTMPFMFCNINNVCNFASRNDYSYWLSTPEPMPMSMQPLKGQSIQPFISRCAVCEAPAVVIAVHSQTIQIPHCPQGWDSLWIGYSFMMHTSAGAEGSGQALASPGSCLEEFRSAPFIECHGRGTCNYYANSYSFWLATVDVSDMFSKPQSETLKAGDLRTRISRCQVCMKRT

SEQ ID NO: 911685 - protein, 170 aa, Homo sapiens
MPFMFCNINNVCNFASRNDYSYWLSTPEPMPMSMQPLKGQSIQPFISRCAVCEAPAVVIAVHSQTIQIPHCPQGWDSLWIGYSFMMHTSAGAEGSGQALASPGSCLEEFRSAPFIECHGRGTCNYYANSYSFWLATVDVSDMFSKPQSETLKAGDLRTRISRCQVCMKRT

SEQ ID NO: 911686 - protein, 1616 aa, Homo sapiens
MKLRGVSLAAGLFLLALSLWGQPAEAAACYGCSPGSKCDCSGIKGEKGERGFPGLEGHPGLPGFPGPEGPPGPRGQKGDDGIPGPPGPKGIRGPPGLPGFPGTPGLPGMPGHDGAPGPQGIPGCNGTKGERGFPGSPGFPGLQGPPGPPGIPGMKGEPGSIIMSSLPGPKGNPGYPGPPGIQGLPGPTGIPGPIGPPGPPGLMGPPGPPGLPGPKGNMGLNFQGPKGEKGEQGLQGPPGPPGQISEQKRPIDVEFQKGDQGLPGDRGPPGPPGIRGPPGPPGGEKGEKGEQGEPGKRGKPGKDGENGQPGIPGLPGDPGYPGEPGRDGEKGQKGDTGPPGPPGLVIPRPGTGITIGEKGNIGLPGLPGEKGERGFPGIQGPPGLPGPPGAAVMGPPGPPGFPGERGQKGDEGPPGISIPGPPGLDGQPGAPGLPGPPGPAGPHIPPSDEICEPGPPGPPGSPGDKGLQGEQGVKGDKGDTCFNCIGTGISGPPGQPGLPGLPGPPGSLGFPGQKGEKGQAGATGPKGLPGIPGAPGAPGFPGSKGEPGDILTFPGMKGDKGELGSPGAPGLPGLPGTPGQDGLPGLPGPKGEPGGITFKGERGPPGNPGLPGLPGNIGPMGPPGFGPPGPVGEKGIQGVAGNPGQPGIPGPKGDPGQTITQPGKPGLPGNPGRDGDVGLPGDPGLPGQPGLPGIPGSKGEPGIPGIGLPGPPGPKGFPGIPGPPGAPGTPGRIGLEGPPGPPGFPGPKGEPGFALPGPPGPPGLPGFKGALGPKGDRGFPGPPGPPGRTGLDGLPGPKGDVGPNGQPGPMGPPGLPGIGVQGPPGPPGIPGPIGQPGLHGIPGEKGDPGPPGLDVPGPPGERGSPGIPGAPGPIGPPGSPGLPGKAGASGFPGTKGEMGMMGPPGPPGPLGIPGRSGVPGLKGDDGLQGQPGLPGPTGEKGSKGEPGLPGPPGPMDPNLLGSKGEKGEPGLPGIPGVSGPKGYQGLPGDPGQPGLSGQPGLPGPPGPKGNPGLPGQPGLIGPPGLKGTIGDMGFPGPQGVEGPPGPSGVPGQPGSPGLPGQKGDKGDPGISSIGLPGLPGPKGEPGLPGYPGNPGIKGSVGDPGLPGLPGTPGAKGQPGLPGFPGTPGPPGPKGISGPPGNPGLPGEPGPVGGGGHPGQPGPPGEKGKPGQDGIPGPAGQKGEPGQPGFGNPGPPGLPGLSGQKGDGGLPGIPGNPGLPGPKGEPGFHGFPGVQGPPGPPGSPGPALEGPKGNPGPQGPPGRPGYEGLPGPEGPPGLPGNGGIKGEKGNPGQPGLPGLPGLKGDQGPPGLQGNPGRPGLNGMKGDPGLPGVPGFPGMKGPSGVPGSAGPEGEPGLIGPPGPPGLPGPSGQSIIIKGDAGPPGIPGQPGLKGLPGPQGPQGLPGPTGPPGDPGRNGLPGFDGAGGRKGDPGLPGQPGTRGLDGPPGPDGLQGPPGPPGTSSVAHGFLITRHSQTTDAPQCPQGTLQVYEGFSLLYVQGNKRAHGQDLGTAGSCLRRFSTMPFMFCNINNVCNFASRNDYSYWLSTPEPMPMSMQPLKGQSIQPFISRCAVCEAPAVVIAVHSQTIQIPHCPQGWDSLWIGYSFMMVFYTLPCICHHS

SEQ ID NO: 911687 - protein, 105 aa, Homo sapiens
RGEGRVAPSSSSFFFLPLLKSFFLFTQASLSLSGSSSLHINPQDYVNWLEPAGNFVRVLKELREPEKNETAWSQPGCRLVLTGPESLGAACRGCGLLWVLSRIKV

SEQ ID NO: 911688 - protein, 1604 aa, Homo sapiens
MKLRGVSLAAGLFLLALSLWGQPAEAAACYGCSPGSKCDCSGIKGEKGERGFPGLEGHPGLPGFPGPEGPPGPRGQKGDDGIPGPPGPKGIRGPPGLPGFPGTPGLPGMPGHDGAPGPQGIPGCNGTKGERGFPGSPGFPGLQGPPGPPGIPGMKGEPGSIIMSSLPGPKGNPGYPGPPGIQGLPGPTGIPGPIGPPGPPGLMGPPGPPGLPGPKGNMGLNFQGPKGEKGEQGLQGPPGPPGQISEQKRPIDVEFQKGDQGLPGDRGPPGPPGIRGPPGPPGGEKGEKGEQGEPGKRGKPGKDGENGQPGIPGLPGDPGYPGEPGRDGEKGQKGDTGPPGPPGLVIPRPGTGITIGEKGNIGLPGLPGEKGERGFPGIQGPPGLPGPPGAAVMGPPGPPGFPGERGQKGDEGPPGISIPGPPGLDGQPGAPGLPGPPGPAGPHIPPSDEICEPGPPGPPGSPGDKGLQGEQGVKGDKGDTCFNCIGTGISGPPGQPGLPGLPGPPGSLGFPGQKGEKGQAGATGPKGLPGIPGAPGAPGFPGSKGEPGDILTFPGMKGDKGELGSPGAPGLPGLPGTPGQDGLPGLPGPKGEPGGITFKGERGPPGNPGLPGLPGNIGPMGPPGFGPPGPVGEKGIQGVAGNPGQPGIPGPKGDPGQTITQPGKPGLPGNPGRDGDVGLPGDPGLPGQPGLPGIPGSKGEPGIPGIGLPGPPGPKGFPGIPGPPGAPGTPGRIGLEGPPGPPGFPGPKGEPGFALPGPPGPPGLPGFKGALGPKGDRGFPGPPGPPGRTGLDGLPGPKGDVGPNGQPGPMGPPGLPGIGVQGPPGPPGIPGPIGQPGLHGIPGEKGDPGPPGLDVPGPPGERGSPGIPGAPGPIGPPGSPGLPGKAGASGFPGTKGEMGMMGPPGPPGPLGIPGRSGVPGLKGDDGLQGQPGLPGPTGEKGSKGEPGLPGPPGPMDPNLLGSKGEKGEPGLPGIPGVSGPKGYQGLPGDPGQPGLSGQPGLPGPPGPKGNPGLPGQPGLIGPPGLKGTIGDMGFPGPQGVEGPPGPSGVPGQPGSPGLPGQKGDKGDPGISSIGLPGLPGPKGEPGLPGYPGNPGIKGSVGDPGLPGLPGTPGAKGQPGLPGFPGTPGPPGPKGISGPPGNPGLPGEPGPVGGGGHPGQPGPPGEKGKPGQDGIPGPAGQKGEPGQPGFGNPGPPGLPGLSGQKGDGGLPGIPGNPGLPGPKGEPGFHGFPGVQGPPGPPGSPGPALEGPKGNPGPQGPPGRPGYEGLPGPEGPPGLPGNGGIKGEKGNPGQPGLPGLPGLKGDQGPPGLQGNPGRPGLNGMKGDPGLPGVPGFPGMKGPSGVPGSAGPEGEPGLIGPPGPPGLPGPSGQSIIIKGDAGPPGIPGQPGLKGLPGPQGPQGLPGPTGPPGDPGRNGLPGFDGAGGRKGDPGLPGQPGTRGLDGPPGPDGLQGPPGPPGTSSVAHGFLITRHSQTTDAPQCPQGTLQVYEGFSLLYVQGNKRAHGQDLGTAGSCLRRFSTMPFMFCNINNVCNFASRNDYSYWLSTPEPMPMSMQPLKGQSIQPFISRCAVCEAPAVVIAVHSQTIQIPHCPQGWDSLWIGYSFMM

SEQ ID NO: 911689 - protein, 1361 aa, Homo sapiens
MVKRPKGDTGPPGPPGLVIPRPGTGITIGEKGNIGLPGLPGEKGERGFPGIQGPPGLPGPPGAAVMGPPGPPGFPGERGQKGDEGPPGISIPGPPGLDGQPGAPGLPGPPGPAGPHIPPSDEICEPGPPGPPGSPGDKGLQGEQGVKGDKGDTCFNCIGTGISGPPGQPGLPGLPGPPGSLGFPGQKGEKGQAGATGPKGLPGIPGAPGAPGFPGSKGEPGDILTFPGMKGDKGELGSPGAPGLPGLPGTPGQDGLPGLPGPKGEPGGITFKGERGPPGNPGLPGLPGNIGPMGPPGFGPPGPVGEKGIQGVAGNPGQPGIPGPKGDPGQTITQPGKPGLPGNPGRDGDVGLPGDPGLPGQPGLPGIPGSKGEPGIPGIGLPGPPGPKGFPGIPGPPGAPGTPGRIGLEGPPGPPGFPGPKGEPGFALPGPPGPPGLPGFKGALGPKGDRGFPGPPGPPGRTGLDGLPGPKGDVGPNGQPGPMGPPGLPGIGVQGPPGPPGIPGPIGQPGLHGIPGEKGDPGPPGLDVPGPPGERGSPGIPGAPGPIGPPGSPGLPGKAGASGFPGTKGEMGMMGPPGPPGPLGIPGRSGVPGLKGDDGLQGQPGLPGPTGEKGSKGEPGLPGPPGPMDPNLLGSKGEKGEPGLPGIPGVSGPKGYQGLPGDPGQPGLSGQPGLPGPPGPKGNPGLPGQPGLIGPPGLKGTIGDMGFPGPQGVEGPPGPSGVPGQPGSPGLPGQKGDKGDPGISSIGLPGLPGPKGEPGLPGYPGNPGIKGSVGDPGLPGLPGTPGAKGQPGLPGFPGTPGPPGPKGISGPPGNPGLPGEPGPVGGGGHPGQPGPPGEKGKPGQDGIPGPAGQKGEPGQPGFGNPGPPGLPGLSGQKGDGGLPGIPGNPGLPGPKGEPGFHGFPGVQGPPGPPGSPGPALEGPKGNPGPQGPPGRPGYKGLPGPEGPPGLPGNGGIKGEKGNPGQPGLPGLPGLKGDQGPPGLQGNPGRPGLNGMKGDPGLPGVPGFPGMKGPSGVPGSAGPEGEPGLIGPPGPPGLPGPSGQSIIIKGDAGPPGIPGQPGLKGLPGPQGPQGLPGPTGPPGDPGRNGLPGFDGAGGRKGDPGLPGQPGTRGLDGPPGPDGLQGPPGPPGTSSVAHGFLITRHSQTTDAPQCPQGTLQVYEGFSLLYVQGNKRAHGQDLGTAGSCLRRFSTMPFMFCNINNVCNFASRNDYSYWLSTPEPMPMSMQPLKGQSIQPFISRCAVCEAPAVVIAVHSQTIQIPHCPQGWDSLWIGYSFMMHTSAGAEGSGQALASPGSCLEEFRSAPFIECHGRGTCNYYANSYSFWLATVDVSDMFSKPQSETLKAGDLRTRISRCQVCMKRT

SEQ ID NO: 911690 - protein, 383 aa, Homo sapiens [sequence omitted]

SEQ ID NO: 911691 - protein, 1087 aa, Homo sapiens
MKLRGVSLAAGLFLLALSLWGQPAEAAACYGCSPGSKCDCSGIKGEKGERGFPGLEGHPGLPGFPGPEGPPGPRGQKGDDGIPGPPGPKGIRGPPGLPGFPGTPGLPGMPGHDGAPGPQGIPGCNGTKGERGFPGSPGFPGLQGPPGPPGIPGMKGEPGSIIMSSLPGPKGNPGYPGPPGIQGLPGPTGIPGPIGPPGPPGLMGPPGPPGLPGPKGNMGLNFQGPKGEKGEQGLQGPPGPPGQISEQKRPIDVEFQKGDQGLPGDRGPPGPPGIRGPPGPPGGEKGEKGEQGEPGKRGKPGKDGENGQPGIPGLPGDPGYPGEPGRDGEKGQKGDTGPPGPPGLVIPRPGTGITIGEKGNIGLPGLPGEKGERGFPGIQGPPGLPGPPGAAVMGPPGPPGFPGERGQKGDEGPPGISIPGPPGLDGQPGAPGLPGPPGPAGPHIPPSDEICEPGPPGPPGSPGDKGLQGEQGVKGDKGDTCFNCIGTGISGPPGQPGLPGLPGPPGSLGFPGQKGEKGQAGATGPKGLPGIPGAPGAPGFPGSKGEPGDILTFPGMKGDKGELGSPGAPGLPGLPGTPGQDGLPGLPGPKGEPGGITFKGERGPPGNPGLPGLPGNIGPMGPPGFGPPGPVGEKGIQGVAGNPGQPGIPGPKGDPGQTITQPGKPGLPGNPGRDGDVGLPGDPGLPGQPGLPGIPGSKGEPGIPGIGLPGPPGPKGFPGIPGPPGAPGTPGRIGLEGPPGPPGFPGPKGEPGFALPGPPGPPGLPGFKGALGPKGDRGFPGPPGPPGRTGLDGLPGPKGDVGPNGQPGPMGPPGLPGIGVQGPPGPPGIPGPIGQPGLHGIPGEKGDPGPPGLDVPGPPGERGSPGIPGAPGPIGPPGSPGLPGKAGASGFPGTKGEMGMMGPPGPPGPLGIPGRSGVPGLKGDDGLQGQPGLPGPTGEKGSKGEPGLPGPPGPMDPNLLGSKGEKGEPGLPGIPGVSGPKGYQGLPGDPGQPGLSGQPGLPGPPGPKGNPGLPGQPGLIGPPGLKGTIGDMGFPGPQGVEGPPGPSGVPGQPGSPGLPGQKGDKGDPGISSIGLPGLPGPKVIFGI

SEQ ID NO: 911692 - protein, 214 aa, Homo sapiens
EPTKPLVRRAGAKSRSRRKKQKKNSRQEAVPWKKPKGINSNSTANLEDPEVGDAESMAISEPIKGSRKPCVNKEELALKKPMAKCAWKGPREPPQDARAEAESPGGASESDQDGGHESPPKKKAVAWVSAKNPAPMRKKKKVSLGPVSYVLVDSEDGRKKPVMPKKGPGSRREASDQKAPRGQQPAEATASTSRGPKAKPEGSPRRATNESRKV

SEQ ID NO: 911693 - protein, 214 aa, Homo sapiens; identical to SEQ ID NO: 911692

SEQ ID NO: 911694 - protein, 214 aa, Homo sapiens; identical to SEQ ID NO: 911692

SEQ ID NO: 911695 - protein, 138 aa, Homo sapiens
MKSISCQEIPGQQSRGRTCRGRKFDGHRCAGQQQDIRHCYSIQHCPLKGSWSEWSTWGLCMPPCGPNPTRARQRLCTPLLPKYPPTVSMVEGQGEKNVTFWGRPLPRCEELQGQKLVVEEKRPCLHVPACKDPEEEEL

SEQ ID NO: 911696 - protein, 469 aa, Homo sapiens
MITEGAQAPRLLLPPLLLLLTLPATGSDPVLCFTQYEESSGKCKGLLGGGVSVEDCCLNTAFAYQKRSGGLCQPCRSPRWSLWSTWAPCSVTCSEGSQLRYRRCVGWNGQCSGKVAPGTLEWQLQACEDQQCCPEMGGWSGWGPWEPCSVTCSKGTRTRRRACNHPAPKCGGHCPGQAQESEACDTQQVCPTHGAWATWGPWTPCSASCHGGPHEPKETRSRKCSAPEPSQKPPGKPCPGLAYEQRRCTGLPPCPVAGGWGPWGPVSPCPVTCGLGQTMEQRTCNHPVPQHGGPFCAGDATRTHICNTAVPCPVDGEWDSWGEWSPCIRRNMKSISCQEIPGQQSRGRTCRGRKFDGHRCAGQQQDIRHCYSIQHCPLKGSWSEWSTWGLCMPPCGPNPTRARQRLCTPLLPKYPPTVSMVEGQGEKNVTFWGRPLPRCEELQGQKLVVEEKRPCLHVPACKDPEEEEL

SEQ ID NO: 911697 - protein, 469 aa, Homo sapiens; identical to SEQ ID NO: 911696

SEQ ID NO: 911698 - protein, 258 aa, Homo sapiens
MITEGAQAPRLLLPPLLLLLTLPATGSDPVLCFTQYEESSGKCKGLLGGGVSVEDCCLNTAFAYQKRSGGLCQPCRSPRWSLWSTWAPCSVTCSEGSQLRYRRCVGWNGQCSGKVAPGTLEWQLQACEDQQCCPEMGGWSGWGPWEPCSVTCSKGTRTRRRACNHPAPKCGGHCPGQAQESEACDTQQVCPTHGAWATWGPWTPCSASCHGGPHEPKETRSRKCSAPEPSQKPPGKPCPGLAYEQRRCTGLPPCPAAL

SEQ ID NO: 911699 - protein, 593 aa, Homo sapiens
MVSPPPGAAAVAARAGLRVGPAPRPLMGSQGRSGPPGNGGPGEGEGGEARKLQEGRVARGKRRKGKGKGKARAGQGGRGSGAEGKPGPQTAKEAAGPGADAGARACPREEAEGGRSVEEGARGIVKGVEGSAGAGKEAQGREYGKKEEWRVRARRREGARPGRAQGRGGQAWADIAGTGVAMAAAAGEEEEEEEAARESAARPAAGPALWRLPEELLLLICSYLDMRALGRLAQVCRWLRRFTSCDLLWRRIARASLNSGFTRLGTDLMTSVPVKERVKVSQNWRLGRCREGILLKWRCSQMPWMQLEDDSLYISQANFILAYQFRPDGASLNRRPLGVFAGHDEDVCHFVLANSHIVSAGGDGKIGIHKIHSTFTVKYSAHEQEVNCVDCKGGIIVSGSRDRTAKVWPLASGRLGQCLHTIQTEDRVWSIAISPLLSSFVTGTACCGHFSPLRIWDLNSGQLMTHLGSDFPPGAGVLDVMYESPFTLLSCGYDTYVRYWDLRTSVRKCVMEWEEPHDSTLYCLQTDGNHLLATGSSYYGVVRLWDRRQRACLHAFPLTSTPLSSPVYCLRLTTKHLYAALSYNLHVLDFQNP

SEQ ID NO: 911700 - protein, 325 aa, Homo sapiens
MTSVPVKERVKVSQNWRLGRCREGILLKWRCSQMPWMQLEDDSLYISQANFILAYQFRPDGASLNRRPLGVFAGHDEDVCHFVLANSHIVSAGGDGKIGIHKIHSTFTVKYSAHEQEVNCVDCKGGIIVSGSRDRTAKVWPLASGRLGQCLHTIQTEDRVWSIAISPLLSSFVTGTACCGHFSPLRIWDLNSGQLMTHLGSDFPPGAGVLDVMYESPFTLLSCGYDTYVRYWDLRTSVRKCVMEWEEPHDSTLYCLQTDGNHLLATGSSYYGVVRLWDRRQRACLHAFPLTSTPLSSPVYCLRLTTKHLYAALSYNLHVLDFQNP

SEQ ID NO: 911701 - protein, 341 aa, Homo sapiens
LCCVEPYVCRWLGTDLMTSVPVKERVKVSQNWRLGRCREGILLKWRCSQMPWMQLEDDSLYISQANFILAYQFRPDGASLNRRPLGVFAGHDEDVCHFVLANSHIVSAGGDGKIGIHKIHSTFTVKYSAHEQEVNCVDCKGGIIVSGSRDRTAKVWPLASGRLGQCLHTIQTEDRVWSIAISPLLSSFVTGTACCGHFSPLRIWDLNSGQLMTHLGSDFPPGAGVLDVMYESPFTLLSCGYDTYVRYWDLRTSVRKCVMEWEEPHDSTLYCLQTDGNHLLATGSSYYGVVRLWDRRQRACLHAFPLTSTPLSSPVYCLRLTTKHLYAALSYNLHVLDFQNP

SEQ ID NO: 911702 - protein, 353 aa, Homo sapiens
ASDLKRLCLHTTQTEDRVWSIAISPLLRMTSVPVKERVKVSQNWRLGRCREGILLKWRCSQMPWMQLEDDSLYISQANFILAYQFRPDGASLNRRPLGVFAGHDEDVCHFVLANSHIVSAGGDGKIGIHKIHSTFTVKYSAHEQEVNCVDCKGGIIVSGSRDRTAKVWPLASGRLGQCLHTIQTEDRVWSIAISPLLSSFVTGTACCGHFSPLRIWDLNSGQLMTHLGSDFPPGAGVLDVMYESPFTLLSCGYDTYVRYWDLRTSVRKCVMEWEEPHDSTLYCLQTDGNHLLATGSSYYGVVRLWDRRQRACLHAFPLTSTPLSSPVYCLRLTTKHLYAALSYNLHVLDFQNP

SEQ ID NO: 911703 - protein, 304 aa, Homo sapiens
MRGDLLKWRCSQMPWMQLEDDSLYISQANFILAYQFRPDGASLNRRPLGVFAGHDEDVCHFVLANSHIVSAGGDGKIGIHKIHSTFTVKYSAHEQEVNCVDCKGGIIVSGSRDRTAKVWPLASGRLGQCLHTIQTEDRVWSIAISPLLSSFVTGTACCGHFSPLRIWDLNSGQLMTHLGSDFPPGAGVLDVMYESPFTLLSCGYDTYVRYWDLRTSVRKCVMEWEEPHDSTLYCLQTDGNHLLATGSSYYGVVRLWDRRQRACLHAFPLTSTPLSSPVYCLRLTTKHLYAALSYNLHVLDFQNP

SEQ ID NO: 911704 - protein, 381 aa, Homo sapiens
MVSPPPGAAAVAARAGLRVGPAPRPLMGSQGRSGPPGNGGPGEGEGGEARKLQEGRVARGKRRKGKGKGKARAGQGGRGSGAEGKPGPQTAKEAAGPGADAGARACPREEAEGGRSVEEGARGIVKGVEGSAGAGKEAQGREYGKKEEWRVRARRREGARPGRAQGRGGQAWADIAGTGVAMAAAAGEEEEEEEAARESAARPAAGPALWRLPEELLLLICSYLDMRALGRLAQVCRWLRRFTSCDLLWRRIARASLNSGFTRLGTDLMTSVPVKERVKVSQNWRLGRCREGILLKWRCSQMPWMQLEDDSLYISQANFILAYQFRPDGASLNRRPLGVFAGHDEDVCHFVLANSHIVSAGGDGKIGIHKIQGILLLASLI

SEQ ID NO: 911705 - protein, 272 aa, Homo sapiens
MIYVPISAILNRMYSRKSQVNLLKEQSALCAGQLAYCSAGGDGKIGIHKIHSTFTVKYSAHEQEVNCVDCKGGIIVSGSRDRTAKVWPLASGRLGQCLHTIQTEDRVWSIAISPLLSSFVTGTACCGHFSPLRIWDLNSGQLMTHLGSDFPPGAGVLDVMYESPFTLLSCGYDTYVRYWDLRTSVRKCVMEWEEPHDSTLYCLQTDGNHLLATGSSYYGVVRLWDRRQRACLHAFPLTSTPLSSPVYCLRLTTKHLYAALSYNLHVLDFQNP

SEQ ID NO: 911706 - protein, 564 aa, Homo sapiens
MVSPPPGAAAVAARAGLRVGPAPRPLMGSQGRSGPPGNGGPGEGEGGEARKLQEGRVARGKRRKGKGKGKARAGQGGRGSGAEGKPGPQTAKEAAGPGADAGARACPREEAEGGRSVEEGARGIVKGVEGSAGAGKEAQGREYGKKEEWRVRARRREGARPGRAQGRGGQAWADIAGPALWRLPEELLLLICSYLDMRALGRLAQVCRWLRRFTSCDLLWRRIARASLNSGFTRLGTDLMTSVPVKERVKVSQNWRLGRCREGILLKWRCSQMPWMQLEDDSLYISQANFILAYQFRPDGASLNRRPLGVFAGHDEDVCHFVLANSHIVSAGGDGKIGIHKIHSTFTVKYSAHEQEVNCVDCKGGIIVSGSRDRTAKVWPLASGRLGQCLHTIQTEDRVWSIAISPLLSSFVTGTACCGHFSPLRIWDLNSGQLMTHLGSDFPPGAGVLDVMYESPFTLLSCGYDTYVRYWDLRTSVRKCVMEWEEPHDSTLYCLQTDGNHLLATGSSYYGVVRLWDRRQRACLHAFPLTSTPLSSPVYCLRLTTKHLYAALSYNLHVLDFQNP

SEQ ID NO: 911707 - protein, 325 aa, Homo sapiens; identical to SEQ ID NO: 911700

SEQ ID NO: 911708 - protein, 498 aa, Homo sapiens
MVSPPPGAAAVAARAGLRVGPAPRPLMGSQGRSGPPGNGGPGEGEGGEARKLQEGRVARGKRRKGKGKGKARAGQGGRGSGAEGKPGPQTAKEAAGPGADAGARACPREEAEGGRSVEEGARGIVKGVEGSAGAGKEAQGREYGKKEEWRVRARRREGARPGRAQGRGGQAWADIAGTGVAMAAAAGEEEEEEEAARESAARPAAGPALWRLPEELLLLICSYLDMRALGRLAQVCRWLRRFTSCDLLWRRIARASLNSGFTRLGTDLMTSVPVKERVKVSQNWRLGRCREGILLKWRCSQMPWMQLEDDSLYISQANFILAYQFRPDGASLNRRPLGVFAGHDEDVCHFVLANSHIVSAGGDGKIGIHKIHSTFTVKYSAHEQEVNCVDCKGGIIVSGSRDRTAKVWPLASGRLGQCLHTIQTEDRVWSIAISPLLSSFVTGTACCGHFSPLRIWDLNSGRFDTGVIPRAGVESYSPTHAAGDPISVPARRVSLKPY

SEQ ID NO: 911709 - protein, 468 aa, Homo sapiens
MVSPPPGAAAVAARAGLRVGPAPRPLMGSQGRSGPPGNGGPGEGEGGEARKLQEGRVARGKRRKGKGKGKARAGQGGRGSGAEGKPGPQTAKEAAGPGADAGARACPREEAEGGRSVEEGARGIVKGVEGSAGAGKEAQGREYGKKEEWRVRARRREGARPGRAQGRGGQAWADIAGTGVAMAAAAGEEEEEEEAARESAARPAAGPALWRLPEELLLLICSYLDMRALGRLAQVCRWLRRFTSCDLLWRRIARASLNSGFTRLGTDLMTSVPVKERVKVSQNWRLGRCREGILLKWRCSQMPWMQLEDDSLYISQANFILAYQFRPDGASLNRRPLGVFAGHDEDVCHFVLANSHIVSAGGDGKIGIHKIHSTFTVKYSAHEQEVNCVDCKGGIIVSGSRDRTAKVLFCDRDGLLRALLTPENLGPQQWALLTPGSDSQGWSESYSPTHAAGDPISVPARRVSLKPY

SEQ ID NO: 911710 - protein, 115 aa, Homo sapiens
MDNRKEPPFFNDDNMGPFYYRLHFCDTMELFIETLTGTCFELRVSPFETVISVKAKIRRLEGIPICRQHLIWNNMELENDYCLNDYNISEGCTLKLVLAMRGGPINTRRDLQIPR

SEQ ID NO: 911711 - protein, 585 aa, Homo sapiens
MVIFTSLHRYVIFISCIIVINWYMSRVHGMHPKETTRQLSLAVKDGLIVETLTVGCKGSKAGIEQEGYWLPGDEIDWETENHDWYCFECHLPGEVLICDLCFRVYHSKCLSDEFRLRDSSSPWQCPVCRSIKKKNTNKQEMGTYLRFIVSRMKERAIDLNKKGKDNKHPMYRRLVHSAVDVPTIQEKVNEGKYRSYEEFKADAQLLLHNTVIFYGADSEQADIARMLYKDTCHELDELQLCKNCFYLSNARPDNWFCYPCIPNHELVWAKMKGFGFWPAKVMQKEDNQVDVRFFGHHHQRAWIPSENIQDITVNIHRLHVKRSMGWKKACDELELHQRFLREGRFWKSKNEDRGEEEAESSISSTSNEQLKVTQEPRAKKGRRNQSVEPKKEEPEPETEAVSSSQEIPTMPQPIEKVSVSTQTKKLSASSPRMLHRSTQTTNDGVCQSMCHDKYTKIFNDFKDRMKSDHKRETERVVREALEKLRSEMEEEKRQAVNKAVANMQGEMDRKCKQVKEKCKEEFVEEIKKLATQHKQLISQTKKKQWCYNCEEEAMYHCCWNTSYCSIKCQQEHWHAEHKRTCRRKR

SEQ ID NO: 911712 - protein, 602 aa, Homo sapiens
MARLTKRRQADTKAIQHLWAAIEIIRNQKQIANIDRITKYMSRVHGMHPKETTRQLSLAVKDGLIVETLTVGCKGSKAGIEQEGYWLPGDEIDWETENHDWYCFECHLPGEVLICDLCFRVYHSKCLSDEFRLRDSSSPWQCPVCRSIKKKNTNKQEMGTYLRFIVSRMKERAIDLNKKGKDNKHPMYRRLVHSAVDVPTIQEKVNEGKYRSYEEFKADAQLLLHNTVIFYGADSEQADIARMLYKDTCHELDELQLCKNCFYLSNARPDNWFCYPCIPNHELVWAKMKGFGFWPAKVMQKEDNQVDVRFFGHHHQRAWIPSENIQDITVNIHRLHVKRSMGWKKACDELELHQRFLREGRFWKSKNEDRGEEEAESSISSTSNEQLKVTQEPRAKKGRRNQSVEPKKEEPEPETEAVSSSQEIPTMPQPIEKVSVSTQTKKLSASSPRMLHRSTQTTNDGVCQSMCHDKYTKIFNDFKDRMKSDHKRETERVVREALEKLRSEMEEEKRQAVNKAVANMQGEMDRKCKQVKEKCKEEFVEEIKKLATQHKQLISQTKKKQWCYNCEEEAMYHCCWNTSYCSIKCQQEHWHAEHKRTCRRKR

SEQ ID NO: 911713 - protein, 360 aa, Homo sapiens [sequence omitted]

SEQ ID NO: 911714 - protein, 727 aa, Homo sapiens
MDNRKEPPFFNDDNMGPFYYRLHFCDTMELFIETLTGTCFELRVSPFETVISVKAKIRRLEGIPICRQHLIWNNMELENDYCLNDYNISEGCTLKLVLAMRGGPINTRRVPTDDPLRKMAEYLDSSRVEVWEKTSCSKQVTFLVYQEGDQLNFFPAVDRGDGTLTPLSDSSKKIDFHLHVLRRKGEHRMSGGSMYNSDTDEDEETEPSSSGQQIIENSITMNKMKLLKAKMKNMNLSKKPKKAVKIKPHPPVAPRPSSGSTAPSRHRLLRVLPNIGQSCSPAFGNAYPPEISRNGISSLATQLSAERYISSITGEFLKEDNSWENNTLSHFSSNVKLPPQIPHLELGNDQELADSVLHLGSSLPRQTKHFLGNLPSSNGNIVLPSEECVTEQSLLPKVGSLASFAEGNADEQSSGLEGACKVNLELLLTNADKGLKAPEQHLKHVAGVLNGESVETSVLNYRELSPHKNRLLSPLRCSAPMSLHNSLVKPERQSKCFEFGKLQPSSSQSLDVQNITDSSFSRTTCFQGVKVDSLGKRSDVISKVEARDITEMTNKASKEPVGCVNNISFLASLAGSTSRNRLQSTRGAGRLQNSGTGLSTNLQHFQEENFRKSSPQLEHTGVFLSTHGVGMNGNNAAAGKSVGECTTHHLPPVKAPLQTKKKTTNHCFLCGKKTGLASSYECRCGNNFCASHRYAETHGCTYDYKSAGRRYLHEANPVVNAPKLPKI

SEQ ID NO: 911715 - protein, 602 aa, Homo sapiens; identical to SEQ ID NO: 911712

SEQ ID NO: 911716 - protein, 727 aa, Homo sapiens; identical to SEQ ID NO: 911714

SEQ ID NO: 911717 - protein, 679 aa, Homo sapiens
MDNRKEPPFFNDDNMGPFYYRLHFCDTMELFIETLTGTCFELRVSPFETVISVKAKIRRLEVPTDDPLRKMAEYLDSSRVEVWEKTSCSKQVTFLVYQEGDQLNFFPAVDRGDGTLTPLSDSSKKIDFHLHVLRRKGEHRMSGGSMYNSDTDEDEETEPSSSGQQIIENSITMNKMKLLKAKMKNMNLSKKPKKAVKIKPHPPVAPRPSSGSTAPSRHRLLRVLPNIGQSCSPAFGNAYPPEISRNGISSLATQLSAERYISSITGEFLKEDNSWENNTLSHFSSNVKLPPQIPHLELGNDQELADSVLHLGSSLPRQTKHFLGNLPSSNGNIVLPSEECVTEQSLLPKVGSLASFAEGNADEQSSGLEGACKVNLELLLTNADKGLKAPEQHLKHVAGVLNGESVETSVLNYRELSPHKNRLLSPLRCSAPMSLHNSLVKPERQSKCFEFGKLQPSSSQSLDVQNITDSSFSRTTCFQGVKVDSLGKRSDVISKVEARDITEMTNKASKEPVGCVNNISFLASLAGSTSRNRLQSTRGAGRLQNSGTGLSTNLQHFQEENFRKSSPQLEHTGVFLSTHGVGMNGNNAAAGKSVGECTTHHLPPVKAPLQTKKKTTNHCFLCGKKTGLASSYECRCGNNFCASHRYAETHGCTYDYKSAGRRYLHEANPVVNAPKLPKI

SEQ ID NO: 911718 - protein, 718 aa, Homo sapiens
MDNRKEPPFFNDDNMGPFYYRLHFCDTMELFIETLTGTCFELRVSPFETVISVKAKIRRLEGIPICRQHLIWNNMELENDYCLNDYNISEGCTLKLVLAMRGGPINTRRVPTDDPLRKMAEYLDSSRVEVWEKTSCSKQVTFLVYQEGDQLNFFPAVDRGDGTLTPLSDSSKKIDFHLHVLRRKGEHRMSGGSMYNSDTDEDEETEPSSSGQQIIENSITMNKMKLLKAKMKNMNLSKKPKKAVKIKPHPPVAPRPSSGSTAPSRHRLLRVLPNIGQSCSPAFGNAYPPEISRNGISSLATQLSAERYISSITGEFLKEDNSWENNTLSHFSSNVKLPPQIPHLELGNDQELADSVLHLGSSLPRQTKHFLGNLPSSNGNIVLPSEECVTEQSLLPKVGSLASFAEGNADEQSSGLEGACKVNLELLLTNADKGLKAPEQHLKHVAGVLNGESVETSVLNYRELSPHKNRLLSPLRCSAPMSLHNSLVKPERQSKCFEFGKLQPSSSQSLDVQNITDSSFSRTTCFQGVKVDSLGKRSDVISKVEARDITEMTNKASKEPVGCVNNISFLASLAGSTSRNRLQSTRGAGRLQNSGTGLSTNLQHFQEENFRKSSPQLEHTGVFLSTHGVGMNGNNAAAGKSVGECTTHHLPPVKAPLQTKKKTTNHCFLCGKKTGLASSYECRQVGELEKLRCFLCDNPAWGLCKIKYLNCLFITSLR

SEQ ID NO: 911719 - protein, 249 aa, Homo sapiens
MDNRKEPPFFNDDNMGPFYYRLHFCDTMELFIETLTGTCFELRVSPFETVISVKAKIRRLEGIPICRQHLIWNNMELENDYCLNDYNISEGCTLKLVLAMRGGPINTRRVPTDDPLRKMAEYLDSSRVEVWEKTSCSKQVTFLVYQEGDQLNFFPAVDRGDGTLTPLSDSSKKIDFHLHVLRRKGEHRMSGGSMYNSDTDEDEETEPSSSGQQIIENSITMNKMKLLKAKMKNMNLSKKENVLLITSHL

SEQ ID NO: 911720 - protein, 652 aa, Homo sapiens
MDNRKEPPFFNDDNMGPFYYRLHFCDTMELFIETLTGTCFELRVSPFETVISVKAKIRRLEGIPICRQHLIWNNMELENDYCLNDYNISEGCTLKLVLAMRGGPINTRRVPTDDPLRKMAEYLDSSRVEVWEKTSCSKQVTFLVYQEGDQLNFFPAVDRGDGTLTPLSDSSKKIDFHLHVLRRKGEHRMSGGSMYNSDTDEDEETEPSSSGQQIIENSITMNKMKLLKAKMKNMNLSKKPKKAVKIKPHPPVAPRPSSGSTAPSRHRLLRVLPNIGQSCSPAFGNAYPPEISRNGISSLATQLSAERYISSITGEFLKEDNSWENNTLSHFSSNVKLPPQIPHLELGNDQELADSVLHLGSSLPRQTKHFLGNLPSSNGNIVLPSEECVTEQSLLPKVGSLASFAEGNADEQSSGLEGACKVNLELLLTNADKGLKAPEQHLKHVAGVLNGESVETSVLNYRELSPHKNRLLSPLRCSAPMSLHNSLVKPERQSKCFEFGKLQPSSSQSLDVQNITDSSFSRTTCFQGVKVDSLGKRSDVISKVEARDITEMTNKASKEPVGCVNNISFLASLAGSTSRNRLQSTRGAGRLQNSGTGLSTNLQHFQEENFRKSSPQLEHTGVFLVSIFLSTCSSSYPCSDSTYLKFGFCLHK

SEQ ID NO: 911721 - protein, 132 aa, Homo sapiens
MAEYLDSSRVEVWEKTSCSKQVTFLVYQEGDQLNFFPAVDRGDGTLTPLSDSSKKIDFHLHVLRRKGEHRMSGGSMYNSDTDEDEETEPSSSGQQIIENSITMNKMKLLKAKMKNMNLSKKVKLLAFDQAYL

SEQ ID NO: 911722 - protein, 217 aa, Homo sapiens
MARLTKRRQADTKAIQHLWAAIEIIRNQKQIANIDRITKYMSRVHGMHPKETTRQLSLAVKDGLIVETLTVGCKGSKAGIEQEGYWLPGDEIDWETENHDWYCFECHLPGEVLICDLCFRVYHSKCLSDEFRLRDSSSPWQCPVCRSIKKKNTNKQEMGTYLRFIVSRMKERAIDLNKKGKDNKHPMYRRLVHSAVDVPTIQEVKSVSFISTSSTFS

SEQ ID NO: 911723 - protein, 104 aa, Homo sapiens
ALSTCRRASEPADKTAGEAELASGRQGGRPGCEPLSPAALPPPAVVGPEWRKAGVARALGAGLPGRVLSPPLALRPDAGRCCPGTGAAGRLCPGHTLWRLFLWA

SEQ ID NO: 911724 - protein, 602 aa, Homo sapiens; identical to SEQ ID NO: 911712

SEQ ID NO: 911725 - protein, 548 aa, Homo sapiens
MARLTKRRQADTKAIQHLWAAIEIIRNQKQIANIDRITKYMSRVHGMHPKETTRQLSLAVKDGLIVETLTVGCKGSKAGIEQEGYWLPGDEISIKKKNTNKQEMGTYLRFIVSRMKERAIDLNKKGKDNKHPMYRRLVHSAVDVPTIQEKVNEGKYRSYEEFKADAQLLLHNTVIFYGADSEQADIARMLYKDTCHELDELQLCKNCFYLSNARPDNWFCYPCIPNHELVWAKMKGFGFWPAKVMQKEDNQVDVRFFGHHHQRAWIPSENIQDITVNIHRLHVKRSMGWKKACDELELHQRFLREGRFWKSKNEDRGEEEAESSISSTSNEQLKVTQEPRAKKGRRNQSVEPKKEEPEPETEAVSSSQEIPTMPQPIEKVSVSTQTKKLSASSPRMLHRSTQTTNDGVCQSMCHDKYTKIFNDFKDRMKSDHKRETERVVREALEKLRSEMEEEKRQAVNKAVANMQGEMDRKCKQVKEKCKEEFVEEIKKLATQHKQLISQTKKKQWCYNCEEEAMYHCCWNTSYCSIKCQQEHWHAEHKRTCRRKR

SEQ ID NO: 911726 - protein, 585 aa, Homo sapiens; identical to SEQ ID NO: 911711

SEQ ID NO: 911727 - protein, 568 aa, Homo sapiens
MARLTKRRQADTKAIQHLWAAIEIIRNQKQIANIDRITKYMSRVHGMHPKETTRQLSLAVKDGLIVETLTVGCKGSKAGIEQEGYWLPGDEIDWETENHDWYCFECHLPGEVLICDLCFRVYHSKCLSDEFRLRDSSSPWQCPVCRSIKKKNTNKQEMGTYLRFIVSRMKERAIDLNKKGKDNKHPMYRRLVHSAVDVPTIQEKVNEGKYRSYEEFKADAQLLLHNTVIFYGADSEQADIARMLYKDTCHELDELQLCKNCFYLSNARPDNWFCYPCIPNHELVWAKMKGFGFWPAKVMQKEDNQVDVRFFGHHHQRAWIPSENIQDITVNIHRLHVKRSMGWKKACDELELHQRFLREGRFWKSKNEDRGEEEAESSISSTSNEQLKVTQEPRAKKGRRNQSVEPKKEEPEPETEAVSSSQEIPTMPQPIEKVSVSTQTKKLSASSPRMLHRSTQTTNDGVCQSMCHDKYTKIFNDFKDRMKSDHKRETERVVREALEKLRSEMEEEKRQAVNKAVANMQGEMDRKCKQVKEKCKEEFVEEIKKLATQHKQLISQTKKKQWVNTSLF

SEQ ID NO: 911728 - protein, 634 aa, Homo sapiens
MDNRKEPPFFNDDNMGPFYYRLHFCDTMELFIETLTGTCFELRVSPFETVISVKAKIRRLEGIPICRQHLIWNNMELENDYCLNDYNISEGCTLKLVLAMRGGPINTRRVPTDDPLRKMAEYLDSSRVEVWEKTSCSKQVTFLVYQEGDQLNFFPAVDRGDGTLTPLSDSSKKIDFHLHVLRRKGEHRMSGGSMYNSDTDEDEETEPSSSGQQIIENSITMNKMKLLKAKMKNMNLSKKPKKAVKIKPHPPVAPRPSSGSTAPSRHRLLRVLPNIGQSCSPAFGNAYPPEISRNGISSLATQLSAERYISSITGEFLKEDNSWENNTLSHFSSNVKLPPQIPHLELGNDQELADSVLHLGSSLPRQTKHFLGNLPSSNGNIVLPSEECVTEQSLLPKVGSLASFAEGNADEQSSGLEGACKVNLELLLTNADKGLKAPEQHLKHVAGVLNGESVETSVLNYRELSPHKNRLLSPLRCSAPMSLHNSLVKPERQSKCFEFGKLQPSSSQSLDVQNITDSSFSRTTCFQGVKVDSLGKRSDVISKVEARDITEMTNKASKEPVGCVNNISFLASLAGSTSRNRLQSTRGAGRLQNSGTGLSTNLQHFQEENFRKSSPQLEHTGVFLENVLLITSHL

SEQ ID NO: 911729 - protein, 761 aa, Homo sapiens
MDNRKEPPFFNDDNMGPFYYRLHFCDTMELFIETLTGTCFELRVSPFETVISVKAKIRRLEDPGDPTEVSGWPSPVTTSAHSVMTLEAFVCPKRFGIPICRQHLIWNNMELENDYCLNDYNISEGCTLKLVLAMRGGPINTRRVPTDDPLRKMAEYLDSSRVEVWEKTSCSKQVTFLVYQEGDQLNFFPAVDRGDGTLTPLSDSSKKIDFHLHVLRRKGEHRMSGGSMYNSDTDEDEETEPSSSGQQIIENSITMNKMKLLKAKMKNMNLSKKPKKAVKIKPHPPVAPRPSSGSTAPSRHRLLRVLPNIGQSCSPAFGNAYPPEISRNGISSLATQLSAERYISSITGEFLKEDNSWENNTLSHFSSNVKLPPQIPHLELGNDQELADSVLHLGSSLPRQTKHFLGNLPSSNGNIVLPSEECVTEQSLLPKVGSLASFAEGNADEQSSGLEGACKVNLELLLTNADKGLKAPEQHLKHVAGVLNGESVETSVLNYRELSPHKNRLLSPLRCSAPMSLHNSLVKPERQSKCFEFGKLQPSSSQSLDVQNITDSSFSRTTCFQGVKVDSLGKRSDVISKVEARDITEMTNKASKEPVGCVNNISFLASLAGSTSRNRLQSTRGAGRLQNSGTGLSTNLQHFQEENFRKSSPQLEHTGVFLSTHGVGMNGNNAAAGKSVGECTTHHLPPVKAPLQTKKKTTNHCFLCGKKTGLASSYECRCGNNFCASHRYAETHGCTYDYKSAGRRYLHEANPVVNAPKLPKI

SEQ ID NO: 911730 - protein, 813 aa, Homo sapiens
IGRWCHKGAGRGGSGALSASAFREVARRVVGPCRPVGGRASQRTRLRVQNSKHEQQYILPIFKPGLPRTGIQLPATYFRRTRKVKVMDNRKEPPFFNDDNMGPFYYRLHFCDTMELFIETLTGTCFELRVSPFETVISVKAKIRRLEGIPICRQHLIWNNMELENDYCLNDYNISEGCTLKLVLAMRGGPINTRRVPTDDPLRKMAEYLDSSRVEVWEKTSCSKQVTFLVYQEGDQLNFFPAVDRGDGTLTPLSDSSKKIDFHLHVLRRKGEHRMSGGSMYNSDTDEDEETEPSSSGQQIIENSITMNKMKLLKAKMKNMNLSKKPKKAVKIKPHPPVAPRPSSGSTAPSRHRLLRVLPNIGQSCSPAFGNAYPPEISRNGISSLATQLSAERYISSITGEFLKEDNSWENNTLSHFSSNVKLPPQIPHLELGNDQELADSVLHLGSSLPRQTKHFLGNLPSSNGNIVLPSEECVTEQSLLPKVGSLASFAEGNADEQSSGLEGACKVNLELLLTNADKGLKAPEQHLKHVAGVLNGESVETSVLNYRELSPHKNRLLSPLRCSAPMSLHNSLVKPERQSKCFEFGKLQPSSSQSLDVQNITDSSFSRTTCFQGVKVDSLGKRSDVISKVEARDITEMTNKASKEPVGCVNNISFLASLAGSTSRNRLQSTRGAGRLQNSGTGLSTNLQHFQEENFRKSSPQLEHTGVFLSTHGVGMNGNNAAAGKSVGECTTHHLPPVKAPLQTKKKTTNHCFLCGKKTGLASSYECRCGNNFCASHRYAETHGCTYDYKSAGRRYLHEANPVVNAPKLPKI

SEQ ID NO: 911731 - protein, 727 aa, Homo sapiens; identical to SEQ ID NO: 911714

SEQ ID NO: 911732 - protein, 250 aa, Homo sapiens
MDNRKEPPFFNDDNMGPFYYRLHFCDTMELFIETLTGTCFELRVSPFETVISVKAKIRRLEGIPICRQHLIWNNMELENDYCLNDYNISEGCTLKLVLAMRGGPINTRRVPTDDPLRKMAEYLDSSRVEVWEKTSCSKQVTFLVYQEGDQLNFFPAVDRGDGTLTPLSDSSKKIDFHLHVLRRKGEHRMSGGSMYNSDTDEDEETEPSSSGQQIIENSITMNKMKLLKAKMKNMNLSKKVKLLAFDQAYL

SEQ ID NO: 911733 - protein, 1884 aa, Homo sapiens
GCLCCSSEQLQELPSRELQDAFPVPLAQLPQQTTEKTVTMGDVKLVASSHISKTSLSVDPSRVDSMPLTEAPAFILPPRNLCIKEGATAKFEGRVRGYPEPQVTWHRNGQPITSGGRFLLDCGIRGTFSLVIHAVHEEDRGKYTCEATNGSGARQVTVELTVEGSFAKQLGQPVVSKTLGDRFSASAVETRPSIWGECPPKFATKLGRVVVKEGQMGRFSCKITGRPQPQVTWLKGNVPLQPSARVSVSEKNGMQVLEIHGVNQDDVGVYTCLVVNGSGKASMSAELSIQGLDSANRSFVRETKATNSDVRKEVTNVISKESKLDSLEAAAKSKNCSSPQRGGSPPWAANSQPQPPRESKLESCKDSPRTAPQTPVLQKTSSSITLQAARVQPEPRAPGLGVLSPSGEERKRPAPPRPATFPTRQPGLGSQDVVSKAANRRIPMEGQRDSAFPKFESKPQSQEVKENQTVKFRCEGLAVMEVAPSFSSVLKDCAVIEGQDFVLQCSVRGTPVPRITWLLNGQPIQYARSTCEAGVAELHIQDALPEDHGTYTCLAENALGQVSCSAWVTVHEKKSSRKSEYLLPVAPSKPTAPIFLQGLSDLKVMDGSQVTMTVQVSGNPPPEVIWLHNGNEIQESEDFHFEQRGTQHSLWIQEVFPEDTGTYTCEAWNSAGEVRTQAVLTVQEPHDGTQPWFISKPRSVTASLGQSVLISCAIAGDPFPTVHWLRDGKALCKDTGHFEVLQNEDVFTLVLKKVQPWHAGQYEILLKNRVGECSCQVSLMLQNSSARALPRGREPASCEDLCGGGVGADGGGSDRYGSLRPGWPARGQGWLEEEDGEDVRGVLKRRVETRQHTEEAIRQQEVEQLDFRDLLGKKVSTKTLSEDDLKEIPAEQMDFRANLQRQVKPKTVSEEERKVHSPQQVDFRSVLAKKGTSKTPVPEKVPPPKPATPDFRSVLGGKKKLPAENGSSSAETLNAKAVESSKPLSNAQPSGPLKPVGNAKPAETLKPMGNAKPAETLKPMGNAKPDENLKSASKEELKKDVKNDVNCKRGHAGTTDNEKRSESQGTAPAFKQKLQDVHVAEGKKLLLQCQVSSDPPATIIWTLNGKTLKTTKFIILSQEGSLCSVSIEKALPEDRGLYKCVAKNDAGQAECSCQVTVDDAPASENTKAPEMKSRRPKSSLPPVLGTESDATVKKKPAPKTPPKAAMPPQIIQFPEDQKVRAGESVELFGKVTGTQPITCTWMKFRKQIQESEHMKVENSENGSKLTILAARQEHCGCYTLLVENKLGSRQAQVNLTVVDKPDPPAGTPCASDIRSSSLTLSWYGSSYDGGSAVQSYSIEIWDSANKTWKELATCRSTSFNVQDLLPDHEYKFRVRAINVYGTSEPSQESELTTVGEKPEEPKDEVEVSDDDEKEPEVDYRTVTINTEQKVSDFYDIEERLGSGKFGQVFRLVEKKTRKVWAGKFFKAYSAKEKENIRQEISIMNCLHHPKLVQCVDAFEEKANIVMVLEIVSGGELFERIIDEDFELTERECIKYMRQISEGVEYIHKQGIVHLDLKPENIMCVNKTGTRIKLIDFGLARRLENAGSLKVLFGTPEFVAPEVINYEPIGYATDMWSIGVICYILVSGLSPFMGDNDNETLANVTSATWDFDDEAFDEISDDAKDFISNLLKKDMKNRLDCTQCLQHPWLMKDTKNMEAKKLSKDRMKKYMARRKWQKTGNAVRAIGRLSSMAMISGLSGRKSSTGSPTSPLNAEKLESEEDVSQAFLEAVAEEKPHVKPYFSKTIRDLEVVEGSAARFDCKIEGYPDPEVVWFKDDQSIRESRHFQIDYDEDGNCSLIISDVCGDDDAKYTCKAVNSLGEATCTAELIVETMEEGEGEGEEEEE

SEQ ID NO: 911734 - protein, 1833 aa, Homo sapiens
GCLCCSSEQLQELPSRELQDAFPVPLAQLPQQTTEKTVTMGDVKLVASSHISKTSLSVDPSRVDSMPLTEAPAFILPPRNLCIKEGATAKFEGRVRGYPEPQVTWHRNGQPITSGGRFLLDCGIRGTFSLVIHAVHEEDRGKYTCEATNGSGARQVTVELTVEGSFAKQLGQPVVSKTLGDRFSASAVETRPSIWGECPPKFATKLGRVVVKEGQMGRFSCKITGRPQPQVTWLKGNVPLQPSARVSVSEKNGMQVLEIHGVNQDDVGVYTCLVVNGSGKASMSAELSIQGLDSANRSFVRETKATNSDVRKEVTNVISKESKLDSLEAAAKSKNCSSPQRGGSPPWAANSQPQPPRESKLESCKDSPRTAPQTPVLQKTSSSITLQAARVQPEPRAPGLGVLSPSGEERKRPAPPRPATFPTRQPGLGSQDVVSKAANRRIPMEGQRDSAFPKFESKPQSQEVKENQTVKFRCEGLAVMEVAPSFSSVLKDCAVIEGQDFVLQCSVRGTPVPRITWLLNGQPIQYARSTCEAGVAELHIQDALPEDHGTYTCLAENALGQVSCSAWVTVHEKKSSRKSEYLLPVAPSKPTAPIFLQGLSDLKVMDGSQVTMTVQVSGNPPPEVIWLHNGNEIQESEDFHFEQRGTQHSLWIQEVFPEDTGTYTCEAWNSAGEVRTQAVLTVQEPHDGTQPWFISKPRSVTASLGQSVLISCAIAGDPFPTVHWLRDGKALCKDTGHFEVLQNEDVFTLVLKKVQPWHAGQYEILLKNRVGECSCQVSLMLQNSSARALPRGREPASCEDLCGGGVGADGGGSDRYGSLRPGWPARGQGWLEEEDGEDVRGVLKRRVETRQHTEEAIRQQEVEQLDFRDLLGKKVSTKTLSEDDLKEIPAEQMDFRANLQRQVKPKTVSEEERKVHSPQQVDFRSVLAKKGTSKTPVPEKVPPPKPATPDFRSVLGGKKKLPAENGSSSAETLNAKAVESSKPLSNAQPSGPLKPVGNAKPAETLKPMGNAKPAETLKPMGNAKPDENLKSASKEELKKDVKNDVNCKRGHAGTTDNEKRSESQGTAPAFKQKLQDVHVAEGKKLLLQCQVSSDPPATIIWTLNGKTLKTTKFIILSQEGSLCSVSIEKALPEDRGLYKCVAKNDAGQAECSCQVTVDDAPASENTKAPEMKSRRPKSSLPPVLGTESDATVKKKPAPKTPPKAAMPPQIIQFPEDQKVRAGESVELFGKVTGTQPITCTWMKFRKQIQESEHMKVENSENGSKLTILAARQEHCGCYTLLVENKLGSRQAQVNLTVVDKPDPPAGTPCASDIRSSSLTLSWYGSSYDGGSAVQSYSIEIWDSANKTWKELATCRSTSFNVQDLLPDHEYKFRVRAINVYGTSEPSQESELTTVGEKPEEPKDEVEVSDDDEKEPEVDYRTVTINTEQKVSDFYDIEERLGSGKFGQVFRLVEKKTRKVWAGKFFKAYSAKEKENIRQEISIMNCLHHPKLVQCVDAFEEKANIVMVLEIVSGGELFERIIDEDFELTERECIKYMRQISEGVEYIHKQGIVHLDLKPENIMCVNKTGTRIKLIDFGLARRLENAGSLKVLFGTPEFVAPEVINYEPIGYATDMWSIGVICYILNRLDCTQCLQHPWLMKDTKNMEAKKLSKDRMKKYMARRKWQKTGNAVRAIGRLSSMAMISGLSGRKSSTGSPTSPLNAEKLESEEDVSQAFLEAVAEEKPHVKPYFSKTIRDLEVVEGSAARFDCKIEGYPDPEVVWFKDDQSIRESRHFQIDYDEDGNCSLIISDVCGDDDAKYTCKAVNSLGEATCTAELIVETMEEGEGEGEEEEE

SEQ ID NO: 911735 - protein, 115 aa, Homo sapiens
TLTVLSRARLGSLLWQNLGSQEVLVPGNSCFSGAGLYSLQPLALPSWNQGQRLSPTLVSIFQKTGNAVRAIGRLSSMAMISGLSGRKSSTGSPTSPLNAEKLESEGKEVCPSQLV

SEQ ID NO: 911736 - protein, 75 aa, Homo sapiens
SVPTVDDAPASENTKAPEMKSRRPKSSLPPVLGTESDATVKKKPAPKTPPKAGNWPRHYLGSKKSSTMGVLPLPC

SEQ ID NO: 911737 - protein, 1676 aa, Homo sapiens
MIILFSPLLTHPTPTLTTNRSFVRETKATNSDVRKEVTNVISKESKLDSLEAAAKSKNCSSPQRGGSPPWAANSQPQPPRESKLESCKDSPRTAPQTPVLQKTSSSITLQAARVQPEPRAPGLGVLSPSGEERKRPAPPRPATFPTRQPGLGSQDVVSKAANRRIPMEGQRDSAFPKFESKPQSQEVKENQTVKFRCEVSGIPKPEVAWFLEGTPVRRQEGSIEVYEDAGSHYLCLLKARTRDSGTYSCTASNAQGQVSCSWTLQVERLAVMEVAPSFSSVLKDCAVIEGQDFVLQCSVRGTPVPRITWLLNGQPIQYARSTCEAGVAELHIQDALPEDHGTYTCLAENALGQVSCSAWVTVHEKKSSRKSEYLLPVAPSKPTAPIFLQGLSDLKVMDGSQVTMTVQVSGNPPPEVIWLHNGNEIQESEDFHFEQRGTQHSLWIQEVFPEDTGTYTCEAWNSAGEVRTQAVLTVQEPHDGTQPWFISKPRSVTASLGQSVLISCAIAGDPFPTVHWLRDGKALCKDTGHFEVLQNEDVFTLVLKKVQPWHAGQYEILLKNRVGECSCQVSLMLQNSSARALPRGREPASCEDLCGGGVGADGGGSDRYGSLRPGWPARGQGWLEEEDGEDVRGVLKRRVETRQHTEEAIRQQEVEQLDFRDLLGKKVSTKTLSEDDLKEIPAEQMDFRANLQRQVKPKTVSEEERKVHSPQQVDFRSVLAKKGTSKTPVPEKVPPPKPATPDFRSVLGGKKKLPAENGSSSAETLNAKAVESSKPLSNAQPSGPLKPVGNAKPAETLKPMGNAKPAETLKPMGNAKPDENLKSASKEELKKDVKNDVNCKRGHAGTTDNEKRSESQGTAPAFKQKLQDVHVAEGKKLLLQCQVSSDPPATIIWTLNGKTLKTTKFIILSQEGSLCSVSIEKALPEDRGLYKCVAKNDAGQAECSCQVTVDDAPASENTKAPEMKSRRPKSSLPPVLGTESDATVKKKPAPKTPPKAAMPPQIIQFPEDQKVRAGESVELFGKVTGTQPITCTWMKFRKQIQESEHMKVENSENGSKLTILAARQEHCGCYTLLVENKLGSRQAQVNLTVVDKPDPPAGTPCASDIRSSSLTLSWYGSSYDGGSAVQSYSIEIWDSANKTWKELATCRSTSFNVQDLLPDHEYKFRVRAINVYGTSEPSQESELTTVGEKPEEPKDEVEVSDDDEKEPEVDYRTVTINTEQKVSDFYDIEERLGSGKFGQVFRLVEKKTRKVWAGKFFKAYSAKEKENIRQEISIMNCLHHPKLVQCVDAFEEKANIVMVLEIVSGGELFERIIDEDFELTERECIKYMRQISEGVEYIHKQGIVHLDLKPENIMCVNKTGTRIKLIDFGLARRLENAGSLKVLFGTPEFVAPEVINYEPIGYATDMWSIGVICYILVSGLSPFMGDNDNETLANVTSATWDFDDEAFDEISDDAKDFISNLLKKDMKNRLDCTQCLQHPWLMKDTKNMEAKKLSKDRMKKYMARRKWQKTGNAVRAIGRLSSMAMISGLSGRKSSTGSPTSPLNAEKLESEEDVSQAFLEAVAEEKPHVKPYFSKTIRDLEVVEGSAARFDCKIEGYPDPEVVWFKDDQSIRESRHFQIDYDEDGNCSLIISDVCGDDDAKYTCKAVNSLGEATCTAELIVETMEEGEGEGEEEEE

SEQ ID NO: 911738 - protein, 1608 aa, Homo sapiens
MIILFSPLLTHPTPTLTTNRSFVRETKATNSDVRKEVTNVISKESKLDSLEAAAKSKNCSSPQRGGSPPWAANSQPQPPRESKLESCKDSPRTAPQTPVLQKTSSSITLQAARVQPEPRAPGLGVLSPSGEERKRPAPPRPATFPTRQPGLGSQDVVSKAANRRIPMEGQRDSAFPKFESKPQSQEVKENQTVKFRCEVSGIPKPEVAWFLEGTPVRRQEGSIEVYEDAGSHYLCLLKARTRDSGTYSCTASNAQGQVSCSWTLQVERLAVMEVAPSFSSVLKDCAVIEGQDFVLQCSVRGTPVPRITWLLNGQPIQYARSTCEAGVAELHIQDALPEDHGTYTCLAENALGQVSCSAWVTVHEKKSSRKSEYLLPVAPSKPTAPIFLQGLSDLKVMDGSQVTMTVQVSGNPPPEVIWLHNGNEIQESEDFHFEQRGTQHSLWIQEVFPEDTGTYTCEAWNSAGEVRTQAVLTVQEPHDGTQPWFISKPRSVTASLGQSVLISCAIAGDPFPTVHWLRDGKALCKDTGHFEVLQNEDVFTLVLKKVQPWHAGQYEILLKNRVGECSCQVSLMLQNSSARALPRGREPASCEDLCGGGVGADGGGSDRYGSLRPGWPARGQGWLEEEDGEDVRGVLKRRVETRQHTEEAIRQQEVEQLDFRDLLGKKVSTKTLSEDDLKEIPAEQMDFRANLQRQVKPKTVSEEERKVHSPQQVDFRSVLAKKGTSKTPVPEKVPPPKPATPDFRSVLGGKKKLPAENGSSSAETLNAKAVESSKPLSNAQPSGPLKPVGNAKPAETLKPMGNAKPAETLKPMGNAKPDENLKSASKEELKKDVKNDVNCKRGHAGTTDNEKRSESQGTAPAFKQKLQDVHVAEGKKLLLQCQVSSDPPATIIWTLNGKTLKTTKFIILSQEGSLCSVSIEKALPEDRGLYKCVAKNDAGQAECSCQVTVDDAPASENTKAPEMKSRRPKSSLPPVLGTESDATVKKKPAPKTPPKAAMPPQIIQFPEDQKVRAGESVELFGKVTGTQPITCTWMKFRKQIQESEHMKVENSENGSKLTILAARQEHCGCYTLLVENKLGSRQAQVNLTVVDKPDPPAGTPCASDIRSSSLTLSWYGSSYDGGSAVQSYSIEIWDSANKTWKELATCRSTSFNVQDLLPDHEYKFRVRAINVYGTSEPSQESELTTVGEKPEEPKDEVEVSDDDEKEPEVDYRTVTINTEQKVSDFYDIEERLGSVSGGELFERIIDEDFELTERECIKYMRQISEGVEYIHKQGIVHLDLKPENIMCVNKTGTRIKLIDFGLARRLENAGSLKVLFGTPEFVAPEVINYEPIGYATDMWSIGVICYILVSGLSPFMGDNDNETLANVTSATWDFDDEAFDEISDDAKDFISNLLKKDMKNRLDCTQCLQHPWLMKDTKNMEAKKLSKDRMKKYMARRKWQKTGNAVRAIGRLSSMAMISGLSGRKSSTGSPTSPLNAEKLESEEDVSQAFLEAVAEEKPHVKPYFSKTIRDLEVVEGSAARFDCKIEGYPDPEVVWFKDDQSIRESRHFQIDYDEDGNCSLIISDVCGDDDAKYTCKAVNSLGEATCTAELIVETMEEGEGEGEEEEE

SEQ ID NO: 911739 - protein, 615 aa, Homo sapiens
DLHVDWKTSKKKRGGLFVEQIIIHGAFRTDKPDPPAGTPCASDIRSSSLTLSWYGSSYDGGSAVQSYSIEIWDSANKTWKELATCRSTSFNVQDLLPDHEYKFRVRAINVYGTSEPSQESELTTVGEKPEEPKDEVEVSDDDEKEPEVDYRTVTINTEQKVSDFYDIEERLGSGKFGQVFRLVEKKTRKVWAGKFFKAYSAKEKENIRQEISIMNCLHHPKLVQCVDAFEEKANIVMVLEIVSGGELFERIIDEDFELTERECIKYMRQISEGVEYIHKQGIVHLDLKPENIMCVNKTGTRIKLIDFGLARRLENAGSLKVLFGTPEFVAPEVINYEPIGYATDMWSIGVICYILVSGLSPFMGDNDNETLANVTSATWDFDDEAFDEISDDAKDFISNLLKKDMKNRLDCTQCLQHPWLMKDTKNMEAKKLSKDRMKKYMARRKWQKTGNAVRAIGRLSSMAMISGLSGRKSSTGSPTSPLNAEKLESEEDVSQAFLEAVAEEKPHVKPYFSKTIRDLEVVEGSAARFDCKIEGYPDPEVVWFKDDQSIRESRHFQIDYDEDGNCSLIISDVCGDDDAKYTCKAVNSLGEATCTAELIVETMEEGEGEGEEEEE

SEQ ID NO: 911740 - protein, 402 aa, Homo sapiens
MNCLHHPKLVQCVDAFEEKANIVMVLEIVSGGELFERIIDEDFELTERECIKYMRQISEGVEYIHKQGIVHLDLKPENIMCVNKTGTRIKLIDFGLARRLENAGSLKVLFGTPEFVAPEVINYEPIGYATDMWSIGVICYILVSGLSPFMGDNDNETLANVTSATWDFDDEAFDEISDDAKDFISNLLKKDMKNRLDCTQCLQHPWLMKDTKNMEAKKLSKDRMKKYMARRKWQKTGNAVRAIGRLSSMAMISGLSGRKSSTGSPTSPLNAEKLESEEDVSQAFLEAVAEEKPHVKPYFSKTIRDLEVVEGSAARFDCKIEGYPDPEVVWFKDDQSIRESRHFQIDYDEDGNCSLIISDVCGDDDAKYTCKAVNSLGEATCTAELIVETMEEGEGEGEEEEE

SEQ ID NO: 911741 - protein, 499 aa, Homo sapiens
EPAPLIRHNGRRETEEPKDEVEVSDDEKEPEVDYRTVTINTEQKVSDFYDIEERLGSGKFGQVFRLVEKKTRKVWAGKFFKAYSAKEKENIRQEISIMNCLHHPKLVQCVDAFEEKANIVMVLEIVSGGELFERIIDEDFELTERECIKYMRQISEGVEYIHKQGIVHLDLKPENIMCVNKTGTRIKLIDFGLARRLENAGSLKVLFGTPEFVAPEVINYEPIGYATDMWSIGVICYILVSGLSPFMGDNDNETLANVTSATWDFDDEAFDEISDDAKDFISNLLKKDMKNRLDCTQCLQHPWLMKDTKNMEAKKLSKDRMKKYMARRKWQKTGNAVRAIGRLSSMAMISGLSGRKSSTGSPTSPLNAEKLESEEDVSQAFLEAVAEEKPHVKPYFSKTIRDLEVVEGSAARFDCKIEGYPDPEVVWFKDDQSIRESRHFQIDYDEDGNCSLIISDVCGDDDAKYTCKAVNSLGEATCTAELIVETMEEGEGEGEEEEE

SEQ ID NO: 911742 - protein, 961 aa, Homo sapiens
MIILFSPLLTHPTPTLTTNRSFVRETKATNSDVRKEVTNVISKESKLDSLEAAAKSKNCSSPQRGGSPPWAANSQPQPPRESKLESCKDSPRTAPQTPVLQKTSSSITLQAARVQPEPRAPGLGVLSPSGEERKRPAPPRPATFPTRQPGLGSQDVVSKAANRRIPMEGQRDSAFPKFESKPQSQEVKENQTVKFRCEVSGIPKPEVAWFLEGTPVRRQEGSIEVYEDAGSHYLCLLKARTRDSGTYSCTASNAQGQVSCSWTLQVERLAVMEVAPSFSSVLKDCAVIEGQDFVLQCSVRGTPVPRITWLLNGQPIQYARSTCEAGVAELHIQDALPEDHGTYTCLAENALGQVSCSAWVTVHEKKSSRKSEYLLPVAPSKPTAPIFLQGLSDLKVMDGSQVTMTVQVSGNPPPEVIWLHNGNEIQESEDFHFEQRGTQHSLWIQEVFPEDTGTYTCEAWNSAGEVRTQAVLTVQEPHDGTQPWFISKPRSVTASLGQSVLISCAIAGDPFPTVHWLRDGKALCKDTGHFEVLQNEDVFTLVLKKVQPWHAGQYEILLKNRVGECSCQVSLMLQNSSARALPRGREPASCEDLCGGGVGADGGGSDRYGSLRPGWPARGQGWLEEEDGEDVRGVLKRRVETRQHTEEAIRQQEVEQLDFRDLLGKKVSTKTLSEDDLKEIPAEQMDFRANLQRQVKPKTVSEEERKVHSPQQVDFRSVLAKKGTSKTPVPEKVPPPKPATPDFRSVLGGKKKLPAENGSSSAETLNAKAVESSKPLSNAQPSGPLKPVGNAKPAETLKPMGNAKPAETLKPMGNAKPDENLKSASKEELKKDVKNDVNCKRGHAGTTDNEKRSESQGTAPAFKQKLQDVHVAEGKKLLLQCQVSSDPPATIIWTLNGKTLKTTKFIILSQEGSLCSVSIEKALPEDRGLYKCVAKNDAGQAECSCQVTVDDFANGSKLGSY

SEQ ID NO: 911743 - protein, 951 aa, Homo sapiens
MIILFSPLLTHPTPTLTTNRSFVRETKATNSDVRKEVTNVISKESKLDSLEAAAKSKNCSSPQRGGSPPWAANSQPQPPRESKLESCKDSPRTAPQTPVLQKTSSSITLQAARVQPEPRAPGLGVLSPSGEERKRPAPPRPATFPTRQPGLGSQDVVSKAANRRIPMEGQRDSAFPKFESKPQSQEVKENQTVKFRCEVSGIPKPEVAWFLEGTPVRRQEGSIEVYEDAGSHYLCLLKARTRDSGTYSCTASNAQGQVSCSWTLQVERLAVMEVAPSFSSVLKDCAVIEGQDFVLQCSVRGTPVPRITWLLNGQPIQYARSTCEAGVAELHIQDALPEDHGTYTCLAENALGQVSCSAWVTVHEKKSSRKSEYLLPVAPSKPTAPIFLQGLSDLKVMDGSQVTMTVQVSGNPPPEVIWLHNGNEIQESEDFHFEQRGTQHSLWIQEVFPEDTGTYTCEAWNSAGEVRTQAVLTVQEPHDGTQPWFISKPRSVTASLGQSVLISCAIAGDPFPTVHWLRDGKALCKDTGHFEVLQNEDVFTLVLKKVQPWHAGQYEILLKNRVGECSCQVSLMLQNSSARALPRGREPASCEDLCGGGVGADGGGSDRYGSLRPGWPARGQGWLEEEDGEDVRGVLKRRVETRQHTEEAIRQQEVEQLDFRDLLGKKVSTKTLSEDDLKEIPAEQMDFRANLQRQVKPKTVSEEERKVHSPQQVDFRSVLAKKGTSKTPVPEKVPPPKPATPDFRSVLGGKKKLPAENGSSSAETLNAKAVESSKPLSNAQPSGPLKPVGNAKPAETLKPMGNAKPAETLKPMGNAKPDENLKSASKEELKKDVKNDVNCKRGHAGTTDNEKRSESQGTAPAFKQKLQDVHVAEGKKLLLQCQVSSDPPATIIWTLNGKTLKTTKFIILSQEGSLCSVSIEKALPEDRGLYKCVAKNDAGQAECSCQVTVDG

SEQ ID NO: 911744 - protein, 76 aa, Homo sapiens
MASNVIRMPETLLPRSLSPCPPSAMPPQIIQFPEDQKVRAGESVELFGKVTGTQPITCTWMKFRKQVSDGMGWALG

SEQ ID NO: 911745 - protein, 1953 aa, Homo sapiens
GCLCCSSEQLQELPSRELQDAFPVPLAQLPQQTTEKTVTMGDVKLVASSHISKTSLSVDPSRVDSMPLTEAPAFILPPRNLCIKEGATAKFEGRVRGYPEPQVTWHRNGQPITSGGRFLLDCGIRGTFSLVIHAVHEEDRGKYTCEATNGSGARQVTVELTVEGSFAKQLGQPVVSKTLGDRFSASAVETRPSIWGECPPKFATKLGRVVVKEGQMGRFSCKITGRPQPQVTWLKGNVPLQPSARVSVSEKNGMQVLEIHGVNQDDVGVYTCLVVNGSGKASMSAELSIQGLDSANRSFVRETKATNSDVRKEVTNVISKESKLDSLEAAAKSKNCSSPQRGGSPPWAANSQPQPPRESKLESCKDSPRTAPQTPVLQKTSSSITLQAARVQPEPRAPGLGVLSPSGEERKRPAPPRPATFPTRQPGLGSQDVVSKAANRRIPMEGQRDSAFPKFESKPQSQEVKENQTVKFRCEVSGIPKPEVAWFLEGTPVRRQEGSIEVYEDAGSHYLCLLKARTRDSGTYSCTASNAQGQVSCSWTLQVERLAVMEVAPSFSSVLKDCAVIEGQDFVLQCSVRGTPVPRITWLLNGQPIQYARSTCEAGVAELHIQDALPEDHGTYTCLAENALGQVSCSAWVTVHEKKSSRKSEYLLPVAPSKPTAPIFLQGLSDLKVMDGSQVTMTVQVSGNPPPEVIWLHNGNEIQESEDFHFEQRGTQHSLWIQEVFPEDTGTYTCEAWNSAGEVRTQAVLTVQEPHDGTQPWFISKPRSVTASLGQSVLISCAIAGDPFPTVHWLRDGKALCKDTGHFEVLQNEDVFTLVLKKVQPWHAGQYEILLKNRVGECSCQVSLMLQNSSARALPRGREPASCEDLCGGGVGADGGGSDRYGSLRPGWPARGQGWLEEEDGEDVRGVLKRRVETRQHTEEAIRQQEVEQLDFRDLLGKKVSTKTLSEDDLKEIPAEQMDFRANLQRQVKPKTVSEEERKVHSPQQVDFRSVLAKKGTSKTPVPEKVPPPKPATPDFRSVLGGKKKLPAENGSSSAETLNAKAVESSKPLSNAQPSGPLKPVGNAKPAETLKPMGNAKPAETLKPMGNAKPDENLKSASKEELKKDVKNDVNCKRGHAGTTDNEKRSESQGTAPAFKQKLQDVHVAEGKKLLLQCQVSSDPPATIIWTLNGKTLKTTKFIILSQEGSLCSVSIEKALPEDRGLYKCVAKNDAGQAECSCQVTVDDAPASENTKAPEMKSRRPKSSLPPVLGTESDATVKKKPAPKTPPKAAMPPQIIQFPEDQKVRAGESVELFGKVTGTQPITCTWMKFRKQIQESEHMKVENSENGSKLTILAARQEHCGCYTLLVENKLGSRQAQVNLTVVDKPDPPAGTPCASDIRSSSLTLSWYGSSYDGGSAVQSYSIEIWDSANKTWKELATCRSTSFNVQDLLPDHEYKFRVRAINVYGTSEPSQESELTTVGEKPEEPKDEVEVSDDDEKEPEVDYRTVTINTEQKVSDFYDIEERLGSGKFGQVFRLVEKKTRKVWAGKFFKAYSAKEKENIRQEISIMNCLHHPKLVQCVDAFEEKANIVMVLEIVSGGELFERIIDEDFELTERECIKYMRQISEGVEYIHKQGIVHLDLKPENIMCVNKTGTRIKLIDFGLARRLENAGSLKVLFGTPEFVAPEVINYEPIGYATDMWSIGVICYILVSGLSPFMGDNDNETLANVTSATWDFDDEAFDEISDDAKDFISNLLKKDMKNRLDCTQCLQHPWLMKDTKNMEAKKLSKDRMKKYMARRKWQKTGNAVRAIGRLSSMAMISGLSGRKSSTGSPTSPLNAEKLESEEDVSQAFLEAVAEEKPHVKPYFSKTIRDLEVVEGSAARFDCKIEGYPDPEVVWFKDDQSIRESRHFQIDYDEDGNCSLIISDVCGDDDAKYTCKAVNSLGEATCTAELIVETMEEGEGEGEEEEE

SEQ ID NO: 911746 - protein, 1902 aa, Homo sapiens
GCLCCSSEQLQELPSRELQDAFPVPLAQLPQQTTEKTVTMGDVKLVASSHISKTSLSVDPSRVDSMPLTEAPAFILPPRNLCIKEGATAKFEGRVRGYPEPQVTWHRNGQPITSGGRFLLDCGIRGTFSLVIHAVHEEDRGKYTCEATNGSGARQVTVELTVEGSFAKQLGQPVVSKTLGDRFSASAVETRPSIWGECPPKFATKLGRVVVKEGQMGRFSCKITGRPQPQVTWLKGNVPLQPSARVSVSEKNGMQVLEIHGVNQDDVGVYTCLVVNGSGKASMSAELSIQGLDSANRSFVRETKATNSDVRKEVTNVISKESKLDSLEAAAKSKNCSSPQRGGSPPWAANSQPQPPRESKLESCKDSPRTAPQTPVLQKTSSSITLQAARVQPEPRAPGLGVLSPSGEERKRPAPPRPATFPTRQPGLGSQDVVSKAANRRIPMEGQRDSAFPKFESKPQSQEVKENQTVKFRCEVSGIPKPEVAWFLEGTPVRRQEGSIEVYEDAGSHYLCLLKARTRDSGTYSCTASNAQGQVSCSWTLQVERLAVMEVAPSFSSVLKDCAVIEGQDFVLQCSVRGTPVPRITWLLNGQPIQYARSTCEAGVAELHIQDALPEDHGTYTCLAENALGQVSCSAWVTVHEKKSSRKSEYLLPVAPSKPTAPIFLQGLSDLKVMDGSQVTMTVQVSGNPPPEVIWLHNGNEIQESEDFHFEQRGTQHSLWIQEVFPEDTGTYTCEAWNSAGEVRTQAVLTVQEPHDGTQPWFISKPRSVTASLGQSVLISCAIAGDPFPTVHWLRDGKALCKDTGHFEVLQNEDVFTLVLKKVQPWHAGQYEILLKNRVGECSCQVSLMLQNSSARALPRGREPASCEDLCGGGVGADGGGSDRYGSLRPGWPARGQGWLEEEDGEDVRGVLKRRVETRQHTEEAIRQQEVEQLDFRDLLGKKVSTKTLSEDDLKEIPAEQMDFRANLQRQVKPKTVSEEERKVHSPQQVDFRSVLAKKGTSKTPVPEKVPPPKPATPDFRSVLGGKKKLPAENGSSSAETLNAKAVESSKPLSNAQPSGPLKPVGNAKPAETLKPMGNAKPAETLKPMGNAKPDENLKSASKEELKKDVKNDVNCKRGHAGTTDNEKRSESQGTAPAFKQKLQDVHVAEGKKLLLQCQVSSDPPATIIWTLNGKTLKTTKFIILSQEGSLCSVSIEKALPEDRGLYKCVAKNDAGQAECSCQVTVDDAPASENTKAPEMKSRRPKSSLPPVLGTESDATVKKKPAPKTPPKAAMPPQIIQFPEDQKVRAGESVELFGKVTGTQPITCTWMKFRKQIQESEHMKVENSENGSKLTILAARQEHCGCYTLLVENKLGSRQAQVNLTVVDKPDPPAGTPCASDIRSSSLTLSWYGSSYDGGSAVQSYSIEIWDSANKTWKELATCRSTSFNVQDLLPDHEYKFRVRAINVYGTSEPSQESELTTVGEKPEEPKDEVEVSDDDEKEPEVDYRTVTINTEQKVSDFYDIEERLGSGKFGQVFRLVEKKTRKVWAGKFFKAYSAKEKENIRQEISIMNCLHHPKLVQCVDAFEEKANIVMVLEIVSGGELFERIIDEDFELTERECIKYMRQISEGVEYIHKQGIVHLDLKPENIMCVNKTGTRIKLIDFGLARRLENAGSLKVLFGTPEFVAPEVINYEPIGYATDMWSIGVICYILNRLDCTQCLQHPWLMKDTKNMEAKKLSKDRMKKYMARRKWQKTGNAVRAIGRLSSMAMISGLSGRKSSTGSPTSPLNAEKLESEEDVSQAFLEAVAEEKPHVKPYFSKTIRDLEVVEGSAARFDCKIEGYPDPEVVWFKDDQSIRESRHFQIDYDEDGNCSLIISDVCGDDDAKYTCKAVNSLGEATCTAELIVETMEEGEGEGEEEEE

SEQ ID NO: 911747 - protein, 350 aa, Homo sapiens
MIILFSPLLTHPTPTLTTNRSFVRETKATNSDVRKEVTNVISKESKLDSLEAAAKSKNCSSPQRGGSPPWAANSQPQPPRESKLESCKDSPRTAPQTPVLQKTSSSITLQAARVQPEPRAPGLGVLSPSGEERKRPAPPRPATFPTRQPGLGSQDVVSKAANRRIPMEGQRDSAFPKFESKPQSQEVKENQTVKFRCEGLAVMEVAPSFSSVLKDCAVIEGQDFVLQCSVRGTPVPRITWLLNGQPIQYARSTCEAGVAELHIQDALPEDHGTYTCLAENALGQVSCSAWVTVHEKKSSRKSEYLLPVAPSKPTAPIFLQGLSDLKVMDGSQVTMTVQVSGLSLQLSLGD

SEQ ID NO: 911748 - protein, 81 aa, Homo sapiens
VKAGPGESPWRRKAIPTSLWGNQKTQLRREAAPEGPSAGSLCSVSIEKALPEDRGLYKCVAKNDAGQAECSCQVTVDDAPA

SEQ ID NO: 911749 - protein, 915 aa, Homo sapiens
MSRLASGFQGSHQPLSNAQPSGPLKPVGNAKPAETLKPMGNAKPAETLKPMGNAKPDENLKSASKEELKKDVKNDVNCKRGHAGTTDNEKRSESQGTAPAFKQKLQDVHVAEGKKLLLQCQVSSDPPATIIWTLNGKTLKTTKFIILSQEGSLCSVSIEKALPEDRGLYKCVAKNDAGQAECSCQVTVDDAPASENTKAPEMKSRRPKSSLPPVLGTESDATVKKKPAPKTPPKAAMPPQIIQFPEDQKVRAGESVELFGKVTGTQPITCTWMKFRKQIQESEHMKVENSENGSKLTILAARQEHCGCYTLLVENKLGSRQAQVNLTVVDKPDPPAGTPCASDIRSSSLTLSWYGSSYDGGSAVQSYSIEIWDSANKTWKELATCRSTSFNVQDLLPDHEYKFRVRAINVYGTSEPSQESELTTVGEKPEEPKDEVEVSDDDEKEPEVDYRTVTINTEQKVSDFYDIEERLGSGKFGQVFRLVEKKTRKVWAGKFFKAYSAKEKENIRQEISIMNCLHHPKLVQCVDAFEEKANIVMVLEIVSGGELFERIIDEDFELTERECIKYMRQISEGVEYIHKQGIVHLDLKPENIMCVNKTGTRIKLIDFGLARRLENAGSLKVLFGTPEFVAPEVINYEPIGYATDMWSIGVICYILVSGLSPFMGDNDNETLANVTSATWDFDDEAFDEISDDAKDFISNLLKKDMKNRLDCTQCLQHPWLMKDTKNMEAKKLSKDRMKKYMARRKWQKTGNAVRAIGRLSSMAMISGLSGRKSSTGSPTSPLNAEKLESEEDVSQAFLEAVAEEKPHVKPYFSKTIRDLEVVEGSAARFDCKIEGYPDPEVVWFKDDQSIRESRHFQIDYDEDGNCSLIISDVCGDDDAKYTCKAVNSLGEATCTAELIVETMEEGEGEGEEEEE

SEQ ID NO: 911750 - protein, 737 aa, Homo sapiens
ERGPCGRLPRGDAPASENTKAPEMKSRRPKSSLPPVLGTESDATVKKKPAPKTPPKAAMPPQIIQFPEDQKVRAGESVELFGKVTGTQPITCTWMKFRKQIQESEHMKVENSENGSKLTILAARQEHCGCYTLLVENKLGSRQAQVNLTVVDKPDPPAGTPCASDIRSSSLTLSWYGSSYDGGSAVQSYSIEIWDSANKTWKELATCRSTSFNVQDLLPDHEYKFRVRAINVYGTSEPSQESELTTVGEKPEEPKDEVEVSDDDEKEPEVDYRTVTINTEQKVSDFYDIEERLGSGKFGQVFRLVEKKTRKVWAGKFFKAYSAKEKENIRQEISIMNCLHHPKLVQCVDAFEEKANIVMVLEIVSGGELFERIIDEDFELTERECIKYMRQISEGVEYIHKQGIVHLDLKPENIMCVNKTGTRIKLIDFGLARRLENAGSLKVLFGTPEFVAPEVINYEPIGYATDMWSIGVICYILVSGLSPFMGDNDNETLANVTSATWDFDDEAFDEISDDAKDFISNLLKKDMKNRLDCTQCLQHPWLMKDTKNMEAKKLSKDRMKKYMARRKWQKTGNAVRAIGRLSSMAMISGLSGRKSSTGSPTSPLNAEKLESEEDVSQAFLEAVAEEKPHVKPYFSKTIRDLEVVEGSAARFDCKIEGYPDPEVVWFKDDQSIRESRHFQIDYDEDGNCSLIISDVCGDDDAKYTCKAVNSLGEATCTAELIVETMEEGEGEGEEEEE

SEQ ID NO: 911751 - protein, 1676 aa, Homo sapiens; identical to SEQ ID NO: 911737

SEQ ID NO: 911752 - protein, 318 aa, Homo sapiens
TSSCRSCRDFGLARRLENAGSLKVLFGTPEFVAPEVINYEPIGYATDMWSIGVICYILVSGLSPFMGDNDNETLANVTSATWDFDDEAFDEISDDAKDFISNLLKKDMKNRLDCTQCLQHPWLMKDTKNMEAKKLSKDRMKKYMARRKWQKTGNAVRAIGRLSSMAMISGLSGRKSSTGSPTSPLNAEKLESEEDVSQAFLEAVAEEKPHVKPYFSKTIRDLEVVEGSAARFDCKIEGYPDPEVVWFKDDQSIRESRHFQIDYDEDGNCSLIISDVCGDDDAKYTCKAVNSLGEATCTAELIVETMEEGEGEGEEEEE

SEQ ID NO: 911753 - protein, 859 aa, Homo sapiens
MIILFSPLLTHPTPTLTTNRSFVRETKATNSDVRKEVTNVISKESKLDSLEAAAKSKNCSSPQRGGSPPWAANSQPQPPRESKLESCKDSPRTAPQTPVLQKTSSSITLQAARVQPEPRAPGLGVLSPSGEERKRPAPPRPATFPTRQPGLGSQDVVSKAANRRIPMEGQRDSAFPKFESKPQSQEVKENQTVKFRCEVSGIPKPEVAWFLEGTPVRRQEGSIEVYEDAGSHYLCLLKARTRDSGTYSCTASNAQGQVSCSWTLQVERLAVMEVAPSFSSVLKDCAVIEGQDFVLQCSVRGTPVPRITWLLNGQPIQYARSTCEAGVAELHIQDALPEDHGTYTCLAENALGQVSCSAWVTVHEKKSSRKSEYLLPVAPSKPTAPIFLQGLSDLKVMDGSQVTMTVQVSGNPPPEVIWLHNGNEIQESEDFHFEQRGTQHSLWIQEVFPEDTGTYTCEAWNSAGEVRTQAVLTVQEPHDGTQPWFISKPRSVTASLGQSVLISCAIAGDPFPTVHWLRDGKALCKDTGHFEVLQNEDVFTLVLKKVQPWHAGQYEILLKNRVGECSCQVSLMLQNSSARALPRGREPASCEDLCGGGVGADGGGSDRYGSLRPGWPARGQGWLEEEDGEDVRGVLKRRVETRQHTEEAIRQQEVEQLDFRDLLGKKVSTKTLSEDDLKEIPAEQMDFRANLQRQVKPKTVSEEERKVHSPQQVDFRSVLAKKGTSKTPVPEKVPPPKPATPDFRSVLGGKKKLPAENGSSSAETLNAKAVESSKPLSNAQPSGPLKPVGNAKPAETLKPMGNAKPAETLKPMGNAKPDENLKSASKEEQLMRLRKQAEKNVEKKIDKYTEVLKTHGLLV

SEQ ID NO: 911754 - protein, 88 aa, Homo sapiens
MEPRMESCLAQVLQKDVGKRLQVGQELIDYFSDKQKSADLEHDQTMLDKLVDGLATSWVNSSNYKVSCALEGTFGGGWAALVDQNWPL

SEQ ID NO: 911755 - protein, 1716 aa, Homo sapiens
MEPRMESCLAQVLQKDVGKRLQVGQELIDYFSDKQKSADLEHDQTMLDKLVDGLATSWVNSSNYKVVLLGMDILSALVTRLQDRFKAQIGTVLPSLIDRLGDAKDSVREQDQTLLLKIMDQAANPQYVWDRMLGGFKHKNFRTREGICLCLIATLNASGAQTLTLSKIVPHICNLLGDPNSQVRDAAINSLVEIYRHVGERVRADLSKKGLPQSRLNVIFTKFDEVQKSGNMIQSANDKNFDDEDSVDGNRPSSASSTSSKAPPSSRRNVGMGTTRRLGSSTLGSKSSAAKEGAGAVDEEDFIKAFDDVPVVQIYSSRDLEESINKIREILSDDKHDWEQRVNALKKIRSLLLAGAAEYDNFFQHLRLLDGAFKLSAKDLRSQVVREACITLGHLSSVLGNKFDHGAEAIMPTIFNLIPNSAKIMATSGVVAVRLIIRHTHIPRLIPVITSNCTSKSVAVRRRCFEFLDLLLQEWQTHSLERHISVLAETIKKGIHDADSEARIEARKCYWGFHSHFSREAEHLYHTLESSYQKALQSHLKNSDSIVSLPQSDRSSSSSQESLNRPLSAKRSPTGSTTSRASTVSTKSVSTTGSLQRSRSDIDVNAAASAKSKVSSSSGTTPFSSAAALPPGSYASLGRIRTRRQSSGSATNVASTPDNRGRSRAKVVSQSQRSRSANPAGAGSRSSSPGKLLGSGYGGLTGGSSRGPPVTPSSEKRSKIPRSQGCSRETSPNRIGLARSSRIPRPSMSQGCSRDTSRESSRDTSPARGFPPLDRFGLGQPGRIPGSVNAMRVLSTSTDLEAAVADALKKPVRRRYEPYGMYSDDDANSDASSVCSERSYGSRNGGIPHYLRQTEDVAEVLNHCASSNWSERKEGLLGLQNLLKSQRTLSRVELKRLCEIFTRMFADPHSKRVFSMFLETLVDFIIIHKDDLQDWLFVLLTQLLKKMGADLLGSVQAKVQKALDVTRDSFPFDQQFNILMRFIVDQTQTPNLKVKVAILKYIESLARQMDPTDFVNSSETRLAVSRIITWTTEPKSSDVRKAAQIVLISLFELNTPEFTMLLGALPKTFQDGATKLLHNHLKNSSNTSVVSALVTIGAYVMSMTSAEPLSRTYSNRIPRFLVLFQEMSSILEDGAILSPSEGMNLIFKYAVFSQVVQSTTFSLGYPVSHSFTELVLFFNTGKMQVLNFVCHSSTPNINHLTPGGLYDDYSFLVYITLKIGLMILREKKNHPGQILPIYLHVGKKTKERIEYILYTALNNDAYSASPQGSPSNTIGRTPSRHTSSRTSPLTSPTNCSHGGLSPSRLWGWSADGLAKHPPPFSQPNSIPTAPSHKALRRSYSPSMLDYDTENLNSEEIYSSLRGVTEAIEKFSFRSQEDLNEPIKRDGKKECDIVSRDGGAASPATEGRGGSEVEGGRTALDNKTSLLNTQPPRAFPGPRARDYNPYPYSDAINTYDKTALKEAVFDDDMEQLRDVPIDHSDLVADLLKELSNHNERVEERKGALLELLKITREDSLGVWEEHFKTILLLLLETLGDKDHSIRALALRVLREILRNQPARFKNYAELTIMKTLEAHKDSHKEVVRAAEEAASTLASSIHPEQCIKVLCPIIQTADYPINLAAIKMQTKVVERIAKESLLQLLVDIIPGLLQGYDNTESSVRKASVFCLVAIYSVIGEDLKPHLAQLTGSKMKLLNLYIKRAQTTNSNSSSSSDVSTHS

SEQ ID NO: 911756 - protein, 1683 aa, Homo sapiens
MEPRMESCLAQVLQKDVGKRLQVGQELIDYFSDKQKSADLEHDQTMLDKLVDGLATSWVNSSNYKVVLLGMDILSALVTRLQDRFKAQIGTVLPSLIDRLGDAKDSVREQDQTLLLKIMDQAANPQYVWDRMLGGFKHKNFRTREGICLCLIATLNASGAQTLTLSKIVPHICNLLGDPNSQVRDAAINSLVEIYRHVGERVRADLSKKGLPQSRLNVIFTKFDEVQKSGNMIQSANDKNFDDEDSVDGNRPSSASSTSSKAPPSSRRNVGMGTTRRLGSSTLGSKSSAAKEGAGAVDEEDFIKAFDDVPVVQIYSSRDLEESINKIREILSDDKHDWEQRVNALKKIRSLLLAGAAEYDNFFQHLRLLDGAFKLSAKDLRSQVVREACITLGHLSSVLGNKFDHGAEAIMPTIFNLIPNSAKIMATSGVVAVRLIIRHTHIPRLIPVITSNCTSKSVAVRRRCFEFLDLLLQEWQTHSLERHISVLAETIKKGIHDADSEARIEARKCYWGFHSHFSREAEHLYHTLESSYQKALQSHLKNSDSIVSLPQSDRSSSSSQESLNRPLSAKRSPTGSTTSRASTVSTKSVSTTGSLQRSRSDIDVNAAASAKSKVSSSSGTTPFSSAAALPPGSYASLGRIRTRRQSSGSATNVASTPDNRGRSRAKVVSQSQRSRSANPAGAGSRSSSPGKLLGSGYGGLTGGSSRGPPVTPSSEKRSKIPRSQGCSRETSPNRIGLARSSRIPRPSMSQGCSRDTSRESSRDTSPARGFPPLDRFGLGQPGRIPGSVNAMRVLSTSTDLEAAVADALKKPVRRRYEPYGMYSDDDANSDASSVCSERSYGSRNGGIPHYLRQTEDVAEVLNHCASSNWSERKEGLLGLQNLLKSQRTLSRVELKRLCEIFTRMFADPHSKEKMGADLLGSVQAKVQKALDVTRDSFPFDQQFNILMRFIVDQTQTPNLKVKVAILKYIESLARQMDPTDFVNSSETRLAVSRIITWTTEPKSSDVRKAAQIVLISLFELNTPEFTMLLGALPKTFQDGATKLLHNHLKNSSNTSVVSALVTIGAYVMSMTSAEPLSRTYSNRIPRFLVLFQEMSSILEDGAILSPSEGMNLIFKYAVFSQVVQSTTFSLGYPVSHSFTELVLFFNTGKMQVLNFVCHSSTPNINHLTPGGLYDDYSFLVYITLKIGLMILREKKNHPGQILPIYLHVGSKTKERIEYILYTALNNDAYSASPQGSPSNTIGRTPSRHTSSRTSPLTSPTNCSHGGLSPSRLWGWSADGLAKHPPPFSQPNSIPTAPSHKALRRSYSPSMLDYDTENLNSEEIYSSLRGVTEAIEKFSFRSQEDLNEPIKRDGKKECDIVSRDGGAASPATEGRGGSEVEGGRTALDNKTSLLNTQPPRAFPGPRARDYNPYPYSDAINTYDKTALKEAVFDDDMEQLRDVPIDHSDLVADLLKELSNHNERVEERKGALLELLKITREDSLGVWEEHFKTILLLLLETLGDKDHSIRALALRVLREILRNQPARFKNYAELTIMKTLEAHKDSHKEVVRAAEEAASTLASSIHPEQCIKVLCPIIQTADYPINLAAIKMQTKVVERIAKESLLQLLVDIIPGLLQGYDNTESSVRKASVFCLVAIYSVIGEDLKPHLAQLTGSKMKLLNLYIKRAQTTNSNSSSSSDVSTHS

SEQ ID NO: 911757 - protein, 1716 aa, Homo sapiens; identical to SEQ ID NO: 911755

SEQ ID NO: 911758 - protein, 112 aa, Homo sapiens [sequence omitted]

SEQ ID NO: 911759 - protein, 1106 aa, Homo sapiens
MEPRMESCLAQVLQKDVGKRLQVGQELIDYFSDKQKSADLEHDQTMLDKLVDGLATSWVNSSNYKVVLLGMDILSALVTRLQDRFKAQIGTVLPSLIDRLGDAKDSVREQDQTLLLKIMDQAANPQYVWDRMLGGFKHKNFRTREGICLCLIATLNASGAQTLTLSKIVPHICNLLGDPNSQVRDAAINSLVEIYRHVGERVRADLSKKGLPQSRLNVIFTKFDEVQKSGNMIQSANDKNFDDEDSVDGNRPSSASSTSSKAPPSSRRNVGMGTTRRLGSSTLGSKSSAAKEGAGAVDEEDFIKAFDDVPVVQIYSSRDLEESINKIREILSDDKHDWEQRVNALKKIRSLLLAGAAEYDNFFQHLRLLDGAFKLSAKDLRSQVVREACITLGHLSSVLGNKFDHGAEAIMPTIFNLIPNSAKIMATSGVVAVRLIIRHTHIPRLIPVITSNCTSKSVAVRRRCFEFLDLLLQEWQTHSLERHISVLAETIKKGIHDADSEARIEARKCYWGFHSHFSREAEHLYHTLESSYQKALQSHLKNSDSIVSLPQSDRSSSSSQESLNRPLSAKRSPTGSTTSRASTVSTKSVSTTGSLQRSRSDIDVNAAASAKSKVSSSSGTTPFSSAAALPPGSYASLGRIRTRRQSSGSATNVASTPDNRGRSRAKVVSQSQRSRSANPAGAGSRSSSPGKLLGSGYGGLTGGSSRGPPVTPSSEKRSKIPRSQGCSRETSPNRIGLARSSRIPRPSMSQGCSRDTSRESSRDTSPARGFPPLDRFGLGQPGRIPGSVNAMRVLSTSTDLEAAVADALKKPVRRRYEPYGMYSDDDANSDASSVCSERSYGSRNGGIPHYLRQTEDVAEVLNHCASSNWSERKEGLLGLQNLLKSQRTLSRVELKRLCEIFTRMFADPHSKRVFSMFLETLVDFIIIHKDDLQDWLFVLLTQLLKKMGADLLGSVQAKVQKALDVTRDSFPFDQQFNILMRFIVDQTQTPNLKVKVAILKYIESLARQMDPTDFVNSSETRLAVSRIITWTTEPKSSDVRKAAQIVLISLFELNTPEFTMLLGALPKTFQDGATKLLHNHLKNSSNTSVVSALVTIGAYVMSMTSA

SEQ ID NO: 911760 - protein, 839 aa, Homo sapiens
MEPRMESCLAQVLQKDVGKRLQVGQELIDYFSDKQKSADLEHDQTMLDKLVDGLATSWVNSSNYKVVLLGMDILSALVTRLQDRFKAQIGTVLPSLIDRLGDAKDSVREQDQTLLLKIMDQAANPQYVWDRMLGGFKHKNFRTREGICLCLIATLNASGAQTLTLSKIVPHICNLLGDPNSQVRDAAINSLVEIYRHVGERVRADLSKKGLPQSRLNVIFTKFDEVQKSGNMIQSANDKNFDDEDSVDGNRPSSASSTSSKAPPSSRRNVGMGTTRRLGSSTLGSKSSAAKEGAGAVDEEDFIKAFDDVPVVQIYSSRDLEESINKIREILSDDKHDWEQRVNALKKIRSLLLAGAAEYDNFFQHLRLLDGAFKLSAKDLRSQVVREACITLGHLSSVLGNKFDHGAEAIMPTIFNLIPNSAKIMATSGVVAVRLIIRHTHIPRLIPVITSNCTSKSVAVRRRCFEFLDLLLQEWQTHSLERHISVLAETIKKGIHDADSEARIEARKCYWGFHSHFSREAEHLYHTLESSYQKALQSHLKNSDSIVSLPQSDRSSSSSQESLNRPLSAKRSPTGSTTSRASTVSTKSVSTTGSLQRSRSDIDVNAAASAKSKVSSSSGTTPFSSAAALPPGSYASLGRIRTRRQSSGSATNVASTPDNRGRSRAKVVSQSQRSRSANPAGAGSRSSSPGKLLGSGYGGLTGGSSRGPPVTPSSEKRSKIPRSQGCSRETSPNRIGLARSSRIPRPSMSQGCSRDTSRESSRDTSPARGFPPLDRFGLGQPGRIPGSVNAMRVLSTSTDLEAAVADALVRGTVCMYTVFLKYSSAFLSVLTGNCPQIRL

SEQ ID NO: 911761 - protein, 109 aa, Homo sapiens
MEPRMESCLAQVLQKDVGKRLQVGQELIDYFSDKQKSADLEHDQTMLDKLVDGLATSWVNSSNYKVVLLGMDILSALVTRLQDRFKAQIGTGELRHLWSGPGPFRPPAE

SEQ ID NO: 911762 - protein, 1538 aa, Homo sapiens
MEPRMESCLAQVLQKDVGKRLQVGQELIDYFSDKQKSADLEHDQTMLDKLVDGLATSWVNSSNYKVVLLGMDILSALVTRLQDRFKAQIGTVLPSLIDRLGDAKDSVREQDQTLLLKIMDQAANPQYVWDRMLGGFKHKNFRTREGICLCLIATLNASGAQTLTLSKIVPHICNLLGDPNSQVRDAAINSLVEIYRHVGERVRADLSKKGLPQSRLNVIFTKFDEVQKSGNMIQSANDKNFDDEDSVDGNRPSSASSTSSKAPPSSRRNVGMGTTRRLGSSTLGSKSSAAKEGAGAVDEEDFIKAFDDVPVVQIYSSRDLEESINKIREILSDDKHDWEQRVNALKKIRSLLLAGAAEYDNFFQHLRLLDGAFKLSAKDLRSQVVREACITLGHLSSVLGNKFDHGAEAIMPTIFNLIPNSAKIMATSGVVAVRLIIRHTHIPRLIPVITSNCTSKSVAVRRRCFEFLDLLLQEWQTHSLERHISVLAETIKKGIHDADSEARIEARKCYWGFHSHFSREAEHLYHTLESSYQKALQSHLKNSDSIVSLPQSDRSSSSSQESLNRPLSAKRSPTGSTTSRASTVSTKSVSTTGSLQRSRSDIDVNAAASAKSKVSSSSGTTPFSSAAALPPGSYASLGRIRTRRQSSGSATNVASTPDNRGRSRAKVVSQSQRSRSANPAGAGSRSSSPGKLLGSGYGGLTGGSSRGPPVTPSSEKRSKIPRSQGCSRETSPNRIGLARSSRIPRPSMSQGCSRDTSRESSRDTSPARGFPPLDRFGLGQPGRIPGSVNAMRVLSTSTDLEAAVADALKKPVRRRYEPYGMYSDDDANSDASSVCSERSYGSRNGGIPHYLRQTEDVAEVLNHCASSNWSERKEGLLGLQNLLKSQRTLSRVELKRLCEIFTRMFADPHSKRVFSMFLETLVDFIIIHKDDLQDWLFVLLTQLLKKMGADLLGSVQAKVQKALDVTRDSFPFDQQFNILMRFIVDQTQTPNLKVKVAILKYIESLARQMDPTDFVNSSETRLAVSRIITWTTEPKSSDVRKAAQIVLISLFELNTPEFTMLLGALPKTFQDGATKLLHNHLKNSSNTSVGSPSNTIGRTPSRHTSSRTSPLTSPTNCSHGGLSPSRLWGWSADGLAKHPPPFSQPNSIPTAPSHKALRRSYSPSMLDYDTENLNSEEIYSSLRGVTEAIEKFSFRSQEDLNEPIKRDGKKECDIVSRDGGAASPATEGRGGSEVEGGRTALDNKTSLLNTQPPRAFPGPRARDYNPYPYSDAINTYDKTALKEAVFDDDMEQLRDVPIDHSDLVADLLKELSNHNERVEERKGALLELLKITREDSLGVWEEHFKTILLLLLETLGDKDHSIRALALRVLREILRNQPARFKNYAELTIMKTLEAHKDSHKEVVRAAEEAASTLASSIHPEQCIKVLCPIIQTADYPINLAAIKMQTKVVERIAKESLLQLLVDIIPGLLQGYDNTESSVRKASVFCLVAIYSVIGEDLKPHLAQLTGSKMKLLNLYIKRAQTTNSNSSSSSDVSTHS

SEQ ID NO: 911763 - protein, 1707 aa, Homo sapiens
MEPRMESCLAQVLQKDVGKRLQVGQELIDYFSDKQKSADLEHDQTMLDKLVDGLATSWVNSSNYKVVLLGMDILSALVTRLQDRFKAQIGTVLPSLIDRLGDAKDSVREQDQTLLLKIMDQAANPQYVWDRMLGGFKHKNFRTREGICLCLIATLNASGAQTLTLSKIVPHICNLLGDPNSQVRDAAINSLVEIYRHVGERVRADLSKKGLPQSRLNVIFTKFDEVQKSGNMIQSANDKNFDDEDSVDGNRPSSASSTSSKAPPSSRRNVGMGTTRRLGSSTLGSKSSAAKEGAGAVDEEDFIKAFDDVPVVQIYSSRDLEESINKIREILSDDKHDWEQRVNALKKIRSLLLAGAAEYDNFFQHLRLLDGAFKLSAKDLRLRHLSSVLGNKFDHGAEAIMPTIFNLIPNSAKIMATSGVVAVRLIIRHTHIPRLIPVITSNCTSKSVAVRRRCFEFLDLLLQEWQTHSLERHISVLAETIKKGIHDADSEARIEARKCYWGFHSHFSREAEHLYHTLESSYQKALQSHLKNSDSIVSLPQSDRSSSSSQESLNRPLSAKRSPTGSTTSRASTVSTKSVSTTGSLQRSRSDIDVNAAASAKSKVSSSSGTTPFSSAAALPPGSYASLGRIRTRRQSSGSATNVASTPDNRGRSRAKVVSQSQRSRSANPAGAGSRSSSPGKLLGSGYGGLTGGSSRGPPVTPSSEKRSKIPRSQGCSRETSPNRIGLARSSRIPRPSMSQGCSRDTSRESSRDTSPARGFPPLDRFGLGQPGRIPGSVNAMRVLSTSTDLEAAVADALKKPVRRRYEPYGMYSDDDANSDASSVCSERSYGSRNGGIPHYLRQTEDVAEVLNHCASSNWSERKEGLLGLQNLLKSQRTLSRVELKRLCEIFTRMFADPHSKRVFSMFLETLVDFIIIHKDDLQDWLFVLLTQLLKKMGADLLGSVQAKVQKALDVTRDSFPFDQQFNILMRFIVDQTQTPNLKVKVAILKYIESLARQMDPTDFVNSSETRLAVSRIITWTTEPKSSDVRKAAQIVLISLFELNTPEFTMLLGALPKTFQDGATKLLHNHLKNSSNTSVVSALVTIGAYVMSMTSAEPLSRTYSNRIPRFLVLFQEMSSILEDGAILSPSEGMNLIFKYAVFSQVVQSTTFSLGYPVSHSFTELVLFFNTGKMQVLNFVCHSSTPNINAFDSRSACMMIIHFWFIYTENWPYDSKGKKKPSWADSTHLFTCGLKDQGKNRIYSIYSPWNNDAYSASPQGSPSNTIGRTPSRHTSSRTSPLTSPTNCSHGGLSPSRLWGWSADGLAKHPPPFSQPNSIPTAPSHKALRRSYSPSMLDYDTENLNSEEIYSSLRGVTEAIEKFSFRSQEDLNEPIKRDGKKECDIVSRDGGAASPATEGRGGSEVEGGRTALDNKTSLLNTQPPRAFPGPRARDYNPYPYSDAINTYDKTALKEAVFDDDMEQLRDVPIDHSDLVADLLKELSNHNERVEERKGALLELLKITREDSLGVWEEHFKTILLLLLETLGDKDHSIRALALRVLREILRNQPARFKNYAELTIMKTLEAHKDSHKEVVRAAEEAASTLASSIHPEQCIKVLCPIIQTADYPINLAAIKMQTKVVERIAKESLLQLLVDIIPGLLQGYDNTESSVRKASVFCLVAIYSVIGEDLKPHLAQLTGSKMKLLNLYIKRAQTTNSNSSSSSDVSTHS

SEQ ID NO: 911764 - protein, 1352 aa, Homo sapiens
MKALDVKWFICFTVSKKNNYSPVSFSCFRHLSSVLGNKFDHGAEAIMPTIFNLIPNSAKIMATSGVVAVRLIIRHTHIPRLIPVITSNCTSKSVAVRRRCFEFLDLLLQEWQTHSLERHISVLAETIKKGIHDADSEARIEARKCYWGFHSHFSREAEHLYHTLESSYQKALQSHLKNSDSIVSLPQSDRSSSSSQESLNRPLSAKRSPTGSTTSRASTVSTKSVSTTGSLQRSRSDIDVNAAASAKSKVSSSSGTTPFSSAAALPPGSYASLGRIRTRRQSSGSATNVASTPDNRGRSRAKVVSQSQRSRSANPAGAGSRSSSPGKLLGSGYGGLTGGSSRGPPVTPSSEKRSKIPRSQGCSRETSPNRIGLARSSRIPRPSMSQGCSRDTSRESSRDTSPARGFPPLDRFGLGQPGRIPGSVNAMRVLSTSTDLEAAVADALKKPVRRRYEPYGMYSDDDANSDASSVCSERSYGSRNGGIPHYLRQTEDVAEVLNHCASSNWSERKEGLLGLQNLLKSQRTLSRVELKRLCEIFTRMFADPHSKRVFSMFLETLVDFIIIHKDDLQDWLFVLLTQLLKKMGADLLGSVQAKVQKALDVTRDSFPFDQQFNILMRFIVDQTQTPNLKVKVAILKYIESLARQMDPTDFVNSSETRLAVSRIITWTTEPKSSDVRKAAQIVLISLFELNTPEFTMLLGALPKTFQDGATKLLHNHLKNSSNTSVVSALVTIGAYVMSMTSAEPLSRTYSNRIPRFLVLFQEMSSILRMGPSSAPVNEMNLIFKYAVFSQVVQSTTFSLGYPVSHSFTELVLFFNTGKMQVLNFVCHSSTPNINHLTPGGLYDDYSFLVYITLKIGLMILREKKNHPGQILPIYLHVGKKTKERIEYFYIQPLNNDAYSASPQGSPSNTIGRTPSRHTSSRTSPLTSPTNCSHGGLSPSRLWGWSADGLAKHPPPFSQPNSIPTAPSHKALRRSYSPSMLDYDTENLNSEEIYSSLRGVTEAIEKFSFRSQEDLNEPIKRDGKKECDIVSRDGGAASPATEGRGGSEVEGGRTALDNKTSLLNTQPPRAFPGPRARDYNPYPYSDAINTYDKTALKEAVFDDDMEQLRDVPIDHSDLVADLLKELSNHNERVEERKGALLELLKITREDSLGVWEEHFKTILLLLLETLGDKDHSIRALALRVLREILRNQPARFKNYAELTIMKTLEAHKDSHKEVVRAAEEAASTLASSIHPEQCIKVLCPIIQTADYPINLAAIKMQTKVVERIAKESLLQLLVDIIPGLLQGYDNTESSVRKASVFCLVAIYSVIGEDLKPHLAQLTGSKMKLLNLYIKRAQTTNSNSSSSSDVSTHS

SEQ ID NO: 911765 - protein, 1724 aa, Homo sapiens
MEPRMESCLAQVLQKDVGKRLQVGQELIDYFSDKQKSADLEHDQTMLDKLVDGLATSWVNSSNYKVVLLGMDILSALVTRLQDRFKAQIGTVLPSLIDRLGDAKDSVREQDQTLLLKIMDQAANPQYVWDRMLGGFKHKNFRTREGICLCLIATLNASGAQTLTLSKIVPHICNLLGDPNSQVRDAAINSLVEIYRHVGERVRADLSKKGLPQSRLNVIFTKFDEVQKSGNMIQSANDKNFDDEDSVDGNRPSSASSTSSKAPPSSRRNVGMGTTRRLGSSTLGSKSSAAKEGAGAVDEEDFIKAFDDVPVVQIYSSRDLEESINKIREILSDDKHDWEQRVNALKKIRSLLLAGAAEYDNFFQHLRLLDGAFKLSAKDLRSQVVREACITLGHLSSVLGNKFDHGAEAIMPTIFNLIPNSAKIMATSGVVAVRLIIRHTHIPRLIPVITSNCTSKSVAVRRRCFEFLDLLLQEWQTHSLERHISVLAETIKKGIHDADSEARIEARKCYWGFHSHFSREAEHLYHTLESSYQKALQSHLKNSDSIVSLPQSDRSSSSSQESLNRPLSAKRSPTGSTTSRASTVSTKSVSTTGSLQRSRSDIDVNAAASAKSKVSSSSGTTPFSSAAALPPGSYASLGRIRTRRQSSGSATNVASTPDNRGRSRAKVVSQSQRSRSANPAGAGSRSSSPGKLLGSGYGGLTGGSSRGPPVTPSSEKRSKIPRSQGCSRETSPNRIGLARSSRIPRPSMSQGCSRDTSRESSRDTSPARGFPPLDRFGLGQPGRIPGSVNAMRVLSTSTDLEAAVADALKKPVRRRYEPYGMYSDDDANSDASSVCSERSYGSRNGGIPHYLRQTEDVAEVLNHCASSNWSERKEGLLGLQNLLKSQRTLSRVELKRLCEIFTRMFADPHSKRVFSMFLETLVDFIIIHKDDLQDWLFVLLTQLLKKMGADLLGSVQAKVQKALDVTRDSFPFDQQFNILMRFIVDQTQTPNLKVKVAILKYIESLARQMDPTDFVNSSETRLAVSRIITWTTEPKSSDVRKAAQIVLISLFELNTPEFTMLLGALPKTFQDGATKLLHNHLKNSSNTSVVSALVTIGAYVMSMTSAEPLSRTYSNRIPRFLVLFQEMSSILEDGAILSPSEGMNLIFKYAVFSQVVQSTTFSLGYPVSHSFTELVLFFNTGKMQVLNFVCHSSTPNINHLTPGGLYDDYSFLVYITLKIGLMILREKKNHPGQILPIYLHVGKKTKERIEYILYTALNNDAYSASPQGSPSNTIGRTPSRHTSSRTSPLTSPTNCSHGGLSPSRLWGWSADGLAKHPPPFSQPNSIPTAPSHKALRRSYSPSMLDYDTENLNSEEIYSSLRGVTEAIEKFSFRSQEDLNEPIKRDGKKECDIVSRDGGAASPATEGRGGSEVEGGRTALDNKTSLLNTQPPRAFPGPRARDYNPYPYSDAINTYDKTALKEAVFDDDMEQLRDVPIDHSDLVADLLKELSNHNERVEERKGALLELLKITREDSLGVWEEHFKTILLLLLETLGDKDHSIRALALRVLREILRNQPARFKNYAELTIMKTLEAHKDSHKEVVRAAEEAASTLASSIHPEQCIKVLCPIIQTADYPINLAAIKMQTKVVERIAKESLLQLLVDIIPGLLQGYDNTESSVRKASVFCLVAIYSVIGEDLKPHLAQLTGSKMKLLNLYIKRAQTTNSNSSTTRTAAPPGQQHHRRYR

SEQ ID NO: 911766 - protein, 654 aa, Homo sapiens
MKLSLVAAMLLLLSAARAEEEDKKEDVGTVVGIDLGTTYSCVGVFKNGRVEIIANDQGNRITPSYVAFTPEGERLIGDAAKNQLTSNPENTVFDAKRLIGRTWNDPSVQQDIKFLPFKVVEKKTKPYIQVDIGGGQTKTFAPEEISAMVLTKMKETAEAYLGKKVTHAVVTVPAYFNDAQRQATKDAGTIAGLNVMRIINEPTAAAIAYGLDKREGEKNILVFDLGGGTFDVSLLTIDNGVFEVVATNGDTHLGGEDFDQRVMEHFIKLYKKKTGKDVRKDNRAVQKLRREVEKAKRALSSQHQARIEIESFYEGEDFSETLTRAKFEELNMDLFRSTMKPVQKVLEDSDLKKSDIDEIVLVGGSTRIPKIQQLVKEFFNGKEPSRGINPDEAVAYGAAVQAGVLSGDQDTGDLVLLDVCPLTLGIETVGGVMTKLIPRNTVVPTKKSQIFSTASDNQPTVTIKVYEGERPLTKDNHLLGTFDLTGIPPAPRGVPQIEVTFEIDVNGILRVTAEDKGTGNKNKITITNDQNRLTPEEIERMVNDAEKFAEEDKKLKERIDTRNELESYAYSLKNQIGDKEKLGGKLSSEDKETMEKAVEEKIEWLESHQDADIEDFKAKKKELEEIVQPIISKLYGSAGPPPTGEEDTAEKDEL

SEQ ID NO: 911767 - protein, 654 aa, Homo sapiens; identical to SEQ ID NO: 911766

SEQ ID NO: 911768 - protein, 654 aa, Homo sapiens; identical to SEQ ID NO: 911766

SEQ ID NO: 911769 - protein, 654 aa, Homo sapiens; identical to SEQ ID NO: 911766

SEQ ID NO: 911770 - protein, 420 aa, Homo sapiens
MKLSLVAAMLLLLSAARAEEEDKKEDVGTVVGIDLGTTYSCVGVFKNGRVEIIANDQGNRITPSYVAFTPEGERLIGDAAKNQLTSNPENTVFDAKRLIGRTWNDPSVQQDIKFLPFKVVEKKTKPYIQVDIGGGQTKTFAPEEISAMVLTKMKETAEAYLGKKVTHAVVTVPAYFNDAQRQATKDAGTIAGLNVMRIINEPTAAAIAYGLDKREGEKNILVFDLGGGTFDVSLLTIDNGVFEVVATNGDTHLGGEDFDQRVMEHFIKLYKKKTGKDVRKDNRAVQKLRREVEKAKRALSSQHQARIEIESFYEGEDFSETLTRAKFEELNMDLFRSTMKPVQKVLEDSDLKKSDIDEIVLVGGSTRIPKIQQLVKEFFNGKEPSRGINPDEAVAYGAAVQAGVLSGDQDTGRSSSQHLS

SEQ ID NO: 911771 - protein, 654 aa, Homo sapiens; identical to SEQ ID NO: 911766

SEQ ID NO: 911772 - protein, 459 aa, Homo sapiens
MRIINEPTAAAIAYGLDKREGEKNILVFDLGGGTFDVSLLTIDNGVFEVVATNGDTHLGGEDFDQRVMEHFIKLYKKKTGKDVRKDNRAVQKLRREVEKAKRALSSQHQARIEIESFYEGEDFSETLTRAKFEELNMDLFRSTMKPVQKVLEDSDLKKSDIDEIVLVGGSTRIPKIQQLVKEFFNGKEPSRGINPDEAVAYGAAVQAGVLSGDQDTGDLVLLDVCPLTLGIETVGGVMTKLIPRNTVVPTKKSQIFSTASDNQPTVTIKVYEGERPLTKDNHLLGTFDLTGIPPAPRGVPQIEVTFEIDVNGILRVTAEDKGTGNKNKITITNDQNRLTPEEIERMVNDAEKFAEEDKKLKERIDTRNELESYAYSLKNQIGDKEKLGGKLSSEDKETMEKAVEEKIEWLESHQDADIEDFKAKKKELEEIVQPIISKLYGSAGPPPTGEEDTAEKDEL

SEQ ID NO: 911773 - protein, 461 aa, Homo sapiens
APPFWWWAPPSIGSYLVRISKNEMSPSMKEDLSESLTRAKFEELNMDLFRSTMKPVQKVLEDSGFDQRVMEHFIKLYKKKTGKDVRKDNRAVQKLRREVEKAKRALSSQHQARIEIESFYEGEDFSETLTRAKFEELNMDLFRSTMKPVQKVLEDSDLKKSDIDEIVLVGGSTRIPKIQQLVKEFFNGKEPSRGINPDEAVAYGAAVQAGVLSGDQDTGDLVLLDVCPLTLGIETVGGVMTKLIPRNTVVPTKKSQIFSTASDNQPTVTIKVYEGERPLTKDNHLLGTFDLTGIPPAPRGVPQIEVTFEIDVNGILRVTAEDKGTGNKNKITITNDQNRLTPEEIERMVNDAEKFAEEDKKLKERIDTRNELESYAYSLKNQIGDKEKLGGKLSSEDKETMEKAVEEKIEWLESHQDADIEDFKAKKKELEEIVQPIISKLYGSAGPPPTGEEDTAEKDEL

SEQ ID NO: 911774 - protein, 537 aa, Homo sapiens
MKLSLVAAMLLLLSAARAEEEDKKEDVGTVVGIDLGTTYSCVGVFKNGRVEIIANDQGNRITPSYVAFTPEGERLIGDAAKNQLTSNPENTVFDAKRLIGRTWNDPSVQQDIKFLPFKVVEKKTKPYIQVDIGGGQTKTFAPEEISAMVLTKMKETAEAYLGKKVTHAVVTVPAYFNDAQRQATKDAGTIAGLNVMRIINEPTAAAIAYGLDKREGEKNILVFDLGGGTFDVSLLTIDNGVFEVVATNGDTHLGGEDFDQRVMEHFIKLYKKKTGKDVRKDNRAVQKLRREVEKAKRALSSQHQARIEIESFYEGEDFSETLTRAKFEELNMDLFRSTMKPVQKVLEDSDLKKSDIDEIVLVGGSTRIPKIQQLVKEFFNGKEPSRGINPDEAVAYGAAVQAGVLSGDQDTGDLVLLDVCPLTLGIETVGGVMTKLIPRNTVVPTKKSQIFSTASDNQPTVTIKVYEGERPLTKDNHLLGTFDLTGIPPAPRGVPQIEVTFEIDVNGILRVTAEDKGTGNKNKITITNTHKWNRNRK

SEQ ID NO: 911775 - protein, 335 aa, Homo sapiens
SISDFFKFEELNMDLFRSTMKPVQKVLEDSDLKKSDIDEIVLVGGSTRIPKIQQLVKEFFNGKEPSRGINPDEAVAYGAAVQAGVLSGDQDTGDLVLLDVCPLTLGIETVGGVMTKLIPRNTVVPTKKSQIFSTASDNQPTVTIKVYEGERPLTKDNHLLGTFDLTGIPPAPRGVPQIEVTFEIDVNGILRVTAEDKGTGNKNKITITNDQNRLTPEEIERMVNDAEKFAEEDKKLKERIDTRNELESYAYSLKNQIGDKEKLGGKLSSEDKETMEKAVEEKIEWLESHQDADIEDFKAKKKELEEIVQPIISKLYGSAGPPPTGEEDTAEKDEL

SEQ ID NO: 911776 - protein, 207 aa, Homo sapiens
MVLLSRLVCNQPTVTIKVYEGERPLTKDNHLLGTFDLTGIPPAPRGVPQIEVTFEIDVNGILRVTAEDKGTGNKNKITITNDQNRLTPEEIERMVNDAEKFAEEDKKLKERIDTRNELESYAYSLKNQIGDKEKLGGKLSSEDKETMEKAVEEKIEWLESHQDADIEDFKAKKKELEEIVQPIISKLYGSAGPPPTGEEDTAEKDEL

SEQ ID NO: 911777 - protein, 181 aa, Homo sapiens
CHSKNTIHIYLKGDFNLWDPTRSRRNSSQIDVNGILRVTAEDKGTGNKNKITITNDQNRLTPEEIERMVNDAEKFAEEDKKLKERIDTRNELESYAYSLKNQIGDKEKLGGKLSSEDKETMEKAVEEKIEWLESHQDADIEDFKAKKKELEEIVQPIISKLYGSAGPPPTGEEDTAEKDEL

SEQ ID NO: 911778 - protein, 145 aa, Homo sapiens
NISPTKPITLLTQVVCHHLDQNRLTPEEIERMVNDAEKFAEEDKKLKERIDTRNELESYAYSLKNQIGDKEKLGGKLSSEDKETMEKAVEEKIEWLESHQDADIEDFKAKKKELEEIVQPIISKLYGSAGPPPTGEEDTAEKDEL

SEQ ID NO: 911779 - protein, 573 aa, Homo sapiens
MKLSLVAAMLLLLSAARAEEEDKKEDVGTVVGIDLGTTYSCVGVFKNGRVEIIANDQGNRITPSYVAFTPEGERLIGDAAKNQLTSNPENTVFDAKRLIGRTWNDPSVQQDIKFLPFKVVEKKTKPYIQVDIGGGQTKTFAPEEISAMVLTKMKETAEAYLGKKVTHAVVTVPAYFNDAQRQATKDAGTIAGLNVMRIINEPTAAAIAYGLDKREGEKNILVFDLGGGTFDVSLLTIDNGVFEVVATNGDTHLGGEDFDQRVMEHFIKLYKKKTGKDVRKDNRAVQKLRREVEKAKRALSSQHQARIEIESFYEGEDFSETLTRAKFEELNMDLFRSTMKPVQKVLEDSDLKKSDIDEIVLVGGSTRIPKIQQLVKEFFNGKEPSRGINPDEAVAYGAAVQAGVLSGDQDTGDLVLLDVCPLTLGIETVGGVMTKLIPRNTVVPTKKSQIFSTASDNQPTVTIKVYEGERPLTKDNHLLGTFDLTGIPPAPRGVPQIEVTFEIDVNGILRVTAEDKGTGNKNKITITNDQNRLTPEEIERMVNDAEKFAEEDKKLKERIDTRNELESYRYGGL

SEQ ID NO: 911780 - protein, 420 aa, Homo sapiens; identical to SEQ ID NO: 911770

SEQ ID NO: 911781 - protein, 125 aa, Homo sapiens
APPFWWWAPPSIGSYLVRISKNEMSPSMKEDLSESLTRAKFEELNMDLFRSTMKPVQKVLEDSGFDQRVMEHFIKLYKKKTGKDVRKDNRAVQKLRREVEKAKRALSSQHQARIGHLKKRVKNLG

SEQ ID NO: 911782 - protein, 654 aa, Homo sapiens; identical to SEQ ID NO: 911766

SEQ ID NO: 911783 - protein, 654 aa, Homo sapiens; identical to SEQ ID NO: 911766

SEQ ID NO: 911784 - protein, 654 aa, Homo sapiens; identical to SEQ ID NO: 911766

SEQ ID NO: 911785 - protein, 692 aa, Homo sapiens
MKLSLVAAMLLLLSAARAEEEDKKEDVGTVVGIDLGTTYSCVGVFKNGRVEIIANDQGNRITPSYVAFTPEGERLIGDAAKNQLTSNPENTVFDAKRLIGRTWNDPSVQQDIKFLPFKVVEKKTKPYIQVDIGGGQTKTFAPEEISAMVLTKMKETAEAYLGKKVTHAVVTVPAYFNDAQRQATKDAGTIAGLNVMRIINEPTAAAIAYGLDKREGEKNILVFDLGGGTFDVSLLTIDNGVFEVVATNGDTHLGGEDFDQRVMEHFIKLYKKKTGKDVRKDNRAVQKLRREVEKAKRALSSQHQARIEIESFYEGEDFSETLTRAKFEELNMVMFLVFCFANEISLDSEFRTLHLDTEITDITVTMSFFYDLFRSTMKPVQKVLEDSDLKKSDIDEIVLVGGSTRIPKIQQLVKEFFNGKEPSRGINPDEAVAYGAAVQAGVLSGDQDTGDLVLLDVCPLTLGIETVGGVMTKLIPRNTVVPTKKSQIFSTASDNQPTVTIKVYEGERPLTKDNHLLGTFDLTGIPPAPRGVPQIEVTFEIDVNGILRVTAEDKGTGNKNKITITNDQNRLTPEEIERMVNDAEKFAEEDKKLKERIDTRNELESYAYSLKNQIGDKEKLGGKLSSEDKETMEKAVEEKIEWLESHQDADIEDFKAKKKELEEIVQPIISKLYGSAGPPPTGEEDTAEKDEL

SEQ ID NO: 911786 - protein, 459 aa, Homo sapiens; identical to SEQ ID NO: 911772

SEQ ID NO: 911787 - protein, 400 aa, Homo sapiens
MKLSLVAAMLLLLSAARAEEEDKKEDVGTVVGIDLGTTYSCVGVFKNGRVEIIANDQGNRITPSYVAFTPEGERLIGDAAKNQLTSNPENTVFDAKRLIGRTWNDPSVQQDIKFLPFKVVEKKTKPYIQVDIGGGQTKTFAPEEISAMVLTKMKETAEAYLGKKVTHAVVTVPAYFNDAQRQATKDAGTIAGLNVMRIINEPNQPTVTIKVYEGERPLTKDNHLLGTFDLTGIPPAPRGVPQIEVTFEIDVNGILRVTAEDKGTGNKNKITITNDQNRLTPEEIERMVNDAEKFAEEDKKLKERIDTRNELESYAYSLKNQIGDKEKLGGKLSSEDKETMEKAVEEKIEWLESHQDADIEDFKAKKKELEEIVQPIISKLYGSAGPPPTGEEDTAEKDEL

SEQ ID NO: 911788 - protein, 449 aa, Homo sapiens
MKLSLVAAMLLLLSAARAEEEDKKEDVGTVVGIDLGTTYSCVGVFKNGRVEIIANDQGNRITPSYVAFTPEGERLIGDAAKNQLTSNPENTVFDAKRLIGRTWNDPSVQQDIKFLPFKVVEKKTKPYIQVDIGGGQTKTFAPEEISAMVLTKMKETAEAYLGKKVTHAVVTVPAYFNDAQRQATKDAGTIAGLNVMRIINEPTAAAIAYGLDKREGEKNILVFDLGGGTFDVSLLTIDNGVFEVVATNGDTHLGGEDFDQRVMEHFIKLYKKKTGKDVRKDNRAVQKLRREVEKAKRALSSQHQARIEIESFYEGEDFSETLTRAKFEELNMDLFRSTMKPVQKVLEDSDLKKSDIDEIVLVGGSTRIPKIQQLVKEFFNGKEPSRGINPDEAVAYGAAVQAGVLSGDQDTGDLVLLDVCPLTLGIETVGGVMTKLIPRNTVVPTKKFC

SEQ ID NO: 911789 - protein, 368 aa, Homo sapiens
APPFWWWAPPSIGSYLVRISKNEMSPSMKEDLSESLTRAKFEELNMDLFRSTMKPVQKVLEDSDLKKSDIDEIVLVGGSTRIPKIQQLVKEFFNGKEPSRGINPDEAVAYGAAVQAGVLSGDQDTGDLVLLDVCPLTLGIETVGGVMTKLIPRNTVVPTKKSQIFSTASDNQPTVTIKVYEGERPLTKDNHLLGTFDLTGIPPAPRGVPQIEVTFEIDVNGILRVTAEDKGTGNKNKITITNDQNRLTPEEIERMVNDAEKFAEEDKKLKERIDTRNELESYAYSLKNQIGDKEKLGGKLSSEDKETMEKAVEEKIEWLESHQDADIEDFKAKKKELEEIVQPIISKLYGSAGPPPTGEEDTAEKDEL

SEQ ID NO: 911790 - protein, 657 aa, Homo sapiens
MKLSLVAAMLLLLSAARAEEEDKKEDVGTVVGIDLGTTYSCVGVFKNGRVEIIANDQGNRITPSYVAFTPEGERLIGDAAKNQLTSNPENTVFDAKRLIGRTWNDPSVQQDIKFLPFKVVEKKTKPYIQVDIGGGQTKTFAPEEISAMVLTKMKETAEAYLGKKVTHAVVTVPAYFNDAQRQATKDAGTIAGLNVMRIINEPTAAAIAYGLDKREGEKNILVFDLGGGTFDVSLLTIDNGVFEVVATNGDTHLGGEDFDQRVMEHFIKLYKKKTGKDVRKDNRAVQKLRREVEKAKRALSSQHQARIEIESFYEGEDFSETLTRAKFEELNMDLFRSTMKPVQKVLEDSDLKKSDIDEIVLVGGSTRIPKIQQLVKEFFNGKEPSRGINPDEAVAYGAAVQAGVLSGDQDTGDLVLLDVCPLTLGIETVGGVMTKLIPRNTVVPTKKSQIFSTASDNQPTVTIKVYEGERPLTKDNHLLGTFDLTGIPPAPRGVPQIEVTFEIDVNGILRVTAEDKGTGNKNKITITNDQNRLTPEEIERMVNDAEKFAEEDKKLKERIDTRNELESYAYSLKNQIGDKEKLGGKLSSEDKETMEKAVEEKIEWLESHQDADIEDFKAKKKELEEIVQPIISKLYGSAGPPPTGEEDTAELHHHHHH

SEQ ID NO: 911791 - protein, 114 aa, Homo sapiens
MVNDAEKFAEEDKKLKERIDTRNELESYAYSLKNQIGDKEKLGGKLSSEDKETMEKAVEEKIEWLESHQDADIEDFKAKKKELEEIVQPIISKLYGSAGPPPTGEEDTAEKDEL

SEQ ID NO: 911792 - protein, 483 aa, Homo sapiens
MKLSLVAAMLLLLSAARAEEEDKKEDVGTVVGIDLGTTYSCVGVFKNGRVEIIANDQGNRITPSYVAFTPEGERLIGDAAKNQLTSNPENTVFDAKRLIGRTWNDPSVQQDIKFLPFKVVEKKTKPYIQVDIGGGQTKTFAPEEISAMVLTKMKETAEAYLGKKVTHAVVTVPAYFNDAQRQATKDAGTIAGLNVMRIINEPTAAAIAYGLDKREGEKNILVFDLGGGTFDVSLLTIDNGVFEVVATNGDTHLGGEDFDQRVMEHFIKLYKKKTGKDVRKDNRAVQKLRREVEKAKRALSSQHQARIEIESFYEGEDFSETLTRAKFEELNMDLFRSTMKPVQKVLEDSDLKKSDIDEIVLVGGSTRIPKIQQLVKEFFNGKEPSRGINPDEAVAYGAAVQAGVLSGDQDTGDLVLLDVCPLTLGIETVGGVMTKLIPRNTVVPTKKSQIFSTASDNQPTVTIKVYEGERPLTKDLDCNSWRP

SEQ ID NO: 911793 - protein, 68 aa, Homo sapiens
ADSGGSLDDEAVEEKIEWLESHQDADIEDFKAKKKELEEIVQPIISKLYGSAGPPPTGEEDTAEKDEL

SEQ ID NO: 911794 - protein, 494 aa, Homo sapiens
MGPWGWKLRWTVALLLAAAGTAVGDRCERNEFQCQDGKCISYKWVCDGSAECQDGSDESQETCLSVTCKSGDFSCGGRVNRCIPQFWRCDGQVDCDNGSDEQGCPPKTCSQDEFRCHDGKCISRQFVCDSDRDCLDGSDEASCPVLTCGPASFQCNSSTCIPQLWACDNDPDCEDGSDEWPQRCRGLYVFQGDSSPCSAFEFHCLSGECIHSSWRCDGGPDCKDKSDEENCGQIHSSAFRGRSAPSAKAGHIRPPLERQASGYPARQPSPPRSLSGLAARAWGGEEGEGAAGSLAASALPGRADGWKVEPRPSLGAEPQRQGLKAMAPGPTAPQIGDAGDRALPLRPVIDLREGFTQGRLPGFLSSRSIIAWTRRRSAQLQCWSREVQSAALSLPVPGLRVGPRHLGASSLATPQRLGRAPAPGPGEWSDRPPSAASSWGTENLFARLPPERARASSLQVLPRPPGSPISHTPRLTVHTQIPESQPLVTPFGEF

SEQ ID NO: 911795 - protein, 136 aa, Homo sapiens
TCHHGRLILFYFWEETKSCYVGLAGLKLRVQAILPPQPSKLLGLQAWATVPSLLEVFLTCNSPTCPLERASQGRGSGSHVVGAASPGAFLLGPWQGVFLPGAAWPGPQDPLGLASARDLSLSTCVSRSPQWPPLLG

SEQ ID NO: 911796 - protein, 948 aa, Homo sapiens
MGPWGWKLRWTVALLLAAAGTAVGDRCERNEFQCQDGKCISYKWVCDGSAECQDGSDESQETCLSVTCKSGDFSCGGRVNRCIPQFWRCDGQVDCDNGSDEQGCPPKTCSQDEFRCHDGKCISRQFVCDSDRDCLDGSDEASCPVLTCGPASFQCNSSTCIPQLWACDNDPDCEDGSDEWPQRCRGLYVFQGDSSPCSAFEFHCLSGECIHSSWRCDGGPDCKDKSDEENCAVATCRPDEFQCSDGNCIHGSRQCDREYDCKDMSDEVGCVNVTLCEGPNKFKCHSGECITLDKVCNMARDCRDWSDEPIKECGTNECLDNNGGCSHVCNDLKIGYECLCPDGFQLVAQRRCEDIDECQDPDTCSQLCVNLEGGYKCQCEEGFQLDPHTKACKAVGSIAYLFFTNRHEVRKMTLDRSEYTSLIPNLRNVVALDTEVASNRIYWSDLSQRMICSTQLDRAHGVSSYDTVISRDIQAPDGLAVDWIHSNIYWTDSVLGTVSVADTKGVKRKTLFRENGSKPRAIVVDPVHGFMYWTDWGTPAKIKKGGLNGVDIYSLVTENIQWPNGITLDLLSGRLYWVDSKLHSISSIDVNGGNRKTILEDEKRLAHPFSLAVFEDKVFWTDIINEAIFSANRLTGSDVNLLAENLLSPEDMVLFHNLTQPRGVNWCERTTLSNGGCQYLCLPAPQINPHSPKFTCACPDGMLLARDMRSCLTEAEAAVATQETSTVRLKVSSTAVRTQHTTTRPVPDTSRLPGATPGLTTVEIVTMSHQALGDVAGRGNEKKPSSVRALSIVLPIATELGLWSRGQLCDRACLSLQCSSSSFAWGSSFYGRTGGLRTSTASTLTTPSIRRPQRMRSTFATTRTATATPRDRWSVWRMTWREHLPGVPSLPRTLPETSPALFYSKTEKTKALPARALFYIFIHLGGRTGFGQCPCNGLGWDFGFFLSS

SEQ ID NO: 911797 - protein, 782 aa, Homo sapiens
ISGASSVRPDVRPKQDCDNGSDEQGCPPKTCSQDEFRCHDGKCISRQFVCDSDRDCLDGSDEASCPVLTCGPASFQCNSSTCIPQLWACDNDPDCEDGSDEWPQRCRGLYVFQGDSSPCSAFEFHCLSGECIHSSWRCDGGPDCKDKSDEENCAVATCRPDEFQCSDGNCIHGSRQCDREYDCKDMSDEVGCVNVTLCEGPNKFKCHSGECITLDKVCNMARDCRDWSDEPIKECGTNECLDNNGGCSHVCNDLKIGYECLCPDGFQLVAQRRCEDIDECQDPDTCSQLCVNLEGGYKCQCEEGFQLDPHTKACKAVGSIAYLFFTNRHEVRKMTLDRSEYTSLIPNLRNVVALDTEVASNRIYWSDLSQRMICSTQLDRAHGVSSYDTVISRDIQAPDGLAVDWIHSNIYWTDSVLGTVSVADTKGVKRKTLFRENGSKPRAIVVDPVHGFMYWTDWGTPAKIKKGGLNGVDIYSLVTENIQWPNGITLDLLSGRLYWVDSKLHSISSIDVNGGNRKTILEDEKRLAHPFSLAVFEDKVFWTDIINEAIFSANRLTGSDVNLLAENLLSPEDMVLFHNLTQPRGVNWCERTTLSNGGCQYLCLPAPQINPHSPKFTCACPDGMLLARDMRSCLTEAEAAVATQETSTVRLKVSSTAVRTQHTTTRPVPDTSRLPGATPGLTTVEIVTMSHQALGDVAGRGNEKKPSSVRALSIVLPIVLLVFLCLGVFLLWKNWRLKNINSINFDNPVYQKTTEDEVHICHNQDGYSYPSRQMVSLEDDVA

SEQ ID NO: 911798 - protein, 596 aa, Homo sapiens
MGPWGWKLRWTVALLLAAAGTAVGDRCERNEFQCQDGKCISYKWVCDGSAECQDGSDESQETCLSVTCKSGDFSCGGRVNRCIPQFWRCDGQVDCDNGSDEQGCPPKTCSQDEFRCHDGKCISRQFVCDSDRDCLDGSDEASCPVLTCGPASFQCNSSTCIPQLWACDNDPDCEDGSDEWPQRCRGLYVFQGDSSPCSAFEFHCLSGECIHSSWRCDGGPDCKDKSDEENCAVATCRPDEFQCSDGNCIHGSRQCDREYDCKDMSDEVGCVNVTLCEGPNKFKCHSGECITLDKVCNMARDCRDWSDEPIKECGTNECLDNNGGCSHVCNDLKIGYECLCPDGFQLVAQRRCEDIDECQDPDTCSQLCVNLEGGYKCQCEEGFQLDPHTKACKAVGSIAYLFFTNRHEVRKMTLDRSEYTSLIPNLRNVVALDTEVASNRIYWSDLSQRMICSTQLDRAHGVSSYDTVISRDIQAPDGLAVDWIHSNIYWTDSVLGTVSVADTKGVKRKTLFRENGSKPRAIVVDPVHGFMYWTDWGTPAKIKKGGLNGVDIYSLVTENIQWPNGITLGQSILDRYHQRSHFQCQPPHRFRCQLVG

SEQ ID NO: 911799 - protein, 418 aa, Homo sapiens
TCHHGRLILFYFWEETKSCYVGLAGLKLRVQAILPPQPSKLLGLQAWATVPSLLEVFLTCNSPTCPLERASQGRGSGSHVVGAASPGAFLLGPWQGVFLPGAAWPGPRTLWDWHQHVTSPYPLVCLDLLSGRLYWVDSKLHSISSIDVNGGNRKTILEDEKRLAHPFSLAVFEDKVFWTDIINEAIFSANRLTGSDVNLLAENLLSPEDMVLFHNLTQPRGVNWCERTTLSNGGCQYLCLPAPQINPHSPKFTCACPDGMLLARDMRSCLTEAEAAVATQETSTVRLKVSSTAVRTQHTTTRPVPDTSRLPGATPGLTTVEIVTMSHQALGDVAGRGNEKKPSSVRALSIVLPIVLLVFLCLGVFLLWKNWRLKNINSINFDNPVYQKTTEDEVHICHNQDGYSYPSRQMVSLEDDVA

SEQ ID NO: 911800 - protein, 203 aa, Homo sapiens
MVFCHVDQASLKLLDSLKRSSCLGLPRSFETFVIRRTPMRRACRHVALRRRLFILSEAEAAVATQETSTVRLKVSSTAVRTQHTTTRPVPDTSRLPGATPGLTTVEIVTMSHQALGDVAGRGNEKKPSSVRALSIVLPIVLLVFLCLGVFLLWKNWRLKNINSINFDNPVYQKTTEDEVHICHNQDGYSYPSRQMVSLEDDVA

SEQ ID NO: 911801 - protein, 834 aa, Homo sapiens
MGPWGWKLRWTVALLLAAAGTAVGDRCERNEFQCQDGKCISYKWVCDGSAECQDGSDESQETCLSVTCKSGDFSCGGRVNRCIPQFWRCDGQVDCDNGSDEQGCPPKTCSQDEFRCHDGKCISRQFVCDSDRDCLDGSDEASCPVLTCGPASFQCNSSTCIPQLWACDNDPDCEDGSDEWPQRCRGLYVFQGDSSPCSAFEFHCLSGECIHSSWRCDGGPDCKDKSDEENCAVATCRPDEFQCSDGNCIHGSRQCDREYDCKDMSDEVGCVNVTLCEGPNKFKCHSGECITLDKVCNMARDCRDWSDEPIKECGTNECLDNNGGCSHVCNDLKIGYECLCPDGFQLVAQRRCEDIDECQDPDTCSQLCVNLEGGYKCQCEEGFQLDPHTKACKAVGSIAYLFFTNRHEVRKMTLDRSEYTSLIPNLRNVVALDTEVASNRIYWSDLSQRMICSTQLDRAHGVSSYDTVISRDIQAPDGLAVDWIHSNIYWTDSVLGTVSVADTKGVKRKTLFRENGSKPRAIVVDPVHGFMYWTDWGTPAKIKKGGLNGVDIYSLVTENIQWPNGITLDLLSGRLYWVDSKLHSISSIDVNGGNRKTILEDEKRLAHPFSLAVFEDKVFWTDIINEAIFSANRLTGSDVNLLAENLLSPEDMVLFHNLTQPRGVNWCERTTLSNGGCQYLCLPAPQINPHSPKFTCACPDGMLLARDMRSCLTEAEAAVATQETSTVRLKVSSTAVRTQHTTTRPVPDTSRLPGATPGLTTVEIVTMSHQALGDVAGRGNEKKPSSVRALSIVLPIVLLVFLCLGVFLLWKNWRLKNINSINFDNPVSTKNTKN

SEQ ID NO: 911802 - protein, 860 aa, Homo sapiens [sequence omitted]

SEQ ID NO: 911803 - protein, 825 aa, Homo sapiens
MGPWGWKLRWTVALLLAAAGTAVGDRCERNEFQCQDGKCISYKWVCDGSAECQDGSDESQETCLSVTCKSGDFSCGGRVNRCIPQFWRCDGQVDCDNGSDEQGCPPKTCSQDEFRCHDGKCISRQFVCDSDRDCLDGSDEASCPVLTCGPASFQCNSSTCIPQLWACDNDPDCEDGSDEWPQRCRGLYVFQGDSSPCSAFEFHCLSGECIHSSWRCDGGPDCKDKSDEENCAVATCRPDEFQCSDGNCIHGSRQCDREYDCKDMSDEVGCVNVTLCEGPNKFKCHSGECITLDKVCNMARDCRDWSDEPIKECGTNECLDNNGGCSHVCNDLKIGYECLCPDGFQLVAQRRCEDIDECQDPDTCSQLCVNLEGGYKCQCEEGFQLDPHTKACKAVGSIAYLFFTNRHEVRKMTLDRSEYTSLIPNLRNVVALDTEVASNRIYWSDLSQRMICSTQLDRAHGVSSYDTVISRDIQAPDGLAVDWIHSNIYWTDSVLGTVSVADTKGVKRKTLFRENGSKPRAIVVDPVHGFMYWTDWGTPAKIKKGGLNGVDIYSLVTENIQWPNGITLDLLSGRLYWVDSKLHSISSIDVNGGNRKTILEDEKRLAHPFSLAVFEDKVFWTDIINEAIFSANRLTGSDVNLLAENLLSPEDMVLFHNLTQPRGVNWCERTTLSNGGCQYLCLPAPQINPHSPKFTCACPDGMLLARDMRSCLTEAEAAVATQETSTVRLKVSSTAVRTQHTTTRPVPDTSRLPGATPGLTTVEIVTMSHQGKDWALPRPLFTQRRVPSVATNILVTRWSPGVVLTPLLTFSHLGRVSLGPQFPYL

SEQ ID NO: 911804 - protein, 556 aa, Homo sapiens
MGPWGWKLRWTVALLLAAAGTAVGDRCERNEFQCQDGKCISYKWVCDGSAECQDGSDESQETCLSVTCKSGDFSCGGRVNRCIPQFWRCDGQVDCDNGSDEQGCPPKTCSQDEFRCHDGKCISRQFVCDSDRDCLDGSDEASCPVLTCGPASFQCNSSTCIPQLWACDNDPDCEDGSDEWPQRCRGLYVFQGDSSPCSAFEFHCLSGECIHSSWRCDGGPDCKDKSDEENCAVATCRPDEFQCSDGNCIHGSRQCDREYDCKDMSDEVGCVNVTLCEGPNKFKCHSGECITLDKVCNMARDCRDWSDEPIKECGTNECLDNNGGCSHVCNDLKIGYECLCPDGFQLVAQRRCEDIDECQDPDTCSQLCVNLEGGYKCQCEEGFQLDPHTKACKAVGSIAYLFFTNRHEVRKMTLDRSEYTSLIPNLRNVVALDTEVASNRIYWSDLSQRMICSTQLDRAHGVSSYDTVISRDIQAPDGLAVDWIHSNIYWTDSVLGTVSVADTKGVKRKTLFRENGSKPRAIVVDPVHGCVSTTLRAAEGMEVAVSQDSPTALQPG

SEQ ID NO: 911805 - protein, 80 aa, Homo sapiens
NVIQGERLQAKGHRGGSCSWVRIHDAEGCRGNGGSRKELQELVSGLGMVAQSTCNPSTLGGQGGWIIKTSLTNMVKPRLY

SEQ ID NO: 911806 - protein, 860 aa, Homo sapiens [sequence omitted]

SEQ ID NO: 911807 - protein, 116 aa, Homo sapiens
MGPWGWKLRWTVALLLAAAGTAVGDRCERNEFQCQDGKCISYKWVCDGSAECQDGSDESQETCLSVTCKSGDFSCGGRVNRCIPQFWRCDGQVDCDNGSDEQGCRKCGPAFAIEPI

SEQ ID NO: 911808 - protein, 860 aa, Homo sapiens [sequence omitted]

SEQ ID NO: 911809 - protein, 563 aa, Homo sapiens
MARDCRDWSDEPIKECGTNECLDNNGGCSHVCNDLKIGYECLCPDGFQLVAQRRCEDIDECQDPDTCSQLCVNLEGGYKCQCEEGFQLDPHTKACKAVGSIAYLFFTNRHEVRKMTLDRSEYTSLIPNLRNVVALDTEVASNRIYWSDLSQRMICSTQLDRAHGVSSYDTVISRDIQAPDGLAVDWIHSNIYWTDSVLGTVSVADTKGVKRKTLFRENGSKPRAIVVDPVHGFMYWTDWGTPAKIKKGGLNGVDIYSLVTENIQWPNGITLDLLSGRLYWVDSKLHSISSIDVNGGNRKTILEDEKRLAHPFSLAVFEDKVFWTDIINEAIFSANRLTGSDVNLLAENLLSPEDMVLFHNLTQPRGVNWCERTTLSNGGCQYLCLPAPQINPHSPKFTCACPDGMLLARDMRSCLTEAEAAVATQETSTVRLKVSSTAVRTQHTTTRPVPDTSRLPGATPGLTTVEIVTMSHQALGDVAGRGNEKKPSSVRALSIVLPIVLLVFLCLGVFLLWKNWRLKNINSINFDNPVYQKTTEDEVHICHNQDGYSYPSRQMVSLEDDVA

SEQ ID NO: 911810 - protein, 860 aa, Homo sapiens [sequence omitted]

SEQ ID NO: 911811 - protein, 209 aa, Homo sapiens [sequence omitted]

SEQ ID NO: 911812 - protein, 142 aa, Homo sapiens
APFSRLRTPVPWSPTHVLTDRVGEASPRMHHHPGLVPILPTPTHFHSRGLLALSQFRVVHCVHLAFVLLFCTVFCRVCWDGIPGQGKPVSMNAGDREGQVDRDFKAVIVNIENCHCRLYVRPPSASTSMQMPPSHSLPQSCR

SEQ ID NO: 911813 - protein, 854 aa, Homo sapiens
MGPWGWKLRWTVALLLAAAGTAVGDRCERNEFQCQDGKCISYKWVCDGSAECQDGSDESQETCLSVTCKSGDFSCGGRVNRCIPQFWRCDGQVDCDNGSDEQGCPPKTCSQDEFRCHDGKCISRQFVCDSDRDCLDGSDEASCPVLTCGPASFQCNSSTCIPQLWACDNDPDCEDGSDEWPQRCRGLYVFQGDSSPCSAFEFHCLSGECIHSSWRCDGGPDCKDKSDEENCAVATCRPDEFQCSDGNCIHGSRQCDREYDCKDMSDEVGCVNVTLCEGPNKFKCHSGECITLDKVCNMARDCRDWSDEPIKECGTNECLDNNGGCSHVCNDLKIGYECLCPDGFQLVAQRRCEDIDECQDPDTCSQLCVNLEGGYKCQCEEGFQLDPHTKACKAVGSIAYLFFTNRHEVRKMTLDRSEYTSLIPNLRNVVALDTEVASNRIYWSDLSQRMICSTQLDRAHGVSSYDTVISRDIQAPDGLAVDWIHSNIYWTDSVLGTVSVADTKGVKRKTLFRENGSKPRAIVVDPVHGFMYWTDWGTPAKIKKGGLNGVDIYSLVTENIQWPNGITLDLLSGRLYWVDSKLHSISSIDVNGGNRKTILEDEKRLAHPFSLAVFEDKVFWTDIINEAIFSANRLTGSDVNLLAENLLSPEDMVLFHNLTQPRGVNWCERTTLSNGGCQYLCLPAPQINPHSPKFTCACPDGMLLARDMRSCLTEAEAAVATQETSTVRLKVSSTAVRTQHTTTRPVPDTSRLPGATPGLTTVEIVTMSHQALGDVAGRGNEKKPSSVRALSIVLPIVLLVFLCLGVFLLWKNWRLKNINSINFDNPVYQKTTEDEVHICHNQDGYSYPSVSDPL

SEQ ID NO: 911814 - protein, 637 aa, Homo sapiens
MGPWGWKLRWTVALLLAAAGTAVGDRCERNEFQCQDGKCISYKWVCDGSAECQDGSDESQETCLSVTCKSGDFSCGGRVNRCIPQFWRCDGQVDCDNGSDEQGCPPKTCSQDEFRCHDGKCISRQFVCDSDRDCLDGSDEASCPVLTCGPASFQCNSSTCIPQLWACDNDPDCEDGSDEWPQRCRGLYVFQGDSSPCSAFEFHCLSGECIHSSWRCDGGPDCKDKSDEENCAVATCRPDEFQCSDGNCIHGSRQCDREYDCKDMSDEVGCVNVTLCEGPNKFKCHSGECITLDKVCNMARDCRDWSDEPIKECGTNECLDNNGGCSHVCNDLKIGYECLCPDGFQLVAQRRCEDIDECQDPDTCSQLCVNLEGGYKCQCEEGFQLDPHTKACKAVGSIAYLFFTNRHEVRKMTLDRSEYTSLIPNLRNVVALDTEVASNRIYWSDLSQRMICSTQLDRAHGVSSYDTVISRDIQAPDGLAVDWIHSNIYWTDSVLGTVSVADTKGVKRKTLFRENGSKPRAIVVDPVHGFMYWTDWGTPAKIKKGGLNGVDIYSLVTENIQWPNGITLDLLCAVPPLCCPTAQRRPRLTCPDARAQAHCSHAHAHCQPIHPGYCHLHLSTLPGSGPEEELIPAPSHP

SEQ ID NO: 911815 - protein, 144 aa, Homo sapiens
SHPKTISPETLDISTSLIAVLIITFCIVTVLGREALTKGALWAVFLLAGSALLCAVVTGVIWRQPESKTKLSFKVPFLPVLPILSIFVNVYLMMQLDQGTWVRFAVWMLIGFIIYFGYGLWHSEEASLDADQARTPDGNLDQCK

SEQ ID NO: 911816 - protein, 629 aa, Homo sapiens
MGCKVLLNIGQQMLRRKVVDCSREETRLSRCLNTFDLVALGVGSTLGAGVYVLAGAVARENAGPAIVISFLIAALASVLAGLCYGEFGARVPKTGSAYLYSYVTVGELWAFITGWNLILSYIIGTSSVARAWSATFDELIGRPIGEFSRTHMTLNAPGVLAENPDIFAVIIILILTGLLTLGVKESAMVNKIFTCINVLVLGFIMVSGFVKGSVKNWQLTEEDFGNTSGRLCLNNDTKEGKPGVGGFMPFGFSGVLSGAATCFYAFVGFDCIATTGEEVKNPQKAIPVGIVASLLICFIAYFGVSAALTLMMPYFCLDNNSPLPDAFKHVGWEGAKYAVAVGSLCALSASLLGSMFPMPRVIYAMAEDGLLFKFLANVNDRTKTPIIATLASGAVAAVMAFLFDLKDLVDLMSIGTLLAYSLVAACVLVLRYQPEQPNLVYQMASTSDELDPADQNELASTNDSQLGFLPEAEMFSLKTILSPKNMEPSKISGLIVNISTSLIAVLIITFCIVTVLGREALTKGALWAVFLLAGSALLCAVVTGVIWRQPESKTKLSFKVPFLPVLPILSIFVNVYLMMQLDQGTWVRFAVWMLIGFIIYFGYGLWHSEEASLDADQARTPDGNLDQCK

SEQ ID NO: 911817 - protein, 235 aa, Homo sapiens
MGCKVLLNIGQQMLRRKVVDCSREETRLSRCLNTFDLVALGVGSTLGAGVYVLAGAVARENAGPAIVISFLIAALASVLAGLCYGEFGARVPKTGSAYLYSYVTVGELWAFITGWNLILSYIIGTSSVARAWSATFDELIGRPIGEFSRTHMTLNAPGVLAENPDIFAVIIILILTGLLTLGVKESAMVNKIFTCINVLVLGFIMVSGFVKGSVKNWQLTEEDFGNTSGRLCLNK

SEQ ID NO: 911818 - protein, 629 aa, Homo sapiens; identical to SEQ ID NO: 911816

SEQ ID NO: 911819 - protein, 564 aa, Homo sapiens [sequence omitted]

SEQ ID NO: 911820 - protein, 148 aa, Homo sapiens
MAPFEPLASGILLLLWLIAPSRACTCVPPHPQTAFCNSDLVIRAKFVGTPEVNQTTLYQRYEIKMTKMYKGFQALGDAADIRFRLHPRHGECLRILPQVPQPQRGVSHCWKTAGWTLAHHYLQVLWLPGNSLSFSSAPGLHQDLHCWL

SEQ ID NO: 911821 - protein, 116 aa, Homo sapiens
SSAQRDTRVIRAKFVGTPEVNQTTLYQRYEIKMTKMYKGFQALGDAADIRFRLHPRHGECLRILPQVPQPQRGVSHCWKTAGWTLAHHYLQVLWLPGNSLSFSSAPGLHQDLHCWL

SEQ ID NO: 911822 - protein, 147 aa, Homo sapiens
AYYNPPLSHGVNGMPFTQPTMAPFEPLASGILLLLWLIAPSRACTCVPPHPQTAFCNSDLVIRAKFVGTPEVNQTTLYQRYEIKMTKMYKGFQALGDAADIRFRLHPRHVNGMPFTPWRQRRVVVARRGLQRWGLCVVVYGLEFFGR

SEQ ID NO: 911823 - protein, 80 aa, Homo sapiens
GRLLLLNSRPLDPRPTLLAVRYAQCFPVYPSPANCRVALIACGRTSSSKALKRASSPVTLPACLGSQGCAPGKSLRSQIA

SEQ ID NO: 911824 - protein, 168 aa, Homo sapiens
AYYNPPLSHGVNGMPFTQPTMAPFEPLASGILLLLWLIAPSRACTCVPPHPQTAFCNSDLVIRAKFVGTPEVNQTTLYQRYEIKMTKMYKGFQALGDAADIRFRLHPRHGECLRILPQVPQPQRGVSHCWKTAGWTLAHHYLQVLWLPGNSLSFSSAPGLHQDLHCWL

SEQ ID NO: 911825 - protein, 178 aa, Homo sapiens
ELGCSLGAGHQARALPCQMPVYSAWPAEPTMAPFEPLASGILLLLWLIAPSRACTCVPPHPQTAFCNSDLVIRAKFVGTPEVNQTTLYQRYEIKMTKMYKGFQALGDAADIRFRLHPRHGECLRILPQVPQPQRGVSHCWKTAGWTLAHHYLQVLWLPGNSLSFSSAPGLHQDLHCWL

SEQ ID NO: 911826 - protein, 148 aa, Homo sapiens; identical to SEQ ID NO: 911820

SEQ ID NO: 911827 - protein, 148 aa, Homo sapiens; identical to SEQ ID NO: 911820

SEQ ID NO: 911828 - protein, 148 aa, Homo sapiens; identical to SEQ ID NO: 911820

SEQ ID NO: 911829 - protein, 116 aa, Homo sapiens
MIRLELSTLIRAKFVGTPEVNQTTLYQRYEIKMTKMYKGFQALGDAADIRFRLHPRHGECLRILPQVPQPQRGVSHCWKTAGWTLAHHYLQVLWLPGNSLSFSSAPGLHQDLHCWL

SEQ ID NO: 911830 - protein, 148 aa, Homo sapiens; identical to SEQ ID NO: 911820

SEQ ID NO: 911831 - protein, 148 aa, Homo sapiens; identical to SEQ ID NO: 911820

SEQ ID NO: 911832 - protein, 110 aa, Homo sapiens
MAPFEPLASGILLLLWLIAPSRACTCVPPHPQTAFCNSDLVIRAKFVGTPEVNQTTLYQRYEIKMTKMYKGFQALGDAADIRFRLHPRHGECLRILPQVPQPQRGVSHCW

SEQ ID NO: 911833 - protein, 148 aa, Homo sapiens; identical to SEQ ID NO: 911820

SEQ ID NO: 911834 - protein, 148 aa, Homo sapiens; identical to SEQ ID NO: 911820

SEQ ID NO: 911835 - protein, 112 aa, Homo sapiens
MMMHGHGRSFSWSENCRMDSCTSLPASFVAPWEQPELKLSAGASPRPTLLAVRNAQCFPVYPSPANCRVALIACGRTSSSKALKRASSPVTLPACLGSQGCAPGKSLRSQIA

SEQ ID NO: 911836 - protein, 124 aa, Homo sapiens
SSAQRDTREPTMAPFEPLASGILLLLWLIAPSRACTCVPPHPQTAFCNSDLVIRAKFVGTPEVNQTTLYQRYEIKMTKMYKGFQALGDAADIRFRLHPRHGECLRILPQVPQPQRGVSHCWGTA

SEQ ID NO: 911837 - protein, 148 aa, Homo sapiens; identical to SEQ ID NO: 911820

SEQ ID NO: 911838 - protein, 116 aa, Homo sapiens; identical to SEQ ID NO: 911821

SEQ ID NO: 911839 - protein, 106 aa, Homo sapiens
MYLGGVRASLPSGSVLKAEERKFCSTGEAGRSPQRCFPPPFQVFPCLSIPCKLQSGTHCLWTDQLLQGSEKGFQSRHLACLPREPGLCTWQVPAVPDSLNPARSGS

SEQ ID NO: 911840 - protein, 138 aa, Homo sapiens
NPIPLPQAPGPAGQWLGETVHRACTCVPPHPQTAFCNSDLVIRAKFVGTPEVNQTTLYQRYEIKMTKSGMSAGPHPFPVSTRCIVFTGGIIFHLLMFISHPWFQPRFWFLFLRPPPPPQFSGGHNVLLHVPPGRPPWG

SEQ ID NO: 911841 - protein, 160 aa, Homo sapiens
NRARTLPFTQPTMAPFEPLASGILLLLWLIAPSRACTCVPPHPQTAFCNSDLVIRAKFVGTPEVNQTTLYQRYEIKMTKMYKGFQALGDAADIRFRLHPRHGECLRILPQVPQPQRGVSHCWKTAGWTLAHHYLQVLWLPGNSLSFSSAPGLHQDLHCWL

SEQ ID NO: 911842 - protein, 148 aa, Homo sapiens; identical to SEQ ID NO: 911820

SEQ ID NO: 911843 - protein, 148 aa, Homo sapiens; identical to SEQ ID NO: 911820

SEQ ID NO: 911844 - protein, 121 aa, Homo sapiens
LGTPSTVFCNSDLVIRAKFVGTPEVNQTTLYQRYEIKMTKMYKGFQALGDAADIRFRLHPRHGECLRILPQVPQPQRGVSHCWKTAGWTLAHHYLQVLWLPGNSLSFSSAPGLHQDLHCWL

SEQ ID NO: 911845 - protein, 125 aa, Homo sapiens
SSVQCTPKTDGLLVIPDVIRAKFVGTPEVNQTTLYQRYEIKMTKMYKGFQALGDAADIRFRLHPRHGECLRILPQVPQPQRGVSHCWKTAGWTLAHHYLQVLWLPGNSLSFSSAPGLHQDLHCWL

SEQ ID NO: 911846 - protein, 148 aa, Homo sapiens; identical to SEQ ID NO: 911820

SEQ ID NO: 911847 - protein, 148 aa, Homo sapiens; identical to SEQ ID NO: 911820

SEQ ID NO: 911848 - protein, 197 aa, Homo sapiens
MAPFEPLASGILLLLWLIAPSRACTCVPPHPQTAFCNSDLVIRAKFVGTPEVNQTTLYQRYEIKMTKMYKGFQALGDAADIRFRLHPRHGECLRILPQENCRMDSCTSLPASFVAPWEQPELKLSAGASPRPTLLAVRNAQCFPVYPSPANCRVALIACGRTSSSKALKRASSPVTLPACLGSQGCAPGKSLRSQIA

SEQ ID NO: 911849 - protein, 166 aa, Homo sapiens
MAPFEPLASGILLLLWLIAPSRACTCVPPHPQTAFCNSDLVIRAKFVGTPEVNQTTLYQRYEIKMTKMYKGFQALGDAADIRFRLHPRHGECLRILPQVPQPQRGVSHCWCFPVYPSPANCRVALIACGRTSSSKALKRASSPVTLPACLGSQGCAPGKSLRSQIA

SEQ ID NO: 911850 - protein, 110 aa, Homo sapiens; identical to SEQ ID NO: 911832

SEQ ID NO: 911851 - protein, 146 aa, Homo sapiens
MAPFEPLASGILLLLWLIAPSRACTCVPPHPQTAFCNSDLVIRAKFVGTPEVNQTTLYQRYEIKMTKMYKGFQALGDAADIRFRLHPRHVWGKKILKQGYNNHNEEVFRGRKTSSEMDSLHSYPAVSWRCAESSPVLTRRAPGASR

SEQ ID NO: 911852 - protein, 442 aa, Homo sapiens
MALPGARARGWAAAARAAQRRRRVENAGGSPSPEPAGRRAALYVHWPYCEKRCSYCNFNKYIPRRLEEAAMQKCLVTEAQTLLRLSGVQRVESVFFGGGTPSLASPHTVAAVLEAVAQAAHLPADLEVTLEANPTSAPGSRLAEFGAAGVNRLSIGLQSLDDTELRLLGRTHSACDALRTLAEARRLFPGRVSVDLMLGLPAQQVGPWLGQLQELLHHCDDHLSLYQLSLERGTALFAQVQRGALPAPDPELAAEMYQRGRAVLREAGFHQYEVSNFARNGALSTHNWTYWQCGQYLGVGPGAHGRFMPQGAGGHTREARIQTLEPDNWMKEVMLFGHGTRKRVPLGRLELLEEVLALGLRTDVGITHQHWQQFEPQLTLWDVFGANKEVQELLERGLLQLDHRGLRCSWEGLAVLDSLLLTLLPQLQEAWQQRTPSPVPGG

SEQ ID NO: 911853 - protein, 342 aa, Homo sapiens
MALPGARARGWAAAARAAQRRRRVENAGGSPSPEPAGRRAALYVHWPYCEKRCSYCNFNKYIPRRLEEAAMQKCLVTEAQTLLRLSGVQRVESVFFGGGTPSLASPHTVAAVLEAVAQAAHLPADLEVTLEANPTSAPGSRLAEFGAAGVNRLSIGLQSLDDTELRLLGRTHSACDALRTLAEARRLFPGRVSVDLMLGLPAQQVGPWLGQLQELLHHCDDHLSLYQLSLERGTALFAQVQRGALPAPDPELAAEMYQRGRAVLREAGFHQYEVSNFARNGAGPTKGEGKGGTGAGGGGQGTGPKGGPGKKGTEKGEKGGGGRHPNGPGQRNAEKGAARQGG

SEQ ID NO: 911854 - protein, 504 aa, Homo sapiens
MALPGARARGWAAAARAAQRRRRVENAGGSPSPEPAGRRAALYVHWPYCEKRCSYCNFNKYIPRRLEEAAMQKCLVTEAQTLLRLSGVQRVESVFFGGGTPSLASPHTVAAVLEAVAQAAHLPADLEVTLEANPTSAPGSRLAEFGAAGVNRLSIGLQSLDDTELRLLGRTHSACDALRTLAEARRLFPGRVSVDLMLGLPAQQVGPWLGQLQELLHHCDDHLSLYQLSLERGTALFAQVQRGALPAPDPELAAEMYQRGRAVLREAGFHQYEVSNFARNVSSGADGWRWRMGRLQCDQGVVTFCREGSWPRWWDILTWGPLPESKNEACPLHSALFPPSPQGALSTHNWTYWQCGQYLGVGPGAHGRFMPQGAGGHTREARIQTLEPDNWMKEVMLFGHGTRKRVPLGRLELLEEVLALGLRTDVGITHQHWQQFEPQLTLWDVFGANKEVQELLERGLLQLDHRGLRCSWEGLAVLDSLLLTLLPQLQEAWQQRTPSPVPGG

SEQ ID NO: 911855 - protein, 434 aa, Homo sapiens
MALPGARARGWAAAARAAQRRRRVENAGGSPSPEPAGRRAALYVHWPYCEKRCSYCNFNKYIPRRLEEAAMQKCLVTEAQTLLRLSGVQRVESVFFGGGTPSLASPHTVAAVLEAVAQAAHLPADLEVTLEANPTSAPGSRLAEFGAAGVNRLSIGLQSLDDTELRLLGRTHSACDALRTLAEARRLFPGRVSVDLMLGLPAQQVGPWLGQLQELLHHCDDHLSLYQLSLERGTALFAQVQRGALPAPDPELAAEMYQRGRAVLREAGFHQYEVSNFARNGALSTHNWTYWQCGQYLGVGPGAHGRFMPQGAGGHTREARIQTLEPDNWMKEVMLFGHGTRKRVPLGRLELLEEVLALGLRTDVGITHQHWQQFEPQLTLWDVFGANKEVQELLERGLLQLDHRCVGGCRAEGAEAYQGALTTALHRPRRSEKD

SEQ ID NO: 911856 - protein, 246 aa, Homo sapiens [sequence omitted]

SEQ ID NO: 911857 - protein, 135 aa, Homo sapiens [sequence omitted]

SEQ ID NO: 911858 - protein, 113 aa, Homo sapiens
MSAAEISMLNWTLPHLSPYPNYVAQSSQASSPPLTLWLPQHWQQFEPQLTLWDVFGANKEVQELLERGLLQLDHRGLRCSWEGLAVLDSLLLTLLPQLQEAWQQRTPSPVPGG

SEQ ID NO: 911859 - protein, 304 aa, Homo sapiens
MALPGARARGWAAAARAAQRRRRVENAGGSPSPEPAGRRAALYVHWPYCEKRCSYCNFNKYIPRRLEEAAMQKCLVTEAQTLLRLSGVQRVESVFFGGGTPSLASPHTVAAVLEAVAQAAHLPADLEVTLEANPTSAPGSRLAEFGAAGVNRLSIGLQSLDDTELRLLGRTHSACDALRTLAEARRLFPGRVSVDLMLGLPAQQVGPWLGQLQELLHHCDDHLSLYQLSLERGTALFAQVQRGALPAPDPELAAEMYQRGRAVLREAGFHQYEVSNFARNVSSGADGWRWRMGRLQCDQGVVTF

SEQ ID NO: 911860 - protein, 313 aa, Homo sapiens
MALPGARARGWAAAARAAQRRRRVENAGGSPSPEPAGRRAALYVHWPYCEKRCSYCNFNKYIPRRLEEAAMQKCLVTEAQTLLRLSGVQRVESVFFGGGTPSLASPHTVAAVLEAVAQAAHLPADLEVTLEANPTSAPGSRLAEFGAAGVNRLSIGLQSLDDTELRLLGRTHSACDALRTLAEARRLFPGRVSVDLMLGLPAQQVGPWLGQLQELLHHCDDHLSLYQLSLERGTALFAQVQRGALPAPDPELAAEMYQRGRAVLREAGFHQYEVSNFARNGRSYHIDWVSYLWLGMDIMPRAGAHRRWKWTEL

SEQ ID NO: 911861 - protein, 355 aa, Homo sapiens
MALPGARARGWAAAARAAQRRRRVENAGGSPSPEPAGRRAALYVHWPYCEKRCSYCNFNKYIPRRLEEAAMQKCLVTEAQTLLRLSGVQRVESVFFGGGTPSLASPHTVAAVLEAVAQAAHLPADLEVTLEANPTSAPGSRLAEFGAAGVNRLSIGLQSLDDTELRLLGRTHSACDALRTLAEARRLFPGRVSVDLMLGLPAQQVGPWLGQLQELLHHCDDHLSLYQLSLERGTALFAQVQRGALPAPDPELAAEMYQRGRAVLREAGFHQYEVSNFARNGALSTHNWTYWQCGQYLGVGPGAHGRFMPQGAGGHTREARIQTLEPDNWMKEAGGSFGPGATHRCGDHSPALAAV

SEQ ID NO: 911862 - protein, 400 aa, Homo sapiens
MARYEAGVESAEDCNFNKYIPRRLEEAAMQKCLVTEAQTLLRLSGVQRVESVFFGGGTPSLASPHTVAAVLEAVAQAAHLPADLEVTLEANPTSAPGSRLAEFGAAGVNRLSIGLQSLDDTELRLLGRTHSACDALRTLAEARRLFPGRVSVDLMLGLPAQQVGPWLGQLQELLHHCDDHLSLYQLSLERGTALFAQVQRGALPAPDPELAAEMYQRGRAVLREAGFHQYEVSNFARNGALSTHNWTYWQCGQYLGVGPGAHGRFMPQGAGGHTREARIQTLEPDNWMKEVMLFGHGTRKRVPLGRLELLEEVLALGLRTDVGITHQHWQQFEPQLTLWDVFGANKEVQELLERGLLQLDHRGLRCSWEGLAVLDSLLLTLLPQLQEAWQQRTPSPVPGG

SEQ ID NO: 911863 - protein, 316 aa, Homo sapiens
MALPGARARGWAAAARAAQRRRRVENAGGSPSPEPAGRRAALYVHWPYCEKRCSYCNFNKYIPRRLEEAAMQKCLVTEAQTLLRLSGVQRVESVFFGGGTPSLASPHTVAAVLEAVAQAAHLPADLEVTLEANPTSAPGSRLAEFGAAGVNRLSIGLQSLDDTELRLLGRTHSACDALRTLAEARRLFPGRVSVDLMLGLPAQQVGPWLGQLQELLHHCDDHLSLYQLSLERGTALFAQVQRGALPAPDPELAAEDVFGANKEVQELLERGLLQLDHRGLRCSWEGLAVLDSLLLTLLPQLQEAWQQRTPSPVPGG

SEQ ID NO: 911864 - protein, 105 aa, Homo sapiens [sequence omitted]

SEQ ID NO: 911865 - protein, 379 aa, Homo sapiens
MGRRRRLCLQLYFLWLGCVVLWAQGTAGQPQPPPPKPPRPQPPPQQVRSATAGSEGGFLAPEYREEGAAVASRVRRRGQQDVLRGPNVCGSRFHSYCCPGWKTLPGGNQCIVPICRNSCGDGFCSRPNMCTCSSGQISSTCGSKSIQQCSVRCMNGGTCADDHCQCQKGYIGTYCGQPVCENGCQNGGRCIGPNRCACVYGFTGPQCERDYRTGPCFTQVNNQMCQGQLTGIVCTKTLCCATIGRAWGHPCEMCPAQPQPCRRGFIPNIRTGACQDVDECQAIPGICQGGNCINTVGSFECRCPAGHKQSETTQKCEDIDECSIIPGICETGECSNTVGSYFCVCPRGYVTSTDGSRCIDLFRIPPTCCRELDSLSPIC

SEQ ID NO: 911866 - protein, 327 aa, Homo sapiens
MGRRRRLCLQLYFLWLGCVVLWAQGTAGQPQPPPPKPPRPQPPPQQVRSATAGSEGGFLAPEYREEGAAVASRVRRRGQQDVLRGPNVCGSRFHSYCCPGWKTLPGGNQCIVPICRNSCGDGFCSRPNMCTCSSGQISSTCGSKSIQQCSVRCMNGGTCADDHCQCQKGYIGTYCGQPVCENGCQNGGRCIGPNRCACVYGFTGPQCERDYRTGPCFTQVNNQMCQGQLTGIVCTKTLCCATIGRAWGHPCEMCPAQPQPCRRGFIPNIRTGACQDVDECQAIPGICQGGNCINTVGSFECRCPAGHKQSETTQKCEGESLYFGKHA

SEQ ID NO: 911867 - protein, 142 aa, Homo sapiens
MSESLVVCDVAEDLVEKLRKFRFRKETNNAAIIMKIDKDKRLVVLDEELEGISPDELKDELPERQPRFIVYSYKYQHDDGRVSYPLCFIFSSPVGCKPEQQMMYAGSKNKLVQTAELTKVFEIRNTEDLTEEWLREKLGFFH

SEQ ID NO: 911868 - protein, 142 aa, Homo sapiens; identical to SEQ ID NO: 911867

SEQ ID NO: 911869 - protein, 142 aa, Homo sapiens; identical to SEQ ID NO: 911867

SEQ ID NO: 911870 - protein, 154 aa, Homo sapiens
MNKFVGLSNVDPKSESLVVCDVAEDLVEKLRKFRFRKETNNAAIIMKIDKDKRLVVLDEELEGISPDELKDELPERQPRFIVYSYKYQHDDGRVSYPLCFIFSSPVGCKPEQQMMYAGSKNKLVQTAELTKVFEIRNTEDLTEEWLREKLGFFH

SEQ ID NO: 911871 - protein, 142 aa, Homo sapiens; identical to SEQ ID NO: 911867

SEQ ID NO: 911872 - protein, 142 aa, Homo sapiens; identical to SEQ ID NO: 911867

SEQ ID NO: 911873 - protein, 198 aa, Homo sapiens
AGGGGQRPGGLGGRFRSQQLASAHSYEYLASAAATTPQGSIFQLGPGWTRPAGHGTRSESLVVCDVAEDLVEKLRKFRFRKETNNAAIIMKIDKDKRLVVLDEELEGISPDELKDELPERQPRFIVYSYKYQHDDGRVSYPLCFIFSSPVGCKPEQQMMYAGSKNKLVQTAELTKVFEIRNTEDLTEEWLREKLGFFH

SEQ ID NO: 911874 - protein, 142 aa, Homo sapiens; identical to SEQ ID NO: 911867

SEQ ID NO: 911875 - protein, 352 aa, Homo sapiens
MPQAASGAAAAAAQRLRGGAALPVHVLVPVVQEPREAAVLHPHDHPAGPLHVRHVRGAEPLVAGRGRPLQRHALATLPVQRGATLRHQLGVHGSAQPVHLPRPHEAQELRVTAPRDLEHLGARAGDPCWEARRLPLLPSAQWDPAQHPSPLSPSTPISDCACLHQPAGGRALRTPGAPIGALQIPRNVKLGGVREERQKLGASLPFENLRSSQSSETLLVPRPPPSEGTSCSVYVCISIYTSVLLGLPPSLGSKSQGVYVQVTPTQPHSPSSSPAVSPNLPSCCFAWLCSYGESGNPAVPKAGPQKAGQKEGGTGRQQEGRAGRQEAAACQSAEWSHWRFKLTGLQPHSHSR

SEQ ID NO: 911876 - protein, 394 aa, Homo sapiens
MKRQNVRTLALIVCTFTYLLVGAAVFDALESEPELIERQRLELRQQELRARYNLSQGGYEELERVVLRLKPHKAGVQWRFAGSFYFAITVITTIGYGHAAPSTDGGKVFCMFYALLGIPLTLVMFQSLGERINTLVRYLLHRAKKGLGMRRADVSMANMVLIGFFSCISTLCIGAAAFSHYEHWTFFQAYYYCFITLTTIGFGDYVALQKDQALQTQPQYVAFSFVYILTGLTVIGAFLNLVVLRFMTMNAEDEKRDAEHRALLTRNGQAGGGGGGGSAHTTDTASSTAAAGGGGFRNVYAEVLHFQSMCSCLWYKSREKLQYSIPMIIPRDLSTSDTCVEQSHSSPGGGGRYSDTPSRRCLCSGAPRSAISSVSTGLHSLSTFRGLMKRRSSV

SEQ ID NO: 911877 - protein, 394 aa, Homo sapiens; identical to SEQ ID NO: 911876

SEQ ID NO: 911878 - protein, 394 aa, Homo sapiens; identical to SEQ ID NO: 911876

SEQ ID NO: 911879 - protein, 535 aa, Homo sapiens
GAARGRGVGGSRAAEVAAGAQAAGAAGMAKSNGENGPRAPAAGESLSGTRESLAQGPDAATTDELSSLGSDSEANGFAERRIDKFGFIVGSQGAEGALEEVPLEVLRQRESKWLDMLNNWDKWMAKKHKKIRLRCQKGIPPSLRGRAWQYLSGGKVKLQQNPGKFDELDMSPGDPKWLDVIERDLHRQFPFHEMFVSRGGHGQQDLFRVLKAYTLYRPEEGYCQAQAPIAAVLLMHMPAEQAFWCLVQICEKYLPGYYSEKLEAIQLDGEILFSLLQKVSPVAHKHLSRQKIDPLLYMTEWFMCAFSRTLPWSSVLRVWDMFFCEGVKIIFRVGLVLLKHALGSPEKVKACQGQYETIERLRSLSPKIMQEAFLVQEVVELPVTERQIEREHLIQLRRWQETRGELQCRSPPRLHGAKAILDAEPGPRPALQPSPSIRLPLDAPLPGSKAKPKPPKQAQKEQRKQMKGRGQLEKPPAPNQAMVVAAAGDACPPQHVPPKDSAPKDSAPQDLAPQVSAHHRSQESLTSQESEDTYL

SEQ ID NO: 911880 - protein, 715 aa, Homo sapiens
GAARGRGVGGSRAAEVAAGAQAAGAAGMAKSNGENGPRAPAAGESLSGTRESLAQGPDAATTDELSSLGSDSEANGFAERRIDKFGFIVGSQGAEGALEEVPLEVLRQRESKWLDMLNNWDKWMAKKHKKIRLRCQKGIPPSLRGRAWQYLSGGKVKLQQNPGKFDELDMSPGDPKWLDVIERDLHRQFPFHEMFVSRGGHGQQDLFRVLKAYTLYRPEEGYCQAQAPIAAVLLMHMPAEQAFWCLVQICEKYLPGYYSEKLEAIQLDGEILFSLLQKVSPVAHKHLSRQKIDPLLYMTEWFMCAFSRTLPWSSVLRVWDMFFCEGVKIIFRVGLVLLKHALGSPEKVKACQGQYETIERLRSLSPKIMQEAFLVQEVVELPVTERQIEREHLIQLRRWQETRELPPSEFLQVAEATWLVLNVSSHSGAAVQAAGVTKIARSVIAPLAEHHVSVLMLSTYQTDFILVREQDLSVVIHTLAQEFDIYREVGGEPVPVTRDDSSNGFPRTQHAPPRRQPLAVLNPAPSQFFAFSLIEGYISIVMDAETQKKFPSDLLLTSSSGELWRMVRIGGQPLGFDECGIVAQIAGPLAAADISAYYISTFNFDHALGARGRYRQRHRGPPAAAGRPGFLRPMGNRAASLLSPRPRLPKTSLSYFLKLWNEPPVLLGTLVPLSVCKLRAGTGFYADTCVHSQVEWAGASLTACLPMQGNTVLGA

SEQ ID NO: 911881 - protein, 756 aa, Homo sapiens
GAARGRGVGGSRAAEVAAGAQAAGAAGMAKSNGENGPRAPAAGESLSGTRESLAQGPDAATTDELSSLGSDSEANGFAERRIDKFGFIVGSQGAEGALEEVPLEVLRQRESKWLDMLNNWDKWMAKKHKKIRLRCQKGIPPSLRGRAWQYLSGGKVKLQQNPGKFDELDMSPGDPKWLDVIERDLHRQFPFHEMFVSRGGHGQQDLFRVLKAYTLYRPEEGYCQAQAPIAAVLLMHMPAEQAFWCLVQICEKYLPGYYSEKLEAIQLDGEILFSLLQKVSPVAHKHLSRQKIDPLLYMTEWFMCAFSRTLPWSSVLRVWDMFFCEGVKIIFRVGLVLLKHALGSPEKVKACQGQYETIERLRSLSPKIMQEAFLVQEVVELPVTERQIEREHLIQLRRWQETRELPPSEFLQVAEATWLVLNVSSHSGAAVQAAGVTKIARSVIAPLAEHHVSVLMLSTYQTDFILVREQDLSVVIHTLAQEFDIYREVGGEPVPVTRDDSSNGFPRTQHGPSPTVHPIQSPQNRFCVLTLDPETLPAIATTLIDVLFYSHSTPKEAASSSPEPSSITFFAFSLIEGYISIVMDAETQKKFPSDLLLTSSSGELWRMVRIGGQPLGFDECGIVAQIAGPLAAADISAYYISTFNFDHALGARGRYRQRHRGPPAAAGRPGFLRPMGNRAASLLSPRPRLPKTSLSYFLKLWNEPPVLLGTLVPLSVCKLRAGTGFYADTCVHSQVEWAGASLTACLPMQGNTVLGA

SEQ ID NO: 911882 - protein, 485 aa, Homo sapiens
LRGLTRHYVAGFGRATLRDRNPTPADLELQEFVSYVCGSAAASVLSALEEVPLEVLRQRESKWLDMLNNWDKWMAKKHKKIRLRCQKGIPPSLRGRAWQYLSGGKVKLQQNPGKFDELDMSPGDPKWLDVIERDLHRQFPFHEMFVSRGGHGQQDLFRVLKAYTLYRPEEGYCQAQAPIAAVLLMHMPAEQAFWCLVQICEKYLPGYYSEKLEAIQLDGEILFSLLQKVSPVAHKHLSRQKIDPLLYMTEWFMCAFSRTLPWSSVLRVWDMFFCEGVKIIFRVGLVLLKHALGSPEKVKACQGQYETIERLRSLSPKIMQEAFLVQEVVELPVTERQIEREHLIQLRRWQETRGELQCRSPPRLHGAKAILDAEPGPRPALQPSPSIRLPLDAPLPGSKAKPKPPKQAQKEQRKQMKGRGQLEKPPAPNQAMVVAAAGDACPPQHVPPKDSAPKDSAPQDLAPQVSAHHRSQESLTSQESEDTYL

SEQ ID NO: 911883 - protein, 510 aa, Homo sapiens
GAARGRGVGGSRAAEVAAGAQAAGAAGMAKSNGENGPRAPAAGESLSGTRESLAQGPDAATTDELSSLGSDSEANGFAERRIDKFGFIVGSQGAEGALEEVPLEVLRQRESKWLDMLNNWDKWMAKKHKKIRLRCQKGIPPSLRGRAWQYLSGGKVKLQQNPGKFDELDMSPGDPKWLDVIERDLHRQFPFHEMFVSRGGHGQQDLFRVLKAYTLYRPEEGYCQAQAPIAAVLLMHMPAEQAFWCLVQICEKYLPGYYSEKLEAIQLDGEILFSLLQKVSPVAHKHLSRQKIDPLLYMTEWFMCAFSRTLPWSSVLRVWDMFFCEGVKIIFRVGLVLLKHALGSPEKVKACQGQYETIERLRSLSPKIMQEAFLVQEVVELPVTERQIEREHLIQLRRWQETRELPPSEFLQVAEATWLVLNVSSHSGAAVQAAGVTKIARSVIAPLAEHHVSVLMLSTYQTDFILVREQDLSVVIHTLAQEFDIYREVEWAGASLTACLPMQGNTVLGA

SEQ ID NO: 911884 - protein, 438 aa, Homo sapiens
AWHEAGRIRGLGLVGGGVGSARAAMELHILEHRVRVLSVARPGLWLYTHPLIKLLFLPRRSRCKFFSLTETPEDYTLMVDEEGFKELPPSEFLQVAEATWLVLNVSSHSGAAVQAAGVTKIARSVIAPLAEHHVSVLMLSTYQTDFILVREQDLSVVIHTLAQEFDIYREVGGEPVPVTRDDSSNGFPRTQHGPSPTVHPIQSPQNRFCVLTLDPETLPAIATTLIDVLFYSHSTPKEAASSSPEPSSITFFAFSLIEGYISIVMDAETQKKFPSDLLLTSSSGELWRMVRIGGQPLGFDECGIVAQIAGPLAAADISAYYISTFNFDHALGARGRYRQRHRGPPAAAGRPGFLRPMGNRAASLLSPRPRLPKTSLSYFLKLWNEPPVLLGTLVPLSVCKLRAGTGFYADTCVHSQVEWAGASLTACLPMQGNTVLGA

SEQ ID NO: 911885 - protein, 469 aa, Homo sapiens
MKRAAVYKHRVRMLSDLPCRSLCLCPHRILNLGLTMPQCSVAAVLLTTVDRITRCSDLLSSYNECDEEKALVYDTLAIILRWDGYSPPFNLSLAKCRPWWCHVVQSFCSPTEDTVVELPPSEFLQVAEATWLVLNVSSHSGAAVQAAGVTKIARSVIAPLAEHHVSVLMLSTYQTDFILVREQDLSVVIHTLAQEFDIYREVGGEPVPVTRDDSSNGFPRTQHGPSPTVHPIQSPQNRFCVLTLDPETLPAIATTLIDVLFYSHSTPKEAASSSPEPSSITFFAFSLIEGYISIVMDAETQKKFPSDLLLTSSSGELWRMVRIGGQPLGFDECGIVAQIAGPLAAADISAYYISTFNFDHALGARGRYRQRHRGPPAAAGRPGFLRPMGNRAASLLSPRPRLPKTSLSYFLKLWNEPPVLLGTLVPLSVCKLRAGTGFYADTCVHSQVEWAGASLTACLPMQGNTVLGA

SEQ ID NO: 911886 - protein, 400 aa, Homo sapiens
AWHEAGRIRGLGLVGGGVGSARAAMELHILEHRVRVLSVARPGLWLYTHPLIKLLFLPRRSRCKFFSLTETPEDYTLMVDEEGFKELPPSEFLQVAEATWLVLNVSSHSGAAVQAAGVTKIARSVIAPLAEHHVSVLMLSTYQTDFILVREQDLSVVIHTLAQEFDIYREVGGEPVPVTRDDSSNGFPRTQHGPSPTVHPIQSPQNRFCVLTLDPETLPAIATTLIDVLFYSHRFPSDLLLTSSSGELWRMVRIGGQPLGFDECGIVAQIAGPLAAADISAYYISTFNFDHALGARGRYRQRHRGPPAAAGRPGFLRPMGNRAASLLSPRPRLPKTSLSYFLKLWNEPPVLLGTLVPLSVCKLRAGTGFYADTCVHSQVEWAGASLTACLPMQGNTVLGA

SEQ ID NO: 911887 - protein, 275 aa, Homo sapiens
AWHEAGRIRGLGLVGGGVGSARAAMELHILEHRVRVLSVARPGLWLYTHPLIKLLFLPRRSRCKFFSLTETPEDYTLMVDEEGFKELPPSEFLQVAEATWLVLNVSSHSGAAVQAAGVTKIARSVIAPLAEHHVSVLMLSTYQTDFILVREQDLSVVIHTLAQEFDIYREVGGEPVPVTRDDSSNGFPRTQHGPSPTVHPIQSPQNRFCVLTLDPETLPAIATTLIDVLFYSHRWTLELRLCPHSTVPYTLSHHFPPIYQFCTSCLSSLGVPGSP

SEQ ID NO: 911888 - protein, 756 aa, Homo sapiens; identical to SEQ ID NO: 911881

SEQ ID NO: 911889 - protein, 677 aa, Homo sapiens
GAARGRGVGGSRAAEVAAGAQAAGAAGMAKSNGENGPRAPAAGESLSGTRESLAQGPDAATTDELSSLGSDSEANGFAERRIDKFGFIVGSQGAEGALEEVPLEVLRQRESKWLDMLNNWDKWMAKKHKKIRLRCQKGIPPSLRGRAWQYLSGGKVKLQQNPGKFDELDMSPGDPKWLDVIERDLHRQFPFHEMFVSRGGHGQQDLFRVLKAYTLYRPEEGYCQAQAPIAAVLLMHMPAEQAFWCLVQICEKYLPGYYSEKLEAIQLDGEILFSLLQKVSPVAHKHLSRQKIDPLLYMTEWFMCAFSRTLPWSSVLRVWDMFFCEGVKIIFRVGLVLLKHALGSPEKVKACQGQYETIERLRSLSPKIMQEAFLVQEVVELPVTERQIEREHLIQLRRWQETRELPPSEFLQVAEATWLVLNVSSHSGAAVQAAGVTKIARSVIAPLAEHHVSVLMLSTYQTDFILVREQDLSVVIHTLAQEFDIYREVGGEPVPVTRDDSSNGFPRTQHGSPVTFLLTSSSGELWRMVRIGGQPLGFDECGIVAQIAGPLAAADISAYYISTFNFDHALGARGRYRQRHRGPPAAAGRPGFLRPMGNRAASLLSPRPRLPKTSLSYFLKLWNEPPVLLGTLVPLSVCKLRAGTGFYADTCVHSQVEWAGASLTACLPMQGNTVLGA

SEQ ID NO: 911890 - protein, 366 aa, Homo sapiens
MSPGDPKWLDVIERDLHRQFPFHEMFVSRGGHGQQDLFRVLKAYTLYRPEEGYCQAQAPIAAVLLMHMPAEQAFWCLVQICEKYLPGYYSEKLEAIQLDGEILFSLLQKVSPVAHKHLSRQKIDPLLYMTEWFMCAFSRTLPWSSVLRVWDMFFCEGVKIIFRVGLVLLKHALGSPEKVKACQGQYETIERLRSLSPKIMQEAFLVQEVVELPVTERQIEREHLIQLRRWQETRGELQCRSPPRLHGAKAILDAEPGPRPALQPSPSIRLPLDAPLPGSKAKPKPPKQAQKEQRKQMKGRGQLEKPPAPNQAMVVAAAGDACPPQHVPPKDSAPKDSAPQDLAPQVSAHHRSQESLTSQESEDTYL

SEQ ID NO: 911891 - protein, 327 aa, Homo sapiens
GAARGRGVGGSRAAEVAAGAQAAGAAGMAKSNGENGPRAPAAGESLSGTRESLAQGPDAATTDELSSLGSDSEANGFAERRIDKFGFIVGSQGAEGALEEVPLEVLRQRESKWLDMLNNWDKWMAKKHKKIRLRCQKGIPPSLRGRAWQYLSGGKVKLQQNPGKFDELDMSPGDPKWLDVIERDLHRQFPFHEMFVSRGGHGQQDLFRVLKAYTLYRPEEGYCQAQAPIAAVLLMHMPAEQAFWCLVQICEKYLPGYYSEKLEAIQLDGEILFSLLQKVSPVAHKHLSRQKIDPLLYMTEWFMCASRAGSPYNYTVHELTFHILPTL

SEQ ID NO: 911892 - protein, 361 aa, Homo sapiens
MVDEEGFKELPPSEFLQVAEATWLVLNVSSHSGAAVQAAGVTKIARSVIAPLAEHHVSVLMLSTYQTDFILVREQDLSVVIHTLAQEFDIYREVGGEPVPVTRDDSSNGFPRTQHGPSPTVHPIQSPQNRFCVLTLDPETLPAIATTLIDVLFYSHSTPKEAASSSPEPSSITFFAFSLIEGYISIVMDAETQKKFPSDLLLTSSSGELWRMVRIGGQPLGFDECGIVAQIAGPLAAADISAYYISTFNFDHALGARGRYRQRHRGPPAAAGRPGFLRPMGNRAASLLSPRPRLPKTSLSYFLKLWNEPPVLLGTLVPLSVCKLRAGTGFYADTCVHSQVEWAGASLTACLPMQGNTVLGA

SEQ ID NO: 911893 - protein, 301 aa, Homo sapiens
MLSTYQTDFILVREQDLSVVIHTLAQEFDIYREVGGEPVPVTRDDSSNGFPRTQHGPSPTVHPIQSPQNRFCVLTLDPETLPAIATTLIDVLFYSHSTPKEAASSSPEPSSITFFAFSLIEGYISIVMDAETQKKFPSDLLLTSSSGELWRMVRIGGQPLGFDECGIVAQIAGPLAAADISAYYISTFNFDHALGARGRYRQRHRGPPAAAGRPGFLRPMGNRAASLLSPRPRLPKTSLSYFLKLWNEPPVLLGTLVPLSVCKLRAGTGFYADTCVHSQVEWAGASLTACLPMQGNTVLGA

SEQ ID NO: 911894 - protein, 158 aa, Homo sapiens
MSPGDPKWLDVIERDLHRQFPFHEMFVSRGGHGQQDLFRVLKAYTLYRPEEGYCQAQAPIAAVLLMHMPAEQAFWCLVQICEKYLPGYYSEKLEAIQLDGEILFSLLQKVSPVAHKHLSRQKIDPLLYMTEWFMCASRAGSPYNYTVHELTFHILPTL

SEQ ID NO: 911895 - protein, 460 aa, Homo sapiens
DLASMEDKTEKWSSQPEGPLKLKASSTDMPSQISVVNVDQLWEDSVLTVKFPKLMVPRFSFAAPSSEDDVFIPTVREVQCPEANIDTALCKESPGLWGASILKAGAGVPGEQPVDLNLPLEAPPISKVRVHIQGAQVESQEVTIHSIVTPEFVDLSVPRTFSTQIVRESEIPTSEIQTPSYGFSLLKVKIPEPHTQARVYTTMTQHSRTQEGTEEAPIQATPGVDSISGDLQPDTGEPFEMISSSVNVLGQQTLTFEVPSGHQLADSCSDEEPAEILEFPPDDSQEATTPLADEGRAPKDKPESKKSGLLWFWLPNIGFSSSVDETGVDSKNDVQRSAPIQTQPEARPEAELPKKQEKAGWFRFPKLGFSSSPTKKSKSTEDGAELEEQKLQEETITFFDARESFSPEEKEEGELIGPVGTGLDSRVMVTSAARTELILPEQDRKADDESKGSGLGPNEG

SEQ ID NO: 911896 - protein, 273 aa, Homo sapiens
DLASMEDKTEKWSSQPEGPLKLKASSTDMPSQISVVNVDQLWEDSVLTVKFPKLMVPRFSFAAPSSEDDVFIPTVREVQCPEANIDTALCKESPGLWGASILKAGAGVPGEQPVDLNLPLEAPPISKVRVHIQGAQVESQEVTIHSIVTPEFVDLSVPRTFSTQIVRESEIPTSEIQTPSYGFSLLKVKIPEPHTQARVYTTMTQHSRTQEGTEEAPIQATPGVDSISGDLQPDTGEPFEMISSSVNVLGSRWPEGTSNVSVCCPSTLTLEEI

SEQ ID NO: 911897 - protein, 72 aa, Homo sapiens
TKPNGKEHNSRNIRLEPEVSLKEEGELIGPVGTGLDSRVMVTSAARTELILPEQDRKADDESKGSGLGPNEG

SEQ ID NO: 911898 - protein, 460 aa, Homo sapiens; identical to SEQ ID NO: 911895

SEQ ID NO: 911899 - protein, 162 aa, Homo sapiens
RVHSHSAVYASSMSPPIAEQIIRSLKLIMGLDGTTQGLQRVQQLAKNTRYFRQRLQEMGFIIYGNENASVVPLLLYMPGKVAAFARHMLEKKIGVVVVGFPATPLAEARARFCVSAAHTREMLDTVLEALDEMGDLLQLKYSRHKKSARPELYDETSFELED

SEQ ID NO: 911900 - protein, 162 aa, Homo sapiens; identical to SEQ ID NO: 911899

SEQ ID NO: 911901 - protein, 225 aa, Homo sapiens
MDIRPNHTIYINNMNDKIKKEELKRSLYALFSQFGHVVDIVALKTMKMRGQAFVIFKELGSSTNALRQLQGFPFYGKPMRIQYAKTDSDIISKMRGTFADKEKKKEKKKAKTVEQTATTTNKKPGQGTPNSANTQGNSTPNPQVPDYPPNYILFLNNLPEETNEMMLSMLFNQFPGFKEVRLVPGRHDIAFVEFENDGQAGAARDALQGFKITPSHAMKITYAKK

SEQ ID NO: 911902 - protein, 225 aa, Homo sapiens; identical to SEQ ID NO: 911901

SEQ ID NO: 911903 - protein, 259 aa, Homo sapiens
MSVCSCEAWTTVDVRVQIGYTSLHEELNDITWIIIDQIYHNFNIIIYECTQNLERKLKRSLYALFSQFGHVVDIVALKTMKMRGQAFVIFKELGSSTNALRQLQGFPFYGKPMRIQYAKTDSDIISKMRGTFADKEKKKEKKKAKTVEQTATTTNKKPGQGTPNSANTQGNSTPNPQVPDYPPNYILFLNNLPEETNEMMLSMLFNQFPGFKEVRLVPGRHDIAFVEFENDGQAGAARDALQGFKITPSHAMKITYAKK

SEQ ID NO: 911904 - protein, 198 aa, Homo sapiens
GRLLLLLLEFKLLTMYGDMKMRGQAFVIFKELGSSTNALRQLQGFPFYGKPMRIQYAKTDSDIISKMRGTFADKEKKKEKKKAKTVEQTATTTNKKPGQGTPNSANTQGNSTPNPQVPDYPPNYILFLNNLPEETNEMMLSMLFNQFPGFKEVRLVPGRHDIAFVEFENDGQAGAARDALQGFKITPSHAMKITYAKK

SEQ ID NO: 911905 - protein, 140 aa, Homo sapiens
MDIRPNHTIYINNMNDKIKKEELKRSLYALFSQFGHVVDIVALKTMKMRGQAFVIFKELGSSTNALRQLQGFPFYGKPMRIQYAKTDSDIISKMRGTFADKEKKKEKKKAKTVEQTATTTNKKPGQVPWLQGSTSGTREA

SEQ ID NO: 911906 - protein, 140 aa, Homo sapiens; identical to SEQ ID NO: 911905

SEQ ID NO: 911907 - protein, 154 aa, Homo sapiens
MDIRPNHTIYINNMNDKIKKEELKRSLYALFSQFGHVVDIVALKTMKMRGQAFVIFKELGSSTNALRQLQGFPFYGKPMRIQYAKTDSDIISKMRGTFADKEKKKEKKKAKTVEQTATTTNKKPGQGTPNSANTQGNSTPNPQVPDYHSTLPGK

SEQ ID NO: 911908 - protein, 225 aa, Homo sapiens; identical to SEQ ID NO: 911901

SEQ ID NO: 911909 - protein, 225 aa, Homo sapiens; identical to SEQ ID NO: 911901

SEQ ID NO: 911910 - protein, 211 aa, Homo sapiens
AAAYYYYSRIQASNDVRGHGRDVIAESREQSMKMRGQAFVIFKELGSSTNALRQLQGFPFYGKPMRIQYAKTDSDIISKMRGTFADKEKKKEKKKAKTVEQTATTTNKKPGQGTPNSANTQGNSTPNPQVPDYPPNYILFLNNLPEETNEMMLSMLFNQFPGFKEVRLVPGRHDIAFVEFENDGQAGAARDALQGFKITPSHAMKITYAKK

SEQ ID NO: 911911 - protein, 173 aa, Homo sapiens
MDIRPNHTIYINNMNDKIKKEELKRSLYALFSQFGHVVDIVALKTMKMRGQAFVIFKELGSSTNALRQLQGFPFYGKPMRIQYAKTDSDIISKMRGTFADKEKKKEKKKAKTVEQTATTTNKKPGQGTPNSANTQGNSTPNPQVPDYPPNYILFLNNLPEETNEMMLSMLFNQ

SEQ ID NO: 911912 - protein, 157 aa, Homo sapiens
MDIRPNHTIYINNMNDKIKKEELKRSLYALFSQFGHVVDIVALKTMKMRGQAFVIFKELGSSTNALRQLQGFPFYGKPMRIQYAKTDSDIISKMRGTFADKEKKKEKKKAKTVEQTATTTNKKPGQGTPNSANTQGNSTPNPQVIFFPCRAYLKIRL

SEQ ID NO: 911913 - protein, 140 aa, Homo sapiens; identical to SEQ ID NO: 911905

SEQ ID NO: 911914 - protein, 583 aa, Homo sapiens
NRYKMAEGDEAARGQQPHQGLWRRRRTSDPSAAVNHVSSTTSLGENYEDDDLVNSDEVMKKPCPVQIVLAHEDDHNFELDEEALEQILLQEHIRDLNIVVVSVAGAFRKGKSFLLDFMLRYMYNKDSQSWIGGNNEPLTGFTWRGGCERETTGIQVWNEVFVIDRPNGTKVAVLLMDTQGAFDSQSTIKDCATVFALSTMTSSVQVYNLSQNIQEDDLQHLQLFTEYGRLAMEEIYQKPFQTLMFLIRDWSYPYEHSYGLEGGKQFLEKRLQVKQNQHEELQNVRKHIHNCFSNLGCFLLPHPGLKVATNPSFDGRLKDIDEDFKRELRNLVPLLLAPENLVEKEISGSKVTCRDLVEYFKAYIKIYQGEELPHPKSMLQATAEANNLAAVAGARDTYCKSMEQVCGGDKPYIAPSDLERKHLDLKEVAIKQFRSVKKMGGDEFCRRYQDQLEAEIEETYANFIKHNDGKNIFYAARTPATLFAVMFAMYIISGLTGFIGLNSIAVLCNLVMGLALIFLCTWAYVKYSGEFREIGTVIDQIAETLWEQVFSKLFEVTRRRMVHRALSSAQRQRLSSNNNKKKN

SEQ ID NO: 911915 - protein, 412 aa, Homo sapiens
MDTQGAFDSQSTIKDCATVFALSTMTSSVQVYNLSQNIQEDDLQHLQLFTEYGRLAMEEIYQKPFQTLMFLIRDWSYPYEHSYGLEGGKQFLEKRLQVKQNQHEELQNVRKHIHNCFSNLGCFLLPHPGLKVATNPSFDGRLKDIDEDFKRELRNLVPLLLAPENLVEKEISGSKVTCRDLVEYFKAYIKIYQGEELPHPKSMLQATAEANNLAAVAGARDTYCKSMEQVCGGDKPYIAPSDLERKHLDLKEVAIKQFRSVKKMGGDEFCRRYQDQLEAEIEETYANFIKHNDGKNIFYAARTPATLFAVMFAMYIISGLTGFIGLNSIAVLCNLVMGLALIFLCTWAYVKYSGEFREIGTVIDQIAETLWEQVLKPLGDNLMEENIRQSVTNSIKAGLTDQVSHHARLKTD

SEQ ID NO: 911916 - protein, 507 aa, Homo sapiens
NRYKMAEGDEAARGQQPHQGLWRRRRTSDPSAAVNHVSSTTSLGENYEDDDLVNSDEVMKKPCPVQIVLAHEDDHNFELDEEALEQILLQEHIRDLNIVVVSVAGAFRKGKSFLLDFMLRYMYNKVYNLSQNIQEDDLQHLQLFTEYGRLAMEEIYQKPFQTLMFLIRDWSYPYEHSYGLEGGKQFLEKRLQVKQNQHEELQNVRKHIHNCFSNLGCFLLPHPGLKVATNPSFDGRLKDIDEDFKRELRNLVPLLLAPENLVEKEISGSKVTCRDLVEYFKAYIKIYQGEELPHPKSMLQATAEANNLAAVAGARDTYCKSMEQVCGGDKPYIAPSDLERKHLDLKEVAIKQFRSVKKMGGDEFCRRYQDQLEAEIEETYANFIKHNDGKNIFYAARTPATLFAVMFAMYIISGLTGFIGLNSIAVLCNLVMGLALIFLCTWAYVKYSGEFREIGTVIDQIAETLWEQVLKPLGDNLMEENIRQSVTNSIKAGLTDQVSHHARLKTD

SEQ ID NO: 911917 - protein, 210 aa, Homo sapiens [sequence omitted]

SEQ ID NO: 911918 - protein, 587 aa, Homo sapiens
NRYKMAEGDEAARGQQPHQGLWRRRRTSDPSAAVNHVSSTTSLGENYEDDDLVNSDEVMKKPCPVQIVLAHEDDHNFELDEEALEQILLQEHIRDLNIVVVSVAGAFRKGKSFLLDFMLRYMYNKDSQSWIGGNNEPLTGFTWRGGCERETTGIQVWNEVFVIDRPNGTKVAVLLMDTQGAFDSQSTIKDCATVFALSTMTSSVQVYNLSQNIQEDDLQHLQLFTEYGRLAMEEIYQKPFQTLMFLIRDWSYPYEHSYGLEGGKQFLEKRLQVKQNQHEELQNVRKHIHNCFSNLGCFLLPHPGLKVATNPSFDGRLKDIDEDFKRELRNLVPLLLAPENLVEKEISGSKVTCRDLVEYFKAYIKIYQGEELPHPKSMLQATAEANNLAAVAGARDTYCKSMEQVCGGDKPYIAPSDLERKHLDLKEVAIKQFRSVKKMGGDEFCRRYQDQLEAEIEETYANFIKHNDGKNIFYAARTPATLFAVMFAMYIISGLTGFIGLNSIAVLCNLVMGLALIFLCTWAYVKYSGEFREIGTVIDQIAETLWEQVLKPLGDNLMEENIRQSVTNSIKAGLTDQVSHHARLKTD

SEQ ID NO: 911919 - protein, 583 aa, Homo sapiens; identical to SEQ ID NO: 911914

SEQ ID NO: 911920 - protein, 149 aa, Homo sapiens [sequence omitted]

SEQ ID NO: 911921 - protein, 141 aa, Homo sapiens
LLGRAGLFPGGAWGLRPRTALAATNMETLYRVPFLVLECPNLKLKKPPWLHMPSAMTVYALVVVSYFLITGGIIYDVIVEPPSVGSMTDEHGHQRPVAFCGLQSKWTIYYGRTCIQLPIYNGRFRFHNPGPIECTKYPKTQ

SEQ ID NO: 911922 - protein, 141 aa, Homo sapiens; identical to SEQ ID NO: 911921

SEQ ID NO: 911923 - protein, 141 aa, Homo sapiens; identical to SEQ ID NO: 911921

SEQ ID NO: 911924 - protein, 72 aa, Homo sapiens
RGAEGEKVLDAANMGTLYRVAHYRLASVLTWKHRKKRGLVETMSDRTMNMCIVHVLVSVLTFPRSIGGNHLE

SEQ ID NO: 911925 - protein, 142 aa, Homo sapiens
LLGRAGLFPGGAWGLRPRTALAATNMETLYRVPFLVLECPNLKLKKPPWLHMPSAMTVYALVVVSYFLITGGIIYDVIVEPPSVGSMTDEHGHQRPVAFCGLQSKWTIYYGRTCIQLPIYNGRFRFHNPGPIECTKYPFFHG

SEQ ID NO: 911926 - protein, 141 aa, Homo sapiens; identical to SEQ ID NO: 911921

SEQ ID NO: 911927 - protein, 141 aa, Homo sapiens; identical to SEQ ID NO: 911921

SEQ ID NO: 911928 - protein, 139 aa, Homo sapiens
LLGRAGLFPGGAWGLRPRTALAATNMETLYRVPFLVLECPNLKLKKPPWLHMPSAMTVYALVVVSYFLITGGIIYDVIVEPPSVGSMTDEHGHQRPVAFCGLQSKWTIYYGRTCIQLPIYNGRFLRAFHPWDPGSWPTP

SEQ ID NO: 911929 - protein, 141 aa, Homo sapiens; identical to SEQ ID NO: 911921

SEQ ID NO: 911930 - protein, 179 aa, Homo sapiens
RKLVISTHLIRGHRRTEDERRISDEKGDTRIQLSKYSEDGIAGFGITRSAWGLRPRTALAATNMETLYRVPFLVLECPNLKLKKPPWLHMPSAMTVYALVVVSYFLITGGIIYDVIVEPPSVGSMTDEHGHQRPVAFCGLQSKWTIYYGRTCIQLPIYNGRFRFHNPGPIECTKYPKTQ

SEQ ID NO: 911931 - protein, 99 aa, Homo sapiens
RKLVISTHLIRGHRRTEDERRISDEKGDTRIQLSKYSEDGIAGFGITRSAWGLRPRTALAATNMETLYRVPFLVLECPNLKLKKPPWLHMPSAMTVNNL

SEQ ID NO: 911932 - protein, 148 aa, Homo sapiens
AVSGEAGGGLRRITDLGDYLYAKLVHLVFQYCIALYLSTYTESLEEESRAWLRNAVRTEDLCMLVCGCLYLPLSTGGHKFYVCSSSEPPSVGSMTDEHGHQRPVAFCGLQSKWTIYYGRTCIQLPIYNGRFRFHNPGPIECTKYPKTQ

SEQ ID NO: 911933 - protein, 112 aa, Homo sapiens
LLGRAGLFPGGAWGLRPRTALAATNMETLYRVPFLVLECPNLKLKKPPWLHMPSAMTVYALVVVSYFLITGGIIYDVIVEPPSVGSMTDEHGHQRPVAFCGLQGLSDGLECL

SEQ ID NO: 911934 - protein, 112 aa, Homo sapiens; identical to SEQ ID NO: 911933

SEQ ID NO: 911935 - protein, 411 aa, Homo sapiens
MAEGSRGGPTCSGVGGRQDPVSGSGGCNFPEYELPELNTRAFHVGAFGELWRGRLRGAGDLSLREPPASALPGSQAADSDREDAAVARDLDCSLEAAAELRAVCGLDKLKCLEDGEDPEVIPENTDLVTLGVRKRFLEHREETITIDRACRQETFVYEMESHAIGKKPENSADMIEEGELILSVNILYPVIFHKHKEHKPYQTMLVLGSQKLTQLRDSIRCVSDLQIGGEFSNTPDQAPEHISKDLYKSAFFYFEGTFYNDKRYPECRDLSRTIIEWSESHDRGYGKFQTARMEDFTFNDLCIKLGFPYLYCHQGDCEHVIVITDIRLVHHDDCLDRTLYPLLIKKHWLWTRKCFVCKMYTARWVTNNDSFAPEDPCFFCDVCFRMLHYDSEGNKLGEFLAYPYVDPGTFN

SEQ ID NO: 911936 - protein, 291 aa, Homo sapiens
MAEGSRGGPTCSGVGGRQDPVSGSGGCNFPEYELPELNTRAFHVGAFGELWRGRLRGAGDLSLREPPASALPGSQAADSDREDAAVARDLDCSLEAAAELRAVCGLDKLKCLEDGEDPEVIPENTDLVTLGVRKRFLEHREETITIDRACRQETFVYEMESHAIGKKPENSADMIEEGELILSVNILYPVIFHKHKEHKPYQTMLVLGSQKLTQLRDSIRCVSDLQIGGEFSNTPDQAPEHISKDLYKSAFFYFEGTFYNDKRYPECRDLSRTIIDVGKSPMDREANGKGS

SEQ ID NO: 911937 - protein, 411 aa, Homo sapiens; identical to SEQ ID NO: 911935

SEQ ID NO: 911938 - protein, 411 aa, Homo sapiens; identical to SEQ ID NO: 911935

SEQ ID NO: 911939 - protein, 171 aa, Homo sapiens
MAEGSRGGPTCSGVGGRQDPVSGSGGCNFPEYELPELNTRAFHVGAFGELWRGRLRGAGDLSLREPPASALPGSQAADSDREDAAVARDLDCSLEAAAELRAVCGLDKLKCLEDGEDPEVIPENTDLVTLGVRKRFLEHREETITIDRACRQETFVYEMVIKSLIFFTLFS

SEQ ID NO: 911940 - protein, 411 aa, Homo sapiens; identical to SEQ ID NO: 911935

SEQ ID NO: 911941 - protein, 169 aa, Homo sapiens
TLELDPIGAPLLTAPEHISKDLYKSAFFYFEGTFYNDKRYPECRDLSRTIIEWSESHDRGYGKFQTARMEDFTFNDLCIKLGFPYLYCHQGDCEHVIVITDIRLVHHDDCLDRTLYPLLIKKHWLWTRKCFVCKMYTARWVTNNDSFAPEDPCFFCECSCQCAHGQQHS

SEQ ID NO: 911942 - protein, 361 aa, Homo sapiens
MAEGSRGGPTCSGVGGRQDPVSGSGGCNFPEYELPELNTRAFHVGAFGELWRGRLRGAGDLSLREPPASALPGSQAADSDREDAAVARDLDCSLEAAAELRAVCGLDKLKCLEDGEDPEVIPENTDLVTLGVRKRFLEHREETITIDRACRQETFVYEMESHAIGKKPENSADMIEEGELILSVNILYPVIFHKDLYKSAFFYFEGTFYNDKRYPECRDLSRTIIEWSESHDRGYGKFQTARMEDFTFNDLCIKLGFPYLYCHQGDCEHVIVITDIRLVHHDDCLDRTLYPLLIKKHWLWTRKCFVCKMYTARWVTNNDSFAPEDPCFFCDVCFRMLHYDSEGNKLGEFLAYPYVDPGTFN

SEQ ID NO: 911943 - protein, 212 aa, Homo sapiens
SRRQSVRRPGGTRSHSPTHGRRDAGARLTMWKLGRGRVLLDEPPEEEDGLRGGPPPAAAAAAQVQGASFRGWKEVTSLFNKDDEQHLLERCKSPKSKGTNLRLKEELKAEKKSGFWDNLVLKQNIQSKKPDEIEGWEPPKLALEDISADPEDTVGGHPSWSGWEDDAKGSTKYTSLASSANSSRWSLRAAGRLVSIRRQSKGHLTDSPEEAE

SEQ ID NO: 911944 - protein, 212 aa, Homo sapiens; identical to SEQ ID NO: 911943

SEQ ID NO: 911945 - protein, 212 aa, Homo sapiens; identical to SEQ ID NO: 911943

SEQ ID NO: 911946 - protein, 212 aa, Homo sapiens; identical to SEQ ID NO: 911943

SEQ ID NO: 911947 - protein, 203 aa, Homo sapiens
MGGSLRVAVLGAPGVGKTAIIRQFLFGDYPERHRPTDGPRLYRPAVLLDGAVYDLSIRDGDVAGPGSSPGGPEEWPDAKDWSLQDTDAFVLVYDICSPDSFDYVKALRQRIAETRPAGAPEAPILVVGNKRDRQRLRFGPRRALAALVRRGWRCGYLECSAKYNWHVLRLFRELLRCALVRARPAHPALRLQGALHPARCSLM

SEQ ID NO: 911948 - protein, 197 aa, Homo sapiens
MCSLAHMGLGFRWGGGGGGVSGRRKGMRLRVYTHWGNSPAVGSPRLSSPFGPQAGGRARSAHPRGRQQAGQAAAALRTAARAGRPSAQGLALRLPRVLRQVQLARAASLPRAAALRSGARAPCTPGPAPAGGAASRALQPHVTRSDSAIHGPHLVTGTIRDLDWTGSPNFTGTGQGSLRPDWMRKAPTQSPKRLAPF

SEQ ID NO: 911949 - protein, 84 aa, Homo sapiens
SRSASPCALGRPARAAVRGAASRALQPHVTRSDSAIHGPHLVTGTIRDLDWTGSPNFTGTGQGSLRPDWMRKAPTQSPKRLAPF

SEQ ID NO: 911950 - protein, 203 aa, Homo sapiens; identical to SEQ ID NO: 911947

SEQ ID NO: 911951 - protein, 333 aa, Homo sapiens
MGGSLRVAVLGAPGVGKTAIIRQFLFGDYPERHRPTDGPRLYRPAVLLDGAVYDLSIRDGDVAGPGSSPGGPEEWPDAKDWSLQDTDAFVLVYDICSPDSFDYVKALRQRIAETRKGPGSSGGGELGQVWQGLCLRRVCRVSQRRGPGLQAFARGKVLSCMCSLAHMGLGFRWGGGGGGVSGRRKGMRLRVYTHWGNSPAVGSPRLSSPFGPQAGGRARSAHPRGRQQAGQAAAALRTAARAGRPSAQGLALRLPRVLRQVQLARAASLPRAAALRSGARAPCTPGPAPAGGAASRALQPHVTRSDSAIHGPHLVTGTIRDLDWTGSPNLHWR

SEQ ID NO: 911952 - protein, 186 aa, Homo sapiens
PASAPGWRELGVSCLSQSGFGDSCVLRLFMEEMSGESVVSSAVPAAATRTTSFKGTSPSSKYVKLNVGGALYYTTMQTLTKQDTMLKAMFSGRMEVLTDSEGWILIDRCGKHFGTILNYLRDGAVPLPESRREIEELLAEAKYYLVQGLVEECQAALQFTGGENPSLFPAMTAPSPLARACPAGQL

SEQ ID NO: 911953 - protein, 342 aa, Homo sapiens
PASAPGWRELGVSCLSQSGFGDSCVLRLFMEEMSGESVVSSAVPAAATRTTSFKGTSPSSKYVKLNVGGALYYTTMQTLTKQDTMLKAMFSGRMEVLTDSEGWILIDRCGKHFGTILNYLRDGAVPLPESRREIEELLAEAKYYLVQGLVEECQAALQNKDTYEPFCKVPVITSSKEEQKLIATSNKPAVKLLYNRSNNKYSYTSNSDDNMLKNIELFDKLSLRFNGRVLFIKDVIGDEICCWSFYGQGRKIAEVCCTSIVYATEKKQTKVEFPEARIYEETLNILLYEAQDGRGPDNALLEATGGAAGRSHHLDEDEERERIERVRRIHIKRPDDRAHLHQ

SEQ ID NO: 911954 - protein, 342 aa, Homo sapiens; identical to SEQ ID NO: 911953

SEQ ID NO: 911955 - protein, 342 aa, Homo sapiens; identical to SEQ ID NO: 911953

SEQ ID NO: 911956 - protein, 342 aa, Homo sapiens; identical to SEQ ID NO: 911953

SEQ ID NO: 911957 - protein, 342 aa, Homo sapiens; identical to SEQ ID NO: 911953

SEQ ID NO: 911958 - protein, 765 aa, Homo sapiens
FPSPFEEVPEAHRASPREGTSGGERLQDLVKSKMSETSRTAFGGRRAVPPNNSNAAEDDLPTVELQGVVPRGVNLQEFLNVTSVHLFKERWDTNKVDHHTDKYENNKLIVRRGQSFYVQIDFSRPYDPRRDLFRVEYVIGRYPQENKGTYIPVPIVSELQSGKWGAKIVMREDRSVRLSIQSSPKCIVGKFRMYVAVWTPYGVLRTSRNPETDTYILFNPWCEDDAVYLDNEKEREEYVLNDIGVIFYGEVNDIKTRSWSYGQFEDGILDTCLYVMDRAQMDLSGRGNPIKVSRVGSAMVNAKDDEGVLVGSWDNIYAYGVPPSAWTGSVDILLEYRSSENPVRYGQCWVFAGVFNTFLRCLGIPARIVTNYFSAHDNDANLQMDIFLEEDGNVNSKLTKDSVWNYHCWNEAWMTRPDLPVGFGGWQAVDSTPQENSDGMYRCGPASVQAIKHGHVCFQFDAPFVFAEVNSDLIYITAKKDGTHVVENVDATHIGKLIVTKQIGGDGMMDITDTYKFQEGQEEERLALETALMYGAKKPLNTEGVMKSRSNVDMDFEVENAVLGKDFKLSITFRNNSHNRYTITAYLSANITFYTGVPKAEFKKETFDVTLEPLSFKKEAVLIQAGEYMGQLLEQASLHFFVTARINETRDVLAKQKSTVLTIPEIIIKVRGTQVVGSDMTVTVEFTNPLKETLRNVWVHLDGPGVTRPMKKMFREIRPNSTVQWEEVCRPWVSGHRKLIASMSSDSLRHVYGELDVQIQRRPSM

SEQ ID NO: 911959 - protein, 765 aa, Homo sapiens; identical to SEQ ID NO: 911958

SEQ ID NO: 911960 - protein, 326 aa, Homo sapiens
MYRCGPASVQAIKHGHVCFQFDAPFVFAEVNSDLIYITAKKDGTHVVENVDATHIGKLIVTKQIGGDGMMDITDTYKFQEGQEEERLALETALMYGAKKPLNTEGVMKSRSNVDMDFEVENAVLGKDFKLSITFRNNSHNRYTITAYLSANITFYTGVPKAEFKKETFDVTLEPLSFKKEAVLIQAGEYMGQLLEQASLHFFVTARINETRDVLAKQKSTVLTIPEIIIKVRGTQVVGSDMTVTVEFTNPLKETLRNVWVHLDGPGVTRPMKKMFREIRPNSTVQWEEVCRPWVSGHRKLIASMSSDSLRHVYGELDVQIQRRPSM

SEQ ID NO: 911961 - protein, 232 aa, Homo sapiens
SAAASGGEDEEEASSPDSGHLKDGIRRGRPRADTVRDLINEGEHSSSRIRCNICNRVFPREKSLQAHKRTHTGERPYLCDYPDCGKAFVQSGQLKTHQRLHTGEKPFVCSENGCLSRFTHANRHCPKHPYARLKREEPTDTLSKHQAADNKAAAEWLARYWEMREQRTPTLKGKLVQKADQEQQDPLEYLQSDEEDDEKRGAQRRLQEQRERLHGALALIELANLTGAPLRQ

SEQ ID NO: 911962 - protein, 119 aa, Homo sapiens
MPQSKSRKIAILGYRSVGKSSLTIQFVEGQFVDSYDPTIENTFTKLITVNGQEYHLQLVDTAGQDEYSIFPQTYSIDINGYILVYSVTSIKSFEVIKVIHGQIVGYGGESTNTYYVGWE

SEQ ID NO: 911963 - protein, 119 aa, Homo sapiens; identical to SEQ ID NO: 911962

SEQ ID NO: 911964 - protein, 119 aa, Homo sapiens; identical to SEQ ID NO: 911962

SEQ ID NO: 911965 - protein, 119 aa, Homo sapiens; identical to SEQ ID NO: 911962

SEQ ID NO: 911966 - protein, 119 aa, Homo sapiens; identical to SEQ ID NO: 911962

SEQ ID NO: 911967 - protein, 119 aa, Homo sapiens; identical to SEQ ID NO: 911962

SEQ ID NO: 911968 - protein, 108 aa, Homo sapiens
MGTFNLGKSSLTIQFVEGQFVDSYDPTIENTFTKLITVNGQEYHLQLVDTAGQDEYSIFPQTYSIDINGYILVYSVTSIKSFEVIKVIHGQIVGYGGESTNTYYVGWE

SEQ ID NO: 911969 - protein, 108 aa, Homo sapiens; identical to SEQ ID NO: 911968

SEQ ID NO: 911970 - protein, 103 aa, Homo sapiens
MPQSKSRKIAILGYRSVGKSSLTIQFVEGQFVDSYDPTIENIVDTAGQDEYSIFPQTYSIDINGYILVYSVTSIKSFEVIKVIHGQIVGYGGESTNTYYVGWE

SEQ ID NO: 911971 - protein, 156 aa, Homo sapiens
MGDGVSDTSSRGCAGAVQSALGENGVIKKRRKKGEGHDAASFSRDFSGGIAASPFFAFKVKRRPDAPPAYFGGRRRRATARRGAVLTPAGHVGVLWGGGAPPRGRFRAVGSARASEREAAAPAAAPALYAALSRRGRRRSQQQEPPPPRLMWLGRG

SEQ ID NO: 911972 - protein, 76 aa, Homo sapiens
PRAAGFGTSGNKKDLHMERVISYEEGKALAESWNAAFLESSAKENQTAVDVFRRIILEAEKMDGAASQGKSSCSVM

SEQ ID NO: 911973 - protein, 116 aa, Homo sapiens
MPQSKSRKIAILGYRSVGKSSLTIQFVEGQFVDSYDPTIENTFTKLITVNGQEYHLQLVDTAGQVSDLWYLRILYSISDILVLALIFKSTSYAKKTPQVVCRQSLTPNGLACSGST

SEQ ID NO: 911974 - protein, 132 aa, Homo sapiens
RRVVSEIPVLKTNAGPRDRELWVQRLKEEYQPLSGKSSLTIQFVEGQFVDSYDPTIENTFTKLITVNGQEYHLQLVDTAGQDEYSIFPQTYSIDINGYILVYSVTSIKSFEVMVPRSGEQSLLLGNLAKVNK

SEQ ID NO: 911975 - protein, 119 aa, Homo sapiens; identical to SEQ ID NO: 911962

SEQ ID NO: 911976 - protein, 119 aa, Homo sapiens; identical to SEQ ID NO: 911962

SEQ ID NO: 911977 - protein, 119 aa, Homo sapiens; identical to SEQ ID NO: 911962

SEQ ID NO: 911978 - protein, 119 aa, Homo sapiens; identical to SEQ ID NO: 911962

SEQ ID NO: 911979 - protein, 119 aa, Homo sapiens; identical to SEQ ID NO: 911962

SEQ ID NO: 911980 - protein, 156 aa, Homo sapiens
MGDGVSDTSSRGCAGAVQSALGENGVIKKRRKKGEGHDAASFSRDFSGGIAASPFFAFKVKRRPDAPPAYFGGRRRRATARRGAVLTPAGHVGVLWGGGAPPRGRFRAVGSARASEREAAAPAAAPALYAALVQVPEDRDPGLPVCGEILIDDSIC

SEQ ID NO: 911981 - protein, 119 aa, Homo sapiens; identical to SEQ ID NO: 911962

SEQ ID NO: 911982 - protein, 165 aa, Homo sapiens
MPQSKSRKIAILGYRSVGKSSLTIQFVEGQFVDSYDPTIENTFTKLITVNGQEYHLQLVDTAGQDEYSIFPQTYSIDINGYILVYSVTSIKRIPIMLVGNKKDLHMERVISYEEGKALAESWNAAFLESSAKENQTAVDVFRRIILEAEKMDGAASQGKSSCSVM

SEQ ID NO: 911983 - protein, 119 aa, Homo sapiens; identical to SEQ ID NO: 911962

SEQ ID NO: 911984 - protein, 312 aa, Homo sapiens [sequence omitted]

SEQ ID NO: 911985 - protein, 183 aa, Homo sapiens
MACAAVMIPGLLRCSVGAIRIEAASLRLTLSTLRHLTLTSIMKSKRKTDHMERTASVLRREIVAAAKVCGAASESPSVKSLRLLVADQDFSFKAGQWVDFFIPGVSVVGGFSICSSPRLLEQERVIELAVKYTNHPPALWVHNTCTLDCEVAVRVGGEFFFDPQPADASRNKADERIKEIDTF

SEQ ID NO: 911986 - protein, 312 aa, Homo sapiens [sequence omitted]

SEQ ID NO: 911987 - protein, 174 aa, Homo sapiens
MACAAVMIPGLLRCSVGAIRIEAASLRLTLSTLRHLTLTSIMKSKRKTDHMERTASVLRREIVAAAKVCGAASESPSVKSLRLLVADQDFSFKAGQWVDFFIPGVSVVGGFSICSSPRLLEQERVIELAVKYTNHPPALWVHNTCTLDCEVAVRVGGEFFFDPQPADASRKKYP

SEQ ID NO: 911988 - protein, 574 aa, Homo sapiens
MATLVVNKLGAGVDSGRQGSRGTAVVKVLECGVCEDVFSLQGDKVPRLLLCGHTVCHDCLTRLPLHGRAIRCPFDRQVTDLGDSGVWGLKKNFALLELLERLQNGPIGQYGAAEESIGISGESIIRCDEDEAHLASVYCTVCATHLCSECSQVTHSTKTLAKHRRVPLADKPHEKTMCSQHQVHAIEFVCLEEGCQTSPLMCCVCKEYGKHQGHKHSVLEPEANQIRASILDMAHCIRTFTEEISDYSRKLVGIVQHIEGGEQIVEDGIGMAHTEHVPGTAENARSCIRAYFYDLHETLCRQEEMALSVVDAHVREKLIWLRQQQEDMTILLSEVSAACLHCEKTLQQDDCRVVLAKQEITRLLETLQKQQQQFTEVADHIQLDASIPVTFTKDNRVHIGPKMEIRVVTLGLDGAGKTTILFKLKQDEFMQPIPTIGFNVETVEYKNLKFTIWDVGGKHKLRPLWKHYYLNTQAVVFVVDSSHRDRISEAHSELAKLLTEKELRDALLLIFANKQDVAGALSVEEITELLSLHKLCCGRSWYIQGCDARSGMGLYEGLDWLSRQLVAAGVLDVA

SEQ ID NO: 911989 - protein, 546 aa, Homo sapiens
MATLVVNKLGAGVDSGRQGSRGTAVVKVLECGVCEDVFSLQGDKVPRLLLCGHTVCHDCLTRLPLHGRAIRCPFDRQVTDLGDSGVWGLKKNFALLELLERLQNGPIGQYGAAEESIGISGESIIRCDEDEAHLASVYCTVCATHLCSECSQVTHSTKTLAKHRRVPLADKPHEKTMCSQHQVHAIEFVCLEEGCQTSPLMCCVCKEYGKHQGHKHSVLEPEANQIRASILDMAHCIRTFTEEISDYSRKLVGIVQHIEGGEQIVEDGIGMAHTEHVPGTAENARSCIRAYFYDLHETLCRQEEMALSVVDAHVREKLIWLRQQQEDMTILLSEVSAACLHCEKTLQQDDCRVVLAKQEITRLLETLQKQQQQFTEVADHIQLDASIPVTFTKDNRVHIGPKMEIRVVTLGLDGAGKTTILFKLKQDEFMQPIPTIGFNVETVEYKNLKFTIWDVGGKHKLRPLWKHYYLNTQAVVFVVDSSHRDRISEAHSELAKLLTEKELRDALLLIFANKQDVAGALSVEEITELLSLHKLCCGRSCFSDNM

SEQ ID NO: 911990 - protein, 398 aa, Homo sapiens
MCSQHQVHAIEFVCLEEGCQTSPLMCCVCKEYGKHQGHKHSVLEPEANQIRASILDMAHCIRTFTEEISDYSRKLVGIVQHIEGGEQIVEDGIGMAHTEHVPGTAENARSCIRAYFYDLHETLCRQEEMALSVVDAHVREKLIWLRQQQEDMTILLSEVSAACLHCEKTLQQDDCRVVLAKQEITRLLETLQKQQQQFTEVADHIQLDASIPVTFTKDNRVHIGPKMEIRVVTLGLDGAGKTTILFKLKQDEFMQPIPTIGFNVETVEYKNLKFTIWDVGGKHKLRPLWKHYYLNTQAVVFVVDSSHRDRISEAHSELAKLLTEKELRDALLLIFANKQDVAGALSVEEITELLSLHKLCCGRSWYIQGCDARSGMGLYEGLDWLSRQLVAAGVLDVA

SEQ ID NO: 911991 - protein, 369 aa, Homo sapiens
MATLVVNKLGAGVDSGRQGSRGTAVVKVLECGVCEDVFSLQGDKVPRLLLCGHTVCHDCLTRLPLHGRAIRCPFDRQVTDLGDSGVWGLKKNFALLELLERLQNGPIGQYGAAEESIGISGESIIRCDEDEAHLASVYCTVCATHLCSECSQVTHSTKTLAKHRRVPLADKPHEKTMCSQHQVHAIEFVCLEEGCQTSPLMCCVCKEYGKHQGHKHSVLEPEANQIRASILDMAHCIRTFTEEISDYSRKLVGIVQHIEGGEQIVEDGIGMAHTEHVPGTAENARSCIRAYFYDLHETLCRQEEMALSVVDAHVREKLIWLRQQQEDMTILLSEVSAACLHCEKTLQQFPLQRKLNRGMDGTSQIDLHF

SEQ ID NO: 911992 - protein, 569 aa, Homo sapiens
MATLVVNKLGAGVDSGRQGSRGTAVVKVLECGVCEDVFSLQGDKVPRLLLCGHTVCHDCLTRLPLHGRAIRCPFDRQVTDLGDSGVWGLKKNFALLELLERLQNGPIGQYGAAEESIGISGESIIRCDEDEAHLASVYCTVCATHLCSECSQVTHSTKTLAKHRRVPLADKPHEKTMCSQHQVHAIEFVCLEEGCQTSPLMCCVCKEYGKHQGHKHSVLEPEANQIRASILDMAHCIRTFTEEISDYSRKLVGIVQHIEGGEQIVEDGIGMAHTEHVPGTAENARSCIRAYFYDLHETLCRQEEMALSVVDAHVREKLIWLRQQQEDMTILLSEVSAACLHCEKTLQQDDCRVVLAKQEITRLLETLQKQQQQFTEVADHIQLDASIPVTFTKDNRVHIGPKMEIRVVTLGLDGAGKTTILFKLKQDEFMQPIPTIGFNVETVEYKNLKFTIWDVGGKHKLRPLWKHYYLNTQAVVFVVDSSHRDRISEAHSELAKLLTEKELRDALLLIFANKQDVAGALSVEEITELLSLHKLCCGRSWYIQGCDARSVFQIICDQYTGKEVVTEKG

SEQ ID NO: 911993 - protein, 574 aa, Homo sapiens; identical to SEQ ID NO: 911988

SEQ ID NO: 911994 - protein, 574 aa, Homo sapiens; identical to SEQ ID NO: 911988

SEQ ID NO: 911995 - protein, 256 aa, Homo sapiens
MFQTGGLIVFYGLLAQTMAQFGGLPVPLDQTLPLNVNPALPLSPTGLAGSLTNALSNGLLSGGLLGILENLPLLDILKPGGGTSGGLLGGLLGKVTSVIPGLNNIIDIKVTDPQLLELGLVQSPDGHRLYVTIPLGIKLQVNTPLVGASLLRLAVKLDITAEILAVRDKQERIHLVLGDCTHSPGSLQISLLDGLGPLPIQGLLDSLTGILNKVLPELVQGNVCPLVNEVLRGLDITLVHDIVNMLIHGLQFVIKV

SEQ ID NO: 911996 - protein, 206 aa, Homo sapiens
LCELLVSRIAFREIPRIHFTSCLSALMVFCSLELLVFSLYGSWCKGDSLLEEKQKLIRPEHRRMNLAAPCGRHCVPFLLWDHWEGIKGSRVGLPLVGASLLRLAVKLDITAEILAVRDKQERIHLVLGDCTHSPGSLQISLLDGLGPLPIQGLLDSLTGILNKVLPELVQGNVCPLVNEVLRGLDITLVHDIVNMLIHGLQFVIKV

SEQ ID NO: 911997 - protein, 256 aa, Homo sapiens; identical to SEQ ID NO: 911995

SEQ ID NO: 911998 - protein, 93 aa, Homo sapiens
PGSPATPAFGSHWLPRPAVGCTRVHPSSLGRGNKRLPLPTSPAAQDPQQRRRLQQGDQEGVRQGRGCLSWRRPWWPSSTFSTNILEGRETSTS

SEQ ID NO: 911999 - protein, 93 aa, Homo sapiens; identical to SEQ ID NO: 911998

SEQ ID NO: 912000 - protein, 115 aa, Homo sapiens
MESPYVAQAGLKLPVLKLSSCLSFPKCWDYRKSKSRRLWTKSWKHWTMMETANVTSRNSWPLLPWLLLPATSSLNMSEIRKQPNLSCNRDGHARKQTARACSLVGAELSSRVVAN

SEQ ID NO: 912001 - protein, 93 aa, Homo sapiens; identical to SEQ ID NO: 911998

SEQ ID NO: 912002 - protein, 93 aa, Homo sapiens; identical to SEQ ID NO: 911998

SEQ ID NO: 912003 - protein, 93 aa, Homo sapiens; identical to SEQ ID NO: 911998

SEQ ID NO: 912004 - protein, 93 aa, Homo sapiens; identical to SEQ ID NO: 911998

SEQ ID NO: 912005 - protein, 102 aa, Homo sapiens
LSTFAEDIEIAIILFLGEWSHSILALEYVCHHSDSSWRLPEMTVPLNGVIRQHKTDKPDQVFLKDLSSTPMASNNTASIAQARKLVEQLKMEANIDRIKEVH

SEQ ID NO: 912006 - protein, 98 aa, Homo sapiens
NGNEREKKQAANSYQEEEEVGDALLPVERTLIEDKAGWGLVPGLQPLLHILTTLPPRSVGNSYYCWAGLGWAGLRRSSPAQISSGEGKTTLLGPSLGS

SEQ ID NO: 912007 - protein, 98 aa, Homo sapiens; identical to SEQ ID NO: 912006

SEQ ID NO: 912008 - protein, 98 aa, Homo sapiens; identical to SEQ ID NO: 912006

SEQ ID NO: 912009 - protein, 134 aa, Homo sapiens
MVYLIYSRASILYCAHASYSTRQGQYDEPPDARESFVISRHAMKSYCVEAHLSQQQRIDPAVHCCLHNSDLLSCDCHSAWADAACLVSLLPGFRFACCQGRLIRVASSSNPSVDAPSAKRRRPLKSLRAPGTLM

SEQ ID NO: 912010 - protein, 98 aa, Homo sapiens; identical to SEQ ID NO: 912006

SEQ ID NO: 912011 - protein, 633 aa, Homo sapiens
MEESPLSRAPSRGGVNFLNVARTYIPNTKVECHYTLPPGTMPSASDWIGIFKVEAACVRDYHTFVWSSVPESTTDGSPIHTSVQFQASYLPKPGAQLYQFRYVNRQGQVCGQSPPFQFREPRPMDELVTLEEADGGSDILLVVPKATVLQNQLDESQQERNDLMQLKLQLEGQVTELRSRVQELERALATARQEHTELMEQYKGISRSHGEITEERDILSRQQGDHVARILELEDDIQTISEKVLTKEVELDRLRDTVKALTREQEKLLGQLKEVQADKEQSEAELQVAQQENHHLNLDLKEAKSWQEEQSAQAQRLKDKVAQMKDTLGQAQQRVAELEPLKEQLRGAQELAASSQQKATLLGEELASAAAARDRTIAELHRSRLEVAEVNGRLAELGLHLKEEKCQWSKERAGLLQSVEAEKDKILKLSAEILRLEKAVQEERTQNQVFKTELAREKDSSLVQLSESKRELTELRSALRVLQKEKEQLQEEKQELLEYMRKLEARLEKVADEKWNEDATTEDEEAAVGLSCPAALTDSEDESPEDMRLPPYGLCERGDPGSSPAGPREASPLVVISQPAPISPHLSGPAEDSSSDSEAEDEKSVLMAAVQSGGEEANLLLPELGSAFYDMAR

SEQ ID NO: 912012 - protein, 115 aa, Homo sapiens
MEESPLSRAPSRGGVNFLNVARTYIPNTKVECHYTLPPGTMPSASDWIGIFKVEAACVRDYHTFVWSSVPESTTDGSPIHTSVQFQGTREDGKLGERSQGSGGLKEGSGLRNIKS

SEQ ID NO: 912013 - protein, 548 aa, Homo sapiens [sequence omitted]

SEQ ID NO: 912014 - protein, 553 aa, Homo sapiens
MEESPLSRAPSRGGVNFLNVARTYIPNTKVECHYTLPPGTMPSASDWIGIFKVEAACVRDYHTFVWSSVPESTTDGSPIHTSVQFQASYLPKPGAQLYQFRYVNRQGQVCGQSPPFQFREPRPMDELVTLEEADGGSDILLVVPKATVLQNQLDESQQERNDLMQLKLQLEGQVTELRSRVQELERALATARQEHTELMEQYKGISRSHGEITEERDILSRQQGDHVARILELEDDIQTISEKVLTKEVELDRLRDTVKALTREQEKLLGQLKEVQADKEQSEAELQVAQQENHHLNLDLKEAKSWQEEQSAQAQRLKDKVAQMKDTLGQAQQRVAELEPLKEQLRGAQELAASSQQKATLLGEELASAAAARDRTIAELHRSRLEVAEVNGRLAELGLHLKEEKCQWSKERAGLLQSVEAEKDKILKLSAEILRLEKAVQEDEEAAVGLSCPAALTDSEDESPEDMRLPPYGLCERGDPGSSPAGPREASPLVVISQPAPISPHLSGPAEDSSSDSEAEDEKSVLMAAVQSGGEEANLLLPELGSAFYDMAR

SEQ ID NO: 912015 - protein, 633 aa, Homo sapiens; identical to SEQ ID NO: 912011

SEQ ID NO: 912016 - protein, 621 aa, Homo sapiens
MVRTHYMVTSIIMIMIEGQWVWERKEGEGQAERREKSMACGRWRREETVYGTPSKGLGPRTVDYWGPGSILLPTASYLPKPGAQLYQFRYVNRQGQVCGQSPPFQFREPRPMDELVTLEEADGGSDILLVVPKATVLQNQLDESQQERNDLMQLKLQLEGQVTELRSRVQELERALATARQEHTELMEQYKGISRSHGEITEERDILSRQQGDHVARILELEDDIQTISEKVLTKEVELDRLRDTVKALTREQEKLLGQLKEVQADKEQSEAELQVAQQENHHLNLDLKEAKSWQEEQSAQAQRLKDKVAQMKDTLGQAQQRVAELEPLKEQLRGAQELAASSQQKATLLGEELASAAAARDRTIAELHRSRLEVAEVNGRLAELGLHLKEEKCQWSKERAGLLQSVEAEKDKILKLSAEILRLEKAVQEERTQNQVFKTELAREKDSSLVQLSESKRELTELRSALRVLQKEKEQLQEEKQELLEYMRKLEARLEKVADEKWNEDATTEDEEAAVGLSCPAALTDSEDESPEDMRLPPYGLCERGDPGSSPAGPREASPLVVISQPAPISPHLSGPAEDSSSDSEAEDEKSVLMAAVQSGGEEANLLLPELGSAFYDMAR

SEQ ID NO: 912017 - protein, 633 aa, Homo sapiens; identical to SEQ ID NO: 912011

SEQ ID NO: 912018 - protein, 633 aa, Homo sapiens; identical to SEQ ID NO: 912011

SEQ ID NO: 912019 - protein, 633 aa, Homo sapiens; identical to SEQ ID NO: 912011

SEQ ID NO: 912020 - protein, 360 aa, Homo sapiens
MEESPLSRAPSRGGVNFLNVARTYIPNTKVECHYTLPPGTMPSASDWIGIFKVEAACVRDYHTFVWSSVPESTTDGSPIHTSVQFQASYLPKPGAQLYQFRYVNRQGQVCGQSPPFQFREPRPMDELVTLEEADGGSDILLVVPKATVLQNQLDESQQERNDLMQLKLQLEGQVTELRSRVQELERALATARQEHTELMEQYKGISRSHGEITEERDILSRQQGDHVARILELEDDIQTISEKVLTKEVELDRLRDKVEPSSALACLTSSTCVMFLCAESDVYTLLQVLCLALVWILKSTVAAIIFPVMILALELSEKGVDYLFSQHDLSFLDDVIPDKDTDQEGWMTMTWEDDDGKSGR

SEQ ID NO: 912021 - protein, 222 aa, Homo sapiens
MEESPLSRAPSRGGVNFLNVARTYIPNTKVECHYTLPPGTMPSASDWIGIFKVEAACVRDYHTFVWSSVPESTTDGSPIHTSVQFQASYLPKPGAQLYQFRYVNRQGQVCGQSPPFQFREPRPMDELVTLEEADGGSDILLVVPKATVLQNQLDESQQERNDLMQLKLQLEGQVTELRSRVQELERALATARQEHTELMEQYKVGAGPGRGQGLAAHPASKI

SEQ ID NO: 912022 - protein, 123 aa, Homo sapiens
DRMGTDLEGQTYVLETKSDTSKMSRNPQGLETRYALSPGVVAGAVSVWCWSCGGKEVDWKDFRLSTLSFIGGQISQGQDGRITTKPGTIPWWSQLSQCSPDLHPQHQGGMSLHPSPRHHAQCQ

SEQ ID NO: 912023 - protein, 691 aa, Homo sapiens
MEESPLSRAPSRGGVNFLNVARTYIPNTKVECHYTLPPGTMPSASDWIGIFKVEAACVRDYHTFVWSSVPESTTDGSPIHTSVQFQASYLPKPGAQLYQFRYVNRQGQVCGQSPPFQFREPRPMDELVTLEEADGGSDILLVVPKATVLQNQLDESQQERNDLMQLKLQLEGQVTELRSRVQELERALATARQEHTELMEQYKGISRSHGEITEERDILSRQQGDHVARILELEDDIQTISEKVLTKEVELDRLRDTVKALTREQEKLLGQLKEVQADKEQSEAELQVAQQENHHLNLDLKEAKSWQEEQSAQAQRLKDKVAQMKDTLGQAQQRVAELEPLKEQLRGAQELAASSQQKATLLGEELASAAAARDRTIAELHRSRLEVAEVNGRLAELGLHLKEEKCQWSKERAGLLQSVEAEKDKILKLSAEILRLEKAVQEERTQNQVFKTELAREKDSSLVQLSESKRELTELRSALRVLQKEKEQLQEEKQELLEYMRKLEARLEKVADEKWNEDATTEDEEAAVGLSCPAALTDSEDESPEDMRLPPYGLCERGDPGSSPAGPREASPLVVISQPAPISPHLSGPAEDSSSDSEAEDEKSVLMAAVQSGGEEANLLLPELGSAFYDMASGFTVGTLSETSTGGPATPTWKECPICKERFPAESDKDALEDHMDGHFFFSTQDPFTFE

SEQ ID NO: 912024 - protein, 720 aa, Homo sapiens
RYAPDLPGMNRDRAPLASVCWEDRYLKARMEESPLSRAPSRGGVNFLNVARTYIPNTKVECHYTLPPGTMPSASDWIGIFKVEAACVRDYHTFVWSSVPESTTDGSPIHTSVQFQASYLPKPGAQLYQFRYVNRQGQVCGQSPPFQFREPRPMDELVTLEEADGGSDILLVVPKATVLQNQLDESQQERNDLMQLKLQLEGQVTELRSRVQELERALATARQEHTELMEQYKGISRSHGEITEERDILSRQQGDHVARILELEDDIQTISEKVLTKEVELDRLRDTVKALTREQEKLLGQLKEVQADKEQSEAELQVAQQENHHLNLDLKEAKSWQEEQSAQAQRLKDKVAQMKDTLGQAQQRVAELEPLKEQLRGAQELAASSQQKATLLGEELASAAAARDRTIAELHRSRLEVAEVNGRLAELGLHLKEEKCQWSKERAGLLQSVEAEKDKILKLSAEILRLEKAVQEERTQNQVFKTELAREKDSSLVQLSESKRELTELRSALRVLQKEKEQLQEEKQELLEYMRKLEARLEKVADEKWNEDATTEDEEAAVGLSCPAALTDSEDESPEDMRLPPYGLCERGDPGSSPAGPREASPLVVISQPAPISPHLSGPAEDSSSDSEAEDEKSVLMAAVQSGGEEANLLLPELGSAFYDMASGFTVGTLSETSTGGPATPTWKECPICKERFPAESDKDALEDHMDGHFFFSTQDPFTFE

SEQ ID NO: 912025 - protein, 633 aa, Homo sapiens; identical to SEQ ID NO: 912011

SEQ ID NO: 912026 - protein, 769 aa, Homo sapiens
MEESPLSRAPSRGGVNFLNVARTYIPNTKVECHYTLPPGTMPSASDWIGIFKVEAACVRDYHTFVWSSVPESTTDGSPIHTSVQFQASYLPKPGAQLYQFRYVNRQGQVCGQSPPFQFREPRPMDELVTLEEADGGSDILLVVPKATVLQNQLDESQQERNDLMQLKLQLEGQVTELRSRVQELERALATARQEHTELMEQYKVGAGPGRGQGLAAHPASKIEPSEEGEGEMLVGFYNGSGIKEIGLRGVAGIKLDVTRDMFQTCNETQFFEHRNAGVKVEVATLIGKGMFPYSFFFKEGNVIARWKQSDPGVLFLKPLFHHLRDESQPPFSSGGNLIQGISRSHGEITEERDILSRQQGDHVARILELEDDIQTISEKVLTKEVELDRLRDTVKALTREQEKLLGQLKEVQADKEQSEAELQVAQQENHHLNLDLKEAKSWQEEQSAQAQRLKDKVAQMKDTLGQAQQRVAELEPLKEQLRGAQELAASSQQKATLLGEELASAAAARDRTIAELHRSRLEVAEVNGRLAELGLHLKEEKCQWSKERAGLLQSVEAEKDKILKLSAEILRLEKAVQEERTQNQVFKTELAREKDSSLVQLSESKRELTELRSALRVLQKEKEQLQEEKQELLEYMRKLEARLEKVADEKWNEDATTEDEEAAVGLSCPAALTDSEDESPEDMRLPPYGLCERGDPGSSPAGPREASPLVVISQPAPISPHLSGPAEDSSSDSEAEDEKSVLMAAVQSGGEEANLLLPELGSAFYDMAR

SEQ ID NO: 912027 - protein, 662 aa, Homo sapiens
RYAPDLPGMNRDRAPLASVCWEDRYLKARMEESPLSRAPSRGGVNFLNVARTYIPNTKVECHYTLPPGTMPSASDWIGIFKVEAACVRDYHTFVWSSVPESTTDGSPIHTSVQFQASYLPKPGAQLYQFRYVNRQGQVCGQSPPFQFREPRPMDELVTLEEADGGSDILLVVPKATVLQNQLDESQQERNDLMQLKLQLEGQVTELRSRVQELERALATARQEHTELMEQYKGISRSHGEITEERDILSRQQGDHVARILELEDDIQTISEKVLTKEVELDRLRDTVKALTREQEKLLGQLKEVQADKEQSEAELQVAQQENHHLNLDLKEAKSWQEEQSAQAQRLKDKVAQMKDTLGQAQQRVAELEPLKEQLRGAQELAASSQQKATLLGEELASAAAARDRTIAELHRSRLEVAEVNGRLAELGLHLKEEKCQWSKERAGLLQSVEAEKDKILKLSAEILRLEKAVQEERTQNQVFKTELAREKDSSLVQLSESKRELTELRSALRVLQKEKEQLQEEKQELLEYMRKLEARLEKVADEKWNEDATTEDEEAAVGLSCPAALTDSEDESPEDMRLPPYGLCERGDPGSSPAGPREASPLVVISQPAPISPHLSGPAEDSSSDSEAEDEKSVLMAAVQSGGEEANLLLPELGSAFYDMAR

SEQ ID NO: 912028 - protein, 121 aa, Homo sapiens [sequence omitted]

SEQ ID NO: 912029 - protein, 633 aa, Homo sapiens; identical to SEQ ID NO: 912011

SEQ ID NO: 912030 - protein, 253 aa, Homo sapiens
MEESPLSRAPSRGGVNFLNVARTYIPNTKVECHYTLPPGTMPSASDWIGIFKVEAACVRDYHTFVWSSVPESTTDGSPIHTSVQFQASYLPKPGAQLYQFRYVNRQGQVCGQSPPFQFREPRPMDELVTLEEADGGSDILLVVPKATVLQNQLDESQQERNDLMQLKLQLEGQVTELRSRVQELERALATARQEHTELMEQYKGISRSHGEITEERDILSRQQGDHVARILELEDDIQTISEKVLTKEVELDR

SEQ ID NO: 912031 - protein, 123 aa, Homo sapiens
MEESPLSRAPSRGGVNFLNVARTYIPNTKVECHYTLPPGTMPSASDWIGIFKVEAACVRDYHTFVWSSVPESTTDGSPIHTSVQFQASYLPKPGAQLYQFRYVNRQGQVMLSPNTCIYIQQNY

SEQ ID NO: 912032 - protein, 766 aa, Homo sapiens
MASDTPESLMALCTDFCLRNLDGTLGYLLDKETLRLHPDIFLPSEICDRLVNEYVELVNAACNFEPHESFFSLFSDPRSTRLTRIHLREDLVQDQDLEAIRKQDLVELYLTNCEKLSAKSLQTLRSFSHTLVSLSLFGCTNIFYEEENPGGCEDEYLVNPTCQVLVKDFTFEGFSRLRFLNLGRMIDWVPVESLLRPLNSLAALDLSGIQTSDAAFLTQWKDSLVSLVLYNMDLSDDHIRVIVQLHKLRHLDISRDRLSSYYKFKLTREVLSLFVQKLGNLMSLDISGHMILENCSISKMEEEAGQTSIEPSKSSIIPFRALKRPLQFLGLFENSLCRLTHIPAYKVSGDKNEEQVLNAIEAYTEHRPEITSRAINLLFDIARIERCNQLLRALKLVITALKCHKYDRNIQVTGSAALFYLTNSEYRSEQSVKLRRQVIQVVLNGMESYQEVTVQRNCCLTLCNFSIPEELEFQYRRVNELLLSILNPTRQDESIQRIAVHLCNALVCQVDNDHKEAVGKMGFVVTMLKLIQKKLLDKTCDQVMEFSWSALWNITDETPDNCEMFLNFNGMKLFLDCLKEFPEKQELHRNMLGLLGNVAEVKELRPQLMTSQFISVFSNLLESKADGIEVSYNACGVLSHIMFDGPEAWGVCEPQREEVEERMWAAIQSWDINSRRNINYRSFEPILRLLPQGISPVSQHWATWALYNLVSVYPDKYCPLLIKEGGMPLLRDIIKMATARQETKEMARKVIEHCSNFKEENMDTSR

SEQ ID NO: 912033 - protein, 766 aa, Homo sapiens; identical to SEQ ID NO: 912032

SEQ ID NO: 912034 - protein, 766 aa, Homo sapiens; identical to SEQ ID NO: 912032

SEQ ID NO: 912035 - protein, 718 aa, Homo sapiens
MPRPGYVELVNAACNFEPHESFFSLFSDPRSTRLTRIHLREDLVQDQDLEAIRKQDLVELYLTNCEKLSAKSLQTLRSFSHTLVSLSLFGCTNIFYEEENPGGCEDEYLVNPTCQVLVKDFTFEGFSRLRFLNLGRMIDWVPVESLLRPLNSLAALDLSGIQTSDAAFLTQWKDSLVSLVLYNMDLSDDHIRVIVQLHKLRHLDISRDRLSSYYKFKLTREVLSLFVQKLGNLMSLDISGHMILENCSISKMEEEAGQTSIEPSKSSIIPFRALKRPLQFLGLFENSLCRLTHIPAYKVSGDKNEEQVLNAIEAYTEHRPEITSRAINLLFDIARIERCNQLLRALKLVITALKCHKYDRNIQVTGSAALFYLTNSEYRSEQSVKLRRQVIQVVLNGMESYQEVTVQRNCCLTLCNFSIPEELEFQYRRVNELLLSILNPTRQDESIQRIAVHLCNALVCQVDNDHKEAVGKMGFVVTMLKLIQKKLLDKTCDQVMEFSWSALWNITDETPDNCEMFLNFNGMKLFLDCLKEFPEKQELHRNMLGLLGNVAEVKELRPQLMTSQFISVFSNLLESKADGIEVSYNACGVLSHIMFDGPEAWGVCEPQREEVEERMWAAIQSWDINSRRNINYRSFEPILRLLPQGISPVSQHWATWALYNLVSVYPDKYCPLLIKEGGMPLLRDIIKMATARQETKEMARKVIEHCSNFKEENMDTSR

SEQ ID NO: 912036 - protein, 766 aa, Homo sapiens; identical to SEQ ID NO: 912032

SEQ ID NO: 912037 - protein, 312 aa, Homo sapiens
MLSRSSLTRRYWNSSSSGMLKLQSVRQQFRCTVTSWEDESIQRIAVHLCNALVCQVDNDHKEAVGKMGFVVTMLKLIQKKLLDKTCDQVMEFSWSALWNITDETPDNCEMFLNFNGMKLFLDCLKEFPEKQELHRNMLGLLGNVAEVKELRPQLMTSQFISVFSNLLESKADGIEVSYNACGVLSHIMFDGPEAWGVCEPQREEVEERMWAAIQSWDINSRRNINYRSFEPILRLLPQGISPVSQHWATWALYNLVSVYPDKYCPLLIKEGGMPLLRDIIKMATARQETKEMARKVIEHCSNFKEENMDTSR

SEQ ID NO: 912038 - protein, 200 aa, Homo sapiens
TYQRHKAGIGLPEEFPEKQELHRNMLGLLGNVAEVKELRPQLMTSQFISVFSNLLESKADGIEVSYNACGVLSHIMFDGPEAWGVCEPQREEVEERMWAAIQSWDINSRRNINYRSFEPILRLLPQGISPVSQHWATWALYNLVSVYPDKYCPLLIKEGGMPLLRDIIKMATARQETKEMARKVIEHCSNFKEENMDTSR

SEQ ID NO: 912039 - protein, 176 aa, Homo sapiens
MLGLLGNVAEVKELRPQLMTSQFISVFSNLLESKADGIEVSYNACGVLSHIMFDGPEAWGVCEPQREEVEERMWAAIQSWDINSRRNINYRSFEPILRLLPQGISPVSQHWATWALYNLVSVYPDKYCPLLIKEGGMPLLRDIIKMATARQETKEMARKVIEHCSNFKEENMDTSR

SEQ ID NO: 912040 - protein, 140 aa, Homo sapiens
WGWEFFSPSTLADSCPCLQTMLKLIQKKLLDKTVSQVFTKPRYPFPTSKGPGLPLGEVCVLSGAPLPGYQEPWLSPALPSQCDQVMEFSWSALWNITDETPDNCEMFLNFNGMKLFLDCLKVVSTSCSSSCLSCPHGPSS

SEQ ID NO: 912041 - protein, 133 aa, Homo sapiens
GEVCVLSGAPLPGYQEPWLSPALPSQCDQVMEFSWSALWNITDETPDNCEMFLNFNGMKLFLDCLKVVSTSCSSSCLSCPHGPSSVPRLPTNQIRSTPHPCFLEKGSGDRLRPTHPGFAADRSSRPRWPGGAS

SEQ ID NO: 912042 - protein, 766 aa, Homo sapiens; identical to SEQ ID NO: 912032

SEQ ID NO: 912043 - protein, 766 aa, Homo sapiens; identical to SEQ ID NO: 912032

SEQ ID NO: 912044 - protein, 582 aa, Homo sapiens [sequence omitted]

SEQ ID NO: 912045 - protein, 766 aa, Homo sapiens; identical to SEQ ID NO: 912032

SEQ ID NO: 912046 - protein, 431 aa, Homo sapiens
MASDTPESLMALCTDFCLRNLDGTLGYLLDKETLRLHPDIFLPSEICDRLVNEYVELVNAACNFEPHESFFSLFSDPRSTRLTRIHLREDLVQDQDLEAIRKQDLVELYLTNCEKLSAKSLQTLRSFSHTLVSLSLFGCTNIFYEEENPGGCEDEYLVNPTCQVLVKDFTFEGFSRLRFLNLGRMIDWVPVESLLRPLNSLAALDLSGIQTSDAAFLTQWKDSLVSLVLYNMDLSDDHIRVIVQLHKLRHLDISRDRLSSYYKFKLTREVLSLFVQKLGNLMSLDISGHMILENCSISKMEEEAGQTSIEPSKSSIIPFRALKRPLQFLGLFENSLCRLTHIPAYKVSGDKNEEQVLNAIEAYTEHRPEITSRAINLLFDIARIERCNQLLRALKLVITALKCHKYDRNIQVTGSAALFYLTKCSRNRRIR

SEQ ID NO: 912047 - protein, 178 aa, Homo sapiens
MASDTPESLMALCTDFCLRNLDGTLGYLLDKETLRLHPDIFLPSEICDRLVNEYVELVNAACNFEPHESFFSLFSDPRSTRLTRIHLREDLVQDQDLEAIRKQDLVELYLTNCEKLSAKSLQTLRSFSHTLVSLSLFGCTNIFYEEENPGGCEDEYLLPPSSEPLRVAMVQSETAPAL

SEQ ID NO: 912048 - protein, 932 aa, Homo sapiens
MIPARLHRDYKGLVLLGILLGTLWETGCTQIRYSVPEELEKGSRVGDISRDLGLEPRELAERGVRIIPRGRTQLFALNPRSGSLVTAGRIDREELCMGAIKCQLNLDILMEDKVKIYGVEVEVRDINDNAPYFRESELEIKISENAATEMRFPLPHAWDPDIGKNSLQSYELSPNTHFSLIVQNGADGSKYPELVLKRALDREEKAAHHLVLTASDGGDPVRTGTARIRVMVLDANDNAPAFAQPEYRASVPENLALGTQLLVVNATDPDEGVNAEVRYSFRYVDDKAAQVFKLDCNSGTISTIGELDHEESGFYQMEVQAMDNAGYSARAKVLITVLDVNDNAPEVVLTSLASSVPENSPRGTLIALLNVNDQDSEENGQVICFIQGNLPFKLEKSYGNYYSLVTDIVLDREQVPSYNITVTATDRGTPPLSTETHISLNVADTNDNPPVFPQASYSAYIPENNPRGVSLVSVTAHDPDCEENAQITYSLAENTIQGASLSSYVSINSDTGVLYALSSFDYEQFRDLQVKVMARDNGHPPLSSNVSLSLFVLDQNDNAPEILYPALPTDGSTGVELAPRSAEPGYLVTKVVAVDRDSGQNAWLSYRLLKASEPGLFSVGLHTGEVRTARALLDRDALKQSLVVAVQDHGQPPLSATVTLTVAVADSIPQVLADLGSLESPANSETSDLTLYLVVAVAAVSCVFLAFVILLLALRLRRWHKSRLLQASGGGLTGAPASHFVGVDGVQAFLQTYSHEVSLTTDSRKSHLIFPQPNYADMLVSQESFEKSEPLLLSGDSVFSKDSHGLIEQAPPNTDWRFSQAQRPGTSGSQNGDDTGTWPNNQFDTEMLQAMILASASEAADGSSTLGGGAGTMGLSARYGPQFTLQHVPDYRQNVYIPGSNATLTNAAGKRDGKAPAGGNGNKKKSGKKEKK

SEQ ID NO: 912049 - protein, 929 aa, Homo sapiens
MGGSCAQRRRAGPRQVLFPLLLPLFYPTLCEPIRYSIPEELAKGSVVGNLAKDLGLSVLDVSARELRVSAEKLHFSVDAQSGDLLVKDRIDREQICKERRRCELQLEAVVENPLNIFHVIVVIEDVNDHAPQFRKDEINLEISESVSLGMGTILESAEDPDISMNSLSKYQLSPNEYFSLVEKDNPDGGKYPELVLQKTLDRETQSAHHLVLTALDGGDPPRSGTAQIRILVIDANDNPPVFSQDVYRVSLREDVPPGTSILRVKATDQDEGINSEITYSFFGVADKAQHVFSLDYTTGNILTQQPLDFEEVERYTINIEAKDRGSLSTRCKVIVEVVDENDNSPEIIITSLSDQIMEDSPPGVVVALFKTRDQDSGENGEVRCSLSRGVPFKIHSSSNNYYKLVTDEALDREQTPEYNVTIAATDRGKPPLSSSKTITLHITDVNDNAPVFGQSAYLVHVPENNQPGASIAQVSASDPDFGLNGRVSYSLIASDLESRTLSSYVSVSAQSGVVFAQRAFDHEQLRTFELTLQARDQGSPALSANVSLRVLVGDRNDNAPRVLYPALGPDGSALFDTVPRAAQPGYLVTKVVAVDADSGHNAWLSYHVVQASEPGLFSLGLRTGEVRMVRALGDKDSVRQRLLVAVRDGGQPPLSATATLHLVFADSLQEVLPDFSDHPTPSDSQAEMQFYLVVALALISVLFLLAVILAIALRLRQSFSPTAGDCFESVLCSKSGPVGPPNYSEGTLPYAYNFCVPGDQMNPEFNFFTSVDHCPATQDNLNKDSMLLASILTPSVEADKKILKQQAPPNTDWRFSQAQRPGTSGSQNGDDTGTWPNNQFDTEMLQAMILASASEAADGSSTLGGGAGTMGLSARYGPQFTLQHVPDYRQNVYIPGSNATLTNAAGKRDGKAPAGGNGNKKKSGKKEKK

SEQ ID NO: 912050 - protein, 923 aa, Homo sapiens
MGSGAGELGRAERLPVLFLFLLSLFCPALCEQIRYRIPEEMPKGSVVGNLATDLGFSVQELPTRKLRVSSEKPYFTVSAESGELLVSSRLDREEICGKKPACALEFEAVAENPLNFYHVNVEIEDINDHTPKFTQNSFELQISESAQPGTRFILGSAHDADIGSNTLQNYQLSPSDHFSLINKEKSDGSKYPEMVLKTPLDREKQKSYHLTLTALDFGAPPLSSTAQIHVLVTDANDNAPVFSQDVYRVSLSENVYPGTTVLQVTATDQDEGVNAEITFSFSEASQITQFDLNSNTGEITVLNTLDFEEVKEYSIVLEARDGGGMIAQCTVEVEVIDENDNAPEVIFQSLPNLIMEDAELGTHIALLKVRDKDSRHNGEVTCKLEGDVPFKILTSSRNTYKLVTDAVLDREQNPEYNITVTATDRGKPPLSSSSSITLHIGDVNDNAPVFSQSSYIVHVAENNPPGASISQVRASDPDLGPNGQVSYCIMASDLEQRELSSYVSISAESGVVFAQRAFDHEQLRAFELTLQARDQGSPALSANVSLRVLVDDRNDNAPRVLYPALGPDGSALFDMVPHAAEPGYLVTKVVAVDADSGHNAWLSYHVLQASEPGLFSLGLRTGEVRTARALGDRDAVRQRLLVAVRDGGQPPLSATATLHLVFADSLQEVLPDITDRPDPSDLQAELQFYLVVALALISVLFLVAMILAIALRLRRSSSPASWSCFQPGLCVKSESVVPPNYSEGTLPYSYNLCVAHTGKTEFNFLKCSEQLSSGQDILCGDSSGALFPLCNSSELTSHQQAPPNTDWRFSQAQRPGTSGSQNGDDTGTWPNNQFDTEMLQAMILASASEAADGSSTLGGGAGTMGLSARYGPQFTLQHVPDYRQNVYIPGSNATLTNAAGKRDGKAPAGGNGNKKKSGKKEKK

SEQ ID NO: 912051 - protein, 931 aa, Homo sapiens
MASPPRGWGCGELLLPFMLLGTLCEPGSGQIRYSMPEELDKGSFVGNIAKDLGLEPQELAERGVRIVSRGRTQLFALNPRSGSLVTAGRIDREELCAQSPLCVVNFNILVENKMKIYGVEVEIIDINDNFPRFRDEELKVKVNENAAAGTRLVLPFARDADVGVNSLRSYQLSSNLHFSLDVVSGTDGQKYPELVLEQPLDREKETVHDLLLTALDGGDPVLSGTTHIRVTVLDANDNAPLFTPSEYSVSVPENIPVGTRLLMLTATDPDEGINGKLTYSFRNEEEKISETFQLDSNLGEISTLQSLDYEESRFYLMEVVAQDGGALVASAKVVVTVQDVNDNAPEVILTSLTSSISEDCLPGTVIALFSVHDGDSGENGEIACSIPRNLPFKLEKSVDNYYHLLTTRDLDREETSDYNITLTVMDHGTPPLSTESHIPLKVADVNDNPPNFPQASYSTSVTENNPRGVSIFSVTAHDPDSGDNARVTYSLAEDTFQGAPLSSYVSINSDTGVLYALRSFDYEQLRDLQLWVTASDSGNPPLSSNVSLSLFVLDQNDNTPEILYPALPTDGSTGVELAPRSAEPGYLVTKVVAVDKDSGQNAWLSYRLLKASEPGLFAVGLHTGEVRTARALLDRDALKQSLVVAVEDHGQPPLSATFTVTVAVADRIPDILADLGSIKTPIDPEDLDLTLYLVVAVAAVSCVFLAFVIVLLVLRLRRWHKSRLLQAEGSRLAGVPASHFVGVDGVRAFLQTYSHEVSLTADSRKSHLIFPQPNYADTLLSEESCEKSEPLLMSDKVDANKEERRVQQAPPNTDWRFSQAQRPGTSGSQNGDDTGTWPNNQFDTEMLQAMILASASEAADGSSTLGGGAGTMGLSARYGPQFTLQHVPDYRQNVYIPGSNATLTNAAGKRDGKAPAGGNGNKKKSGKKEKK

SEQ ID NO: 912052 - protein, 932 aa, Homo sapiens
MAALQKLPHCRKLVLLCFLLATLWEARAGQIRYSVREEIDRGSFVGNIAKDLGLEPLALAEQGVRIVSRGRSQLFALNPRSGSLVTANRIDREELCAQSAPCLLNFNILLEDKLTIYSVEVEITDINDNAPRFGVEELELKISETTTPGFRIPLKNAHDADVGENALQKYALNPNDHFSLDVRRGADGNKYPELVLERSLDREEEAVHHLVLVASDGGDPVLSGTSRICVKVLDANDNAPVFTQPEYRISIPENTLVGTRILTVTATDADEGYYAQVVYFLEKSPGETSEVFELKSTSGELTIIKDLDYEDATFHEIDIEAQDGPGLLTRAKVIVTVLDVNDNAPEFYMTSATSSVSEDSLPGTIIGLFNVHDRDSGQNAFTTCSLPEDLPFKLEKSVDNYYRLVTTRALDREQFSFYNITLTAKDGGNPSLSTDAHILLQVADINDNAPAFSRTSYSTYIPENNPRGASVFSVTAHDPDSNDNAHVTYSFAEDTVQGAPLSSYISINSDTGVLYALRSFDYEQLRDLQVWVIARDSGNPPLSSNVSLSLFVLDQNDNAPEILYPAFPTDGSTGVELAPRSAEPGYLVTKVVAVDRDSGQNAWLSYHLLKASEPGLFSVGLHTGEVRTARALLDRDALKQSLVVAIQDHGQPPLSATVTLTVAVADRIPDILADLGSLEPSAIPNDSDLTLYLVVAVAAVSCVFLAFVIVLLAHRLRRWHKSRLLQASGGSLTGMQSSHFVGVDGVRAFLQTYSHEVSLTADSRKSHLIFPQPNYADTLISQESCEKKDFLSAPQSLLEEEREETFSQQAPPNTDWRFSQAQRPGTSGSQNGDDTGTWPNNQFDTEMLQAMILASASEAADGSSTLGGGAGTMGLSARYGPQFTLQHVPDYRQNVYIPGSNATLTNAAGKRDGKAPAGGNGNKKKSGKKEKK

SEQ ID NO: 912053 - protein, 930 aa, Homo sapiens
MGGSCAQRRRAGPRQVLFPLLLPLFYPTLSEPIRYSIPEELAKGSVVGNLAKDLGLSVLDVSARKLRVSAEKLHFSVDAESGDLLVKNRIDREQICKERRRCELQLEAVVENPLNIFHVIVVIEDVNDHAPQFDKKEIHLEIFESASAGTRLSLDPATDPDININSIKDYKINSNPYFSLMVRVNSDGGKYPELSLEKLLDREEQRSHSLILTALDGGDPPRSATAHIEISVKDTNDNPPVFSRDEYRISLSENLPPGSPVLQVTATDQDEGVNAEINYYFRSTAQSTKHMFSLDEKTGMIKNNQSFDFEDVERYTMEVEAKDGGGLSTQCKVIIEILDENDNSPEIIITSLSDQILENSPPGMVVALFKTRDLDFGGNGEVRCNIETDIPFKIYSSSNNYYKLVTDGALDREQTPEYNVTIVATDRGKPPLSSSRSITLYVADINDNAPVFDQTSYVVHVAENNPPGASIAQVSASDPDLGLNGHISYSIVASDLEPLAVSSYVSVSAQSGVVFAQRAFDHEQLRAFALTLQARDHGSPTLSANVSLRVLVGDRNDNAPRVLYPALGPDGSAFFDMVPRSAEPGYLVTKVVAVDADSGHNAWLSYHVLQASEPGLFSLGLRTGEVRTARALGDRDAARQRLLVAVRDGGQPPLSATATLHLVFADNLQEILPDLSDRPVLSDPQAELQFYLVVALALISVLFLLAVILAIALRLRRSLSPATWDCFHPGLCVKSGPVVPPNYSEGTLPYSYNLCIAHTGTKEFNFLKCSVPLHSNEDMVCSVSPGALIPPHGGEDLTSHPETLTSQAPPNTDWRFSQAQRPGTSGSQNGDDTGTWPNNQFDTEMLQAMILASASEAADGSSTLGGGAGTMGLSARYGPQFTLQHVPDYRQNVYIPGSNATLTNAAGKRDGKAPAGGNGNKKKSGKKEKK

SEQ ID NO: 912054 - protein, 931 aa, Homo sapiens
MAAPPARPDHTRLLQICLLLGVLVEIRAEQILYSVFEEQEEGSVVGNIAKDLGLAPRELAERGVRIVSRGRTQLFALNPRSGTLVTAGRIDREELCDRSPNCVTNLEILLEDTVKILRVEVEIIDVNDNPPSFGTEQREIKVAENENPGARFPLPEAFDPDVGVNSLQGYQLNSNGYFSLDVQSGADGIKYPELVLERALDREEEAVHHLVLTAFDGGDPVRSGTARILIILVDTNDNAPVFTQPEYHVSVRENVPVGTRLLTVKATDPDEGANGDVTYSFRKVRDKISQLFQLNSLSGDITILGGLDYEDSGFYDIDVEAHDGPGLRARSKVLVTVLDENDNAPEVTVTSLTSSVQESSSPGTVIALFNVHDSDSGGNGLVTCSIPDNLPFTLEKTYGNYYRLLTHRTLDREEVSEYNITVTATDQGTPPLSTETHISLQVMDINDNPPTFPHASYSAYIPENNPRGASILSMTAQDPDSGDNARITYSLAEDTFQGAPLSSYVSINSNTGILYALCSFDYEQFRDLQLLMTASDSGDPPLSSNVSLSLFVLDQNDNVPEILYPTFPTDGSTGVELAPRSADSGYLVTKVVAVDRDSGQNAWLSYSLLKSSEPGLFAVGLHTGEVRTARALLDRDALKQRLVVVVQDHGQPPLSATVTLTVAVADSIPDVLADLGSLKPSADPDDSGLTLYLVVAVAAVSCVFLAFVTVLLALKLRRWHKSRLLHAEGSRLAGVPASHFVGVDGVRAFLQTYSHEVSLTADSRKSHLIFSQPSYADTLISRESCEKSEPLLITQDLLETKGDPNLQQAPPNTDWRFSQAQRPGTSGSQNGDDTGTWPNNQFDTEMLQAMILASASEAADGSSTLGGGAGTMGLSARYGPQFTLQHVPDYRQNVYIPGSNATLTNAAGKRDGKAPAGGNGNKKKSGKKEKK

SEQ ID NO: 912055 - protein, 932 aa, Homo sapiens
MAAQPRGGDYRGFFLLSILLGTPWEAWAGRILYSVSEETDKGSFVGDIAKDLGLEPRELAERGVRIISRGRTQLFALNQRSGSLVTAGRIDREEICAQSARCLVNFNILMEDKMNLYPIDVEIIDINDNVPRFLTEEINVKIMENTAPGVRFPLSEAGDPDVGTNSLQSYQLSPNRHFSLAVQSGDDETKYPELVLERVLDREEERVHHLVLTASDGGDPPRSSTAHIQVTVVDVNDHTPVFSLPQYQVTVPENVPVGTRLLTVHAIDLDEGVNGEVTYSFRKITPKLPKMFHLNSLTGEISTLEGLDYEETAFYEMEVQAQDGPGSLTKAKVLITVLDVNDNAPEVTMTSLSSSIPEDTPLGTVIALFYLQDRDSGKNGEVTCTIPENLPFKLEKSIDNYYRLVTTKNLDRETLSLYNITLKATDGGTPPLSRETHIFMQVADTNDNPPTFPHSSYSVYIAENNPRGASIFLVTAQDHDSEDNAQITYSLAEDTIQGAPVSSYVSINSDTGVLYALQSFDYEQLRELQLRVTAHDSGDPPLSSNMSLSLFVLDQNDNPPEILYPALPTDGSTGMELAPRSAEPGYLVTKVVAVDKDSGQNAWLSYLLLKASEPGLFAVGLYTGEVRTARALLDRDALKQSLVVAVQDHGQPPLSATVTLTVAVADSIPEVLADLGSLEPSDGPYNYDLTLYLVVAVATVSCVFLAFVLVLLALRLRRWHKSRLLQASEGGLANVPTSHFVGMDGVQAFLQTYSHEVSLTADSRKSHLIFPQPNYVDMLISQESCEKNDSLLTSVDFQECKENLPSIQQAPPNTDWRFSQAQRPGTSGSQNGDDTGTWPNNQFDTEMLQAMILASASEAADGSSTLGGGAGTMGLSARYGPQFTLQHVPDYRQNVYIPGSNATLTNAAGKRDGKAPAGGNGNKKKSGKKEKK

SEQ ID NO: 912056 - protein, 849 aa, Homo sapiens
MTNCLSFRNGRGLALLCALLGTLCETGSGQIRYSVSEELDKGSFVGNIANDLGLEPRELAERGVRIVSRGRTQLFSLNPQSGSLVTAERIDREELCAQIPLCLVKINILVEDKLKIFEVEIEIKDINDNAPNFPTEELEIKIGELTVPGTRFPIKTAFDPDVGINSLQNYKLSPNDYFSLAVNSVSEGAKYPELVLERALDREKKEIHQLVLVASDGGDPVHSGNLHIQVIVLDANDNPPMFTQPEYRVSVWENVPVGTRLLTVNATDPDEGFNAQVSYILDKMPGKIAEIFHLNSVSGEVSILKSLDYEDAMFYEIKIEAQDGPGLLSRAKILVTVLDVNDNAPEITITSLTSSVPEEGTVGREIALIDVHDRDSGQNGQVEVFVLGNLPFKLEKSIDQYYRLVTATSLDREQISEYNISLRASDGGSPPLSTETHITLHVIDINDNPPTFPHLSYSAYIPENNPRGASIFSVTAQDPDSNNNARITYALTEDTLQGAPLSSFVSINSNTGVLYALRSFDYEQFRDLKLLVTASDSGNPPLSSNVSLNLFVLDQNDNAPEILYPALPTDGSTGVELAPRSAEPGYLVTKVVAVDRDSGQNAWLSYRLLKASEPGLFSVGLHTGEVRTARALLDRDALKQSLVVAVQDHGQPPLSATVTLTVAVADRIPDILADLGSLEPSAKPNDSDLTLYLVVAVAAVSCVFLAFVIVLLALRLRRWHKSRLLQASGGGLASTPGSHFVGADGVRAFLQTYSHEVSLTADSRKSHLIFPQPNYADTLISQESCEKSEPLLITQDLLEMKGDSNLLKPRPTRTGVSLRPRDPAPAAPKMAMTPAPGPTTSLTQRCCKP

SEQ ID NO: 912057 - protein, 923 aa, Homo sapiens
MGSGAGELGRAERLPVLFLFLLSLFCPALCEQIRYRIPEEMPKGSVVGNLATDLGFSVQELPTRKLRVSSEKPYFTVSAESGELLVSSRLDREEICGKKPACALEFEAVAENPLNFYHVNVEIEDINDHTPKFTQNSFELQISESAQPGTRFILEVAEDADIGLNSLQKYKLSLNPSFSLIIKEKQDGSKYPELALEKTLDREQQSYHRLVLTALDGGHPPLSGTTELRIQVTDANDNPPVFNRDVYRVSLRENVPPGTTVLQVSATDQDEGINSEITYSFYRTGQIFSLNSKSGEITTQKKLDFEETKEYSMVVEGRDGGGLVAQCTVEINIQDENDNSPEVTFHSLLEMILENAVPGTLIALIKIHDQDSGENGEVNCQLQGEVPFKIISSSKNSYKLVTDGTLDREQTPEYNVTITATDRGKPPLSSSISVILHIRDVNDNAPVFHQASYLVSVPENNPPGASIAQVCASDLDLGLNGQVSYSIMASDLEPLALASYVSMSAQSGVVFAQRAFDYEQLRTFELTLQARDQGSPALSANVSLRVLVGDRNDNAPRVLYPALGPDGSALFDMVPRAAEPGYLVTKVVAVDADSGHNAWLSYHVLQASEPGLFSLGLRTGEVRTARALGDRDAARQRLLVAVRDGGQPPLSATATLHLVFADSLQEVLPDITDRPVPSDPQAELQFYLVVALALISVLFLLAVILAVALRLRRSSSPAAWSCFQPGLCVKSGPVVPPNYSQGTLPYSYNLCVAHTGKTEFNFLKCSEQLSSGQDILCGDSSGALFPLCNSSESTSHPELQAPPNTDWRFSQAQRPGTSGSQNGDDTGTWPNNQFDTEMLQAMILASASEAADGSSTLGGGAGTMGLSARYGPQFTLQHVPDYRQNVYIPGSNATLTNAAGKRDGKAPAGGNGNKKKSGKKEKK

SEQ ID NO: 912058 - protein, 931 aa, Homo sapiens
MKIQKKLTGCSRLMLLCLSLELLLEAGAGNIHYSVPEETDKGSFVGNIAKDLGLQPQELADGGVRIVSRGRMPLFALNPRSGSLITARRIDREELCAQSMPCLVSFNILVEDKMKLFPVEVEIIDINDNTPQFQLEELEFKMNEITTPGTRVSLPFGQDLDVGMNSLQSYQLSSNPHFSLDVQQGADGPQHPEMVLQSPLDREEEAVHHLILTASDGGEPVRSGTLRIYIQVVDANDNPPAFTQAQYHINVPENVPLGTQLLMVNATDPDEGANGEVTYSFHNVDHRVAQIFRLDSYTGEISNKEPLDFEEYKMYSMEVQAQDGAGLMAKVKVLIKVLDVNDNAPEVTITSVTTAVPENFPPGTIIALISVHDQDSGDNGYTTCFIPGNLPFKLEKLVDNYYRLVTERTLDRELISGYNITITAIDQGTPALSTETHISLLVTDINDNSPVFHQDSYSAYIPENNPRGASIFSVRAHDLDSNENAQITYSLIEDTIQGAPLSAYLSINSDTGVLYALRSFDYEQFRDMQLKVMARDSGDPPLSSNVSLSLFLLDQNDNAPEILYPALPTDGSTGVELAPLSAEPGYLVTKVVAVDRDSGQNAWLSYRLLKASEPGLFSVGLHTGEVRTARALLDRDALKQSLVVAVQDHGQPPLSATVTLTVAVADRISDILADLGSLEPSAKPNDSDLTLYLVVAAAAVSCVFLAFVIVLLAHRLRRWHKSRLLQASGGGLASMPGSHFVGVDGVRAFLQTYSHEVSLTADSRKSHLIFPQPNYADTLISQESCEKKGFLSAPQSLLEDKKEPFSQQAPPNTDWRFSQAQRPGTSGSQNGDDTGTWPNNQFDTEMLQAMILASASEAADGSSTLGGGAGTMGLSARYGPQFTLQHVPDYRQNVYIPGSNATLTNAAGKRDGKAPAGGNGNKKKSGKKEKK

SEQ ID NO: 912059 - protein, 929 aa, Homo sapiens
MGNSSGWRGPAGQRRMLFLFLLSLLDQVLSEPIRYAIPEELDRGSLVGNLAKDLGFGVGDLPTRNLRVIAEKKFFTVSPENGNLLVSDRIDREEICGKKSTCVLEFEMVAEKPLNFFHVTVLIQDINDNPPTFSQNITELEISELALTGATFALESAQDPDVGVNSLQQYYLSPDPHFSLIQKENLDGSRYPELVLKAPLDREEQPHHHLVLTAVDGGEPSRSCTTQIRVIVADANDNPPVFTQDMYRVNVAENLPAGSSVLKVMAIDMDEGINAEIIYAFINIGKEVRQLFKLDSKTGELTTIGELDFEERDSYTIGVEAKDGGHHTAYCKVQIDISDENDNAPEITLASESQHIQEDAELGTAVALIKTHDLDSGFNGEILCQLKGNFPFKIVQDTKNTYRLVTDGALDREQIPEYNVTITATDKGNPPLSSSKTITLHILDVNDNVPVFHQASYTVHVAENNPPGASIAHVRASDPDLGPNGLVSYYIVASDLEPRELSSYVSVSARSGVVFAQRAFDHEQLRAFELTLQARDQGSPTLSANVSLRVLVDDRNDNAPLVLYPALGPEGSALFDMVPRSAEPGYLVTKVVAVDADSGYNAWLSYHIVQASEPGLFSLGLRTGEVRTARTLGDREAARQRLLVTVRDGGQQPLSATVMLHLIFADSLQEIQPDLSDRPTPSDPQAELQFHLVVALALISVLFLLAVILAISLRLRCSSRPATEGYFQPGVCFKTVPGVLPTYSERTLPYSYNPCAASHSSNTEFKFLNIKAENAAPQDLLCDEASWFESNDNPEMPSNSGNLQKQAPPNTDWRFSQAQRPGTSGSQNGDDTGTWPNNQFDTEMLQAMILASASEAADGSSTLGGGAGTMGLSARYGPQFTLQHVPDYRQNVYIPGSNATLTNAAGKRDGKAPAGGNGNKKKSGKKEKK

SEQ ID NO: 912060 - protein, 750 aa, Homo sapiens
MANRLQRGDRSRLLLLLCIFLGTLRGFRARQIRYSVPEETEKGSFVGNISKDLGLEPRELAKRGVRIVSRGKTQLFAVNPRSGSLITAGRIDREELCETVSSCFLNMELLVEDTLKIYGVEVEIIDINDNAPSFQEDEVEIKVSEHAIPGARFALPNARDPDVGVNSLQSYQLSPNNYFSLQLRGRTDGAKNPELVLEGSLDREKEAAHLLLLTALDGGDPIRKGAVPIRVVVLDVNDHIPMFTQSVYRVSVPENISSGTRVLMVNATDPDEGINGEVMYSFRNMESKASEIFQLDSQTGEVQVRGSLDFEKYRFYEMEIQGQDGGGLFTTTTMLITVVDVNDNAPEITITSSINSILENSPPGTVIALLNVQDQDSGENGQVSCFIPNHLPFKLEKTYGNYYKLITSRVLDRELVQSYNITLTATDQGSPPLSAETHVWLNVADDNDNPPVFPHSSYSAYIPENNPRGASIFSVTALDPDSKQNALVTYSLTDDTVQGVPLSSYVSINSNTGVLYALQSFDYEQFRDLELRVIARDSGDPPLSSNVSLSLFVLDQNDNAPEILYPALPTDGSTGVELAPRSAEPGYLVTKVVAVDKDSGQNAWLSYRLLKASEPGLFAVGEHTGEQAPPNTDWRFSQAQRPGTSGSQNGDDTGTWPNNQFDTEMLQAMILASASEAADGSSTLGGGAGTMGLSARYGPQFTLQHVPDYRQNVYIPGSNATLTNAAGKRDGKAPAGGNGNKKKSGKKEKK

SEQ ID NO: 912061 - protein, 850 aa, Homo sapiens
MAAQRNRSKESKDCSGLVLLCLFFGIPWEAGARQISYSIPEELEKGSFVGNISKDLGLAPRELAERGVRIVSRGRTQLFSLNPRSGSLITAGRIDREELCAQSARCVVSFNILVEDRVKLFGIEIEVTDINDNAPKFQAENLDVKINENVAAGMRFPLPEAIDPDVGVNSLQSYQLSPNKHFSLRVQSRANGVKYPELVLEHSLDREEEAIHHLVLTASDGGDPLRSGTVLVSVTVFDANDNAPVFTLPEYRVSVPENLPVGTQLLTVTATDRDEGANGEVTYSFRKLPDTQLLKFQLNKYTGEIKISENLDYEETGFYEIEIQAEDGGAYLATAKVLITVEDVNDNSPELTITSLFSPVTEDSPLGTVVALLNVHDLDSEQNGQVTCSILAYLPFKLEKSIDSYYRLVIHRALDREQVSSYNITVTATDGGSPPLSTEAHFMLQVADINDNPPTFSQVSYFTYIPENNARGASIFSVTALDPDSKENAQIIYSLAEDTIQGVPLSSYISINSDTGVLYALRSFDYEQFHELQMQVTASDSGDPPLSSNVSLSLFVLDQNDNAPEILYPALPTDGSTGVELAPRSAEPGYLVTKVVAVDRDSGQNAWLSYRLLKASEPGLFAVGEHTGEVRTARALLDRDALKQSLVVAVQDHGQPPLSATVTLTVAVADSIPQVLADLGSFESPANSETSDLTLYLVVAVAAVSCVFLAFVIVLLAHRLRRWHKSRLLQASGGGLTGVSGSHFVGVDGVRAFLQTYSHEVSLTADSRKSHLIFPQPNYADTLISQESCEKNDPLSLLDDSKFPIEDTPLVPVSFIFIFTFVKKKKIGFYFEVCGMMVESVNAKTLMSRI

SEQ ID NO: 912062 - protein, 808 aa, Homo sapiens
MGGSCAQRRRAGPRQVLFPLLLPLFYPTLCEPIRYSIPEELAKGSVVGNLAKDLGLSVLDVSARELRVSAEKLHFSVDAQSGDLLVKDRIDREQICKERRRCELQLEAVVENPLNIFHVIVVIEDVNDHAPQFRKDEINLEISESVSLGMGTILESAEDPDISMNSLSKYQLSPNEYFSLVEKDNPDGGKYPELVLQKTLDRETQSAHHLVLTALDGGDPPRSGTAQIRILVIDANDNPPVFSQDVYRVSLREDVPPGTSILRVKATDQDEGINSEITYSFFGVADKAQHVFSLDYTTGNILTQQPLDFEEVERYTINIEAKDRGSLSTRCKVIVEVVDENDNSPEIIITSLSDQIMEDSPPGVVVALFKTRDQDSGENGEVRCSLSRGVPFKIHSSSNNYYKLVTDEALDREQTPEYNVTIAATDRGKPPLSSSKTITLHITDVNDNAPVFGQSAYLVHVPENNQPGASIAQVSASDPDFGLNGRVSYSLIASDLESRTLSSYVSVSAQSGVVFAQRAFDHEQLRTFELTLQARDQGSPALSANVSLRVLVGDRNDNAPRVLYPALGPDGSALFDTVPRAAQPGYLVTKVVAVDADSGHNAWLSYHVVQASEPGLFSLGLRTGEVRMVRALGDKDSVRQRLLVAVRDGGQPPLSATATLHLVFADSLQEVLPDFSDHPTPSDSQAEMQFYLVVALALISVLFLLAVILAIALRLRQSFSPTAGDCFESVLCSKSGPVGPPNYSEGTLPYAYNFCVPGDQMNPEFNFFTSVDHCPATQDNLNKDSMLLASILTPSVEADKKILKQVSI

SEQ ID NO: 912063 - protein, 837 aa, Homo sapiens
MANRLQRGDRSRLLLLLCIFLGTLRGFRARQIRYSVPEETEKGSFVGNISKDLGLEPRELAKRGVRIVSRGKTQLFAVNPRSGSLITAGRIDREELCETVSSCFLNMELLVEDTLKIYGVEVEIIDINDNAPSFQEDEVEIKVSEHAIPGARFALPNARDPDVGVNSLQSYQLSPNNYFSLQLRGRTDGAKNPELVLEGSLDREKEAAHLLLLTALDGGDPIRKGAVPIRVVVLDVNDHIPMFTQSVYRVSVPENISSGTRVLMVNATDPDEGINGEVMYSFRNMESKASEIFQLDSQTGEVQVRGSLDFEKYRFYEMEIQGQDGGGLFTTTTMLITVVDVNDNAPEITITSSINSILENSPPGTVIALLNVQDQDSGENGQVSCFIPNHLPFKLEKTYGNYYKLITSRVLDRELVQSYNITLTATDQGSPPLSAETHVWLNVADDNDNPPVFPHSSYSAYIPENNPRGASIFSVTALDPDSKQNALVTYSLTDDTVQGVPLSSYVSINSNTGVLYALQSFDYEQFRDLELRVIARDSGDPPLSSNVSLSLFVLDQNDNAPEILYPALPTDGSTGVELAPRSAEPGYLVTKVVAVDKDSGQNAWLSYRLLKASEPGLFAVGEHTGEVRTARALLDRDALKQSLVVAVQDHGQPPLSATVTLTVAVADSIPEVLADLGSLESLANSETSDLSLYLVVAVAAVSCIFLVFVIVLLALRLWRWHKSRLLQASEGGLAGMPTSHFVGVDGVQAFLQTYSHEVSLIADSQKSHLIFPQPNYGDTLISQESCEKSEPLLIAEDSAIILGKCDPTSNQVRFISLPPNCWCLGTSLLRRCFLSLL

SEQ ID NO: 912064 - protein, 820 aa, Homo sapiens
MAAPPARPDHTRLLQICLLLGVLVEIRAEQILYSVFEEQEEGSVVGNIAKDLGLAPRELAERGVRIVSRGRTQLFALNPRSGTLVTAGRIDREELCDRSPNCVTNLEILLEDTVKILRVEVEIIDVNDNPPSFGTEQREIKVAENENPGARFPLPEAFDPDVGVNSLQGYQLNSNGYFSLDVQSGADGIKYPELVLERALDREEEAVHHLVLTAFDGGDPVRSGTARILIILVDTNDNAPVFTQPEYHVSVRENVPVGTRLLTVKATDPDEGANGDVTYSFRKVRDKISQLFQLNSLSGDITILGGLDYEDSGFYDIDVEAHDGPGLRARSKVLVTVLDENDNAPEVTVTSLTSSVQESSSPGTVIALFNVHDSDSGGNGLVTCSIPDNLPFTLEKTYGNYYRLLTHRTLDREEVSEYNITVTATDQGTPPLSTETHISLQVMDINDNPPTFPHASYSAYIPENNPRGASILSMTAQDPDSGDNARITYSLAEDTFQGAPLSSYVSINSNTGILYALCSFDYEQFRDLQLLMTASDSGDPPLSSNVSLSLFVLDQNDNVPEILYPTFPTDGSTGVELAPRSADSGYLVTKVVAVDRDSGQNAWLSYSLLKSSEPGLFAVGLHTGEVRTARALLDRDALKQRLVVVVQDHGQPPLSATVTLTVAVADSIPDVLADLGSLKPSADPDDSGLTLYLVVAVAAVSCVFLAFVTVLLALKLRRWHKSRLLHAEGSRLAGVPASHFVGVDGVRAFLQTYSHEVSLTADSRKSHLIFSQPSYADTLISRESCEKSEPLLITQDLLETKGDPNLQVSQSYNRSYHTEI

SEQ ID NO: 912065 - protein, 813 aa, Homo sapiens
MASPPRGWGCGELLLPFMLLGTLCEPGSGQIRYSMPEELDKGSFVGNIAKDLGLEPQELAERGVRIVSRGRTQLFALNPRSGSLVTAGRIDREELCAQSPLCVVNFNILVENKMKIYGVEVEIIDINDNFPRFRDEELKVKVNENAAAGTRLVLPFARDADVGVNSLRSYQLSSNLHFSLDVVSGTDGQKYPELVLEQPLDREKETVHDLLLTALDGGDPVLSGTTHIRVTVLDANDNAPLFTPSEYSVSVPENIPVGTRLLMLTATDPDEGINGKLTYSFRNEEEKISETFQLDSNLGEISTLQSLDYEESRFYLMEVVAQDGGALVASAKVVVTVQDVNDNAPEVILTSLTSSISEDCLPGTVIALFSVHDGDSGENGEIACSIPRNLPFKLEKSVDNYYHLLTTRDLDREETSDYNITLTVMDHGTPPLSTESHIPLKVADVNDNPPNFPQASYSTSVTENNPRGVSIFSVTAHDPDSGDNARVTYSLAEDTFQGAPLSSYVSINSDTGVLYALRSFDYEQLRDLQLWVTASDSGNPPLSSNVSLSLFVLDQNDNTPEILYPALPTDGSTGVELAPRSAEPGYLVTKVVAVDKDSGQNAWLSYRLLKASEPGLFAVGLHTGEVRTARALLDRDALKQSLVVAVEDHGQPPLSATFTVTVAVADRIPDILADLGSIKTPIDPEDLDLTLYLVVAVAAVSCVFLAFVIVLLVLRLRRWHKSRLLQAEGSRLAGVPASHFVGVDGVRAFLQTYSHEVSLTADSRKSHLIFPQPNYADTLLSEESCEKSEPLLMSDKVDANKEERRVQVSFLFR

SEQ ID NO: 912066 - protein, 878 aa, Homo sapiens
MGPKTLPQLAGKWQVLCMLSLCCWGWVSGQLRYSVVEESEPGTLVGNVAQDLGLKMTDLLSRRLQLGSEENGRYFSLSLMSGALAVNQKIDRESLCGASTSCLLPVQVVTEHPLELIRVEVEILDLNDNSPSFATPEREMRISESAASGARFPLDSAQDPDVGTNTVSFYTLSPNSHFSLNVKTLKDGKPFPELVLEQQLDREAQARHQLVLTAVDGGTPARSGTTLISVIVLDINDNAPTFQSSVLRVGIPENAPIGTLLLRLNATDPDEGTNGQLDYSFGDHTSEAVRNLFGLDPSSGAIHVLGPIDFEESRFYEIHARARDQGQPAMEGHCVIQVDVGDVNDNAPEVLLASLANPVLESTPVGTVVGLFNVRDRDSGRNGEVSLDISPDLPFQIKPSENHYSLLTSQPLDREATSHYIIELLASDAGSPSLHKHLTIRLNISDVNDNAPRFNQQLYTAYILENRPPGSLLCTVAASDPDTGDNARLTYSIVGNQVQGAPASSFVYVNPEDGRIFAQRTFDYELLQMLQIVVGVRDSGSPPLHANTSLHVFVLDENDNAPAVLHPRPDWEHSAPQRLPRSAPPGSLVTKVTAVDADAGHNAWLSYSLLPQSTAPGLFLVSTHTGEVRTARALLEDDSDTQQVVVLVRDNGDPSLSSTATVLLVLEDEDPEEMPKSSDFLIHPPERSDLTLYLIVALATVSLLSLVTFTFLSAKCLQGNADGDGGGGQCCRRQDSPSPDFYKQSSPNLQVSSDGTLKYMEVTLRPTDSQSHCYRTCFSPASDGSDFTFLRPLSVQQPTALALEPDAIRSRSNTLRERSQVRGSAPPRATPGGGTGEAARPHKGLNLHPLLSGRLGRWLRSTRFSGSLDRLRETRVAD
